United States Patent 6,551,795 (NUCLEIC ACID AND AMINO ACID SEQUENCES RELATING TO PSEUDOMONAS AERUGINOSA FOR DIAGNOSTICS AND THERAPEUTICS) - sequence listing, part 6

SEQ ID NO: 12277 - DNA, 1668 bp, Pseudomonas aeruginosa
atccccacgcggcaggggcaggcagcagcccttgccgcttctctcgctgctgcatccctaaccgcaaggagttatcaccatgaacgccgtactcaaaaccgaagccgtcgccatcgaagccgccgcaccgctggaaatggccgacccgtccaagaacctgattctggttccgctctcgcagttgctgccgcgccgctccaagcgcaacgcccgcaagatgccgcgcctgtccatccccgaactggccgcgagcattgcccgcatcggcctgctgcaaaacctgatcgtcatcctttccgcagatggcgaggcttacgaggtggtggcaggcgaccgccgactgaccgccttgaagctgctggcgaagaagaagcgcatccccgccgactacgaagtgccgtgcctgctggtgcccgatgcttcggcccgtaccgtcagcctcgcggaaaacctgatgcgcgagcagatgcaccccgccgaccagttcgaggcgttcgccgcgctggtcaaggaaggccggcccatcgaggacattgccgccgacttcggcgtgtccccgctggtggtgcagcgccgcttgaagctcgcccacatcgcgccgcgcctgatggccgactaccgcgccggaaccgtcacgctggaacagttgatggccttgaccatcaccgacgaccacgccgcgcaggaagccgcgttctttggtgcgccggaatggcagcgcagcccgtccaagctgcgcgagcgcctgaccgaacgcgaaatcgacgcctcgcacgcgctggtgcgcttcgtcgggctggacacctaccggcaggcaggcggcggcgtccgccgcgacctgttcgcagaaggcgatgccggaacctacctcaccgataccgcagtgctggaaacgctggtgcgcgacaagctggcaacgctggccgaggacgtgcgcgccgaggggtgggcatgggtggaggccgtgccgcatctggcctacgaggaacggcaggcgttccagaacgccccgcgccatcgccgcgagccgaccacccgcgaagcccgccgcatcgcctcgctggaaacccgcctcgaaaagatcgacgccgaactggaagaagcctgcgacgccgaggacaaggccaaggccgagaagctggaacagcggcgcgatcaggtggtcggggaactgcaagacgcggaggatgccttgcagggctatgcccccgaggtgcgcgaggtggccggtgccatcgtcaccatcgaccgcaacggcgaggccgtcattcatcgcggcctgctgcgcgaagccgaggccaaggcgctgcgcacgctggaaaagctgcggcgcggtttcggcagtgccgaaggcgaagccgccaacgacgagcacgaggacgccgacgacgcgcccaaggccgcgagcctgtccgaccggctggcgcagcggttgagcgcccaccgcacggcggcgctgcaaatcgaagttgcacggcatccgcatgtcgcgctggccgcgctggtgcatggcatggtgcagaccgtcttgcagcccgacgcctacggcgatggcctgccgctgggcgtgcgcctcacggcgcaagaccgactggaaggcatggccccggactggccggaatcgcccgctgccgtggcgctgcgcgaactgcaacaggtggccggtga

SEQ ID NO: 12278 - DNA, 297 bp, Pseudomonas aeruginosa
accagccgaggcgctggccgcttgacccgcgccgaaggcaagcgccccggcctcgaccggggcgcttcgctgcaaggagaagcccccatgacccgcaccaccaccagccgcccgcgcatggcggcgatctacgcccccggcacggtgcgcgcccgccgctggcacggcgacggcgacgtgcgcggctaccgcccgcccttgggctggtcggcttgcgctgacctcaccgacattcatcccatcacgggccacgccttgccgcgtgccgtgtggtggctcatcgagacgaagaaataa

SEQ ID NO: 12279 - DNA, 1227 bp, Pseudomonas aeruginosa
gactgcctccatccggttgcgctgtgtggccggagctttgaaagctatggaggttcacaccatgcgtcccgctcctttgcggcctgccgccactgtctcgaccgctgccgcgcagccccaacgctatctcaccaacgacgaagccgccgaatacctgcgcctgtcgccgcgcacgctggaaaagcagcgcgtgatcggtggtggtccgcgctttcgcaagttcggccggcgcgtcatgtacgccgtggccgacctcgatgcctgggccgccgaccgcagcttcgagacgacttccgatcccgagtacgccgagcaccactcggccgacagccgtgcgcgctgatcggcggcgcgcggcaggccatcgccatgtccagcaccgcgctgccgtcccggcagcggccgatgcaggagcgcgaacagctcgacctgttccgcgccttgcccggcgacatggcaccgcgcgacagccaagacctgatggcctatccgttcttctcgctcggcaagtccaagcgggtcaagcccatcgacttccgcgcgggcaacgtcacgatccgcgtggaaggcacggccgagcacggcatcgccacgatttgggatgcagacgtgttgatatgggcggcctcgcagatcgtggaggcgaaggacgcgggcctgcggccgtcgcggctgatgcgcgccacgccctacgagatcctgcgcttcatcgggcgtggcaagtcgctgcgcgactaccagcgcctcaaagccgcgctggatcgcctgcaatcgaccaccgtggccacgtccatccgcgagacgaccgggcggcgcttgcaccgcttctcgtggatcaacgaatggaaggaactggccgatgccagcggcacgccgctgggcatcgagctgattctgccggactggttctatgcgggcgtgctcgacgccgccctggtgctgaccatcgacccggcgtatttccggctgacgggcggcatcgagcggtggctgtaccgcctggtacgcaagcacggcggcaagcaggaatacggttggcagttcgattttcgctacctgcaccagaagtccggcagcaccgccaagtcctacgacttcgcctgcgacctgcgcgcgcttgtcgcgcggcagtcgttgcccggctacgtcctgggcatcgagcagatgccggacaacggcatggagctgctgacgttccggcccgtgccgccgacggcacggggataa

SEQ ID NO: 12280 - DNA, 339 bp, Pseudomonas aeruginosa
tgccgctgcccgcgaaatcaccgccttggtggacgaactgctgcggtggccgacatgacagagaagccgccaccgaacagcaagcgcacggccaagcgcgtcggcatcggcgcacgtccgcccgcgaatccgcacgccgaggcgtggattcgccagggcgacgcggatgcgctgggcaagggcgacctctacaccgcccgcctcacccttgacatcacgcccgccatgcgggcgcgcatcaaggtgtcggccttcacgcaaggcgtgaccgtggccgatctgctgcgcggcttgctggagcgcgagtttccagaacactgcagggagaacacgccatga

SEQ ID NO: 12281 - DNA, 429 bp, Pseudomonas aeruginosa
cgcgcgtggcgctggcctacatcgaaccgcgcttcaagctctatctgcgcttcggtgaacccgcgcgcaccctccagctcgaccgctggcggcgctgcgcggtgttcctaccgggcgccgtgttctgccgcatccgctggcaggccaacgactacggcaccgtgcgctggcagctcatggcgatgcaggcttgcacgccgctcgatgcggcgcagcgcatccccggcgtgcagccgggcgcgagcctgctgctgcacgccgagggcgagaacgcagtgcgcgcggtgctggagcgcatcgacgccatcgaggcgctgggtatcgcgcccggcggcgcctcgctcgcgtactggcgcacgctcgccaaccggctcgctgcgcgcttgccgctgcccgaatacaccgccgagcggcacgccgcctggctga

SEQ ID NO: 12282 - DNA, 609 bp, Pseudomonas aeruginosa
ccatcaagacgctgctggtcaaccagcgccaggccagcccgcagtcgctcgccaagcacctgcgctacatcgaacgcgacggcgtgggccgcgatggcgagccgggccaagcctacgggccgcagaccgatgctgccgacctcgacgccttcaaggaacgctgcgccgacgaccgacaccatttccgcttcatcctctcgcccgaggatggcgcggaactcgaagacctgcgcacctacacgcggtacctcatgggccgcatggaggccgacctgggcacgggcctcgattgggtggcggtcaaccactggaataccgacaacccgcacacgcacatcgtcgtgcgcgggcgcgacggcaccggcaaagacctcatcatcgcgggcgactacatcgcgcacggcttccgccatcgcgccgccgagctggcgaccgaatggctggggccacgcaccgagctggagatccagcagaccttgcagcgcgaggtggaacaggagcgatggacgagcctggatcgcaccctgcaacgcgaggctggccagggtggccgggtgcagatcgaacgcttcaacgaaccgcggctgcaacgccaacgcctgttgctga

SEQ ID NO: 12283 - DNA, 2490 bp, Pseudomonas aeruginosa
ggtcagcgcaagccgaccagcccaagggcgggcggtagccgcgcacgtcgccgtcgccgtgccagcggcgggcgcgcaccgtgccgggggcgtagatcgccgccatgcgcgggcggctggtggtggtgcgggtcatgggggcttctccttgcagcgaagcgccccggtcgaggccggggcgcttgccttcggcgcgggtcaagcggccagcgcctcggctggttcatccgccattgcctcggcatcctccggggcgtcctgctccgggcctgcctcctgcgcggcattctgcgggcctgcggccttgaagatggcgggcatccagcccgtgccatcggccagccgctcggcctcgctggcaatgtcggccttcttgagcttcgccagccgggtgacagattccggtgcaaacgcgcccacggcatccagaatcacagccttggaaacgtgcttgaagtagccttctgcggtcggcttccaccatgcggctatgtcgaggcccacggcctgcgccagttcctcgccgggctggtgcgccgtggcgcgaggcgtcaccacgtccaccgtggaagccacgcacacggccagcaaccgcaccagttcgtcttgcgacttcgccagcagcacagcgagcagttcggcgctgtcctccggcaaggcttcaccggccacctgttgcagttcgcgcagcgccacggcagcgggcgattccggccagtccggggccatgccttccagtcggtcttgcgccgtgaggcgcacgcccagcggcaggccatcgccgtaggcgtcgggctgcaagacggtctgcaccatgccatgcaccagcgcggccagcgcgacatgcggatgccgtgcaacttcgatttgcagcgccgccgtgcggtgggcgctcaaccgctgcgccagccggtcggacaggctcgcggccttgggcgcgtcgtcggcgtcctcgtgctcgtcgttggcggcttcgccttcggcactgccgaaaccgcgccgcagcttttccagcgtgcgcagcgccttggcctcggcttcgcgcagcaggccgcgatgaatgacggcctcgccgttgcggtcgatggtgacgatggcaccggccacctcgcgcacctcgggggcatagccctgcaaggcatcctccgcgtcttgcagttccccgaccacctgatcgcgccgctgttccagcttctcggccttggccttgtcctcggcgtcgcaggcttcttccagttcggcgtcgatcttttcgaggcgggtttccagcgaggcgatgcggcgggcttcgcgggtggtcggctcgcggcgatggcgcggggcgttctggaacgcctgccgttcctcgtaggccagatgcggcacggcctccacccatgcccacccctcggcgcgcacgtcctcggccagcgttgccagcttgtcgcgcaccagcgtttccagcactgcggtatcggtgaggtaggttccggcatcgccttctgcgaacaggtcgcggcggacgccgccgcctgcctgccggtaggtgtccagcccgacgaagcgcaccagcgcgtgcgaggcgtcgatttcgcgttcggtcaggcgctcgcgcagcttggacgggctgcgctgccattccggcgcaccaaagaacgcggcttcctgcgcggcgtggtcgtcggtgatggtcaaggccatcaactgttccagcgtgacggttccggcgcggtagtcggccatcaggcgcggcgcgatgtgggcgagcttcaagcggcgctgcaccaccagcggggacacgccgaagtcggcggcaatgtcctcgatgggccggccttccttgaccagcgcggcgaacgcctcgaactggtcggcggggtgcatctgctcgcgcatcaggttttccgcgaggctgacggtacgggccgaagcatcgggcaccagcaggcacggcacttcgtagtcggcggggatgcgcttcttcttcgccagcagcttcaaggcggtcagtcggcggtcgcctgccaccacctcgtaagcctcgccatctgcggaaaggatgacgatcaggttttgcagcaggccgatgcgggcaatgctcgcggccagttcggggatggacaggcgcggcatcttgcgggcgttgcgcttggagcggcgcggcagcaactgcgagagcggaaccagaatcaggttcttggacgggtcggccatttccagcggtgcggcggcttcgatggcgacggcttcggttttgagtacggcgttcatggtgataactccttgcggttagggatgcagcagcgagagaagcggcaagggctgctgcctgcccctgccgcgtggggattcaggctttcaactggcgcaggccatcggccagcagccacagggcgcgattcaggcgcacgctttggtcgatgccctgcacgggccgggtggtctggcggcggccactcgcggcgcgggcggacaggccgcctttggtcaagttctcctgcgtgcggttga

SEQ ID NO: 12284 - DNA, 222 bp, Pseudomonas aeruginosa
aggggacagcaagaccgcctccctcgcacctccacgcacgcggtttttggcaagcgaagcgcgcaggcccgaatagcaatccgggccggaggcatcagcgatgtgaaaggcgggcagttcttaaatgcgcgcccagtcccggtgcagatcgtcaacgatcatgggatgacggtgcccgcctcggtctgcatgttcgcgcaagtgaggatgatctggcggtag

SEQ ID NO: 12285 - DNA, 450 bp, Pseudomonas aeruginosa
cgcgcatcggtcaactcgaaggcatacaggcaggccggcaacccatggtcgcgggcgtccagcagggagcgcttgaggtactgggagaagcgctgggcgtcgatgtcggccagttgcagtgcgcgacggtcgctctgcagcaagtcggcgatgtgcccggcgaggatcgccagcaggctgaaggtacgttcgttgaagacgaagaatggcatctgctccaccgccagcagggcgaggatccgcccatcggtgtcgaccagcggcacgcacacctgcagcgcgctgtgcgcacgctgctcgccgcgctccagcagttcctggcgcacgctgaccagttcgccgcgctccaggcaggtgcgcaccagcagatcgtcggcgtccagcgccggcatctcgccgagcgtcgccaaggattgcggctccggggtgcggtcgtggcgcacccggtag

SEQ ID NO: 12286 - DNA, 387 bp, Pseudomonas aeruginosa
actccttctctgtccactgccagccggccagggtgtcgacgatccaggtgtattgcggacggctgcggttcagcgcgccagggaagccacggcgccaggtgctgccgaggtagacctggccatagcggtcctgcagcaggtcctggctgcgcgcgccatcgagcgccagcgcaccgccatgggccgccagcaggtcgtccggcacgcggttctccaggcgattgcgctggtagtcgatgccgccgcgcagttgccaggccgggccgtcgaagaacagtgtgtgggcccattccagggacagcgcctcgccgttgccgaggtcgtcgccctggcgggtggagaagcggttgtgcgccagcgaccagctcaactggtcgcgcccgctga

SEQ ID NO: 12287 - DNA, 498 bp, Pseudomonas aeruginosa
agtcgagaccgccgaagtcgcgcttgttccaacccagttgcaggccctggggagtgcgttcgaggatttccgccgcctgccgccgcagctgctcgcggttgtcgcgcgagtggccgtcgcccagtgcgcccagggcctcgcccagcgcttcgccgccatggccgagacgcaccagcgcctcgacccgctgcgccggatccagctcgccgcgctccagcaggcgttgcagggcggcgcgattctggctgcgcagggcggcctggatctcttcgttgcgcccgatcttcaggccccggccgcgcgcccaggccagccagtcatccttcagcggctcctggttggtggcggcgagctggtcgaggaactgctcgaaccacagctgcagcatcgccggctcgccattccaggcccgccgcgcctcgccctgggcgagcagcggcccctgggccacggcgagcaggcgcaggtaggcggcgaagctgtccggggtggccctga

SEQ ID NO: 12288 - DNA, 543 bp, Pseudomonas aeruginosa
cactcagcgggaaatgccgggccatccgcgcccagaccccggtctcttcctgcaactgctgggtgtgttcgagaatctgttgcaagcgctgccaggccaggcgctgtttcggataacgctgcacgtagccgcgcagccatgcctcgccctcttccggcgtgccgcgggtttcatggctgtagaccagcgcatcgagttcctcgtcggtcatctgtcgctgcgcaccgatgggcgccagcagctcgatggcgctgtcgaaatcgaacatctgcagcgacaggcgccaggcatgcccgcgcagggccgggtcatcggcgccggccagcagttgcttccacaggcccagcgcccgcgggccgttgccggtccattcgccaaggcgcgcgagatcggccagcagcgtcctgtcctccgggcgcagggccagcagctcctggccgacctcccaggcccgctcgacccgcccggcggccatgttcagacgcaggtcggcggccagcgcctcatggtcctcggggcgcaattcgcgccagcgccggatga

SEQ ID NO: 12289 - DNA, 585 bp, Pseudomonas aeruginosa
agcgttcggccaggtcgtagcgctggctgccttcggcggcgcgtacgccctgggcgagccaggccagggtcgattcatcctccggcaaggcgtccagccgctcgtccagcaacaacgccgcctgttcgccgcgctcgccagcgagcaggctggcgaaggcctggcgcagataggccaggcgcttcgccggctcggtttgcgcttcggccagttgccgctggatgtccgccgccggcagcggctcgccggaagccaggtaccagcgcgccgcctcgtccagccagcgctgccggccctgcgggtcgcggccggccagttcggcaaaggtccgcgccgccaggtccggcgcgtccagggccagggcatgacgggcaagtcgttcgagcatggcgtcgttcaacgaaacgtgctcgatcttgcgcaggcgctccagcaatcggcgcgtctgctcctcatccatgccctcgggcctggccagggcgccaaggatgtccagttccacctcgtagaacggcgttgccaggcggtccttgccgcgcagacgggcgaggtgatgacgcgcctgctcgaagtcgccgagcttga

SEQ ID NO: 12290 - DNA, 219 bp, Pseudomonas aeruginosa
ccagatcgcccactggccgtattcgatgtgccgccacgccaccaaggtcgcgctgcaggctacggcgagtgtgaccgccaacacagcctggagcagctcgtcatgcgcggccgcgtggcccgtcaagtgcgccccacgccagcgcagcagggtgccgtaacggcgtgcgagcgctgcgtggcgcaaggtatcgacaccggcgagcgccaccgatggtag

SEQ ID NO: 12291 - DNA, 1404 bp, Pseudomonas aeruginosa
cgcgacagcagcagcggcgagcgctgcgcaagcgatggcaaacgccgctccccaggcgagcgcgaacgacaggccgagaaagccgaggatgatcgccaccccctggccgagcgccgcgagcggtgcgctaccgacccgctcgacgacgaccgccacggagatcgtcgcgatattcgccagcagccagttggcatcgccgctggcgctgtagagcacgaacagcggcagcgacacggcgagcgcgcgccccatggcgcggccgtcgaacaggcgtgtcagcgaggcgcacacacgacgcgccgcctagagcgctgccaactggtcgagcgtgacgatccgcgcgatgccgcccaggacctcgatggagcgccggtgctcctcgtcgctggccgccgcgcaggcctcctccaacaccagcacttggtagtcgcgatcgtgcgcatcgcgcgcggcggcctgcacagcccaggtcgtactgacaccggcgagcaccaggcgctcgatccgcctcgcccgcaacacggcctccaggcgcgtggcatagaaggcgctgatgcgcggcttgagcacttccatctgcacggcatcccgcttcaggtcaggatgaaatgcgcaaccgcgcccgcagaggtcgagagcgccgagtgcctgcgcggcagcgaagatcggcgaatgttccggcaggtccggatagccgggctcgaagcccaccctcaccgcgatccgcagccagccacgctgctcggcgacggcgagagcgcggttgaaacgcgcgaccacgccacgcaaggcggcctgttctgcacagcgggcaatcctaccgtcgggatgcatgatatcgacgatgtagtcgagaccgatcagtgctgtgttcatcgggaactcctcttccatctgccggaacccaaagccctggattcagggctcctcgaattgcgccaggcgtgtcagcaacggaccggccgccgccagcagggcgcgctcgctctcgtcgagacaggcgtgcatggcacgcaccagccattcttcgcgcttggcgcggttgccgtagagatttcgccggccctccgagctcagcgacacgcgggttctgcgcccatcttgcggatcggcgtgacggacgatcagccctccgcgttccagttcgcgcagcagcgcggccagattcgacgagcgcatccgctcggcggcggccagctcggaaggtgtgacgtcgccgccaaggcggtcgatcgcgccaagcacgaccagttgcgagaattgcaccggatcggcctgcgcctcgcgacgcaggcggcgggtcagggtggtgacctggctgcgcagatgcgctgccagttggagatcctggttggtgggcatatttatctacataatcatagctatattttcatagcaaaataa

SEQ ID NO: 12292 - DNA, 4884 bp, Pseudomonas aeruginosa
cacatccaacgccgcccgccatgggacccgaccgacggcacgacagctgaaatgaaagagccccgcactagggcggggctcttgcttgccgtcagtccggtcgcatcaggggatgcagacaccgtgctggctgctctgcgccaggtccatcagctcgcggttggccacggcgtacatggcgtagtcggtacccgacgcggcacgcagttcgaccagcatcgcccgccagcgctcgaccagcggcaggtgctgttccagccacaggccgacgcgagcctcgacctccttcggtccgtcctgcatctgcaacaccgagacggtgatcgcccgctgctgccagtcgaggtcgtcgcggaacgcctcgcgggccagcgcctgccagttgttctccaccggcaggttggtgatctgttgcaggtaccaggtcaggtccagcgcgctgcccacggcgaaataggccttggccacttccgcggtgtcctggccggtcacgtcggacgcctcgatgatcggcagcagcgtgtacaagtggctggtaccggccaccatgcgtgccagcagttccggcacgccggcgtcgacgtaggtctggtagcgcgcctgccacagctcgcgggtcggcccttcgagcagctcgttgagcttcaggccgagggcggcgatgcgcgggccgaagtgggccacgtcgcgcgccgcgtccagctcgttgcggcggctgcggaggaaccagcgggtggcgcggcggccgaggcgcatcagttcgtccatcagggtcagctggatatcagcgggcacctggtagtcgagattctcgatctggcggaaccaatgcggcaggtggaatacgtcgcggacgatcacgtaggccccggcgacgttggccgcgctcatgccggtggactccttcaggcgctgcacgaaggtgatgcccatgtggttgaccaggtcgttggcgatctgcgtgctgacgatctcgcgcttcaggcgatggcggcgcatggcgtcgccgaacttctccgccagcaatgccgggaaggcggtctccatgtcgcgggtcaggtagtcatcgtcgggcaccagcgatttcagcagcgattccttgaggtcgatcttgctgtaggagatcagcaccgacagctcggcgcgggtcagcccctggccggcactgatgcgttccgccagctcctcgtcggaaggcaggaactccagggcgcgatcgagcttgccacgcgcctcgaggtcgcccatcagccgcttgtactcggcgatccgctcgcgggcgcgacgttgcgccagggacagcgcctgggtctgcttgtagttgttgcccagcaccagggcgccgaccgcgtcggtcatcttcaccagcagcgcgttgcgctgcttctcggtcatgtcgccggcctgcaccacttcgttgagcaggatcttgatgttgacctcatggtcggagcagtccacgccaccggcgttgtcgatgaagtcggtgttgttggcaccgccgtgcaggccgaactcgacccgcgccagttgggtcatgcccaggttgccgccctcgcccaccaccttcgcgcgcagctcgcggccgtcgacgcgcagaccatcgttggccttgtcgccgacatcggcgtgggtttccttgctcgacttcacgtaggtaccgatcccgccgttccagagcaggtcgaccggcgccttgagcagcgcatggatcagctcggtgggcgccagcctgtcggcctggatgtcgaagcgcgccttcatttccggggtgatggcgatgctcttggcgctgcgcaggaagatcccgccgccggcggagatcagcttggcgtcgtagtcggcccagctcgaacgcggcaggttgaacaggcgctggcgctcgacgaagctgctggcggcgtccgggttcgggtcgatgaagatatgcatgtggttgaaggcggccaccagttgcagcttgtccgacatcagcaggccgttgccgaacacgtcgccggccatgtcgccgatgccgatgacgctgatgttgtccttctgcacgtcgatgccgcgctcgcggaagtgccgttgcacgctgacccaggcgcccttggcggtaatccccatgcccttgtggtcgtagccggcggagccgcccgaggcgaaggcgtcgccgagccagaagccgtactcggcggcgatgccgttggcgatgtcggagaaggtcgccgtgcccttgtccgcggcgaccaccaggtagggatcgtcctcgtcgtggcggaccacgttggccggcggcaccacttcgccttccttgaggttgtcggtgatatcgagcaggccggaaatgaagatccggtagcaggcgatcgcctcggcctggatctcgtcgcggctaccgccaagcggcaggcggcgcgggacgaagccgcccttggcgccgaccggcacgatcaccgcgttcttcacctgctgggccttgaccaggccgagcacctcggtgcggaagtcttcctcgcggtccgaccagcgcaagccgccgcgagccaccttgccgccgcgcaggtgcacgccctcgacgcgcggcgagtagacgaagatctcgtacttgggcaccggcctgggcagctccggaatggccttcgggttgaacttgaagctgaagtagctcttgttctggccgttgccgtcgggctggtagaagttggtccgcagggtcgccttgatcaggtcgaggtagcgccgcaggatgcggtcctcgttgagcacctggacttcgtcgagggcaccgaggatcgcctgctccagcttctgttgcttgtcttccaggtcttccgcggtgagtttgcgcgccaggtagaagcgggtcttgaacagccgcaccagctcgcgggcgatgtcggtgtgggcattcagcgcactggcgatgtagccgaggtcgaagcccaggcggatctgcttcaggtaacgcgcgtaggcacgcagcagggcgacgtcgcgccacggcaggttggcggtcagcaccaggcggttgaaggcgtcgttctcggcgtcgccgctgacgatgtggacgaaggcgtcctggaggatctcgttgagctgctggatgtccacgtccagcccttcggcgtaggtgaaggcgaagtcgtggatccagtattcgcggccgttctggtggcgcaggcggtaggggaattcgccgagcacgcgcaggccgaggttctccaggatcggcaggacgtcggacagggccagcggggtgtcggcgtggtacagcttgcagtgcagttgctgctcgccctgcgccagcggctggtagaagctcatcaccagcgggcgctgctcggagaggctgagcaggtgctgcaggtcgaccaccgcgaagtgcggggcgaagcgctcgcggtagccggccgggaagcctttcgggaagtcggccaggacgttggtgcccttggcctcgccgaggttttccaccaccaggctgctgtagtcgtcctgccaggaacggcaggcctggatcacttcttcctccaggcgcgccgggtcgatgtcgatgcgcgacttcgggtcgacgcggaggatgaactgcacgcgggccagcaccgactcggagaagaaggtccagaactcgcagtcgctggcctgcaggcgctccatcaggacctgctggatcttcaggcgcgtctcggtggaatacacgtcgcgcggcacgtaggccaggcagtagcagaagcgaccgtaggggtccttgcgcaggaacacgcggatcttgttgcgctcctggatgcggacgatcgccagggcggtgctgaacagctcgtccaccggggtctggaacaggtcgtcgcgcggcagtacttccagcacctgggccagttccttgccgaggtgggccttggtgtcgaaaccggagcgccgcatcacttcggcgaccttgccgcggatgaaggggatgtcgttgacgctctcgttgtacaccgaggaggtgaacaggcccatgaagcggcactcgcggatcacccggcccttgccgtccagctcgcggatcgacacgtagtccgggtaggccgggcggtgcacacggctcggatgggcagccttggcgaaggacagcaggaccggttcgcgcaggtaggcgacggcatagtcctcgatgtgcaggtcatccttgctcaggccggcacgcagcagacgggtcaggccgaggaaggatttctcgtcgtagaccatgcgcccgccgtcggcctcgtcggcgacgctgaattcctcgtagccgaggaaggtgaagtggttgtccagcagccattcgagatagctgcgtacttccttcagttcctccgccggcaccttcagcttggccttgccaagccaggtcagcagttcgcgggccttggccttcatcggttcgaagtcggcgacggtcacgcgtacttcaccgagcacttccaggatggccttctccagcgcccgcagttcgccggcgtgggcgcaacggtcgatctccaggtacatcagcgattcctggctgacgtccttgccctggctacccttgggcaggatttccttcagctcgcccttggccgagcggcgcacgctgaggacgttggtctgcagggtatggatgctgtagccgcggcggttcagttccatgcgtaccgagtcgaccaggaacggcaggtccgggtgcagcacttccaccgcggtgtgggtggattgccagccgtgcttctcgtagtcggggttgtatacgcggacttcgggctggtcgcggtcgaagcgctccagcaggcgccaggcggaaagggtgcaaccgaccaggtcggaaagccgacgctgggtcagttcatcgagggagatcaggctgaagaactgttcggcgaacagcgtgacttgtggtaa

SEQ ID NO: 12293 - DNA, 561 bp, Pseudomonas aeruginosa
aggctttgcaggttgtcgcgcatggccagggtggccatgcgatcggcatcggtctggaggaattcgccagcgcgcatcgaaccctggctggtgtcctcgccggcggcgttgcgcggcgcgttcgaacatccgctggcgagcgcgccgagcagcaacagcagcccaccgacccagcgccgccacccacgccgggcgcggccctcccccttgcgccgggcaagccccggcaatgtcgctcctgacaaacgctctgtccattcgctgttcgcatcgcggaaaccgacccgcctgagccggcgaagttccccgggcgcgtcgatccgccgcgcttcgcgaggcaggtcacggcgagaggcggaggcttttcaccggcatacccgcgcgggttcacgaataggcgcggcacgagcgtcggagagtacgctaggcagtcgccgtgcgctaacatgtgcgggatcggggagcgtcatccgccgcagagcggagccttctccccgcccgcgcgcgccggcctcgccgtgcgccaccgagcgacaccccagcaggccttggaaccggtag

SEQ ID NO: 12294 - DNA, 327 bp, Pseudomonas aeruginosa
ccgacggccacctgctggtggaaggcgcgccgggactggccaagaccaaggccatcaaggacctcgccgaaggcctcgaagccgagttccaccgtatccagttcactcccgacctgctccccgccgacatcaccggcaccgaaatctaccgtccggagaccggcaccttcgtgttccagcaaggcccgatcttccatcacctggtgctggccgacgagatcaaccgcgccccggccaaggtgcagtcggcgctgctcgaagccatggccgagcgccaggtttcggtcggccgcagcacctacgacctgccacagctgttcctggtga

SEQ ID NO: 12295 - DNA, 1026 bp, Pseudomonas aeruginosa
ccttcgaggcggaagccgccggcatcgaccaggaccgggtcgtgcagcgcatcctcgacgtggtcgccgtggcctgaggccgccgccatgctgagcgccgccccgggcgtcgaactgggcctcgacgagcttctggaaatgcgccaccggctccacgaagcgcgcctgttctcctcgcagaaccgccgcagcccgctggtcggcctgcatcactcgcgcctgcgcggacgcggcgtggacttcgaccaggtgcgcatctaccagcccggcgacgacgtacggaccatcgactggcgcgtcaccgcgcgcacccgcgagccgcacaccaagctgttccacgaggaacgcgagcgaccggtgttcgtcctggtcgaacagagccagcgcctgttcttcggctccggcctgtgcttcaaggcggtgctggcggcacgcgcggcggccttcatcggctggtcggcgctggcccacaacgaccgtatcggcggcctggtattcagcgaccgcgactgccacgaaatcaagccgcgacgcagcaagcacagcctgctgcaactgttcaaccagctattgcgggccaatcgcgagctgcgcgagacgccggccgagcggcctggcgaactgttcggcctggccctacgccgcgcccgcgaagtgctgcgcccgggcagcctgatcctggtgctgtgcgacgagcgcacactcaatgacgtcgccgagcagcaactcagcctgatcgcacgccataccgacctggtgctgctgccgctgtccgacccgctcgaccatgcccttcccgccgccggactgctgcgcttccgcgaaggcgccgccgacctcgagctggacacccacgccgacgagctgcgccaggcctatcgcgaacaggccgaggcgcgccgcgcgcgctggcagcggctggcccagcgactgggcgtgccgctgctgccgctgtcgacccaggaagacctggtggagcagttgcgggacctgctggaacaacaccagccggggtatcgcgcatga

SEQ ID NO: 12296 - DNA, 351 bp, Pseudomonas aeruginosa
tcgctcccctgcccgtcggctggtggccgccagcgcccggctggtggctgctggccgccctgctgccgttgctcggctgggggctctggcgactgcgccggcacctgccgcggcgcaccatcgccacccgcggcgaagcgccgctggatccgctgcgcgaagcggccctggccgaactggcggcgcttgccaagccctacggcagggcttccgccgggccctggctgcaagccatcaacggcctgctcaagcgggtctgcagggcgcgctggccagatagcggcagccacgccctcagcggccgcgcctggctggcgttcctcgacaaccgttgcccggccgccggcctga

SEQ ID NO: 12297 - DNA, 1116 bp, Pseudomonas aeruginosa
tcctggtggaaggcggctaccgcgccgactgcaccctcgacgacaaggccgtggacggcctcgacgccgccgtcgccacctggattcgcaagcatgtttgagttcgcctggccctgggtcttcgccttcgccccgttgccctggctgctgcgcctggtgctgccggccgccgacagcggcgaggcggcgctcaaggtgagcttcctcgacgaactcgaaagcctcgccggacgccgtgcccgcgcacgcctgccggcctggcggcagcaggtgcgcttcgccctgctctggttcctcctgctgctcgccgcggcccgcccgcagtgggtcggcgaccccctgccgctacccgccagcggccgcgacctgctgctcgcggtggatgtctccggctccatggactaccgcgacatgcgctggcaggaagacgagatcagccgcctggaactgatcaagaaactcttcggcgacttcatcgaagaccgtcgtggcgaccgcgtcggcctgatcctgttcggcagccaggcctacctgcaggcgccgctgaccttcgaccggcacaccgtgcgggtctggctggacgaggcacagatcggcatcgccggcaagaacaccgcgatcggcgacgccatcggcctggcggtcaagcgcctgcgccagcggcctgcggaaagccgggtgctggtgctgatcaccgacggcgccaacaccggcggacagatagccccgcagatcgccgcgcaactggccgccgagcaacaggtgaagatctacaccatcggcatcggcgccgacccgcagcaaggcggcgtgcccggcctgttcggcttcaacccggggctcgatctcgacgagccgaccctgcgcggtatcgccgagagcactggcggcgaatacttccgcgcgcgatccagcgccgagctggaaagcatttccgcgaccctcgaccgcctcgaaccggtcgcccagcagactacccgggcgcgcccggccctggcgctgtacagttggccgctggccgccgccctcggcctgagtgtgctgctggtggcgctggaactctggccacgggaaaaccggacctggccgcgccgccgttccgggaggcaaccatga

SEQ ID NO: 12298 - DNA, 402 bp, Pseudomonas aeruginosa
gcgaacccgagcgccagggcatccgcagcgccctcgagcaccgggcggcgcgcctcgccgtgctcggcgtcggcacgccgaagggcgctccggtgcagcaggaggatggcagcttcctcaaggacgaccagggcggcatcctcctgcccaggctcgacgaaagcgggctgcgccgcttcgccgcggagatcggcgccggctaccagcgcctgcggccgaacgaccgcgacctcgacagcctcggcctgctggcccgcggcggcacgctggaggaagatcgcgagaacgccctgctgcgcctgcagcgctgggccgaccagggttactggctgctcctgccgctgctcctgctggccgcctgtgccggacggcgcggctggctgttctgcctgccgctgttga

SEQ ID NO: 12299 - DNA, 3063 bp, Pseudomonas aeruginosa
gcctgccgcaaccggccatggccttccagttcgaagacctctggctgcgtccggaccagcaaggccagcgcctgttgcaacggggccaggcggacgaggcggcgaagcgcttcgaggacttccgctggaaaggcctgtcgctctaccaggcccgcgagtacgccgccgcggcccaggccttcgcccaaggcgaccaggccgacgatcactacaaccgtggcaacgccctggcccgccagggcgaactggaagccgccgtcgacgcctacgaacaagccctggagcgccagccgcaactggtcgccgcgcaacgcaacaaggccctggtcgaggaactgctgcgccaacgccaggaacaggcggcgcagcagcaggccggcgagaacaaggaacagcgccaggaagcgagccagcagagcccgccatccggaagcagccagcggccgccgcgcgacgcggcgaccgtcgatgcgcagaaggcccaggccgcggcgccctcgaccagcctgccggaagacgaaggcgagaagaccgccggagcacccggccaagcgcagccgcagcccaacgccgaggacgagcggacgggcgacgaggaagccgacgacggactcgacgacgaacgtcgccaggccctcgagcaatggctgcgacagattcccgacgatcccgccgaattgctgcggcgcaagttctggtaccaacagcagcaacgccaggaagccacgccatgatccgcctgttctgcagcctgcttctcgcgctcctctgcgtttccgcccatgccagcttcagcgccagcgtcgaccgcgcccgcctgaccgaaggggaaagcgtcgaactgacgctggaatcggacgacccgaccctcttcggcaaacccgacctgagcccgctggacgccctcttcgaggtcctcggcacgcgccaggtcaaccgtctcgccacgcagaacggccgggcccaggccaccacccgctggatcgtcaccctcctgccgaagcagagcggctacgtggcgatcccgccgatcagcctcggcgccagcagcacccagccgatcaggctgcacgtactggaggcgcgcgaccgcgccaagagcagcaagctggcgccggtcttcatcgatgccagcgtcgaccaggagacagtctacgtgcaggcccaggcgatcctcaccctgcgcatctaccactcggtgtcgctatacgacgacagcagcctgaccccgctggcgatgaacgacgcgaaggtcgaacagctcggcgaggcgcgcacctacgagaaggagatcaacggcatccgccacggcgtgatcgaggtgcgctacgcgatcttcccgcagaagagcggcaccctggagattcctgcgcaagccttcagtgcgaccctggtcgaccgtggcagcgacgactacaaccccttcggcccgcgccccggccggcagatgcgggtgacttcgccgagcatcccgctacaggtccggcccaagcccgccgactatccggccgacgcgccctggatgccggcccgcgcgctgagcatcagcgaaagctggagcccgcagccggagcaggcacaggtcggcgaatcgctgacgcgcaacgtgctgctgaaggtcgaggggctttccggcacccagcttccgccgttgccgctgcccgacgtgcaaggcctgcggcgctacccggaccaaccgcagctggccgaccagagcaccgaccagggcctcatcggcagtcgcgaggagcgcgaggcgctggtgcccgagcaggccgggcgcatcgagttgccggcgctcgaagtggtctggtggaacacccgcgaagaccgcctggagcgcaccagcctgccaccgcgcaccctggaagtggccgccgcgccgcaggccgaggcggagccgccggcggcggcgctgccgctcggcgaacgcctggagccgacgctctggccctggcaactggctaccgccgtgctggccctgaccaccctgctcggcttcggcctctggtggcgcgcccgccagctgccggcggtgatccgcgccgcggccaacggcccgagcagccgcagcctgctcgacgagctgcgccgcgcctgcctggccaacgatccccatgcgacccgccaggccctggacgcctgggcccgtcagcaacccgataccctggccgacatggcggcccgcttcgtaccgctgtccgacgccctggatggcctcaacggcgcgctgtacagcgagagcggccattcctggcagggcgaggacctgtggcgggcgatccgcgccctgcccaccacggaacaagcgccggcgggagcggtcgacaatggcggcctgccaccgctctatccgcgctgaacggcgctatggttaggactggcacgatattccgattccgcaagagggcccgcatgcgcttccgtaccctgtacctcgtcctgtgcggcctgctcctgggccacgccgcgacggccgccgaaccgccgaccgcgcccacgccgccgacgcagccggccgaagggccgggcggcgcggactatcgccatgccagcgtgcatcagtggcacttcggcgaaggcgctcgcgaatactgggtgttcacccccgagcaaccggtccccggcaacgctccgctggtgatcttcctgcacggctggagcgtgatgcagccggacctctaccgcgcctggatcgaccatatcgtccgccgcggcatggtggtggtctacccgcgctaccagccggacctgaagacgcccaacgcagacttcctcgacaatgccgccggcgccctcggcgacgccctcaggcgcctgcaggccggcgagctgggggtgcgcccgcggctgaaccaggtcgcctacctcggccactccgccggcggactgctcgccgccaacctggcggccgccagcgaacgcctgaagctgccggcggcgaaggcgctgatggtggtcgagcccggcaagagccagggcaagcgctgggacggcgtgacccaggaacgcctgtcggggctggccaagggcaccctgctgctggcggtctgcggcgactag

SEQ ID NO: 12300 - DNA, 432 bp, Pseudomonas aeruginosa
  unsure (327): Identity of nucleotide at the above locations are unknown.
gacagccacgtggcctgcaccgacgccaagcgcatctaccgccagagccggcacattccgcccagcgacaagaacctgctgctgctgcgcagcgatcgccacggcgctccgccgctgctggccaaccacgcggcacccaccgcgccggtattcggcccgcagtatccgaaggaagaagacagcgactggttgctcgaccgcgtcgagaagcgcctcgaagtccagcaggccgaaggccgctataccggccacgacccgctggtgatcgacgccctcgactggtacggcacctggaagctgttcgatggcctcaccgacgcggcgttntacaaccgcaaccgccagtacgccctgggcgttacgccggagcagaccggcatgggccagtggagcgacggcaccccggtgaagccgatcaaggtgctcaagtag

SEQ ID NO: 12301 - DNA, 540 bp, Pseudomonas aeruginosa
  unsure (121): Identity of nucleotide at the above locations are unknown.
gcgcgggcaacgcccgcggcgaaccaggcacagcgtcccatccgtcatgcgaacagataccatgcatatccacgtactcgtcgtcgaagacaacttcgatctcgccggcaccgtcatcgantacctcgaggccgccggggtggtctgcgatcacgcccgcgacggccaggccggcctcaacctggcgcgcgccaaccgctactacgtgatcctgctggacatcatgctgccgcgcatcaacggccggcaggtctgtcgccagctacgcgaagccggcctgcagaccccggtactcatgctcaccgccctggataccctgcaggacaagctcgacggcttcgacgccggcgccgacgactacctgctcaagcccttcgaactgccggagctgctggtccgcctgcaagccctcagccggcgccgcagcggccaggcccagcgcctgcaggtcgacgacctggtgatggacctcgacagccgccaggccagccgcggcggcacgcccctggcgctgtcccccaccgcctggaagatccttga

SEQ ID NO: 12302 - DNA, 1485 bp, Pseudomonas aeruginosa
gtgcctgatgcgcgccagccccgcgctggtcacccgcgagcagctggggcgcagcgtctggggcgacgaaccgccggaaagcaacaccctcaacgtgcacatgcaccacctgcgcagcaccgtcgacaaggggttcgccacccctctgatccataccctgcacagcgtcggcttccagctggagcgcaaatgaaacgcggcctgagcctgatccccatcgtcggcggcggcgtcaccctgatcctcgccggggtgttgctggtctacacgcgcatgctcggcgactacggcgagaccggcgccctctacctgctcagcatgatgatggaagaggaagggctgtacttcgcccagcgctaccaggaagacccggctacgccggcgccggacagctactacttcaagggcagcgtcggcaccgcggggctgccgccgaaactcagggagatgctcgacaccccgccctacaagagcatcggcgccatgcaactgctcggcaactgggacgacgatgacgaagaggaggatgacgacgcgcccagcgacgatgcctacgtggtggtccgccagccactggccgacggcaagacgctctacctctacgacaacgacgccgccggcagcatcgacacgccgctgtccgacgccatcatcgacgcccgcgtcaggcagacctggatcgtcaccctatcggtcaccctgccttcgctggccgccgtcggcctgctggtctggttcatcgtcgcgccgttgcgcaagctgacgcgctggtcgatgaccctcgacgaccttgccccggacagccagcggccgcgcttcaactaccgcgaactcaacgtgctggcggataccctgtggaacagcgtgacccggatcaaggacttcagccagcgcgaggagcgcttcctgcgctacgccagccatgagctgcgcaccccgctggcggtgatcggcatgaacctggagctgctcgaccaacccggccgcgcgccctccccgcatgccttgcaacgcatccgccgctcggcgctgggcatgcagcagatgaccgaaaccctgctctggctcagccgcgagagcggcgaactgcgcgacgacggacacatcgaggtcggtcgcctgctggaggagctgctcgaggaacagcaggcgctgagccagcgccgcggcctgaccttccacctcgacgtggagccacacagcctgccgcagacccgcgcacggatcatcatcggcaacctgctgcgcaacgccctgcagtacagcgacgagggcgtggtggaaatcgtcgtgcgcgaccgcagcctgctgatcagcaaccccatcggtgcggcccagggcacggaggagtcgatggcgttcggttatggcctgggcctcgacctggtccagcgcctgtgccagaagagcggctggcgcctgcattacagcagcgacgagcagcgcttccgctgcgagctgctgttccccgccacaccggactga

SEQ ID NO: 12303 - DNA, 1251 bp, Pseudomonas aeruginosa
aacaggaagacgctgaccagcaggcagaggaagatcaccaccggccggttgttgaaaatcaggcgttctaccagggctcgccttgttttgctgatgctggttcatggcactcatgcgacccccgccttattgttgttgttcgagcgcggcaccgttcgccgcagcgaggtgcacgccgccctggccgaccaggatcaggtggccgtcgccggtggcgctgacgccggccagggacagccggtcgggacggttgaacacgctgaagctgcgcccgccgtcggtgctttcgaggacactgccgccgtggccgaccacgacgatacgcccgtccgccagcagcgcgccgtcggagagaccgaattccaggtcgccggacgccgccttcagcggtatctcttcccagctgtcgccgaaatcggcggagcggaacaggtggccgcgcaggccgtagaccagcacgccgcccgcatcggcggtaccgatggcgccgaacagcgagccctcgtaggggccttcgagtttttcccaggtggcgccccagtccttcgagcggaacaggctgccggcttcgccgaccaccagcaggccgttgtccttgaccgcggcgatggcgttgaggtggaactggtcctcgttgtccaggcgctcgctgacgtcttcccagtgctggccgccgtcgcgggtctccagcagcgcgccataggcaccgacggccaggccgtgctgttcgtcggcgaaccagatgtccagcaacggcgcttcgcggccgaggtcctcgaactgcctggtccaggtgctgccggcgtcgtcgctgacgaggatctgcgcatcgtgcccgaccgcccagcccttgcgctcgttgacgaagaacaccgaggtgagcaactggcgggtcggcaccttggcctgggtccaggtcttgccgtcgtcgtcggagagcaggatatgcccacggtcgccgaccgcgaccagccgcttgccggcatgggcgacgctgagcagcaggctgctggcggccttcggcgattccacggcgaattgcggcggcgcggcggttggcgtcgactcggccaggaccggggtggcggcgaaggtcagaagagaaagtgccccgagaaacgacagggccctgctggccaggggcgatctggaaggaatggccggatgccgcgaagcgtccgcggtttggccgggcgaagtgcgccacgtcatgggctcacgcatggataccgtccccgttgttgttattag

SEQ ID NO: 12304 - DNA, 1632 bp, Pseudomonas aeruginosa
gcgtgtaagccgtctgtaacggggggatcggcgccgccctcctccccggagggaagcggtcggcgccggcgagcggagcgatcagcgggtgccgcggcggcgcagggccgagggcttgaagtaggagtcgtccggtatcgcctgggtgaagtcgatggtacccggctcctcgttgtccaggttctgcacgtggtagcgacgcgcctgcaggtcgtggaacacatccagcgcgctccaggtgtacggcaggtcgtagaagttcttcaggtaggccatcgacacccgccacagttcgccgcgaccgtcgtactggtcgaccaccgccgcgctccagctgtcctcgtcgaggtacagggtgcgcttggagtagatatgccgcgcgcccggcttcagggtaccttccaccacccacacgcggtgcagctcgtagcgggtgtattgcggatcgaggtggcccggcttgagcagttcctcgtacttcacctcggggctgctgaccttgtagttgttgtagggaatgtagatttccttcttgcccagcagcttccagtcatagcggtccggcgcgccgttgaacatgtcggtgtcgtcggcggtgcgcaggccgtcggcggcggcgatcggcgtgtcgtaggcaaggttcggcgcacgccgcacacggcgctggccggcgttgtagccccaggcctggcgcggctccttgacctggtcgagggtctcgtgcaccagcaccgcgccgccggccaggcgcgccgggctcttggtgaacgacaggtagtagaacatcaggttgttcaggtcggcgaagctgccgcccttgaggtagtacttgaacagcgcttcctgctgcgaggtcaccagcgagtagctaccgttgcgctgtaccgcgacttccgaagcgcggcgcacgacataggtgccgcggtagcgggcgacgtggttccacagcgcctccacgccgctcttcggaatcgggaacggcaccccgccataggcgtcggcgaacccgttgccgccgtccagcagcctggcgctggtggcattggcgaaggtgttgtcgtacagccactgcggcgccgaaccggaacggcgactggggtagaccggcatccggaagctgtccgggtaggtcttgaacagcgccagctggcccggggtcaggtgttccctgtactgctccaggttggccttgtcgatggtgaacagcggcttgtccgcggcgaacgggtccgggtggtgctggcccggcttgtagccggccggcgcctgggtgatgccgccggtccaggcgggaatgctgccggcggcgttgccggccttctccgcgcccagcggggtgaggctcgacttcagttgcgccgcctcgccggcggaaacgccggccagcgcgccgccgctgcccagtgccagcgccagggaagcgccgatcagcaggtgcttgttcaacatgagggttctccgtgtgaggtgccgggcgctcgcggcgcccgtgtcgttatcggttcggtcagaaggagtacttcacggtcaggccgatgttgtcgcggtcgcggatgttgttgttctgcccgccgccgtagaactcggtgtactgcagttcgccttccaggctgttcaggtaggtggccttga

SEQ ID NO: 12305 - DNA, 3618 bp, Pseudomonas aeruginosa
caccctcttccgggcgaagctggcggatcaggccaggctcttgctcaccacttcgtagacgtcgctggacaattcgccggaggccaggatgcgttccagctcgccgcgcatcagcgcctgccgcgcctcgtcgtacttgcgccagcgggtcagcggcaccagcaggcgcgaggcgatctgcgggttgagtgcgttgagcacgatcacctggtcggcgaggaagcgatagccggcgccgtcaggacgatggaagttgaccaggttctggttggcgaacgcgccgatcagcgcgcgcaccttgttcgggttcttcagggtgaaggccgggtgctgcatcagcgcctggacccgctccagcccgcccggcagcggcgagccggcctgcacgctgaaccactggtccatcaccagcgggtcatccttgaagtaatcggcgaacatggccagggccttgcccttctccgcctcgaagccggagttgaccagcaccgccagggcggtcaggcgctcggtcatgttgtcgcagccttcgtactgctccaggcaggcggcgaggatttcctcccggcccgacagcgacaggtaggacagcgcgatgttctgcaggctgcgccgggctatgtgcgaggcctcggcgaggtaggcggtgtcacgggaaatcttgcggttggcctggtaacgctgccacagcggctcgaacagcgcttcgccgatacgctggcgggcgaattcgcgggcggcatggatcgcgtcgacatcggcgacttcgctgatctcggtgagataggcctcgctgggcagcgagagcatctcggcgaccatcgcctggtccagcgcctcgtccgccaggagggtgcggtaggcctcgatcaggcgcgggtcgagtaccagttgctcgccgcgctggtgctggccgatcagctcctgcaggacctgcaccgagagctgttggccggcctcccagcggttgaagccgtcgctgtcgtgctgcatgaggaacagcaactggtcgcggctgtaggggaagctcagtttcaccggcgcggagaagccgcgcagcagcgatggcagcggctgctccggcacctcgacgaagacgaagcgctgctcggcctcggtcaccgccagcacgcggttgccgccctgggccgcggcctcgccttccaggcgcagcggaagttcgtggccctggccgtcgagcagacccagctccagcgggatgacgaagggttccttgctcggctggccgggagtcggcgggcagctctggcgcaccgtcagggtgtagcggcgggcggcggcgtcgtactcgccttccaccgccaggcgcggagtgccggactggctgtaccagcgcttgaactgggtcaggtcgacgccattggcgtcttccatggccttgacgaaatcgtcgcaggtcaccgcctggccgtcgtggcgctggaagtacaggtccgagcccttgcggaagccttcggcgccgagcagggtgtggatcatccgcaccacttccgagcccttctcgtagacggtcagggtgtagaagttggaaatctcgatgaacgagtcggggcgcaccggatgcgccatcggcccggcgtcctcggcgaactggttggtgcgcaggaaggcgacgtcctcgacgcgcttgaccgtgcgcgagttcatgtcggcggagaactccgagtcgcggaatacggtgaagccctccttgagcgacagttggaaccagtcgcggcaggtgacccggttgcccgaccagttgtggaaatactcatgcgccaccacgccctcgacccgctggtgggcggcgtcggtggcggtttcggcgcgggccaggacgcaactggagttgaagatgttgaggcccttgttctccatcgcgcccatgttgaagtcgttgaccgcgacgatcatgaagatgtccaggtcgtactcgcggccgtagacctcctcgtcccagcgcatcgacttcttcaggctgtccatggcgtgctggaccttgtcaatgttctccggctcgacgtagatgcgcaacgccacgtcgcgctggctcatggtgcggaagctgtcctcgacgcaccagaggtcgccggcgaccagggcgaacaggtaggccggcttcttgaacgggtcttcccaggtcgcccagtgccggccgttgccttcggaaccgctggccaccgggttgccgttggagagcagcaccgggtagcgctgctgttcggcgctgacggtggtggtgaagcgactcatcacgtcgggacggtcgaggtaataggtgatcttgcggaaaccctcggcctcgcactgggtgcagaacatcttgccggacttgtacaggccttccagcgcggtgttgctctccggatggatacgcaccgtgctcctgaggacgaactcggcctgccgcggtttcaccccgagctgctcgtcgtccagttggtagtcgtccgcgccgagcgcctggccgtccagttcgagcgccagcagctccagttgctggccatgcagcaacagcggcggcaggccggcgccgcgctcggggttgcgccgcagcttcaactcggcgtgtaccaggctgtggtcttcgaacagttcgaacttcaggtgggtctcgtcgatcaggtagtccggcgcctgatagtccttgaggtggatgactttcggttgctcggtgcgcatggcttgtggcccttctgctcagtgatgcacggcgatctggtaggccgtgtatttgcgaatgttgatcaccccggtgtcgaggatcaggtactggcccttgataccgcgaagcgtgccttcgacgataggcgttttttccaggtcgaggctggcgaccttgctcgggtaggcctcgaccgggtaggcgatctcgagcggatcgaggtcgataaccggttggatcgcctgcaggccgaaacgttgctgcaattcgcgcaggccgtcggcgcactggtcgaacaactgctcgcggactgccgccagatcgaccggctcggcttcgcccttgagcatggcccgccaattggtgcggtcggcgacctggctgcgcagcaggtcttccaccaggccggactgctggcgggtggccacgcgcaggatcggcagcgcctggcgcgcgccctggtcgatccagcgggtgggaatctggctggcgcgggtgatgccgaccttcaccccggaggagttggccaggtacaccacgtgatcggtcatgcagaaccgctcgccccactccggttcgcggcaggtgccctgctcgtagtggcacttctccgggctgacgatgcaactgtcgcactgcgccagccgggtgaagcagggatagcaatagccctggctgaaactcttcttcgtcttgcggccgcaatgggtgcagaagatgctgccgaggtactccaggcgcagcggccggccgatcagcgggttcaccgcgacttcgcggtcgtcgaggcggaaggcgtattgcacgggagcattgctttccaggcgcgccgtcatcttgctcagcgcgccgcgggcgatttcttccatcagtgcacggagtccgacttgaacaggatgttcgggatcggctcgtcggaatgcgaggagcagtgctgcgggcccatgtag

SEQ ID NO: 12306 - DNA, 975 bp, Pseudomonas aeruginosa
cctctgggtatgacgctgttgaccgaattgctagacgaattgcgccacccggccgtccgcgacctggcctggaccgtgctcgccccgccgttgatgcgccggaccccggagccgcagcgccatccgctcgccgccagccgctggcgccaggaaccggagcgcctggccgcctggttgcgcgaacaggagcgacagccgcagcatctcgccgcgtggctcgcgcaatggccacggcagcgtctcggcctgtactacgaacatctctggcaattcgccctggaacaggccccggacgtgcgcctgatcgccgccaacctgccggtgcgcgacggcgggcatacccttggcgaactcgacctgctgctgcgggacgacgacggcatccaccacctggaactggcgatcaaactctacctggggccccagtccggccccggcgactggctcgggcccggcggccaggaccgcctgtcacgcaagctggaacacctctgccgacaccagttgccgctggcggcgacccgcgagggtcgccaggtgctggccgcccatggcgccgaatcggccgtttccgcattgtggctgagcggctacctgttccatccctggcccgggccgggcagcctgcccgccgacatcgagccacggcatctgcgtggccgctggctccgccagcgcgactggccggcgtacctggccagcctggccggaccgcaggccgggcagcattggctgcatctgtcgcgcgagcactggctggcgccggccatgcggcggcaggacccgctcgcccctccgcgcgacggcgcttgctggaacatcgccttcgccgacgaggcacgtccgcaaatgctggtaagggtggtgccgcgcgacggctactgggtagaggccgagcgcctgttcctggccagcgacgactggccaccggggctcagcctgtggggtagcgcgcgccaggccgcggatgcctga

SEQ ID NO: 12307 - DNA, 567 bp, Pseudomonas aeruginosa
ccagtggggaaacggcaaggagtcagctcacggtgcgcaggcgccccgtggtcttgtgccgggcgcagcagttggtgtcgccggcgacgaagcgcgccgggttgtcgacccggtcgagcggcaggttgcagcgttcgccgccgggcagcagcgcctcgcagcgcggctgctggaagtggtccagccactggcggtactggctctcggagacgaagcacttggccgccgcgtaggccagcggattgtcctggtaacgcgggatgtcctgcaaggggatggtcaggtgcccggcgccgggatggtaggcgacgaataccacgccctggccggatagacgctccagcagttgctccggcccctgggcggccagacggtcgcgctcggcgcgcagctcggccagttcctgctccagttgctggtccagctcgttgcggtaggccagttcgacgtcgcggatcgagacctgctccttgtagccggccaccgccgccgccactcgagcctccagttcgtcggcgaactccgagcgcagcaggtcggtctcgttgcgcccctggttctcgatga

SEQ ID NO: 12308 - DNA, 612 bp, Pseudomonas aeruginosa
gcaacgccgaggcctggcagcacctggcggtcggcgagcgcctgctggccagcggtgcgcgcggcgccgccgtggccttcgcccatagccgcctgtggaacgtcaccgaagacggccagagcctgctcggttcgtcgcagggcatgcgccaggccaatcccggcggcggtgcgcaactggtcaatctctggctatgagcgcgccccgggttcgcctcggcgacctctcggtcggcttcgtccaggcgctggccgacgccctgctcgccgccggcgtcgagcccgcagcactgctcgagcagtacggcctcgaccagcggcgcctggccgaacccggggcgcgcctgtcgatccctcgctacatgcgcctcggccatgccgccatacagctcagcggagaccccgcccttggcctgcagatgggccgcctgagccgtctcggacagatgggcctggccggcgtcagcgtcgcccaggcgcccaacatgcgcgccgccgcgcgggcaatgatccacctggaaccgctttacgcgcagaactaccggggccagtcgagcctggtggaagacgccggcggcgcctggctgcgcttctattcgatcagcccttataa

SEQ ID NO: 12309 - DNA, 555 bp, Pseudomonas aeruginosa
agccccattgcaacaccagccacagcccgaccagccccagcagcggccgccagcggcgccactggctgctctgctggcgcgcggcgaactcggcctgggccaggtcggtgcccagcggctgctcgctcagccagacgtgcggattgcccgccaggggctggacttccactccctccggggccgccacctcctgcgcggcgaaggcccgctggggcggcgggcaactgtcgcgcagtaccggccaatcctcgctgccgcaggccaggcgtacggcgccgctgccgccgagcaaccagcgctcttccagccagaacaggcaactgccctcgcccggcaggcaatcggcatcgacatgcagcgaagccggcgccttgcccgcgccctcggccagcgccagccaggcggcaagccaggtgcgctgcacggcgaatacccggtggcggccgtcggccagcgccgacccaagggcaaggtgcatctgctcgacatcgtcggccagttgttcctccaccgcgaaaggcagcgactggcgcaaccagcgcgccttctgtgtag

SEQ ID NO: 12310 - DNA, 396 bp, Pseudomonas aeruginosa
gcaggttcaccgcgcaggcggtcaccgcctccaccggcaggtacagccgccagggcgcgcggatctccgccagcgcctgggcgaacggcgcgcgccggcactcgccatcctgcacccaccataccgccagttccccatcggcccccgccgtgctggcgggcggcaggaacagcgcactcactccactcatcgctcgtccttcttccaatcgtcgccgcccgtcgacgggatgggcaggccgccctgccccatgtcgcgggccatcacgcgtatcttgccgtccttgccccgctgcaaggtactcaccagcacctgccggcggtcgcccaggctgacctcgctgatcacctggaagtagcgggtgccgacggcaaagttgacgttacttgcctttga

SEQ ID NO: 12311 - DNA, 1011 bp, Pseudomonas aeruginosa
aaccacgcgcgcgcttcatcgccgcgccacctcgacccgtggcaggcggaaaccgtcgctgctcagcgacaacgcccgcccctcgggtccgcgctcggccaggcgcaggcggaacggactgagttcgccactggagaggatcagcaattgcggctggtcggtgcctttcttctgctccttctcgcccttgctgccggccagcaccagcggctggccgtccagctcgaaggtcagctccgcccactccggcaggcggtggctgtcgcgcgccaccggcaaccagcgcgccttcgcttcgtcgtagcgcagtacctggtaggcatcgcgctccaggcgcaggccgtactcgcggttgtccagcacggcctcgtcggtcagcacgccgatcagcccggcgagccgctcggcctcgctgtccagctcccgcgaggtgctggcgaagccggtgctgagcaccgccaggccgatcagtacgctgatgatgaccatcaccaccatcagctcgatgagggtgaagccgcgcgaagcccgcatgtccggtcagttgtcccagttaccgatgtcggcgtcgttgtcgctgccgccttccttgccgtcggcgcccagcgaatacaggtcgaacgggcccttggtgcccggcgccaggtactggtagggattgccccacggatcgaccggcagcttcttcaggtagccgtccttgttccagttcttcggctgcggattgccggtgggcttcttcaccagcgcctcgaggccctgctgggtgctcggataggcgaagttgtccagcttgtacatgtccagcgcggcagcgatggccttgatgtcgcccttggccacggtgaccttggcctggtcgggacggctcattacctgcggcaccaccagggcggcgaggatgccgaggatgaccaccacgaccatgatttcgatcagggtgaagcccgactgttggcgacgctgcaatgggcggctctgattcacgcgattaccccacgagttggttga

SEQ ID NO: 12312 - DNA, 2091 bp, Pseudomonas aeruginosa
acacccggaccacgtcgggcaccacgtagcccagcaggaagccgacgatggccagcgaagcgaccatcaggatcaccggatagagcagcgccagctggatcttctgccgcgactgctggcgctgctcggtgtagtcggcaagttgctccagcaccgggccgaggtgcccggcatgctcgccggcagccacagtcgcccggtacagctcgggaaaggcggtgggaaactcgcgcaggctgccggccaggctatggccttcgaggaccttggcgcgcaccgcgagaagcatcgactggatgcgctgcgaggtggactgcgccgcggcggcgcgcagcgcctcctcgatcggcaacgcggcctggaccagggtcgccagttgccgggtcaccaatgccaggtcgcgcgcggacagtccgcgggcgaacgtcaggcgcccgccctgcccgctctgctcgcgggtacgggtgggcttcacgtcgagcggcgccaattggcgctcgcgcagcaactggcggacctggcgcgcgctgtccgcctccagcacgcccttctgctggcgaccgctggggtcgagggcgaggtattcgaaggcggccattattcttcccgggtcacgcgcaggacttcctcgaccgtggtgacgccttccagcaccttgcgccgaccgtcgtcgcggatgctcggtccgctggtgcgggcatgccgggtcatttcctgctcggaggattcgttgtggatcagcgagcgcatgtggtcgtcgaacaccaccagctcatagataccggtacgcccgcgatagccatgctggtggcactcgccgcagccgcgggcgcgatgcagggtcggcggcgcggcgggatcgacgccgagcagcgcgcactcggcctcgtcggcgcggtagggctccttgcacgccgggcagagcacccgcaccaggcgctgggccagcacgccaagcatggaggaggacagcaggaacggctcgatgcccatgtccaccaggcgggtgatcgcaccgatggcgctgttggtgtgcagggtcgagagcaccaggtggccggtcagcgaagcctgcaccgcgatctcggcggtctcccggtcgcggatctcgccgaccatcaccacgtccgggtcctgccggaggatcgcccgcaggccgcgggcgaaggtcatgtcgaccttggcgttgacctgggtctggccgatgccctccaggtggtattcgatcggatcctcgacggtgaggatgttccgcgtgcggtcgttgagcgtggtcaggctggcgtacagggtggtggtcttgcccgagccggtggggccggtgaccagcaggatgccgtgcggcttgcgcaccgtttcgtccatcagcttgcggtcgcgctcgctcatgcccaagtgttgcaggttcaggcgcccggcctgcttgtcgagcagacgcagcaccacccgttcaccgttggccgagggcagggtcgagacgcggatgtccacctcgcgcccgccgacccgcagggaaatccgcccatcctggggaatacgcttctcggcgatgtccagccgtgccatgaccttgatccgcgataccagcagggccgccagctcgcgcttgggctccagcacctcgcgcagcacgccgtcgacgcggaagcgcaccaccaggcgtttctcgaaggtttccaggtggatgtccgaggcgttctcgcggatcgcctcgccgaggatcgcgttgatcaggcgaatgatcggcgcgtcgtcctcctgctccatcaggtcctcggtttccgggacctggtcggccagcgcggcgaggtccaggctgccgccgaggtcctcggcgagctgcatggccgccgaggagtcgtgctggtaggaggccgccagggcctggttgaaggcgtcctcgccgagcgccttgagcggcaggcggcggccggcgaagcgctgcgcctcggcgatcgccgccagctccacctgcggccggcaggccagccagtactgctcctccaggcacaggaacagcaggccctggcgcttggcgaagctgaacggcagacgccgtggcggtgcggccggcgcggcgatgtcgggtaa

SEQ ID NO: 12313 - DNA, 732 bp, Pseudomonas aeruginosa
gtagcctactggcaacgaactgctatgatccctcggcgatcttcagacataacgataaagaccaggagtgatgtattgcctttctccggcgcctcttcccgctggctgcagcggtacgccccggcccttctggctgttgccctgatcatcgccatgagcatcagcctcgcctggcaggcggccggctggttgcgcctgcaacgcagcccggtagccgtcgccgcctcgccggtcagccacgagtcgatccgcagcgatccgacccgcctggcgcgcctcttcggcaccagcgcccaggaccccaacgccccgccaccggccaccaacctcgacctggtgctcaagggcagcttcgtccagagcgatcccaagctgtccagcgcgatcatccagcgccagggcgacaagccgcaccgctacgcggtcggcggcgagatcagcgacggcgtgaagctgcacgcggtctaccgcgaccgcgtcgaactgcagcgcggcgggcgcctggaaagcctgcccttcccgcaccgttccgggggactgctggccagcgcggacgacattacaagcgagaacgactcgatcgaacaactgcaaagcctgcaggatgagaacgctgcagcattgcgcgagcgcctggacgccttgcgccagcagatggaagccacgcccatcgcagaacccgccgaagaagactcgagcgagcccacgaccacgcctacggaaagcgactga

SEQ ID NO: 12314 - DNA, 3132 bp, Pseudomonas aeruginosa
cccgatgtcccagcctttgctccgcgccctgtttgccccttccagtcgttcgtacgttcccgccgtccttctcagcctggccctcggcatccaggcggcgcacgccgaaaacagcggcgggaacgccttcgtcccggccggcaaccagcaggaggcgcactggacgatcaacctcaaggatgccgacatccgcgaattcatcgaccagatttccgaaatcaccggcgagaccttcgtcgtcgacccgcgggtcaagggccaggtcagcgtggtctccaaggcccagctctcgttgagcgaggtctaccagttgttcctctcggtgatgagcacccacggcttcaccgtggttgcccagggcgaccaggcgcgcatcgtgcccaacgccgaggccaagaccgaggccggcggcggccagagcgcgccggatcgcctggagacgcgggtgatccaggtgcagcagagcccggtatcggaactcatcccgctgatccgtccgctggtcccacaatatggccacctcgccgcggtgccctcggccaacgcgctgatcatcagcgaccgcagcgccaatatcgcgcgaatcgaagacgtgatccgccagctcgaccagaagggcagccacgactacagcgtgatcaacctgcgctacggctgggtgatggacgccgccgaggtgctcaacaacgccatgagccgcggccaggccaagggcgcggcgggcgcccaggtgatcgccgacgcgcgcaccaaccgcctgatcatcctcggcccgccgcaggcgcgcgccaagctggtgcaactggcgcaatcgctggacaccccgaccgcgcgctcggccaacacccgggtgatccgcctgcgccacaacgacgccaagaccctcgcggaaaccctcggccagatttccgaaggcatgaagaacaatggcggccagggcggcgaacagaccggcggcggccgaccgagcaacatcctcatccgtgccgacgaaagcaccaacgccctggtcctgctggccgacccggacacggtcaacgctctcgaagacatcgttcgccagctcgacgtgccgcgtgcccaggtattggtggaagcggccatcgtcgagatctccggcgacatccaggatgccgtcggcgtgcaatgggcgatcaacaagggcggcatgggcggaaccaagaccaacttcgccaataccggactgtccatcggcaccctgctgcaatcgctcgagagcaacaaggcaccggaatccatccccgacggcgccatcgtcggcatcggcagcagcagcttcggcgcgctggtcaccgcgctctcggccaacaccaagagcaacctgctgtcgaccccgagcctgttgaccctggacaaccagaaagcggagattctggtcggccagaacgtaccgttccagaccggctcctacaccaccaacagcgaaggttcgagcaacccgttcaccaccgtggagcgcaaggatatcggcgtcagcctcaaggtcactccgcacatcaacgacggcgcggccctgcgcctggagatcgagcaggagatctcggccctgctgcccaacgcccagcagcgcaacaataccgacctgatcaccagcaagcgctcgatcaagagcaccatcctcgccgagaacggccaggtgatcgtgatcggcggcctgatccaggacgacgtttcccaagccgagtcgaaggttcccctgctcggggacatcccattgctcggtcgcctgttccgttccaccaaggacacccacaccaagcgcaacctgatggtcttcctgcgtcctacggtggtccgcgacagcgccggtctcgccgcgctctcgggcaagaaatacagcgacatccgggtcatcgacggcactcgcggcccggagggacgacccagcatcctgccgaccaacgccaaccagttgttcgatggacaggccgtcgatctgcgcgaactgaagacggaataacggcgccataccggcaaggcggcctcatacgaaaaaaaggcgctgctcctttcggaacagcgccttttccgcatctccccaccaactcagtcgaggtagatcattttccgggtcatgccgccatcgaccaggaattcctggccggtgacgaaaccggcgtcctcggagagcagccaagccaccagcgacgcgacatcctccaccgttccgacccggccgaccaggtgctggtcgtggtccagctcggtcagcggcgcagcctcgcgctcggcggcctcgcgggtatcgatccagccggggctgagcgcattgacacggatatccgggcccaggctggcggccagggcatgggtcagcgccagcaacccgcccttgctcgcggcgtaggcctcggagtcaggctccgactggtgggcacgagtcgaggcgatgttgacgatggcgccattgtgcgcgcgcagataaggcgtgcagtacttggccagcagcatcggaccggtcaggttgaccgccagggtccgggtccactcgccgagactcagcgcctccagcggcgtattgcgcggattggcgatggcggcgttgcagaccaggccgtcgaggcggccgaactgaccgagcacctcggccacgctcatcgccacctggccctcctgggccacgtccatggccacgaaccaggcgtgctcgcccagcgcctcggccaccctggccccgcgttcacggtcgttgtcggcaagcactacctgccagccctcggcgatcagccaggcactgatgcccaggccaatgccccgggccgccccggtgaccagggcgaccttgccgttgcctcgcaggttgggttcgatcacagcgcggccagcccccgagccatgtcggccttgaggtcgtcgaggtcttccaggccgaccgcgacccggatcaggctgtcgccgatcccggcgcgcgcgcggtcctcgggggacagtcgaccgtgggaggtggtcgccgggtgggcgatggtggtcttggtgtcgcccaggttggtggtgatcgagaccatccgggtagcgtcgatgaagcgccaggcggcatcgcgcccgcccttcacgtcgaagctgacgaccgcgccgaagccgctctgctggcgccgggccaactcatgctga

SEQ ID NO: 12315 - DNA, 462 bp, Pseudomonas aeruginosa
acccgctcgatgcccggctggcgctccagccattcggccagggccagggcactggcgctgtgcgcctgcatgcggatacgcagggtttccaggcccttgaggaacagccaggcgttgaacgggctgagggtcggtccggcggtgcggaggaagccgaccacttccttcatctgctcgccgcgaccggcgaccaccccgcccatgccccggccctggccgtcgatgtacttggtcgcggagtggatcaccacgtccgcaccgagcttcagcggctgttgcagggccggcgtgcagaagcagttgtccaccgccagcagcgcacccttggcgtgggcgatctcggccagcgcggcgatatccaccagctcggccagcgggttggatggcgactcgacgaagaacagcttggtattcggcttgcacgccgcctcccaggccgcgagatcgctcaacggcggatag

SEQ ID NO: 12316 - DNA, 2040 bp, Pseudomonas aeruginosa
gtcatgccgctctcccctttgtcagtcgttgtacagatcgatgatcgcgctgaccgcctggctcttggccttggtcgcatcgttgcgcgcctgttcgatccggttcaggtaagcctcgttgacgtcgccggtcacgtactcgccgtcgaacacggcgcagtcgaagtgatcgatcttgatcttgccgccgccgaccgcgtcgatcaggtcgggcaggtcctggtagaccagccagtcggcgccgatcagcttgctgacgtcctcggtgctgcgattgtgcgcgatcagctcgtgcgcactcggcatgtcgatgccgtagacgttggggtagcgcacggccggcgcggcggagcagaagtagacgttcttcgccccggcctcgcgggccatctggatgatctgcttgcaggtggtgccgcggacgatggagtcatccaccagcatcacgttcttgccgcggaactccagctcgatggcgttgagcttctgccgcacggatttcttccgcgccgcctggccgggcatgatgaaggtgcggccgatgtagcggttcttgacgaagccctcgcggaacttcacgccgagccggttggccagttccagcgccgcggtgcggctggtgtccgggatcgggatgaccacgtcgatgtcgtggtcgggacgctcgcggaggatcttgtcggcaagcttctcgcccatgcgcaggcgcgccttgtacaccgagatgccgtccatgatcgaatccggacgcgccaggtagacgtgctcgaagatgcacggcgcgtacttcggtgctttggcgcactggcgggtatagagcttgccttcctcggtgatgtacaccgcctcgcccggcgccaggtcgcggatcagggtgaagccgagtacgtccagggccacgctctcggaggcgatcatgtattcgacgccgttctcggtatgccgctggccgaagacgatcggacggatcgcattggggtcgcggaaaccgacgatgccatggccggtgatcatcgccaccaccgcgtagccgccgacgcaacggtcgtgcacgcaggaaaccgcggcgaagatgtcctcctcggtgggctgcagcttgttgcgcaccgccagctcgtgggcgaacacgttgagcagcacttccgaatcggagttggtgttcacgtggcgcaggtcggattcgtagatttccttggccaactgctcgacattggtcaggttgccgttgtgcgccagggtgatgccgtagggcgagttgacgtagaacggctgcgcttccgccgagctggagctgccggcggtcgggtaacgcacatggccgatgccgacgctgccgatcaggcgctgcatgtggcgctgctggaagacgtcgcggaccaggccgttgtccttgcgcaggtacagcttatcgtcatggcaggtgacgataccggcagcgtcctggccgcgatgttggaggacggtgagcgcgtcatacagcgcctgattgacgttcgacttgcccacgataccgacgatgccacacatgtgacgcaacccctacttggctcaagctggaaagatgggaagcgcgatcggtccgtcccggaccatcgagctgaccagggcctgtgggccgctggctcccgcgaatcggtgaccttcgccgccgactggctcgcggcacgtcctgtgccgccggcgccgcgccatcgacgcgccgccctggaaaaccgcgggaccaggcctcggccagtgtcccgccaaaatcactggctgggaagcagcccgccgatgccgctcggcggcgttatcggcgcggccggcaaccactggccggcgaaaccgagaatgaagttcttcgaccagtcggcaaccatcaggaaatgcggcatcagcaccgactgctgccaccaagggtcctgctgtaccggggccaggctgagcaggccgaccagcagcacgaccagcagtacgccgcgcgcaccgccgaagaccatgccgaggaagcggtcggtgccggagaggccggtgacccggatcagttcgccgatgaggtag

SEQ ID NO: 12317 - DNA, 1311 bp, Pseudomonas aeruginosa
ctccccgttatccgttctacgggccagccattccaggccttcggccacgctatagaacgatccgaacagcagaatgacatcatccgcggtagccttggcgcactgcgcgtccagggcggcggcgatatccgcatggctgctcgccggaacctggcgcaggatcagcgccgcctccagctccgcggccggccgcgaacgcggagtcggcaacggtgcaacggcccaatcctgcaccaagccggtcaagggttccagtacgccatccaggtctttgtccgccagcaggccgaagaccgccaggtagcgtcctcgtggcgctgcggcacgcaggcgttgcgccaggtactgggcggcctggggattgtgcccgacgtccagcaggagctggcgtggctggccgttccaggacaggtcgcggcgatcgaggcgaccggtcacccgggtccgccgcagcgcctcggccaggcgctccgcctgccagggcaactcgagcaacgcgtaggcctgcagggccagcgcggcgttttccatgggcaacccgagcaacggcagatcgtgcagcgccagcgcctggccgtccgcggccagcccgcgccagtgccagccatgatcggcgagcgccaggtcgtagtcgcgaccgcgcaggtaaagcggtgcccccagcgcagccacctgctccagcaatggctgcgggggatcgaaatcgccgcacagggccggtttgccggcgcgcaggataccggctttctcgaaagccacgctttcgcgggtatcgcccagccagtccgcatggtccaggccgatgctggtgatcagcgccaggtcggcgtcgatcaggttgaccgcatccaggcgcccgccaaggccgacttccagcaccgcgaagtccagcccggcgcgctcgaacagccagaaggcggccagagtgcccatttcgaaataggtcagggaaatctcgccacgtgcggcctccaccgcggagaaggcgtcgcacagttgcgcatcgccggcctcgacgccatcgatccgcacccgctcgttgtagcgcagcaggtgcggcgagctgtagaccccgaccgacaacccctgctcacgcagcagttcggcgagcagggcgcaggtggagcccttgccgttggtcccggtaacggtgaccacgcgtttcgccggccttcccaggccgagccggcgcgctacctcgcgggaacgctccaggcccatgtcgatggccgtcggatggagttgttcgagatagctcagccaatcggccagggaacgctgggtcatgcggatacggggctcggcgaatga

SEQ ID NO: 12318 - DNA, 228 bp, Pseudomonas aeruginosa
gtgaaggccgacagcagattggccaggcgcggccgcaactcggcacgatgcacgatcatgtcgatggcgccatgctcaaggaggaactcgctacgctggaagccttccggcagcttctcgcggacggtctgctcgatcacgcggggaccggcgaagccgatcagcgccttgggttcgccgacgatcacgtcgccgagcatcgccaggctggcggaaacgccgccgtag

SEQ ID NO: 12319 - DNA, 456 bp, Pseudomonas aeruginosa
accgggtcggtcaataccgagacgaacgggatgccttcttcgcgcaggcgcgccaggaccgccgaggtcttggccatctgcatcagcgagatcagcgcttcctgcatgcgcgcgccgccggaggcggagaagcagatcagcgggcagcgcttctccagggcgacgttggctgcgcgaacgaagcgctcgccgacgatggcgcccatcgaaccgcccatgaaggagaactcgaaggcgcaggcgaccaccggcataccctgcagcttgccgctcatggcgatcagcgcgtccttctcgccggtgtccttctgtgccgcggcgaggcgatccttgtacttcttgctgtcgcggaatttcaggcggtccaccggctcgaggtcggcacccagctcctcgcgaccgtcctcatcgaggaagatgtccaggcgggtacgcgcgttgatgcgcatgtggtga

SEQ ID NO: 12320 - DNA, 675 bp, Pseudomonas aeruginosa
gcacgagccagatccagcttggtcgccgcttcgtcggcaccggagaggaagtcgaagtcatcgtcggcgtctccgtccagggcggaggcgaccgctgcatcttcggcggagaaactcggcgtcgcgctcttcggctcgtcaaggttgctggccaactcgtccaactgcgcactcacctcgtccaactgggcggcgaaactgtcctcgcccttctccggagcggccggctccgtcggctcgtcggccagcgacaggtcgaagtcgtccggcagggacaacgccggctcttcggcagcctcggtatcgagggtgaattcgttgtcggcgggcgccgcggcgggcacttcgtcgttcagcgaaagcaggaagtcgtcgtccgaaagcttgtcttccggcgcatcgagatccagggagaaatcgcccaggtcgtcatgcttgggttggctcggagtctctgccaactccgcgaaatccaggccgaagtcgagatcgtcgacaggcttgtccgccgcggtcgaggccgccaggtccagatcgctgtccagggtcaggtcgtccagcgccccgctgtcggacttgaggtcggcctgcacgtcgtcgccgcccaggtcgtccaggctcaggtcgaaggcgtcgtcgagatcctgtcctgccgcatccggcttggccgcgtga

SEQ ID NO: 12321 - DNA, 471 bp, Pseudomonas aeruginosa
atgtcggcctcgcccagagcatcggaagtctgcgcggtggtcttctcgacctgcggcgcagcggctgcgacctgcggctcaggctcgtcgagggtcaggtcgtcgaagccgtcctttcccaggtccagcgcatcctcctgttcctcgccggcatccgcggcgaaagcctggacttcttccttctctttctgcgcattgcgccgcgacaggatcatcagcagcaccagcaacgccagcagtgcgctaccgccgatcaccgccaaccacagcgggttggccagcagttcgtcgaggaagctcggtgccggctgctctgccgcctgtaccggagcgggcgccggaacggcaggtgccggaggcttctcggcagctggcgcgggcggcggcgccaccggaggctgcgccggagcggcgggtgcttctccggctggagcaggagtcggcgctgccgcagcgggagtcccgggctga

SEQ ID NO: 12322 - DNA, 240 bp, Pseudomonas aeruginosa
agcgggcgaggatcttgttggtctccgcctgggctttccactcctcgcggctctgcccgttgggcagttccttgtcgatccaggggatcaggctgccgcccagcggcgcgccgaaatgctcggtggggaaggcttcgctgcgcagggtctccgccaccttgcggtcgatgtcgaggatcgcgctggccgggttggccaggtcatccgccaccgatgcatgggcggcgcccatctgcttga

SEQ ID NO: 12323 - DNA, 1551 bp, Pseudomonas aeruginosa
tctgatcggtatcgacgttggcgcgatccagcggagcgacgagaccggtcgtctgggtatagggtttcatctcggttctcctcaggcgagcaattcgcggacatcgatgaagcggccgttgacggccgcggcggcggccatcgccgggctgaccaggtgggtacggccaccggcgccctgacggccctcgaagttgcggttggaggtcgaggcgcagtgttcgccgctctccagccggtccgggttcatcgccaggcacatggaacagcccggctcgcgccattcgaagccggcctcgatgaagatccggtccaggccttccttctcggcctgctccttgaccaacccggaacccggcaccaccagcgcctgcttgatggtcgcggcgaccttgcggcccctggccacttcggcggcagcgcgcaggtcctcgatccgcgagttggtgcaggaaccgatgaatacccggtccagctggatgtcggtgatcgcctggttcggccgcaggcccatgtatttcaaggcgcgctcgatcgaaccgcgcttgatcgggtcgctctcgcgggccgggtccggcacgttctggtccacggccaggaccatttccggcgacgtgccccagctgacctgcggcttgatctgcgcggcgtccagctcgaccacggtatcgaagcgggcatcggcgtccgacaccagcccctgccagcaggcgacggcctggtcccattgctcggcgctcggcgcgaagggccggcccttcacgtagtcgatggtcttctggtcgacggcgaccaggccgacgcgggcgcccgcctcgatcgacatgttgcagatggtcatccgcccttcgatggacaggtcgcggatggcgctgccggcgaactcgatggcgtggccgttgccgccggcggtgccgatcctgccgatcaccgcgaggacgatatccttcgccgtgacgccggccggcaacctgccttcgaccttgaccagcatgttcttcatcttcttcgccaccaggcactgggtcgccagcacatgctctacctcggaagtgccgatgccgtgggccagcgcgccgaaggcgccgtgggtggaagtgtgcgagtcgccgcagaccacggtcatccccgggagggtcgcgccctgctccggaccgaccacatggacgatgccctggcgcacgtcgttcatcttgaattcggtgatgccgaagtcgtcgcagttctcgtcgagggtctgcacctgcaggcgcgagacctcgtcggcgatggcggcgatgccgcccttgcgctcggtgcgggtggtcggcacgttgtggtccggggtggcgatgttggcgtcgatccgccacggcttgcgcccggccaggcgaagaccctcgaaggcctgcggcgaggtcacttcgtgcaggatatggcggtcgatgtagatcagcgccgaaccgtcgtcgcgctgcttgaccaggtgcatgtcccagagtttgtcgtagagggtcttgccggccatcgggatttcctcatcagctcatttctatgcccacagggcttgtga

SEQ ID NO: 12324 - DNA, 927 bp, Pseudomonas aeruginosa
gctccgggcagccgaaaccagcggaggcccgcaatggacctgaacagcctcaacaccttcatcgccattgccgagaccggcagcttctccgaagccggcgagcgcctgcacctgacccaaccggcggtgagcaagcgcatcgccgccctcgaacagcagctcaatgcccggctgttcgaccgggtcggccgcgaggtcaacctcaccgaggccggccgcgccctgctgccgcgcgcctaccagttgctcaacgtgctcgacgacacccgccgggcgctgaacaacctcaccggcgaggtcagcggccggctggtcctggccaccagccaccacatcggcctgcatcgcctgccgccgctgctgcgcgccttcacccgggcgcatccgcaggtggcgctggatatccagttcctggattcggaagtggcctacgaggagatccttcatggtcgtgcggaactggcggtgatcaccctggccccggaaaccgccgaaccggtgcgcgcagtcccggtgtgggacgacccgctggacttcgtcgccgccccggagcacccgctggcccgacagggcacggtgttcctcgccgacgtcgccaagcaccccgcggtattccccggcggcaacaccttcacccaccacatcgtgcggcgcatgttcgaagccgaagggctgacgccgaacatcgccatgagcaccaactacctggagaccatcaagatgatggtctccatcggcctggcctggagcgtgctgccgcggaccatgctcgacgaccaggtggtgcgcctgccgctgcaggacatccagctcagccgccagctcggctatatcctgcacaccgagcggaccctgtcgaacgccgcgcgcgccttcatgcgcctgctcgacgaacaggcattcggcaacggcactccagcggcctga

SEQ ID NO: 12325 - DNA, 999 bp, Pseudomonas aeruginosa
agcgctaggaagaaaagctttcggccgcggaatcggcgtattcatgtagcactgcgatcaaccctggctcatatcgacgcgctccgccagaaagtccaggaacgcccgcacgcgcagcggcagatagccgccctggccgacgtagacggcgtggacttcctccaggtcgcctgggttgtatgcctcgagcacgggaatcaggcgcccggcggctatgtcctcgcgcacctggaacgcggccagccgcgccaggcccaggccggccacggccagacggcgcagcgcctcgccatcgctggcctgggcgttgcccgacaacggcaccacgagttcctcgccggcgtcccgcagcggccagccggagcgcgttcgcacatagttggcgccgaggcggttgtgccccagcagcgcctgcggcgtggccggcatgccatgccgggccagataggccggcgcaccgacgatcagcatgcgcgtgctccccagcttgcgcgccaccaggctcgagcttttcagcggccccgcgcgcacggccacgtcggtgcgctgctcgaggatgtcgacgacctcatcggtcagcacgatatccagcgtcacctcgggatgctgcgcgaggaactcgggcagcagcggcagcaggaagtgatgcccgaaaggcacgttggcgttgactcgcaagcgcccacgcggcgccgcgttttcgctcgcacaccgctcggcttcctccagatcggccaggatacgcaccccgcgctcgtagaacgcgcatccctcgggtgtcagttgcaattgtcgggtggagcggttcagcaagcgggttcccaggcgctgttcgagccgggtgatcaacttgctgactgccgagggcgtcatgccgcaacgtcgagcggcggcggaaaagccccccgactcgacgacccgggcaaacacctccagttcgccggaacggttgacttcaagccgggccatggcgccctgcctgatgatttcgcttcataa

SEQ ID NO: 12326 - DNA, 1377 bp, Pseudomonas aeruginosa
atctttgaattcatcatcagctacagaataaccactgaattcaacgacatgaaacgacccatcgaaagacttcccgccgcgacctccagcgcaacccgggctttcgcgctcgcgacgagcctgttgtacgcctgcgccgcgccggccgcttcctggaccgccagctggcaggccagcccgcagccggtctgggctgaggacttcctgtttcccagcaacgtgccagccgaactgcacgaccagacggtgcggcaattggcgcgaatcagcctgggaggaacgcgcgtgcgcatcgtcctggcaaatacctatggaaagcgcccgatccggatcggccgggccaccctggccaaacccggttccgagcgcgccgcggtcgccaccggcagcctgcatgacgtgacctttggcggacgccggacggcgaccatcgcgcccggcgccacgctactcagcgatccggtggcgatgccggtggccgcgctctcgcaggtgctggtgagtctctacctgccggccgccacgcccatggaaaccttccactgggacggccgccagacgggctggatcgtcgccggcgagcagacccaaagccacgcattgcagctggacgcggcggacagccagagcaccagcgcgcgcctgctgttgacaggtatcctggtcgaaaccgaaacggcaacgcggacgctggtgacgctcggcgactcgatcaccgacggagccagcgccagcctcgaccggaacagccgttggccggacttcctcgccgaacgcctggccccgcatggcgtcgccgtggtcaatgcggggatttccggcgcccgtctgctgagcgacggcatgggcgcgagcgcgctggcacgtctggaccgcgacgtactggcccagccaggcgcaagcagcatggtggtgatgctcggcatcaacgacattgcctggcccggtaccgctttcgcccggaatgccgcaccgcccaccctggaagcgctgatcgccggctaccggcaattgatcgaacgggcgcacaaccggggtatccgggtcgtcggcgcgaccctcacgccgttcgagggcgcactgcccggcacgccgttgagcgattattaccatcccgccaaggaagccctgcgcaggcaggttaacgagtggatccgtcatgccggcgccttcgatgcggtgatcgacttcgacgcggcattgcgcgatccggagcagccgtcgcggctcgccgcgcgctacgactccggcgaccatctgcaccccagcgacgaaggcaaccgggcgatggcggccgccgtcgacctcgacgtcctgctggacgaggtgcccgacggcctaccggcggagccccgggccgatagcgcaacgaaatga

SEQ ID NO: 12327 - DNA, 948 bp, Pseudomonas aeruginosa
attatcagcaagtactctggtgcggaacccgtcttcggcatcccgcacgaactagatagggatcatcggaagtatttcaagagccttgagaacgaccgttcgtcgtgctcagatcgaaactcatcctttcgagaaccgtcgctatggaacgcgcaatcccgaccttcccctgccgcgatctggacagcgccagcgccttctaccagtccctcggcttccaccttggcgctcgctatccgacctacgccatcctccagcgcggcgcccctggagctgcacctgtcgctgttcgaagcgctcgaaccgaagaccaattgcagcgctgcctacctgcgcctggaggacgcccaggcgctgcatcgccaggccgcggccctcggcctgggcggccaggggattccacgcatcacggccctggaagaccagccctggggtatgcgcgaattcgccctggtcgatcccgacggcaacctgctgcgggtcggccaggagctcgatgcgacgccagagcaacaccgggttcgcctggccagcgccgacgacgtccccgcggtggccgcgctctggcaagccaatgtccgcgaagccggggaaaccctggatgccggcgaccagcaggcgatccaggcactgctcctggccgcctcgcgcaaccgcttgctctggctggcggaggcccagcagcatccccgcggtttcgtcctcgcccacctgtggcagatcgaggacggtcaggcacgggtgggagagatcgcagagctctacgtactgccgcaggcccgccgccagggcctggcccgggaactggtgggcagtgccgaggaggccctgcgctcgcgcggcgccggcctgatccgcgcgcaatcggcccttgacgcgccgctgtccaacctgttctggcagggcctgggctgggacgccgactacctgaccttcactcgctactga

SEQ ID NO: 12328 - DNA, 954 bp, Pseudomonas aeruginosa
cctggggagcatcatcatgcgcaacgtcatgctgatcaccggagccagccgcggcatcggcgccgccaccgctctgctcgccgccgagcgcggctatgcggtcgtcctcaactatctgcgcaaccgcgaggccgccgaagcgctgcgccagcgcatcgagcgccagggcggcgaagccctggcggtggcggccgacgtagccgaggaaggcgatgtcgagcggctgttcgccgccatcgacgaacgtttcggccgcctcgacgtgctggtcaacaacgccggcgtgctggaagcgcagacgcgcctggaaaacatcgacgcggcgcgcctgcacagggtattcgcgaccaacgtgaccggcagcttcctctgcgcccgcgaggcggtgaagcgcctgtcgacccgccacggcgggcgcggcggcagcatcgtcaacgtatcctcgatggcctcgcggctgggatcgcccaacgaatacatcgactatgccgccgccaagggcgccatcgacagcatgaccatcgggctggccagggaagtggcggcggagggtatccgggtcaacgcggtgcggcccggactgatcgataccgagatccacgccagcggcggcgagcccggccgtatcgaacgcctgaagggcggcataccgctaggacgcggcggtacggcggaggaagtcgcgcgggcgattctctggctggcgtcggacgaagccagcgacagcaccggcggcttcatcgatgtcagcggcggccgctaggcctgctacgcaagctaggccgcctggctgaacgacacctgcaacagccggtcgatggtttcgcaatcgctttcccggcgaatccgcgcgaacagctcgacggcttcgggataggtgcgcgtgagcatgcccagccactgcttgagacgccccggggcatagcgcggggcgagcttgcgccgggcctgtag

SEQ ID NO: 12329 - DNA, 804 bp, Pseudomonas aeruginosa
ccagaagtcgcgcagcagcggcaacagctcgctccagggcatctcgtggatttcgccgccatcgcgccaggcggcgatctgccgagccaggccaggacgcgagaccaggccgcgaccgagcatgatgtcctccaccccgctgacctcgcgacaacgcaggtagtcgtcgagcgtccacacttcgccattggcgaacaccggcacgcgcaccgcctcggccacccgcgccacccactcccagtgcgccggcggcctgtagccatcgaccttggtccgggcatgcaccactacatgggccgagccgccgtcggccagggcccgcgcgcaatccagggcgccgtcgggactgtcgtagcccaggcgcatcttcgaggtcaccgcaatctcgctcggcaccgcgcgacgcacggcggcgacgatgtcgtgcatcagctccggctccttgagcaataccgcgccgccgcgcgagcggttcacggtcttggccggacaaccgaagttcaggtcgatcaccggggcacccagctcacaggcgaacgcggcgttatccgccaggcacgcaggatcggagccgagcaactgcacacgcatcggcgtcccggcgcgggtccggctgccgtcgcgcagctccggcgccagcttgtggaaagccgtggccggcagcaggcgatcggtgatgcggatgaattcggtgacgcaccaatcgatgccgccgacgcgggtcagcacgtcgcggaggatttcatccaccagaccttccatcggcgccagggcgatttgcacgaaccactacctcgaaaatga

SEQ ID NO: 12330 - DNA, 711 bp, Pseudomonas aeruginosa
cgcggcaatgccggcaccggcgaccaccgcctcgcgggcgaaggtgatgttgttgcaggacagcacccgctggcagggcaggctgtctccggaaagcggccagtagcgctgggagtcggtggacagaaggaccgcgcgatgcccggcaagctcggccaccgatgtcggcgtgccgtgcgccgccaggtagtcggggctggcgcagagccagcggctggtagagagcaggcgacgggccaccagggtggaatcctccggctggccgaccatgatcacgatgtcgacgccctcctgcagcggatcgacgctgcgcgaggccagctcgacctcggcggtgatctgcgggtactggcgcatgaagtcgcccagcaggctggcgaggaacatctggccgaactctatcggcgaggtgatccgcagcaatcccgacggcgcctgttgcaactgcatgaccgcctgctcggcctcggcgaaatcgtgcatgatctgccggcagcgctcgtagtaggcctgccctacttcggtcaggcgcaacttgcgggtagtgcgattgagcaggcgcacgcccaggcgctcctccagcagggcgatgcgccggctcaccgtggacttctgcatgcccaggctctgcgcggcctgggtgaagctgtggtactccaccacgcgggtgaagatcagcgcatcatcaagccccattattgttccctataa

SEQ ID NO: 12331 - DNA, 1122 bp, Pseudomonas aeruginosa
gcaacaaagagtccgaagtgtagcgcctataacgtccggcggaacactgctagattggccgaattttgccgacggaacactccacccatgcccgcccaactcaaacgtcgcctgaccgtcttcctggtggccgtcggcctgatcgccctggccttcttcctgcactggtggttcatcggccgccacgtggaaagcaccgacaacgcctacgtccagggcgagatcacgcgggtggccagccagttgggcgcgcgggtcgaggaagtcctggtgcgcgacaaccagcacgtggacaaggggcagctactggtacgcctggaagacgccgacttcaagctcgccgtcgagcgcgcccaggccgcgctggccacccgcgaggcggaactggcccaggcgcgcagcaagctggtgcagcagggcagcctgatcgccgccagcgccgccgacgtcaacgccagccaggcaaccctcggtcgcgcacagatcgacctgaaccgcgccgaagccctgcgcaagcccggctacgtttccgaggaacgggtcaccaccctcaccgccgacaaccatgtggctcgctcgcaactggccaaggcccgcgccgacctcgaggcacaacgcgtccagcgcgacaccctgggcgccgagatcaagcgcctggaagcgcagatcgccagcgcccgcaccgaactggcgcaagccgaaatcaacctgtcacgcaccctgatccattcgccgatcagcggcctggtcggccagcgcagcgcacgcaacggccagtacgtgcaggtcggcacccatttgctgtcgctggtgccggacgaagacatctgggtccaggccaacttcaaggagacccaggtaggccgcatgcgcgacgggcagaaggcgcgcctgaccttcgacgccttccccgacacgcctatcgacggccgcatcgatagcctgttcgccgcttccggcgcgcagttcagcctgctgccaccggacaacgccaccggaaacttcaccaaggtggtgcaacgcatcccggtgaagatcgtgttcgaggccgacaacccgctgcatggccgcatccgccccggcatgtccgtcgaagccgaggtcgagctccgtgaccgctga

SEQ ID NO: 12332 - DNA, 1563 bp, Pseudomonas aeruginosa
ggcgctggcccggccgcttggcgaaccgacccggcgcgactggatcgcggtgctcagcgccatgctcggcgcattcatggcggtgctcgacatccagatcaccaactcctcgctgaaggacatccagggcgcgctggcggcaaccctcgaggaaggctcgtggatctccacctcctacctggtggcggagatcatcatgatcccgatgaccgcctggctggtgcaactgctctcggcacgccgcctggcggtgatgatctcggtgggcttcctggtgtcctcgctgctctgctcgttcgcctggaacctggaaagcatgatcgtgttccgcgccatgcagggtttcaccggcggcgcgctgattccgctggcgttcaccctggccctggtcaagttgccggaacaccaccgtccgaagggcatggcgctgttcgccatcaccgccaccttcgcgccctccatcggaccgaccctgggaggctggctgacggaaaacttcggctgggaatacatcttctatatcaacgtgccgccgggcctgttgatgatcgccgggctgctctacggcctggagaaaaaggcgccgcattgggaactgctgaagagtaccgactacgccggcattgtcaccctcggcatcggcctgggctgcctgcaggttttcctcgaggaaggtcaccgcaaggactggctggagtcgcaactgatcgtcagcctcggcagcgtcgccctgttcagcctggtcctgttcgtcatcctgcaactgtcgcggccgaacccgctgatcgacctgggcatcctgcgcaaccgcaacttcggcctcgcgagcatttccagcatcggtctgggcatgggcctgtacggctcgatctacgtactgccgctgtacctggcacaaatccagggctacaacgccatgcagatcggcgaggtgatcatgtggatgggcattccccagctgttcctgatcccgctggtcccgaagttgatgaagctggtctcgccgcgcctgctctgcgccgccggcttcggcctgttcggccttgccagcttcttctccggggtgctcaacccggacttcgccggaccgcagttcaaccagatccagctactgcgcgccctcggccagccgatgatcatggtgaccatttcgctgatcgccaccgcctacctgcagccacaggatgccggctcggcctcgagcctgttcaacatcctgcgcaacctcggcggcgccatcggcatcgccctgctcgcgaccctgctcgacagtcgcgccaaggtgtacttcgactatctgcgcgaagccctggtgccgaccaacccgcaggtcgacgaacgcctcgcgcaactcgccgcgcaactgggcagccagcaggcggcgctgggcaaactcagcgagatcacccaccagcaggcgatgatcatggcctacaacgatgctttccatgtcatcggcatggtgctcgcagtgagcatgctcgcggtgctgctgacccgctcgctgccggccggcatcggcacccgcgccgacgccggggctcactgaggatcagacgttga

SEQ ID NO: 12333 - DNA, 423 bp, Pseudomonas aeruginosa
acgaagccttcaacgccgatacccgtccgggcaagatcaacctgggcgtgggcgtgtactacaacgaggaggggcgcattccgctgttgcgtgccgtgcaggctgccgagaaggcccgcatcgaggcccacgcgccgcgcggctacctgccgatcgaagggatcgccgcctacgaccagggcgtacagaaactgctgttcggtaacgagtccgagctgctggccgccggccgtgtggtcacgacccaggccgtcggcggcaccggcgcgctcaagctcggcgccgacttcctcaagcgcctgctgcccgacgccaccgtggccatcagcgacccgagctgggaaaaccaccgcgcactgttcgaagccgccggcttcccggtgcagaactaccgctattacgacgccgccagcaatggcgtga

SEQ ID NO: 12334 - DNA, 411 bp, Pseudomonas aeruginosa
ccaaagtgccgaagcccttgccagttccaccagttgggcttgcagctcggtgttttgcacactagttcgcggctggtggcacaacacagagcgggacagcctgaacaactgacaggcacgacgctcggagatgtcggtttgcgcctgcatctcctgcccccccgccccgctgccggactccccctttccccgggtgaccactttcagcgccccgatgtcgaggagggactcggcgagcaacttcttcagccggctgttttccagttcgagatccttcaggcgcttggcatccggcacggtcatgccgacgaacttggcccgctaggtgtagaacgtggcatcactgaagctgtgtcggcgacacagctccttcaccggcacaccggcttctgcctgcttcagaaagtctag

SEQ ID NO: 12335 - DNA, 216 bp, Pseudomonas aeruginosa
accgtccttcttgatctgcccaattatcttttgaaggcgctgctcaccactagcatcggaaaacagctgccgggactgaacattgtcaaatttatggcagtgattacagactcccgcctcatcaaatacgatttcagcgtcagatgtatccataacacagcgcgaacagatcttcatcacaacaacctcccgaagcactcacctcggcctgcctaa

SEQ ID NO: 12336 - DNA, 489 bp, Pseudomonas aeruginosa
ctaatcagtaccgcacgatgcttgccatggaaaacgaataggcttcccgccgctactgccgacacacacgtacgctcaaaaagatcgatgaggtcagcgatggagccagctccaccacaggcgatcactggcacatggacgttagaagcgatattttccactagagcgttgtcgaagcctttctgcactccatctcgatcaatagaatttagaaaaatctcacccactccagcctcttcgagcgcttgcgcccactccaatggggagcgtttcatgtcgcgcgtcccattctctgagaacacggagtgtcctccccagaaacccttgcggcagtcgatagagccaactacgctttgcgaaccaaacttatcggcaattcttcgaatcaacgaaagatccataagagcggcggtatttatcgaaactttttcgacacctagggaaaagattttttccgcatgctccaatgtcttgataccgcccccatag

SEQ ID NO: 12337 - DNA, 294 bp, Pseudomonas aeruginosa
aggaccacaggtaaatctggcgtggcaagaccaaagagttcaaagctgacgctttgccggttctccaaagcaaccacaatcatgaaaagggcgacaactaacagccccaccgccattaacgtacgcttgacccaaagcatggcaactccaacatctgaacaaggcagagatcactccggctcgttgacccgatcccgcaactccttgcccggcttgaagtgcggcacgaacttgccgtcgaggcgtaccgactccccggtcttggggttgcgaccgacgcgcggggcgcggtag

SEQ ID NO: 12338 - DNA, 657 bp, Pseudomonas aeruginosa
tggatcagagacttagccctgattctccatctgagcacggatcagatcaccgatggtggtcggaccagcgctttctacttcctgcttacgcagttctttcattgcgtccttctcgtcgtcgacgtccttggacttgacggagaggctgatgacgcggctcttgcggtcgatgctgatgatcttggcttcgacttcctcgccttccttcaggacgttgcgcgcgtcttcgacgcggtcacggctgatttcggaagccttcaggataccttcgatgtcgtcgcccaggctgatgacagcgcccttggcgtcgacttccttcacggtaccgcggacgatgctgcctttctcgtgcagggacgcgtagttggagaacggatcgtcttccagctgcttgatgcccaaggagatgcgctcgcgctccgggtcgaccgacaggatgacggtttccagctcgtcgcccttcttgaagcgacgtacggcttcttcgccgacttcgttccaggagatgtcggacaggtggaccaggccgtcaatgccgccgtccagaccgatgaagataccgaagtcggtgatcgacttgatggtaccggagatacggtcacccttgttgaactggctggagaagtcttccccacgggttggatttgcactgcttga

SEQ ID NO: 12339 - DNA, 1095 bp, Pseudomonas aeruginosa
tacccagggagatacgacgacgtttttgtcgatgtccagaacctgaatttccatttcttcaccaacttggacgactttcgacggatggatgttcccccccctccagtccatttcggagacgtgtaccaggccttccacgccctcttccagctcggcgaagcagccgtagtcggtgaggttggtgacgcgagccatgacgcgggtgccttccgggtaacgcgccttgatggcaacccacgggtcttcgcccagttgcttcaggcccagggatacacggttgcgctcgcggtcgaacttcaggaccttgacgtcgatctcgtcgccaacgttgacgatctcggacggatgcttgatgcgcttccaggccatgtcggtgatgtgcagcaggccgtttacgccgcccaggtccacgaatgcgccgtagtcggtgaggttcttgacgatacccttgacctgctggccttcctgcagcgattccagcagagcttcacgctcggcgctgttctcggcttccaggacgctgcggcgggaaacgacaacgttgttgcgcttctggtcgagcttgatgaccttgaactcgagctctttgccttccaggtgggtggtgtcgcgaaccggacgaacgtcgaccagcgaacccggcaggaacgcgcggatgccgttgacgtcgacggtgaaaccgcccttgaccttgccgttgatgacgcccttgaccacttcgtcggcagcgaaagccgcttccagaacaatccagctctcggcgcgcttggctttctcgcgggacagcttggtctcgccaaagccgttttttaccgcgtccagtgcgacgtggacttcgtcacccaccttgatggtcagctcgccctgttcgttgtagaactgctcgaccgggatgacgccctcggatttcagaccggcatggacggtgacccagtcaccatcgatgtcgaccacgatgccggtgatgatggcacccggctgcatgtcgagggatttcagactttcttcaaagagttttgcgaagctttcgctcatgttcatacctgtagtcaaaggcccggaagggcccgattccgcatcaccagccaatgcggt

SEQ ID NO: 12340 - DNA, 570 bp, Pseudomonas aeruginosa
cgccccccttcccaaacctccccgccctcgccaatcggcctgctggcggcgtcaatcaaacgtgaacgagagcgtttgggcctttccatttccgagttggccaagcgggccggcatcgccaagtccacgctgtcgcagcttgaagcgggtgtcggcaacccgagcttggaaacgctctgggccttggctatggcgctggatgtccaggtgacccggttgatcgcccaaccgagaagccgcgttcaggtcatccgcgccgatgaaggggccaccgtggcttcggaacaggcccactacgcggccaccctgctggcggtctgcccggccggcgttcagcgtgatctctaccggctcgtggtcgagcctggagcgccacggctgtccgatccgcatctcccgggaacgctcgaacatgtcgtcatttgtcacggacgtgccaggttggggccggtcgggcacccggtagagctgtccgcaggcgactatgcgagctattcggccgacgaggcccacatgttcgaggcgctcgaagccaaaaccaccgccgtcatgttgatcgagcacacgtga

SEQ ID NO: 12341 - DNA, 327 bp, Pseudomonas aeruginosa
cagagcgccggtagatgccggccacgcgctgcccatcggccaccgggcgatgttccaggccggtttcggcagcaatgtccttcgcagcctgcgccagttcccggttgcgcaacgtgcccagcaggttgcgcgccaggatcacgcgctgcccgcgacgctctgccaatccctgttccgccaggaagtcggcgcgctgctgcatcgcctgcttggcctcgccaccaaagcccaggtcgcccaggcccgagccgccgccgatcaactgctggtcgagccaggtggccccgatcacgcgggcctgccgctcgatgggtaggtgcgatttaa

SEQ ID NO: 12342 - DNA, 420 bp, Pseudomonas aeruginosa
atcaggcgcggcagcggatgcacgaaggacgcccaggccagcgcagcgaggccgcaggcggacaggcccgccagcacgatgcgagcgagcaaacctgtgcgggccgagcgaggacgcggcgcggcgtcggcagtggaaacggcggtcatggcagcgccctcccggtcagccaggcggcgtgccgctcggcggtgtattcgggcagcggcaagcgcgcagcgagccggttggcgagcgtgcgccagtacgcgagcgaggcgccgccgggcgcgatacccagcgcctcgatggcgtcgatgcgctccagcaccgcgcgcactgcgttctcgccctcggcgtgcagcagcaggctcgcgcccggctgcacgccggggatgcgctgcgccgcatcgagcggcgtgcaagcctgcatcgccatga

SEQ ID NO: 12343 - DNA, 1236 bp, Pseudomonas aeruginosa
agggcgaggaaacccagtgctggcgcgggtttgcggccgatcggcacgcctgatagcacgatagtcccacgcctgatagcacgataccccgcacgcctgatagcacgacgccatccacaggctttcccgaagttatccccgtgccgtcggcggcacgggccggaacgtcagcagctccatgccgttgtccggcatctgctcgatgcccaggacgtagccgggcaacgactgccgcgcgacaagcgcgcgcaggtcgcaggcgaagtcgtaggacttggcggtgctgccggacttctggtgcaggtagcgaaaatcgaactgccaaccgtattcctgcttgccgccgtgcttgcgtaccaggcggtacagccaccgctcgatgccgcccgtcagccggaaatacgccgggtcgatggtcagcaccagggcggcgtcgagcacgcccgcatagaaccagtccggcagaatcagctcgatgcccagcggcgtgccgctggcatcggccagttccttccattcgttgatccacgagaagcggtgcaagcgccgcccggtcgtctcgcggatggacgtggccacggtggtcgattgcaggcgatccagcgcggctttgaggcgctggtagtcgcgcagcgacttgccacgcccgatgaagcgcaggatctcgtagggcgtggcgcgcatcagccgcgacggccgcaggcccgcgtccttcgcctccacgatctgcgaggccgcccatatcaacacgtctgcatcccaaatcgtggcgatgccgtgctcggccgtgccttccacgcggatcgtgacgttgcccgcgcggaagtcgatgggcttgacccgcttggacttgccgagcgagaagaacggataggccatcaggtcttggctgtcgcgcggtgccatgtcgccgggcaaggcgcggaacaggtcgagctgttcgcgctcctgcatcggccgctgccgggacggcagcgcggtgctggacatggcgatggcctgccgcgcgccgccgatcagcgcgcacggctgtcggccgagtggtgctcggcgtactcgggatcggaagtcgtctcgaagctgcggtcggcggcccaggcatcgaggtcggccacggcgtacatgacgcgccggccgaacttgcgaaagcgcggaccaccaccgatcacgcgctgcttttccagcgtgcgcggcgacaggcgcaggtattcggcggcttcgtcgttggtgagatag

SEQ ID NO: 12344 - DNA, 540 bp, Pseudomonas aeruginosa
acgcggttatttcttcgtctcgatgagccaccacacggcacgcggcaaggcgtggcccgtgatgggatgaatgtcggtgaggtcagcgcaagccgaccagcccaagggcgggcggtagccgcgcacgtcgccgtcgccgtgccagcggcgggcgcgcaccgtgccgggggcgtagatcgccgccatgcgcgggcggctggtggtggtgcgggtcatgggggcttctccttgcagcgaagcgccccggtcgaggccggggcgcttgccttcggcgcgggtcaagcggccagcgcctcggctggttcatccgccattgcctcggcatcctccggggcgtcctgctccgggcctgcctcctgcgcggcattctgcgggcctgcggccttgaagatggcgggcatccagcccgtgccatcggccagccgctcggcctcgctggcaatgtcggccttcttgagcttcgccagccgggtgacagattccggtgcaaacgcgcccacggcatccagaatcacagccttggaaacgtgcttgaagtag

SEQ ID NO: 12345 - DNA, 1803 bp, Pseudomonas aeruginosa
ctacggcgcagtccagcgaactaccgggctggagtcatcgtgaaacaaaaaaaggggccgattcaaccgggtgaatcggccctttctgaaagaccctgccgccggcgaaacccctcagcgattgagcatgaaggtctcgtactccaggtcgtccagcgcggtggtcaggcggtacagcccgaccagcacgcagaccagcagcgacagggtgaagccgtagccgaagaagctcggcccgagcagcaggctgacgaaggtcagggcgccgttgacgatcacgaacagcacgcagagttcgaggacgatgcggcgcttgtccaggtagaagaagacgttgagcaaggccatgaacactacctggatgctcaccccgatcaggtcgatgtagaacagcggcaggtaatagcgggaaattcccagccagccgagcagttgcggcgccagcaggaacagcaggaccaccgccagcccctgcaccttgcagatttccagcaggccctggcggatggcgaggatcatctgctccttgagcaggccgatgtgctgcagggtctctccgccgcggatcgcctcgtagacccgctcgtaccactcggcgaagtcggtctcgatgcgcaccaggaacaccgccatgccgggaatgatcgacaggtaggcgaggaagatcggcaggtcgtagaggatcgaggcgcgcagcgggccgatcaccaggtccgaggtggaggggttgaaccagaagatgaacttgtcgatccaggtccccaggttgtagcagaggccggtcagcagcagactgacgaagacctgccggcggtcgaggaagtcgaaggccaccatgcgcctggccgggtactcgcggaggatgtcgtagaggaagacgaacagcaggctggcgtggccgatcagcaatgccagcagcaggccgtccatctgcatgaaacgcagcaggtaggcacaggcgaccatcagcgcgtagccgatgaacatcaccagcaggatgcgtttgtaggccttcattcccgacaggaagatgatcaccagccacaggttgcagagcaccacgaagttggccatcaccagcaggcggtaggcgaacggctcatcgaacagggtcgccagcaatatcgccgagagcaggcccgccgccaacgtcaccagcaacagcacgcccagcaggttgggcaggatcgcctcgtgcttgcgctcgaacaggcgatcggaaatgaagcgggtgaagaacagttgcagtcccccggtgaagatcagcgacagcgccatcaggtaggtcaccgtgatcaggaactgccggaccagcacgtccggcaccaccacgccgaggctcagcacgccgatcagcatcacgctgacgatcgacagcacccagggaccggagctgatcagcccggcgtagaggtaggcgcgcagggtcgccgtataggaatcgcgggaaaggatcttccgcagttcgaagccgatgccggccatgtcatgcaatctccgtggcttcgcggtacagcccgcggtaacgtccgagcatcagcgcctcggtgtagtagcgttcgacccgttgcaggccgaccgcctgggccgcctgccagcgctgcggattgcgcagcagggcgaggatcgcccgcgaagtggcctgcgggtcggcgatcgccaccacctccccggcgcgacccagggcgcgatcttcggcgtcggcgccttcgatcagttcgcggcaggagccgacgtcgctgctcaccaccggggcgccggcagcccaggcttcgaggatcaccagcggctgcgcttcgctga

SEQ ID NO: 12346 - DNA, 1101 bp, Pseudomonas aeruginosa
cccagctggagacgccgccgcggacatagggccaggtgccctccagcagcaggcagacatcggcgacgggcgccgtcggagcggtgtgttcggtcatgtccagtatctcgccagggccgcgaagggcggccgttgcagcatgtcgtcgggcattccggcgagaagccgggggatgtcccggtagcgccgctggaagaacgccacctcggcgcggaacggcgccagctgggcgctatcgattcccgcctcctcggcggcctggagggcgcgtccggcatcctccaggcggccttgttcgagggcgatgcgcccggccagcagatgcaggtcggccgagggtgcgccgcgcagcgcctggtcggtatgctcgcgcgcctgctcgaggatgtgctccagcacgctgccctgggccaaccccaggtaggccagttcccagtaccagcgcgccagggttccgtgcagcgcgccgcgtcgcgccggcgtggcgccggcgaggcggccgagggcggcctcgatgcgctggttgatccggctttccttctggtcgagcatcgagtaggccagcaggcggacgtcgtcggcggggtcgcgcagggccagcttgaggatcgggatcgcctccttgccgggcatccgccgggtggcgaagatcgccgtgagccgctggttcgggtccggcgcatggcgcaggacgtcctgcagaccgccgtcgctgaacatcatgtcgaggcgcttttccttcggccggaacggcagctcggggacgcccatcgcctgccaggcctgctcgccacgctggcgcggcaggtacagcgccgggaataccgccgcagcgacgccgaccgctccgatcagcggcacgaagaaggccaggctgaagaggaacagcgggctccacggcagcgggaacttgtagcgccgcggcagcagcagccatacgccgacgcacagcagcgcgctgcccaggccgtgggcgaacaggtagagcgccagcgcctggccgaacggcaggtcggcgaagacgctcgcccaactgctcagctcgaacaggaaggcgccgctaaacagccacttgctgatcattcaggccgcactcgttga

SEQ ID NO: 12347 - DNA, 2763 bp, Pseudomonas aeruginosa
tcggcgcaggcgcagggccttgtcctggtagccgctggcatccagtgcgtcggcgtaggcggcctgcaccagccagtcgttgggattggacttgaggtacaggcggaaccaggccagcgcctggtcgttacgctcgagcagcaggctggcgctggcgaacggcagccacagcgtgctgtcccgcagcgccaggccatgccactgcgccaacaggggcgccaggctgtcgcgacggccacggtcgatgtagaaccagagcaggcgttcgcgcaccaggttctcgccggggaaacgcaccagggcttcccggtacagacgctcggcgacgtcgccatggccttcctgttccgccagccgcgccctagccacccagtaataggggctgccctgcgcttccggcaggccttcggcctcggccagcaggctcttcagggccggccagtcgtggaggttctccgccagttgcagggcgctggccaggcgccgcggatcgcggctgcgctgccaactgccgataagcacctgcaaggcctgcttcggattgctgtcccggtacagggcgatcaactggtcctcgtcgctgctgttcaggcggatgtccagggccagcatgcgctcgtaggcggcgcgggcatcgtcgtcctgctccagggcccaggccagcgccgcgcgcaggcgccagaactccggctcgcggatcgcgcgggtatccacgccggcgaggaccttccaggcctggcgcggatcgaacaggttccagtgggtttccgcccactgcatgcgttccttgacactcagcgggaaatgccgggccatccgcgcccagaccccggtctcttcctgcaactgctgggtgtgttcgagaatctgttgcaagcgctgccaggccaggcgctgtttcggataacgctgcacgtagccgcgcagccatgcctcgccctcttccggcgtgccgcgggtttcatggctgtagaccagcgcatcgagttcctcgtcggtcatctgtcgctgcgcaccgatgggcgccagcagctcgatggcgctgtcgaaatcgaacatctgcagcgacaggcgccaggcatgcccgcgcagggccgggtcatcggcgccggccagcagttgcttccacaggcccagcgcccgcgggccgttgccggtccattcgccaaggcgcgcgagatcggccagcagcgtcctgtcctccgggcgcagggccagcagctcctggccgacctcccaggcccgctcgacccgcccggcggccatgttcagacgcaggtcggcggccagcgcctcatggtcctcggggcgcaattcgcgccagcgccggatgaagcgttcggccaggtcgtagcgctggctgccttcggcggcgcgtacgccctgggcgagccaggccagggtcgattcatcctccggcaaggcgtccagccgctcgtccagcaacaacgccgcctgttcgccgcgctcgccagcgagcaggctggcgaaggcctggcgcagataggccaggcgcttcgccggctcggtttgcgcttcggccagttgccgctggatgtccgccgccggcagcggctcgccggaagccaggtaccagcgcgccgcctcgtccagccagcgctgccggccctgcgggtcgcggccggccagttcggcaaaggtccgcgccgccaggtccggcgcgtccagggccagggcatgacgggcaagtcgttcgagcatggcgtcgttcaacgaaacgtgctcgatcttgcgcaggcgctccagcaatcggcgcgtctgctcctcatccatgccctcgggcctggccagggcgccaaggatgtccagttccacctcgtagaacggcgttgccaggcggtccttgccgcgcagacgggcgaggtgatgacgcgcctgctcgaagtcgccgagcttgaccagcaggtcgatcagggtcaggcgcagcgcgtcgttctccgggtgcgcctgcaacagcagttcggcgtagttcaccgagaccgcgtcgggctcgccatcgccgctgggcatgaatacctcttcgctgttgaaggtcagccacagcaccagcgccaccccgagagcgaccggcagcagggcccagggattcagcaggcgcgcctggggatgcttgtcagcggcagacgagttggccatcgcgcacctgctccatcggcaactcgaacgtccacaggccgttgccggcctttcccgggaaggccttgccggccgcgctcagccggcaatcgcccgccgcgcgcaccaccaggcgcaatggcaggtgcccggcgaaggcgaactcgacgcggccatcgtcgcggtagcgccagtgcttcagcggcaggttggcctcctccagcgccggccgcggatcgcggctgtcgcgcaggaccaggcgcgcattcgccgcactcaggtgtacatagcgcccctggggcaggtcgcgcacgcccgcgactcccgtggagcgagcgaggtccggccaacccagcgccgggtccaggcgcaccgtgcgcaaggcggcgaagccgcgcaactgccagctgccatcggcacgcttggccaggctggcgcgatgcaggccttccaggcgcgggatgtagtcgctcatccacagcgacaacggatgctccgcctgcatcgccgcgtagatctggtgcatggtgcggatcgaggcctgcttggtccccgaatagaagtggtagtacaggtgcaggccgcgcaggcggcgcgggctgtcggtcagggcgaaggtatcgatga

SEQ ID NO: 12348 - DNA, 1122 bp, Pseudomonas aeruginosa
catgtgcgggatcggggagcgtcatccgccgcagagcggagccttctccccgcccgcgcgcgccggcctcgccgtgcgccaccgagcgacaccccagcaggccttggaaccggtagtccagacaatgagcaacgagccagaaagcacgcagcacaagagcgccctgcagggactgaagggctacctgtcgagccagatcctcggccaggaaaaactcgtcgaccgcctgctgatcgcgctgctagccgacggccacctgctggtggaaggcgcgccgggactggccaagaccaaggccatcaaggacctcgccgaaggcctcgaagccgagttccaccgtatccagttcactcccgacctgctccccgccgacatcaccggcaccgaaatctaccgtccggagaccggcaccttcgtgttccagcaaggcccgatcttccatcacctggtgctggccgacgagatcaaccgcgccccggccaaggtgcagtcggcgctgctcgaagccatggccgagcgccaggtttcggtcggccgcagcacctacgacctgccacagctgttcctggtgatggcgacacagaacccgatcgagcaggaaggtacctacccgttgccggaagcccagctcgaccgcttcctcatgcacgtcaagatcggctacccggaggcctcggtggaacgccgcatactccagcaggcgcgtggcgaggcactgaacggcgaggcccggccggagcgccgggtgacccaggaaaccatcttcgccgcgcgccaggaaatcctcggcctgtacatggccgacgcggtggaggaatacctggtgcaactgatcatggccacccgcaccccggccaagcacgacgcggaactcgccgaatggatctcctacggcgccagcccgcgcggctccatcgccctcgaccgctgcgcgcgcgcccacgcctggctggccggacgcgacttcgtcagccccgaggacatccaggcggtgctgttcgacgtgctgcgccatcgcctgatcctgaccttcgaggcggaagccgccggcatcgaccaggaccgggtcgtgcagcgcatcctcgacgtggtcgccgtggcctgaggccgccgccatgctga

SEQ ID NO: 12349 - DNA, 582 bp, Pseudomonas aeruginosa
gcgccgccccgggcgtcgaactgggcctcgacgagcttctggaaatgcgccaccggctccacgaagcgcgcctgttctcctcgcagaaccgccgcagcccgctggtcggcctgcatcactcgcgcctgcgcggacgcggcgtggacttcgaccaggtgcgcatctaccagcccggcgacgacgtacggaccatcgactggcgcgtcaccgcgcgcacccgcgagccgcacaccaagctgttccacgaggaacgcgagcgaccggtgttcgtcctggtcgaacagagccagcgcctgttcttcggctccggcctgtgcttcaaggcggtgctggcggcacgcgcggcggccttcatcggctggtcggcgctggcccacaacgaccgtatcggcggcctggtattcagcgaccgcgactgccacgaaatcaagccgcgacgcagcaagcacagcctgctgcaactgttcaaccagctattgcgggccaatcgcgagctgcgcgagacgccggccgagcggcctggcgaactgttcggcctggccctacgccgcgcccgcgaagtgctgcgcccgggcagcctga

SEQ ID NO: 12350 - DNA, 3105 bp, Pseudomonas aeruginosa
cgacccgctggtggcgatcctccagctgactcccgggatgcttgccggcgacctgtcgccgacccgcctggagcaggcccggcgcaagctgctcgacctgcttcgcacgcgcaacgacgcgcagaccgcgatcgtcgtctacgccggcagcgcgcataccctggtgccgctgtcggacgaccagctcaccgcgcgcaacctgctcgacgccctgaaaccttcgatcatgcccgagcccggccagcgcgccgacctcgccgtgcgccaggccctcgacctgctggaacagggcgcccagggccgcggccgcctgctgctgctgaccagcgagctgagcgaacccgagcgccagggcatccgcagcgccctcgagcaccgggcggcgcgcctcgccgtgctcggcgtcggcacgccgaagggcgctccggtgcagcaggaggatggcagcttcctcaaggacgaccagggcggcatcctcctgcccaggctcgacgaaagcgggctgcgccgcttcgccgcggagatcggcgccggctaccagcgcctgcggccgaacgaccgcgacctcgacagcctcggcctgctggcccgcggcggcacgctggaggaagatcgcgagaacgccctgctgcgcctgcagcgctgggccgaccagggttactggctgctcctgccgctgctcctgctggccgcctgtgccggacggcgcggctggctgttctgcctgccgctgttgatgctgagcctgccgcaaccggccatggccttccagttcgaagacctctggctgcgtccggaccagcaaggccagcgcctgttgcaacggggccaggcggacgaggcggcgaagcgcttcgaggacttccgctggaaaggcctgtcgctctaccaggcccgcgagtacgccgccgcggcccaggccttcgcccaaggcgaccaggccgacgatcactacaaccgtggcaacgccctggcccgccagggcgaactggaagccgccgtcgacgcctacgaacaagccctggagcgccagccgcaactggtcgccgcgcaacgcaacaaggccctggtcgaggaactgctgcgccaacgccaggaacaggcggcgcagcagcaggccggcgagaacaaggaacagcgccaggaagcgagccagcagagcccgccatccggaagcagccagcggccgccgcgcgacgcggcgaccgtcgatgcgcagaaggcccaggccgcggcgccctcgaccagcctgccggaagacgaaggcgagaagaccgccggagcacccggccaagcgcagccgcagcccaacgccgaggacgagcggacgggcgacgaggaagccgacgacggactcgacgacgaacgtcgccaggccctcgagcaatggctgcgacagattcccgacgatcccgccgaattgctgcggcgcaagttctggtaccaacagcagcaacgccaggaagccacgccatgatccgcctgttctgcagcctgcttctcgcgctcctctgcgtttccgcccatgccagcttcagcgccagcgtcgaccgcgcccgcctgaccgaaggggaaagcgtcgaactgacgctggaatcggacgacccgaccctcttcggcaaacccgacctgagcccgctggacgccctcttcgaggtcctcggcacgcgccaggtcaaccgtctcgccacgcagaacggccgggcccaggccaccacccgctggatcgtcaccctcctgccgaagcagagcggctacgtggcgatcccgccgatcagcctcggcgccagcagcacccagccgatcaggctgcacgtactggaggcgcgcgaccgcgccaagagcagcaagctggcgccggtcttcatcgatgccagcgtcgaccaggagacagtctacgtgcaggcccaggcgatcctcaccctgcgcatctaccactcggtgtcgctatacgacgacagcagcctgaccccgctggcgatgaacgacgcgaaggtcgaacagctcggcgaggcgcgcacctacgagaaggagatcaacggcatccgccacggcgtgatcgaggtgcgctacgcgatcttcccgcagaagagcggcaccctggagattcctgcgcaagccttcagtgcgaccctggtcgaccgtggcagcgacgactacaaccccttcggcccgcgccccggccggcagatgcgggtgacttcgccgagcatcccgctacaggtccggcccaagcccgccgactatccggccgacgcgccctggatgccggcccgcgcgctgagcatcagcgaaagctggagcccgcagccggagcaggcacaggtcggcgaatcgctgacgcgcaacgtgctgctgaaggtcgaggggctttccggcacccagcttccgccgttgccgctgcccgacgtgcaaggcctgcggcgctacccggaccaaccgcagctggccgaccagagcaccgaccagggcctcatcggcagtcgcgaggagcgcgaggcgctggtgcccgagcaggccgggcgcatcgagttgccggcgctcgaagtggtctggtggaacacccgcgaagaccgcctggagcgcaccagcctgccaccgcgcaccctggaagtggccgccgcgccgcaggccgaggcggagccgccggcggcggcgctgccgctcggcgaacgcctggagccgacgctctggccctggcaactggctaccgccgtgctggccctgaccaccctgctcggcttcggcctctggtggcgcgcccgccagctgccggcggtgatccgcgccgcggccaacggcccgagcagccgcagcctgctcgacgagctgcgccgcgcctgcctggccaacgatccccatgcgacccgccaggccctggacgcctgggcccgtcagcaacccgataccctggccgacatggcggcccgcttcgtaccgctgtccgacgccctggatggcctcaacggcgcgctgtacagcgagagcggccattcctggcagggcgaggacctgtggcgggcgatccgcgccctgcccaccacggaacaagcgccggcgggagcggtcgacaatggcggcctgccaccgctctatccgcgctga

SEQ ID NO: 12351 - DNA, 756 bp, Pseudomonas aeruginosa
  unsure (144): Identity of nucleotide at the above locations are unknown.
agccgatcaaggtgctcaagtaggcgcgggcaacgcccgcggcgaaccaggcacagcgtcccatccgtcatgcgaacagataccatgcatatccacgtactcgtcgtcgaagacaacttcgatctcgccggcaccgtcatcgantacctcgaggccgccggggtggtctgcgatcacgcccgcgacggccaggccggcctcaacctggcgcgcgccaaccgctactacgtgatcctgctggacatcatgctgccgcgcatcaacggccggcaggtctgtcgccagctacgcgaagccggcctgcagaccccggtactcatgctcaccgccctggataccctgcaggacaagctcgacggcttcgacgccggcgccgacgactacctgctcaagcccttcgaactgccggagctgctggtccgcctgcaagccctcagccggcgccgcagcggccaggcccagcgcctgcaggtcgacgacctggtgatggacctcgacagccgccaggccagccgcggcggcacgcccctggcgctgtcccccaccgcctggaagatccttgagtgcctgatgcgcgccagccccgcgctggtcacccgcgagcagctggggcgcagcgtctggggcgacgaaccgccggaaagcaacaccctcaacgtgcacatgcaccacctgcgcagcaccgtcgacaaggggttcgccacccctctgatccataccctgcacagcgtcggcttccagctggagcgcaaatga

SEQ ID NO: 12352 - DNA, 438 bp, Pseudomonas aeruginosa
tggaagaggaagggctgtacttcgcccagcgctaccaggaagacccggctacgccggcgccggacagctactacttcaagggcagcgtcggcaccgcggggctgccgccgaaactcagggagatgctcgacaccccgccctacaagagcatcggcgccatgcaactgctcggcaactgggacgacgatgacgaagaggaggatgacgacgcgcccagcgacgatgcctacgtggtggtccgccagccactggccgacggcaagacgctctacctctacgacaacgacgccgccggcagcatcgacacgccgctgtccgacgccatcatcgacgcccgcgtcaggcagacctggatcgtcaccctatcggtcaccctgccttcgctggccgccgtcggcctgctggtctggttcatcgtcgcgccgttgcgcaagctga

SEQ ID NO: 12353 - DNA, 1302 bp, Pseudomonas aeruginosa
ccggccggcgcctgggtgatgccgccggtccaggcgggaatgctgccggcggcgttgccggccttctccgcgcccagcggggtgaggctcgacttcagttgcgccgcctcgccggcggaaacgccggccagcgcgccgccgctgcccagtgccagcgccagggaagcgccgatcagcaggtgcttgttcaacatgagggttctccgtgtgaggtgccgggcgctcgcggcgcccgtgtcgttatcggttcggtcagaaggagtacttcacggtcaggccgatgttgtcgcggtcgcggatgttgttgttctgcccgccgccgtagaactcggtgtactgcagttcgccttccaggctgttcaggtaggtggccttgatccccagggtgtaggccttgcgaccttcgatgaagttgccggtctggtaggagttgccttcgaagtcgtccttgtagaccacgtagggcgacacgttgaccccggcgaacacgtcgttccaggtgccgctgagcagcagggtgtagccgtaggcgttgcggttcacctggtcgccacggtcgccgccggaaacgtacgagctgttgccgcgcccggcatagtagcgggtgctgccgtcgtaggcggtgtacttcaggctgctgccgcgcaggtgttccgaagccagctcggcgacgccggtcaacgagtcgaagctcagcgacggaccgaagttgtagatggtcccgagggaggtgttgaacgcctcgacccgctcgtagttgtggatctgcccgccgaggccgaccatctgcccgccgacgttgatctgcccgccgttggcggcttccgccgcaccgtgggcgaggtcgccgatcaggtcgttggtggcggcgatgccgatcggcaggttcggccggtaggccagctcgccgaacaccgaggcgtcgcccaccgtggtgttgaagctgaagccgtacatgcggatgtcttcggcgaactcgcggcgggcattgatgttgcccatcacgtcggcggtcaccaggccgttggccagggcttcggcgaggttgccggcgatcggccgcagggtgttggccagcgccgccaggtcggccccggcatagtcgccgatgtcggcgtacagggtcggctccttggagtggtagttgacgaagtagaagccgaactcggtgctgttcagttcctcggcgatgtagcggaaggccacgccgaactggccgtcgttgcgcgcgttgatgtccttgccgatggacgacaccttcatcacgttgccgtaggccggggtcacgccgttggcatatag

SEQ ID NO: 12354 - DNA, 1392 bp, Pseudomonas aeruginosa
gccggtgttcttcagcgcgccgctgagcagcggattgttgcccagcgcctggtacaggccgatgacgttgccgaagccgggcaccggggtgtccagcgcggtgccggtgaagtcgctgtagccggtgttgccgccgtcggcgaacaggtcggtctcggagaagaaggtaccgaccgggtcgaggcgggtttccttccagttccactggtagaaggtttccatcgacaggttgtcggtcaggccgatgttgaagctcagcgcttccaccggcatcagcacttccttgagctcggaaccgggcaggcggtacttggcggcgtccaccgggttggtggtgttgaccccgccacggtagaagatgccctcgccccagttgaacacctggcggccgaagcgcgcgctcagcggcatgttgccgatgtcccagctgccgtagacgtaggcgtcgaggatttccgccttgtgcccggcgatatcgcgggtctggctggtgaaacggtcgtcgtggggatagctctggctcggctgcgatggatcgttgtggctgtagtagtcgttgcgcttgtccatgatctgggtgtcatagaacgccgtgccgcggatgaacacgccatagttgcgccaggtcgcctccaggtccgaggtgatcttgtagacctcggaaaccaggccggtatcgaagttgcggttgccgtcgttggtgttgatgtcgttgttgctcttgtcctgcccctgcacccgccacagggtgccgtaggacagggtggtgtcgagcgaaccggacacctcgttgtcgaggaagctgaattcgacggcctgggcctggccgcccagcagcggcagcagcccgacgaaggcgaagccggcccgggccggcgcggagcgcagccggggctggcggttggggatgtacatcgggaactcactccatgtggtcatgcgttgggcgccgccactgcgggcggttcgccgttcggccgtttctctgcggccttgttatgggtggtcgcggcgtcaccggcctcgcatcgacgaaagggaaccgcgcgacgaggcagtgcaaccgggatgccaattcaacggaatcctccaggcaattcaatggattgcgaaaaaaacaggacttcctgcgggatgactgttcattcactgaccagaaaacaggaagtgtccgacaaaacgcgccaggcgaatttcgccggtggcgcgaaaagtcccttcgcagagcctgcgcagggaggttcgcgaaacacgattaagcggactccatcaatggaaaacagtgaagcgattcccagaagtaacaaagggcgttaccagccagtggccagtaacaccctcttccgggcgaagctggcggatcaggccaggctcttgctcaccacttcgtag

SEQ ID NO: 12355 - DNA, 2346 bp, Pseudomonas aeruginosa
agcggtcgggttttgagcggacggagatcaccgtggcagagcgccaccgttcaccgaaccggtgcgcagcgccccgccgcgccgacgagggcggacaggggcgatacgcagaacctgtgcgagctggagaaaagccgttttcaacgcagtttctccgctacgcaacagatcgcggaaaggctctcagagttcggcggccaggcgcgaaccctggttgatggcgcgcttggcatccagctcggcggcgacgtcggcgccaccgatcaggtgcacgctctggccggccgccagcaggccgtcctgcaactcgcgcagcgggtcctggccggcgcagacgatcacggtatccaccggcagcacctgcggctcgccctcggcaacgcggatatgcaggccggcgtcgtccatcccgagatactccacggcattcaccatctgcacctgcttgttcttcacgccggcgcgatggatccagccggtggtcttgccgaggccgtcgccgaccttgctcttcttgcgttgcaggaggaacacctggcgcgccgccggatgcacctcggccttgatcccggcgatgccgccgcgggcttccaggcgagtatcgatcccccactccttccagaacgcctcgcgctccaggctggtggacggaccggcatgggtgatgaattcggagacgtcgaagccgatgccgccggcgccgatcaccgccaccttgccacccaccggcttgcgctcgaggatcgcatccaggtagctgatcaccttcggatgctcgatgccggggatcgccggtgtgcgcggaacgatgccggtggcgaggacgatctcgtcgtagccgcccgcgaccaggttgtccacgccgacccggcggttcaggtgcagttcgacaccggtgctctccagcttgttgcggaagtagcgcagggtctcgtggaactcttccttgccgggaacccgcttggccacgttgaactgcccgccgatctcgccggcggcgtcgaacaggctgacccggtgcccacgctcggcggccacggtggcggcggccaggccggccgggccggcgccgaccacggcgatttttttcggcctggtggtggggatgtagttcagctcggtttcgtggcaggcgcgcgggttgaccaggcaactggtcagcttgccgccgaaggtgtggtcgaggcaggcctggttgcagccgatacaggtgttgatccgttcggcgtggccggcggcggccttgttgacgaaatccgggtcggcgaggaacggccgggccatggagaccatgtcggcatcgccctcggccaggaccttctccgccacctcgggagtgttgatgcggttggtggtgatcagcgggatgccgacctcgccgcgcagcttggcggtgaccttggtgaaggccgcgcgcggtaccttggtggcgatggtcgggatgcgcgcctcgtgccagccgatgccggtattgatcagggtcgcgccggccttctcgacggccttcgccagcagcacgatctcgtcccagctgctgccgccctcgaccaggtcgagcatcgacaggcgatagatgatgatgaagttcggccccaccgcctcgcgcacccggcggacgatctccaccggcaggcgcatgcggttctcgtagctgccgccccagcggtcggtgcgctggttggtgtgctgcacgaggaactggttgatgaagtagccttccgatcccatgatctcgacgccgtcgtagccggcgacctgggccaggctggcgcagttgacgaagtcggcgatctgcttctggatgccttcctcgtcgagttccttgggcttgaacggattgatcggcgcctggatcgcgctcggcgccacgtgcttcggactgtaggcgtagcggccggcatgcaggatctgcatgcagatcttgccacccgcctcatgcaccgcctgggtcacgatcctgtgcttctccgcctcttccggcgtgctcagcttggccgcgccggaatacacgccgccctcctcgttcgggccgatgccgccggtgaccatcaggccgacgccaccgcgggcgcgttcggcgaagaacgccgccatgcgctcgaagccctgcggcttctcttccaggccagtgtgcatggaccccatcagggtgcggttgcgcagggtggtgaagccgaggtccaacggggcgagcaggtgcggatagggaacggcggcggtcatcgggggtctccacatcgggcgaaacgcgttcacggatatgccgcggcctcgggcgcaatgcgcgggacgggcagcggtcggtatggcgacgactctaaggagcgccaccggagcgctcaatga

SEQ ID NO: 12356 - DNA, 576 bp, Pseudomonas aeruginosa
tcggaatgcacagggatgcttggcaagccgacgccactcccctaccctgtgggctgccttggagacccgcatgcgcaagctgatcttcctgatcctcatcaccctcttcgccgcctacgccggctgggccgaacgccgcccggtaggccactacctgtccgacctgcgcagccaggtcagcgtggtccagggccagcccggcgagcgcggcaacctgctggcggtccagccggaactgttcacgccggactaccagagcgccgaacggttgcaactgaaattccacgcctacctggaaaatgcccgccgccagggcctgctcaacgagcgcacggtggtggtgttccccgagcatgtcggcacctggctggtggccagcggcgagaagcccgaggtctacgccgctgccgactggcccacggcgatggactggatggccgcgagcaacccactgaaggtggcgcgcggctggatcaccgcgcgcggcgatcagcgtctcaccgacaccctgttccggatgaaggcggtggacatggcccacgactaccagaccctgttcggcgggctcgcccatga

SEQ ID NO: 12357 - DNA, 504 bp, Pseudomonas aeruginosa
tttcaaggtgacggtggtcgccggctccatcgtcctgcccgaccccgaggtcgaggacggcgagctgcgtcccggcaccggccagctgtacaacgtcagcctgaccttcggtcccgacggccggccgctcggccagccgcaacgcaaggtgttcccgacccgccacgaactgagctacctcaacaacggtcgcggcgagcgcctgcaggtgctggatacgccggcaggacgcctgggcgtgctgatcggcaccgacagctggtacccggacacctacgccaccctggtcgaacagcgcgtcgaactgctggcgatccccgccgccctgaaccagagcggtcgctggcagcagccctggcccggcttcgatgcggagctggttcccggcgacgtacgcctggcgccgaacagcctgagcaacgccgaggcctggcagcacctggcggtcggcgagcgcctgctggccagcggtgcgcgcggcgccgccgtggccttcgcccatag

SEQ ID NO: 12358 - DNA, 1143 bp, Pseudomonas aeruginosa
ccgcctgtggaacgtcaccgaagacggccagagcctgctcggttcgtcgcagggcatgcgccaggccaatcccggcggcggtgcgcaactggtcaatctctggctatgagcgcgccccgggttcgcctcggcgacctctcggtcggcttcgtccaggcgctggccgacgccctgctcgccgccggcgtcgagcccgcagcactgctcgagcagtacggcctcgaccagcggcgcctggccgaacccggggcgcgcctgtcgatccctcgctacatgcgcctcggccatgccgccatacagctcagcggagaccccgcccttggcctgcagatgggccgcctgagccgtctcggacagatgggcctggccggcgtcagcgtcgcccaggcgcccaacatgcgcgccgccgcgcgggcaatgatccacctggaaccgctttacgcgcagaactaccggggccagtcgagcctggtggaagacgccggcggcgcctggctgcgcttctattcgatcagcccttataacgcctataaccgcttcgtcgtcgattcggtgctggcaggctggatcagccatctcggcgccctggcaaggcagccgttgaaagcggagcgggtggagatcgaatatccagcgccgccttgggccgagcgctacgaggcattcttcggctgcccggtggaattcggcgcgccgaccaaccagttgcgcctgagccaggccagcctggccctggcgaatgccgagcactgtccgagcacctggagccagatgctggaactctgcaaccgcgaactggagcagttgacccgcacccgcagttggcgcgagcgcgtcagccgcctgctggggccgatgctcaatggtcgcgaaccggacctcgaggaaatcgccgcgcgcctcaagttgccgacctggaccctgcggcgcaagctggccgaggaaggcacccagttccgcagcatcctcaacgacacccgccgcgacctggcgatggtctacatccgcgagaccgacctggctttcggcgaaatcgcctacctgttcggcttcgcctcggcggaagccttccagcgcgccttcaagcgctggagcgggcagacgcccggcgaattccgccgcgcccagcgacagagcgcctga

SEQ ID NO: 12359 - DNA, 1458 bp, Pseudomonas aeruginosa
agcaccaccagcaggaggaacgcgccgagccagagcagcgccaggcggtcccgcgccggcagcccgcgccagcggatcgccagctgcgaggtttccgcctgggccctgaggcgctcgtggaattgcgtcatcaccttcatctcaacctcctatcaccagacgcgcgctgaccgtcgagccatcgcggctggccgaacccagctgcaccgccagcccggactcgctgagacgcgaacgcagccgttccagcacgtcgaaaccgggagcccgcacctggagggcgacgtcaccgcgagcggcgctgaagtccagttgctcgacgctcaccgttggctcgccgccgatcaccgtggcggcctggccaagcaggccgagcaactggccctcgccgccgctgctggcgctgtcggccaggtgctggtcgaactgcgcgcgcaggttgatcagcttgcggtcctcgggaaacaactggcggtagagttctgcgctctgcgccgcgtagcggtcgccttcgcgctgcaactgccaggcctggaccagggtaaagccccattgcaacaccagccacagcccgaccagccccagcagcggccgccagcggcgccactggctgctctgctggcgcgcggcgaactcggcctgggccaggtcggtgcccagcggctgctcgctcagccagacgtgcggattgcccgccaggggctggacttccactccctccggggccgccacctcctgcgcggcgaaggcccgctggggcggcgggcaactgtcgcgcagtaccggccaatcctcgctgccgcaggccaggcgtacggcgccgctgccgccgagcaaccagcgctcttccagccagaacaggcaactgccctcgcccggcaggcaatcggcatcgacatgcagcgaagccggcgccttgcccgcgccctcggccagcgccagccaggcggcaagccaggtgcgctgcacggcgaatacccggtggcggccgtcggccagcgccgacccaagggcaaggtgcatctgctcgacatcgtcggccagttgttcctccaccgcgaaaggcagcgactggcgcaaccagcgcgccttctgtgtaggcaggttcaccgcgcaggcggtcaccgcctccaccggcaggtacagccgccagggcgcgcggatctccgccagcgcctgggcgaacggcgcgcgccggcactcgccatcctgcacccaccataccgccagttccccatcggcccccgccgtgctggcgggcggcaggaacagcgcactcactccactcatcgctcgtccttcttccaatcgtcgccgcccgtcgacgggatgggcaggccgccctgccccatgtcgcgggccatcacgcgtatcttgccgtccttgccccgctgcaaggtactcaccagcacctgccggcggtcgcccaggctgacctcgctgatcacctggaagtag

SEQ ID NO: 12360 - DNA, 690 bp, Pseudomonas aeruginosa
agccccgctgtagcctcatggctggctcccgaggaaaccgacgaggcgcgccgcggcgcgttcctcgatgctgccacgctcgcggccgaggggcttcgccgcgacccagacgatcacccgccgcatatcctgctcggcggtgctgtcgacctgggtgcgccactcccagcggcgcccggcgaactccagctcgccctggttgtggccgctggagggcggcgtctgttccagttgcaattcgttgagacggttgtcggcgatccacatcgccagggtcttgtcttccagccgcgaggcgttctgcaggctgcgcgcgctggcactgagcacgctggccgcgaccatggcgaagatcgccagggccaccagcacttccagcagggtgaaaccacgcgcgcgcttcatcgccgcgccacctcgacccgtggcaggcggaaaccgtcgctgctcagcgacaacgcccgcccctcgggtccgcgctcggccaggcgcaggcggaacggactgagttcgccactggagaggatcagcaattgcggctggtcggtgcctttcttctgctccttctcgcccttgctgccggccagcaccagcggctggccgtccagctcgaaggtcagctccgcccactccggcaggcggtggctgtcgcgcgccaccggcaaccagcgcgccttcgcttcgtcgtag

SEQ ID NO: 12361 - DNA, 1407 bp, Pseudomonas aeruginosa
ttcacgcgattaccccacgagttggttgagagaaaggatcggaagaagaatggccaggacgatgaccagcaccaccgcgcccatgaatatcagcatgaacggttcgaacaggccgaccatcaggccgatctgcgccgccaggtcgttctcctggttgcgcgcggtgcgcgccagcatctggtccagctcgccggagcgctcgccgctggcgatcatgtgcagcatcatcggcgggaactgtccggtggcttccagcgagcgggtcaggctggcgccctcgcggaccttctgcgcggccttgaccacttcgttgcggatgatccggttggcgatcacctcggcggcgatcgccagcgcctccaccagcggcacgccgctgcgggtgaggatcgccagggtcgaggcgaagcgcgcggtgtcggtggaacgcaccagccgaccgaccagcggcacgcgcagcaggaagccatgccagcgctcgcgaaaggcatccttgcgcagcgcgtagcggaagccgatcaccccgccgatcgccgcgacgaaggccagcgcgccccaggccttgacccagtcgctgacgccgatcagcacgcgggtcaacagtggcagggtctgcccgctgtcgatgaacacccggaccacgtcgggcaccacgtagcccagcaggaagccgacgatggccagcgaagcgaccatcaggatcaccggatagagcagcgccagctggatcttctgccgcgactgctggcgctgctcggtgtagtcggcaagttgctccagcaccgggccgaggtgcccggcatgctcgccggcagccacagtcgcccggtacagctcgggaaaggcggtgggaaactcgcgcaggctgccggccaggctatggccttcgaggaccttggcgcgcaccgcgagaagcatcgactggatgcgctgcgaggtggactgcgccgcggcggcgcgcagcgcctcctcgatcggcaacgcggcctggaccagggtcgccagttgccgggtcaccaatgccaggtcgcgcgcggacagtccgcgggcgaacgtcaggcgcccgccctgcccgctctgctcgcgggtacgggtgggcttcacgtcgagcggcgccaattggcgctcgcgcagcaactggcggacctggcgcgcgctgtccgcctccagcacgcccttctgctggcgaccgctggggtcgagggcgaggtattcgaaggcggccattattcttcccgggtcacgcgcaggacttcctcgaccgtggtgacgccttccagcaccttgcgccgaccgtcgtcgcggatgctcggtccgctggtgcgggcatgccgggtcatttcctgctcggaggattcgttgtggatcagcgagcgcatgtggtcgtcgaacaccaccagctcatag

SEQ ID NO: 12362 - DNA, 969 bp, Pseudomonas aeruginosa
ggctccttgcacgccgggcagagcacccgcaccaggcgctgggccagcacgccaagcatggaggaggacagcaggaacggctcgatgcccatgtccaccaggcgggtgatcgcaccgatggcgctgttggtgtgcagggtcgagagcaccaggtggccggtcagcgaagcctgcaccgcgatctcggcggtctcccggtcgcggatctcgccgaccatcaccacgtccgggtcctgccggaggatcgcccgcaggccgcgggcgaaggtcatgtcgaccttggcgttgacctgggtctggccgatgccctccaggtggtattcgatcggatcctcgacggtgaggatgttccgcgtgcggtcgttgagcgtggtcaggctggcgtacagggtggtggtcttgcccgagccggtggggccggtgaccagcaggatgccgtgcggcttgcgcaccgtttcgtccatcagcttgcggtcgcgctcgctcatgcccaagtgttgcaggttcaggcgcccggcctgcttgtcgagcagacgcagcaccacccgttcaccgttggccgagggcagggtcgagacgcggatgtccacctcgcgcccgccgacccgcagggaaatccgcccatcctggggaatacgcttctcggcgatgtccagccgtgccatgaccttgatccgcgataccagcagggccgccagctcgcgcttgggctccagcacctcgcgcagcacgccgtcgacgcggaagcgcaccaccaggcgtttctcgaaggtttccaggtggatgtccgaggcgttctcgcggatcgcctcgccgaggatcgcgttgatcaggcgaatgatcggcgcgtcgtcctcctgctccatcaggtcctcggtttccgggacctggtcggccagcgcggcgaggtccaggctgccgccgaggtcctcggcgagctgcatggccgccgaggagtcgtgctggtag

SEQ ID NO: 12363 - DNA, 2262 bp, Pseudomonas aeruginosa
agctgcacgcggtctaccgcgaccgcgtcgaactgcagcgcggcgggcgcctggaaagcctgcccttcccgcaccgttccgggggactgctggccagcgcggacgacattacaagcgagaacgactcgatcgaacaactgcaaagcctgcaggatgagaacgctgcagcattgcgcgagcgcctggacgccttgcgccagcagatggaagccacgcccatcgcagaacccgccgaagaagactcgagcgagcccacgaccacgcctacggaaagcgactgacccgatgtcccagcctttgctccgcgccctgtttgccccttccagtcgttcgtacgttcccgccgtccttctcagcctggccctcggcatccaggcggcgcacgccgaaaacagcggcgggaacgccttcgtcccggccggcaaccagcaggaggcgcactggacgatcaacctcaaggatgccgacatccgcgaattcatcgaccagatttccgaaatcaccggcgagaccttcgtcgtcgacccgcgggtcaagggccaggtcagcgtggtctccaaggcccagctctcgttgagcgaggtctaccagttgttcctctcggtgatgagcacccacggcttcaccgtggttgcccagggcgaccaggcgcgcatcgtgcccaacgccgaggccaagaccgaggccggcggcggccagagcgcgccggatcgcctggagacgcgggtgatccaggtgcagcagagcccggtatcggaactcatcccgctgatccgtccgctggtcccacaatatggccacctcgccgcggtgccctcggccaacgcgctgatcatcagcgaccgcagcgccaatatcgcgcgaatcgaagacgtgatccgccagctcgaccagaagggcagccacgactacagcgtgatcaacctgcgctacggctgggtgatggacgccgccgaggtgctcaacaacgccatgagccgcggccaggccaagggcgcggcgggcgcccaggtgatcgccgacgcgcgcaccaaccgcctgatcatcctcggcccgccgcaggcgcgcgccaagctggtgcaactggcgcaatcgctggacaccccgaccgcgcgctcggccaacacccgggtgatccgcctgcgccacaacgacgccaagaccctcgcggaaaccctcggccagatttccgaaggcatgaagaacaatggcggccagggcggcgaacagaccggcggcggccgaccgagcaacatcctcatccgtgccgacgaaagcaccaacgccctggtcctgctggccgacccggacacggtcaacgctctcgaagacatcgttcgccagctcgacgtgccgcgtgcccaggtattggtggaagcggccatcgtcgagatctccggcgacatccaggatgccgtcggcgtgcaatgggcgatcaacaagggcggcatgggcggaaccaagaccaacttcgccaataccggactgtccatcggcaccctgctgcaatcgctcgagagcaacaaggcaccggaatccatccccgacggcgccatcgtcggcatcggcagcagcagcttcggcgcgctggtcaccgcgctctcggccaacaccaagagcaacctgctgtcgaccccgagcctgttgaccctggacaaccagaaagcggagattctggtcggccagaacgtaccgttccagaccggctcctacaccaccaacagcgaaggttcgagcaacccgttcaccaccgtggagcgcaaggatatcggcgtcagcctcaaggtcactccgcacatcaacgacggcgcggccctgcgcctggagatcgagcaggagatctcggccctgctgcccaacgcccagcagcgcaacaataccgacctgatcaccagcaagcgctcgatcaagagcaccatcctcgccgagaacggccaggtgatcgtgatcggcggcctgatccaggacgacgtttcccaagccgagtcgaaggttcccctgctcggggacatcccattgctcggtcgcctgttccgttccaccaaggacacccacaccaagcgcaacctgatggtcttcctgcgtcctacggtggtccgcgacagcgccggtctcgccgcgctctcgggcaagaaatacagcgacatccgggtcatcgacggcactcgcggcccggagggacgacccagcatcctgccgaccaacgccaaccagttgttcgatggacaggccgtcgatctgcgcgaactgaagacggaataa

SEQ ID NO: 12364 - DNA, 567 bp, Pseudomonas aeruginosa
ccctgggagcgcagggtcttctgcaattcctcggcgcgcgcccggttggacaggctggcaagctgtaccgaccagctctgcggcaggttgttggcgtccaggcgcttctccgcgggcggcgggctcggcggcgcagcgggcggttgcggctggcttggcggcaggctggcggccggcgcctgggcctgggcgggcggctgggtggccggcggggtcgccggcaggccgccgatcggctggctgggctggccggcggcggccggggagccttcctcgacgatctcgggagcgttgccttcttcgccgggctgcagttccggcacctcggtcggctgcacctcgacactgggcatggccggcgattgcgggcgcggcggcgcttccaccacgacctggcgcgactcgtcttcgcgggtgaacagcatcggcaggaagatcaccgccagggcgatcagcaccaacgccccgacgatgcgctgcttcagccctctttccagcaaggccatgattaactccccgttatccgttctacgggccagccattccaggccttcggccacgctatag

SEQ ID NO: 12365 - DNA, 444 bp, Pseudomonas aeruginosa
aggccgacagcagattggccaggcgcggccgcaactcggcacgatgcacgatcatgtcgatggcgccatgctcaaggaggaactcgctacgctggaagccttccggcagcttctcgcggacggtctgctcgatcacgcggggaccggcgaagccgatcagcgccttgggttcgccgacgatcacgtcgccgagcatcgccaggctggcggaaacgccgccgtagaccgggtcggtcaataccgagacgaacgggatgccttcttcgcgcaggcgcgccaggaccgccgaggtcttggccatctgcatcagcgagatcagcgcttcctgcatgcgcgcgccgccggaggcggagaagcagatcagcgggcagcgcttctccagggcgacgttggctgcgcgaacgaagcgctcgccgacgatggcgcccatcgaaccgcccatga

SEQ ID NO: 12366 - DNA, 447 bp, Pseudomonas aeruginosa
gagtcgcttcatttccggatcaggccaggcgctccagcaactcgcgggcttccgcctgctggctgtcgttaccttcggccaggacttcgtcgaggatatcgcgcgcgccttcgctatcgcccatgtcgatgtaggcacgagccagatccagcttggtcgccgcttcgtcggcaccggagaggaagtcgaagtcatcgtcggcgtctccgtccagggcggaggcgaccgctgcatcttcggcggagaaactcggcgtcgcgctcttcggctcgtcaaggttgctggccaactcgtccaactgcgcactcacctcgtccaactgggcggcgaaactgtcctcgcccttctccggagcggccggctccgtcggctcgtcggccagcgacaggtcgaagtcgtccggcagggacaacgccggctcttcggcagcctcggtatcgagggtga

SEQ ID NO: 12367 - DNA, 1026 bp, Pseudomonas aeruginosa
aacgcccgtaggcgatatagatgtcggcctcgcccagagcatcggaagtctgcgcggtggtcttctcgacctgcggcgcagcggctgcgacctgcggctcaggctcgtcgagggtcaggtcgtcgaagccgtcctttcccaggtccagcgcatcctcctgttcctcgccggcatccgcggcgaaagcctggacttcttccttctctttctgcgcattgcgccgcgacaggatcatcagcagcaccagcaacgccagcagtgcgctaccgccgatcaccgccaaccacagcgggttggccagcagttcgtcgaggaagctcggtgccggctgctctgccgcctgtaccggagcgggcgccggaacggcaggtgccggaggcttctcggcagctggcgcgggcggcggcgccaccggaggctgcgccggagcggcgggtgcttctccggctggagcaggagtcggcgctgccgcagcgggagtcccgggctgagccggcgcctgcgcggccgcattgggctgggacgcatccggcagggctgcgttcggctgggctgcgccctggccttcggcgcccaactgcccttgcagcttggccaactgggcgtccttcagctggatcaacttctgcagcttgtccaactggctctgcagatcctgcatgcggctctgcagttcttcgttctcgcggcgagtgctatcgaggctttccttggtcaccgccagggtatcggcgagcgccttgctgtcgcccttcccgcccttgtcggcacccttgctggccttgccctcgccagacaccaggcgcaggttgtccgtggcgtcgaccttggatggcgccgacccggcggcattgcgctgggtcgcatccaactgcctggcgccagcgctgcccgcggccggattgcggctgccgcgccagctctggttctgcgcctgcacctgggacagcgcctcgcgcggcgagcgctccagcatctgctgttcggtgggaatgcgcaggacctggccgctcttcagccggttga

SEQ ID NO: 12368 - DNA, 2364 bp, Pseudomonas aeruginosa
gcgtggcactttacttgcccaccttcgcccaggcaatcgaggcgccacccattgcgggcggcgccggatcgatcagcgctccagcaggatgcgcagcatgcgccgcagcggctcggcagcgccccacagcaactggtcgccaacggtgaaggcgccgagatactgggagcccatgttcagcttgcgcaggcgcccgaccggaacgctcagggtgccggtgacggcggccggggtcagctcgcgcacgcttacctcgcggtggttcggcaccagcttgacccagggattgtgctggctgatcaggccctcgatgtcggtcagcggcacatccttgttcaacttgatggtcagcgcctggctgtggcaacgcatggcgccgacgcgcacgcagataccgtcgaccgggatcgggttcttgaagcgggcgaggatcttgttggtctccgcctgggctttccactcctcgcggctctgcccgttgggcagttccttgtcgatccaggggatcaggctgccgcccagcggcgcgccgaaatgctcggtggggaaggcttcgctgcgcagggtctccgccaccttgcggtcgatgtcgaggatcgcgctggccgggttggccaggtcatccgccaccgatgcatgggcggcgcccatctgcttgagcagttcacgcatgttctgcgcgccggcgccggaggcggcctggtaggtcatggcactcatccactcgaccaggccggcgtcgaacagcccgcccagggccatcagcatcaggctgacggtgcagttgccgccgatgtagttgcgggtgccggcgtccagagcctggtcgatgaccttgcggttgaccgggtcgaggacgatcaccgcgtcgtcttccatgcgcagactggaggcggcatcgatccagtagccctgccagccggcctcgcgcagcttggggaatacttcgctggtgtagtcgccgccctggcaggtcaggatcacgtcgagggtcttcagctcgtcgatgctgtaggcgtccttcagcggagcgatgtccttgcccacttccgggccctggccaccgacgttcgacgtggtgaagaacaccggctcgatcaggtcgaagtcccgctcttccagcatccgctgcatgagtacggaacccaccatcccgcgccaaccgatcagacctacacgcttcatcgcaactacacctatatgagagaagtgagctggccggcagccatcatggcgccggccaagcccgtcagattacagattcttgagtgccgcgactacggcatcgcccatttcccgggtgccgaccttgcggcagccttcggaccagatgtcgccggtgcgcagcccttggtcgaggaccttgctcaccgcctgctcgatggcgtcggcggcggtcgcctggctgaagctgtagcgcaacatcatcgagaccgagaggatggtcgccaacgggttggcgatgccctgaccggcgatgtccggggcggaaccgtggcagggttcgtacatgcccttgttgttcgcgtcgagcgaggcagaaggcagcatgccgatggaaccggtcagcatggaagcctcatccgacaggatgtcgccgaacatgttgtcggtgaccatcacgtcgaactgcttgggcgcgcgcaccagttgcatggcggcgttatccacgtacatatgggaaagctcgacgtccgggtagtccttcgccacctcttccaccacttcccgccacagttggctggaggcgaggacgttggccttgtccaccgagcagagcctgttgttgcgtacgcgggccatgtcgaaaccgacgcgggcgatacgacggatttcgctctcgctgtacggcagggtgtcgtaggcttggcgctcgccgttctccagcacgcgctgctcgcggggctggccgaagtagatgccgccggtcagttcgcggacgatgaggatgtccagcccggcgaccacttccggcttcaggctggaggccgcggccagttgcggatagaggatggccggacgcaggttggcgaacaggcccagttgcgagcgaatcttcagcagaccgcgctcgggacggatatcgcgttcgatcctgtcccacttcggcccccctaccgcgcccagcagcaccgcatcggcctggcgcgcgcgctgcagggtctggtcggccagcggcacgccgtgcttgtcgatggccgcgccaccgatgacgtcctcggccagttcgaagccgagctggaacctgtcgttggccagttccagcaccttgaccgcttccgccatgatttccgggccgataccgtcaccggggagaaccaggatctgcttgctcataacaccctcttgtccttcattcattga

SEQ ID NO: 12369 - DNA, 819 bp, Pseudomonas aeruginosa
acctactccgggagaaaaaccgggcgcaccctacccaggatgcgcccggcaaggggactcgcgtggcgctcagcggaacagccagggctgctgctggcggtagccgtcctcgaaggcacggatcgcatcggcgtcctgcagcgtcaggccgatgtcgtcgaggccgttgagcaggcaatgcttgcggaacgggtcgacctcgaaacccagcaccttgccatcaggacgggtaacggtctgcgccgccaggtcgatggacaactggtagccttcgttcgcctcgacctggcggaacagttcgtccacctcggcctcgggcaggatgatcggcagcaagccgttcttgaaactgttgttgaagaagatgtcggcatagctcggtgcgatcaccgtgcggaaaccgtactcgtccagcgcccagggcgcgtgctcgcgggacgagccgcagccgaagttctcccgcgccagcagtacgctggcgccctggtagcgcggctggttgaggacgaagtccgggttcagcggacgcttcgagttgtcctgtcccggctgcccgacatccaggtagcgccattcgtcgaacaggttggggccgaagccggtgcgcttgatcgacttgaggaattgcttgggaatgatctgatcggtatcgacgttggcgcgatccagcggagcgacgagaccggtcgtctgggtatagggtttcatctcggttctcctcaggcgagcaattcgcggacatcgatgaagcggccgttgacggccgcggcggcggccatcgccgggctgaccaggtgggtacggccaccggcgccctga

SEQ ID NO: 12370 - DNA, 585 bp, Pseudomonas aeruginosa
cggccctcgaagttgcggttggaggtcgaggcgcagtgttcgccgctctccagccggtccgggttcatcgccaggcacatggaacagcccggctcgcgccattcgaagccggcctcgatgaagatccggtccaggccttccttctcggcctgctccttgaccaacccggaacccggcaccaccagcgcctgcttgatggtcgcggcgaccttgcggcccctggccacttcggcggcagcgcgcaggtcctcgatccgcgagttggtgcaggaaccgatgaatacccggtccagctggatgtcggtgatcgcctggttcggccgcaggcccatgtatttcaaggcgcgctcgatcgaaccgcgcttgatcgggtcgctctcgcgggccgggtccggcacgttctggtccacggccaggaccatttccggcgacgtgccccagctgacctgcggcttgatctgcgcggcgtccagctcgaccacggtatcgaagcgggcatcggcgtccgacaccagcccctgccagcaggcgacggcctggtcccattgctcggcgctcggcgcgaagggccggcccttcacgtag

SEQ ID NO: 12371 - DNA, 663 bp, Pseudomonas aeruginosa
tcgatggtcttctggtcgacggcgaccaggccgacgcgggcgcccgcctcgatcgacatgttgcagatggtcatccgcccttcgatggacaggtcgcggatggcgctgccggcgaactcgatggcgtggccgttgccgccggcggtgccgatcctgccgatcaccgcgaggacgatatccttcgccgtgacgccggccggcaacctgccttcgaccttgaccagcatgttcttcatcttcttcgccaccaggcactgggtcgccagcacatgctctacctcggaagtgccgatgccgtgggccagcgcgccgaaggcgccgtgggtggaagtgtgcgagtcgccgcagaccacggtcatccccgggagggtcgcgccctgctccggaccgaccacatggacgatgccctggcgcacgtcgttcatcttgaattcggtgatgccgaagtcgtcgcagttctcgtcgagggtctgcacctgcaggcgcgagacctcgtcggcgatggcggcgatgccgcccttgcgctcggtgcgggtggtcggcacgttgtggtccggggtggcgatgttggcgtcgatccgccacggcttgcgcccggccaggcgaagaccctcgaaggcctgcggcgaggtcacttcgtgcaggatatggcggtcgatgtag

SEQ ID NO: 12372 - DNA, 189 bp, Pseudomonas aeruginosa
acaacctcaccggcgaggtcagcggccggctggtcctggccaccagccaccacatcggcctgcatcgcctgccgccgctgctgcgcgccttcacccgggcgcatccgcaggtggcgctggatatccagttcctggattcggaagtggcctacgaggagatccttcatggtcgtgcggaactggcggtga

SEQ ID NO: 12373 - DNA, 522 bp, Pseudomonas aeruginosa
cggttactggttgtccagtgccgggcgctggccattgatggcgatacgcttcggcttggcttcttccggaaccagccgcaccaggtcgatgttcagcaggccgttggccagcgaagccgccttgacctcgatatgatcggcgaggcggaacgacagcttgaaggcgcgctgggcgatgccctggtgcaggtaggtcacgttgtccgtggacttctcgcgcttgccgccactgacggtcagcacgccgcgctcgacctgcaggtccaggtcttcttcctggaagccggcggcggcgatgacgatgcgatactcgtcgtcaccgtgcttttcgacgttgtagggcgggtaggtactcccggcctcattgcgcagggccgactcgaacagatcgttgaagcgatcgaagcctacggaatgacggaacagcggggcgagggaaaaagcgttgctcattgcgaatctcctgaattatcagcaagtactctggtgcggaacccgtcttcggcatcccgcacgaactag

SEQ ID NO: 12374 - DNA, 780 bp, Pseudomonas aeruginosa
ccttcactcgctactgacctggggagcatcatcatgcgcaacgtcatgctgatcaccggagccagccgcggcatcggcgccgccaccgctctgctcgccgccgagcgcggctatgcggtcgtcctcaactatctgcgcaaccgcgaggccgccgaagcgctgcgccagcgcatcgagcgccagggcggcgaagccctggcggtggcggccgacgtagccgaggaaggcgatgtcgagcggctgttcgccgccatcgacgaacgtttcggccgcctcgacgtgctggtcaacaacgccggcgtgctggaagcgcagacgcgcctggaaaacatcgacgcggcgcgcctgcacagggtattcgcgaccaacgtgaccggcagcttcctctgcgcccgcgaggcggtgaagcgcctgtcgacccgccacggcgggcgcggcggcagcatcgtcaacgtatcctcgatggcctcgcggctgggatcgcccaacgaatacatcgactatgccgccgccaagggcgccatcgacagcatgaccatcgggctggccagggaagtggcggcggagggtatccgggtcaacgcggtgcggcccggactgatcgataccgagatccacgccagcggcggcgagcccggccgtatcgaacgcctgaagggcggcataccgctaggacgcggcggtacggcggaggaagtcgcgcgggcgattctctggctggcgtcggacgaagccagcgacagcaccggcggcttcatcgatgtcagcggcggccgctag

SEQ ID NO: 12375 - DNA, 561 bp, Pseudomonas aeruginosa
cccaggcgcatcttcgaggtcaccgcaatctcgctcggcaccgcgcgacgcacggcggcgacgatgtcgtgcatcagctccggctccttgagcaataccgcgccgccgcgcgagcggttcacggtcttggccggacaaccgaagttcaggtcgatcaccggggcacccagctcacaggcgaacgcggcgttatccgccaggcacgcaggatcggagccgagcaactgcacacgcatcggcgtcccggcgcgggtccggctgccgtcgcgcagctccggcgccagcttgtggaaagccgtggccggcagcaggcgatcggtgatgcggatgaattcggtgacgcaccaatcgatgccgccgacgcgggtcagcacgtcgcggaggatttcatccaccagaccttccatcggcgccagggcgatttgcacgaaccactacctcgaaaatgacaggcggcggattctatataatccgccgcccggaacaaagtgcgaatgcctgccggccgacgcgcgacgggtcaggccccggcgagcagagcctggccatagccgtcgatga

SEQ ID NO: 12376 - DNA, 1095 bp, Pseudomonas aeruginosa
ggtcgatcacgaacggatcggcgtagtcccaattcatcaatgctgctccaggctgccggccagttcgcgcgcttccctggccagttgtgtgatctgatcccaggcccgcgcccggatcaggctcggcggcgccagccaggtgccgccgacacaggcgacattgggcaggcggaggaaattcagcaggttgtccaggttgaccccgccggtcgggcagaagcggatgccggtgaacggccccttcaggcttttcagcattttcacgctggcagtgccatcggccgggaacagcttcagcgagcgataaccgtactccagcgccagcaacacttccgaaggcgtcatcaccccgggcaggtatggcaggccggcatcctccgcggcggcggcaaggcgcggcgtgcatccggggctgacggcgaactgcgcgcccgcgtcgcgtgcctcgagaaactgctcggtgtggatcagggtacccgcccccagcaggacctcgggcacctcgcgatggatggcggcgatcgcgtccagcgcctgcggcgtgcgcagcgtcacttccaacaccgtgacgccgcccgcatacaacgcgcgcgccaggtcgggcgccagcgccacgtcctcgatcaccagcaccggcaataccgggctggcctgcagcaggacccgatccagcggcaatgtcatgggcattcctcgattcgaaacggctcgccccgccggatcgctccgcgcgggccacagcgctttttaccgaagaaccgaggtcaggacaacgacaacccctctgctacgcgcctcaggaagcgctcgccgtcttttccacgcgccggcaagcgcgcatcgccgggcgctcctcgagcagcgccagcagcgactcgctcagcctgcgctcgccgagcagtcggtggtggccgccgcccggcaggcgcagcaagcgactggccggccaggcggcatggatgcgctcggcattttccaccgctacgcgcgtgtcgtcgtcggcatgcaccaccagtccgggcatttccagacggtagcgcgccacatccaggcacgccgcggatatgcccgcctgccgctcgaccaggcggatga

SEQ ID NO: 12377 - DNA, 405 bp, Pseudomonas aeruginosa
aatgcgagcgagccagggccggcaaaccgacgaaacgagcgaacaggcgcaactgttcgagaatccgcgacggcgccgagaccgtcaccagcgcttcgctgcgcagccccatctgggctgccagcaacgccgccgcgccacccagggaatgaccgaccaccgcacgcagcggcggcaactcgccagcggcctccagcaaggcgtgggcgaacagcaccacgttcgcctccctgcccggcgagcggccatgggccggcgcatcgagggcatacaccgaataacccgcgccgaccagttgctcgatcagatgggcgaactgtgtcggcctgccggcccagccatgcagcagcaggactgccggcccctctccccagcgcaacaccgacagcccgaagcgcagagtga

SEQ ID NO: 12378 - DNA, 1638 bp, Pseudomonas aeruginosa
agatcgtgttcgaggccgacaacccgctgcatggccgcatccgccccggcatgtccgtcgaagccgaggtcgagctccgtgaccgctgaggcgctggcccggccgcttggcgaaccgacccggcgcgactggatcgcggtgctcagcgccatgctcggcgcattcatggcggtgctcgacatccagatcaccaactcctcgctgaaggacatccagggcgcgctggcggcaaccctcgaggaaggctcgtggatctccacctcctacctggtggcggagatcatcatgatcccgatgaccgcctggctggtgcaactgctctcggcacgccgcctggcggtgatgatctcggtgggcttcctggtgtcctcgctgctctgctcgttcgcctggaacctggaaagcatgatcgtgttccgcgccatgcagggtttcaccggcggcgcgctgattccgctggcgttcaccctggccctggtcaagttgccggaacaccaccgtccgaagggcatggcgctgttcgccatcaccgccaccttcgcgccctccatcggaccgaccctgggaggctggctgacggaaaacttcggctgggaatacatcttctatatcaacgtgccgccgggcctgttgatgatcgccgggctgctctacggcctggagaaaaaggcgccgcattgggaactgctgaagagtaccgactacgccggcattgtcaccctcggcatcggcctgggctgcctgcaggttttcctcgaggaaggtcaccgcaaggactggctggagtcgcaactgatcgtcagcctcggcagcgtcgccctgttcagcctggtcctgttcgtcatcctgcaactgtcgcggccgaacccgctgatcgacctgggcatcctgcgcaaccgcaacttcggcctcgcgagcatttccagcatcggtctgggcatgggcctgtacggctcgatctacgtactgccgctgtacctggcacaaatccagggctacaacgccatgcagatcggcgaggtgatcatgtggatgggcattccccagctgttcctgatcccgctggtcccgaagttgatgaagctggtctcgccgcgcctgctctgcgccgccggcttcggcctgttcggccttgccagcttcttctccggggtgctcaacccggacttcgccggaccgcagttcaaccagatccagctactgcgcgccctcggccagccgatgatcatggtgaccatttcgctgatcgccaccgcctacctgcagccacaggatgccggctcggcctcgagcctgttcaacatcctgcgcaacctcggcggcgccatcggcatcgccctgctcgcgaccctgctcgacagtcgcgccaaggtgtacttcgactatctgcgcgaagccctggtgccgaccaacccgcaggtcgacgaacgcctcgcgcaactcgccgcgcaactgggcagccagcaggcggcgctgggcaaactcagcgagatcacccaccagcaggcgatgatcatggcctacaacgatgctttccatgtcatcggcatggtgctcgcagtgagcatgctcgcggtgctgctgacccgctcgctgccggccggcatcggcacccgcgccgacgccggggctcactga

SEQ ID NO: 12379 - DNA, 2040 bp, Pseudomonas aeruginosa
ggatcagacgttgaccaggcgctcgcgcagcgtctggatctcgtcgcgcagttgcgccgccgcctcgaactccaggtcgcgggccaactggtacatcttttcctccagttggcggatgcgcttgctgatctcgctcggcgagcgcagttcgttctcgtagcgcccgctctcctccgccaccttggccacgcccttgcgcttgccgcgcgcgccgggcaccacggcgccttcgagaatgtccttgatgtccttgcgcacccccttgggcacgatgccatgggcttcgttgaaggcgatctgcttggcccgacgccgctcggtctcgtcgatcgcacgctgcatcgagccggtgacgttgtcggcgtagaggatcgccttgccgtgcaggttgcgcgcggcacgaccgatggtctggatcagcgagcgctccgagcgcaggaagccttccttgtccgcgtcgaggatcgccaccagcgacacctcgggcatgtccaggccttcgcgcagcaggttgatccccaccagcacgtcgaacgcaccggcgcgcaggtcgcggatgatctccactcgctcgacggtatcgatgtccgagtgcaagtagcgcacccgcacgtcgtgatcgccgagataatcggtgaggtcctcggccatgcgcttggtcagggtagtcaccagcacccgctcgtccttggccacacgctggcggatctgcgagagcaggtcgtccacctgggtcatcgccggacgtacctcgatctccggatcgaccagcccggtgggacgcaccacctgctcgatgacccgcccggcatgctccgcctcgtaggggcccggggtggcggagacgaagatggtctgcggactcaccgcctcccactcttcgaagcgcagcggccggttgtccagcgccgaaggcaggcggaaaccgtattccaccagggtctccttgcgcgagcggtcgcccttgaacatcgcgccgacctgcggaacgctgacgtgcgattcgtcgataaccagcagcgagttggccggcaggtagtcgtagagcgtcggcggcggctcgccgggggcccgcccggaaagatagcgcgagtagttctcgatgccgttgcagtagcccagctcgaggatcatctccaggtcgaaacgggtgcgctgctccaggcgctgcgcttccaccagcttgttgttgttgcgcaggtagtccaggcgttccttgagttcggccttgatctggtcgaccgcctccagcagcgtctcgcgcggggtcacgtagtggctcttggggtagaaggtgaagcgcggcagcttgcggatcacctcgccggtgagcggatcgaaggccgagaggctttccacctcgtcgtcgaacaactcgacacgaatcgcctcgagatcggattcggccgggaagatgtcgatcacatcgccacgcacacggaaagtcgcacgggcgaaatccatgtcgttgcgggtgtactgcaggctggtcagtcgccgcagcagttcgcgctggtcgatgcggtcgccgcggtccaggtgcaggaccatcttcaggtaggacgcgggatcaccgaggccgtagatggacgacacggtggcgacgatgatcgcatccggacgctcgagcagcgccttggtcgccgacaggcgcatctgctcgatatggtcgttgatcgaggagtccttctcgatataggtatcggaagacgggacgtaggcctccggctggtagtagtcgtagtaggaaacgaagtactccacggaattgtgcgggaagaacgtcttgaactccccgtagagctgggccgccagggtcttgttcggcgccaggaccagggtcgggcgctgcacctgggcaatcacgttggcgatgctgaaagtcttgccagagcccgtcacccccagcagggtctggtgcgaaagccccgcctccagcccctcgaccatctgccggatggcttccggttggtcgccggcgggcttgaagcgcgagtcgagttggaacgtatccatgaaaaacctcgcagggagctgtga

SEQ ID NO: 12380 - DNA, 423 bp, Pseudomonas aeruginosa
atcggcccgcgtgctgtcccaggtgaagcgagtgatccgcaccaactattcgaacccaccgacccacggcgccagcgtcgtctcctccgtgctcaacagcccggaactgcgggccctctgggagcaggaactgggcgagatgcgcgaccgcatccgcgacatgcgcctggcgatggtcgagcaactggcagcccacggcgccaagcgcgacttcagcttcgtcggtcgccaacgtggcatgttctcctattccggcctgaccgccgaccaggtcgagcgcctgaagaccgagttcggtatctacgccgtcagcaccggccgtatctgcgtcgccgcgctgaacaaatcgaacctggagaccatcaccaaggccatcgtccaggtcctgtagggaaaatggggaagtcatcgggagaggcttga

SEQ ID NO: 12381 - DNA, 1914 bp, Pseudomonas aeruginosa
agggcttcatgcccatccacgaaaccaccttatcgccgtggaacgcacctggatcgacagccccagcaaagcagtcgcttcctggtccggcaccggaaacatcgtacggagaaaacaaaaaaggccgctaggcggccttttccggagaacgatgactcagggttctcgccgcctctggcgatagatccagtcgacgatttcaccgtcaggcgcatagccgctgacggtttcccgcagcaactggcgaacccgcgagtagtcgtccttctccacggcggccagcaactgctccagcacgaccttgaaggcctcccagctcaggtgttcctcgttggcccgcatgatcatcggatggtcggtgggattcacgttgtcaccgatcagcagctcttcgtagagcttctcgccaggacgcaggccactgaactcgatggcgatgtcaccatggggcgaacgctcggaacgcacgctcaggccggacaggtggatcatcttctcggcgagctccaggatcttcaccggcggccccatgtccagcacgaatacatctccgccctgccccatcgaaccggcctggatgaccaactgcgccgcctcgggaatggtcatgaagtaacgggtgatgctcgggtgggtgaccgtcaccgggccgccgcgcttgatctgctcgcggaacagcggaatgaccgagccggacgaaccgaggacgttgccgaagcggaccatggtgaaacgggtcttgttgacgtgatgcacgtccttccgatcgccgaacagcaccggcgccgattcgttgctgagcgcctgaaggaccatctccgccaggcgcttggtgctgcccatcacattggtcggccgcaccgccttgtcggtggaaatcagcacgaagttctgcacgccgacctgcaccgcggcctgcaccgcatgcaaggtgcctatcacgttgttgagaacgccttcggcgatgttgtgctcgacgatcggcacatgcttgtaggccgccgcatggtagacggtattgaccttccaggtacgcatcacgtccaccaggcgctcgggattgcgcaccgaaccgaggatcggcaacaggttcaccgaaagcgactcgcgcttgatccgacgctccagttcctgatggatgctatagaggttgtattcgctgtgctcgaacaggatcagcacgctaggcgaacaactcatgatctgccgacagagttccgaaccgatagagccgcccgccccggtcaccatcaccacctgaccgcggatgcaccgttccagcagctccttgcgcggtgcgacgctgtcgcgccccagcaggtcagcgatgtccacctcctgcaggtcgtccaccttgacccggccgctggccaggtccatgaagccgggcatgctgcgcacgtgcagcgggaacggctccagggactcgagaatctctcggcgccgggcccgagtggcggaaggaatcgccaggagaacctcctgcgcgcccgtctcgtcgatcatctggcggatatgcttggcggtatagacccgcagaccggcaatgacccggttggcgatctgcttgtcgtcatcgatgaacgccaccggacgcatcgcccgaccgagacgcaacgccgcaaccaactggttgccggccgcccccgcgccatagatagccaccctgggcaggccatcctggcgattgagaaatggtaccgactgcacagcagagtaccagtcgcccatgaaatactggcgcatggccagacgcaagccgccgatcagcagcatgctcaaccaccagtagttgaacaccagggaacgcggcaccggcgccggcggggagcggtaccaatagaccagcaacgacaggaccagcgcggaaatggtgacggccttggcgatcgcgataagggcgtcgttgcctag

SEQ ID NO: 12382 - DNA, 183 bp, Pseudomonas aeruginosa
aaacggtcgcatgtaaggtttactcagcagttgcttcggcacatcctcatgggagtcgaagataacctgcttaccttgctttttcagtcgaagaccaacaggtatcagttcgggatcatgaaaatgatagacatcagccccaagcgccaaagcctgttcataaatttttcgggtggtttttag

SEQ ID NO: 12383 - DNA, 240 bp, Pseudomonas aeruginosa
gctagcacagccagaactgcaacagcccgcagcccctggacatccagccgaatgtttctgcctgaacttaccgcgaccataccgttcagcaatttagagctactagatgacatgctgatgaatgatcctgcggaaacctgctgtaaacaggtgaccgaggacggccacctccttttctacctcaacgcgcaagcgccgcgacgaacggatgcccttcgttatcagaggccggtacgatga

SEQ ID NO: 12384 - DNA, 453 bp, Pseudomonas aeruginosa
tcggtgaggttcttgacgatacccttgacctgctggccttcctgcagcgattccagcagagcttcacgctcggcgctgttctcggcttccaggacgctgcggcgggaaacgacaacgttgttgcgcttctggtcgagcttgatgaccttgaactcgagctctttgccttccaggtgggtggtgtcgcgaaccggacgaacgtcgaccagcgaacccggcaggaacgcgcggatgccgttgacgtcgacggtgaaaccgcccttgaccttgccgttgatgacgcccttgaccacttcgtcggcagcgaaagccgcttccagaacaatccagctctcggcgcgcttggctttctcgcgggacagcttggtctcgccaaagccgttttttaccgcgtccagtgcgacgtggacttcgtcacccaccttgatggtcagctcgccctgttcgttgtag

SEQ ID NO: 12385 - DNA, 306 bp, Pseudomonas aeruginosa
gtggcggctgggaactcattggcgaaggcgttgaagacagtcaggaaggcgcgtggcttgagccaggaagccttctctgacgtgtccagccgcacctatatgagcaccctcgaacgcgacctgaaaagcccgaccctgcataagctggccgagctgtgcgaggtgatggagatccacccgctcacgctgctgacgctggcctacgcgggcgacagcacgcacaaggccgacgagctgctggcgcaggtgcgccgggagctggaggcggtgctgaaggagcgcggcgcggcgaagccgcgcgcgtga

SEQ ID NO: 12386 - DNA, 237 bp, Pseudomonas aeruginosa
cgtgatgggcaggaaccgccagcgttgaggacgggcacgcacctgcacaacctgccgcagcgagcgccagcgtgttcgccagcgcccgcccatcgcggcggggcgctggccgggccgatccggcgcagccggttcggcggcatcgaggggcgccaagcatcgcgcggcggggatagcccgcagggctttcccctggaggcaagcgaagcgcgcagcgccgcaggcgcgaaggcgtga

SEQ ID NO: 12387 - DNA, 1647 bp, Pseudomonas aeruginosa
agtgcgtccagctcaattctcgtatcagtgatacgagaatctgctcgtcggggaaggtggccgcgaactgcaccatgcggcgcaggttctgctcggcaaagctgccgccgtactccttcaccaactgcgccgccagggtgggcaggacttccttgccataagcgccccggcgcccgtccaagacctgcgtgcggatgcgctggccgatgcgccaatagagcatcgtcagctcgctattcaccgtcgaggcggcgcgcttgcgcgccgcctcgatcagtgcccgaatgtcgcccagcagcgccgaaggcgctgtggacgatgctgcggatgaccggcgcgtgttcatgccgccgcctccgcaagctggcgtgcgcccgtgatggcctggcgccggctggccaccagttcggccgcatcgcgcaccggcttgtcctcggtgtggacgtagtgcatgaacatcgctacggtcttgtggcccgtcagcttcatgcccactttggtcggcacgcccgaattggcaatgtcggtcgtcgagcgatggcggatgccgtgcgtgccgacgtgcgggacgccggcggccttgagcacccggcaccagccgccatagtgctcgccaaaggtcaggtgcttggccgggtcgttcggcgatggcaggacgtaggggcagccctcccggcgcggcgccgtcgaaagcagccgataggcttcctcgctcatgggcttggaaatgccgccgaccttgctgtcgggccacaccacgcgccggttctcgaagtccagccagctccattcgagcgggcagatttcggagcgccgggcggcgaactcgaattgcagccggatcgccagcgggatgacgtagttctccagcccctccgcctccagcttctccaactggcggaagatccgcaccatttcctcgtccacgatgagccgggtttccttgcccggcgggtacatggggacgtggcggcacgggttcgtgccgtccgggcggtagccccacacttcggccaggttgaacatcttgcgcagcacgccgaaggtcttgttcgcctcggtcggcttgtaggccagtttctccatcagcccggcaatgtcgggccgcttcacgtcatgcaccttcttgcggcccagcagcgggatgatgttgcggtctatgacgccctgatagccgtcctgcgtgctgggcttgttgcgcttcttggagtagtcctccatgaacttcttgcacaactcggccatcgtgggcgccttgcgcgcctcggccttggcgccgccggggtcgccgccccggcgaacctcggccagccagtcctgtgccttgactcgtgcctgttcgacggtcagctccccgtacagccccagcgagggcttgcggggctggccggagttcgtgcggtactggagcatgaacacccggcggccggtcggggtaatcttgcacaggaagccgggcaccacggtatcccgcagttcaacatccttggcctggggttgggccgactccacggcggtcttggtgagcttgatctttgccatgatgactcctcggaacaacccggattccaggagccagataggagcggcgcgagggaaaaccgggtcaagtttcagaaagcaccggcatatgatggacgcgcgtaa

SEQ ID NO: 12388 - DNA, 1659 bp, Pseudomonas aeruginosa
gaatcgcgggaaaggatcttccgcagttcgaagccgatgccggccatgtcatgcaatctccgtggcttcgcggtacagcccgcggtaacgtccgagcatcagcgcctcggtgtagtagcgttcgacccgttgcaggccgaccgcctgggccgcctgccagcgctgcggattgcgcagcagggcgaggatcgcccgcgaagtggcctgcgggtcggcgatcgccaccacctccccggcgcgacccagggcgcgatcttcggcgtcggcgccttcgatcagttcgcggcaggagccgacgtcgctgctcaccaccggggcgccggcagcccaggcttcgaggatcaccagcggctgcgcttcgctgatcgaggtgaggaccatcaggccgagttgcggcaggacctcgccgatccgacggaaaccgaggaacttcaccttgtcctgcaggccgaggctggccaccaggctgcggcattcgctggcatagtccggatcttcctcctccggaccgacgatccagccctccgcctccggcatcgcgctgaccaccccgcgcatggcgcggatgaaggtcttcacgtccttgatcggcactacccggccgaccagcccgaccaccggcggaatccccggcggccgccgttcgagggcgccggcccaggcatcgaggtcgatgccgttggggatcacccgggtgcgccgtggctcggcgccatcgagtacctggcgctggcggttgccttcgtagagggcgacgatcggattggccgcgcgataggtgagcaggccgacacgctcgaagaagcggatccacaagcgacggatgtagctgacctcggcatccagtccggtactcagctgctcgtcggggttctccgcgatccagttggcctgggccaggtcgattttgcgctccttggtgtagatgccgtgctcgctgagcaggtagcggcagccccagcgacgttgcaggatgcagcccagcaggccggcgtagccggtggagatcgagtgcagcatgcgcgcccgcggcatccgccgggccgcctcggcgagcatgaacaccggcgcctgcatcgagcgcagggtccagaagtaattgacgaaggacggatcggtgcaatagcgctcgtagcctgcggtgatcgcctcccaactggccttgctgtggagaaagtcctcgcggccgatgcggccctcggcgagcaggtcgagcagcgcgtcgccctcctccacgtccggcgtctccgggtagtggaagaaacggtgcagatcgcgcaacgccttttcggtctcgctactgccctgtcgcgtctgcgggttcggcgaactccaggcggtttacaggaagtgttcctcgatgtgcagcacattgtccgggatcgggtagtggcgcttgccgtaggcatccttctggccgccgatgaagaacaccgagaaggtcaggtcggggagaccgaggatcaactggttgacccagctggagacgccgccgcggacatagggccaggtgccctccagcagcaggcagacatcggcgacgggcgccgtcggagcggtgtgttcggtcatgtccagtatctcgccagggccgcgaagggcggccgttgcagcatgtcgtcgggcattccggcgagaagccgggggatgtcccggtag

SEQ ID NO: 12389 - DNA, 1662 bp, Pseudomonas aeruginosa
agcgccagcgcctggccgaacggcaggtcggcgaagacgctcgcccaactgctcagctcgaacaggaaggcgccgctaaacagccacttgctgatcattcaggccgcactcgttgaaaaggaaatgtcccagcgcctgccgatcgttgccggcgtccagttcgtactggcggatgcgcacgcccagcgactccagctcgcgggcctggccgaagcgttcggcgaagagaatcctcaggcgctgcagatacccctgggagccttcggcggaagtcagcggcaacaacaccagcaggacccgccggccctcgtcgttgcgcagtcgcaactgcacgtcgaggccacgctggctgccttccagcagacgctggacctcttcgccgtagcgcgcatcggtcaactcgaaggcatacaggcaggccggcaacccatggtcgcgggcgtccagcagggagcgcttgaggtactgggagaagcgctgggcgtcgatgtcggccagttgcagtgcgcgacggtcgctctgcagcaagtcggcgatgtgcccggcgaggatcgccagcaggctgaaggtacgttcgttgaagacgaagaatggcatctgctccaccgccagcagggcgaggatccgcccatcggtgtcgaccagcggcacgcacacctgcagcgcgctgtgcgcacgctgctcgccgcgctccagcagttcctggcgcacgctgaccagttcgccgcgctccaggcaggtgcgcaccagcagatcgtcggcgtccagcgccggcatctcgccgagcgtcgccaaggattgcggctccggggtgcggtcgtggcgcacccggtagagtccggcgatgcgcagcgaaccgtactgggccagcagcgccagcacggtttccgccagcgcatcgagcggtgcctcatcgcccggcagctcgcgcagcagttgtcgcagaccgagcagcgaactgcgcaggctctggtcgttgccggcgacccgctgttccaggcgatcgtgggagatgcgcaggatgtgatgggcgcgggtgaattcgtcgaggcgcaactggcggtactcgttcgccagctccaggcgctccaggcggcgttcccagatgtcgcggaactcgcccaccaacatggcgcagagcagcacgccgacgatgaaggccgccggtacctgggcataagcctcgacgccctggacgcgaaacgcgaacagcgccgccaccagcagcgccgcgctggccaacccgcggacgaagccgtagcgcatgcccagcaacaggggcgcgaggatcacccagggaaaggtggcgttgacctgcagcgggtcgtccgggctgaaccaccagcccaggcccagcgcgagcgcgctgatgaccagcgtctcgacccaggagacgctgccgctggcgcgcggtgcgagggcgaaatccttgtgcgcggacatcgccgtcactcgagccgcaggtcgccgaccagctcgcgcaggactttctgcgcggcgcccgccaggctttcccgggaccagccggcgcgcgccccgctggtgctccagagcacccgcccggaggccggctccagcacctgcaggctgacgcccaccgccggctcgccgtcgaggccgttcttgtactgccactcctcgacgctgccggtgaccacgtag

SEQ ID NO: 12390 - DNA, 2493 bp, Pseudomonas aeruginosa
ttcaccgagaccgcgtcgggctcgccatcgccgctgggcatgaatacctcttcgctgttgaaggtcagccacagcaccagcgccaccccgagagcgaccggcagcagggcccagggattcagcaggcgcgcctggggatgcttgtcagcggcagacgagttggccatcgcgcacctgctccatcggcaactcgaacgtccacaggccgttgccggcctttcccgggaaggccttgccggccgcgctcagccggcaatcgcccgccgcgcgcaccaccaggcgcaatggcaggtgcccggcgaaggcgaactcgacgcggccatcgtcgcggtagcgccagtgcttcagcggcaggttggcctcctccagcgccggccgcggatcgcggctgtcgcgcaggaccaggcgcgcattcgccgcactcaggtgtacatagcgcccctggggcaggtcgcgcacgcccgcgactcccgtggagcgagcgaggtccggccaacccagcgccgggtccaggcgcaccgtgcgcaaggcggcgaagccgcgcaactgccagctgccatcggcacgcttggccaggctggcgcgatgcaggccttccaggcgcgggatgtagtcgctcatccacagcgacaacggatgctccgcctgcatcgccgcgtagatctggtgcatggtgcggatcgaggcctgcttggtccccgaatagaagtggtagtacaggtgcaggccgcgcaggcggcgcgggctgtcggtcagggcgaaggtatcgatgacgccgcggaagccgtagtacggcccctgccagagattggtgtagacgttctcgttgatgatcggcgcgtagtactgcacgccgccgcgggtgggccggatcagcgggtagagtccggtcagcgagggaaaggcccgggtcagcgcggtattgccgccgttgacgttcatcagcccggcgtcgtaggcgagcttgatggtggcggcgtcgggcagcgcgtcgccggaccagaagatcatcttcaccggcttccgcggggtggtcaggcgctgctcgatgtagtcgcgggcgccgatcacctcgcgtacgaagtcgaccttgtcgtagcccgggatggccatcttgtagccatactgggcctcgaagttctcgccctgctcggccagttgcggctgccagaagaacggatggctgaaggtatggctggcgacctcgaccttgtcgtcggcgaagatgcgccgggcgatcggctccagctccctggccaggtgcgggtacatgcccttcggcccgacctcgccttcgatcaccgagaccgaggtgaggaacggatagggcttgatgaagtcctccagcacctgctggccggcatagggactgccgggcacctcggcacgggagacgaagccgtcgccatcgatgtgcacggtggcgatgcgccggccattctcggtggtcgcgtcgggactcggcagcggcgcaaggcgcaaggccttgcgcaggaaggcgaacggatcgaggatccagcgccggtgctcgctaccctcctccagcacatagggcgccagggcgaagccgccccagtcggcggtcgccaccggcacgtactccttgccgtcgcccttgagcttgagcgccggggccacccgcgccgggtcgagtacggtgagcgccggcaggtcgcggacccggatcaccagcggcgcttcgaaggcgcccagcagcgcctggtcgtgggtctcggtgctcggcttgaccttgagcttctgcgacagccggcgaatacccaggcgctgcaacaggccgtcgttctctgtgggcaggccggcgaggaacgccaccggcaccttttcgtcgagacgcgcagcgatccagttgtcgaaggcgtcgctggccagcggcggtccactggtcatccaggtgactacccccgcgtagataccgctcagcggacgttcgggcagcggctggtcggtgggcaggtagtcgacccgataaccgaggtattcgagcaggccgccgaggtagacgtggccggggctcagggtcaggtcgccctcgcgcggatcgtagagcagcgcgatgcgccgcggttgcacctcgacgtcgctcacccccaggtagtccagcgccggggtgctgacgaacggcacgtagccttcgctacgcaggcgcgcagcgagcgcgcgcgcctcgtcgcgccgctccggcggcaggtagtcgatggcgacgatgggcatgccctgggcgcgcagggcatccaggtgacccttcagccaatcgcgatcgtcctggggcacctcgcggtattgcccggcagcggcgtcccaaccggcatggatcgactccacggccaccgccgacgcgacgccgggcaactccggcagcacttcgaaaccgcgattgaaaaacagcttgaggcccggctcctggcgatgcagctgggcgaggaaactggccagcgcccggcgctggccctcgcggcgctcctcggcctgtag

SEQ ID NO: 12391 - DNA, 1308 bp, Pseudomonas aeruginosa
caaacgctctgtccattcgctgttcgcatcgcggaaaccgacccgcctgagccggcgaagttccccgggcgcgtcgatccgccgcgcttcgcgaggcaggtcacggcgagaggcggaggcttttcaccggcatacccgcgcgggttcacgaataggcgcggcacgagcgtcggagagtacgctaggcagtcgccgtgcgctaacatgtgcgggatcggggagcgtcatccgccgcagagcggagccttctccccgcccgcgcgcgccggcctcgccgtgcgccaccgagcgacaccccagcaggccttggaaccggtagtccagacaatgagcaacgagccagaaagcacgcagcacaagagcgccctgcagggactgaagggctacctgtcgagccagatcctcggccaggaaaaactcgtcgaccgcctgctgatcgcgctgctagccgacggccacctgctggtggaaggcgcgccgggactggccaagaccaaggccatcaaggacctcgccgaaggcctcgaagccgagttccaccgtatccagttcactcccgacctgctccccgccgacatcaccggcaccgaaatctaccgtccggagaccggcaccttcgtgttccagcaaggcccgatcttccatcacctggtgctggccgacgagatcaaccgcgccccggccaaggtgcagtcggcgctgctcgaagccatggccgagcgccaggtttcggtcggccgcagcacctacgacctgccacagctgttcctggtgatggcgacacagaacccgatcgagcaggaaggtacctacccgttgccggaagcccagctcgaccgcttcctcatgcacgtcaagatcggctacccggaggcctcggtggaacgccgcatactccagcaggcgcgtggcgaggcactgaacggcgaggcccggccggagcgccgggtgacccaggaaaccatcttcgccgcgcgccaggaaatcctcggcctgtacatggccgacgcggtggaggaatacctggtgcaactgatcatggccacccgcaccccggccaagcacgacgcggaactcgccgaatggatctcctacggcgccagcccgcgcggctccatcgccctcgaccgctgcgcgcgcgcccacgcctggctggccggacgcgacttcgtcagccccgaggacatccaggcggtgctgttcgacgtgctgcgccatcgcctgatcctgaccttcgaggcggaagccgccggcatcgaccaggaccgggtcgtgcagcgcatcctcgacgtggtcgccgtggcctga

SEQ ID NO: 12392 - DNA, 807 bp, Pseudomonas aeruginosa
cgtcgccgagcagcaactcagcctgatcgcacgccataccgacctggtgctgctgccgctgtccgacccgctcgaccatgcccttcccgccgccggactgctgcgcttccgcgaaggcgccgccgacctcgagctggacacccacgccgacgagctgcgccaggcctatcgcgaacaggccgaggcgcgccgcgcgcgctggcagcggctggcccagcgactgggcgtgccgctgctgccgctgtcgacccaggaagacctggtggagcagttgcgggacctgctggaacaacaccagccggggtatcgcgcatgaatccgctcgaccggctggaaccgctgatcgctcccctgcccgtcggctggtggccgccagcgcccggctggtggctgctggccgccctgctgccgttgctcggctgggggctctggcgactgcgccggcacctgccgcggcgcaccatcgccacccgcggcgaagcgccgctggatccgctgcgcgaagcggccctggccgaactggcggcgcttgccaagccctacggcagggcttccgccgggccctggctgcaagccatcaacggcctgctcaagcgggtctgcagggcgcgctggccagatagcggcagccacgccctcagcggccgcgcctggctggcgttcctcgacaaccgttgcccggccgccggcctgacccgctggatgatcctggtggaaggcggctaccgcgccgactgcaccctcgacgacaaggccgtggacggcctcgacgccgccgtcgccacctggattcgcaagcatgtttga

SEQ ID NO: 12393 - DNA, 2772 bp, Pseudomonas aeruginosa
gttcgcctggccctgggtcttcgccttcgccccgttgccctggctgctgcgcctggtgctgccggccgccgacagcggcgaggcggcgctcaaggtgagcttcctcgacgaactcgaaagcctcgccggacgccgtgcccgcgcacgcctgccggcctggcggcagcaggtgcgcttcgccctgctctggttcctcctgctgctcgccgcggcccgcccgcagtgggtcggcgaccccctgccgctacccgccagcggccgcgacctgctgctcgcggtggatgtctccggctccatggactaccgcgacatgcgctggcaggaagacgagatcagccgcctggaactgatcaagaaactcttcggcgacttcatcgaagaccgtcgtggcgaccgcgtcggcctgatcctgttcggcagccaggcctacctgcaggcgccgctgaccttcgaccggcacaccgtgcgggtctggctggacgaggcacagatcggcatcgccggcaagaacaccgcgatcggcgacgccatcggcctggcggtcaagcgcctgcgccagcggcctgcggaaagccgggtgctggtgctgatcaccgacggcgccaacaccggcggacagatagccccgcagatcgccgcgcaactggccgccgagcaacaggtgaagatctacaccatcggcatcggcgccgacccgcagcaaggcggcgtgcccggcctgttcggcttcaacccggggctcgatctcgacgagccgaccctgcgcggtatcgccgagagcactggcggcgaatacttccgcgcgcgatccagcgccgagctggaaagcatttccgcgaccctcgaccgcctcgaaccggtcgcccagcagactacccgggcgcgcccggccctggcgctgtacagttggccgctggccgccgccctcggcctgagtgtgctgctggtggcgctggaactctggccacgggaaaaccggacctggccgcgccgccgttccgggaggcaaccatgaacctgttgctggacgcctggccgcactggctgcgcccctactggctgctgctggcgccgctgcttggctggttgctgtggaagctgctgcatcgccagcgtcgtgccggacgctggcagttgctgttgccgacggccttccagccctggctgctggtcggcggcgccgggcggcagaaccgcatgccctggatctgcctcggcatcgcctggctgctggccctgctggccttgctcgggcccagttggcagcaactggaacagccctcgatgaagcgtagcgacccgctggtggcgatcctccagctgactcccgggatgcttgccggcgacctgtcgccgacccgcctggagcaggcccggcgcaagctgctcgacctgcttcgcacgcgcaacgacgcgcagaccgcgatcgtcgtctacgccggcagcgcgcataccctggtgccgctgtcggacgaccagctcaccgcgcgcaacctgctcgacgccctgaaaccttcgatcatgcccgagcccggccagcgcgccgacctcgccgtgcgccaggccctcgacctgctggaacagggcgcccagggccgcggccgcctgctgctgctgaccagcgagctgagcgaacccgagcgccagggcatccgcagcgccctcgagcaccgggcggcgcgcctcgccgtgctcggcgtcggcacgccgaagggcgctccggtgcagcaggaggatggcagcttcctcaaggacgaccagggcggcatcctcctgcccaggctcgacgaaagcgggctgcgccgcttcgccgcggagatcggcgccggctaccagcgcctgcggccgaacgaccgcgacctcgacagcctcggcctgctggcccgcggcggcacgctggaggaagatcgcgagaacgccctgctgcgcctgcagcgctgggccgaccagggttactggctgctcctgccgctgctcctgctggccgcctgtgccggacggcgcggctggctgttctgcctgccgctgttgatgctgagcctgccgcaaccggccatggccttccagttcgaagacctctggctgcgtccggaccagcaaggccagcgcctgttgcaacggggccaggcggacgaggcggcgaagcgcttcgaggacttccgctggaaaggcctgtcgctctaccaggcccgcgagtacgccgccgcggcccaggccttcgcccaaggcgaccaggccgacgatcactacaaccgtggcaacgccctggcccgccagggcgaactggaagccgccgtcgacgcctacgaacaagccctggagcgccagccgcaactggtcgccgcgcaacgcaacaaggccctggtcgaggaactgctgcgccaacgccaggaacaggcggcgcagcagcaggccggcgagaacaaggaacagcgccaggaagcgagccagcagagcccgccatccggaagcagccagcggccgccgcgcgacgcggcgaccgtcgatgcgcagaaggcccaggccgcggcgccctcgaccagcctgccggaagacgaaggcgagaagaccgccggagcacccggccaagcgcagccgcagcccaacgccgaggacgagcggacgggcgacgaggaagccgacgacggactcgacgacgaacgtcgccaggccctcgagcaatggctgcgacagattcccgacgatcccgccgaattgctgcggcgcaagttctggtaccaacagcagcaacgccaggaagccacgccatga

SEQ ID NO: 12394 - DNA, 1326 bp, Pseudomonas aeruginosa
  unsure (1012),(1238): Identity of nucleotide at the above locations are unknown.
gactggcacgatattccgattccgcaagagggcccgcatgcgcttccgtaccctgtacctcgtcctgtgcggcctgctcctgggccacgccgcgacggccgccgaaccgccgaccgcgcccacgccgccgacgcagccggccgaagggccgggcggcgcggactatcgccatgccagcgtgcatcagtggcacttcggcgaaggcgctcgcgaatactgggtgttcacccccgagcaaccggtccccggcaacgctccgctggtgatcttcctgcacggctggagcgtgatgcagccggacctctaccgcgcctggatcgaccatatcgtccgccgcggcatggtggtggtctacccgcgctaccagccggacctgaagacgcccaacgcagacttcctcgacaatgccgccggcgccctcggcgacgccctcaggcgcctgcaggccggcgagctgggggtgcgcccgcggctgaaccaggtcgcctacctcggccactccgccggcggactgctcgccgccaacctggcggccgccagcgaacgcctgaagctgccggcggcgaaggcgctgatggtggtcgagcccggcaagagccagggcaagcgctgggacggcgtgacccaggaacgcctgtcggggctggccaagggcaccctgctgctggcggtctgcggcgactaggacagccacgtggcctgcaccgacgccaagcgcatctaccgccagagccggcacattccgcccagcgacaagaacctgctgctgctgcgcagcgatcgccacggcgctccgccgctgctggccaaccacgcggcacccaccgcgccggtattcggcccgcagtatccgaaggaagaagacagcgactggttgctcgaccgcgtcgagaagcgcctcgaagtccagcaggccgaaggccgctataccggccacgacccgctggtgatcgacgccctcgactggtacggcacctggaagctgttcgatggcctcaccgacgcggcgttntacaaccgcaaccgccagtacgccctgggcgttacgccggagcagaccggcatgggccagtggagcgacggcaccccggtgaagccgatcaaggtgctcaagtaggcgcgggcaacgcccgcggcgaaccaggcacagcgtcccatccgtcatgcgaacagataccatgcatatccacgtactcgtcgtcgaagacaacttcgatctcgccggcaccgtcatcgantacctcgaggccgccggggtggtctgcgatcacgcccgcgacggccaggccggcctcaacctggcgcgcgccaaccgctactacgtga

SEQ ID NO: 12395 - DNA, 3120 bp, Pseudomonas aeruginosa
gctgcgcaccccgctggcggtgatcggcatgaacctggagctgctcgaccaacccggccgcgcgccctccccgcatgccttgcaacgcatccgccgctcggcgctgggcatgcagcagatgaccgaaaccctgctctggctcagccgcgagagcggcgaactgcgcgacgacggacacatcgaggtcggtcgcctgctggaggagctgctcgaggaacagcaggcgctgagccagcgccgcggcctgaccttccacctcgacgtggagccacacagcctgccgcagacccgcgcacggatcatcatcggcaacctgctgcgcaacgccctgcagtacagcgacgagggcgtggtggaaatcgtcgtgcgcgaccgcagcctgctgatcagcaaccccatcggtgcggcccagggcacggaggagtcgatggcgttcggttatggcctgggcctcgacctggtccagcgcctgtgccagaagagcggctggcgcctgcattacagcagcgacgagcagcgcttccgctgcgagctgctgttccccgccacaccggactgaagcgcggcggccttcctccgcgcgaaaaaaaccgcggccggggccgcggtcttggcgaggctcggtgcgactcagtgagcgaacagcgaggccttcctggcctgcagcttggccgggttgatcaggaaacgcgccagggccggcagcagccagagggcgccgaacatgttccagagcagcatgaaggtcagcatcaggcccatgtcggcctggaacttgatcgccgagaagatccaggtggccacgccgatcgccaggcacaggccggtgaacagcaccgccttgccggtggagcggagggtctcgtagtaggcctcctgcaacggcaggcccatgcgcaggaaagactccaggcgggtgtagatgtagatcccgtagtccaccccgatgccgacgccgagggcgatcaccggcagggtcgcgaccttcacgccgatgcccagcgccgccatcagcgcgttgcccagcaccgaggtgaggatcagcggcaggacgatgcagagggtcgcggcgaaggaacggaaggtgatcatgcacatggccgccacgcagatgtacaccagaaccaggatgatcagttcggactgcttgatcacctcgttggtggcggcctcgatcccggcgttgccggcggccagctggaactgcaggtcgtccttgtcgttctccgcggcgaaggcctgcaccgccgccaccgcgcggtcgagggtctcggccttgtggtcgttgaggaagaccagcagcggcgccagcgagcagtcggtgttgtagagaccgtcggcacgggcgatggagttgttcagcacgtcctggttgcgcgacagggtctcccatttcaggttgccttcgttcatccccttgatcacctgcttggacacggtgaccatcgagatcgccgactgcacgccctcggtgttctccagcttccaggccagttcgtccatggccgccagggcctggtgggtggagcagccttccggggaggtcttgaccatcaccaccagcacgtccgaactggtcgagtagttgcggatgatgaagtcgttgtcgaggttgtagcgcgagtcgggacgcagttccggcgcaccctggtcgaggtcgccgatcttcaggtgcttgccataccagaggccgccgccgagcatcagcagggcgatggcgatggacaccggggccaccttcgggctggcgaagttcgacagcaggcgccagaacgggtgctcgcgcaccgcgtcatccttgctgcgctgcaccgccttcttgctgatgccgatgtaggagatcgccacgggcagcaggatcaggttggtgaagacgatcaccgccacgccgatcgaggcgccgatggccagctcgcggatcaccccgatgtcgatcaccagcagggtgatgaagccgacggcgtcggcgaggatcgcgatcatccccggcaggaacagttggcggaaggtcagccgcgccgccatcagcgcattgtcggcgccgctggactgcaaggcgatgccattgatcttctgcacgccgtgggaaataccgatggcgaagatcaggaacggcaccagcatcgaatagggatcgaggccgaaaccgaccaggttgagcaggccgagctgccagagcaccgcgaccagggtggtgatcagcacggcgatggtgctgcggatgcacttggtgaaccagtacagcaggaccagggtgatcagcaggcagataccgaagaagccgaccaccatcaccagcccgtcgatcaggtcgccgaccttcttcgcgaagccgacgatgtgcaccttcacgttgggattctgcaactggtacttgtcgcggatcttctcttccagctcatgggagaactggcggtagtcgagcttgatcagttcgctctggttcttcgggttcgggtacatctccagcagcggtacgtcgacgatgctcgacttgaagttgttcgccaccaggcggccgatctgcccggacttgagcacgttgttgcgcagttcctccagcgcccgcggcgaaccgtcgtaggtctgcgggatcacctcgccgccggcgaagccttcctcggtcacttcggtccagcgcacgctggggctccacaacgacttcaggccggaacggtcgacgccggggatgtagaacacctcgtcatggatctgccggagcgtctccatgtactccttggtgaagatgtcgccgttcaccgcctccaccgagatgcgcacggtgttgccgaggttggccaggtcgttgcggtgctcgagcattttctggatgaacgggtgctccagcgggatcatcttctcgaagctggtggacggccgcacctgggtggcctggtagaacaggaagacgctgaccagcaggcagaggaagatcaccaccggccggttgttgaaaatcaggcgttctaccagggctcgccttgttttgctgatgctggttcatggcactcatgcgacccccgccttattgttgttgttcgagcgcggcaccgttcgccgcagcgaggtgcacgccgccctggccgaccaggatcaggtggccgtcgccggtggcgctga

SEQ ID NO: 12396 - DNA, 315 bp, Pseudomonas aeruginosa
agtcgatggtacccggctcctcgttgtccaggttctgcacgtggtagcgacgcgcctgcaggtcgtggaacacatccagcgcgctccaggtgtacggcaggtcgtagaagttcttcaggtaggccatcgacacccgccacagttcgccgcgaccgtcgtactggtcgaccaccgccgcgctccagctgtcctcgtcgaggtacagggtgcgcttggagtagatatgccgcgcgcccggcttcagggtaccttccaccacccacacgcggtgcagctcgtagcgggtgtattgcggatcgaggtggcccggcttga

SEQ ID NO: 12397 - DNA, 402 bp, Pseudomonas aeruginosa
cgccggtacaactcgcggacctgctcggcgagccgctcgtcgggcacccaaaggacctgctggccggattcctcgctgacccggtgcggcacgttcagacgccgcagcaggccgacgaagccggccaggtcgaccgagaggggaaacttcaggacctgcaccgcgctcactcgtcagcctccggccgcttcacttcgacccaaacaaacttgtgccggtccaggcgggtttcctcatccaggcggtaggccgccagcttgccgtacatcaccgcgctgtagtccaggcaggccaggttcggccggatcggcgccggcgtgccgcgtcgccagtagtggccgacgaacaacagcggttcgtcggcgccgtaggtcagcaggctggacttctgctcctcgctga

SEQ ID NO: 12398 - DNA, 1149 bp, Pseudomonas aeruginosa
tgcacagcgcctcgccggcgtcgaccatcgcgtgcacccggtgcagggcctcgcggatgcgcgggccgcggtcgacgatgtcgccgaggaacagcacctggcgccgcggatggcgccagacgccgccctgcaggcggtagccgagcaggtcgaggaggcggtccagggtatgcgcgcagccgtggacatcgccgatcaggtcgtagccacgtccggggtcgagttgcatcagtcgcctccgcccaggcggctgccccagccgagcttggtccggcagatctcgtagtagttgtggtcgatggggtggatcaggcgcagcttctgcggcttcttgctgatcgtcacagtatcgccgggggcgcaggtgaaatggttctgcccgtcgcaggagacctgcgggtagatctgcatgttcggcgacacgacgatcttcagctcgctgttgccgtccaccacgatcgggcggctggaaagcatgtgtgggtacatcggcacgatgacgatggcatccagcttcggatgcatgatcggaccgccggcggacagcgcgtaggcggtggaaccggtgggcgtggcgacgatcaggccgtcggccttctggctgcagacgaactggccgtcgatatacagctcgaactcgatcatccgggtcgacttgcccgggtgcaggaccacgtcgttgagcgcatcgccctgccccatcgagtcgataccgcgacgcacctgggcatcgaggaggaagcggctctcgacgatgtactggccgtccagcacctcgccgaccttggcctccagttcatccgggcggatgtcggtgaggaagcccaggctgccgcggttgatccccagcaccggcaccttgtgccgggccagcgctcgggccgcgccgagcatgctgccatcgccgccgaccaccaccaccaggtcgcagatctcgcccatgatcttccgcgagcaggtctgcaggccgtgtccgggcaggacttcggcgatggtgtcctcgaggatcacatgcaggtggcgatcgatcaggaatttcttcagccggcgaatggtgtccagcacctgggtgctgccgaggcgtccgattatgccgattttgggaaagggttccatgcggttcctgcgaaaagctggcgggcgggatag

SEQ ID NO: 12399 - DNA, 1032 bp, Pseudomonas aeruginosa
agcggattatgggcgaaagccggggacagcggcacacccgcgcatgtaagggaaatcgccgcgagtggcgcaacccggctaacctctgggtatgacgctgttgaccgaattgctagacgaattgcgccacccggccgtccgcgacctggcctggaccgtgctcgccccgccgttgatgcgccggaccccggagccgcagcgccatccgctcgccgccagccgctggcgccaggaaccggagcgcctggccgcctggttgcgcgaacaggagcgacagccgcagcatctcgccgcgtggctcgcgcaatggccacggcagcgtctcggcctgtactacgaacatctctggcaattcgccctggaacaggccccggacgtgcgcctgatcgccgccaacctgccggtgcgcgacggcgggcatacccttggcgaactcgacctgctgctgcgggacgacgacggcatccaccacctggaactggcgatcaaactctacctggggccccagtccggccccggcgactggctcgggcccggcggccaggaccgcctgtcacgcaagctggaacacctctgccgacaccagttgccgctggcggcgacccgcgagggtcgccaggtgctggccgcccatggcgccgaatcggccgtttccgcattgtggctgagcggctacctgttccatccctggcccgggccgggcagcctgcccgccgacatcgagccacggcatctgcgtggccgctggctccgccagcgcgactggccggcgtacctggccagcctggccggaccgcaggccgggcagcattggctgcatctgtcgcgcgagcactggctggcgccggccatgcggcggcaggacccgctcgcccctccgcgcgacggcgcttgctggaacatcgccttcgccgacgaggcacgtccgcaaatgctggtaagggtggtgccgcgcgacggctactgggtagaggccgagcgcctgttcctggccagcgacgactggccaccggggctcagcctgtggggtag

SEQ ID NO: 12400 - DNA, 558 bp, Pseudomonas aeruginosa
accgcgccaatcgcccatcgaggcgggcgaaaccaccacggctggcgtccagcaggcgatagccggtatcggcccagcccgcctcggcaagggtcgccgcgacctgggcggcgacgccgtggtcctccggcaccgccagcgcgcccaccacgggatgccgcccggcctcgccgagcaccaggccggccagtgtcgtaccggtaccggcggccacccagatcgcgtcgtaatcgtcccagccgagcgtcggcaactgggtcgctatgcgctccaccagcccgatacaaccgcgcgcgcccagcagcccgccaccgccctcggcgaccggcagcaagcctgggtaacgttcccgccagggaagccagaagccggcggcatgccgctggcgatagccgccgtagccgagccagtgcagttccatgccgagactgcgcaggtcgcgcaccgtcggcgtatcgacttcgtgtccgcgcaacaggccgacgcaacggaaaccgaaacgcgcgccagcgccggccagcgcgtgcaggtggttggagtgggcgccgccgaggctga

SEQ ID NO: 12401 - DNA, 750 bp, Pseudomonas aeruginosa
ccggccaccgccgccgccactcgagcctccagttcgtcggcgaactccgagcgcagcaggtcggtctcgttgcgcccctggttctcgatgaaacgcagttgccgggtcagttcctcgcggttgcgctggaactgctcgccctgctccagcagacgctgctgcaattcggcgttctcccgcgcctgccgttccagggcctgttgcaggctgagcacttcgctgcgcaggatgtccagttgcccgcgggcgtcctgttcgcgcctggccagttcctcttcgtgctgccgggcgagcccggccaggcgctgctcctgctgccgggccagggcggcgagctgttgtcgctgctgcttgaccagttgcgccaggcgcgccgtctgctcgtcctcctgcttgcgcggaggctccgcgggcggtgccttcggggcggcgggaccggcggcgtaccattgctcttcggcggccatctgcagccgctgcggctccaccgcggcaggctcttcgtccaccagcaggcccagctggttgcgcctgagcgcgtcgcggatgagcacgaaatggttgcgtccggcgctgctctccgggtcccagaggtgcatctggtgccaggacaccgggcactggctgcgacaggccaggcggatcggcccgccgcccatgtcggggccgcgtccggcgcgttcggcgaggttgcgcagaggcaggttccagccggtgtcggcgccgccctgctcgtcgaaatcgagatag

SEQ ID NO: 12402 - DNA, 462 bp, Pseudomonas aeruginosa
ttcagctcggtttcgtggcaggcgcgcgggttgaccaggcaactggtcagcttgccgccgaaggtgtggtcgaggcaggcctggttgcagccgatacaggtgttgatccgttcggcgtggccggcggcggccttgttgacgaaatccgggtcggcgaggaacggccgggccatggagaccatgtcggcatcgccctcggccaggaccttctccgccacctcgggagtgttgatgcggttggtggtgatcagcgggatgccgacctcgccgcgcagcttggcggtgaccttggtgaaggccgcgcgcggtaccttggtggcgatggtcgggatgcgcgcctcgtgccagccgatgccggtattgatcagggtcgcgccggccttctcgacggccttcgccagcagcacgatctcgtcccagctgctgccgccctcgaccaggtcgagcatcgacaggcgatag

SEQ ID NO: 12403 - DNA, 1200 bp, Pseudomonas aeruginosa
caagttactgatcggaatgcacagggatgcttggcaagccgacgccactcccctaccctgtgggctgccttggagacccgcatgcgcaagctgatcttcctgatcctcatcaccctcttcgccgcctacgccggctgggccgaacgccgcccggtaggccactacctgtccgacctgcgcagccaggtcagcgtggtccagggccagcccggcgagcgcggcaacctgctggcggtccagccggaactgttcacgccggactaccagagcgccgaacggttgcaactgaaattccacgcctacctggaaaatgcccgccgccagggcctgctcaacgagcgcacggtggtggtgttccccgagcatgtcggcacctggctggtggccagcggcgagaagcccgaggtctacgccgctgccgactggcccacggcgatggactggatggccgcgagcaacccactgaaggtggcgcgcggctggatcaccgcgcgcggcgatcagcgtctcaccgacaccctgttccggatgaaggcggtggacatggcccacgactaccagaccctgttcggcgggctcgcccatgatttcaaggtgacggtggtcgccggctccatcgtcctgcccgaccccgaggtcgaggacggcgagctgcgtcccggcaccggccagctgtacaacgtcagcctgaccttcggtcccgacggccggccgctcggccagccgcaacgcaaggtgttcccgacccgccacgaactgagctacctcaacaacggtcgcggcgagcgcctgcaggtgctggatacgccggcaggacgcctgggcgtgctgatcggcaccgacagctggtacccggacacctacgccaccctggtcgaacagcgcgtcgaactgctggcgatccccgccgccctgaaccagagcggtcgctggcagcagccctggcccggcttcgatgcggagctggttcccggcgacgtacgcctggcgccgaacagcctgagcaacgccgaggcctggcagcacctggcggtcggcgagcgcctgctggccagcggtgcgcgcggcgccgccgtggccttcgcccatagccgcctgtggaacgtcaccgaagacggccagagcctgctcggttcgtcgcagggcatgcgccaggccaatcccggcggcggtgcgcaactggtcaatctctggctatga

SEQ ID NO: 12404 - DNA, 414 bp, Pseudomonas aeruginosa
cccgcacccgcagttggcgcgagcgcgtcagccgcctgctggggccgatgctcaatggtcgcgaaccggacctcgaggaaatcgccgcgcgcctcaagttgccgacctggaccctgcggcgcaagctggccgaggaaggcacccagttccgcagcatcctcaacgacacccgccgcgacctggcgatggtctacatccgcgagaccgacctggctttcggcgaaatcgcctacctgttcggcttcgcctcggcggaagccttccagcgcgccttcaagcgctggagcgggcagacgcccggcgaattccgccgcgcccagcgacagagcgcctgatcacatctcggtggcgtcgtccgccggctctggcagatcgcattcggcggcatgctgctccagcagttcttcctggtag

SEQ ID NO: 12405 - DNA, 933 bp, Pseudomonas aeruginosa
cggtcgccttcgcgctgcaactgccaggcctggaccagggtaaagccccattgcaacaccagccacagcccgaccagccccagcagcggccgccagcggcgccactggctgctctgctggcgcgcggcgaactcggcctgggccaggtcggtgcccagcggctgctcgctcagccagacgtgcggattgcccgccaggggctggacttccactccctccggggccgccacctcctgcgcggcgaaggcccgctggggcggcgggcaactgtcgcgcagtaccggccaatcctcgctgccgcaggccaggcgtacggcgccgctgccgccgagcaaccagcgctcttccagccagaacaggcaactgccctcgcccggcaggcaatcggcatcgacatgcagcgaagccggcgccttgcccgcgccctcggccagcgccagccaggcggcaagccaggtgcgctgcacggcgaatacccggtggcggccgtcggccagcgccgacccaagggcaaggtgcatctgctcgacatcgtcggccagttgttcctccaccgcgaaaggcagcgactggcgcaaccagcgcgccttctgtgtaggcaggttcaccgcgcaggcggtcaccgcctccaccggcaggtacagccgccagggcgcgcggatctccgccagcgcctgggcgaacggcgcgcgccggcactcgccatcctgcacccaccataccgccagttccccatcggcccccgccgtgctggcgggcggcaggaacagcgcactcactccactcatcgctcgtccttcttccaatcgtcgccgcccgtcgacgggatgggcaggccgccctgccccatgtcgcgggccatcacgcgtatcttgccgtccttgccccgctgcaaggtactcaccagcacctgccggcggtcgcccaggctga

SEQ ID NO: 12406 - DNA, 495 bp, Pseudomonas aeruginosa
cctcatggctggctcccgaggaaaccgacgaggcgcgccgcggcgcgttcctcgatgctgccacgctcgcggccgaggggcttcgccgcgacccagacgatcacccgccgcatatcctgctcggcggtgctgtcgacctgggtgcgccactcccagcggcgcccggcgaactccagctcgccctggttgtggccgctggagggcggcgtctgttccagttgcaattcgttgagacggttgtcggcgatccacatcgccagggtcttgtcttccagccgcgaggcgttctgcaggctgcgcgcgctggcactgagcacgctggccgcgaccatggcgaagatcgccagggccaccagcacttccagcagggtgaaaccacgcgcgcgcttcatcgccgcgccacctcgacccgtggcaggcggaaaccgtcgctgctcagcgacaacgcccgcccctcgggtccgcgctcggccaggcgcaggcggaacggactga

SEQ ID NO: 12407 - DNA, 312 bp, Pseudomonas aeruginosa
agccgcgcgaagcccgcatgtccggtcagttgtcccagttaccgatgtcggcgtcgttgtcgctgccgccttccttgccgtcggcgcccagcgaatacaggtcgaacgggcccttggtgcccggcgccaggtactggtagggattgccccacggatcgaccggcagcttcttcaggtagccgtccttgttccagttcttcggctgcggattgccggtgggcttcttcaccagcgcctcgaggccctgctgggtgctcggataggcgaagttgtccagcttgtacatgtccagcgcggcagcgatggccttga

SEQ ID NO: 12408 - DNA, 327 bp, Pseudomonas aeruginosa
acggcagacgccgtggcggtgcggccggcgcggcgatgtcgggtaatggggctgtcatcatggatgccttatagcggtaaccttacagaagtatcttggtcgtatatgaccactgaacggttaccgtcagtattgttagttgttagtcgttttgtgcggccgatcccgagttcctcttgcagaagtatcctggcgagccgttatcttaagcacaagcgtgcctggcccggccagtcacacctattgatagaagtaggtagcctactggcaacgaactgctatgatccctcggcgatcttcagacataacgataaagaccaggagtga

SEQ ID NO: 12409 - DNA, 537 bp, Pseudomonas aeruginosa
tgtattgcctttctccggcgcctcttcccgctggctgcagcggtacgccccggcccttctggctgttgccctgatcatcgccatgagcatcagcctcgcctggcaggcggccggctggttgcgcctgcaacgcagcccggtagccgtcgccgcctcgccggtcagccacgagtcgatccgcagcgatccgacccgcctggcgcgcctcttcggcaccagcgcccaggaccccaacgccccgccaccggccaccaacctcgacctggtgctcaagggcagcttcgtccagagcgatcccaagctgtccagcgcgatcatccagcgccagggcgacaagccgcaccgctacgcggtcggcggcgagatcagcgacggcgtgaagctgcacgcggtctaccgcgaccgcgtcgaactgcagcgcggcgggcgcctggaaagcctgcccttcccgcaccgttccgggggactgctggccagcgcggacgacattacaagcgagaacgactcgatcgaacaactgcaaagcctgcaggatga

SEQ ID NO: 12410 - DNA, 420 bp, Pseudomonas aeruginosa
gaacgctgcagcattgcgcgagcgcctggacgccttgcgccagcagatggaagccacgcccatcgcagaacccgccgaagaagactcgagcgagcccacgaccacgcctacggaaagcgactgacccgatgtcccagcctttgctccgcgccctgtttgccccttccagtcgttcgtacgttcccgccgtccttctcagcctggccctcggcatccaggcggcgcacgccgaaaacagcggcgggaacgccttcgtcccggccggcaaccagcaggaggcgcactggacgatcaacctcaaggatgccgacatccgcgaattcatcgaccagatttccgaaatcaccggcgagaccttcgtcgtcgacccgcgggtcaagggccaggtcagcgtggtctccaaggcccagctctcgttga

SEQ ID NO: 12411 - DNA, 447 bp, Pseudomonas aeruginosa
agaacaatggcggccagggcggcgaacagaccggcggcggccgaccgagcaacatcctcatccgtgccgacgaaagcaccaacgccctggtcctgctggccgacccggacacggtcaacgctctcgaagacatcgttcgccagctcgacgtgccgcgtgcccaggtattggtggaagcggccatcgtcgagatctccggcgacatccaggatgccgtcggcgtgcaatgggcgatcaacaagggcggcatgggcggaaccaagaccaacttcgccaataccggactgtccatcggcaccctgctgcaatcgctcgagagcaacaaggcaccggaatccatccccgacggcgccatcgtcggcatcggcagcagcagcttcggcgcgctggtcaccgcgctctcggccaacaccaagagcaacctgctgtcgaccccgagcctgttga

SEQ ID NO: 12412 - DNA, 1290 bp, Pseudomonas aeruginosa
ccagggcgaccttgccgttgcctcgcaggttgggttcgatcacagcgcggccagcccccgagccatgtcggccttgaggtcgtcgaggtcttccaggccgaccgcgacccggatcaggctgtcgccgatcccggcgcgcgcgcggtcctcgggggacagtcgaccgtgggaggtggtcgccgggtgggcgatggtggtcttggtgtcgcccaggttggtggtgatcgagaccatccgggtagcgtcgatgaagcgccaggcggcatcgcgcccgcccttcacgtcgaagctgacgaccgcgccgaagccgctctgctggcgccgggccaactcatgctgaggatggctcggcaggcccgcgtagtagacccgctcgatgcccggctggcgctccagccattcggccagggccagggcactggcgctgtgcgcctgcatgcggatacgcagggtttccaggcccttgaggaacagccaggcgttgaacgggctgagggtcggtccggcggtgcggaggaagccgaccacttccttcatctgctcgccgcgaccggcgaccaccccgcccatgccccggccctggccgtcgatgtacttggtcgcggagtggatcaccacgtccgcaccgagcttcagcggctgttgcagggccggcgtgcagaagcagttgtccaccgccagcagcgcacccttggcgtgggcgatctcggccagcgcggcgatatccaccagctcggccagcgggttggatggcgactcgacgaagaacagcttggtattcggcttgcacgccgcctcccaggccgcgagatcgctcaacggcggatagtcgacctggataccgaagcgcttgaagtacttgtcgaacaggctgatggtcgagccgaacacgctgcgcgagaccagcacgtggtcgccggagctgcacaggctcatcaccagggcgaggatcgccgacatgcccgacgccgtggccaccgcctgctcggctccttcgagggcggcgatgcgctcctcgaaggtgcgtaccgtggggttggtgtaacgcgaatagacgttgcccggcacttcgccggcgaaccgcgcggccgcgtcggcggcggtgcggaagacgtagctggaagtggtgaacagcgcctcgccgtgctcgccctccggcgtccgccgttgcccggcgcgaaccgccagggtgtcgaaggccgcgccttccaggtcgctgtcgagacgcccggcatcccagtcctgagtcatgccgctctcccctttgtcagtcgttgtacagatcgatga

SEQ ID NO: 12413 - DNA, 531 bp, Pseudomonas aeruginosa
gcttctgctgcttgctcaactggtcgcgcaggcgatccgcctcggcgcgctggatcaccggcccgacgaagacccggttcatcccgtcgaagctgcggatgtaggcgttgtagccctgggagcgcagggtcttctgcaattcctcggcgcgcgcccggttggacaggctggcaagctgtaccgaccagctctgcggcaggttgttggcgtccaggcgcttctccgcgggcggcgggctcggcggcgcagcgggcggttgcggctggcttggcggcaggctggcggccggcgcctgggcctgggcgggcggctgggtggccggcggggtcgccggcaggccgccgatcggctggctgggctggccggcggcggccggggagccttcctcgacgatctcgggagcgttgccttcttcgccgggctgcagttccggcacctcggtcggctgcacctcgacactgggcatggccggcgattgcgggcgcggcggcgcttccaccacgacctggcgcgactcgtcttcgcgggtga

SEQ ID NO: 12414 - DNA, 720 bp, Pseudomonas aeruginosa
ccttggcgcactgcgcgtccagggcggcggcgatatccgcatggctgctcgccggaacctggcgcaggatcagcgccgcctccagctccgcggccggccgcgaacgcggagtcggcaacggtgcaacggcccaatcctgcaccaagccggtcaagggttccagtacgccatccaggtctttgtccgccagcaggccgaagaccgccaggtagcgtcctcgtggcgctgcggcacgcaggcgttgcgccaggtactgggcggcctggggattgtgcccgacgtccagcaggagctggcgtggctggccgttccaggacaggtcgcggcgatcgaggcgaccggtcacccgggtccgccgcagcgcctcggccaggcgctccgcctgccagggcaactcgagcaacgcgtaggcctgcagggccagcgcggcgttttccatgggcaacccgagcaacggcagatcgtgcagcgccagcgcctggccgtccgcggccagcccgcgccagtgccagccatgatcggcgagcgccaggtcgtagtcgcgaccgcgcaggtaaagcggtgcccccagcgcagccacctgctccagcaatggctgcgggggatcgaaatcgccgcacagggccggtttgccggcgcgcaggataccggctttctcgaaagccacgctttcgcgggtatcgcccagccagtccgcatggtccaggccgatgctggtga

SEQ ID NO: 12415 - DNA, 1338 bp, Pseudomonas aeruginosa
ccacgcgtttcgccggccttcccaggccgagccggcgcgctacctcgcgggaacgctccaggcccatgtcgatggccgtcggatggagttgttcgagatagctcagccaatcggccagggaacgctgggtcatgcggatacggggctcggcgaatgagtgaaggccgacagcagattggccaggcgcggccgcaactcggcacgatgcacgatcatgtcgatggcgccatgctcaaggaggaactcgctacgctggaagccttccggcagcttctcgcggacggtctgctcgatcacgcggggaccggcgaagccgatcagcgccttgggttcgccgacgatcacgtcgccgagcatcgccaggctggcggaaacgccgccgtagaccgggtcggtcaataccgagacgaacgggatgccttcttcgcgcaggcgcgccaggaccgccgaggtcttggccatctgcatcagcgagatcagcgcttcctgcatgcgcgcgccgccggaggcggagaagcagatcagcgggcagcgcttctccagggcgacgttggctgcgcgaacgaagcgctcgccgacgatggcgcccatcgaaccgcccatgaaggagaactcgaaggcgcaggcgaccaccggcataccctgcagcttgccgctcatggcgatcagcgcgtccttctcgccggtgtccttctgtgccgcggcgaggcgatccttgtacttcttgctgtcgcggaatttcaggcggtccaccggctcgaggtcggcacccagctcctcgcgaccgtcctcatcgaggaagatgtccaggcgggtacgcgcgttgatgcgcatgtggtgatcgcacttcgggcagacatccagggtcttttccagctccggacggtacagcacggcttcgcaggacgggcatttgtgccacaggccttccggtaccgaactcttctgggactcggaacgcatgatggaagggatcagcttgtctaccagccagttgctcatgctctttgttctccagtgcaaggtcgggatggccgcaccgatccggtgacggcgtccctgagcaaattcatcttcgtgaccgccggcagcggtgggccccacggctgcgaagcgtttcgcggcctgtcccatcccccgcctgcgcggtcacctgggcgatacccggcgagcggctatcgcgaaatatctggcctccctatcggcggccgggcgttgtcgcggaaacggcgacacgctagtggacggcggcgggccgcccgtcgtcacatcatgtctcgtcgcggcgccgcgaacgcaccgcgtccacgaacgcgcggaccctcgccgcatccttga

SEQ ID NO: 12416 - DNA, 330 bp, Pseudomonas aeruginosa
cctgctcgactgccctgccgacgttatccggcgtcagaccgccggccagcaccaggggtttgcccaggtcggtcggcaccagcgaccagtcgaacgccgcccccgtgccgccgggcacgccttccacataggtatccaggagaatcccggcagctcccggatatgccgccgcgcgcccgacgatgtcgtcgccgggcttcacccgcagggccttcaggtagggtcgccgatgtccctcgcagtcctcggcgcgctcgtcgccatggaattgcagcaggtccagcggcaccgcatcgagaatctcgcccagttcgcagcggctggcgttga

SEQ ID NO: 12417 - DNA, 3678 bp, Pseudomonas aeruginosa
caaaagcccgattcgacgtcagccgacgatatcgggcaatccggaaaggaaatgcggccccaggtagcgctcgggcaactcgaactccccggggtactccacccgcaccagatagagtccgtaggggtgagcggtgaccccaccggcgcgccggtcgcgcgcctcgagcacctccttcgcccattcgatcggccgctcgccggcaccgatggtcatcaggacgccagcgatgttgcgcaccatatggtgaaggaaagcgttaccgcggatgtccagcacgatcaaccgaccatgctccagcaagcgcacgtgatgcatggtcttgaccggcgacttggcctggcactgcaccgcccggaacgaggtgaagtcatgggtgccgaccagtacctgggccgcctcgcgcatccgcccgatatccagcggccgatggttccaggtgacctcctcggccaggtgcgccgggcggatcggatcgttgtagatggcgtagcgatagcgccgggccatggccgagaagcgcgcgtggaaatgcgccggcatcaccctcgcccaggtcacactgatatccgcgggcaggttggcgttggtgcccatcacccatgctttcaacgggcgctccaccgcggtgtcgaaatgcaccacctggccgctggcatgaacggcagcgtcggtacggccggcgcagatcaccccgaccggctcggcggcaaccttcgacaaggcgcgctccagcgcttcctgcacggaaggcacgccggcttcctggcgctgccagccacgatagcgggagcccttgtactcgatgccgagggcgattctggaaacgccagcggcagccgattcggctgccgctggcggaacaacatcgttcatgagagtcgcttcatttccggatcaggccaggcgctccagcaactcgcgggcttccgcctgctggctgtcgttaccttcggccaggacttcgtcgaggatatcgcgcgcgccttcgctatcgcccatgtcgatgtaggcacgagccagatccagcttggtcgccgcttcgtcggcaccggagaggaagtcgaagtcatcgtcggcgtctccgtccagggcggaggcgaccgctgcatcttcggcggagaaactcggcgtcgcgctcttcggctcgtcaaggttgctggccaactcgtccaactgcgcactcacctcgtccaactgggcggcgaaactgtcctcgcccttctccggagcggccggctccgtcggctcgtcggccagcgacaggtcgaagtcgtccggcagggacaacgccggctcttcggcagcctcggtatcgagggtgaattcgttgtcggcgggcgccgcggcgggcacttcgtcgttcagcgaaagcaggaagtcgtcgtccgaaagcttgtcttccggcgcatcgagatccagggagaaatcgcccaggtcgtcatgcttgggttggctcggagtctctgccaactccgcgaaatccaggccgaagtcgagatcgtcgacaggcttgtccgccgcggtcgaggccgccaggtccagatcgctgtccagggtcaggtcgtccagcgccccgctgtcggacttgaggtcggcctgcacgtcgtcgccgcccaggtcgtccaggctcaggtcgaaggcgtcgtcgagatcctgtcctgccgcatccggcttggccgcgtgaccgctgtcgtcgagcgacaggtcgtcgaggctgaagctatccagctcgtcctgcgccagcttggcgccggccaggccggcaaccgcggcgaccgcgaccattgccggatagcgcgacttgagctgctcgacctgcggctgtgcgccgccgatttcgcgcagctcgttttcctggcgagcgaaaccttcgcgatcgcccatctcggcatagacttccatcagcttgaggcgcaggtcggtgcgctgcggctcgtcgtagatggcgttctgcaacagttcggcggcctggttgaaacgcccgtaggcgatatagatgtcggcctcgcccagagcatcggaagtctgcgcggtggtcttctcgacctgcggcgcagcggctgcgacctgcggctcaggctcgtcgagggtcaggtcgtcgaagccgtcctttcccaggtccagcgcatcctcctgttcctcgccggcatccgcggcgaaagcctggacttcttccttctctttctgcgcattgcgccgcgacaggatcatcagcagcaccagcaacgccagcagtgcgctaccgccgatcaccgccaaccacagcgggttggccagcagttcgtcgaggaagctcggtgccggctgctctgccgcctgtaccggagcgggcgccggaacggcaggtgccggaggcttctcggcagctggcgcgggcggcggcgccaccggaggctgcgccggagcggcgggtgcttctccggctggagcaggagtcggcgctgccgcagcgggagtcccgggctgagccggcgcctgcgcggccgcattgggctgggacgcatccggcagggctgcgttcggctgggctgcgccctggccttcggcgcccaactgcccttgcagcttggccaactgggcgtccttcagctggatcaacttctgcagcttgtccaactggctctgcagatcctgcatgcggctctgcagttcttcgttctcgcggcgagtgctatcgaggctttccttggtcaccgccagggtatcggcgagcgccttgctgtcgcccttcccgcccttgtcggcacccttgctggccttgccctcgccagacaccaggcgcaggttgtccgtggcgtcgaccttggatggcgccgacccggcggcattgcgctgggtcgcatccaactgcctggcgccagcgctgcccgcggccggattgcggctgccgcgccagctctggttctgcgcctgcacctgggacagcgcctcgcgcggcgagcgctccagcatctgctgttcggtgggaatgcgcaggacctggccgctcttcagccggttgatgttgccatcgacgaaggcgcccggattcagttcctggaacgcgagcatcgcctggggtacggaaacgcgatcggtacggttgcgctgggcgatctcccagagcgtgtcgttggaaacggtgcgataggtgtcgctgcctgccggcgcggtggtacgcaccggagccggagcctgcggggctcgcggggcgccggtcgcgcgcggcgcgctgaccggcgcttgcggagcgcttgccgcggcctgcggggagtacagcggcggatccagcaggacggtgtactcgcgcagcaggcggccgttcggccagagcacctggaccaggaagttcaggtagggctcctgcaccggcttcgacgaggtcacgcgaatgacgctcttgccgttgggcttcaccaccggcgtgaacttcaggtcggtgaggtagtacaggcgatcgacgcccgccttgctgaactcttccggcgacgccaggctcgggatcacctcgcccgaacccaggtcacgaacttcgagcagctcgatctcggcatccaacggttggttcaacgccgacttcagggtgatttcccccagtcccaatccatgcgccatgccggaagtcaggaccgaggccgccgcgattgcccgaaccagtgtacgaagccgaaccatagtgtaatcccttggttttaa

SEQ ID NO: 12418 - DNA, 1773 bp, Pseudomonas aeruginosa
ttctacaaatctgtgggtaagtatcttttacagatagtgttttatcaacaactcacccaggagcacggcattcagcgcggcaccttttcgcacattatcagacacaatccacaaattgacctgacagggatcagcctgccccgccctcacccggccgacataggtctcgtcctggccgagggcatcgccgaccaccgtcggataatcgccctcgccgacccattcgatacctttcgtcgcatcgaggacccgcgtcaccgcggccaggtccaccggctccgcgcactgcagggtcacgctgaggctatcgccgaagaataccggcgcctggatgcaggtaacgttcaacggtccgatacgctcgccaagcaaggcctgcacctccgcgaagatgcgccgctcgatcgcgctgtgtccctcggcatccaccgcgccgacctgcgcgagcaggttgaaggcgatctggcggtcgaagagacgcggctccagggggcgcgcattgagcagttcggcggtctgccgggcgagttccttgaccccttcgcgccccaggctggagacggagaggcaggctgtcaggttcagttgccggcaatccagcgtggccaggagtggcgccagcacttcgcacagttcggcggctacggcgcaaggactggacaaaaggaacggcgctgcttgcgaggccaggcgttcggcattcaccgaaaccatgaccggcggtgcgacgctcggttccagggcgccgctcaggtcgatcaccgaacaacccgccgcgcgggcgcgctcggcatgggcacgcgacacctcggctgccgcggcgaagaaggccaggccgacactggaaaaatcgaagctatcgacatcgccgacgcgcaggctgctttcggcgaaacccatgcgctgcccggccgactcggcgctggccagcaggtgcagacgatgaagcgggaagtcgcgttcgtcgaggagaccgaccagagcctcgccaaccgatccggtggcgcctacgactgcgacattgaggggctgggacatgggaaaagcctcggcggtctgcgaaataggcgtggcactttacttgcccaccttcgcccaggcaatcgaggcgccacccattgcgggcggcgccggatcgatcagcgctccagcaggatgcgcagcatgcgccgcagcggctcggcagcgccccacagcaactggtcgccaacggtgaaggcgccgagatactgggagcccatgttcagcttgcgcaggcgcccgaccggaacgctcagggtgccggtgacggcggccggggtcagctcgcgcacgcttacctcgcggtggttcggcaccagcttgacccagggattgtgctggctgatcaggccctcgatgtcggtcagcggcacatccttgttcaacttgatggtcagcgcctggctgtggcaacgcatggcgccgacgcgcacgcagataccgtcgaccgggatcgggttcttgaagcgggcgaggatcttgttggtctccgcctgggctttccactcctcgcggctctgcccgttgggcagttccttgtcgatccaggggatcaggctgccgcccagcggcgcgccgaaatgctcggtggggaaggcttcgctgcgcagggtctccgccaccttgcggtcgatgtcgaggatcgcgctggccgggttggccaggtcatccgccaccgatgcatgggcggcgcccatctgcttgagcagttcacgcatgttctgcgcgccggcgccggaggcggcctggtag

SEQ ID NO: 12419 - DNA, 231 bp, Pseudomonas aeruginosa
ccggcgatgtccggggcggaaccgtggcagggttcgtacatgcccttgttgttcgcgtcgagcgaggcagaaggcagcatgccgatggaaccggtcagcatggaagcctcatccgacaggatgtcgccgaacatgttgtcggtgaccatcacgtcgaactgcttgggcgcgcgcaccagttgcatggcggcgttatccacgtacatatgggaaagctcgacgtccgggtag

SEQ ID NO: 12420 - DNA, 1254 bp, Pseudomonas aeruginosa
aggatggccggacgcaggttggcgaacaggcccagttgcgagcgaatcttcagcagaccgcgctcgggacggatatcgcgttcgatcctgtcccacttcggcccccctaccgcgcccagcagcaccgcatcggcctggcgcgcgcgctgcagggtctggtcggccagcggcacgccgtgcttgtcgatggccgcgccaccgatgacgtcctcggccagttcgaagccgagctggaacctgtcgttggccagttccagcaccttgaccgcttccgccatgatttccgggccgataccgtcaccggggagaaccaggatctgcttgctcataacaccctcttgtccttcattcattgaacggcgggcatgcgccgccgcgatcgaaccgtcactcccgacgcagccacagcaccagcacgtcggtgctgaacgagccgtcgtcggcaatctcgaaatactccctgacttcctcgcccaccgccagctgcaggctgcggatcgcctggcggaacacctccggcgtacgcatccgctcgacccacgactggaactccaggcgcaggcgctggcgccggcttccggttaccagcaagcccgcctcgccgctcaggcgcgcccactcggccggcgagtagttgcgcacatggctggtgtcgcggagcagctcgacggtctgcaggaaggtgtccggcaaggcctgcccgggcgccgccacgtcgacgaagatcgccaccccgccgggcttgagcacccgccgcacctcgcgcagggccaggccgacatcgcgccagtgatgggtggaatagcgactgaagacgaaatcgaactcgccgtcggcgaagggcaggctctccgccttgccctgttcggtacggatgttcgccatgccccgttccgcggcgctctgcgccaccacggcgagcatctcggcggaaagatcgtaggccaccacctcccctgccagggcggcgacctggaagctcacgtggccggcgccgcagcccaggtcgaggacccgcgcttccgggcgcccggccagggcgtcgcgcagcaaggcgaattcctcgccctgggcatgcacggcgctgctcaggtaggccgaagcctgggcgccaaactggcgctggacaacgtcatcgtggtcgctcatgaacctactccgggagaaaaaccgggcgcaccctacccaggatgcgcccggcaaggggactcgcgtggcgctcagcggaacagccagggctgctgctggcggtag

SEQ ID NO: 12421 - DNA, 1482 bp, Pseudomonas aeruginosa
ctcaaattcatatttttcatccaaagcattcccaacaggaatccattggcgctaagctccgggcagccgaaaccagcggaggcccgcaatggacctgaacagcctcaacaccttcatcgccattgccgagaccggcagcttctccgaagccggcgagcgcctgcacctgacccaaccggcggtgagcaagcgcatcgccgccctcgaacagcagctcaatgcccggctgttcgaccgggtcggccgcgaggtcaacctcaccgaggccggccgcgccctgctgccgcgcgcctaccagttgctcaacgtgctcgacgacacccgccgggcgctgaacaacctcaccggcgaggtcagcggccggctggtcctggccaccagccaccacatcggcctgcatcgcctgccgccgctgctgcgcgccttcacccgggcgcatccgcaggtggcgctggatatccagttcctggattcggaagtggcctacgaggagatccttcatggtcgtgcggaactggcggtgatcaccctggccccggaaaccgccgaaccggtgcgcgcagtcccggtgtgggacgacccgctggacttcgtcgccgccccggagcacccgctggcccgacagggcacggtgttcctcgccgacgtcgccaagcaccccgcggtattccccggcggcaacaccttcacccaccacatcgtgcggcgcatgttcgaagccgaagggctgacgccgaacatcgccatgagcaccaactacctggagaccatcaagatgatggtctccatcggcctggcctggagcgtgctgccgcggaccatgctcgacgaccaggtggtgcgcctgccgctgcaggacatccagctcagccgccagctcggctatatcctgcacaccgagcggaccctgtcgaacgccgcgcgcgccttcatgcgcctgctcgacgaacaggcattcggcaacggcactccagcggcctgaagcgattcaggtcggacgccacgggtaggccctcccctctttgccgtccgcggccagcgctcacccgacctgcatgccaatgccctcgcgactcagccctcgccgacccacgcctgcacctcgacctccacgtcgacccccagcgccagcccggcggtcaccgtcgagcgtaccggcaaggccccctgcacatgacgctggtagacctcgttgaaaccggcgaagtgggccatgtccgacagccagacggtgaccttcaccagttggtcgaaacgcgcgccacagctctccagggtctcgccgatgcgtgccatcaccgcttcggtctgggtctggatatcgccacgtaccacctcgccggtcggactcatcggcacctgtccggaaagaaacaggaagccgccggcccgcaccgcgcgggaaaagggaaacggcaggctgctggggtaacgctggatgtcatcgctcatctggattgcctcctgtggatgaagcgctag

SEQ ID NO: 12422 - DNA, 663 bp, Pseudomonas aeruginosa
gaagaaaagctttcggccgcggaatcggcgtattcatgtagcactgcgatcaaccctggctcatatcgacgcgctccgccagaaagtccaggaacgcccgcacgcgcagcggcagatagccgccctggccgacgtagacggcgtggacttcctccaggtcgcctgggttgtatgcctcgagcacgggaatcaggcgcccggcggctatgtcctcgcgcacctggaacgcggccagccgcgccaggcccaggccggccacggccagacggcgcagcgcctcgccatcgctggcctgggcgttgcccgacaacggcaccacgagttcctcgccggcgtcccgcagcggccagccggagcgcgttcgcacatagttggcgccgaggcggttgtgccccagcagcgcctgcggcgtggccggcatgccatgccgggccagataggccggcgcaccgacgatcagcatgcgcgtgctccccagcttgcgcgccaccaggctcgagcttttcagcggccccgcgcgcacggccacgtcggtgcgctgctcgaggatgtcgacgacctcatcggtcagcacgatatccagcgtcacctcgggatgctgcgcgaggaactcgggcagcagcggcagcaggaagtgatgcccgaaaggcacgttggcgttga

SEQ ID NO: 12423 - DNA, 786 bp, Pseudomonas aeruginosa
gaacgaccgttcgtcgtgctcagatcgaaactcatcctttcgagaaccgtcgctatggaacgcgcaatcccgaccttcccctgccgcgatctggacagcgccagcgccttctaccagtccctcggcttccaccttggcgctcgctatccgacctacgccatcctccagcgcggcgcccctggagctgcacctgtcgctgttcgaagcgctcgaaccgaagaccaattgcagcgctgcctacctgcgcctggaggacgcccaggcgctgcatcgccaggccgcggccctcggcctgggcggccaggggattccacgcatcacggccctggaagaccagccctggggtatgcgcgaattcgccctggtcgatcccgacggcaacctgctgcgggtcggccaggagctcgatgcgacgccagagcaacaccgggttcgcctggccagcgccgacgacgtccccgcggtggccgcgctctggcaagccaatgtccgcgaagccggggaaaccctggatgccggcgaccagcaggcgatccaggcactgctcctggccgcctcgcgcaaccgcttgctctggctggcggaggcccagcagcatccccgcggtttcgtcctcgcccacctgtggcagatcgaggacggtcaggcacgggtgggagagatcgcagagctctacgtactgccgcaggcccgccgccagggcctggcccgggaactggtgggcagtgccgaggaggccctgcgctcgcgcggcgccggcctgatccgcgcgcaatcggcccttga

SEQ ID NO: 12424 - DNA, 1635 bp, Pseudomonas aeruginosa
ccgtactccagcgccagcaacacttccgaaggcgtcatcaccccgggcaggtatggcaggccggcatcctccgcggcggcggcaaggcgcggcgtgcatccggggctgacggcgaactgcgcgcccgcgtcgcgtgcctcgagaaactgctcggtgtggatcagggtacccgcccccagcaggacctcgggcacctcgcgatggatggcggcgatcgcgtccagcgcctgcggcgtgcgcagcgtcacttccaacaccgtgacgccgcccgcatacaacgcgcgcgccaggtcgggcgccagcgccacgtcctcgatcaccagcaccggcaataccgggctggcctgcagcaggacccgatccagcggcaatgtcatgggcattcctcgattcgaaacggctcgccccgccggatcgctccgcgcgggccacagcgctttttaccgaagaaccgaggtcaggacaacgacaacccctctgctacgcgcctcaggaagcgctcgccgtcttttccacgcgccggcaagcgcgcatcgccgggcgctcctcgagcagcgccagcagcgactcgctcagcctgcgctcgccgagcagtcggtggtggccgccgcccggcaggcgcagcaagcgactggccggccaggcggcatggatgcgctcggcattttccaccgctacgcgcgtgtcgtcgtcggcatgcaccaccagtccgggcatttccagacggtagcgcgccacatccaggcacgccgcggatatgcccgcctgccgctcgaccaggcggatgaaatgcgagcgagccagggccggcaaaccgacgaaacgagcgaacaggcgcaactgttcgagaatccgcgacggcgccgagaccgtcaccagcgcttcgctgcgcagccccatctgggctgccagcaacgccgccgcgccacccagggaatgaccgaccaccgcacgcagcggcggcaactcgccagcggcctccagcaaggcgtgggcgaacagcaccacgttcgcctccctgcccggcgagcggccatgggccggcgcatcgagggcatacaccgaataacccgcgccgaccagttgctcgatcagatgggcgaactgtgtcggcctgccggcccagccatgcagcagcaggactgccggcccctctccccagcgcaacaccgacagcccgaagcgcagagtgacgcgctccgagctggccagcagcggcagctcccaatccttcggcggccactcgccaggcaccatgaacgtccgacgcatacgctcggccgtccaacgcggcgcgatgcggccgatcgtcccgttgaaaccgcgaatccaggtcaggctgctcatctcgcacctcctcagttcaccgcctgcttggcggcacgcagaacccggtcggacagctcccccggccccaatgcccgggccagcgccaaaccgccaatcatcagcaccaggtcggccagggcgacgtcggtttcctcgggactttccgccaggctggcgaccatgatctcgacatgtctgctcaagacctcgcgaaacccctccggcaggcgcgccacctcggctagggtcgccggcagcggacaaccggcgtcgacctgtgcgtcccgatgcttgcgcgacaggtag

SEQ ID NO: 12425 - DNA, 1692 bp, Pseudomonas aeruginosa
aaaattttaccggaagaacaatcacttacctcccctcccccaaaaacgaggcccgcaactgggcgggcctcgtcatcgactgtggaagaaagccggtcagccgggaatggcgtcgcggatcttctcccattccttggtttcctttttcgacgccccgcccagcagctccagggcctggcgcaagcgatagcgcgacaggtcggcgccaaggatctccatggcgtccagcaccgaaaccgagctggcatgcccggtgatggccgggaacatcagcggcatcacgtcgcgcagcttgagctggaggtgttcggcgacagcctggatgcagccggtgatgcgttccttctcccactggcgcagggattcgagtttccacagcaccagttgcaggacctggcggacctgggtcggatcgagcttcttgtgttcgaacagcgaagcgtccagcggcaccccgccgctgaagaagaatccggccagcggcgcgatctggctgaagttctccacccgtccctgcacgtgcggagcgatcttcatcaggtattcgggattcaacgcccacttctgcacctcacgggcgaactcctccacggactgctcgcggatccactgcccgttcagccaggagagcttctccaggtcgaagatcggtccgcccagggagacgcgcgacaggtcgaaatgctcgatcatctcggcgagggtgaatttctcgcgctcgtccggcatcgaccagcccatccgcccgaggtagttgagcagcgcctgcggcaggtagcccatgcgctcgtagaaggtgatagaggtcggattcttgcgcttggacagcttgctcttgtccgggttgcgcagcagtggcatgtagcacagctgcggctgctcccagccgaaatactcgtagagcttgatcagcttgggcgccgacggcagccactcttcgccgcgcaggacgtgggtgatgcccatcaggtggtcgtcgaccacgttggcgaggaagtaggtgggcaggccgtcggccttcatcagcacctgcatgtccatgcgatcccacggaatctcgacatcgccgcggagcatgtccggcaccacgcagacgccctcggtcggcaccttcatgcgggtgacgtgggactcgccggcggcgaggcggcgctgcacctcatccttcggcaggtgcatgcagtggccgtcgtagcgcggggtttccttgcgcgccatctgctcggcgcgaaccgcatcgaggcgctcgggcgtgcagaagcaggtgaaggcatggcccttctcgaccagttcgtccgaatacttcttgtagatatgcccgcgctcgctctgccggtacgggccatgcgggccgccgacgtccgggccctcgtcccattcgatgccgagccagcgcagggcgtcgtagatctgctgctcggactcccgcgtcgaacgcagctggtcggtgtcctcgatgcgcaggatgaactgaccgccgtgctgacgcgcgaagcacaggttgaacagcgcgatgtatgcggtaccgacgtgcgggtcgcccgtcggcgacggggcgatgcgagtacgaacagtggtcatggagactctcttgccaagcggaagttaaaacggaaattcaggggcgcgatgttatcaggcgggccgcctccggctccagtaaacgaccggtgtcggccggcaggcggctga

SEQ ID NO: 12426 - DNA, 888 bp, Pseudomonas aeruginosa
attggccgaattttgccgacggaacactccacccatgcccgcccaactcaaacgtcgcctgaccgtcttcctggtggccgtcggcctgatcgccctggccttcttcctgcactggtggttcatcggccgccacgtggaaagcaccgacaacgcctacgtccagggcgagatcacgcgggtggccagccagttgggcgcgcgggtcgaggaagtcctggtgcgcgacaaccagcacgtggacaaggggcagctactggtacgcctggaagacgccgacttcaagctcgccgtcgagcgcgcccaggccgcgctggccacccgcgaggcggaactggcccaggcgcgcagcaagctggtgcagcagggcagcctgatcgccgccagcgccgccgacgtcaacgccagccaggcaaccctcggtcgcgcacagatcgacctgaaccgcgccgaagccctgcgcaagcccggctacgtttccgaggaacgggtcaccaccctcaccgccgacaaccatgtggctcgctcgcaactggccaaggcccgcgccgacctcgaggcacaacgcgtccagcgcgacaccctgggcgccgagatcaagcgcctggaagcgcagatcgccagcgcccgcaccgaactggcgcaagccgaaatcaacctgtcacgcaccctgatccattcgccgatcagcggcctggtcggccagcgcagcgcacgcaacggccagtacgtgcaggtcggcacccatttgctgtcgctggtgccggacgaagacatctgggtccaggccaacttcaaggagacccaggtaggccgcatgcgcgacgggcagaaggcgcgcctgaccttcgacgccttccccgacacgcctatcgacggccgcatcgatag

SEQ ID NO: 12427 - DNA, 234 bp, Pseudomonas aeruginosa
aggatcgccttgccgtgcaggttgcgcgcggcacgaccgatggtctggatcagcgagcgctccgagcgcaggaagccttccttgtccgcgtcgaggatcgccaccagcgacacctcgggcatgtccaggccttcgcgcagcaggttgatccccaccagcacgtcgaacgcaccggcgcgcaggtcgcggatgatctccactcgctcgacggtatcgatgtccgagtgcaagtag

SEQ ID NO: 12428 - DNA, 1242 bp, Pseudomonas aeruginosa
cgggttgcgttgccctcctctcttcacactccgagcagccgcaaaatgagtctgttttctgccgtcgaaatggcaccgcgtgatcccatccttggcctgaacgaagccttcaacgccgatacccgtccgggcaagatcaacctgggcgtgggcgtgtactacaacgaggaggggcgcattccgctgttgcgtgccgtgcaggctgccgagaaggcccgcatcgaggcccacgcgccgcgcggctacctgccgatcgaagggatcgccgcctacgaccagggcgtacagaaactgctgttcggtaacgagtccgagctgctggccgccggccgtgtggtcacgacccaggccgtcggcggcaccggcgcgctcaagctcggcgccgacttcctcaagcgcctgctgcccgacgccaccgtggccatcagcgacccgagctgggaaaaccaccgcgcactgttcgaagccgccggcttcccggtgcagaactaccgctattacgacgccgccagcaatggcgtgaaccgcgccggcctgctggaagacctgaatgccctgccggcccgttcgatcgtggtcctgcacgcctgctgccataatccgaccggcgtcgatctcgagctggacgactggaaacaggtgctggacgtgctcaaggccaagggccacgtgccgttcctcgacatcgcctaccagggcttcggcaacggcatcgaggaagacgccgccgcggtgcgcctgttcgcccagtcgggcctgagcttcttcgtttccagctcgttctccaaatccttctcgctctatggcgaacgcgtcggcgccctctcgatcgtaaccgaaagccgcgatgaatcggcccgcgtgctgtcccaggtgaagcgagtgatccgcaccaactattcgaacccaccgacccacggcgccagcgtcgtctcctccgtgctcaacagcccggaactgcgggccctctgggagcaggaactgggcgagatgcgcgaccgcatccgcgacatgcgcctggcgatggtcgagcaactggcagcccacggcgccaagcgcgacttcagcttcgtcggtcgccaacgtggcatgttctcctattccggcctgaccgccgaccaggtcgagcgcctgaagaccgagttcggtatctacgccgtcagcaccggccgtatctgcgtcgccgcgctgaacaaatcgaacctggagaccatcaccaaggccatcgtccaggtcctgtag

SEQ ID NO: 12429 - DNA, 315 bp, Pseudomonas aeruginosa
tcaagcgccttgccggtgaactcggggggtgcggatcgccttcgggtagccgcgcaaccgtgccatctcgtccagcgcccgtgtgacacgaaaaccgctgataccgtgctccaccaggatgccaaccgactccttggtgaagtcatcgaccaccgtcaggcatttgatccgtcgcccagtgctgagcgcgtcgaagacgaaatccatcgacaagacctagttcggtgcgctcggcaggctcaggcattcgcatgccaccgcgcccctgtggcggcgcctccgccgcttcaccatcaagccgacggctcggtatag

SEQ ID NO: 12430 - DNA, 501 bp, Pseudomonas aeruginosa
cgagccacagagctgttcatgcatggaagccttacccagcaagcacattacaagcttcagcagcaccgctggaaacgtgaaaagagctggacgcctgcccattccccgactcagggcctcgatcatttgcgcaatggaaacatcctcgccatccgccaccagaaacagttcgcccgcagcatcggggtgttcggcacaaagactcaggaaacccacgatgtttctcctagaaaccaggctgcgcgcattacggacaccgtcaagcggaagcggcagaccactagcgacgagcttgagcaaacggccgaagttacctggcgcatcattggcatagatcaaaggcggtcggacaaccaccaactccatacctttaccccggagcaaagtccccagctcctgctcagcctcgtatttggagatggcatagggcgcatgtgggccggctggagaatcttcgttgaaagcctgttgccgggtgctgttaccgttaacgccaattga

SEQ ID NO: 12431 - DNA, 312 bp, Pseudomonas aeruginosa
actgacaaacacgaaacgcttcaccccagcctcgagcgcacgggtagccaaccggacagtcgcatctcggttgacttcacgaaatgcggcgagcgggtctgcaaccttgtcagtgagtatatgggcacgtccagcgagatgaataatgcaatccaccgtcgggaactcgccggcaaacgtggctggatcggtcagatcagcttcgatgtacgtcacagaaggtattctttcaacaacccgccgtaccaccgcaatcaccgcataccctgtccgagcaagctcacagcacaaggccgatccgacgaatcctga

SEQ ID NO: 12432 - DNA, 1380 bp, Pseudomonas aeruginosa
aaacacaccttgattcggtcgagcctagagaaccacgcgcaagcattgaccggcgtgatagagagaaaaacccatctcgtaggcgcaactgcgcagcctggccgcggggacgggcttcatgtcactgaacggcaacggcaatgtcgctcgctcgccgctcagcaagtagtcggcgaacgccttgcccactaccgtaccggtggtcacgccgcgtccgttgtagccggtcaccgccagcaagccttccgcaggctcgaacaggcgcatcagatgatcgggggtgaaggcgatgcaacccgtccagctgtactcccagttgacctggcccaggtcgggaaagtaatggctctggattcgatcggcccattgccgcaggaaccaggcgggcttgttcgcgccattgccgaggcttcccagcaacaggcgaccctgggcatcgcgacggatgctgctgagcaccgtcctggtgtcccaggaaccctggccgtgaggcaggatgcgctcggccgcggcgccgtgcagcggcgccgaagccacctggtagtagtagccgggaaagaagtgccgcctcaggttggtccactcgccctcggtataggcgttggaggcgatcaccacctgttccgccagtaccgcccccgcgctactgcgcaccgcccacagcgcgccctgccgctccagggcgagcaccggcgagcgctggtacagttggccgccccgctgtacgacggcggtggccagtccgcgcgaataggccatgggattgagagtgccggcgcgtcggtcgagcaacgccgcgctgattcgccgggtgccgcaggcctcgtggcaagccgcgccggtcagcaactccagcggagcgccgcggcgcgtccactgcgcgtgacggcgttgcagatcggccacgccgctggcgttgtgcgacatgtgcagggtgccctcgcggcgcaactggcaatcgatgccgaggcgttcgatggtctccatcaccagcgccggcgcccgccccagcacggcgttgagcttttctccctgctcggcgccgagggtggcgaccacctcgtccgggggaatccaggtgccggcgttgatcaatccgacattacgtcccgacccgccgtggccgacctcgtacgcttccagcacgcacaccgaacggccggcctccagcaggtggagcgccgccgaaagcccggtgaaaccggcgccgatcacacatacgtcggcgcgctgctcgccgttcaggctcgccgctccggacaggcgaggcgtaaccacttcccacagacaccgttgctgcaaaccgcccatgcgcgactccgctgccagcctcattgccatgcggcgggagcccgccgcgccccgttcaatcgaaggtga

SEQ ID NO: 12433 - DNA, 333 bp, Pseudomonas aeruginosa
agatgcacgacgacagtccctggggaacctcgttgttcaggcgcagggcctcgtcgaaatcgcggtagccgaccacgtacaggatcggtgcgaaggtctccgtgcgcaccacttcggtctgtcccggcatctcgacgatggccggcgacacgtagtaggcatccggatagcgctcctgcaattgccgctcgccgccgaacacccgccccccctgctcgcgggctcgcgccagggcgtcctgcatggccaggtagctgcgttcgtcgatcagcggcccgaccaggttgccctccagcggatgaccgatacggaccctggaataggctgccttga

SEQ ID NO: 12434 - DNA, 705 bp, Pseudomonas aeruginosa
gacggcaacccacgaagagaacgtcgccgagaacaagtacgacaccctcggcctggaagcggcctacctggccgccgggcagtcgcgccgggtcgaggagatccgccaggcgctgggcctgtaccgcaacctggtgctgcgcgatttcgacgaggaacagggcatccagctcaccgcgctggtcaccctgctgaacgccgacggcagccggcgaacagtgttcctcggccccgaggcggccgggctgaagatcgattgcgaaggtcgcgaggtgttggtcatcacgcctcgctcgccactgggccagagcctgatcggcaggcacccgggcgacgagaccggggcgaaggactccccccttgcggtggaaatcctcgccgtcgactgaggctactgctgcggcgcaccgcaggcgccgcagaacttcgcgcccgccgcgagatcggcgctgcaggcgatacagcgcagcggcgccagggcgccgccgcagccctggcagaatcgtgccgtcgccgcattcgcggtgcggcaggcgcgacaggccattcccgccgcgactggcgccggcggatagccgccctgaccgcggtgatgaccgccgccgtgatgaccaccgccctgtccatgatgacgcccacccatcaacaaccgttcgaagaaccccatggcacaaccctctcgtctggatctgacggcttccagtga

SEQ ID NO: 12435 - DNA, 567 bp, Pseudomonas aeruginosa
ccggcgccgccgcgtgcctcgatcgccagtacttcctggctgatcgcgttgcgcgccacccgcgcggtattgcgcagggaacgcatgatcaggtcggtggaacgctcgtcggccgcacggatcgccgccttcaccgcagggtgtatcggacattcgcgagtggccaggaagcgcgtgcccatgttgatcgcgtcggcgcccagcgccagcgccgcgaccaggccacgtccatcggcgaaaccgccggaggcgatgatcggcacgcgtagccggttggccgcggccggcagcaacaccaggccggggatgtcgtcctcgcccgggtggccggcacactcgaagccgtcgatggagacggcgtccacgcccagtcgctcggccttgagcgcatggcgcacggcggtgcacttgtggatcaccttgacgccgtgtcgacggaattcggcgatgtgctcgccggggtcgttgccggcggttttggaggacgggggattcccgtctcgaggagggctgcgcgatattcggcatagggcaccggcttctgcgtcggcagcaaggtcaggttga

SEQ ID NO: 12436 - DNA, 786 bp, Pseudomonas aeruginosa
gcgatgcccgccggcaggaccagccgctcagcggccagcaacgcaacgcgctcgtcttccggcagcagcggcgccaccagcccggcctcgatcagcggctcgggcagcaggccgcgccccagcgcctccagcaacgccgcgtattcgctcatgcccaggccgctgccgcccaacgcttcatccaggcgcagcgccggccagcccatggcgcagacctcgcgccaggcctggcggtccaccccgctaccggtgaaacgaccgcggcgcacgcgggtcaggtcgccgtcgcgtggcaccagcgaagccgcgctgtcgcggatcatccgcagacgctgctcgcgctcgccggcccactcgtcttgctcactcatctgttcgccctcctgtcgatacgccgtccgcccgtccgtcatctgcacgggaggcgccggcttgtccgcgcggagcgaccgcgcaggccgtggtccggacgcgcgacggatggctcccgctgccgcgccgccggaaatccgttacggcttagccgcgcggtacctgaagctgcccgaggccatggcgatgacctcgccgtcctcgttgcagatttccgccgtgcagaagcagatcgtgcgggtccgtcgcaccaccctgccaaccgcacgaagctcgccgcgggcgctacccatgaagtgggtagccatgtcgatggtcaccatcgagcagtccggcaggcaggcacggatcgcctgggccatggcggcgtccagcaccgacatcaacaccccgccgtggaactgttgcaggtag

SEQ ID NO: 12437 - DNA, 1122 bp, Pseudomonas aeruginosa
cccgggtccggccgatcacctcgccttccgccggcaacggccgccgccactccaggcgctgctcgccgtgaaccaggcgcagcgcgtccacgccagtcgccggattgcccagccagaagcccggatgaccgagcaccagggccatgcacggcaatgcctggagatcgcggcacggatcgacgtaggccagctggcgctcgtccagcgggtcgccgcccagaccgagggtcaatgcgtagaaggcgctgtcgcgccggctgtagcgctggcgtacttcggggatcgggtagttcaggagtacctcaggatcgagcgccatcggccacctcgtcgacttccaacaccgcatccaccgcccaggcgccctggccctcccgcaaggcgatgaccgggttgaggtccaccgagcgcaagcgctctcccgcctcccaggcgaaccgcgagagattcgacagcagccgtgccagcgccgcgacgtcggcccgcggccggccacgcgcgccgaacaggagcggcgcgcctctgatgctacggatcatcgcctcggcttcgtcgacctcgaacgggcagcggcggaacaccacgtcctgcagcacttcgacgaagatcccgcccaggccgaacaacgccaccgggccgaacagcggatcgcgctggatccccatgaagcactccaccccgccctgcagttggcgcgccaccaggacgccatcgagacgcgcctgcggcgccttctcggcggcccggcgcaggagcagttggaaaccggcgcgtaccgcgtccgcatcgcttacgccaagcagcacgccgccgatttccgacttgtgctggatgtccgccgaggcgagcttcagcaccaccgggtatccgatgccctcggcgaaggcaaccgcctcttcggcactgcccagcaccgcctcggcggcggactcgataccggcgcgcgccagcaggcgcttggcctcggcttcgccgggcgtggaggcgggcaactgtagcccgccggcaggccggcgcaggcgcaacggccgggcgaaggcttcgccgagccgccccatggcctggatcgccactaccgcccgggtggggtcttcgaacagtgcgaagccggcctcctcgtag

SEQ ID NO: 12438 - DNA, 1410 bp, Pseudomonas aeruginosa
  unsure (93),(101): Identity of nucleotide at the above locations are unknown.
tccgtttgtctgtggccggcacgacaaccttctcgcgggcgagcgggcccgcgggacgccgccacggcagcgcccggaatgcctgtcggccangggtctanagcgtgtcgccggtaccgagcaacgcggttacctggctggacagcgtgccgccgttgccgtgcagcaacgccacgtcggccttggccccactgccgctcgccggccctggcggcggagctgggtcaccgcctcgatgatcaggaacatcccgtacatccccggatgcacgcaggacagcccgccaccgttggtgttcaccgccaactcgccgccgggcgcgatgcgtccgccctggacgaatgggccgccctcgcccttggcgcagaatcccaggtcctcgaggaacagcagggtgttgatggtaaaggcgtcgtagagcatcaccaggtcgatgtcggcgtgccgcacaccggccatctgcatggctcgcggagcgctttccgaggccgccgtcacggtgaggtcgggcatcgacacgatcgagcgatgccactgcgctccggccgcgccaaggaagtacaccggcgcattgggcaagtcgcgggcgcgctcggcgcgcactaccacgcaggcgccgccgccgtcggtgaccaggcagcagtcggcggcactcagcgggtcgctgaccatccgcgcggcaaggacgtcatcgacgctcaacggcccgcgggcgaacgcctcgggattcaggttggcccattgccgggcagagaccgccacctcggcgagctgctcgcgtgtggtgccgtactggtgcatgtgccggctggccgccagggcataggcggtgatcgggtggcgcggcttgtagggcgtctcgtgccattgtggctcgctcatcgataccaggcggccgccggcggttcgctggttggagccgtagcagatcagcgcagcgtcgcagagaccggcctccagtgccaaagtggcctgcagcaggtgcagctcgaaactggagccgccgatattggtgccatccacgaatttcgggcggatgccgaggtattcggcgaccgacaaggtgggaaaggcatgggagctggtggcggcgaagatcgcgtcgatgtcggaaagcttcaggccggcatcggcaatggccttgagcgacgcctggccgagcagttcgatggcgctgtagcccggcgcctcgccgacgccggcgctaccgatgccgacgatggcggtcttgccacggatggctgcgctcatggtcgtccctcctggtggggaacgaacaccacgacattggcaccatcctgctcgacgatgcgcgcctgcacacgggtgccgatcggcaggctctggtgcccgtcgatccgcgacatcatgcgcacgccctcgtccaggtcgaccagcgcgacattgtga

SEQ ID NO: 12439 - DNA, 816 bp, Pseudomonas aeruginosa
atgaaaagaggaaaaatgaccaaggacgccacaaccaaaggcaccagcagcaaagatgtcggcgcggtagtgaacgccattcagatacttcgccacctggcccacgccgacggaccgcaaggcgtggccgccatcgctcgcgccaccggtatcagcccgagcagcgccttcaatatcctgcgcaccctgagcaacgaacgactgacatccttcgacgatgcgggcaagacctaccaactgggccttggcctgtcggaactggccgtaggattcgtcggacgcagctatgccgacctgatccagccagagctggagcgactaagccttgcccaccacatcctcatcgccctgtggcaagtcaccgacgatgcgcacatccgcgtcatcgcccttgccgcgccgcccgtcgcccacgtcaacgtcgccgtcggcacgcgcctgccggaactggtcggcgccgccgggcgttgcattgccggcctgcgcgaactgccggaggacgaactgcgccgccgactgacccgcgtgcgctgggaaaatccgccgagcttcgagcgctaccaggccgaagcgaccgaggccgtcgagcgcggctgggctatcgaccaggaacacctttaccgcggcgtgagcatggtcgccagcgccatcaccgaccgcgacggacaaccgcgcttcgccatctccgcgatcggcatcagcgcccagcaccagcccgacgacctggaacggatcggcaccagcctgcgggataccgcgcgcttcgtgagccgcgcgctatttccccaaggcgaggcactgaaggggaaatcctga

SEQ ID NO: 12440 - DNA, 345 bp, Pseudomonas aeruginosa
acccaactcctgatcaatgaccgcctcggcggccgcacactgctcaccggcggttcgctcacgtaccaggcgctgggcttcggcatactgctccgcggcctgctgccgtccccgatccacagcctgcgcggcatcccgggcccgctgttcgccggccacgcgcagcgcggcaacctgccggacctgctctgccactgcggactccaactctccccgggaggcacggcaggcagccagatccgcgctcgcggcatccaactgcggccggtagtgtcgcgcgccgagccagacaccgccggcggtgccgaggccgaccagcaccaggcaggccagcgcgaccgataa

SEQ ID NO: 12441 - DNA, 2853 bp, Pseudomonas aeruginosa
ctgatccaggcgttggacggttacggcattgttcgacgcaacgaccgactcgacggttgcgatcctgccctccgccgtcacagtccgcgcttcaagcaagctcgtccgcttcgcctgcgcttcgtcctcgttcgcccgcacggtgacttcggtggcggctcgagcaatggtgtcccagcccttcagcgcatcggccttctctccggtcgccggctcccggcgggcggcagcctgcagaacatccaggctcgaagccgccgcttcgaccttaccgtcgagctcggtgatatccgcggtgttggtggccacctgctgggccaggccgttggccgtctcgatcgactgtccgatgtcggcccagtaggacgcgttcggcggcgaggcgttgagcggcaccgcctgctttgcctgatacagccggttgccgacccgcacgatatcgttcttcgcgtaggtcttcgtcgggtcgtaggccagcacatcggacagattatcgatctggccctgcaggccactgatatcgacctgcatctgatcgatgtcggcgaagaactgctcgcccagcgcggactcgacgtactccttggtgatcagttcgttgtactcgctcgcatccgtcgagctgataccgtcgacccaggccgaccaggggccgacgttgcctgtccggtcgatcagccgcccgcggaaggccaggcgagcgccggccgccagcgaggtcagcgtgtgggtgtcggtcgggtacgcgaacaagcccagggcagttgcgttctgttcgctgccgcccggggtaaccgactgttggatctcggtgtaggcggtgtccgccgcgccactggccgggaatccccactccaggccgatcttccacggtccgctggtggtacgcaggaacgccagcgccggcggcgcgccggtcttaccggtgatgttggtcaacaccgagttcgctgggatcgacgacacgttcatggagttcacagcccgcacgcgcgcaaggtactggccggtgtataccccacgcacttccaccatcagctcccccgtacgcggaaccctgacccactcgcgcgagccccagcgccactctacgtcgtacgctaccgcgtccggtgccgcgtcccaggcgatggtcatgatcgtgaccgccaggccttgctcgaccgcgatgtgctgcgagatcaatacgcgtgcaggcggatcctgcaccccggacggcaggacgctgatcggccgagaatcgatgatcgccccgtgatcgatcgcatcaaacttgccgggctcgtgctggataacctcaagctggaattgctcccaacttggtctggtcacgttcttgacgtagaactgcatcagggccaggtcgtcgtagtcgatcgcccaaccgctctcgggggaaggctgttcactgaagtcggccaccaccgttatgacgcgtccgtcatgaccttgaatcgccctggcttccgagcgcccactgggcaggttgactcgcagccgcgcgccgaccgggagatccacatctcggtctacggtgattgctcgtccagataccgccgagatcctgccgccattcgcacgaccggcaagcatggggtctgccagagccaccacctgtccaggccgcgggatgaatccatccaggccaaccttccagacggccccacgagtctgcaactgctcagtcataagcgcccactgccccgcccgttgcgcctgaccctggctggtgcagccgagagccccgaccgatacctccctgacgatcccgccaagctcgataatcgcatcctcgtcgaagaccgcctccttgtctgtctcgaacgcattggccgggttgtcccaagagaccatcgccagcgaatggcggtctcgcgtccgcgtccccgaatacgcaaccacaccatcgttcagaatctgcgacgtggtataggtgtaaaccgggtcctgaggcatgtcggcgttgacagtgatctggctaccatcccagaacgccaacccatgaaagattgcagcgagatcctgaagaacggcatacgcctcctcttgcttctgaagatagaggttgcaagtgaacctaggctcttgaccgcccttcccatccggaaccaactggtcgcagtactgcgcaatgcgatagagggcccaacggttgaccatgctctggtcgatgcgctcacccaggccgtaataggggttcaacaccaggtcatagaaaacccaggccggattgttggaataagcctccttgaaggtgccgtcccaaacgccattcgtggtaccggggccgccggtaaaataggtccgagtctcagggtcatagttcatcggaacccgcacgatccgcccgcgcatgagcgcagagaacttcggaaagtcgcccccgaactgctgggcgtcatactccacgcagccaacggcggtgagcggaaactcctggttgctgtcgacaacttcagctatcgcagtcagcaccatggtgtcctggaccagagagctgttcgcctccggcgtgatccgccgcacgcgaaccgcccagtgccctcctgccggcaggttgatccgatgagaacggtagtaagtcgtaacgttcttccggtcgacaaacgtgctgagtacggtctggtaaggagcgccatccgtggcgacatcgatcgcgtactcaatacgcaccccattgatgttcccggacgaatcctgcgcctgcaggttgggccaggacaggcgcacgcgtaccgcatccgccgtggcgttcgtgacggtgtagatgtagggctgcgtgctgagcaaggtctggcccaccgcaatctcgttgctggactccgctacaccttccagtcgctcctgatttaa

SEQ ID NO: 12442 - DNA, 1605 bp, Pseudomonas aeruginosa
acacctcaaagaaagaggggccggtctcccggccccctccaatcagctggcggtcagcgaaccagtcacgaaagcctcggggcgatagaccgcgaaggccagccgctcctcggcgcggatggtgaccatgttgttctcgaagtccttgtcgttctcggtggaaaccagaacctcgatgtccatgcggtcgaagatctgggcgccgagagagaacgcaccggtcaggaactcgtcctgagtgatggcctgggtttccaccaccggcagacgccagagggtcggagtggtgccgttctgcgggctgccgatgatgtagcggttctcggcgtccttggtcaactcgatcagcgcccagtcgatggggttgagcacgataccgctggccgggaactcggccagttgcgcctgaaggatcgccaggcggatgcggtcgattcgctgctcggcagtcaccactacgccgctcggcggagcgtaggcctgtgcctgcggaatgatgccgtgcaggttggcgccggtcccgttcccgtagagcagttgaccttcttcgaccagcatcaggccgtaacgagcacgcgcatcgatgtagctctgcaaggccgatgcgtcgtccaggatctggcgacttgccttgaacaggtgggcgatggtgcgaaccggcgcgttttccagctcgaaggtgaggtcggagtacggcttctgagtgccttccgaaacaggagcggcattgttgacgaagccggtctcgcggacgtactcgacggagttcgactcagtggtgccaggcgcaaccaggtcgcggatggtcagtcgacgctgcggagcggcaacgacaccgggacgacgatcaggagcaaccagggcaccgccagagctgtcgatggaggtgatggccgagcgcggcatggatacgcgatgcgaaccgcgcagggagctggttaccccctgctctttcaggctctctgcgaccatttggccggcggtcttcggtgcttcctcgccgccgtcacgcttctcgttggccagcatggcttgttccgcggcgctcagccgtgcttgcaactcaccctgcgttaccagaagtttgtcaacatcggctcgtgccgacttgctcatctcgccgaagttggcgatctgggtgttgacttgttcggcctgagccttgatctggtcgccgacctgcttgaggctggcgttcagttcgccgatttgtttttcgaagtcgctcattgcgattctccttggaggaatttggtgatgtcttgtgctgcccgtagtgcagcggagaggtcaggagcgacagcgccaggcatatcggtcggggtgtcaccacccccgccagcagcgccaagcatgctggtcttgaagtcgttgatgagttcattgcgctggcttctcggcattccgctgcgagccagggcggcatccattcggcgcttggccaagatggcttcgctgcggttgctgggagcgctggagatctcatcggactccaggaaggcatctgcccaccctttgtcgacggcttcgcgcccaccgatccaggtctcggcgtccatctgcttcacgatgtcgtcgatgtcgattcccgtgcgctgtgcgtaa

SEQ ID NO: 12443 - DNA, 669 bp, Pseudomonas aeruginosa
cgttcaaggagagaaacgatggtcgatttgcacgatgaatttggggaaagccgaattttccacgagaagcgcatagaccgaaggtctgtcgatgcactcgcaggactggccgccgggatcactgctgatgggcatatcaatcagcaggaggccgagttcctacaggattggatcgctacgaacctggtccatcttgacgatccagtgaccaacctcctctacaggaggctctcagacatgctttcagatggtgtgttagacgctgatgagtccgccgaactgctcgagattcttagaggatttggcggcctatctgcttccaagccgaagccgagcgacaataccttcaccccatcaaatgctcttccgctcaacaacccagcgccaaagcttgagtggtcaggtcacctctacgttttcactggcgtcatggtctacggacccaggaagcattgcgaagagatcgtcgtcaaccgcggcgggggaatagcctcaggcatcagcaaaaaggtgcactacctggtcgtcggcgagatcggcaacgagcagtggctacacagcacgtatggaaccaagatcaagcgagctgtcgagctgcgcgaggaagggcatcccattgcgatcatcagcgagaagcactggcaagcctcgatgttcaatctggtctag

SEQ ID NO: 12444 - DNA, 783 bp, Pseudomonas aeruginosa
aaggccgcgcaatgcgcggcctttgcattggaggcatggatgcaccttctgtatctcgatgagtccggaagcgtagccgacccaaaccagcgtttctttgtgcttggcggcgtcagcgtctttgagaggcagtcgcattggatagagactgagctgaacaaaattgccgaaagattcaacgccgaatctccatacgacattgagttgcacggctccccgatgcgatctggaagggatgggtggaaacaccatcccttgagcgcccggattcaggcgatcaaggatgcgctggcagttagccttaccagcaagaatgttcgtcttttcgccgcagttatcgacaagcgcgtatttgcaggcgcagaccctgtagagcacgcattcgagaagctatcgatgcgcttcgacctctttttgcggaggctctacaccaagcatggagatgcgcagagaggaatcatgctgttcgacaagagcagcactgagcgaaggattcaaacgcttgcccgcgagttcaaacacactgggcacagccagggccaaacgaagaattatgctgaggttcctgttttcctggactccaaagcttcccggctgatccagcttgccgacctggtagcttttgctctattccgaaaattcgagcacgctgacgatcagttctttgatgtcatcaaggaaaacttcgatgatgatggcgggatacagcacggcctttacctcagaactcaaagcgggccgccccctgcagtaatcgcgcaggtccaaccggcaaggatctag

SEQ ID NO: 12445 - DNA, 645 bp, Pseudomonas aeruginosa
cggcgcccacgagtacgacgagaacggcctcctgcgcggcgagagctgctgaccaccaccaccctgccggtagcagggcatcaccagctccaacccatttacccatccgggcgcactatcgcccaacccagggcaaacctaaaaaggaaaccagccatgaccaccattcccgattcgattcacccgagtgatcttcctgaaatcggccagaccctcgctgatggaatcttctttgcccgccattggctcaatggcaaggaatacgcctacgtcgatctcagcaaaagcgccgagttcactggagaatggggcgagtatggccaggacgtggacggcgccgtcagctaccgagacggagcttcgaatacggtctccatggctgaagctggaagcccgattgccaagcaagctatggagatcggagaaggcgtattcattccttctgttctagaactggctcttctgttctccgccaagcaagcaggcgagctgtctggtttcgcagatcgctggtattggtcgagttcgcagtcctccgccgactacgccttccgcacgtacttctacgacggcgacacgggcctcaacgtcaagggctacggcttccgtgtccgccccgtccgcaagattctcatccttcagtaa

SEQ ID NO: 12446 - DNA, 702 bp, Pseudomonas aeruginosa
ttctctcattcaatccatttcgccgcaggcgattcgcgggaccgtaacccaccgacgagtcagaccagaagcctgccgggaagcgccggccgcctgcccttttctttaggagccaccatgaccaccatcaccgttaatgcaggaagcacaagccttaccaccgacaacccgcagtttgccgcagtagttcttcagatgatcagcgaagagaccgggaatgcatccttggctgaagttgatggaatccccgctattggcgcggaatggcccgtccagggcggaatctatgctggtctcatgcgcggtcgtgacgggcaccctgactaccacctgatcgtcgcctccgcagaaagtgatggtgagcttcagtggggcggctacggaagcaagtcctcagcgaccagtaagtgggatggtcttgccaacaccaaggctctcgtcgaggaaggcgggcaccctgcggcggagttcgcagccagcgtcaccatcagtggccataacgacttctatctcccggcccaggctgaactgatgctcgcctgggcaaacgtcccggaggtcttcgcagaaggatggcactggagcagcacgcagtactccgcctacggcgccttctacacgagcttcctcgacggcgacacgtacggcagcggcaagtacgacgacttccgtgtccgccccgtccgcagattgcttcgctaa

SEQ ID NO: 12447 - DNA, 789 bp, Pseudomonas aeruginosa
cccctcccttcattggctgcgcatgcgcggcgaggatcactcatgcatacccaaaacatgcggctatgggatcaggttcaagcaaccgacccatctgccaccaagagcgcaaaagtcgatggtcagcagatcacgtcgatcagcggccagcacatgatcatgaaggctacccagatgttcggccctgtcgggatcgggtggggctggacggtcatcgaggagcgctttgaccagggcggcccgatcttccgtgaaatcaccgacgctgacggaaagaaggtcagcgaactaattggtcacgaagtcgggcacaccgtgcgcatcaaactgtggttcgaattggacggcaagcgcggagaggtagagcaatacggttgcacgccgttctcctaccggtccaagtggggaatcaccaccgacaccgaggctccgaaaaaatcactaacggacgccgtgaagaaatctcttgcgatgctcgggttcagcgcggacatcttccttggcttgttcgacgaccgcgactatgtggaagcacgtcgtgaagaggagcagatcgccaaggccgaggaccagcaggccgcagaagagcaggcgaatgaagagcgcctcgcctacatcaaatcgattatcgagacgatgcaaggcgcccagtcccagtacgaactcaagaagatccacgacgttgccgtgcgcaagctcactgcgcgcaaagacgatagtggcgtcaagcgcattgctcgcgaattctccgagcagatcaagcgattcaccgaggagaaggcggcatga

SEQ ID NO: 12448 - DNA, 387 bp, Pseudomonas aeruginosa
aagacggcaaggacgtacccggcgctcatttggagcgggcgaagtcttcaatcaggatcaagtgaggaaagcagcatgagcgtgaaatacgatgttgtggcaaccgttggccagtacgagaaagacggccagaccaaatacctgagccgaaaagtaggcgtgatcgtcaataccaagcatggattccgcttaaagatggacgcctgcttcaatccagccggatgtcctcgcaccgatgatggcggcgtatggctcgcgctgttcgagtcgaaggagaaggaacaacagcaacgccaacaacagagccagcaagcggcaccgcctgccagtaacgacttcgacgacgacatcccattcagcccgctgccctatctagccggctcctga

SEQ ID NO: 12449 - DNA, 399 bp, Pseudomonas aeruginosa
gatgcccgacttcctgttcgaagcgctgtgcagcaagttctgcaactgcgagccggtgggcgagacgaacgttgtcgagtgtcgctgcgacgagtacgcggaggaattcaaactgctcgccgccgcgcccggcaaggaggggttgtgatgtcttacgaccgttttggtgtttttttccagtgcggcttctgggagaagacagtggcctttcgagtcgacaacccattaatcgaaggcacaaagatcatcgtctgcggacaatgcattgacccagcggatgccagcgattcgcggaacattgggggcagcttcctttgtgaggattgcgggctgccgttcggtcgaccggaggctcatgaaaaggcaatcgccttgtctggcctggagaaatgcgcatga

SEQ ID NO: 12450 - DNA, 585 bp, Pseudomonas aeruginosa
cggcagagcttcgcgccctgctcagccaggacaaggagaacggcaatggctgaagaactgaaaccctgtccgttctgcggatgttcgatgcgcctggagagcaaccacgactggcaccggatcgtaggcgatcactcggccgagtgcgtgttcctcgacagcgaaaccatgatggtcccagacatagaggatcagcgtgaaatcgccatcgctgactggaacgcccgagcagtccccgcgggccatgtggtggtcagcgctgcggatcttgagtctctgcgcaaggacaaggcgcggctcgacgcaatcgaggataactgctgggacgtgcgctacggcatcagttcgaatgccgatgccggtgacagcagcatcagtatcgagatcgttgggcgctaccagggggtgccgcacattcgggtacttggcgagaactacaccgagaacctgcgcgccgcaatcgatcaggctatgaccgccgaagcatgcccgcctgagcggccggaatacgacgatcacggcaggccacttcgcgccctgctgagcgagcaggagggaggtaacgatgtcagcaatcatcagtga

SEQ ID NO: 12451 - DNA, 507 bp, Pseudomonas aeruginosa
tctgcggggcgcacctcaccagctccttcattggctgatccgatctggaaagccagtcatgtgcttcggagtaacaagctgtggacaacccaagcaccccctcatgcttggatacgacacacccatgaccgcgtggccgtcatagccacccatcgccaaccactgtacgcatatacagcaattcggataatgggctacccactacccggattgcatatgcgcacgaaacccttccgcccgcctcagcggcatgagatcgccggccttcgctactaccgcactgcctcggcctacaactggctcgggatcacgatggcccatccgacccgcgcaatccagttgctgctcgagcagtgcgagccagacgtgctctcgccgatgttcgagattgagatcgacgcgatcctgcgccaagccgacgagtacgcgaaaaccggacaggtgctagagcgcgagcaactgcgcgaaatgctcatgcacctgatcgtcaaagcggcgagcgaataa

SEQ ID NO: 12452 - DNA, 414 bp, Pseudomonas aeruginosa
gtcttcatctgcgccagctgctcgggagtggcccagccgaaggcctggacgtgggattcgttgatgaacggatcgcccagggcgtcgttcttcaggaacaactcgaaggtgggaggagtcagggcgatgccctcttccacgccgaggcgacgcaccaggctgccggcggcgaaattgcgcaccacgcactcgaccgggatcatgtcgagcttcttcaccaggcactcggtatccgacagcagcttgtcgaactgggtcggaatgccggcagcttccagcttctgcatgatgaaggcgttgaacttgttgttcaccgcgcccttgcgatcgagctgttcgatgcgcttgccgtcgaaggcggaggtgtcgttgcggaacagcaggatgagacgatcggcatcgtcggtctggtaa

SEQ ID NO: 12453 - DNA, 912 bp, Pseudomonas aeruginosa
tcaagccaatacgccggtctggcgcatggcctgacgcagcggctcgtggcaacgcgggctgagccaggtcaggggcaggcggatgccctcggggatcagacccatctcatgcagggcccacttcaccggaatggggttggattcgatgaacagcgccttgtgcagcggcatcaggcgatcgttgatggcgcgcgcggctgcggcgtcgccgcgcatggcggcggcgcacaggtcgctcatggcgcgcggcgcgacgttggcggtcacggagatgttgcccttgccacccagcagcatcagctcgacggccgtggcgtcgtcgccggaatagacgaggaagtccttgccgacgcgctcgatgacttccttggcgcgttgcaggtcgccggtggcctccttgatgccgatgatgttcggcaccttggacaggcgctcgacggtctccggaagcatgtcgcaggaggtgcggcccggtacgttgtagaggatctgcgggatcgcaacggcttcggcgatatggcggaagtgctggtacatgccttcctgggtcggcttgttgtagtacggcgtcaccagcaggcaggcgtcggcgccgccgcttttcgcggcctcggtcagcgccaccgcctcgcgggtggagttggcgccggtgccggcgatcaccgggatgcggcccttgacctggtcgaccacgcgacggatcacctggatgtgctcttccacgtccagcgtggccgattcaccggtggtgccgacggcgacgatggcgttggtgccttcctgcaagtggaagtccaccagcttggcgaggctgtcccagtccagtcgaccctgagcatcgaagggggtgaccagtgccaccatactgcccgcaatcatgcaaccgctcctgccgcgaaattaaagcggtaa

SEQ ID NO: 12454 - DNA, 558 bp, Pseudomonas aeruginosa
atgtccaccagccaaccccgcgaacaattccttctgatcagcgccctcggccccaatccgatggagctgaccaccctgctctgccgcgcctgcgtcgagagccgctgcgccgtggtcagcagccgcctgacccgccacggagagttcagcgccctggtgctgcagatctccggaagctgggatgccctcgcccgcctcgagggcagcctgccggccctcaccaagcgcggcgacatcaccctcagcatgacccgcagcaacgcccacgtgacccgcgcccaggcgttgccttacgtggcctatgtcagcgcggtgtatcgcccggacatcctcaacgaactctgccagttcttcatcgaccacaacatcgagctggagaacctgacctgcgacacctaccaggcgccgcacaccaacaccaccatgctcaacgccacgattaccgtgacgctgcccgccggcacccagatcagctggctgcgcgaccagttcctagacttcgccgacgccctgaacctggatgccctgatcgaaccctggcgcccccaacacccctga

SEQ ID NO: 12455 - DNA, 615 bp, Pseudomonas aeruginosa
tggcagcgatgctcgccggcatcgtcgccgcggccgccggcgcaggggatgcgggtatcgcggcgatcgccgggacccaggcggcggcgatccagaaccagttgcgcttttcccggcagaacgagcaggaagccgaccgcgtcggcgtcaccaacatggttcgcgccggttacgatccgcgctcgatgccgaacatgttcgagcgcctggcgcggcagtatcgctacgacggcaagccgccggagttcctcctcacccacccggtcaccgaatcgcgtatcgccgacacccgcaaccgcgccgaacagtatccccagggcggcaaggaagacagcctgcgctaccagcagatgcgcgcgcgcacccagttgctcttcgaggaaaccccggggatggccggcaagcgcttccgcgccatgctcaacgacaatcccaagctggatgccgcgcgctacggactggccatctcgcagacgcgcatcggccagctcaacgatgcccgtgacaacctcaggcaattgctggcgaaggcacccaacgacgtggcctacaacctggcccaggtcgagctggacatcaccgccaaccgccttccggatgccgatcagcggttga

SEQ ID NO: 12456 - DNA, 705 bp, Pseudomonas aeruginosa
agatatcccgcttcaaccagtgcgtgctcggctacaccaaggcgttcgtcgtcgcccatccgcagcaccccttgtgcaatgcctccctgcacagcatcgcgagcctggccaattaccggcagatcagcctcggcagccgctccgggcagcattcgaacctgctgcggccggtcagcgacaaggtgctcttcgtggaaaacttcgacgacatgctgcgtctggtggaagccggcgtcggatggggcatcgcgccgcattatttcgtcgaggaacgcctgcgcaacggtaccctggcagtcctcagcgaactctacgaaccgggcggcatcgacaccaaggtgtattgctactacaacaccgcgctggaatccgagcgcagcttcctgcgctttctcgaaagcgcccgccagcgcctgcgcgaactcggccgccagcgtttcgacgatgcgccggcctggcaaccgagcatcgtcgaaacggcgcagcgccgctcaggcccgaaggcgctcgcgtaccgccagcgcgccgcaccagagtagagcgttctccagcagacgctggccgtgggtggtgagaatcgactcgggatggaactgcaagcccagctgtcgattgcgcggatcggccatcgccatgatctcgccatcggcatcggccaggcagtcgaaaccttccggcaggcgactgaccaccagcgagtggtag

SEQ ID NO: 12457 - DNA, 2694 bp, Pseudomonas aeruginosa
gtgaaggaatcgaagttatccaacagcgtgatgcgcatcgcgctctcccctttcgcgttcggcagcggccacggcggtcagcaccgccagcgccttgttgcgggtttcctcggcctccagccgtggatccgaatccagcaccacgccggcgcctgcccggacccgggcgataccttcgcggacctcggcggagcggatgacgatgctggtatcgaggttgccggcgctgtcgagaatgccgatcgcgccaccgtagctgccgcgatagccatcctcgtactgccgcagcaactgcatggcacggaccttcggcgcaccgaccagggtgcccatgttcaggcaggcacggtaggcatgcagcgcatccagttcgccatgcagttcgccagccacgcgcgagaccaggtgcatcacgtggctgtagcgatcgaccttgagcatgtcgcgcacctgccgcgtaccgctgcggcagacccgcgccagatcgttgcgcgccaggtcgaccagcatcatgtgctcggcgatctccttggcgtccaggcgcaactccgcttccaggcgattgtccagttccgcatcgatggcgccccgggcatcgcgtccgcgcgggcgggtgccggcgatgggatagagttccacctcgcgactctccgcgtcgtacttcaatgccgactccggcgaagcgccgaacaggcagaagtcccccgcatcgaggaagaagcggtacgggctggggttgcgcaggcacaactggcgataggcccgccaggggtccgcacacggcatgctgaagctgcgcgacggtacgatctggaacacgtcgccggccctcacgtgggcctgcaggcgctctacctggcgggcaaagctcgcatcgtccaggtcgacctggtagttgccggcccgtacgcctgccaccggcgactcggaagcctcctccacggcgccatggaattcgtcggcacactggcgcaggctggcggccaaccggtcgtgcccggccggatcgtggacgaacgcctgcagcgaagtccggcgcgccaggtgatcgatgtccagcagcaactccggcaccaggaacaggtagtccgggcaatgccgcgcaggttcggccggcgccggcaagggttcgaactgctcggccaggtcgaagctgaacaagccgcccagcagcgcgggcccctccgcgtcgcccagcgttccgagcacgcggcgcagcgcctccaggctggacaggccatgcaggcgtcgccactcgtccgcatgcgactcttcctgggggaagcgccagtgcagggtgtcgccgtcacgcaagcaggtgacctgggccggacagtcctcgctcaacggcgccagcaaggcgcgtccgttggagttcaacgcccgcagcaccacatcgcgcccccagcactcgatgcgcaggcagctggaaaggatcgccacgctacgccgcgcagccttgctgtccacgtcgaagcagtcgaacagcatccggttggcgccggccatgcgccagatcgacagcgcctccggcaccagcgtgcggtactccagactttcttccagtcgatagccaaccccgctcacgagccacctcctcgcgcccatgggcgactggcctgcgcgacgctagcgcgcaacggcatgttcatcatcggtaaccccccttttcccccaattgcgaccgctgccgtcggcggcgatcgccgcaatggatgtcccgtctcagtccagaggcagcgcctggcgggagagaatctccagcatccggcgcatgctccccaggtgcagttcgccgggcaggaagtcgacgctctgcccaccccaggcgcggtgcagctcctcgctcagttcgtcgagggattcgcccatggactggcgccagagcaaccgccggcacaggcgcagacactcggtataggccgactcggccccatccgcggccagccgcccccgcagcaggccgccgtgtcccgggatcagttgcagcagggtcggcagacgctgcagacgttccagggactccaggtaagcctccatgtcgtcgaacaccagcggccgccacaccccctctgcctcgtcgaactcgcccagggcatcgccgcagaacaggcgtcggcgtcgcacgtcgtagaaaaccacgtgatcgtcgctgtggccgtgggcctctatgacctgcaggcgatgccgcggtcccagctccagccactcgccgtcggccaccgcgcgaaccggcagagcgtcccaggcacaggcctcgggcaaccgctgctccgcacgcaacagttgccggttcaagcgctcgaccacccgcaccgcgctttccgacttccaggcctggcaggtccgctcggacgccaggacctgtacgttcggcagccgcggacacaggtagggcagcaggccgcagtggtcgtagtgcttgtgggtgatcagccagtagtgcacctgggacgggtcggcgacccagcggcacaggtccgcccaaaccaattcggcatcccggctgatccctccttcaaccagcgcccagctcgcctcaccgagacgcagcaggaacaccggcacctggacgtcccccaacaggcacaggtcatcatccagttgaccgggagccgaaagcctcaacatggccggttcacctcctcaggtttgcggtacagcgccgcgccccaggtcgcgccggagccgtag

SEQ ID NO: 12458 - DNA, 999 bp, Pseudomonas aeruginosa
tttttcctgcttcagctgctgctggcgagttcgccaacttgcagcaaattctgccggggcgagattgccaatcgcgctgtgcggtcggtgttcgttgtaatcccgccgccaggccgcgatgcggattctcgcttcggccagcgaacagaaccagtgctcattgaggcattcgtcccggaacttaccgttgaacgactcgatgaaggcattctgcgtgggcttaccaggctgaatcagcttcagcttgatgtcgcgctgataggcccattgatcgagtgccttgccggtgaactcgggcccctggtcggtgcggatcgctttcgggtagccgcgaaaccgcgccatctcgtccagcgcccgtgtgacgcgaaagccgctgataccgtgctccaccaggatgccgaccgactccttggtgaagtcatcgaccaccgtcaggcatttgatccgccgcccggtgctcagtgcatcgaagacgaagtccatcgaccagacctggtttggtgcgctcggcaaactcagacgttcgcgctccaccgcgatgccatggcggcggcgccgccgtttcaccatcaagccggcagcgcggtacaggcgatagatccgcttgtggttgacctgcacgccagcacgccgcagcaggatgtgcaggcggcgatagccaaagcgccggcgctcttgggccagttccaccagttgggcttgcagctcggtgttttgcacactggctcgcggctggtagcgcaacaccgagcgggacagcccgatcaactgacaggcacgacgctcggagatgccggttcgcgcctgcatctcctgcaccgcctcccgccgtgctgtcgggcttacccttttccccgagcgaccactttcagcgactcgatgtcgaggtgggcctcggcgagcaacttcttcaatcggctattttccagttcaagatccttcaaccgtttggcgtccgccacggtcataccgccaaacttggcccgccaggtgtag

SEQ ID NO: 12459 - DNA, 321 bp, Pseudomonas aeruginosa
gagaggtgtctgatgagcaagcaacgacgtacgttttccgccgagttcaaacgagaggccgcggccctggtgttggaccaaggctacagccatatcgacgcctgccgttcgctgggggtggtggattcggccttgcgccgttgggtgaagcagctcgaggcggagcgccagggtgtgaccccgaagagcaaggcgttgacgcctgagcagcaaaagatccaggagctggaagcccggatcaaccggttggagcgggagaacgcgatattaaaaaaggctacagctctcttgatgtcggacgaactcgatcgtacgcgctga

SEQ ID NO: 12460 - DNA, 426 bp, Pseudomonas aeruginosa
caccttcgagcaaagcgtgctgttcactctgatggctcaacacttatcgaaccgtgccgcctcggcatccgcagctcccgctgcaacaagcggatctggcggatggggatctgccgcccgaagcgatctcgcctagcgataccggtactgagggccggctaccggacgaaaggtagccgcgcctcccagcagatcgctaggcctgtaggaaaaatctggaattaccgagagcgcctggattccagcgccggcatgctggcagagccgcgcaatttcaaggccaataccacagtaccctctgtaatcgctgcttacgtcgggggcgcattgctacgcctgcagaatggtttcagggccttagaaacagaaaagcccacctataaaggcgggctattccatattgacatcacgtcaatgcgggcctaa

SEQ ID NO: 12461 - DNA, 603 bp, Pseudomonas aeruginosa
tggcaggctgagcgcgaggaacgtcaggacacgcaggtgcttgggcataacgacttcttacttcttcagctcgacgcgacggttatgagcccaggaatgctcgtcgtggccggtagcgaccggacgctctttaccataggaaaccagttccagctgggccggcgaaacaccctgcagcaccaggtagcgctgaacggccttggcacgacgctcgcccagagccatgttgtactcgcgggtgccgcgttcgtcggtgtggccttccagcactacgcgctgaccgctgcctttcaggtctttcgcgtgtacgtccagagcgcgcatggcttccggcttcaggtcggagctgtcgtactcgaagtagaaggtggtgatcgcacgcagagcggcttcgtcgctcaggctgccgtcaacggcaccgctgttggcgccatagcctgcgttcgggtcgacgccgccattggcaccttcaccggaagcatcgccgcccttggaggagcaacccacagccacagccatggccagagccagcgcagcaaatttgccgaatttcagcatttccatcatgtaactcctaatgaaccccagtgtataagtttgtaa

SEQ ID NO: 12462 - DNA, 1293 bp, Pseudomonas aeruginosa
tattggacatgtcttccggcaacacgttgcccccctggaagccgaacggcaccacggcgatgggaatggcacggtcgttaccgctggagatcaccagcgggtcggcagcctgcgcagcacctgccaccagggccagggcgaacagcgcaatgcgaatcagggtactcacagactcaaatcctccggtttaaagatgatgcggcgctgacgatacaggctgtcgaaggtagcccgcggcaattgctgcatctcgggaatacggccgacgttgcgcaccgccgccaccgccgaactgtcgaaaggcttgtcgccactcgaacggctgacgctggcattggtgatggtaccgtccggcagcatttcgatcagtacttctacgctcattccattacgcgccgatggaggacgccgccactgctggctcaccaggttgacgatcaggtcgtcgagactgccggtgacctcgctgcccacctcgtcggccagggcctgctggcgctcggtcgtatccgaaagcaactcggccaatgcctgcgccttcttgtcctcggcagccttgcgggctgccgcggcagcggcggcggcctttttcttggcggcctcgacggcggctttcttcttcgccgcttccgcagcagccttcttcttggcctcctcggccgctttcttcttcgcgtcctcggctgcctttttcttggcgtcctcagcggcctttttcttggcctcgtcctcggcgcgcttcttggctatgtcagcctgcttcttctgttcggcggccttggcctcggcagctttcttggcttcatcggcctttttcgcctcggcggctttctgggcctcggcctttcgagcctcgtcagccttcttttgttccgccgctttcgcagcagcgacctgctgctgttccagcttttgttgctcgagtttctgctgctcgagcttcttctgttcgagctgctcgacttcgtattgcttggaggcggtcttcttcgcctcgccagcgatcttctggttggtctgtgtcgtcgcctggctcttcgacttgagctggtagagcgtggcctgcacgatcggcttggagggaggaagctccggagcaaacgcccagctgacgaacagcatggcgaagatcagaacgtgcaggaccaccgccaggacgacgggccagaaataactctcggaaggcgagcgctcgaactgttgcttcaagatcagggggcctcggtaatcaacccgacgttgggcacaccggcctgctgcaaggcacccatggcgccaaccaccgcaccatag

SEQ ID NO: 12463 - DNA, 798 bp, Pseudomonas aeruginosa
cgaacccttgccatatcggcttacctctcagtcgtcttagtcgtcgctggtgtgcaccttgcggtgcaggatggcctggaactcgtcggcgaaggtgtagtaacgaccgatcagcatctcagaacgtgcggagaagcggttgtaggcgatgaccgccgggatcgcggcgaacaggccgatggcggtagcgatcagcgcttcggcgatacccggggcgacggtggccagggttgcctgctgcacggtggccaggccacggaaggagttcatgataccccagacggtaccgaacaggccgacgtacgggctggtggaaccgacggttgccaggaatggcaggctggcttcgagtttctcctcctcacgggagatggccacacgcatggcgcgcgccacgccctccatcaccgcatcgggatcgacgccgggctgctggcgcagacgggaaaactccttgaagccggcacggaagatctgctcgacgccggagtccgggtccggattgctaccggcctggcggtacagcttggacaggtcgatgcccgaccagaagcgttcttcgaaggcatccagtgccttcttggcggcgcgcatggcgttaccgcgctggaaaatcatgatccaggatgtgaccgaggcggccacgagggtcagcatgaccagctgcaccacgatactggcgttgctgatcaggctccacatggaggtatggtcgacgacgttcggttccactttaatctcctgctgaaaaagaatccgggcttccggcaaaagccgcacgcaacgtttcggggatag

SEQ ID NO: 12464 - DNA, 873 bp, Pseudomonas aeruginosa
gactgtagcgctggcacggggttccatcaccaacggtgcaatcgtgggcatgttttcccaagccttgaagcggtccttcaactccaccagcaggcgctcggcggtcttcttgccaacaccggggatcttcaccagggtggaggtgtcctgtgcctggacgcaacgcaccagttcgtccacttccaggcccgacatcagcgccagggccagtttcggacccacgccgttgagccggatcagctcacggaacagctctcgctcgcgcttttcggcgaagccatagagcaagtgcgcatcctcacgcacaaccagatgggtatgcaaggtcaccggctcgcccaaccgaatgcaaccgatagagggtcgtcatcggcacttccacttcatagccgacgccattcacatcgaggatcaggtgtggcggctgtttctccgccagggtgccaacgcaagcgtccgatcacgaagagctttccttattcaaagacgcaggcgcccgccacgtcggcgtgcgcccaccaggccatgggggaccagactctgttgggtatgggcatgacacagggcgatggccagggcgtcggaagcatctatctgcggtttctgggtcagcttcaacagatgcatgaccatcatctgcacctgctgcttgtctgcaccgccggtccccacgactgcctgcttgacctgcgaggcggtgtactccgccacgctcaacccctcctccattgccgcgacgatggccgccccccgcgcctgccccagcttcagggccgaatcggcgttgcgcgccatgaacacctgctcgatgctcagggccgtcgggccatgggtgcggatcacctcgcggacgctgcgaaacaccacgtgtag

SEQ ID NO: 12465 - DNA, 903 bp, Pseudomonas aeruginosa
aatcaaagtcataagctggatactaaaagccggaagcggggttcgaacgcatcaagcgtaccccacttccggcttcgcgttatcgctccgatcggctcagccgagctgcgccatcacgtcgtccgggatatcggcattggaatagacgttctgcacgtcgtccaggtcctcgagcatgtcgatcagcttgagcaccttctgcgcggtttccaggtccagggtcgcggtggtcgaagggatcatggtgacttcggcttcgtcgcccttgaatccggcggcggccagcgcctcgttcaccgaaatgaagtcggcgaaggtggtgaacacgtcgatggagccatcgtcgttgactaccacgtcatcggcgccagcctccagggccgcgtccatcagcgcttcctcgtccacgccgggagcgaagctgatctgtcccttgcgctcgaacatgtaggcgaccgaaccatcggtgcccaggttgccgccacacttgctgaaggcatgacgcacttcggcagcggtacggttgcggttgtcggtcatcgcctcgacgatgatcgctacgccgctcggcgcataaccttcataggaaagctcgaccatgttgtcggcatcgttggagccgacgccgcgcgcaatggcacgatcgatggtatcgcgggtcatgttggcggtcagcgccttgtccacggccaggcgcagacgcgggttgtccgccgggacgccgccgccctgccttgcagcgacggtcagctcacggatcagcttggtaaagatcttgcctttcttggcatcttgccgctctttgcggtgcttgatgttggcccatttagaatgaccagccataactcactccgtattgctctctcggcaggaggcgccgcaagcggcgcctccgcgggttga

SEQ ID NO: 12466 - DNA, 1803 bp, Pseudomonas aeruginosa
ttcgaatcactcggccttcggctgctcgcgcaggcgaatgtgcagctcgcgcagggccttgccgtccacggaacccggtgcctgggtcatgacgtcgccagcgctctgggtcttcgggaaggcgatcacttcgcggatagacgatgcaccggtcatcagcatgaccaggcgatccaggccgaaggccaggccgccatgcggcggcgcaccgtacttgagcgcgtcgagcaggaagccgaatttctcttcctgttccgcctcgtcgatgcccagcacacggaacaccgcctgctgcatggacttgtcatggatacggatggaaccgccacccagctcggtaccgttgagcaccatgtcgtaggcgcgggaaagtgccgcgcccggattggcctcaagctcagccggggtgcacttgggcgaggtgaacgggtggtgcagcgcggacagcgagccgtcgtcgttctcctcgaacatcgggaagtccacgacccacatgggcgcccactcccgggtgagcagcttgaggtcatggccgaccttgatacgcagcgcgcccagggcatcgcaaacgatcttggccttgtcggcgccaaagaacacgatgtcgccgtcgaccgcgccaacgcgatcgaggatcacgttcaggttggcctcggggatgaacttcacgatcggcgactgcaggccttccacgcccttggcgcgctcgttgaccttgatgtaggccaggcccttggcaccatagatgccgacgaacttggtgtagtcgtcgatctggctgcgcggcatggaggcggcgcccggtacacacagggcggcgacacgccccttcggatcgttggccggaccggagaagaccttgaactccacttccttcaactggtcggcgacgtccaccaactccagcgggatgcgcaggtcgggcttgtccgaaccgtagcggcgcatggcctcttcgaacggcatgtgcgggaactcgtcgaactcgacatccagcacttccttgaacagctggcgtaccatcttctcggtgatgccgatgatgtcgctctcgtcgaggaagctggtctcgatgtcgatctgggtgaattccggctggcggtcggcacgcaggtcctcgtcacggaagcacttggcgatctggtagtagcgatcgaagccggcgaccatcagcagttgcttgaacagctgtggcgactgcggcagggcgaagaagtggcccgggtaggtacggctcggcaccaggtaatcgcgcgcgccttccggcgtcggccggccgaggatcggggtctcgacgtcgaggaagccgttgtcgtccaggtagcggcgaatgctgctggtgatgcgcgcacgcagcttcagcttggcggccatctccggacgacgcaggtcgatgaagcggtagcgcaggcgcgtttcctcgcccacatcggaatattcatccaacgggaacggcggagtctcggcctggttcagcacttccagttcgtagcccagtacctcgatggagccagacgccatgttcgggttgcgcgcgccttcagggcgcaggcgcaccttgccggtgatcttcaccacgaactcgctgcgcacccggtcggccttggcgaaggtttccgcacggtccggatcgaacaccacctgggccagcccctcgcgatcgcgcacatcgaggaagatcactccaccatggtcgcggcggcggtgaacccaaccgcaaagggtgacttcctggccgtccaggctctcgttcagttggccgcaatagtggctgcgcatcatggtgtggttcgcttctcgtaa

SEQ ID NO: 12467 - DNA, 1389 bp, Pseudomonas aeruginosa
ccgtcactgcggcactgtgatggcagagataatttcaaaaccaaaggagcaatcacaatgaaagtgatgaagtggagcgccattgcactggcggtttccgcaggtagcactcagttcgccgtggccgacgcattcgtcagcgatcaggccgaagcgaaggggttcatcgaagacagcagcctcgacctgctgctccgcaactactatttcaaccgtgacggcaagagcggcagcggggaccgcgtcgactggacccaaggcttcctcaccacctatgaatccggcttcacccaaggcactgtgggcttcggcgtcgatgccttcggctacctcggcctgaagctcgacggtacctctgacaagagcggcaccggcaacctgccagtaatgaacgacggaacgccccgtgacgactacagccgcgccggtggcgccgtgaaggtacgcatctccaagaccatgctgaagtggggcgagatgcagccgaccgctccggtcttcgccgctgggggcagccgcctgttcccccagaccgcgaccggcttccagctgcagagcagcgaactcgaagggctcgacctcgaggcaggccacttcaccgagggcaaggagccgaccaccgtcaaatcgcgtggcgaactctatgccacctacgcaggcgagaccgccaagagcgccgatttcattgggggccgctacgcaatcaccgataacctcagcgcctccctgtacggcgccgaactcgaagacatctatcgccagtattacctgaacagcaactacaccatcccactggcatccgaccaatcgctgggcttcgatttcaacatctaccgcacaaacgatgaaggcaaggccaaggccggcgacatcagcaacaccacttggtccctggcggcagcctacactctggatgcgcacactttcaccttggcctaccagaaggtccatggcgatcagccgtttgattatatcggcttcggccgcaacggctctggcgcaggtggcgactcgattttcctcgccaactctgtccagtactccgacttcaacggccctggcgagaaatcctggcaggctcgctacgacctgaacctagcctcctatggcgttcccggcctgactttcatggtccgctatatcaatggcaaggacatcgatggcaccaagatgtctgacaacaacgtcggctataagaactacggctacggcgaggacggcaagcaccacgagaccaacctcgaagccaagtacgtggtccagtccggtccggccaaggacctgtcgttccgcatccgccaggcctggcaccgtgccaacgccgaccagggcgaaggcgaccagaacgagttccgcctgatcgtcgactatccgctgtcgatcctgtaa

SEQ ID NO: 12468 - DNA, 417 bp, Pseudomonas aeruginosa
cgtccaccactgggtccatcgggtgaaacgcctcgcggagctgggcctggaagaagaagccagcgaactggaacagagcctgatcgagctcacgcgcaacgaccccgaactgcagcagcagttcatgcatgccctgctccgggatgccggtcgcctggccgcggaccctggcgagacgccctgacggcgaactcgcctcgtcagcgacggacgacgaagccagcgatcccctgcagcggcatttgctcgacctcgaccgcagagacctccgcgtgccgcgggccccgccccagccatcgctccagggctttcgcccggtcctcctcgccctcccagacgacttcgacacgcccgtcatccaggtttcgcacccaaccgtcgagttcgaggcgatcagcctcttcccgggtcgcctga

SEQ ID NO: 12469 - DNA, 402 bp, Pseudomonas aeruginosa
acggacacactgctgcttatgaaagaccatctgatcggaagcgtccccgcacacctggtggatgccgcacgcccgaccctgacagcccacgagggcctggtcgcggactacaacattgccgcctggctacatcttccggatgcctgcgacctgctggtgtcactggtggtcagctatctggatggcgggcgccagcgcgaagtggcggtggatcacggacgaatcgaccgccagcaacgcatcctgctttccggcattgcccgcctgcccgtacggcagaaagtggagaacatgcaggtacgcctgaagtcggcgacggccttttcccgactggtcgtggaggagttcttcgtacaagcggtggagcaggaaaacaggtcccagcaggtgtccgaagcttga

SEQ ID NO: 12470 - DNA, 1476 bp, Pseudomonas aeruginosa
acgggaacctcggcggaactacggagtgaaacgactgtcacacgagggtttgccagaagcgtgccaacagcgctttccctgcgcttgctggggttcctccggcagcatgcagcgcctcatgcacatcgttcgccgcaaactgacactttacgtcaccttcgctcccgaggttccgtccgccagccagtgggccaggctttctccgaacagcgcctcctgctccacctgcaagcgctccatggcctgctggaacggcggataccacgcctcgtccagattcgcaggcatgcgctctcggctaggcatgggccaggggcagcgattcagcaagcgatgcagactgtaggcgccaagatcccggcacagcacccactcgcctccgccggcgcgacagacgaactgctccttctcgagaaagtccagcagttcctcccactcatcctcgggcaacagccaacccgcacgatgcaagtgggtcaggcgcagcgactgtccaagctgctggcgctggtggaacaccctcagcacgccgagcaggacgatcagcttgggcagcgagcgccgccgccagagacgggaagaagagagattgcagaccagcaccgcgccgaacagaacgatcatccaggaaagatagatccacagcaggaagataggcacggtggcgaaggcaccgtagatcaactggtagccgggaaacaggcttacgtacagcccgaacagggttttcgcggcttcgaacagtaccgcggtgaacacgccgcccatcagggcatggcgcaccgggacccgggcgttcgggaccgccgaatagagcagggtgaaggccgccacgctgaacgccagcggcatcagccccagcagcgtctccgcgcccggcaacgcgtccgggccatggagcagcgacagcgaagtgatgtaggtggtcacggcgaagccggcccccagcaacaatgggcccaggctgaggatcgcccagtagaggaggaaccgcccgacaccgcggcgtggctggcgaacccgccagatctcgttgaaggctttctcgatggtcaccagcatagtgaaggcggtgactgccagaaagaccaccccgacccaggtcaggtgccgggcctgggtggtgaaactcttcaggtaggtttccaccgcttctccagcggaaggcacgaaattgcgaaagatgaaagtctggatcgactcgcccatgccatggaatgccggaatcagcgaaagcatggaaaacatcaccgtcatcatcggcactaccgcgaacaacgtggtgtaggtcagcgccgccgcgctgttgggagccttgtcggtgacgaagcgatgagcgaggaagcgagcgaactcgaccccatcgttgaaatgttcgcgcatgccctctccttgaagtcgcgccggttcttcgcctctcggggcggtacttcgcgccgacgggttcagtcctggtcgacgaggcggttagaatag

SEQ ID NO: 12471 - DNA, 645 bp, Pseudomonas aeruginosa
caaggcggtggttggccggcctccggaaagagtcctggagatcctcgcttgagcagtccctacatcctggtgctgtactacagtcgccatggcgctaccgcggaaatggcccggcagatcgcccgtggcgtcgaacagggcggcttcgaggcgcgcgtacgcacggttcccgcggtatccaccgaatgcgaagcggtcgccccggacatccccgcggagggggcgctgtacgcgaccctggaggacctgaagaactgcgcgggcctggccctcggcagcccgacccgcttcggtaacatggcttccccgctgaaatacttcctcgacggtaccagtagcctgtggctgaccggcggcctggtcggcaagccggcagcggtcttcacctccaccgccagcctgcacggcggccaggagaccactcagttatcgatgctgttgccgttgctgcaccacggcatgctggtcctgggcattccctacagcgaacccgccctgctggaaacccgcggcggcggcacgccttacggcgccagccacttcgccggcgccgatggcaagcgcagcctcgatgagcacgaactgaccctgtgtcgcgcgctgggcaaacgcctggcggaaaccgccggcaagctggggagttga

SEQ ID NO: 12472 - DNA, 873 bp, Pseudomonas aeruginosa
aaggcggtcacttcctgccgcaagcgaaacccaaggactgcggcacggccatgcgggaattcgccgacggactgtcgacgcttaccagccgagggtttccttgaggaaaggaatggtcagcttgcgctgagcctggagcgaagcgcgatccagttgctccagcagatcgaacagagagttcatgctgcgcgaaccgcggttgaggatgaaacgaccgacttcatcggtcagatgcaggccacgacgggatgcccgcagttgcagggcacgaagcttgtcctcgtcggaaagaccgtgcaactggaagatcagcgccatggtgaggcgggacttcaggtccggcagcttgacctgctgctcccggggcgacttcgatgccgccagcagcaggcgccgaccggtatcacgcagtcgattgaacaggtggaacagcccctcttcccattctcgcttgccaaccagcacatccaggtcgtcgatgcagaccagctcgcactgctcgagatcgtcgaagatttccgggccgtactgcaccagatcggccatcggcaggtagatggttcgctcttcgaactgctcgaaacgcaagcaggccgcctgcaacaggtggctgcggccgacgccgtcgtgtccccagaggtagatgaggctttccgcccagccagcctcggcttcgcacaaacgctcgacatatcccagtgccgcggcattggcaccgggatagtagttggcgaaggtggcgtcgtcgcgcagacgcacactgaggggaagctgaataggtttcatgccaggctgggcggacaatccgaaaacgccgcaggagtcaccgtaagggctgcaaagtttatacgcctcggcaaggccgcacaatga

SEQ ID NO: 12473 - DNA, 1314 bp, Pseudomonas aeruginosa
caggaaaaaacagagaacgaagagtcgggctatgcgcatggagggctctcgacgaacggatgggaacggcggcgacgagctgtgaaggccgcgcaagtggacctataccttaaacagcagtccgtccagcggcaaccgagatggccgctgcgtggcaagcctgataaaatcgcgcgccttcaaaaccggcaaacagcgttgcacgcctgggcggccggccgatctccgaattatccctataggcctggatttatgagcagcaagcaaccctcgttgagctacaaggacgctggtgtggacatcgacgccggcgaagccctggtggaacgcatcaaaggcgtggccaagcgcaccgcacgcccggaagtgatgggcggcctcggcggcttcggcgccctctgcgaaatcccggccggctacaagcagccggtgctggtatccggcaccgacggggtgggcaccaagctgcgcctggcgctcaacctgaacaagcacgacagcatcggccaggacctggtggcgatgtgcgtcaacgacctggtggtctgcggcgccgagccgctgttctttctcgactactacgccaccggcaagctcaacgtcgacgtcgccgccaccgtagtcaccggcatcggtgccggttgcgaactggcgggctgttccctggtcggcggcgagaccgccgaaatgcccggcatgtacgaaggcgaagactatgacctggccggcttctgcgtcggcgtcgtggaaaaggccgagatcatcgacggctccagggtccaggccggcgacgcgcttatcgccctgccctcctccggcccgcactccaacggctactccctgatccgcaagatcatcgaggtttccggcgccgacatcgagcaggtccaactcgacggcaagccgctggccgacctgctgatggcgccgacccgcatctacgtcaagccgctgctgcaactgatcaagcagaccggcgcggtcaaggccatggctcacattaccggcggcggcctgctggacaacatcccgcgcgtcctgccggacaacgcccaggccgtgatcgatgtcgccagctggaaccgtccggcggtattcgactggctgcaggaacagggcaacgtcgacgagaccgagatgcatcgcgtactcaactgcggcgtcggcatggtcatctgcgtggcccagagcgacgccgagaaagccctggaagtcctgcgtgccgccggcgagcaaccctggcagatcggtcgcatcgaaacctgcggcgcggacgccgagcgcgtggtcctgaacaatctgaaaaaccactga

SEQ ID NO: 12474 - DNA, 897 bp, Pseudomonas aeruginosa
agtcgcaagatacgccggaacgcctggccagacgggttcacgaggaagaacaccggatctacccgctggccatgcgctggttcgccgagggccgcttgcgcctgggcgaacagggcgccctgctggatggccaggccctgcctgccaccggccatcagattcgcaccaaggagattcgcaatgcgtaaagccatgctgttcctgctgacgctgctgaccctgccggcctatgctttcgagctgaagccgttcaccgccagctataccgccgactggaaacagatgcccatcagcggcaacgcctcccgcagcctgaaggctctcggcgacggccgctggcaactggacttcgaggcctccatgctgctggccagcctcaacgaagtcagcaccttcaaggtcgagaacgacaccttcctgccgcagacctaccgcttcgcccgccagggtctgggcaaaggcaagcagatcgaactggacttcgactggtcgcagaagcaggtgctcggcagcgaccgcggcgatgcggtgcggcaacccctgaatcgcggtcaactggacaagtccacctatcaactggtcctgcagcatgacgttgccgacggcaagaagagcatgagctaccagatcatcgagggcgaggatgtcgatacctacgacttccgggttctcggcgaggaaaaggtacgcacccaggctggcctgatcaacgcgatcaaggtcgagcgcgtgcgtgatccgggcaagagcaaccgcaagaccatcctctggttcgccaaggactgggactacctgctggtccgcctgtaccagatggaaaccgacggcaaggaataccagatcatgctcaaggaaggcaccatcgacggcaagaccgtcactggcgaaaagagctga

SEQ ID NO: 12475 - DNA, 276 bp, Pseudomonas aeruginosa
aaacgtatcgtatcgatactaaattcctacaggagaatcagcatgaccaaagccatctactaccacgccggctgcgcaatctgtgtcgaagccgaacgttccttgctgccattgctcgatcgcaagcaggtggacatcgaagtggtccatctcgccgaacaatcggcacgcatcgccgaggcggaaaaggccggggtcaggtcggttcctgccctggttgtcgacggacaggtactgcaccttaacttcggtgcggcgctcagcgatctgaaataa

SEQ ID NO: 12476 - DNA, 513 bp, Pseudomonas aeruginosa
cagccgggcgcgctcctctccgctttcttagcctcgccccagaggctgtccagttcctccagcgaacactcttcggctttccggccggcttcgcgcaggttccgctcgatgaaccggaatcgccgctcgaacttgccgttggcctggcgcagagcagcctccggatcgaccttgagatgccgggccaggttgaccacgacgaacagcaggtcgccaacctcctcgcccacggcaccctcgtcaccctctgccatcgcctcgaggacttcgtccagctcctcgcgaaccttgtccaccaccggcagcgcttccggccagtcgaagccgacctgcgccgcgcgcttctgcagcttcgccgcccgtgacaacgccggcagggcgacaggaacgtcatccagcagcgacaactgctgcggctccttggccttggcggcacgctcctcggccttcagttcttcccagcgctgcttgaccgccgcttcggccagcttcgccgcatcgggcttgccatag

SEQ ID NO: 12477 - DNA, 3486 bp, Pseudomonas aeruginosa
cgaaccaggtcatccccgcctcgtgggcgatacctcggccgtcatgggccaggcgctcgatggtcaggcgctgcttcttgcctaccggtatcgcgggaccgcgcgcaccaccgctgggctggaagcgcagcccgcccttatttctggccatggacatgctcagcgcgggtcatagacgccggaagacaggtagcggtcgccgcggtcgcagatgatcgccaccagcacggcattctccagttcgcgggacaggcgcagcatcgccgccaccgccccaccggaggacacgccgcagaagatgccttcctcgcgggccagccggcgcatgatgtcctcggcttcgtcctggtgcatgtcgacgacccggtcgacgcgactggcgtcatagatcttcggcaggtattcctgcggccagcgtcggattcccgggatggccgagccctccatgggttgcaggccgacgatctgcaccgccgggttctgctccttgaggtagcgcgagacgcccatgatggtcccggtggtgcccatggagctgacgaaatgggtgatgctgccgccggtctgctgccagatttccgggccggtgctgtggtaatgggcttccgggttgtcgccattggcgaactggtcgaggaccttgccgcggccttcgcgctgcagcttgtcggccagatcgcgcgcgccctccatgccctcttccttgctgaccagaatgagctcggcgccataggcggtcatcgccgccttgcgttcggccgtggagttgtccggcatgatcaggatcatcttgtaacccttgatcgccgccgccatggccagggcgatgccggtgttgccggaagtagcctcgatcagcgtatcgccggggcggatgtcgccgcgcagttcggcacgggtgatcatcgacagggccgggcggtccttcaccgatcccgccgggttgttgccttcgagcttcaccagcagggtattggaggtttccccgggaaggcgctgcagacgcaccagaggggtattgccaacgcagtcggcgatagtcgggtactgcacggtcatggaggcactcgttcggcactgacggtaaaggctgagcatgataccgggaaactggggccggaccctagcaccgcaatatccggtcatgcatgccgattcagccgaaagaccgcccgaaacggcatgcgatgcgatgaccagaggcgtccgaagagaaaacctggcgttggacagccgatgcctgaccaacgccaaagaaaggtccgacaggcgttgcgcctgccggtgaaagcacgttggccgcggcgatcagaacgaggtggtcatcgaaacgtagtaggcgcgacccggctcgttgtaggttgccgcgccggcgtcgaaggagttgccctggcggtacaggcgcttgtcgaagaggttgcttaccccgccccgtacgctcaggttctcgctgaaggtgtagccggcgctgacgccccagatgccataggtacccacctcttttcgcgagaccaccggcgtgttgcggctggtgccatgcttcggcggctcctggcggccgtagatggtgctggtcagttgggtggaaagacgctcgctggcctgccagtccagggtcgagttcagggtgtactcggggatcaccgaaagcgggttgccggtgtccttgtccttggattgcagcatataggtcaggttggtgctccagctcaggtcctcgtgcagggggaccagcaggttgccttccaggccctcgaccactgctttcttcgcgttgctccattgcaggatgttgttaccggtcccggtctgccccatgacgtccagcggcgcgacgatcttgttcttgtagtcgttgcggaagtaggtgagcccggcgacccagccatcgcgccggaactcgatgcccagttccttgtttacgctggtctcggcgtccaggttctcgttgccgaccaggtagcagccgccgctgctggtctggatcgggcagccgttgccacgggtatagagcaggtagttcgggttgctctggtacaggttgggcgccttgaaggcccgtgcgataccggccttgaccgtgaagtattcgccgagcgtctgggaagcgttcaggctcgggctccagttcaggccgaagtcgctgtgatcgtccaggcgcagcccgggggtgagcatggtgccggggcgcagttcgatattgtcctccacgtacagcgcacggatctccgccttgcttttcgggcttcgcgagccggccgcgggggtccccggcaagctatcgcttcccacgaagccctgcttgagcgaggacgggtcgttgagggtttccttgttccactccgcgcccaccgtcagcacctgctcgaacaacgcatgcaacggaaggttgagttcgccgctgaggcgatagttctccagcttgctggtgctgaacgaacggtcggcgccgatctgcccctcgacggaaccggccagcccctcctccagacggttgttgcgggtggagtcgtactgggcgacgaacctggaagtgccgaacgaccaggtcccgttgtgggtgatggcgtagttctcgcgatacatgcggttggtctccgcaccctcgtcggcgagtccctgggtattggcggtgccgttgttgttctgggtatcgccggcatagatgttgccctgtcggctgaagcccgcttcgaaatcgacgacctggtcgggggtcacctgccacgacagcatcccgctgagatcgcgattgcgtaccccttcgcgtccggccacggtacggctcgggttgacggtatgtccgaggttgatgtcggtatcgtccgaatcggtcttgttcgcgctgccgtacgcgcggaagctcaaggcttcggtcagcggcccgctgaggctgaagttggcgcggcgcgtggcgccatccttggagctttccggaatgttggtgaacaccgtcatggaaccacgcaaacgatcggtcgggcgcttggtgatgatgttgactaccccgcccgccgcgccggaaccgtagcgtgccgccgcgggcccacggaggacctcgatgcgctcgacctcctccggcggcacccagttgctgtcgccgcgggtgtcgcgttcgccgcgccagccgtagcgcaccgagttgcgcgagctgaccggcttgccgtcgaccaggatcagggtgttctccggccccatgccgcggatgtcgatctgccggttgttgccgcgctggccgctggaactgttgccggtgaggttgaccccgggcatggtgcggatgatctcggagagatcgttcaccggcgggcgcttcctgatgtcctcggcggtgatgatggatacccccggtgcctgcttgagctcctgttcggcggtgcccagcaccacctcgtcacccagctggaccaccgattcggcgcgttcgtccagttcttccaggcgctcgtcctcggccagggcctgcccgtccagcaggctcgatga

SEQ ID NO: 12478 - DNA, 453 bp, Pseudomonas aeruginosa
gccagtcgttctgggaattcgaacggctcggctgcaagaccctggtgctttgcccgaccaccgagcaggcgcaataccacgcgaccctgcccgacgaacaggtcgaggccaagcccgcctgcacccgcaagctgcaacgcaagctgcaggagttgcttcaagtccgcccgacgcgcagcgacaagccccacgccatggtttccggacggccgccacggctgctctgcgtcgacgacaacccggccaacctgctgctggtgcagaccctgctcagcgacctcggcgcccaggtcaccgcggtggacagcggctacgcggccctcgaggtggtgcagcgcgagcgcttcgacctggtcttcatggacgtgcagatgcccggcatggacggccgccaggccaccgaggcgatccgccgctgggaggccgagcgggaagtcagcccggtgccggtga

SEQ ID NO: 12479 - DNA, 1146 bp, Pseudomonas aeruginosa
gcgtgctcgaccccgaggaagggctgcgcctggccgccggcaaggccgacctcgccgccgacatgctggcgatgctgctggcctcgctggcggcggaccgccaggcgattcgccaggcccgcgacaacgacgaccgcaccgctttgctcgagagggtccaccggctgcatggcgccacccgctactgtggcgtgccgcagttgcgcgcggcctgccagaccagcgaaaccctgctcaagcagaacgatccggcggcggccgcggccctggacgagctggacaaggccatcgaggccctggccgacactgcctcggccaccacccacctgtcctccaccagcctcgactccagcgaactctgaccatgcgcatcctgttcttcagcacccaggcctacgacagcgagagcttccaggccagcaaccaccggcacggcttcgaactgcacttccagcaggcccacctgcaggcggacacggcggtcctcgcccagggcttcgaagtagtctgcgccttcgtcaacgacgacctctcgcggccggtgctggaacgcctggcggccggcggcacgcgcctggtcgccctgcgctcggccggctacaaccacgtcgacctggccgccgccgaagcgctcggcctgccggtggtgcacgtcccggcctattcgccgcacgctgtcgccgagcacgcggtcggcctgatcctgacgctcaaccggcgcctgcaccgcgcctacaaccggacccgcgagggcgatttctcgctgcatgggctgaccggcttcgacctccacggcaaacgcgtcggagtgatcggcaccggacagatcggcgagaccttcgcccgcatcatggccggcttcggctgcgagctgctggcctacgatccctatcccaatccgcgcatccaagcactcggcggccgctacctgtcgctcgacgccctgctcgccgagtccgacatcgtcagcctgcattgcccgctgaccgccgacacccgccacctcatcgacgcgcagcgcctggcgacgatgaaacccggcgcgatgctgatcaataccggccgtggcgccctggtgaacgccgcggcgctgatcgaggcgctgaagagcggacaactgggctacctcggcctcgatgtctatga

SEQ ID NO: 12480 - DNA, 450 bp, Pseudomonas aeruginosa
catgcgcggctgattggaggctccatggctgaacacgatttccgttacaccctgctcaacccgcaatacaccctcaacgaatgccgcgcgctctccccggggcgctaccaggtcaccggcaccggcggctcgatcaaggccgacgacgtgctgctggtcagcctcaagggcagcaagaccctgagcatgcgcctgaccgtggaaaaggtccgccacctgatcaaccctcccggccagtggctggcggtcgcccgcggcccggcattccgcgaactggcgatccatacctggcaggtcgactgcgaccagtgccaggctcgtctcgacttcgagttcgccgtggacgccagtctcggtcgcaaggccctggcgccggccgccgaagaacgcattcacgaactgggctggcgcagccgcgaagacaagcacctgtgcccgaaatgccagtaa

SEQ ID NO: 12481 - DNA, 543 bp, Pseudomonas aeruginosa
ggcgaacgctccgtccgaccgacggtctgtgaactatcgcccgtacgaaatgcgcaaaggaaacgccatgaaaccctctctcgccctcttcgcctccgccgccctggtcctgggcggttgcgccagccaggagaccaccctggaaaccgagcaggcctaccaggtcgactgggtcggcgcacaaccgacgatggactacagccacatcagcctgaccttcgacggccagggccgcgccttcggcaatggcggctgcaaccactggttcgccagctacaccctgcaggacgacctccttcagttcggcgccatcggcagcacccgccgcctgtgcgcggcggagatcatggagcaggaacggcgcttcctggccctgctgcagagcgtccagcactgggacatttcgccgtccgacgagctgcgcctgtggccggccgaaggcaagccgctgcgcctggtccccgagcacgactgaagcctgaagcggcgctacccggcgccgcccgtttacatttttttgacatccatttcattcccgcttga

SEQ ID NO: 12482 - DNA, 471 bp, Pseudomonas aeruginosa
tcccggtgtacctcgcctgccgactgctcctgcatttccatgatcgccttcccgtgcgcctcagtccgtggctggcaggcgtgctggccatcgtcggcagcgcggcggtacagatactgctctacgccgaccgcaccctctacgacctgtacggattccacctcaacggtttcagcatcggcctgctggtctcgcccggcggcctctccagcctcggcagcggcgacggcaccctgctcagcgcaagcctggcggccctggccctgctctgcctgcaggtgctgctgtacagcgcctgccaggtcagccgcgagcgccttcccgcgctccctcggcgcgcctggcgctacctgttggcggccttcctctgcctggccctgggcgaacgcctggcctatgcgttcagctccctgcgcgactaccggccgatcctgctggccagcgaacgctatccgctttacctgccattga

SEQ ID NO: 12483 - DNA, 330 bp, Pseudomonas aeruginosa
aggccggccagccgccggtgctcatggaggtactcaggcagcagaactaccagttccggatcaatgccgcgcaacgtttcagctatccgcccttcgaccgcagcgtgttcgtcaacctgcgcccccaggacctgcacgtgctggatagcccggagcctgcctggcagcgcgacgcccggaacaccgacgacctgctgcgcttcgtcgatcgccgactacccgaccggccgttcttcgcctgcctgttcctcgagtcgagccacgccaactacagcttccgcgacgagaccgcgaaaatccgcccctatctggtcaacttcaactacctga

SEQ ID NO: 12484 - DNA, 1293 bp, Pseudomonas aeruginosa
aacgctgatatgtctgtcgtgaaacgtcactggcgccgttttctggtcgccgccctggtgctgatcgtcggtgccgccctgctgctctggagccgaccggcggcccaggcgaaactggaagccctggacctcgacgacggcggccacgccacccttgccgaacccggcgagaagccgcgctcgcgggtggtggtgatcgccgcccccgaacagcaactgaacgacgcccagatgctgaacctggctcacgacagcgccgcccgggtgatccagtacttccctccggaaaacggcgattgcagggcgcagcagtcccggctcgaagcggtcattgcccgcctcggcggcaagccgaacctggtcgccggcatcggcccgggctcgaccaccgcctggcgctggctcgccagccaggacgacgacaaggccaaggcgctctcggtcggcttcgacattgccctggccgagcgcgactgcgacgccccgctgccgcaccaggcgtcgcacggccagtggctgctggcctggaacgacaacccggacgacgacaccgcagtcttcgtccgcaagcagtcgagcgcggaaaccagcatcagcgactacgacaccccgctgtccgacgtgctcgcccatcagttgcgcctgcaactgcaaggcaacgccgaggccctgccggtactcgaggtccccgcggcgcaaccctcggacatcgtcaccctgttctattccggcgacggcggctggcgcgacctggacaaggactctgccgagcatatggccagcatgggctacccggtggtcggcatcgacaccctgcgctactactggcaacacaagagcccggaacagagcgccgccgacctctccaagctgatgcaacactaccgcgagaagtggggcgcgaaacgtttcgtcctggccggctactcgttcggcgctgacatcctgccggcgatctacaaccgcctgcccggaaaggaccagcagcaagtgaaagccatgctgctgctggcgctggcgcggaccggcagcttcgagatcgaagtggaaggctggctgggcaaggccggcgaggaagccgccaccggcccggaaatggccaggttgccggcagccaaggtgttctgcatctatggcgccgaagaaaaggacgaaagcggctgtacccaatcccaggccgtcggcgagaagctcgaactgccgggcggccaccacttcgacgaggactacctgtccctggcgaagaagatgctccaggccatccgcgaccgcgagaacgctcccgacgcctga

SEQ ID NO: 12485 - DNA, 510 bp, Pseudomonas aeruginosa
tcagcatggttccggtcaccgccacgccgtaggcagccgccagcgacgccgaggactcgaagccgagcaccagcaggaccacgccgaccatcagcgcccaattcaccccgccgatgtagatctgcccctgctcgtggctggaagtgtgctggatggtcatccgcggcacgtagccgagctggatcgcctggcgggtcagggagaaggcgccggagatcaccgcctgggaggcgatcaccgtggccagggtggacagcgccaccatcggcagcagcgcccagcccggcgccagcaggtagaaggggttgcgcgccgcctcggcgttggaaaggatggtcgcgccctggccgaagtagttcagcaccagcgccggcagcaccagcaggaaccaggcacgggcgatcggcttgcgaccgaagtggcccatgtcggcgtacagcgcctcggcgccggtcagcgccagtacggtggcgccgaggatggcgacaccgatgccgggatgcgagctga

SEQ ID NO: 12486 - DNA, 1404 bp, Pseudomonas aeruginosa
ggtcgttccgacctacgaagacgccgacgtcgtggtggtcaacacctgcggtttcatcgacagcgccaaggccgagtccctggaagtgatcggcgaagccatcgccgagaacggcaaggtcatcgtcaccggctgcatgggcgtggaagagcacgcgatccgcgacgtgcatccaagcgtgctggcggtcaccggcccgcaacagtacgagcaggtggttaccgcggtgcacgaagtggtgccgccgaagaccgaacacaacccgctggtcgacctggtcccgccgcaaggcgtcaagctgaccccgcgccactacgcctacctgaagatttccgaaggctgcaaccacagttgcagcttctgcatcatcccgtccatgcgcggcaagctggtcagccggccggtcggcgacgtgctgagcgaggccgagcgcctggtcaaggccggggtcaaggaactcctggtgatttcccaggacaccagcgcctacggcgtggacctgaagtacaagaccgacttctggaacggccagccggtcaagacccgcatgaaggaactctgcgaggcgctgagcagcatgggcgtgtgggttcgcctgcactacgtctacccgtaccccaacgtcgacgacgtgatcccgctgatggccgccggcaagctcctgccgtacctcgacatccccttccagcacgccagcccgaaggtgctcaaggccatgaagcgcccggccttcgaggacaagaccctggcccggatcaagcagtggcgcgagatctgcccggaactgaccatccgctcgaccttcatcgtcggcttcccgggcgaaaccgaagaagacttccagtacctgctcgactggctgacggaagcccagctcgaccgcgtcggctgcttccagtactcccccgtcgaaggcgctccggccaacgagctgggcctggagccggtgccggacgaggtcaagcaggaccgctgggaacgcttcatggcccaccagcaggcgatttccgccgctcgcctgcagctcaaggtgggcaaggaaatcgaagtgctgatcgacgaagtcgacgaacagggcgcggtcggccgctcctgggccgacgctccggaaatcgacggcaacgtgttcgtcgacagcgacgagctgaagccgggcgacaaggtccgcgtgcgcatcaccgatgccgacgagtacgacctctgggccgagctggtctgagcccccctgaagagccccgccccgcggggctttttcatcgccaaccgttccggagagcacgatgctcaacaacgacgtactacgcagcctgcgctacctgctggatcttcccgacgcacatctggccgaactggccgccccgttcggcgagcaagtcgaagcggacctgctcgaggcttacctga

SEQ ID NO: 12487 - DNA, 405 bp, Pseudomonas aeruginosa
ccctgcgcgtccgtggctgaacgcgcggagccactgctggcggttctgctccaggcgccgccctgcgccgacccctggttcctggagtgccgccaggatcgcgccggcctgaccatcctcgtccgcgacctcgccaaccagcgcacctggcgcgtcgagttcgtcgaagtcgaaggcctgcgccagctcgacgctgccgacctgctggaattctggccagcctgtgcggcatccgagggttggctgtaccgggtcgagcaaggcggctggctggaccaggaatgccgtcgcgagggcttcgtcgcccgcgagaccaaggccgtcgacgagtatttcgtcaatggcggcgatcgctgcctgagcgtgctgtcctggtcgccaccgaaggtttccccgctgatctga

SEQ ID NO: 12488 - DNA, 576 bp, Pseudomonas aeruginosa
cctgcactcacccttatccgacccggagtgccgcccatgcgttccctgtccctccttctcctcctctcgctggcgtccacctgcgaggccgctgcggtattccgctgcgaagacgccagcggccatgtcagcttcacccaactcggttgccccgccgggcaggccggcgagaccgtcgtggcggacaacccgccgccgggaggcaggagcgtcacgccgatggccgagacgaagacgaaaaaggcgtccatcggccggaaaagcgtgccgctcgcggtgatcggagaaagagaagatcgctgcggcagacgcctggacgagaaggaacgccgcaaggcgatcgtggagcagcggataatggcgggaatgacccgctccgatgtggagcgggcgctgggcaagccggaccgggtcagcgggaacaatgcggaggtgcgttatcagtacaaggccgacaagcgacggggagcgagaagcgtgagcttcgatcaggagggatgtgtgaagggaagagaaggtaccgggtggagcgagtcgatcccgggagctaaggccgggccgtcctcataccgatga

SEQ ID NO: 12489 - DNA, 768 bp, Pseudomonas aeruginosa
tacccatatacggacgcttgcaatgccacaggcacacccttagtctttccacctatggaactcaaagatcgcatcaaggcggcgcgcaagcacgcccatctcagccaggtccagcttgcccaggcggtaggcatgacccagacctccatttccgatctggagcgcggcaagtcccgcgccaccagcttcgtcgcgcagatcgccggcgcctgcggcgtcaaccccctgtggctggcggaaggtcgcggggagatgctcgccgagcgcggccaggcgaacgcaggacccaatgccagttggcttggcgcagtagagtcatgggacgacgaaacgcccctggatgccgacgagatcgaactgcccttctacaaggagatcgagctgtccggcggcaagggcagcacggtgatcctgcagaccggcgggcgcaagctgcgcttcggcaagtacaccctgcgcaagaagaacatcgatccggccagtgccgcctgcgtcacggtcagcggcaacagcatggagccggtgctgccggacggcagcacggtaggcgtggacactagcgcgcggacgatcaaggacggcgacatgtacgccttcgaccacgacggccaactgcgcgtgaaactgctctaccgccttccgggcggcggcctgcgcattcgcagcttcaacagcgacgagcacccggacgagcgctacgagccccaggaagccgccgagcacatcaacgtgatcggccgggtgttctggtactcggtgctggtctga

SEQ ID NO: 12490 - DNA, 531 bp, Pseudomonas aeruginosa
cgtcgtcacctaccatcagggtctctccgacccgacgagtcagaatcagcattcctttctcctcacgcgaatatttcaggacaacagtctgcaaaaaagaaatggcggcggatccgcagaaatcaagagcgcgatccttcacccagtattgaccagtcccgccggaatgaaagttcctgccgaacggtcaaaaacgacaaaaggcgcggggttgccgcgcctttcgcctgccagcgtcactcaccctgtcgcgccggcgcgtcgagctcgaacgccgtgtgcagggcacgtaccgccagttccaggtacttctcttcgatcaccacggaaaccttgatttccgaggtggagatcatctggatgttgatgctttccttggccagcgcctcgaacatgcggctggccacgccggcgtgcgaacgcatgccgacgccgacgatggaaaccttggcgatgttggtgtcgccgatggcttcgcgcgcgccgatgttggcggcggtctgcttgaggatttccagggcgttcaggtaa

SEQ ID NO: 12491 - DNA, 411 bp, Pseudomonas aeruginosa
tcgttgcgatgcaccgtgaaggtgaagtcggtggtgttatcgtgcgccacgttctgcacgatcatgtcgacttccacattggcggcactgatcggcccgaggatcttgaaggccacgccgggggtatcgggtacgccacggatggtcagcttggcttcgtcgcggttgaaggcgatgccggagatgatcggctgttccatggattcctcttcatcatcgatagtaatgagggtgcccggaccctcctggaagctgtgcagcacgcgcagcggaacgttgtacttgccggcgaactcgaccgcccggatctgcagcaccttggaaccgaggctggccatttccagcatttcctcgaaggtgatcttgtccagccgacgggcctgcggcactacgcgcggatcggtggtgtag

SEQ ID NO: 12492 - DNA, 624 bp, Pseudomonas aeruginosa
acctgccacattctttcgctacccggactggcggggcgcaccgccggccgggcatcaaggggcgctggccgcccggccccgcatcgctctggcgcggggccggcatggcatcagagcccttgctcgacgaagcgctgggccagggccagggcctcgtccaatttcgctgcatcggtgccgccgccctgggccatatccgggcgtccgccacctttgccaccaactgccgccgcggcttgcttcataagctcgccggccttcagttggccggtcaggtcctgggtcacgcctgcgaccagtacgaccttcccgtccagctcgccgccgagcaggatcactgcgcggccgagcttgttcttcaactggtcgaccagcgccagcagcgccttgccgtccagaccatcgaggcgcgcggcgagtaccttcgcgcccttgatttccaccgccgccgccgaaaggtcgtcgccggccgcgctggcagccttggccttgagctgttccagctccttctccagcgagcggttgcgctccagcagggcgccgagcttgtccagcaggttgtcgcggctgcccttgaccaggctggcggcttccttgagctgctcctcggcaccgttcaggtag

SEQ ID NO: 12493 - DNA, 588 bp, Pseudomonas aeruginosa
gccagcgccgccgcgccggtgaccgcctcgatacggcgtacgccggcagccacgccaccctcgctggtgatcttgaacaggccgatgtcgccggtgcgggatacgtgggtgccaccgcacagctcgacggagaaatcgccgcccatgctcagtacgcgcacctggtcgccgtacttctcgccgaacagcgccatggcgcccttagccttggcggtgtcgatatcggtttcctcggtctcgacctcggtgttgcgacggatttcggcgttgacgatatcctccagggccttcagttgttccgccttgatcgcctcgaagtggctgaagtcgaaacgcaggcgctggctgtccaccagcgagcccttctgttgtacgtggtcgcccagtacctggcgcagcgcggcatgcagcaggtgggtcgcggagtggttgagcgcggtggcctggcgtaccgaagcgtcgacctcggccttgaccgcgccgccgacgctcaggttgccccgggcgaccacgccatggtgcaagtgcgcgccgccagccttggtggtatcgcgcacgtcgaagcgcacgccagccgcctcgaggtag

SEQ ID NO: 12494 - DNA, 1392 bp, Pseudomonas aeruginosa
gtgtcgtacagcttgaacaccacgttgccgggaatcacgctgccctgcagttcggcgaggtcctgttcgaggatcttcagggccttgctccagggtcttggcgaactgttcttcctcggtcttcagcacgcgctcgatgtgtgcctgctgttgcttcagctcggggaaggcatcgcccatctcggcgaccagcgctgcgacgatcttgtggaagaaggtgcccctggcgcccagcttgttgccgtggcggcaggcgcggcggatgatccgccgcaagacgtagccgcgaccctcgttggacggcagtacgccgtcggcgatcaggaagctgcaggaacggatgtggtcggctaccaccttcagcgacggcgcgtcgtcgttggcgcagccgatggcctcggcggaggctttcaacaggttctggaacaggtcgatctcatagttcgagtgcacgtgctggagtaccgcgctgacgcgctccaggcccatgccggtgtccacgctcggcgccggcagcgggtgcatgacgccgtccgcggtgcggttgaactgcatgaacacgttgttccagatctcgatgtagcggtcgccgtcctcttccggcgaaccgggcgggccgccccagatctccggcccatggtcgaagaagatctcggtgcagggaccgcaaggtccggtatcgcccatcgcccagaagttgtcggacgcatagggcgcgcccttgttgtcgccgatccgcaccatacgctcggcgggcacgccgacttccttggtccagatgtcgtaggcctcgtcgtcggtggcgtagacggtgacccagagcttttccttgggcaggttcagccatttctcgccggtgaggaactcccaggcgtaatggatggcgtcgcgcttgaaatagtcgccgaagctgaagttacccagcatttcgaagaaggtgtggtgccgcgcggtgtagccgacgttttccaggtcgttgtgcttgccgccggcgcgcacgcatttctggctggtggtcgcacgggtgtaggcgcgcttttccaggccgaggaagcagtccttgaactggttcatgcccgcgttggtgaacagcagggtcggatcgttcgccgggatcagcgaactggaagcgacacgggtgtgtcccttctcttcgaagaagcggaggaaggcttcacggatttcagcgcttttcataggttcttccacggaaaattggcggccacgaatcgccggcaaagggccgcattatatcggcccttgggcaaggttgtagtgtatttgcgcgatagttattgcctattgccgaccttttcgcttatgagcgacgaaaggccgcgaaggcatccagtacttgtcctatggactcggcggaaacgtccaggtgggtga

SEQ ID NO: 12495 - DNA, 348 bp, Pseudomonas aeruginosa
tccgcacctcgcgctcggcgaggaagtcgcgcagcgcgaccgcccgctcgccgacatcgacatagaccatgttggtctgcaccggctccaccgcatagcccagttcgcgcagcccgtcgcccaggcgcgcggcgttggcgtggtcgtcggccaggcgtgccacctggtggtcgagggcgtacaggccggcagccgccaacaggccggcctggcgcatcccgccgccgaccatcttgcgccagcgacgggccttgccgatcagttctacgctgccgcaaagcaccgagcccaccggcgcaccgaggcccttggacaggcacaccgacaccgagtcgaagtgtcgggtga

SEQ ID NO: 12496 - DNA, 1800 bp, Pseudomonas aeruginosa
gctggatcttctcggtcggctcgcggccggccagggtcaagtcgagcagtttgccgagggcgagcatgggatgtcctcagtcagtgggtgtggtcgcagccgcagtcggggccgtgctcgtggtcgtcgccctcttcgatcggctccatctccagttgcaggctgaccaggttggtcgccatcggccgcagcagcaggttggtgtattcggtatcgccgtcttcgacgtcgacgccgatcagcaactggccgttgccggcttgctggacccacacttccttgccctgccagaccacggcgaaacgggtgcaggaagtttccagctgggtgccgtcggtatcttcgaggatcagttgcaggctatcggacatggtggcgaggctctcaatcgagttggaaggaataaaccgagcccagtttaaggatctgcgtcagttcatccaatgccgtccggcactccagcagcagttgggggtcggccaggtcggtctcgctcaggcggtcgcggtagtgccggtcgacccaggctaccagcgtgtcgtacaggccggcgctcatgatcacccccggattcaccgccgccagctcccgttcctgcagcgccacgcgcaagcgcaggcaagccggaccgccgccgttctgcatgctctgcttgaggtcgaagaccttcacttcgcggatcggaccgtcgtcgccggtgagctggtccaggtagttccagacccgcgggttgttccgacactcctccggtaccaccagcagcatcgaaccgtcggccttcgacagcagttggctgttgaacaggtaggacttcaccgcgtcctccaccgcgacctggtcgcgcggcacgcagatggcgcggaagcggccgccgcggcggcccagcttgtcgtgcagttcggcaaggaccttctcggtatcgaggaaggcgtcctcgtgatggaacagcacctcgccattgcccaccgagatcacatcgttgtggaacacgccctggtcgatcaccgccgggttctgttgagcgtagaccactccggcctcgctcagcccgtgcagacgcgcgacggcctggcaggcttccagggtctggcgcgccggatagcgttgcggcgccgggaagcgactgtcgaaggcgctgcgaccgaagacgaagaactccacgccggcatcgccatagtccttgcagaagcgcgtgtggttggccgcgccttcgtcgccgaactggctcactgccggcagcgccgcgtgatgggcgaaatgccgctcgtcgttgaacatcgccgccagcacgcggctggtggtgggatgctcgatggatcggtggaacttgcagttcaggttggccgcggtgaaatgcacgcggccatcggcggtgtcggcactcgggctgaccgtggcggcattggcggtccacatgctcgaagccgagctgcaggcggcgaggagaggcatcgcttccttcgccgcgcggcggatcacctcctcgtcgctgccggagaagcccaggctacgcagcgcagcggtatccgggcgggcttgcggagcgagtaccccctgcttgaaacccatctccatcagcgccttcatcttcgccaggccctgcttcgccgcttccttcgggttggacaccgcctggctgttgctttgcgaagcgacattgccgtaggacaggccgccgtagttgtgggtcgggccgaccaggccgtcgaaattcacttcatgggcattcataggctgatcccgggagtcagggtggcaggaagggacacgctggggctttccagcgaggcgaccggatag

SEQ ID NO: 12497 - DNA, 420 bp, Pseudomonas aeruginosa
ggaccgaatactgccaccacgccatgcggcttgtgccgtagcacggcggtagcgtcggccagcggaccggatttctcgccagtgcgctcgcggaacgcctgcaccgagatcgccaccttgttgaccatgctggtcacttcggtggccgactcccacagcggcttgccggtttcctcgccgatcactcgggccagctcgtcggcgcgggacttgagggtcgcagcgaagcgctcgagcaactcgatgcgctgctccagcgggcgccgcgcccaggccgggaaggcctcgcgggcggcgcgcacggcagcgtcgacctgggtgacgtcagcgccgcgcccggaccagaccacgccctggccaaccgggtcgagggactccagggtctcgccctggcccgccagccactggccggcaatgtaa

SEQ ID NO: 12498 - DNA, 786 bp, Pseudomonas aeruginosa
atgttacttgaggctgccggagaggaactgcttgaggcggtccgactgcgggttggcgaggacttccttcgggcagccgtgttcctcgaccaggcccttgtgcaggaacaccaactggttcgacacctcgcgggcgaaacccatctcgtgggtcaccaccaccatggtgcggccttcctgcgccaggtcctgcatgaccttcagcacttcgcccaccagttcggggtcgagcgccgaggtcggctcgtcgaacagcatcacttccggctccaccgccagcgcccgggcgatcgccacgcgctgctgctcgccgccgctcatgtgcgccgggtaggcgtccttgcggtgcgccacgccgaccttggccaggtagtgctcggccttctcgatggcttccttcttcgacacgccgagcacatgcacgggcgcctcgatgacgttctccagggcactcatgtgcgaccacaggttgaaatgctggaacaccatcgacaggcgcgagcgcatgcgctgcaactggcgggagtcggcggccttcagcgcgccgtcgcggccaggcaccagcttcagctcctcgccgttgagcaggatcttgccggcgtgcggctgttccagcaggtttatgcagcgcagaaaggtgctcttgccggaaccgctcgagccgatgatgctgatcacgtcgcccgctttcgccgccagcgagacgcccttgagcacctcgtggctaccgtagcgcttgtgcaggtcttggacttccagtttgtacatgtgtgtgttctcggctaa

SEQ ID NO: 12499 - DNA, 975 bp, Pseudomonas aeruginosa
cggatagcgtcagttcgaaccgtagacgtcgaagctgaagtacttgtcctggatctgcttgtacttgccgttggcgcgcagcgcgtcgatggccgcgttgaacttgccggccagctcgctatcgcccttgcgcacggcgatgccgacgccttcgccgaagtacttggcatcggtcagttgcggaccgacgaaggcgtagcccttgccggcatcggtcttgaggaagccgtcctcgaggttcaccgagtcggcgaccaccgcgtcgaggcgaccggccaccaggtccatgttggcttcctgctgggagttgtagcgcaccacttcgacgccggccggggtcagttcggcggaggcgtagcggtcggcggtactgccacgcagcacgccggccttcttgcccttcaggtcggccttgggatcgttgaggctggcgccttccttcatcacgaagcgcgccggggtgttgtagtacttgttggtgaagtcgaccgaacgcttgcgctcgtcggtgatggtcatcgacgagaggatcgcatcgatcttgcgcaccttgagtgccgggatcaggccgtcgaactcctgctcgacccacttgcactgcaccttcatctcttcgcagagggcattgccgatatccacgtcgaagcctgccaactggccgtccggggtcttcagcgagaacggcgggtaggccgcctcgatgccgatgcgcaccggcttgtcggcggcgaaagtgggcagggagagcacggacagcgccagggcgccgagaagtgcgagcttcttcatctggaactccttcgaaggggatggcatcgattggcaggagaaatagaaccttgcccaggctgccgacggatatgcgtgatcaccggctcttgcgcatggcgccttctcgtggacagggcgccagctggggtgagcggcattctagcgacaggccgaaagtggttatttcttcaatgcgacaactaa

SEQ ID NO: 12500 - DNA, 2028 bp, Pseudomonas aeruginosa
aagaccccgcgcggctcgcaccgcgcggggtcgtttcggatcaggcggaagtcaggcggcctgcatcgagcgatgggtctcgatcaggtgctggaccacgcccgggtcggcaagggtggagatgtcgccgagggtgtcgtactcggccgcggcgatcttgcgcaggatgcgccgcatgatcttgcccgaacgggtcttcggcagtcccggcgcccactggatcacatccggcgtggcgatcggaccgatctcgcggcgaacccattgcttcagctcctggcgcagcgcctcgctcggctcgaccccggagttgagggtgacgtagacatagatgccctgccccttgatgtcgtgctgcatgccgaccaccgccgcctcggcgaccttcgggtgggcgaccatcgcgctttccacctcggcggtgcccatgcggtggccggagacgttgagcacgtcgtcgacccgcccggtgatccagtagtagccgtcctcgtcgcggcgcgcgccgtcgccggtgaagtacatgcccttgaaggtcttgaagtaggtgtcgacgaagcggtcatggtcgccgaacagggtccgcgcctggcccggccaggagtcgaggatcaccaggttgccctcggcggcgccctcgatcaggttgccgaggttgtccaccagtgccggtaccacgccgaagaacggcttggccgcggagcccggcttcatcgcgtgggcgcccggcagcggggtcatcaggcaggcgccggtctcggtctgccaccaggtgtcgacgatcgggcagcgcgactggccgacggtctcgtagtaccactgccaggcttccgggttgatcggctcgcccaccgaaccgagcagacgcaggctggaaccgtcggcaccggccaccgccgccttgccttcggccatcatcgcgcggatcgcggtcggcgcggtgtagaggatgttgaccttgtgcttgtcgatgattttcgccacgcgggtcacgtcggggtagttcggcacgccctcgaacagaatggtggtggcgccgttggccagcgggccatagacgatgtaggtgtggccggtgacccagccgatgtcggcggtgcaccagtagacttcgcccggacggtagtcgaagacccgctcgtgggtcagcgaggcgtacaccaggtagccgccggtggtatgcagcacgcccttcggcttgccggtggagccggaggtgtagaggatgaacagcgggtcctcggcgcccatttccttgggtgcgcaagtgctgccggcaaccttcatcaggtcgtcgtaccagacgtcgcggtgctggttccacttgatctccgcaccggtacgcttgcagacgatgatcttctgcacgctggaggtttccgggttggtcagggcgtcgtcgacattggccttcagcggagtgcgcttgccgccgcgcacgccttcgtcggcggtgatcaccaccttcgacttgcaatcgatgatgcgtcctgccagggcctcgggggagaagccgccgaagaccaccgagtggatcgcgccgatgcgggtgcaggcgagcatggcgaccacggcctcggggatcatcggcatgtagatggtcactacgtcgccgcggtgcacgtcctgcccgcgcagggcgttggcgaacctgcagacctgctcgtggagctggcggtaggtgatttcctggtggtcggcgggatcgtcgccttcccagatgatcgccacctggtcgccgcggtcggcgaggtgacggtcgaggcagttgtgcgacacgttgagggtgccgtcggcgaaccacttgatgtccacgtgatggtcgtcgaaggaggtctgcttgaccttctcgaacggcttgatccagtcgatccgctgggcctgctcgcgccagaagccgtcggggttgacgacggactgctggtacatcgtcttgtaggtggcttcgtcggtgaaggtccgtgccaccgcttccgggtgcacggggtacagggatgccgcagacatggctttaacctcggtacgtga

SEQ ID NO: 12501 - DNA, 2103 bp, Pseudomonas aeruginosa
acaggaacagcagcaggaacaggatcagcacggtcatggacggttctccccggcctcttcgccggccagtttggaggcctcggcggcctcgtcggcgaggcccagcccgagctggcgaccgcgcaacaggttgacgaggatttccaggtagcgcagcagcaccaggccgaagccgaccggcaccaccaccgcgatgtaggcctggaggatgccgaagtggtcgaggtcctcggcgccgatgccggcgacgaacagggtcttcacccagtcgtagctggcgaccatgaacagcccggcgtagcccaggcagcagaggcaggcgagtatcccgatcaggcgctgcaagggacgcggcgccaggcgcaccagggcatccaccccgaggtggccggcggtgcgtacgccgtaggcgatgccgaggaagatcagccagccgaacagcgccttggtcagcgcgttgctccaggacatatcctgggctaccccgaggatcgcgtcgcccatcgagtacagcggagcccgcagtgtcggcaggcggtcgccgaggtcgtagaacagggtgaagacgttggtcatcaccacatagaggaaggtcaccagcgtcatcgccgccagcaggaaggcgatagcgccctcctcgaagcggttccagacgcgcacgagtcgattcatcgcagcgttctccacgatgccccgcccggccgggcggggccggacgggtcaatcgggacggttggaagcttcggcggcctggagcagatcggcaccgacattgccgcggaatttctgccataccggctgcatcgcctggcgccagtcggcgcgctgctgcgggctcagggtatggatctcgctggcgccactggcgaggatgcgctggcgggcgtcgcggttgaggcgctcggcctcgaggttcacctgcacggtgacctcgtccatgatccgctgcagttcttcgcggatgtccgccggaaggccattccagaacttcgcgttggtgatcaccatgtagtccaccaagccgtggttggactcggtgaaatacttctgtacctcgttgaccttctggctctcgtagttcgaccaggtgttctcggtgccattcaccacgccggtctgcaagccctggtagacctcggcgaaggacatcttccgggagatcgcgcggagctggcggaactgctcgttgagcacgtcggacgcctgcacgcggaatttcagcccgcgcgcgtcttccggctccagcaacgggcgattggcggagagctgcttcatcccgttgtgccagtaggccaggccgaggatgcccttgccctgcatgctggtcagcaaggcgcgcccctgcgggctgcgctggaagcggtcgaccgcctggatgtcgtcgaagaggaacggcaggtcgaagatctgcaccttgcgcgtgtactgctcgaacttggccagggacggcgccagcatctgcacgtcgcccagcagcagcgcctccatttccttgccgtcgccgaacagcgacgagttgggatagacgtctacctcgacccggccgcccaggcgctgttcgacgagtttcttgaacagcagcgcgccctggcctttgggcgtgttttccgcgaccacgtgggagaacttgatgacgatcggctgcgcggcattcgccaggcaggagccaccgatcgccagggcgcacaacagcgcccgtaccatcgtcttgaacatttcgtgacctcagattgttgttgtgctttcgaggtatcgacgagcctgacgcagccggcgcgttcggagaattcgccattgctcaagcccgcgttcgcgtctgtcgaacgcgttcagccaccctccccggcccgctccagcaggcgtcgcgcgcgccccagcaccggcgcgtcgaccatctcgccgtcgaccacgaagacgccggcaccggaggcgccggcctctgccacccgacgcgcccactccagttccgcgggactcggcatcaatgtctggtggatcggctcgacctggctcggatggatgcacagcaacccgccgaagcccatgtcgcgagcgaagcgcactgcctcgaccagtccggcacggttctggatcgccggatag

SEQ ID NO: 12502 - DNA, 699 bp, Pseudomonas aeruginosa
ccgagaatctgttcggctgcgttgctgccgctgttgagatcgaggtccagggccaggtcgaggctgccgaaggacagccgctcgacccccgcggcggcggcgatctcgcccagcgcggcaaggccgcgggcactctcgacgatgggccagaccggcttgccgctggccacggcggcgtggcgcacctgggcggcgctctccactttcggcaggagcaggccgatcactccggcgtggtcgcggcacagcgccaggtcgtcggcatgcccgggatgctccgccgcgttgatccgcaccagcacccgggcttccggcgtatcgacgaggaaacgccggagattggcccgcgcctcgaccttcagcccctcctccaccgcatcctcgaggtcgacgatgacccggtcggcgccgctggcaagggccttggggatccgctccgggcgggtcgccgggacgaacagcgcgctgcgcacgatctgtcggttcatgtccgcctcctcataccgttccggtcgcgcgcaggcgctggatatcggccgcggtacagcccagttcggcaagcagcgcgtcgctgtcgccgcccagcgccggcaccgcatccatgcgcggaacgaaggcgctgctgctggccggcggcaacaacgccggcaggcgcccggccgggctgtcgatggaggtccagcgttgccgcgcctgtaa

SEQ ID NO: 12503 - DNA, 657 bp, Pseudomonas aeruginosa
gataggcggcgagcagcccgtcggcggcggccttggcggtatgcaactgcttggaatcggcggcgtcgcggaggaactcccagagcccggcggcctgggttccggcgctgccgagcaggtcgacgaagcgctcgcggtcgaagtccatcagcttgcccaccgccactgccgcggcgagggtgccgaccgtggcagtggtatggaacacccggtagtgggaacggccgaggaattcgccgatgcggatgccggcctcgtagccggccaccgccgcgaggatcagctcggcgccgctgcggccgaggtcctgggccgcggccagggcagcagggaagaccaccgccgcggggtgcagcaccgagctgttgtgcaggtcgtcctgctccaccacgtgggaagccgcgccgttcaccagggcggcgaaatacggcgagctgcgccgccggctgggcaggatctgcgcgctaccgtcggccgggcccatgcgttcggcgtagcgctcgaacaatgggatcggatgctggcccttgccggccagcgccgagccgagccagtcgaggaacaattcttccatccgcgccaacaccgccggcggcaggtcctggtagcgcaggccggcgagaaagccggcgagttgctgggtgtagtcggtcatga

SEQ ID NO: 12504 - DNA, 1212 bp, Pseudomonas aeruginosa
gaatttgcaattacgcaatggcgcgttcggatttgccgaacgccatggagtgcccatgcatttcgatctcgccgacctgcgcctgttcatccatatcgccgagtcgcccagcctgacccagggcgcgcgccgcgccttcctttccccggccgccgccagcgcgcgggtcaaggcgctcgaaggccagcttggcagccgcctgctgtaccgcgacagccgcggcgtcgaactgaccccggcgggccagcgtctgctacagcacgcgcggctgatcatgcgccaggtggaatacctgaagagcgagttcaccgagtacggcagcgacgccgccgggcatatccgcatcttcgccaataccaccgcggtcaccgaattccttccggaaatcctcgccggcttcctcgccgctcgtcccggggtcaccgtcgacctgcaggaacgcctcagccgcgacattgtccgcggcgtgctggacggctccaccgacctcggcatcatcgccgggccggtggcggccaccggcctgcagatcctgcatttcagcaccgaccgcctggtgatggcggtgccccagggccatccgctggccggacaggccagggtacgcctacgcgacaccctgcagttccagcatatcggcctgcccgagggcaccaccctgcacgccttcctgtacgaacgggtggagcagatgggcgagcagctatcgctgcgcatccaggtctccagcttcgaggcgatctgccggatgatcgagggcggcgtcggcatcggcgtgatcccgcagtccgccgcgcgccgccacagccggacgatgaagctggcgaccatcgaactcgacgagccctgggcgatccgcgagcgcagcctgctggtacgcgacctggaagcactgccgagttgcctgcgggcgttgatcgaggagttgcagagggtgggagacagcctgtagggcggataacgcccctggcgttgtccgcggggctccggagaatcggcggacaaccgccaggcggttatccgccctacgactcccgacaagccggggtgcgatcgtcgcgaagggcgccgcccaccactcccgctcagttcgccaacccaccgctctccgccaggctgtgctcgtccgcggcgagcatcgccggcatgtgctcgcggaggaactcgacccaggtgcggatcttcgcatccaggtactgccgcgaggggtag

SEQ ID NO: 12505 - DNA, 342 bp, Pseudomonas aeruginosa
tctcggcgctctcctcgacctcgccgaatcccggccggttgtcgctgcaactcaccctcgggaccctcgccggggcctgcaccgggctgttcgtgctgctctacctgctaccccacgtggacggtttcccgatgctgctctgctgcctgctgccggtcttcgcggtcggcgccctgctgctctggcggccgcagtggaacggctacggcgtcggcctactggtgtggttctgcttcgcctcgctgccggccaacatggcgcgctacgacgccctggccttcttcaacgaatacctggcactactcttgtcgatggtcctcgccacggtcgccgccatggtga

SEQ ID NO: 12506 - DNA, 273 bp, Pseudomonas aeruginosa
atagtaatgaaggctttcgccctgatggccctgttcgcctgctcgccgctggtgatggcggctggcgcccaggatcaacctgccagccagcaggaaaacgctgttgaagaatatgcctatggcatgcaactggatgtggctcgcgttatatcttcaaccgacacttccaatgcctgcggcatcgttcccgcacgcatgacctacgaagattcgaacggccagaaacataccgtcgaatatcaggtctggggcaacggctgcactggcggctaa

SEQ ID NO: 12507 - DNA, 1632 bp, Pseudomonas aeruginosa
ccccgcggcggccttgtactatggtggacgggcacggcccgtgcgccgctcccacatgcgacaaccaaggactcccaccatgaccgcactcacccaagcccattgcgaagcctgccgcgccgacgccccgcacgtcagcgacgaagaactgcccgtgctgctgcggcagatcccggattggaacatcgaagtccgcgacggcatcatgcagctagagaaggtctacctgttcaagaacttcaagcatgccctggccttcaccaatgccgtcggcgagatatccgaggccgaaggccaccatccgggcctgctgaccgagtggggcaaagtcaccgtgacctggtggagccactcgatcaagggcctgcaccgcaacgatttcatcatggcggcgcgcaccgacgaggtagcgaaaaccgccgaggggcgcaaatgagtcatttcgccaaggtcgcccgcgtaccgggcgacccgatcctgggcctgctcgacgcctaccgcaacgatccgcgcgcggacaagctggacctcggcgtcggtgtctacaaggatgcccagggcctgaccccgatcctgcgctcggtgaaactcgccgagcagcgcctggtcgagcaggaaaccaccaagagctacgtcggcggccacggcgatgcgctgttcgccgcgcgcctggcggaactggcgctcggcgccgcctcgccgctgttgctggagcaacgcgccgacgccacccagacgcccggcggcaccggcgccttgcgcctggccggcgacttcatcgcccattgcctgcccggccgcggcatctggctgagcgacccgacctggccgatccacgagaccctgttcgccgccgccggcctgaaggtttcccactacccctacgtcagcgccgacaaccgcctggatgtcgaggcgatgcttgctggcctggagcgcattccccagggagacgtggtgctgctgcatgcctgctgccacaacccgaccggtttcgacctgagccacgacgactggcgcagggtgctcgacgtggtgcgtcgccgcgagctgctgccgctgatcgacttcgcctaccagggcttcggcgacggtctcgaggaagacgcctgggcggtacgcctgttcgccggcgaactgccggaggtgctggtcaccagttcctgctcgaagaacttcggcctgtaccgcgaccgcgtcggggcgctgatcgtctgcgcgcagaacgccgagaagctcaccgacctgcgtagccaactggccttcctcgcccgaaacctctggtcgaccccgccggcgcatggcgccgaggtggtcgcggcgatcctcggcgacagcgagttgaagggactttggcaggaagaggtcgaaggcatgcgctcgcgcatcgccagcctgcgcatcggcctggtcgaagccctggcgccgcacggcctggccgagcgcttcgcccatgtcggcgcgcaacgcgggatgttttcctataccggactgagcccgcagcaggtcgctcggctgcgcgacgagcacgccgtttacctggtgtccagcggccgggccaacgtcgccggtatagacgcgcgccgcctcgaccgcctggcgcaagccatcgcccaggtctgcgcggactga

SEQ ID NO: 12508 - DNA, 1290 bp, Pseudomonas aeruginosa
aatgctcaattatgggcaccagttcacactgcgccccacggcccccactttctcgtcttagtgagcaacgcacgtgagaaaccgtctcctgtcactggtcaccctgttcctgtccctcagcgttgccaccgcggtatccgcctccccgccgcccaaggccgggctgccgctgcaacaggagctggcgtcgggcagcgcgctggttaccgaccagaacaccggcaaggtactctactcgcgcaaccccgacctggtggtgccgatcgcctcaatcaccaagctgatgaccgccatggtcgtgctcgactcgaaactgccgctggacgaggtactgccgatcgccatcagcgagaccagcgaaatgcgcggggtgttttcccgggtgcgggtcggcagccagatcagccgccgggacatgctcctgctcgccctgatgtcctcggagaaccgcgccgccgccagcctcgcgcagaactatccgggcggcaagaacgccttcgtcaaggcgatgaacgccaaggcccacgccctgggaatgaagaacacccgctacgtcgagccgaccgggctgtcgctgcacaacgtctccaccgctcgcgacctcacccgcctgctggtggccagccggcaatatccgctgctcagtcagtggagcaccactccggagaagaccgtggccttccgcaaccccaactacaccctgggcttccgcaacaccaaccacctgatcaacaacaagacctggaacatccagttgaccaagaccggcttcaccaacgaggcaggccactgcctggtgatgcgcaccacgatcaaccgcagtccggtcaatctggtggtgctggacgccttcggcaaatacacccacttcgccgacgccacgcgcctgcgacgctggctggaaaccggccaggtcactgcgatcccggccgcggccaaggcctatcgcctgcaacgcgaccgcgagcgcggcctcggccagccggtggcccaggccgtacgctgatccgtcgcgaagaccggccggctcagaaatccaccttgccgcgcccggccttcaccgcgccgcgcttggccttgccgtccagccggcgcttctgcgagccgcgcgtaggcttggtcgggcgccgcgccttctgcaccttggccacgctgcggattaactccgccaggcgctccagggcatcctcgcggttctgctcctgggtccggtactgctgggccttgatcaccaccacgccgtcgccgctgatgcgctggtcgttcagtgccagcagacgctccttgtag

SEQ ID NO: 12509 - DNA, 210 bp, Pseudomonas aeruginosa
atcacctggttgatcgccttcgggatcaccgtcctcggcttgtccgcctcggccgcggtgaagccgagcatttccaggccaccgaaggagaacatgatgatcgccatggccatcaccagtccgctcactccgttggggaagaaaccgccgtgtgcccagaggttgctcaccgaagcctgcggaccgccgctgccgctgaacagcaggtag

SEQ ID NO: 12510 - DNA, 1212 bp, Pseudomonas aeruginosa
gttcgacccgaatattgcgcatcagccagcggcgcgccatgtcttcgccgggatggcgggcgaaacgggtcttcagcaggttctgcgacatgtacaaggggaactgctcgaccaccggccagccgccgatcaggtacaggcgcatcagcgccgggctcagctcggcgtcgcgcatgcgccggtacagctcgtggccggaaacccggtccttgctcgcctggcagtcgacgatcagttgctgcgcccactgcggatagcttcccgcctcctgcaaggggcccgtacggtcaaagaactcgctcacacccgtctcccttctcttcttctcggcaacggcctcatagcagcgaaactactctttcttcgctccgcggtcacctaccggaggttctgtccgaggctcggccacaggccctgggcatccagccctgcgcccggaggctggcgactgaacggcaggggcgcgccgatggccaggccctgggcatagtcgatgccgatctcgcgcagcgcttccatgacttcgacggtctcgacgaactcggcgatggtacgtttgcccatcacgtggccgatatggttgatcacctggaccatggcgcgatcgatgggatcctcgagcatgtccttgacgaagctgccatcgatcttcaggtaatccaccggcgggtgcttgaggtagatgaaggacgacatgccagcgcagaaatcgtccagggagaaacgacaaccggtgtccttgagctcgttgatgaagcggatggcgctggccaggttggcaaccgccacggtttcggtgacctcgaagcagatcgtctgcggcggaatgcggtaacgggcgaacagctcggtgaggaactgcaggaacgactcgtcgccgatggtcgcgccggagaggttgatggcgcaggtgccgatcggctcggcgcgagggtcctgggcgcgctcgacaagggtgcggaaggcattctccaccacccagcgatcgatcagcgtcatcaggccgtagcgctcggcggcgggtatgaagctcagcggcggcaccaggcgcccgccctcgtcgcgcaggcgcagcagcagttcgacgtgcaagccctcctccgcaccttcgcccagcggcacgatgggctgggcatagagactgaagcggtcttcctccagcgccaggtggatgcgctggacccaggtcatctcgccgaagcgcatcgatag

SEQ ID NO: 12511 - DNA, 1425 bp, Pseudomonas aeruginosa
ttcgacgtcgtcctgatggaacacctggacccggttgcggcccttttccttggccatgtagcaggccatatcggcggagcgcagcgcctcctcgagggtcgagatacccggcagcaggtgcaccaggccaacgctgacggtgcagttgaacggctgcccgctccaggtgaagtgcaggtcctggatggtcttgcgcagatggtcggcgatctccacggctttttccgccggacagttctccagcaggatgccgaactcgtcgccgcccagccgcgccagcgtgtcgccctcgcgcaagccttgttgcagcagggtacagacctggcgcagcagttcgtcgccggcggcgtggccgcaggtgtcgttgaccagcttgaactggtccaggtcgaggaacatcagggcgtgccgcccgctgttgcgctccaggcgttccagcgctatctgcaggcgatactcgaactcgcggcggttggtcagcccggtcaacgcatcgtgggtcgcctgccaggacaggcgcgccatgtactggcgctcgcgggtcatgtcgtgaagcaccaggaccaccccggtgatctcgccgccacggtggatcggcgcgcccaccagggtcaccggcacgctgctgccgtcgtgacgcagaaccagcttggaatgctcgcgaccgccgtcgatctcgccgctgaggatctgctcgatcagcagcatgccctcctcccgcgagctttcgtcgacgatccggaacagcgacgccaggggcaggccgcgggccttgtccagcgtccagttggtcatctgctcggcggccgggttgaggtaggaaatgcccccctgggtgtcggcggtgatcactccgtcgccgatcgaggccagggtgatctgggcccgttcgcgctcggcatcgagggcgttctccacttcctggcgctgcatcagttgctgccgggtccgcaggaacgccaggaggatgagcacgctggcggtggtcaggttggccaccagcagcagcctgagcaaggcccgcgagccctcgccaagggcgtcgctgaaggccttggccgccggcgtgaccttctcgttgatcgcgtggatctcggtcttccactgttgcacctgctcggcgctggcctgcccggcgccgatgcccgcgcgcatcttgccggcgacgtcgatcagttccatgacgtacttgtcacccaccagccacagctcgatggcgcgctcgaagtaactgaagtcgtggaagttgcggtacagccagatgatcgcggtaacgtcgtcggcatggttgccgcccttgaggatgccctggcgggccgcctcgatgtccgggtcgggctggtccagggcaaggcgcatctcgcggtcgccgagggggatcgcgatggcctcctcgtagcggcggaagtcttcgtcggcgcgtga

SEQ ID NO: 12512 - DNA, 1986 bp, Pseudomonas aeruginosa
tggctgtttgccgaacctgccctgcacctggcggaacagacagcgttttttattgccgcagccaataaaaaccggatgtcttatatggaatatacgagaaaaaccgccaggcggcagcctggcgcctcacatctgttgcagatgtccgtagagccgggcgtagaggccgccttcggcgatcagttgctggtgatcgccgtcttcggcgatatgcccgccatcgaagaccaggacccggtcggcctgcttcaccgccgacagccgatgggccacgatcaatgtggtgcggccttcgaggaagtccccgagcgcctggtgcagggcgtactcggtagcggcgtcgagggccgaggtggcctcgtcgaggatcaccaccttgggctcggcgaggatcatccgggcgatcgccaggcgctgccgctgaccgcccgacaggcgcaccccggaacgcccgaccacggtgtccagcccctgcggcaggcgccgcacgccgtcggccaactgggcgatctccaaagcccgccagcaggcctggtcactgcgttcgcggcccatggtcaggttggcccgcacgctgtcgttgaacagcgccggatgctggaggaccaccgcgacatgttcgcgcacgcagtccaggccgatttcctccaggggcaccccgccgtagcggatgctgccgcgctgcgcactgtagaggccgagcagcagttgcaccagcgtgctcttgccgccgccgctggcgccgaccagggcaaccttctcgccggcgccgatgttcaggtccaactgctccaggaccttgtcctcgccgtaggcgaaatccagcccgcgcacctcgatgccaacggtcgtgcggccggcgaacggatcgcgcagcggcgggtagcgcggctcgtcggcccgcgccagcaactcgttgatccgctgcaacgcgccgccagcggcgtagtaggcgtattgcaggccgagcagctgttcgaccggaccgatcatgaaccagaggtagctgaacaccgcgagcatctggccgatcgacaggtccgagagcagcacggtgagcatcgccgcggcgcggaacacgtcgatgccgaactggaacagcaggccgctggcgcgcccggcggcgtcgctcttccattgcgaggccacggcgtagtcgcggacctcctgggcgcggtggccgaggcggccgaggaaatagccctggcgattgccggcgcggacttcctggatcgcctcgagggtctcggtgagcgcctgggtgaagcgcgcggtgctgtcgttctcgagcttcttgagatgcttgacgcgcttgcccagctgcaccgtggaccagatcaccagcgggttgaacagcaggatcagcaaggccagctgccagtgcatccagaccaggatcgcggcggtgccgagcagcgtcagcaaggcgaccaggaagcggctgagggtttccccgacgaacttgtccagggtatccaggtcggtgaccaggtgggcgctgatcgacccgccgccgagggtttcgtattcgcccagggcgatatgccggaggcgctcgatcagacgcaggcggatgcggtagacgatgtccttggacagccgcgcgaacagcttcgcctggagcacgttgaacaccagcgccgccccccgcaacagaagggtcgccgccagcatcaggccgatgtagccgaacgccacctgccagtcggcgggcaacaggcggtccatgaaacgcagcgcgccgtcacccttgccgagcagcacttcgtccaccagcagcggcagcagcaagggaatcggcacggtgcagagggtggccagcaccgccaccaggttggcgaacaacagggctttcttatggcgcagtgcgagtcgacgaatctccgcccagctcaggcggtctccgcgctcactcatgccggccccgttccagccagcggccgagcaagggtgaaagttcggcaagcggctggtagccgttggtga

SEQ ID NO: 12513 - DNA, 525 bp, Pseudomonas aeruginosa
catcgcgaccctcggcgtagaacgcccgctggatcgcccttaccagcggccaggcgctttcctcgtcgaggctgcgcgccgccaccagggcccggcaggccggctcggtgtcatagacgaagccttcgggcaacgcgtcgtcgaagcggaacggctggccggtggtctgctgcacggtctgccagtggccgaggatgtagccgcgggtattcgggtcgagcgccgcgccgtggccggcgcgcaggccaccggctaccaggtggaaagcgacgccgtcggcgaccgcctgccgggacagcgcctcggcgaccggggcgaagccccagcaccaggagcacatggggtccatcacgtacagcaggcgggccttggccaaggttcagttctccagcgtggactggcgcggatcgcgaccgagcgggtgcggctggttgcgctgccgcgccagttcgatctgtttctgccgctcgcgagcgccggcgcgggtcttctcgctcagcgagtcccagcagtgcggacagctga

SEQ ID NO: 12514 - DNA, 1020 bp, Pseudomonas aeruginosa
atgaacggaaccgccgccgataccctcgccgtatcgcccccgcccctgcgcaacctctgcgacggccacggccggctcgatccccgggcggtcggctggtccgcccggccgcgggtgctctgccacatccccggccacttcggccggcgcaagcgctggaaccactggtgcatcgtcagccccggctggatgctctcgctgaccatcgccgacctcgactacctgacctacggcgccgcctatttcctcgacctggacagcggccaggcggtagcgcacacgcagatccgcttcttcggcctcggctgccagttgcccgacgagccgcaggccagccatgccttcgagcatccccgcctgcaattgcgcttcgacgaacagcccgggcgcctgcgcgtcaccggccaggccccggacctcggtggcctgccgctggagctggcgctggaagtgcgacgaccgtcgcacctggagtcggtgaacctggtggtgccgatgggcgaacacaccttccatgcctgcagccgccagctcggcctgccgatcagcggctgcctgcagctcggccgccggcgctacgactgccaggcgggccagagctttgccgcgctggacttcggccgcggcgtctggccgctgcatacctactggacccgcgccgccttcgccgcccccggcggcatcgccggcaacttcggcaccggctggaccgaagccagcgacctgcgcgagaacgccctgtggttcggcggcaagctcagccgcgtgctcgacgacgtgcacatccgcgagcctcgcgacccgctggccgaatggcgcctggacagcgcctgcggtcgcgtcgagctgctcttccgtcccgaacagctgcaccaggcgcggcccagcgtcggcctgttctatgccaatacccgccagtggttcggccgtttcaacggcaccctgcgccacgacgacggcgactgcgtgccggtggacggcgccctcggctggatcggttcgacccgcgcgcgctggtga

SEQ ID NO: 12515 - DNA, 780 bp, Pseudomonas aeruginosa
acccgcacatcggctacgacaaggccgccgaaatcgccaagaaggcctacgccgaaggcaccaccctgcgcgccgcggcgctgcagctgggctacctggacgaagcgcagttcgacgaatgggtacggccggagcagatgctggaggccggccaccatggttgaaaccgccaagaccggcgccaccccgctggaaggcgacggcaagcgcatcctgctgatcgtcggctcgcccaagcgcaagagcttctgccacctgctcgccgaatgctacgcccagggcgcgcgcagcaaggatcacgtggtgcgcgaactgaagctgggcgagctggccttcgacccgatcctccacgaaggctacgaacagagccaggtgctcgaacccgacctgctggaagcgcagcggcagatccactgggccgagcacctggtgttcgtctacccggtctggtggggcggcctgccggcgttgctgcagggcttcttcgaccgcgccctgcagccgggcttcgccttccgctaccgcggcacccaggacaaggactgggagcaactgctgggcgggcgcagcgccgacctgctggtctgccacgaccagccgctgtcgcggctgcgcttcctcaagggcccgccggcgcaccggcagatggtgcgcagcgtgctcggcgcctgtggcatcgccacccgccgcctggaagagttcgcgccgatgcgcagttccagcgaggaacagcgccagggctggctgcgtcgcgccgaacagctcggcagccaggtctag

SEQ ID NO: 12516 - DNA, 1197 bp, Pseudomonas aeruginosa
atccggttctggaaaaaaggacttgtcatgaaacactactcagccaccctggcactcctgccactcaccctcgccctgttcctgccccaggcagcccatgcccacggctcgatggaaacgccgcccagtcgggtctacggctgcttcctcgaaggtccggagaatcccaagtcggccgcctgcaaggccgccgtcgccgccggcggcacccaggcgctgtacgactggaatggcgtcaaccagggcaacgccaacggcaaccaccaggcggtggtccccgacggccagctctgcggcgccggcaaggcactgttcaagggcctgaacctggctcgcagcgactggcccagcactgccatcgcgccggacgccagcggcaacttccagttcgtctacaaggccagcgcgccgcacgcgacccgctacttcgacttctacatcaccaaggacggctacaaccccgagaagccgctggcctggagcgacctggaacccgcgccgttctgctcgatcaccagcgtcaagctggagaacggcacctaccggatgaactgcccgctgccccagggcaagaccggcaagcatgtgatctataacgtctggcagcgctcggacagcccggaagccttctacgcctgcatcgacgtgagcttcagcggcgccgtcgccaacccctggcaagcgctgggcaacctgcgcgcgcagcaggacctgccagccggtgctaccgtcaccctgcgtctgttcgatgcccagggccgcgacgcccagcgtcacagcctgaccctggcccagggcgccaacggtgccaagcaatggccgctggcgctggcgcagaaggtcaaccaggactccaccctggtcaacatcggcgtgctggatgcctacggggcggtcagcccggtggccagctcgcaggacaaccaggtctacgtgcgccaggccggctaccgcttccagatcgacatcgaactgccggtcgagggcggcggcgagcaaccgggcggcgacggcaaggtcgacttcgactatccgcaaggcctgcagcaatacgacgccgggaccgtagtgcgcggtgccgatggcaagcgctaccagtgcaagccctacccgaactccggctggtgcaagggctgggacctctactacgccccgggcaagggcatggcctggcaggacgcctggaccctgctgtaa

SEQ ID NO: 12517 - DNA, 2385 bp, Pseudomonas aeruginosa
tgggtgaactgcgagtcgatggagacaccgaccacctcgacgcccagctcgcggaacttatccatgcggttgttgtgggcgatgatttccgaggggcagacgaaagtgaagtcgagcggccagaagaacagtacgacgtacttgccgcgcaggctggaaagctggaaggcatcgacgatggaaccgtcgccgaggaccgcggcggcagtgaaatcgggggcttgcttgttgaccagtacgctcatcgcgaggctcctagaaggttgggttgcgcccggcgacgccaggctcccggaagaatatgcagcgcaggttacccagccacgacgatgcattgaaatgtcgaatttcaattcgcacgatagagtcagcctatgctctcaacctgcggctagactcatgctgtcgcccattacccgtcctcaccgcatgcccttacgcacacgcctgctctggctgttcctgccgttgctggccgccagtctcggcggtatctggctcttgtcggaaagcatcctgctgagccgtttcgaccgagaggaccagcaacgcctgcaagagggcgccaccgtcctgcacaaccggctggacttcgagttgaagcgccacctggacatcgttcgcacctacgcctggtgggatgccagctacgacttcatccagcgccccaacgagaccttcgaacaggaaaacctcgaccacgagatgctcgacgacctgggattcgacttcgtcctgttcctcgacgaccggggtcacctgcaactgaagcagtggtccccgcccgcgcccgaccagcgcgtgctcttcggcgccccctcggcgagcgaccaggccctgctcgaggcactgcagcaacgcgccatccgcctcggcgcgctggactttcgcggacgcaccgaccacagcctgagcgagctgctgctggtcgacaacctgccgaccctgctggtcagcgtgcctatcagcaacaaccagggtagcgcgccggcgaagggcgcgatcctcgccggctacttcctcgaccgggaacgcctggccaacctccgcgaacagatgcaggccgacctgcaaccgatgcccaacatcgccaccgactccacctggaagccgctgcgcagccgcagcggcagtacccacaaccaggccctgctcagcccacggcggttcatcggcgaacatgtccagcaggtctcggtgcagtacctgagttccagcggcgagccgcagctgcgcttcgacatcaccaagaaacgcctgctctacatccagggcgagaaggccatcaacttcttcctcggcgcctccctgctggtcgcgctgggcgctttcctggtcggctacctggccctggagctgtgggtcctgcgccgggtccaacggctcaaccgggaggtcgccgaagtcggacgcaacgcccactcgatacgcctgagcgacttcggcaacgacgagctgggacaactggcgggcgagatgaaccagatgctcgagcgcctggaacacagcgaggcgcgcgaccgggcgatcctccagtcgatgcgcgacggctacttcgaaatggacgtcgacggcgtgatcctcaccgtcaaccccgcgctctgccaactgctcggccagacgcgcgaaacgctgatcggccatccctactacgaactgctcggcgaagacgacctggcgcgtgcccgccaacccttccagcgcgccatgcagagcggcgcaggcaagaccttcgccatccccctgcagcgcgccgacggcagcctcggctacttcgaggccacggtttcgctgatccacgacctgcagggcgaactacggggctaccgcggcatcgtccgcgacgtcagcgaccagatcgcctaccagcagcaattgctggaaatggcctaccgcgacccgctgaccggcctgggcaaccgcaaggccttcgacgaacagctcggccaggcgttgcttcgcgccggctccggcggaagcgaactggcgctgctgtacctggacctggaccgcttcaaggaggtcaacgaccgcttcggccacgacatcggcgatgccctcctcaggaccgtcgccgaacgggtacgcagcaccctgcggcagccggacaaggcctaccgcctgggcggcgacgaattcgccgtgctcctcgaggacagccaggaaaacaatccgcagcgcctcgcagaacgcctgctggcggcgctggtccaaccgatcgcgctgaatggcgaacgcatcgacttcgtcaccccgagcatcggcatcgctctctacccgcggcatgccggcgatgccgaaggactggtccgtgccgccgacagcgccatgtacgaggccaagcgccagcgcaaccactattgcctgtaccaggcgccagcctga

SEQ ID NO: 12518 - DNA, 777 bp, Pseudomonas aeruginosa
ggtttcagcccgcatcccatcggagaaccattccctatgccagccctgagcggcccgcaatacctcggcgaaggcctgaagctgatcatgcgtcccggcctgcgcctgttcgtgctgatccccctgaccctcaacctgctggtgttcgccctgctgatcggcttcgcgatgcagcagttcagccactgggtcgacctgctgatgcccagcctgcccgactggctgagcttcctgcagtacatcgtctggccgttgttcgtcctgctggtgctggtgatcgtgttcttcaccttcaccatggtcgccaacatcatctccgcgccgttcaacggcttcctctcggaaaaggtcgaggtggtggttcgcggccgcgacgacttcccgccgttcagctgggccgaactgctggcgatgatcccgcgcaccatgggtcgcgagatgcgcaagctcgcctacttcctgccgcgcgcgctggtgctgctggtgctgagcttcgtgcccggggtcaacctgatcgccacgccgctgtggatcctcttcggcatctggatgatggcggtgcagtacatcgactatccggcggacaaccacaagctcggctggaacgagatgctcgcctggctgcgcagcaagcgctgggcgtgcatgggtttcggcggggtgacctacctggcgctgctgatcccgctggtcaacctggtcatgatgcccgccgccgtcgccggcgccaccctgttctgggtccgcgaggaaggcgagaaggcgctggtgaaataa

SEQ ID NO: 12519 - DNA, 477 bp, Pseudomonas aeruginosa
agcccggctccggtcccttcgacaacgagttcgacaacacccgcgagatcggtctgcgccaattcgccaaggcctacgagatcgccggccaggcccaggaggaagtgctcggcgaactggattcgcgcttccgtttcgtcgacttcacccgcctgccgatccgcccggagttcaccgacggccagccgcgccagttgtgcaccgcggccatcggcaccagcctggccgccggtagcaccgaagacggtccaggcccgctggggctggaggaaggcaacaatccgttcctctcggcccttggcgggttgctcaccggcgtgccgccgcaggaactggtgcaatgccaggcggaaaagaccatcctcgccgacaccggcaacaagaaaccctacccctggacgccgacggtgctgccgatccagatgttccgcatcggccagttggaactgctcggcgcccccgccgagttcaccgtga

SEQ ID NO: 12520 - DNA, 2226 bp, Pseudomonas aeruginosa
tggaaatcaaaaaaccacccgggaaataaaacgatgaccgaaaactggaaattccgccgtcgaacctttctcaagcacggcgcccaggccgctaccctggccggcctttccgggctgttcccggagacgctccggcgcgccctggccgtcgagccggacatccgcaccggaaccatccaggacgtccagcacgtggtcatcctgatgcaggagaaccgcagcttcgatcactacttcggccacctcaacggcgtccgcggcttcaacgaccctcgcgcgctcaagcgccaggacggcaagccggtctggtaccagaactacaagtacgagttctccccctatcactgggataccaaggtcaccagcgcccagtgggtgagttcgcagaaccatgaatggtcggccttccacgcgatctggaaccagggccgcaactacaagtggatggcggtgcagtaccccgaagccatgggctacttcaagcgcggcgacattccctactactacgccctggccgacgccttcaccctgtgcgaggcctaccaccagtcgatgatgggcccgaccaatccgaaccgcctctaccacatgagcggacgcgccgcccccagcggcgacggcaaggacgtacacatcggcaacgacatgggcgacggcaccatcggcgccagcggcacggtggactggaccacctatcccgagcggctaagcgccgctggcgtggactggcgggtctaccaggaaggcggttaccgctcctcgtcactctggtacctgtacgtcgacgcctactggaaataccggctccaggagcagaacaactatgactgcaacgccctcgcctggttcaggaacttcaagaacgctccgcgcgattcggacctctggcagcgcgccatgctcgcccgcggcgtcgaccagttgcgcaaggatgtgcaggagaacacgctgccgcaggtgtcgtggatcgtcgcgccctactgctactgcgagcatccctggtggggcccctcgttcggcgagtactacgtgacccgggtgctcgaggcgctgaccagcaaccccgaggtctgggccaggaccgtgttcatcctcaactacgacgagggcgacggcttctatgaccacgccagcgccccggtgccgccgtggaaggatggcgtcggcctttccacggtcagcaccgccggcgagatcgaggcatccagcgggctgcccatcgggctcggccaccgcgtcccgctgatcgccatctcgccctggtcgaagggcggcaaggtcagcgccgaagtgttcgaccatacctcggtgctgcgcttcctcgaacgccgcttcggcgtcgtcgaggaaaacatctcgccctggcggcgtgccgtctgcggcgacctgacttcgctgttcgacttccagggcgcaggcgatacccaggtcgcccccgacctgaccaacgtcccgcagagcgacgcgcgcaaggaggacgcctactggcagcagttctaccggcccagtcccaagtactggtcctacgagcccaagagcctgcccggccaggaaaagggccagcgccctaccctcgcggtgccctaccagttgcacgccacgctggccctcgacatcgccgccggcaagctgcgcctgaccctgggcaacgacggcatgagcctgccgggcaatccgcagggacactccgctgcggtattccaggtgcagccgcgggaagtcggcaatccgcgcttctataccgtgaccagctatccggtggtccaggaaagcggagaggaactgggccggaccctcaacgacgaactcgacgacctgctcgacgccaacggccgctacgccttcgaggtgcacggccccaacggcttcttccgcgagttccacggcaacctgcatctcgccgcgcagatggcgcggcccgaggtatcggtcacctatcaacgcaacggcaacctgcagttgaacatccgcaatctcggccgcctgccgtgcagcgtgacggtgacgccgaacccggcctatacccgggagggcagccgtcgctatgaactcgaaccgaaccaggcgatcagtgaagtgtggctgttacgcagcagccagggctggtacgacctcagcgtgaccgccagcaatacggaagccaactatctccgccgcctggccggacacgtcgagaccggcaagccgagcaggagcgatccattgctcgacatcgcagcgacctga

SEQ ID NO: 12521 - DNA, 759 bp, Pseudomonas aeruginosa
ccctggtgcccagcggcagccagcgcatggaattggcagcggcgcggtttcgaacgtctcaacctgctctcccgcggggtcgacagccaactcttccatccctcccggcgcgatcccgaactacgccggcgctggggcctgggcgaacaggacatcgccgtgctgcacgtcggccggctggcggcagagaagaacctcggcctgctcggcggcaccttccgcgcgctctgcgccgcccatccgcagctgaagctgcgcctggtactggtgggcgacgggccggagcgcaggcacctcgaacgggacctgcccgaagcgctgttctgcggcgtccagcgcggcgaaaccctggccgcccactacgcctcgggcgacctgttcctcttcccaagcctgtcggagaccttcggcaacgtggtcctcgaagcccaggccgccggcctcgcggtggtcgccttcgaccaggccgccgccggccagcacatccgccatgggcacaacggcgtgctcgccgcgccgggcgacaagagcggcttcgtcgaagtcgccagttggctgctggacgaccaggaacgcctgcgccgggtccgtctcaacgcccgccaacacgccagccggcaaggttgggacagtatcgtcgagcacttccagaactacctggaagacgcctgcgccagtccgctggtccagcccgctcggtcgaagcccgagcggccgccggcagaggatggcggggccttgccacgcagccgcgagtag

SEQ ID NO: 12522 - DNA, 621 bp, Pseudomonas aeruginosa
agagcccaggcatggcgcatgacgcgaaaggcgcccacaggcgcctttcgctataccagcttagcagttccgccggcggacggcccaggccatcaatcggcgaatgaacgccgatcagtggtggtgaccgccttcgccatggatgtggccgtgggcgatttcctcggcgttggcctcgcgcacgtcgactaccttgaccttgaagttcaggcgctggccggccagcggatggttgccgtcgacggtcacgtcgtcgccgtcgatgtcgcggatggtgacgatctgcatgccgccgtccggagccgaggcgtggaactgcatgccgacttccagttcgtcgacgccttcgaacatctcgcgggtcagggtcgcgaccagttcggcgctgtattcgccataggcgtcttccggctcgatggcgacgctcagttcgtcaccgacgttcttgccttccagggccttctccaggccgacgatgatgttgccggcaccgtgcaggtagaccagcggcgcgccaccagcggaactgtcgatgacatccccggcgtcgttggtcagggtatagtcgatggaaaccgccttgttggccgcgatctgcatggttcgaaaccttttcgataa

SEQ ID NO: 12523 - DNA, 1272 bp, Pseudomonas aeruginosa
cgaaaacgagcggcacagacagctcggccgcgaatttcgctgcggctggtgtgcccgggaagaagaagagcagaccaaggagcagtgatgccctcacgcaacatactggtgatcaactgcggcagttcgtcgatcaagttcgccctggtcaacgaggcccactccctgtttcccctgcacggcctcgccgagcgcctgggcagccgcgatgcggtgctgcgctggaagcgcggcggcgacagcgacagcctgatgattcccaacgccgaccaccgcgccgccctcgcccagttgctgccgatggtgcagaacgccgcgggcggcaagctccacggcatcggccaccgggtggtgcatggcggcgagctgttcacccatgccacgcgcatcgacgaccgggtggtcgaggcgatccgggccaccgcgccgctggcgccgctgcacaacccggccaacctgcaaggcatcgaggcagcgatgacgctgtttcccaagctgccccacgtcgccgtgttcgacaccgccttccaccagagcctgccggagtacgcctaccgctacgccctgccggaggccctctaccgtgagcatggcgtgcgccgctacggtttccacggcaccagccaccgctacgtcagccaccgcgccgcggaaatggccgggttggcggtcggcgacagcagttggctcagcgcccacctcggcaacggcagttcgacctgcgccatcgtcaacggccagagcctcgacaccagcatgggcctgaccccgctggaaggcctggtaatgggcacccgcagcggcgacgtcgaccccaacctgcacagccacctggcgcggaccctgggctggagcctggagcgcatcgactcgatgctgaacaacgaaagtggcctgctcggcctctccgacctgtccaacgacatgcgcaccctggagcaggagcgcgagcagggccaccccggcgcggccctggcgatcgaggtgttctgctaccgcctggccaagtccctggcggcgatgagctgcgccctgccgcaactggacggggtgatcttcaccggtggcatcggcgagaactcgccgctggtgcgcgccaagaccgccgcccacctgcggctgttcgacctgcgcctcgaccaggaggccaacgcccgctgcgtgcgcggcgtcgccgggccgatccaggccgcggggcatccgcgggtactggtgatcccgaccaacgaagagcggcagatcgccctcgacacgctggccctgctcgactga

SEQ ID NO: 12524 - DNA, 402 bp, Pseudomonas aeruginosa
acaaggaaatcccggtggacgaccgcgagcgcgccgagcgggtcaccgagttcgtcgccgggcacatcgatttcgaatggctcaagcagcgctgcggcacgccgcgcgagctgcgcctgtcgccgccggcgttccgctaccaggtggtgcaacgcgcgcagaaggccggcaagcgcatcgtcctgcccgagggcagcgagccgcgcaccgtacaggcggcggcgatctgccaggcgcgcggcatcgcccgctgcgtgctgctggccaagccggaagaggtccaggcggtggcccaggcccagggcatcgtgctaccggaaggcctggagatcatcgaccctgacctggtgcggcagcgctacgtcgaaccgatggtcgagctgcgcaagggcaaggggctga

SEQ ID NO: 12525 - DNA, 219 bp, Pseudomonas aeruginosa
aaaagcccgccgaatggcgggctttttcgtccaggccgcgatcagtactgcggctgggtctgcgccgggccctgggcgcccggaaccggtcgcaggttgacctcgacgcgccggttctgcgcgcgaccgtcggcagtggagttgctcgcgatcggctggtccgggcccatgccgcgggtgctcaggcgggtgccgtcgacgccctgggcggtcaggtag

SEQ ID NO: 12526 - DNA, 621 bp, Pseudomonas aeruginosa
agccgagcagcagggcgatctcgtacagcggtagctgggtggtggtcaggtattgcagggccaggcgcttgcgcacatcgtcgaggacctgctggtaggtggtgcccaacgacgacaggtgccggcgcaggctgcgcccgctggtgtgcagttcgcgggcggcctgttcgagatcggggaagtcgccgggacgcgccagcagcaggcggcgcacacgggtcagcaggccttcctggacgtccagggtggccagcagcgcctcgcactgctgctcgcacatctgcaccgtggccgggttggccagcgccatcggtcgttccaggtactcgctgggcatgctcagccagtgccagggctgctcgaactccgcggccaccccgaacacctcggcgtagcgccgggcatgggccggcggcggataggcgaagccgacccgcacgtcctgcaacggctcgccgaccaggaagcaggcgatggaatacagcgtcgccatcaggccctcagcggcgaacaccgaagcggcgcccagcggcatcgactccaccgcgcgcaactcggcgcggccgtcatcgagcaccagttccagttcgtaggccaggccgagcacccggtagtacttga

SEQ ID NO: 12527 - DNA, 492 bp, Pseudomonas aeruginosa
gcaaccccaggtggctggaaggcgccgacccgaccatggcccgcctgtggcgctggcacgcactggaggaaaccgagcacaaggcggtggcctacgacgtgttcatgctggtcaacggcaaggccaggctgcgccgccgggcgatggtccagggcaccttcttcttcgccctcgacaccaccaagggcctggtccacatgctcaagcgcgacggcctgctgtggaacttcaaggtctggcgcgacggcatcaagtggctgtggggcaaggacggcgtgttccgctcgctggtgggcgtgtacctggacttttacaagaaggacttccacccctggcagcacaataacctgcacctcatcgagcagtaccgcgaccagttcgaaccggaaccgaaggccgcctgaccctcctcgccgcccctccgcgccgcgagaggggcttgcatcgcttccctgccctgcctggtatttcggcctttcgtccatgcattaa

SEQ ID NO: 12528 - DNA, 465 bp, Pseudomonas aeruginosa
tgccctgggcgatcagcgctcgcggcatccacagcggcatcgccagggtcgagccgggcagcgccgccgaggcgatcatccacggcaccttgcgcatctggtaaccggccgggtcgatcagcaccagccgctccactcgctgcggctgcgccagggcgaagttccaggcgatataaccgcccagggagttgccggcgatcgaggccttgtcgatcttcaggaaatcgagcaactggccgaggatcgccaccatgcgctcgccggagtaacggctgtcacgccccggcccggtcaggccgaagcccggcacgtcgaagcgcacgatgcggaagtagggcgacatcgccttcacccagccgtcccaggtgtgcagcgaggcgaccacgccgtggatcatcaccagcaccggcttgtcgcggctgccttcgtcgcggtagtgcagcgggaaaccgtccagctcgatga

SEQ ID NO: 12529 - DNA, 1149 bp, Pseudomonas aeruginosa
acaccgggatcgccgcgagctggatgttggttcgttgcagatgccccaccagcggcccctcgccctgcgccgcctggcgcgccagcgcgccgtagccgccgaggtcctcgaataccgcctgcaagccgtcccactgcgccgttgccatcccgtccgccccaatcgaagcgcggggtgacggcggcctcggccatcgctaacctaggccgatccacgcgccccgcaaggaaagtccgtgccgaccctatcacgccgcctgctctggccgctggccatccttttactggttctcggccgcccgctcgcggccgccgacctctactacctcggccagcgcatcccggacatccagaagccctgggacagccacgactaccaggtgctgatcgacgccctgaagaagatcgaggaaacccagaagaacgccctgccgcgacgcagcggcgaattcaccgggccgctctacctgcgcatggtcagcgaggaaaacttccgcccgcagctgaacatctacagccccctggagatccgccagaacgaggcccgcgaagtactgttcaagctcaaggagctgatgcgcctgtacttcgatttccgcgccgccaaacagccctacggcgccgaggcgctgggcctgatgagctactcgctgcgcgagcagtcgatcctgttcaccctcaccgtcgaattctggatgaccctgtcccaggccgagcagcgcaaccccgcgcgcctgcagggcatgcaggaaaccaaggcggccgcggcgatgctcaccggcagcgccctcgactacctcggcctcaccgcccagttcgagcgccaggacttggtgctctactccgccgaactggccaaggaaatgcccgagctgttcatccacctgccctccccggtgcgcgcccagttgctggaacgcatcgccgctttcgccaaggaccacccttaccccgaggtccgcgacaacatgcgcgacctgcaaccggtgttgcaggcgatccaggccgacgtggaaaaacagctggcgcccgggcggaacgccaaggcaccggacaaacccctggacctgagcccgcctccggaggggaaacccagcggcgtcaaaggtttatgagcggcggattggactctcgcagccctttgccgtag

SEQ ID NO: 12530 - DNA, 321 bp, Pseudomonas aeruginosa
gagaggtgtctgatgagcaagcaacgacgtacgttttccgccgagttcaaacgagaggctgccgccttggtgctggaccaaggctacagccatatcgacgcctgccgttcgctgggggtggtggattcggccttgcgccgttgggtgaagcagctcgaggcggagcgccagggtgtgaccccgaagagcaaggcgttgacgcctgagcagcaaaagatccaggagctggaagcccggatcaaccggttggagcgggagaaagcgatattaaaaaaggctaccgctctcttgatgtcggacgaactcgatcgtacgcgctga

SEQ ID NO: 12531 - DNA, 207 bp, Pseudomonas aeruginosa
acccaggaaaacgctcggctggaaaacacctgccgaggtactgaacgactatctaacatctattcagcaacccagtgttgcgagggccgattgaatccacccaagcgcaaccaggtcggtgcaggcaccttcggtaagaaagcggcgagagactctcggtttccctccccgaacaacaggcgaagagtgcgcaagataggttggtag

SEQ ID NO: 12532 - DNA, 237 bp, Pseudomonas aeruginosa
atccagttgctcatcgcgcatgaactccaactgcattacgttaccgcggatgatctcgtgcgcaccgacagcctgctcagcgatattcagcaaacgagcatgattggtctcgccctgccgacccgccctgaggcgcagcgctggattgctcaggctctgctgcagctgccgaccgaacccagcgtgacgctccttgaagtcattggcgagctgcgcagccacatccatttcacctag

SEQ ID NO: 12533 - DNA, 327 bp, Pseudomonas aeruginosa
cccagccgaccggcccagccagcgcggcgacggcacgaccgccggcaaaggttcccccagcgaccaccgcactgcgcagaccgtgcccaagcaactgctgggccatcgaattcacgattaccgtcgaagtgcgatagaggatcatccgtgctacggccggcaccaccagcccactcagtgccgaaccattcagcagagccgtcatcttggtcttgtcgagtcccgcctcgcgcagaatctcttccagctcgcgacgatcctcgcccgacgacttctccaacgcctgacgtaggatcgactgcaccatcgcctcctccagctcgatga

SEQ ID NO: 12534 - DNA, 3177 bp, Pseudomonas aeruginosa
tccccgactaccagaagcagaacatacctctactccgagagcactgtcctatgggtgtgcgcgtgttcactcagagccaatgcgtacaggaggtgcagaagcatgcgtcccctttctgatattgcgaccacactgttcctggctatcgctgtgcgctacgtcaccaacgaacctacgctggccgatgctgcggcaatcattgcaggcaggacacgcaagtggagcacctggggctccctgacggaagcgcagcaaacgctaatcgcccagagtttgcggctcagaccttctttgctggctcagccaaaacgcttcatgttgagcgccgagggcatcctgaagggcaagttgagctcttttgagctggtggacagctccaatctgaacactgaactccacgagcaagatcggtatcgcctgtcgtcccatctggatattgaccaggtcatcagggaaaacttcgaggcgctcaagaatggtcgtactgcgccggctcatggacagctacccaatgaaggagacgtcgtactcaagcacatcactggagatcacgtcagggtcttcgccatcccggaaaatgaacgtcatgtcctgaatgcgctcgaccagcacgtcctcattccaccatcaacggcgttacccgagatcagctgggagcacgccaggctgatgaagctcgcgaaacaaatggatgcctctcctgacctgcatagccagcacgcagcgtcattggtgaacatctggggtgatgagcccgttcgcaaagccgactcggggaatttttacagagtcaatgcgccgactggttccggcaagagcgtcgcgatggtgatgatggccatcgacgcggccgagcgtggacacagggttgctatcgcagtccctacgctagttgaagtcgagaacaccgtacgcatcatcaagcaatcggcggcggcagtaggcaaagagttgaaggtcgcaccgctgcattccgcctctcggatatacgagcgtgcagagatgcagttcgagcagggcaagaccgatcacccctacgattatgcctgcctgcttgacgtttactcagccgacttgatggctgtggagccaggcaacgagccgtgcttcaacatacgcatatcggcatgtggggatgatggagaggagtcgtcgaagcgcctcaaacattgccccttcctcttcaggtgcggccaaacccggatgctgtcacaggcgatggaggctgacatcgtggtgatcaaccaccacgccctgttgtctggcacaacccgcatcccgctttcagacgctgaacagtttccaggcccccgaagcttggttgaaatcctattgcgaacaacacccgtatttctggtggacgaaatcgatggcctcctgaagtcggctatcgatagcagcgtgatcgagctgaggctgggcaatgtaggtgataacagcccgttgctgcgtctgttcaaccacgttgttggaaagtcccacatccccggaatcgatcgaagcagcctttaccgggtcaactgggcattgatgtactgcacgctgagcgtcagccagctcatgaatcttcagcaagaacgctatttcgaatggccaatcaaagagaccacctggtcggacgctgatgacaccttcatcacacaagcccttggcattacccgagaaacacttgagtacctgtttagcaacgatctcggtcagcttccgcaccacctgcaatcactgagccgcaaccttgccaactggcgttctaacgatggggaacacagactcgaaacgctggccatcaccctgggaaacctgatcgcagacttatccgagagcggcaggctgcctgagcgcctgaaggaacatgatcggatacgcctgaaagcatctctgattctgcgcggtaccctgctggtcatcgagacccacctgcgaaatttgcaggtcgagctacctgccttcgtcaatgcggagatcccttatgcgtacgaggtcaggcggagcatcgccggcccagaaccgctgagcccaagccccaacgggccgctgcaaagagcagtctttggcttcaaacgcaaagacagcagcgaccaagactcgacgctacacgtcgtcgccatgcggggcgaccctcacagtaccctgctctccctccctgacatcagtgcgttgggctatgccggagtgaagaggctgttcatcggcttctccgcaacagcctattttcccggcgccagtgcgttcgatctgaaagcccaggacttcattgatgtgccggacgccaagggccaggtgacgttcgagaacgtcaatcagaccacggcgatctctgggggaccatttgcccaacgcaaattcctggttaccaagctcgccaaggaactctggccatggctaaaggcccggttggaaaagcttgcaaacgatcccgagacccgggacagggcccgcctgctgctggtcaccaacagcgatgcggacgctgaagcactcgccatgaccttggcgaaaatggcggacggcccgggcgagtccgtcggatgggtgcgtggtcgccaaagcgaatataaaccctcatcactggaggcccagcaaatgcttgtctatgacgaccttgccgagttcaccagcggcaagcacaagcataagacgctattggtcagcgcacttgggcctatggccagaggacacaatatcgtcaacgcagacggactctccgctattggtggagttgtgatctgtgtccgtcccttaccggcgtccgacagccccaacaacaacctggcccacatctgctacgaaaccgggaacacagtgctgccacgctccagtccgggagaggtcatgacgcaagaacgcaagctctccaatgcgctgttgcagacgatccgtaccgcacgcccggcgtttagccagcaacccgccaacatccgtcactacaccatcatgaacattctggtgagcctgacccaactcattggacgaggccgccgagggggcacccccgtcacgtgctacttcgcagatgcagcgttcctcaaaggtctgaagccctggtcagagatgctcaatgaaagtgtcaaccggctcaaggaagacggcgactgggaacagttcgagcgtcaccatgcaggcatcgcatcggcggttcagcaatacattcttcgatcaagaaaggagtccgtatga

SEQ ID NO: 12535 - DNA, 360 bp, Pseudomonas aeruginosa
tccaaggcctttggccaagagttggtattgctcggctttcaggctgcgcttatcgcactccctcacccaatcagcgatgcgctcgcgcaattgatctatccctgcgccccctactcgcaggtagcgctggcgatgttgatcgaccacacctttctgggcctcaagctgacttttgcattgctcctgatccagttcggcctttttgtactccttctcgagcctgttggtttcagccaaccacagtcgatacccctgctcggcgaaccaaaccgggaggataccttcgagagcctgcttatcgtgcagctgttcttgcaagacctggtaacgctcccagccatcggcgaccggttgcaatga

SEQ ID NO: 12536 - DNA, 534 bp, Pseudomonas aeruginosa
tgcaaggacccgcacatgagtggaaaacccgccgcccgcgtcaccgatccaacgacctgcccagtgccagggcatggcagcaaccccatcgtccagggctctcccgacgtcgttttcgacggcctgccggcagcacggcaaggcgacgcctcagcctgcggaagcccgatgatctcagccgtttcgtcgacggtactcatcaacggcctgccggcggtgacgctgggtagtatcggggcgcacggcaatgtggtgatcggcggctcggggacggtactcatcggcgacgtcttcacgcccgccccgcgcgctcccgcccttccccctaaccgcaacggcgtgccctgttccgggcgcttccagctcatcgaccacgaaacgggcaagcccgtcgccggacgccgggtcagggtctggtcgagtggcggctggaatgcgttcgacaccacggatgccgacggcatgacctcctggatcgagcgccccaccgcggagaccctctacatcgacctggtgcagaggggcgacgcatga

SEQ ID NO: 12537 - DNA, 1119 bp, Pseudomonas aeruginosa
ttcccgcctattgatcaagaggaaaagcccatggaacagccattcgatctggccgcagagttagccaagcaaccccatctgctggaaatagccggcaacctgttgatgaagggcggccccgaagactatatcggtgcagtgctttgcctacgcggcactctctacttcaaagaggcccatacccctctggtacgagagtcattatgccaatgcttcgatgagttcaagcgcctggcagagccccacctcacccggctctggcgtgaagagcctgcacaaggaaagccactgaccgcataccgtgacacccaaccactgcgcgagatgatgggggcaatggatgaagacgatcatctcagcttctgctacaccagcggcaagaaatcccgcgatgcaggcgcctggctgtttgatatttacggcaagcggagctggcaagccaaaatggggcatgatcttagtgttctggagttctccgtacctctgctatatcaagagcggcagccattggatttcctacagctgtttattgacttcgcacggcgactagagccggagcaggggtatgcggggcatgcctacaatctctcgccgaccagttgggacaatgacgagccctccgaagcctttatggcggcgcgtatgccgggtttggatgtagggacggcttgtctgctggccaatactcccgagttcaaacctacaagaatcaaaactgtcagttggctaaccctcctgaacaacgagcgcctggcgctggccggcgggctcgttgccctgcgtgcgcaactgccctccagccactttgccttctaccgctacggcgatggcgtggtaatccaggccggtgcctatccctatatcgcgggtgatgcggaagactccagacccgctccgtatgtgctgctgaaccacgcgctcaaaggcattcgctatgaaaccgtcggctcgctacacggcggctcccatgacggcgaattgcggctggtgggctgggcggccgatcaatggctgaaacggctggatgtggaagacagcgaactcccccgctggcgcgacaaattgctcaacactgagccatgcttggacgcgacgaactcactgccggagcgcccgtag

SEQ ID NO: 12538 - DNA, 186 bp, Pseudomonas aeruginosa
gggcttacgttttctgggatcaaaagtgctcgccgaggctacactccctatgaggcgagcctgacagaaaaaatatctgcccctcacaagagtgcttataagcaagaattcaacctatctaatcgtgccttcaatatcacccaaacagtatctattacttattattcaacaaccatccctctttaa

SEQ ID NO: 12539 - DNA, 459 bp, Pseudomonas aeruginosa
tggtcagccgcagcggttcggcgcaggacgacctggtcggtgaattccgccgcgccctgctggccgagacggcggctcaggaggccgcgccgaccaccgcgtagcgcggcgccgggcgcgccagctcgccgaggaaggtccacaggcgttcggcctcgccgggtagcggcaggcggcgacggatcagggtgtagcgcaacggcacgtcgaagcgctggccgccggcgcgcaccaggcgacggctggcgaggtcctcgcggaccagggtatgcggcagccaggcgacgcccaggcgcgactgggcgaagaagcgcagcccctcggtctggctggagctgtgatggcgctggaggaacaggccgctgtcgcgcagcagcggttccagggcccagcccaggtggcattcctcggagtagccgaggaacgatagcgcttcggtctgcaggcggtcgaggttga

SEQ ID NO: 12540 - DNA, 492 bp, Pseudomonas aeruginosa
gcatcaccaggtcgatcatcgttgcgcgttcctcaacggtcgggcgttttcagtctacttcgcgcggcggtgcctgttgcaaggctaaagttcggtttgttttgccgatttggcaagcagctcgtcgactcccgcaaaacagaccgggaaaagcggcccacagtagtgaggtcgcgcttttccagccatcgacccgcccgagcatcgtggccgggcgggtccgccacgaggacaggaccatgcagacatcccccgctccggccatcgtcgccggcggcgcctaccagccggtggtgctccacgccggcatcgcctacgtcagcggccagttgccgcgccagcacggcgagctgcgctggaccggcaaggtcggcagcgaactcgacctggaacaggcccgccaggccgcccggctctgcgcggcgcgctgcctgcaggcgctggaggaggcgctgggcggcctgcaacgggtcgagcggctgctcaaggtga

SEQ ID NO: 12541 - DNA, 609 bp, Pseudomonas aeruginosa
tcgcggcggtgcggccatgagcgcgctcttccccgccgcccccgacgccttcggtgccgacgaactgctgcgcctgcgccgcgagaccccggcctggggcagctacgcgcacttcgcccatggctccgccagcctgccgccgcaggtgctctacgacgccctcgacagctggctggaagccgagcggcgctggggcgtgcagcgcgccgccgagcatttcgccgagcccttgctggcggtccgcgacagcgtcgcgcgagtgctcggcacccagccacggcacatcgccctgctcgactgcgccagccgcgcatggtcggtggcctttgccgcggccctggccgcccatccacggatacgggcgatcagcagcttcgacgaatacggttccaacagcctgtgcctgctcgccgcgcgccagcagcgcgggctggagctgcgcctgatcgacgcacgcggcgacgccgcacagctgttgcaacggctcgacgagcagttgcacgacctcgcccccggccagacgccgctgctgtcgctcagcgcggtgcccaccgggcatggcgcggctaccgcgctggagggcgtggccgagcgcatccgcgcccatga

SEQ ID NO: 12542 - DNA, 1449 bp, Pseudomonas aeruginosa
cgctcagcgacaactgccagttgctgcgccaggctctcgacgaactgcgcgccaacggcgccgaggccgagctcgacggcgaacggatcttccagcgcatgggcatggaacgcaccctcggcgaatacctgtcgctgcagcgcctgcatccgctcggcgaagccaacttcaccctcgcacgggagttcgtccagtgaccgccgccctcgccgcgaacccaacccagcgctaccgctgggtcatcctgctgatcgccaccttcgcccaggcctgcgcctgcttcttcgtccagggcatcggcgcgatcgccgtgttcatccagaacgacctgcaactctcgtcgctacagatcggcctgctggtgtcggcggcgcagctggtgccgatcgtcggcctgctggtggccggcgagctgctcgaccgctactccgagcggctggtggtcggcctcggcacgctgatcgtcgcgctggccctctgcgcctcgctgtgggccaccgactacctgaccatcctgctgttcctggtggtcgtcggcgccggctacagcacggcgcagccgggcggcagcaagtcggtgtcacgctggttcgccaagacccagctgggcttcgccatgggcatccgccaggccgggctgccgctgggcggcgcgctgtccgccgcgctgctgccgtacctggcggggatctacggctggcgcagcgcattcctcgccggcggcctggtagcgttcctcggcgcgctggccttcatgctcttctaccgcaccccgccggacgcccccgcgcccggcgcgaaccccgccgaacgcgacctgggcgcggtggtgaagtcgcggctggcgatgatcaccgacccggcgatgaaaaacatcgtctgttccggggtggcgctgatctcggtgcagtacggcatcctggtgttcaccgtgctctacctgcacgagaccctggagatcggcatcggcatggccgcgaccctgctgttcgtcgcccagggcagcggcgtcgccgggcgcatcctgctggccgcctggagcgaccgctgccgcgccgggcgctacttcccggtgatggtctgcctcggcgcggtgatcctcggcctgctggcgctggtcctgctgcccctgcaatcaccgttggggatgggcctggtattggcctggctgggcttcttcggcttcggctggtacagtccctgggtggcctatgtggcggataccgcgccggtcggcaaaaccggcttcgccctcggcctggcgatggccatcaaccagttggcgatcgttctcgcgccgccggcgctggggctgctcaaggacttcagccacagcttcgtccccggctggctggcgctctgcctgatggcggcggtagcccttgtggtcaccgcctggagcggccgcggactgcccaccgcgctgccacagaagcactgaagcgatga

SEQ ID NO: 12543 - DNA, 534 bp, Pseudomonas aeruginosa
ccagttgcaccggcagagtctcgaggccctggccggagagttcggcctggcgctggacgaggccctgctgcaacgcatcactggcttctggcaccgcctgcggccgtggccggacacgctcgccgggatgcacgcgctgaaggccgactactggctcgccgcgctgagcaacggcaacaccgcgctgatgctcgacgtcgcgcggcacgccgggctgccctgggacatgctgctgtgcgccgacctgttcggccactacaagcccgacccgcaggtctacctcggcgcctgccgcctgctcgacctgccgccgcaggaggtgatgctctgcgcggcgcacaactacgacctcaaggccgcgcgcgccctcggcctgaagaccgcgttcatcgcccggccgctggaatacggccccggccagtcccaggacctcgccgccgagcaggactgggacctgatcgccagcgacctgctggacctgcaccggcaactggcggcctcggcctgaccgacttcctccttcctgccccctga

SEQ ID NO: 12544 - DNA, 1104 bp, Pseudomonas aeruginosa
tggcgatgctgctgcaggcgctgtccgcgcgcctgggcatcgccagcggcctggacctggcccaggcctgccgcgaacgctactcgccggagcacctgccgcctgctgtggctggcctgccaaaacggcgatcatcgcctgcgacctggccgaggtgatcggcaccgccatcgccctgaatctgctgttcggcctgccgctggcctggggcgccttgctctgcgtgggcgacgcgctgctggtgctggtcctgatcggacgtggccagcggccgctggaggccttcgtggtggcgttgctgacactgatcttcgcctgcttcgcggtacagttgctgctctcgcgtcccgaactcggcgaggtgctccaagggttcttgccgagcccgcgggtgctcagcgacccggctgccctgtacctggcgatcggcatcgtcggcgcgaccgtcatgccgcacaacctctacctgcattcctcgctggtgcagagccgcgcctacccgcgcagccttgccggcaagcgccaggcgctgcgctgggcggtggccgacagcagcctggcgctgaccctggcgctgctggtcaacgcggcgatcctgatcgtcgccgccagcgtgttccaccgcaacgggcacaccgaggtggtcgatatcgagcaggcccacgcgctgctctcgccattgctcggcctggaactcgcctcgctgctgttcgccgtggcgctgctcgcgtccggcctcaactcgacggtcaccaccaccctggccgggcagatcgtcatggagggcttcctccgcctgcgcctggcgccctgggcgcggcgcctgctgacccgtggcgtcgcagtgctgccggtgctgctggtgaccctgctctacggcgaggatggcaccgcgcggctgctgatcttcagccaggtgatcctgtcgatgcagttgccgctggcagtgatcccgctgctacagttcgtttccgaccggcgcctgatgggcccgctggcgatcggcgccgggacccggtggctggcctgggcggtagcgctggcgatcgtcggcctgaacctgcaactgctggccgacttcgcgttcggctgagcattgcctga

SEQ ID NO: 12545 - DNA, 369 bp, Pseudomonas aeruginosa
actgccagcttgctcttttcgaaaaaagccggcataaccagtacgttcccccgacacaaagctttcttggcactgtcacggagcgggaacatttgcaatatacgctgctccataagcgtgaaagtaaaggaacataagaatatgtctattcaacatcgtactcaggatgcaattcgcaccctaaccgccgcatttgcgccgttcgactgcctgatccaggcaactcgtaaaggaaacttcagtttcaccatcgttgaccagcatggcgtggcctgccacagcgagcgcctgtatccggagcagtacgacgactccggcaaaatggaagaagtgatcaatcgagttcgcaagaaaacactggctgcctga

SEQ ID NO: 12546 - DNA, 492 bp, Pseudomonas aeruginosa
atggacggggcctcatgcccagggatcatagctgccgaagctccagacgtggccctccggatcgcggcaagtgaagccgcgaccgccgtagtcctcgtccttgatgtcgatgacgatctcggcgccggcggcctgggcgctgcggaacagggcgtcgggatcggcgaccaccaggtagaggctctgggtattgccgccggcttcgtcgacgtgccgcatcagccgaccgtaggcgttgtcgcggacgctcgagccgagcatcagcataccgttggcgccgttcgggctggcgtaggtcaactcggcgtggagcacctgtccgtcctcgccgggcaccaccagcttgcgctggaagccaaaggtccggcacagccagtcgatggcggccggcgcatcgcggtaacgcaggcagggaatgacgctggcgacggtgttgctggcgggcgtgtgcatggcgcatacctccgggggaaagcacgaccaccagcatag

SEQ ID NO: 12547 - DNA, 1464 bp, Pseudomonas aeruginosa
ccaggcgcagagcaggccgaggcccagcaggctgaggtcgacgccggccagcacccagtcgccgcgctgcaggctggccaacaggttgccttccgggctacgcagcaggccgagcagcggcaggcccagcgccagcacggcggcgaggcgcagttgcgtgcgaccgagggtcccgctgttgcggcggacgatggcccacagcgcgaccagcgcccaactggcgcaaaacacgcggatctcccaggtgtcgcggccggccagttgcgtcggcagcaggcggttgccccacagcagcgccaggctggccagcggcaggccgccgcagaccgccaggttcagcgcccgcaccagaccaacgccacgactgccgcggacctcgcgcttggccagccagacctgcaacccgccgaagatcatcatcgccccggacagcccgagcaacaggtacatccagcgcaccaactggccgccccactggatcatgtgcaggccggtcagccagccgtaggtggcgtagccgggcgcataggacggctgggcatgcagcagttcgccgctggaggcatcgaagttgaccgtgcgctggtcgtcgaggatgcgcgaggcgtcgcgccggcggatgtccacggtggccgcctcgtcatagggatggtggacgctgatccagcccggcgcgccgccgtcgccccagaccttgccggcctcgacgatcaggccgtcgatggacgccggcggccccgccgggcggccgacttcctcgcgttcgtaggagccctgcacttcatggaagaagcgctcgccatcgttctggtagaccacctgcaggcccgcctgcatgtagtagacgatgaagatcaccaggccggtgtaggcgatcatcaggtggaacggcaggccgatcacccccagcacgttgtgcgcgtcgagccaggcgcgctgccgcgccgcctgcgggcgcagggtgaagaagtccttgaagatccgccggtgcacgatggtcccgctgaccagcgccaccagcatcagcatcccggcgatgccgacgatgtacaggccgaccatgccggcgtgcaggtcgtagtgcagggtgaagaagaactcgccgccgactgtcttcggcagcggctggccgctcaccgcgtccagctgaaagaccttgaactcgctgccgtcgcgcggctcccagccggcgttccagtagggcgcccgctcgctcggcggcagcatccaccaggcatgggcatcgggggcgcgctggcgcaaccagtcgcgcacctggtcggcgcccagcgactgcgcgccgggcaggtgcacgtccggctgcatccagcgggtcagctccttgtcgaagctggccaggctgccggcgaagacgatgacgaacagcagccagctgaccagcagccccgaccaggtatgcaggccggacatcgattgacgcaggttcatggacgcgctccgtag

SEQ ID NO: 12548 - DNA, 2715 bp, Pseudomonas aeruginosa
ccaagcaggaccgcgacgaggatgcggccggtgacggacagtccgccggccagggcctggctggtcatggggtggcgtcccgggtggaaacagggccttgcatcgtcgctacctcgtctggctggcacggcgacgccgcgctcgcgggtggcgaggcggtcgtcgattcggaaggtttgcgactgtatctcaattacgttcgcatttgtacttgctccggacgaccgccaggtcgcgtcgcgccagggattgccggggtccgacgagtgcgggtcgtatcccgtcgcattcgtccgccgcgccatacgtccatctccgctctgcgcaagcgcgccgagcttggtaatatcggctgtttgcggtttcggctggtctcgccgaaggacataccggatgacttcaccctccgccccagacacccagctcagcctggccatcgacccggcccggccgtatgcgcggctgaccctcggcagccacgtgcacagcggctacgacctgcgcagcggacgcatgcagagcatttcccggcaccgtgcggcgctggccttcatctatgccggcgaggcggtttccgggcgtcccggcagcgagccacgggaggcccagcggcgtatcgaacggcgtccggcgcacgagcaggaataccgcgagaccctgcgccgcctcggcttcaagccggcgacccggcgcagcgacgcgctcgaggagagcgccggcgagatgttcgaactgcccggcgacaacgcctggctgcacttcatgcaggacgacctgccgcgcctgcgccagcaaggctggttcatcgacatccgcgccgacttcgcctacgacctgacgcccatcgacgcctggtacgccgaggtcgaggaagccgacgaccgccagtggttcgagctggaactgggcatccaggtcgccggccagcgggtcagcctgctgccggcgctgaccgaactgatccgccgcagtccggccctgctcgatccgcgcgccctcgcccggcacgccgacgaagagcaactggtgctgcgcctggaactcaacccgccgctgcgcgtggcgctgcccttcggccgcctgaagccggtgctggcggcgctttccgacttctacctgggcgaccccgaaccgcagcgcaagctgcgcctgggcgcaccggacgcggcgcgcctggccgatctcgacgagttgccgctggcctgggaaggcggcgacaacctgcgcgacttcgcccgccgcctacgcagtttccaggctcgtccggcgaccccgccgcaaggcctgcgcgccgaactgcggccctaccagctcgaaggcctgagctggatgcagaccctgcgcgaactcgacagcggcggcgtgctggccgacgacatggggctgggcaagaccttgcagtcgctggcccacgtgctcctggaaaagcaggccgggcggctcgacacgccggcgctggtggtgatgcccaccagcctgatccccaactggctggacgaggccgagcgcttcgcccccgatctgcgcgtgctggccctgcacggcgccggccggcgccgcgacttcgcccgcatcgacgagcacgacctggtgctgaccacctatgccctgctgccacgcgacgccgccgagctgggcaagcggcggttccacctgctgatcctcgacgaggcgcagaacatcaagaacgccaccaccaaggccgccgtcgccgcccgcgagctggcggcacggcatcgcctgtgcctgaccggcacgccgctggagaaccacctcggcgaactctggtcgctgttccatttcctgatgcccggctggctcggcgacgcccgccagttcgcccaggactaccgcacgccgatcgagaagcacggcgacgaggcacgcctcagtcacctggccgcgcgcctgcggccgttcctgctgcgacggaccaaggaacaggtggcctcggaactgccgccgaagagcgagttcacccagttcgtcgaactcagcgaggcgcaacgcgaactctacgagaccgtgcgcctggcgctggaccgcaaggtccgcgaggagatcgcccggcgcggcctggcgcgcagccgcatcgtgatcctcgaggcgctgctcaagctgcgccaggtctgctgcgacacgcgcctgctgcaacgccaggaagacggcgcgcgcagcggccgggcgctcagctcgggcaagctggcctacctgctcgacatgctcgacgaactgatcgccgagggtcgccgggtcctgctgttctcgcagttcacctcgatgctcgcgctgatcgaggacgccctgcgccagcgcggcgtcgactacgtcctgctgaccggcgagacccgcgaccgccgcgccccggtacagcgcttccagagcggcaaggtgccggtgttcctgatcagcttgaaggcaggcggggtcggcctcaacctgaccgcggcggacaccgtgatccactacgatccctggtggaacccggcggtggagaaccaggccagcgaccgcgcctaccgcatcggccaggacaagccggtgttcgtctaccggctgatcgcccgcggcacggtggaagagaagatccagcacctgcagcaggaaaaggccgccctcgccgacggcctgttcagcgaaggcaacggcgacggctggaagctcgacgaggccgatatcgacgcgctgttcgcgcccttgcccaaggcgctctga

SEQ ID NO: 12549 - DNA, 306 bp, Pseudomonas aeruginosa
gccagacgtcccttacccccggccagcgcttccgcgaagccgtggccaccgaacacccgctgcaggtggtcggcaccatcaacgccaaccacgccctgctggccaagcgcgccggcttcaaggccatctacctgtccggcggcggtgtcgccgccggttccctgggcctgccggacctgggtatcagcggcctcgacgacgtgctcaccgacgtgcgccggatcaccgacgtctgcgacctgccgctgctggtggacgtcgacaccggcttcggctcctcggcgttcaacgtcgcccgcacggtga

SEQ ID NO: 12550 - DNA, 354 bp, Pseudomonas aeruginosa
agacctcgctggcacccggctccaaggtggtcaccgaatacctgcgcgaagccggcctgctgccgcacctggaagccctcggcttcggcgtggtggcctacgcctgtacgtcttgcaacggcatgtccggcgccctcgacccggcgatccagcaggagatcgtcgagcgcgacctgtacgccaccgcggtgctctccggcaaccgcaacttcgacgggcgcatccacccctacgccaagcaggccttcctcgcctcgccgccgctggtggtggcctacgccatcgccgggaccatccgcttcgacatcgagcgcgacgtgctcggcgtggtggacggcaaggagatccgcctga

SEQ ID NO: 12551 - DNA, 1281 bp, Pseudomonas aeruginosa
gacggacgacgcgtagcgtcatccgccgacgaccggcagcggctgtcgaacgcagccgctgcccctgaattcgattgccgaggacgacgacgcatggcccacccaccccagatccgcatccccgccacctacctgcgcggcggcaccagcaagggcgtgttcttccgcctggaagacctgccggaatcctgccgggtccccggcgaggcgcgcgaccggctgttcatgcgggtgatcggcagtcccgacccctatgccgcgcacatcgacgggatgggcggcgccacctccagcaccagcaagtgcgtgatcctctcgaagagcagccagccgggccatgacgtcgactacctctacggccaggtctccatcgacaagcccttcgtcgactggagcggcaactgcggcaacctctccaccggggccggcgccttcgccctgcacgccgggctggtggatccggcgcggataccggaagacggcatctgcgaggtgcgcatctggcaggccaatatcggcaagaccatcatcgcccacgtgccggtgagcggcggccaagtccaggaaaccggcgacttcgagctggacggagtgaccttcccggcggccgagatcgtgctggagttcctcgacccgtccgacgacggcgaggacggcggcgccatgttccccaccggcaacctggtggacgatctggaggtgccgggggtcggtaccttcaaggcgaccatgatcaacgccgggattcccacggtgttcgtcaatgccgaggagatcggctaccgcggcaccgagctgcgcgaagagatcaacggcgacccgcagcaactggcgcgcttcgaacggatccgcgtcgccggcgccctgcgcatgggcctgatcaagacccccgaggaagccgcgacccgccagcacacgccgaagatcgccttcgtcgccccgccccgcgactaccgcaccgccagcggcaagctggtggcggccggcgatatcgacctgctggtccgcgcgctgtccatgggcaagctgcaccacgcgatgatgggtaccgcggcggtggccatcggcaccgccgcagccattcccggcaccctggtgaacctcgccgccggcggcggcgaacgcagcgcggtacgcttcggccatccctccggcaccctgcgagtgggcgccgaggccagccaggcgaacggcgaatggacggtgaccaaggcgatcatgagccgcagcgcgcgaatcctcatggaaggctgggtgcgcgtacccggcgacgccttctga

SEQ ID NO: 12552 - DNA, 1527 bp, Pseudomonas aeruginosa
cccaagaggaaacccaccacttacgaaccactggagtacgcgatgagtgccaacgtcgatctcaaccaacgtcccgactacgacgccgtcctgcaggacatcgccgactacgtgctggactaccgcatcgattccacggaggccctggacaccgcccgcaactgcctgatggataccctcggctgcggcctgctggcgctgcgcttcccggaatgcaccaagcacctcggcccgctggtcgagggcaccctggtcccgcacggcgcgcgggtgccgggcacctccttccggctcgacccggtcaaggccgcctgggacatcggctgcatcgtccgctggctggactacaacgacacctggctggccgccgagtggggccatccctcggacaacctcggcggcatcctcgccgtcgccgaccacctctcgcagaaacgcctggccaacggcgaagcgccgctgagcatgcgccaggtactggaagcgatgatcatggcccacgagatccagggcgtgatcgccctggagaactcgttcaatcgcgtcggcctcgatcatgtgctgctggtcaaggtcgcgtccaccgccgtctgcgccaagctgatgggggccgaccgcgagcaactgctggccgccctctcccacgccttcgtcgacggccaggccctgcgcacctaccgtcacgcaccgaacgccggctcgcgcaagtcctgggccgctggcgacgcgacgagccgcggcgtgcgcctggcggacatcgccttgcgcggcgagatgggcatccccggcgtgctcagcgcgccgcaatggggtttctacgatgtcctgttcagccacaccagcaaggacctggcgaccaagcccgaggacaagcggcgcttcagcttcccccagggctacggcagctacgtgatggaaaacgtgctgttcaagatcagcttccccgccgaattccacgcgcagaccgccgccgaggccgccgtgcgcctgcatccgctggtgaaggaccgcctgcaacggatcagccgcatcgtcatcaccacccacgagtcggcgatccgcatcatttccaaggtcggcccgctggccaaccccgccgaccgcgaccattgcctgcagtacatgaccgccgtgccgctgatcttcggcgacctggtggccgagcactacgaggacgccttccacgccgcccacccgctgatcgatcgcttgcgcgagaaaatggagatcgtcgaggagccgcgctacagccgtgaatacctggaggcagacaagcgctccatcgccaacgccgtggaagtgttcttcgacgacggcagcagcaccggccaggtcgccgtggagtacccgctcggccatcgccgccggcgcgccgaaggcatcccgctgctgcaggagaagttcaaggccaacctggccacgcgcttcccgccgcagcgctgccagaggatcttcgacctgtgcagccaccaggcatcgctggaagccacgccggtgaaccgcttcatggacctcctggcgatctga

SEQ ID NO: 12553 - DNA, 849 bp, Pseudomonas aeruginosa
aactgcgcaggctggtatgcagcaacccggcccagcgttcggcgctggcgcggatgtcgggctcgacgaggaacgcctcgcagagcgccagccagcgcggctcgggcggcaagggcacgtgcagcggcagcgtctcggccgccgccagctcatggagcaacagcgtcgccaacgcgccgtcgcgaccttcggtgtcgtattctaggggcatgtccaccgccgccagcaacagttgccgcagcagcggcgacaccgccagcacctggcagtgcgccggcatcgccatggcgctgccgggctcgatgtacaggctgcgggtgctcaccccgagcattcgcacctcgtgctcgacgcccggcggaatccacactgcgcgctgtggcggcaccacccagccggcgtcgccggtacgcacctgcatcaccccgctggcaccgtacagcaattgcgcgcgacgatgccgatggcgcggcagcaggtagccgtcgggatagtcggtacccatggccaccacggcccggggcgtggcgtcgtactgctcgatggaagcgttgcgcatggtcgaagcatctggccgaaacgcgaatagtattggccaacctcgcgaagcgggccagccccgggacgcctaagctggccttccgctctcgctccggaaacccgccatgttctatctcctgctctttctctgcggctgcctcaccggggtcagcgccgtgttgttcggctttggcggcggcttcgtggtggtgccgctgctctatcacctgctgcaactcggtcgcgccgccgacgacccgctggcccaggcggccatgcaggtcgcggtggccacctcgacctgcgtga

SEQ ID NO: 12554 - DNA, 3144 bp, Pseudomonas aeruginosa
acttccccccaggtgcggatgaattgcgcagctacaggcggtgcgagcatgggtgcatcagaacgatccacgaacgacccttccgagctgcaaccctgcagtctccctgcctccgcttctcctcgaaaaagccgtctccgccaacgcctgatgctgatcggcttcgccttgccgatcctcgccgcggtgggcatcgtggtacttcacgaagcgcacacctcgcggctgcaggcacgcgagctggcacgctatgccgcgaccctggactacgaggtgcgccagggtcccagcgaggccatcctgttcccggcggacggccccttcgaccgccgcctcggctaccagttgctgccttcgttcatgcagcgcctgtacgaccgcgactacgccatcacccgccaggcgcacttctccccggcactgatgcgctacgccgaacaccggctgttcccgccctacgcggaaaaggcccaggccgggctggacatcgccgattgccgcggcgtgccgatctacgacttccgctatccgcaacggcgctacgcgaacttcgccagcctgccgccgctggtggtgcagagcctgctgttcatcgagaaccgcgacctgctcgatcacgaacgcccctacctcaacccggcggtggactggggtcgcttcacccaggcggcgctgtcgcaggtcggcaagatgctcggcttcagcgcgcactcctccggcggcagcaccctggcgacccagatcgagaaataccgccactctgccgaagggcgcaccggcagcatcggcgacaagctgcggcagatgctctcggccagcgtacgcagctatcgcgaaggcccggccaacttcgccgcgcgccaggacatcgtgctcacctacctcaactcggtgccgctgtcggcggcgccgggctacggcgaggtcaccggcctggccgatggcctgtgggtctggtacggcgccgactaccggcaggtcggcgaggcactcgacggcaaggccggactcgccgcccagggcctggccctgcgccaggtgctggcgctgatgatcgcccaccgccggccttccttctatctggcgccgcgcggccgcgacgagctggaccggatgaccgacagccacctgcgggtcctgacccaggccggcgtcatcgaggcgccgttacgcgatgcggcgctggcacagaagctggcgttccgcgacccccgcagccagccgacggtgcaaccgctgccgaccaacaagggcgtgaccctggctcgcacccgcctggccgggatgctcggcgtgccactgtacgacctcgaccgtctcgacctgcgggccaataccaccctccagcacgagttgcaggaaagcgtcaccgcctacttgcagaaactcgccgacccggactacgccgcccagctcgggctgatcggcgaacgcctgctgaccccgacctcgacccgctcggtacgctacagcttcaccctgttcgaacgtacgccgagcggcaaccaggtgcgggtgcagaccgacaacaccgaccagcccttcgacatcaacgaaggcagcaagctggagttgggctccaccgccaagctacgggtgctggccagctacctggagaccgtcgcgcagatccaccgcgactatggcggcatgagcgtcgccgagctgcgcaaggtggaagtggagccgctcgatttcatcctccgctggggcatcgactacctggtcgccagccgcgaccgcgatctttccgcgatgctccaggcggccatggaacggcgctattcggccagcccctacgagagcttcttcaccggcggcgggctgcacaccttcaacaacttccgcaaggaagacaacggccgccggccgatgctgctggaagccctgcgcgaatcgatcaacctgcccttcgtgcgcctgctgcgcgacctgatccgccacgatatctaccagaacgccgggagcaaggtgcagttgctggccgacgacaaggacccgcgccgcgccgactacctcgaccgtttcgtcgacaaggaaagccaggtctacctgcgccgcttctgggtcaagtaccgcgacaaggacgccaaccagcgcctggagaccttcctcgacggcctgcgtccctggccggtgcggctggccgcgatccaccgctacctgcagccacaggccgacctggcgagcttcagcgccttcctccgcgaacgcctgccccgcggcagcctgaccgacaagcgcgccgccgagctgtacgagcgctacggcccgggcaagttcaacctcaacgaccagggctacgtcgcccgcgtgcacccgctggagctatggctgctcggctatctgcagaagcagccgcaggcgaccttcggcgaggcggtggcggccagcggcgccgagcgcaaggaggtctacggctggctgttcaagtcgcggcacaagaacgcccgcgacaagcgcatccgcatcctgctggaggtggaggccttcctcgacctgcaccagcaatggaagaaactcggctatcccttcgatcacctggtgccctcctacgccaccgccctgggcagctccggcgaccgcccggcggcgctggccgaactgatggggatcatcgtcaacgatggcgtgcgcatgccgaccctgcgcctggagcacctcgacttcgccctgggtacgccctacgagacgcgcttcgccccggaagccaccctcggccagcgggtgatgacctcggaggtcgccacgaccctgcgcaacgcgctgtcccaggtggtcgacgccggcaccgcgcggcgcctgcaaggcaccttcagccgtccggacggcgcgccactggtgatgggcggcaagaccggcaccggcgacaaccgcctgcagaccttcagcgccggcggccacgtgcgcagttcgaaggcactgaaccgcaccgccactttcgtcttctacatcggcccgcggcacttcggtaccctcaccgcctacgtcgacggcagcgagtcgagccagttcaagttcacctcggccctgccagtgcaggtactcaagggcatggcaccgctcctcagggactacctcgacccacgcaccgccacccgctgccaggtaccgttgtcgccgcaacagatcggccgcctgtag

SEQ ID NO: 12555 - DNA, 552 bp, Pseudomonas aeruginosa
gcaccagcagcgccggcggccgcggcgacaacagggcggcgatccacagcaggtatcgcagggtgccgtccgacagctccgcggtgcgcagcggccgcagcaggccgggctgctcgatcagcacttcgaagcgccctcccgggttgtcaatgtgcaggcggctgccgggaaaggcatcgtccaccgcctcgtccagcgccgccgcatcgccgatctcgcggatggtctgcagggccgcggccaggtcggcgccgtcggcgcccagcaccggtgtatgggtgccgatctgcggacaccgcgccggcgcctcggcgtcgctgcggaaatggtcgtagaagcgccaggagcggatccgctcgcgcaggccgagcagttccggcacctgtcgcgggtccaccgccgcgcccagcatgctgtcgaaggtggcgaggtgctgcgccgccacttcccagcgaccgccgccgccgcgtgcgcgcaacaacggcccgcgacggtcgacgaggacattggccgggcgcaggaacgggccggcccagatgcattcgcgcttga

SEQ ID NO: 12556 - DNA, 693 bp, Pseudomonas aeruginosa
atcccgccgatcgccgcgaccaccgtcagcaacgacggccagagtctgccgaagccgttggagaacttcatgcccatggcgaaggcgacctcgaaggccgccgccaccagcagatggaaccaggccatggcggctcctcaggccgaccgcgccagcgccagcaggcgctgttccgcctcggcgcaggagtcctcgaaggacctgccgccggattcctcgccttccgccgcgaccaccgtgacctcgtcgatgccgatgaaacccagcgcggtgcgcaaccagggatcggcgtggttcatcgcctggttctcgccgcccgggccgaagccatggccaccgcgactggtgacgatcagcgcacgcttgccacgcagcagcggccggtactgggcgacgccattgtcgaggacgaaatcgaaggtcaccccgaggcgcacgatctggtcgatccaggccttcaggccgctgggcacgctgaagttgtacatcggcgtggagatcaccagcaggtcgctgtcgaacagttcgccgaccagttggtcgctcagcgccaggtcggcctgcatcgccagcgaacgctgttccggctggggatggaaggcggcggcgacgaaggcctcggtgaccgccggaagcggtacccggccgacttcgcggcgcgccacgcgggcctgcggatgggcttcgcgatag

SEQ ID NO: 12557 - DNA, 909 bp, Pseudomonas aeruginosa
ctacatcggctcgcacctgaagaagtatggcggcgacccgaccttcttcgaccaggcgttcgtccacctgcacgtgccggaaggtgccacgcccaaggacggtcccagcgccggcgtcaccatggccagcgccctgctctccctggcgcgcaaccaggtgccgaagaaaggcgtggcgatgaccggcgaactgaccctgaccggccaggtcctgcccatcggcggggtccgcgagaaggtgatcgccgcgcgccggcagaagatcttcgagctgatcctgccggaagccaaccgcggccacttcgaagagttgcccgactatctcagggaagggctgaccgtgcatttcgccaagcgctacggcgacgtggccaaggtgctgttcccggcctgagccggcggcggatggccgaccggttcggccgtccgccgcgccaaccttggcactcgggcgccagcagggtttatgctggcgccctttccattcgagccgaggagcgctgcatgtccttttccccctcccgtctgctgctgccattgtccatcgtggtcctggccggctgcgccgggcaacagaagccggtggtcaccctggacgacgccgacgactgttcgccgctgaagctgacgcaaggccaggaactggtgctgaccctgccgagcaatcccaccaccggcttccgctgggaactgcgcaaccctgctgccagcgtgctcaagcgccttggcccggaggtctacagcaattccgaagaagacagcggcctggttggcagcggcggcgaatcgacctggcgcttccgcgtcgccgccagcggcgacgaccgcctggaactggtctaccggcggccctgggaaaaggacgcggaaccggcggaaagcttttcctgcgcgatccaggtgcgctga

SEQ ID NO: 12558 - DNA, 492 bp, Pseudomonas aeruginosa
aaccgctgcccgcggcggacacattctgtacgaagaccgacgtcctgcgccgtggcgacctggcctatcctgacaggccccgtcgccctgaggactccatgctccgcgcctccttcgtcctgctcgccctgtcctgcgccgctcctctgctctcgctggccgaaccgttgcgcttcgcaggcgacgacggctgcccctacctgtgccctggcacgccgcagcggcccggctacctggtcgaggcgctcagccaggtccttcgggagccaccgcacttcgacagcctgccctggccgcgcgccgtgcagatggtccgcgacggccatcgcgacggcctggtcggcgcctatggactcgacggcctgcgggtcggcagcgagcccatcggctgggtcgggctggccttctatacccgccacgacagcgactggcactactccggcgatgcatccctgctcggccagcgcctgggcctcgcccagggctacgtga

SEQ ID NO: 12559 - DNA, 768 bp, Pseudomonas aeruginosa
aaagccgtgatgcccgaggtcacccgcgtgagcgagtccgatcgcctgttcgcccaaccccagcaacgtgtcgccgacttcgtgttcaacgaagacgtggtgcgcgtgttccccgacatgatcaagcgctccgtgccgggctaccccaccatcgtcgagaacatcggcgtactcggcgcgcagttcgcccagccgaacagcgtgctctacgacctcggctgctcgctcggcgcggtcacccagtcgctgcgccgccacgtccgcaacgacggctgccgggtgatcggggtggacaactcgcacgcgatgatcgagcgctgcagtgaatacctgcatgcccaggacgccatgtaccaggagctgctgccggtcgagctgatcgaggccgacattctcgccctggacctgcaacccacctcgctggtggcgatgaacttcaccctgcagttcgtcgcccccgaccagcgcctcggcctgctgcgcaggatccgccaggcactgctgcccggcggcgcgctgatcctctcggagaaactgcgcttcgccgatgcgcaggagcacgcgctgctcaccgacctgcacatcgccttcaagcgtgccaacggctacagcgagctggagatcgcgcagaagcgcagcgcgctggaaaacgtcatgctccccgacaccttcgaggaacaccgtgaacggctgctggccgccggcttcagccgggtcagccaatggttccagtgtctcaacttcgcatcgatgatcgccctgccatga

SEQ ID NO: 12560 - DNA, 1011 bp, Pseudomonas aeruginosa
  unsure (105): Identity of nucleotide at the above locations are unknown.
cgggtagtctgcggcttgcgcgaggtgatcgccagcttctgcccgaggatgtggttgagcagggtggacttgcccacgttggggcggcccacaatcgccacgtanccgcaacggctgccggcggggatgtcgtcgtgcatgtcagtcatggccattctccacgcccagagccaccagcgcggcggccgcggccacctgctcggcgatgcggcggctgccgccgtgcccgtgggtcttgtcgctcagcagggccacttcgcaatcgacgaagaaggtccggcaatggggttcgccctggatatccaccacctcgtagcgcggcaggtcgcagccacgcgactgcaggaactcctgcaggcgggtcttggggtccttgttggtgtccaccggggtcagctcgcgcagttgcggtccgagccaggcgatgatccgctcgcgcgcggagtccatgccggtatccaggtagatggcgccgatcagggcttccatcgcatcggcgaggatcgactcgcggcggaacccgccgctcttcagctcgcccgagcccagccgcaggtagtcgcccacctcgaagccgcgcgccagcagggccagggtctcgcccttgaccagtcgcgcgcgcaggcgcgaaagctggccttcgcgagcctgcgggaagtggtggaacagcgcctcgccgatgacgaagttgagaatggcgtcaccgaggaactccaggcgctcgttgttgcgcccggcgtagctgcgatgggtcagggccaggaccatcaggtcccggtctttgaaggtatagccgagcttgcgctcgagtcggtccagcgaattactcacggcatgcgtacacggaattctttgtcgaagtggaccaccaggtcgatgttgctgatcagtggctcgcgtttttcatatttcaggtgcgcccggaattggttgtcttccagttgcacctccagggccttctccaggtccaggttgcggatgccgttgatctgcatccccttgccgacgtag

SEQ ID NO: 12561 - DNA, 1455 bp, Pseudomonas aeruginosa
aaaagggcggtggaaaccgcccttttttcgccagccggcttattcggccagcttgaaggtaatgaagctggcgcgtccctggcgcagcacccgcatcgaaaccgaacggttcttcggcagggccttggccacgtcggcgaagaccttggtcgaggtcaccgccttgttgtccaggtgggtgatgacatcgcccggacgcaggccgatgaccgcggccggaccgtcctggacttccttgatcaccacgccgccctggatatccaggctcttgcgctgctcggcggtcaggtcggcgacggtcacgcccaggcggttgctgctgcgctcggcgcccggagcgcccatcgaggcgatttcctcgtcgtcgtccggaaggctgcctaccgccatgctcagggacttgcgctggccgttgcgaatcacgtccaggttgatcttgtcgcccggcttcatgttgcccaccaggtgcggcaggtcggcggactcgttgatcgactggccgttcaggctgaggatcacatcgcccacctgcaggccacccttggccgccgggccgtcttccaccagttgcgccaccagcgcgccggacggcttgtcgaggccgaaggactcggcgagatccttgttcacttcctggatcaccacgcccagccagccgcgactgaccttgccggctttcttcaactggtcggcgacgttcagcgcgacatcgatcggaatggcgaaggacaggcccatgaagccgccggaacgggtgaagatctgcgagttgatgccgaccacttcgccctgcaggttcagcagcggaccgccggagttacccgggttgatcgccacgtcggtctggatgaagggtacgtagctctcgttcggcaggctacgacccttggcactgacgataccggcggtgaccgagtgatcgaagccgaacggcgaaccgatggccaggacccattcgcccactttcagcttgttcgaatcgcccagtttcagggtcggcaggttcttcgcctcgatcttcagcaccgccacgtcgctgcgcgggtccgcgccgaccagcttggccttgtgctcgctacggtcggacaggcgcaccaggatctcgtcggcatcggccacgacgtgattgttggtgaggatgtagccgtcgttggagatgatgaagccggaacccagcgattgcgcctcgcgctgctggccgcgcggattgcgcggaacctgcgggatgctgcgttcgaggaagtcgcggaacatcggcggcagcccttcgaggtcggggatagacagctgcccgcgcgccatggcgcgatccggcagcttctgccgcgtactgatattcaccaccgccggcgacgcctgttcgaccaaaggcgtgaagtccggcagttctgcccgggccgtcatcgccaggctcaaggccagcaaggccaccatcgcagccatacagcgttttag

SEQ ID NO: 12562 - DNA, 282 bp, Pseudomonas aeruginosa
tcacctgcggcgccccctgctcttcgctgtagccggccagcacggccgggcctttcacctgaggcagggcgatctgcggggtggtcccctgttgcgccatctgcggcagggcgtcgttctggttgtacagacgcacgccggccagcaccgccagggtcaccgaggcagcgaccgccaggcgaccgaccatccgccacggtcccttctccgctttcggcggagcggcctcgtcggccagggcagcagagaccgccgcagcgatatccagcttcggcagggtag

SEQ ID NO: 12563 - DNA, 264 bp, Pseudomonas aeruginosa
tgccggccgctcactatacctgcggcggcgtgctcgtcgaccagcacgggcataccgacgtgccgggcctctacgccatcggcgaaaccaccttcaccggcctgcacggcgccaaccgcatggccagcaattcgctgctggaatgcttcgtctatgcccgctctgccgccgccgacatgctccagcgcctgcccggcacgcccgtgccggaaagcctgccgagctgggacgccagccaggtcaccgactccgacgaggacgtga

SEQ ID NO: 12564 - DNA, 603 bp, Pseudomonas aeruginosa
tcatccgctcggccatgcagcgccgcgaaagccggggcctgcactacacgctggattatccggacctgctgcccgaagcccgcgacactatcctggtgccgcccatctacggcgactgaagcgcaggcggacacgcaggcgccgatggctgtcggcgcccaatgcatcggccgggatacagcagccaaggatgcgccagcggcccggcaggcgcacgcgcagtacgatcagccagggcaacgccaggctgtcagggcgcaattgcaccgcttgccagccgcttccggcgctccacagctgccagccccgctcgtcatggcgcacgccgcggaaggcccgcgagccgcgcagcagtacctggcggtacagcccccaggcaccgtaggccaggcagaccagcgcaagcggcggcttcagccagaccggcagcgccgccagcaggatcgacagcagcgccagggcccacagtgccaggctcgccgccagcaggatcggagagacccgccagcggcattcgaacggctcaatccggctggacacggtccaggatcatccgcaccatccgccgcaggtcggcgtcttccggctcgccgcgctgcatga

SEQ ID NO: 12565 - DNA, 960 bp, Pseudomonas aeruginosa
ccgcgcagcatcgcaatggccgaccccgctttccacaccccgctagtccatgaaggcatcctcgccgtccgcggccctgacgccgccaagttcctccagggccagctgacctgcaacctcgcctacctcaacgacgagacctccagcctcggcggccgctgcaacatcaagggccgcctgctatcgagcttccgcatcctgcccgagggcgacggcctgctgctggcgatggccggcgagctgctcgaggcccagttggcggacctgaagaaatacgccgtattctccaaggccagccttgccgacgagagcgcagcctggctccgcataggcttgcgcgacgccagcgaggcactgcgcgccctggggatagacaccccggcggagagcggcaggatcgcccgccacggcgacctgctcgccgtcgccctgggcgacgcccgcgtcgagctatgggttccggcgcaacgcgccgaggcggtgcttgccacgctccgcgagcacagccgcgaggcgccgctcgacgattggctgctcggccaggtgcgcgcaggcatcggccaggtgttcggcgctacccgcgagctgttcatcccacagatgatcaacctgcaggcggtcggcggggtcagcttcaagaagggctgctataccggccaggaaatcgtcgcccgcatgcagtatctcggccgcctcaagcgccgcctgtatcgcctggcgctggacgcagacgaggtgccggcgcccggcaccgggctgttctcgccagtccattccaccagcgtcggcgaagtggtactggccgcccgtacgccggagaacagcgtggaattgctcgccgtgctgcaggacgacgccgtcgccgacggccggatcagcctcggaagcgccgaaggagcgccgctcgtcctcctcaatctgccttacacgctggacagcgaccgcgaaatccagcgctga

SEQ ID NO: 12566 - DNA, 882 bp, Pseudomonas aeruginosa
ggcggcggaagacccggatgtcagcatccaggccctgagcaaggtgatcggcaacgacgcggcgctgaccgcgcgcatcatccgcgtggtgaacagtccgctgctgcgcagcccgaaggaaatcaccgacctgcagatggcgatcagccggctgggcatcaactacacctgcaacctggccaccggcctggccatggagcagatgttccaggccaccaccgacgtggtcgatcgcaagatgcgcgaagtctggaacaagagcaccgagatcgccggcatctgccacgtgctggcccgtcactacacccgcctggcgccggaccaggcgaccctggccggactggtgcaccagatcggcgtgctgccgatcctcacctacgccgaggatcacaacgagctgctgtcggactccatcagcctgagccatgtgatcgagcgcatccatccgctgatcggcgagcgcattctcaaggcctgggatttccccgcgccgatcgccgaggtcccgcgccagcacctggacttcgcccgcaactcgccgcgcgcggactataccgacctggtccaggtcgccaccctgcagagctaccttggcagcgagcatccctatacccgcctggactggagccagatcccggcgttcgccaagctcggcctcgagccgaccgtcgacatgaaggaagacgaggacctctccagcgccctggaagccgccaccagcatgctgcaataggcccgccctactccaccgggaagcgcacccgcaccagcaagccgcccagttcgccctggtcgagctggatctgcgcccggtgcgcccggcagacctcgccgacgatcgccagccccaggccgctgccggggctgtcgccgcgccggtag

SEQ ID NO: 12567 - DNA, 639 bp, Pseudomonas aeruginosa
gccagcggcgccagcgccaggcccagttcccgggccagggcggtcaggtcgatacgctcggcgccaccctcggcaatggcctgggcgccgctttcgatgcgcgccagggagagcagctggttggccaggtggatcaggcggtcggtgttcttcgccgtggtctccagggtcgaacgccaggcttccggctcctgctcgcgcaggcccagttccaggcgcgccttgagcgccgccagcggcgtgcgcaactcgtgggcggcatcggcgatgaagtgcgactgccgctcgaacaggctgcgcaggcgctgggtgaagtggttcagcgactccaccagcggccgcaattcatgctggacctcgagcatcggcaacggccgcaggtcgtccggctggcgctcttccacctcgcggcgcaggcgatccagcggacgcagcgcggcgctcaccgccagccacaccagcaccagcgcgccgacgccgaggacgcccaggcgcagcagggtatcggtcatcaggctgcgcgccatgcgctcgcgggcgccttcggtctccgccacgcggatctccgccatgccgctcatgctcggttcgctgaccggttgcagcaggctcaccacgcgtacgtcgacgccctggtag

SEQ ID NO: 12568 - DNA, 777 bp, Pseudomonas aeruginosa
gcgctcaggccgctcgccaggagcaccagcagcaggagcagggccagccacagcagcagccttccgcgcaggctgccggcatcagtcacccagcgcctccagcaggtagccgaggccgcggaaggtgactatgcgcacggcgccgccttccagcttcttgcgcaggcggtggacgtagatctcgatggcgtcggcgctggcctcctcgtccaggccgaagacctgggcggccagttgctccttgctcatcacccgccccggacgggcgatcatcgcttccagcaccgcctgttcccgcgaggtcagggtcagcggctgctcgtcgaggctgaagcgccgggtgccgaggtcgtagaccagggcgccgcagcgctgcaactgttcgccaccgagcacgctgcggcgcagcagggccttgacccgcgcctccagctcggacagttcgaaaggctttgccaggtagtcgtcggcgccgagattgaggccgtgcacccggtccttcacctcgccgcgcgcagtcagcatcagcaccggcagggtcttgccgcgcccgcgcaggcgcgccagcacctcgaagccgtccatccgcggcaggccgacgtcgaggatcgccagggcgtactcctcgctggccagagccaggtcggcggccaccccgtcctgcagcaggtctaccgtccagccggcgcccttgagcgcctggaccacgctttcggcgagctgcggatgatcttccaccagaaggatgcgcatggacggttctccaccaccggatga

SEQ ID NO: 12569 - DNA, 1428 bp, Pseudomonas aeruginosa
atggcttctctgccaccggggattgctgaaagcctggcgaaagcttggcgtcttaggatcagtcgatggacggcgcagatcgtccgccaaaacgccctgcagcgtggtgctcggcgtacaagaacaagaatcggagaccactgcatgtcgacttccctgccgcaggccgcaaggtctgtacgttcgtcccgcagcaccaccctgaccaccaccgccgtcgtgctcgccagcatcgcgcccctgggcaacgccgccggcttcctcgaagacagcaaggccagcctggaaacccgcaacttctacatgaaccgcgacttccgcgacggccccggccagtccaagcgcgaggagtgggcgcaaggcttcatcctcaacctgcagtccggctacacccagggcaccgtcggcttcggcctcgacgccatgggcatgctcggcgtcaagctcgactccggccgcggccgcagcggtaccggactgctgccgaaggattccgacggccgcgcgccggacacctactcgaaactgggcctgaccgccaaggtcaaggtctcgcagagcgagctgaaggtcggcacgctgattccgaagttgccatcggtacaaccgaacaacgggcggatcttcccgcagatattcgaaggcgcgctgctcacctcgaaggagatcaaggacctcggcttcaccgccgggcgcctggaaaagaccaagatccgcgactccagcgactccgaggacctcgcgctgaacgacaagaacggccgcttcgccggggtcagcgccgatcacttcgacctcggcggactggactacaagctcaccgaccaactcaccgccagctatcactacagcaacctgcaggacgtctaccgccagcacttcgtcggcctgctgcacagctggccgatcggtcccggcgaactgaccagcgacctgcgcttcgcccgcagcaccgacagcggctcggccaaggccggcggcatcgacaacaagtcgctcaacggcatgttcacctacagccttggcaaccatgccttcggcgcggcctggcagcgaatgaacggcgacgacgccttcccctacctggaaggcagcaacccgtacctggtcaacttcgtccaggtcaacgacttcgccggccccaaggagcgctcctggcaactgcgctacgactacgacttcgtcggcctcggcattcccggcctgaccttcatgacccgctacgtcaagggcgacaatgtcgaactcgccgggcagcgcggcgaaggccgcgaatgggaacgcaacaccgaactgcagtacgtgttccagagcggcgcgctgaagaacctcggaatccgctggcgcaacgcgaccttccgttccaatttcacccgcgacatcgatgagaaccgcctgatcgtcagctataccctgccgatctggtaa

SEQ ID NO: 12570 - DNA, 1824 bp, Pseudomonas aeruginosa
  unsure (976),(1124): Identity of nucleotide at the above locations are unknown.
tcgcgcggccgacgccgatccgccacgccgaggacgaacaaccgctgggcggcgccgtgctgctcaaggtgctcgcctgcatcgccctgctgctggtgttcgccggcctgttcgaaacgctcggcttcatcctcagcgccgccctggtcggctcctgcatggccattctctacggcgcccggccaatccctgcggtggtcaccgcgagcctgctcgggatcggcctctactggctgttcgaccgcgccctggacgtcccgctgccgctgggcgttctcgacttcctgccgctgtgaggacttcgtgatggaaaccttgaactacctcggccagggcttcggcgtcgcgatgacgccgaccaacctgatcaccgcgctgatcggcaccctgatcggcaccatcgtaggcctgctgccaggcctcggtccgatcaacggcgtggcactgctgatcccggtggcattcgccctcggcctgccgccggaaaccgcgctgatcctgctcgccgccgtatacctgggctgcgaatacggcgggcggatcagctcgatcctgctcaacatccccggcgaagcctcgaccgtgatgaccaccctcgacggctacccgatggcacgcaagggcctggccggcgtggccctgtcgctgtcggcctggagttcgttcattggcgctttcatcgccacctgcgggatggtcctgttcgccccgctgctggccaagtgggcgatcgccttcggtccggcggaatatttcgtgctgatggtgttcgccatcgtctgcctcggcgggatggccggcgaccgcccgctgaagaccctgctggcggcgctgctcgggctgttcctgtcgagcgtcgggatcgacgccaacagcggcgtgtaccgcttcaccggggacagcatccacctcgccgacggcatccagttcgtggtcctggtgctgggcctgttctcggtcagcgagatcctcatgntggtggagaagacccaccacggccaggaggcggtgaaagccaccggacgcatgctgttcaacttcaaggaggccgccagcgtattcatggtcaacatgcgatgcggtctgctaggtttcgtcatgggcgaatggcccggcgccggggngaccctggcaagcgcggtggcctatatgaccgagaagaagctggccggtgccaagggcgagttcggcaagggcgacatgcgcggcctggccgctcccgagaccgccatcggcgcctccgcctgcggcgccatggtgccgatgctgaccctcggcgtgcccggctcgggtaccactgcggtgatgatcggcgccctgaccctgtacaacatcactcccggcccgctgttgttccagcagcaaccggacatcgtctggggcctgatcgcctcgctgttcatcgccaacgtcatgctgatcatcctcaacgtgccgatggtccgcgtattcacccgcatcctcgcggtgccgaactgggccctggtgccggccatcgcgatcatcaccgggatcggcgtgtacggcgtgcatgcgaccaccttcgacctgttcctgatggtcggcatcggcgtgatcggctatatcctgcgcaagctcgacttcccgctctcgccgctgctgctgggcttcatcctcggtggactgatggagcaaaacctgcgccgcgcgctgtcgatctccaacggtgaactgggcatcctctggtcgagcccgatcagcctggtaacctgggcgctggtggtggtaatgctgctgttgccgctggtccgcgcctggcgccgccgcgcggcccgtcgcgcgacagggctggccgatgcctga

SEQ ID NO: 12571 - DNA, 936 bp, Pseudomonas aeruginosa
cgtgatcatcgtcttcggcgccgtggccaccacgctttccagcgtgctggcgatcgccttcatgcgccgcagcggcgaggaccgcgccaccgcgttcttcgccagcatgcccggtggtgccagcgagatggtcaacctcgggcagcgccacggcgcggtgctcagccgcgtcgccgcagcgcagagcctgcgcctgttgctggtagtgctgctggtgccggcggcgttccagtacctgctcggcggcggccagccaggcccgcaccaggccgcgccggtggactggcactggctggccctgctgttcccggccggggcgctggtcgcgctgggctggcagaagttgcgccaacccaatccctggctgctcggcccgctgttgctggcggccggcgtcagcctcggcttcgacctgcatatcggcctgccggccggttccagcggcgtcggccaatggctgatcggcagcgccctgggttgccatttcaaccgcagtttcttccgcagcgctccagccttcgtcagtcgtaccctggtttgcacgctgtggatgatgttcgccgcggcgctcgccgccgagttgctcggctggctgaccaccctcgaccaccagtcgctgatgctcggcatgatgcccggcggcatcgccgagctgagcctgaccgccgaagccttgcagctctcggtgccgctggtcaccgccttgcaggtactgaggctattgctggtgctgttcctcgccgagccgtgcttccgctactggaggaagcgcgccggctgatcgagccacgccgccacactggatgtgtggcgttttccagcccgcctcgtgcgggcttttttttccgggcgcggtcagaggcacacagcggcgcccaccatgtgaagagctgggcgacagcggccttcagaggtccggcagcgaccagtcgatag

SEQ ID NO: 12572 - DNA, 1623 bp, Pseudomonas aeruginosa
tctgaatcccaagatcgtccatcccttgcgcaagatcgtcaatccacaggcggcttgcggccggctataacgactcaaaacaacatcccggtccaccgggaagcggaggcgacgatggccaaggcaatcccccaactgatcgacggcgaatggcgcggcagccgttcccgcgagctggtcgaagtcaccgatccggcgacccaggacgtcctcgcgctggcgccgaaggccaccgccgacgagatcgagcaggccatcgccagcgcccagcgcgccttcgagacctggcgcgaagtcccggctcccgagcgagcgcggttgatgctgcgctaccagcacctgctcaaggaacaccacgacgaactcggcgaactgctggcccgggagaccggcaagaacctcgccgatgccaagggcgacgtgtggcgcggcatcgaggtggtcgaacacgccgccaacgtggccagcctgatgatgggcgagacggtggaaaacgtcgcccgcgagatcgacaccgccagttggatccagcccctcggcgtgtgcgccgggatcaccccgttcaattttccggcgatgatcccgctgtggatgttcccgctggccatcgcctgcggcaacaccttcgtcctcaagccctccgaacaggatccgctgacacccaaccgcctcgccgagctgttcctcgaggccggcgcgccgaagggcgtgctgcaggtgattcatggcggccgcgagcaggtcgatgccctccttacccacccggacatccgggcgatttccttcgtcggctcggtcgccgtcggccagcacgtgtaccgcaccggcaccgcgcacctgaagcgggtgcaggccttcgccggggcgaagaaccacatggtgatcctccccgacgcgaacaaggcccaggttctcggcaacctggtcggcgccagttgcggcgccgccggccagcgctgcatggcgatcagcgcggcggtgttcgtcggcgcggcgcgcgagtggattcccgaactggccgagcggatggccgccctgcgccccggccactggcaggacccggacgccgcctatggtccgctgatcagcccgcaggcgcgccagcgcgtgctgcgcctgatcgccgaaggcaaggcggaaggcgccgagtgcctgctcgacggctcgcagtgccaggtcgaaggctatcccaacggcaactggctcggtcccaccctgttccgcgcagtgacgccgaagatgggcctgtaccgcgaggaaatcttcggcccggtgctggcctgcctggaggtggaaagcctggaagaggccatcgccctggtcaacgccaacccctatggcaatggaacaagcctcttcacccgctccggcggcgccgctcggcgctaccagcacgcggtgcaggtcggccaggtgggtatcaacgtaccgatcccggtaccgctgccgttcttctccttcaccggctggaagggttccttctacggcgacctgcacgcctacggcaagcaggcggtgcgcttctataccgagaccaagaccgtcaccagccgctggttcgacgatgaaccgacgaccgacgaatcgtcggccggcccgaacatgaccatccatctcaagtga

SEQ ID NO: 12573 - DNA, 849 bp, Pseudomonas aeruginosa
agggaggcctggctgcccggcctgatcggcggcgagtcgctcgcctcctattgcctgaccgagcccgatgccggctccgacgccgcgcgcctgcgcacccgcgcccgccgcgagggcgacgaatacgtgctggacggcagcaagtgcttcatttccggcgccggcagcacccaggtgctgatcgtcatggcgcgcaccggcgaggacggcgccaggggcatctcctgcttcctggtgccggccgacgcgcccgacatccgctacggccgcaacgaggacaagatgggctggcgcgcgcagccgacccgcaccatcaccttcgaaggcgtgcgcatccccgccggcaaccgcatcggcccggagggccagggcttcgtctatgccatgaaaggcctcgacggcggccgcctgaacatcgccagttgttccctgggcgccgcccaggcggcgctggagcagtcgatgcgctacgtcgaggagcgcgagcagttcggcaagccgctggcgaccttccaggccttgcagttcaagctcgccgacatgctcaccgaactcaccgccagccgccagatggtccgcctcggcgcccatcggctggaccgcggcgacgccgaggcgaccctgtactgcgcaatggccaagcgcttcgccaccgaccgctgcttcgatgtctgcaacgaggccttgcaactgcacggcggctacggctatctcaacgattatccgctggagcgctgggtacgcgacacccgcgtgcaccagatcctcgaaggcaccaacgaaatcatgcgggtgatcgtcgcccgccgcctgctggagcagggcggcatgctcgatcgcctgctgtga

SEQ ID NO: 12574 - DNA, 486 bp, Pseudomonas aeruginosa
tccagggtgcccgcgaacgcgcgccgaacacctggctgccggaggagcgcgagcgcttcgtcgatctgttcgacgcccaggacacccgcgaaggggtcaacgccttcctcgagaagcgcgatcccaagtggcgcaactgctgagccttcccatcgaacccggcgggctgcgccacagcccgcccgagccgagagccccgacatgaacgtgcttttcgaagaacgcccgagcctgcatggcttccgcatcggcattgccaccctggatgcggaaaagagtctgaacgccctgtccctgccgatgatcgagaccctggcggcgaaactcgacgcctgggccgaggacgccggcatcgcctgcgtgctgttgcgcggcaacggcgccaaggccttttgcgccggcggcgacgtgcgcaagctagtggacgcctgccgcgagcaacccggcgaggtaccggccctggcgcgacgcttccttcgccgatga

SEQ ID NO: 12575 - DNA, 879 bp, Pseudomonas aeruginosa
ataccgcctcgactaccgcatccatacctacccgaaacccttcatctgctgggcccacggctatgtgatgggtggcggcatggggctgatgcagggtgccgggattcgcatcgtcaccccgtccagccgcctggcgatgccggagatcggcatcggcctgtacccagacgtcggcgccagctggttcctcgcccgcctgcccggcaggctcggcctgttcctcggcctgagcgcggcgcagatgaacgcccgcgacgctctcgacctcgacctggccgaccgcttccttctcgacgaccagcaggacgccctgctcgccggcctggtgcagatgaactggaacgagtcgccccaggtgcaacttcacagcctgcttcgcgccctcgaacacgaggcccgcggcgaactgccggaggcccagttgctcccgcgccggccgcgcctggacgcactgctcgaccagccggacctggcgagcgcctggcaggcgctggtggcgctgcgcgacgacgccgacccgctgcttgcgcgtggcgcgaagaccctggccgagggctgcccgatgaccgcgcatctggtctggcagcagatcgagcgtgcgcgctacctgtcgctggccgaggtgttccgcctggaatacgccatgagcctgaactgcacgcgccatccggacttcgccgagggggtacgcgcaaggctgatcgatcgcgacaacgcaccgaactggcattggccgcaggtggaatcgatcccgcaggcggtgatcgaggcgcacttcgagccgacctgggagggcgagcatccgctggcggggctctgatccgccgcgccgccctctgccgaaggaaggcgcgggcccgccacgtccatagcgtctaa

SEQ ID NO: 12576 - DNA, 951 bp, Pseudomonas aeruginosa
gctgtttcacagcatccccaagaggcctcgcggccgccacaggaggagctccatgaaacagatcgccttcatcggcctcggccacatgggcgcgccgatggccaccaacctgctcaaggccggctacctgctgaacgtcttcgacctggtgcagaagcgccgtcgacggcctggtcgccgccggcgccagcgccgcccgcagcgcccgcgacgcggtgcagggcgccgacgtgttcatcagcatgctgccggccagccagcacgtcgaaggcctgtacctcgaggaggatggcctgctcgcgcacatcgcccccggcaccctggtggctggaatgctggaccttcgcccggacctcggcgcgaagggtccaccccgccgcccgcgagcgcggcctggcgatgctagacgcgccggtgtccggcggtactgccggcgcggcagccggcaccttgaccttcatggtcggcggagacgccgaagccctggagaaggcccggccgctgttcgaggccatgggtcgcaacatcttccatgccggccccgacggcgccggccaggtcgccaaggtgtgcaacaaccaactcctcgcggtgctgatgatcggtaccgcagaagccatggccctgggcgtggccaacggcctcgaggcgaaggtgctggccgagatcatgcgccgcagctccggcggcaactgggcgctggaagtctacaacccctggccgggggtgatggagaacgctccggcgtcgcgcgactacagcggcggcttcatggcccagttgatggccaaggacctcggcctggcccaggaagccgcccaggccagcgccagcagcacgccgatgggcagcctggcgctgagcctgtaccgcctgttgctgaagcagggctatgcggagcgggacttttccgtggtgcagaaattgttcgatccgacacaaggccaatag

SEQ ID NO: 12577 - DNA, 750 bp, Pseudomonas aeruginosa
gctgggctaacgagtgcatccccctcgcagcggtttatcccggcgagcgcagggcggatgatgctgatcgacgccgctctgcggcatttctcgaacggaaggtgcagcatgaaaatcgccctgatcggcgccaccggtcacgtcggccactatttcctcaacgaagccctgcaacgcggccacgcggtaaccgccctggtccgcgacccgagcaagctggcggcgcgcgacggcctcggcgtagtgcaggcggacgtcagcgacccggcccaggtggccagcgccgtggcaggccacgaggtggtcatcagcgctttcaacggcggctggggcagcgccgacctccgcgcccgccacgccgccggcagccaggccattctcgacggcgtgaaacgctccggcgtgccgcgcctgctggttctcggcggcgccgggagcctggagatcgcccccggccagcgcctggtggacagcccggaattccccgagcagtggaagcagggcgccctcggcgccgccgacgccctcgaccaactgcgcggcgagcaacgactggactgggtgttcctcagcccggcgatgctcctcgaacccggccagcgcagcggcaagttccgcctcggcggcgaccaggttctgttcgacgccaagggcgagagccggatttccctggaagacctggcggtagccatgctcgacgaggccgagcagccccgtcatcatcgccagcgcttcaccgtggcctactga

SEQ ID NO: 12578 - DNA, 459 bp, Pseudomonas aeruginosa
ttccaatgcattccaggtccacattcgatgcagagtccgcatgagcgatctacgccagttccgccacttcgtcgccctcgccgagcacggccactatgcccgcgccgccgaagcggtgaatctcagccagccggcgctgtcacgcagcatccaggcgctggagggacagttgggttgcaccctggtggagcgcggcagccgcggcgtggccctcacggcccacggccggctggtgctggaacacgctcggcgcctgctggccgggcatcgcgcactgcacaacgcggtgagccagttggccaatctcgacagcggcgagctacgcctgggcggcggtcccttccccgccgcacggctgttgcccgaggcactggccggtttctccagcgcccacccacgcgtgcgcgtcgtactgctcatcgaagactggcagaccctacgccagcgcctgctggatga

SEQ ID NO: 12579 - DNA, 798 bp, Pseudomonas aeruginosa
cgccgtcgaactcttcgtcgccgatatccgcgagctgcaaggcgatccgcagttgcgcatccacccgctacgcgagtatcccggcgtactcttctgccgccccggccatccgttgctgcgtctggtgaggccgagcgccgagcaactggccgactacccgctggccggcccgcgcctgcccgaggcagtccgcggcgacctggcgcgcctgctgcaacgcgaagaaccgctcggcatacagtgcgacgacgtgctgatgctcaagggcctggtcggctccagcgagctgatcagcctggcgccctgggacgtggttgccgccgacgtcgaggccggccgcctggcgctgctgccctggcccgccggctccgagcccgcccgcgccaagggctccgcctacggtctggtcagccgcgccggccgcagcctgtcgccggccgcggcagtgttcgtcgagcgggtgctggaacaggaccggcgcttcgccgccacctgaggatcagcgccagcgagcgtcgtcgcggcgctcctgccaggaacggttccagtcgcgcccgcggttgtcacggtcgcggtcgtgatagcgctcgtaacggtagtcgggacgatgccggtggtcgttgcggtcgtagaccacgcaggccgacagcggcaggacgaggatcagcagggaaagcaaacgacgcatggcgcctcctgtgcggttccggcctctcctgcggatgcgggaggattgcctgttccggaacctgcacatcggactgcgcggcgcgcgggcggtgcccgcggcgagagtaa

SEQ ID NO: 12580 - DNA, 609 bp, Pseudomonas aeruginosa
gcagggagaggccagccgactgttcatcgtcgacgccggcctcgacctgaccgccctgcgccagcgctaccccgagcgccagcgctacgccatcgtcaagggccgggtgcgtccctggtccgcggtcgacggaggcaggacgctggtcggcggctacatcagccgtaccgacctcgccgcgatcaacgtgccacgacaatggcacgcggtattcgccaaggtcgacgaacaaaactaccggctagcgccgctggaactgcacctcagcttcggccagcgcctggagccctggatcaccaacgccgttcgccgctgaaacgccccgcctggcgcacgatgcttgcatccgcgcgccgggccctgcaccctgggcacccgccagccatccaccgcgccatgaacagcgaaatcgatccaggccgctgcccgctgtgccagcaatccaaccgctgcaccctggcctatcccgctagcgccacccaggcttgctggtgcttcaccacggagatcgatgcggccgtgctggagcggattcccgccgagctgcgccgccgcgcctgcctctgcccacgctgcgcgcaactgctgccgcccgacgccgacgactga

SEQ ID NO: 12581 - DNA, 759 bp, Pseudomonas aeruginosa
accgatgggaatactgctcgtatgccaaccttcctccgtgccgccctgcgcaggctgagcctggcgggcgccaccctttgcgcactggccagcgggccggtattcgccatgccacttccctccgccaaggacctgcagaaactcgctccccaggccagcctgccgaccctcgaactggcccttaccgcctatgcctgcgcgagtgccagccagggcggcgacaacggcctgctgacggtgatcgactactcgcggccgtcgcgcgacaagcgtctctgggtattcgacctgaaggcccgcaagctgctcttcgaagagtgggtgacccacggcaagaacagcggcgatgaccttgccacctccttctccaaccggccgaacagctaccagtcgtcgatcgggctgttccagaccggccagctctataccggcaagcacggccagtcgctgcgcctggttggcctggagccgggcttcaacgacaagagcgaagaacgcgccatcgtcatgcattccgctgcctacgccgatcccagggtggttcccgggctcggtcgcctgggccgcagccagggctgccctgcggtacgcccggccgtggcggcccggctgatcaacaccctcaagcgcggcagctacgtgttcgcctactatccgcagccgaagtggctggagacctcgcgcttcctcgccccgcagagctgcgccgtggcacgtgcggcgcgtacgccggaagtcatcgccagcctgctcaaatga

SEQ ID NO: 12582 - DNA, 291 bp, Pseudomonas aeruginosa
tccgcggcgcggaattccacaccatccgcaatgccggccacttcatcgacgtcgagcacaaggccgcctggcaacagacccaggacgccctgctggccttcctccgcccgcagcgcacgcagccgctcaacccgatctaccgcccccagcccaacggcgccagcgtccccctcgccgccctcgccagctaaccgccaccgccacggggagccccgctcccctggcggaaaaacccagcgaaatcaacaaaaaccccgccccgggcttcacctgccgccgcgcatctggtaa

SEQ ID NO: 12583 - DNA, 219 bp, Pseudomonas aeruginosa
tccagggcttcatcgacagcatcggcgccgactgacgccaacgatcgatgccgcaacacaaacgcactcggaaaaatcggtaacagcggaaccactgcacagaccagagaaaaagccgccaccaaccaggcctggcggcgacaccggaagtaccctcggcggccgattgccgagccgatcccctacctgccccctgggttttccgacgaaagaccttga

SEQ ID NO: 12584 - DNA, 912 bp, Pseudomonas aeruginosa
caagaacgacacatgattgaagaagccacttccagcaagcactcaggcacgacggacgccccgctggtatccgtcgtagcaccctgcttcaacgcggaaaagtacctggaagaagccctgcgcagcatctacgagcaggactacccgaatttcgaagtgatcatcgtcgacgacggttccaccgacaacagctacgccatgctggagcagttgcagaaagtccacggtttccagctctaccgccagcagaaccagggcgtcagcgcagcgctgaacttcggtctgcaacacgcccgcggcgactacgtagccacgccggacctggacgacatcatgctgccgcactcgttgagcgtgcgcgccgcgtacctcgaccagcacccggaagtcggctgcgtcggcgccctggtgatctacatcgacagcgaaggccaggaaaccaagcggcagaacggcaaccgcatccgccagctggacttcgactacctgctcggcaacgcctatgtctgcggcgccccggtgtccctgtaccgcatggaggccctgcgcgccgccggcttctacgatcccgagatcaaggtgcaggacttccagatgaccctgcgcatcgccagccagggctaccagatccacaagctgccggtgctggtcacccgctaccggcgccaccctgacaacctgtcgcggcgctacaaggtgctgctcgatgccgacctgcgcaccatcgcgccctaccagtcgcatcccgcctacgagcgcggccgcacggagctggtcaacaaggccctgaagtacgccgtggtcgcggacaagcggcatgcctggcaactgctccgctcgctgccgctgcggcagtggaaccgcaccaccttccgccggttgaagcgcttccttctccatcacgagagctga

SEQ ID NO: 12585 - DNA, 1434 bp, Pseudomonas aeruginosa
gccggccgcttgacgcccgcggccgttcttcgagggagcttgaatgaccgcgctgcacgacctcccgggaacccgcctgctggcactgttcgcccgccgggaactctcgcctggcgagtactacgagcatctgctggcccacatccagcgctgggaaccgcatctcaacgcgctgtatcgcttcgacccgcaacgggttcgcgaacaggccgcggcggccaccgagcgctggcgcaagggacagcccaaaggcccgctggacgggctgccggtaaccatcaaggagctgatcgccaccgctggcgaacctatcccattgggcagcgccgccaccgccctgcaacccgcgccctgcgacgcgccgccggccgctcggctgcgcgaagccggcgcgatcgtcctggccaagactacggttccagacttcggcatgctttcatccggcctctccagcttccacggagtcacccgcaatccctggaacctggccaacaataccggcggctccagttcgggcgcggcagcggcggccgccgccggctacggaccgctgcacctgggcaccgacatcggcggctcggtgcgactgccggcgggctggtgcggcctggtgggcttcaagccaagcctcgggcggatccccatcgacccttactacaccggtcgctgcgccggtccgatgacccgctgcatggacgactgcctgctgctgatgcgctacctcgcgcagcccgacgcccgcgacgccaccagcctgccgccggaagcgctggactggagcgccgagccgctgtcggtgcgcggcctgagggtcggcctgcaactcgaccccggctgcggcctgcagcccgacgcggaaatccgcgccgcgatcgaggccgcggcgcggctgttcgaggagcacggcgctcagctcaggatcgtcgaaccgctgatggaccggagcctgctcgacggcctgaacgacttctggcgcgcccgcctgtggagcgaactgctgctcctcgacgagacgcggcgggccagggtgctgccctatgtccacgcctgggccgagggcggcgcacgggtcagcggggtcgatgcggtgcgcggtttcaaccagaccttcgagatgcgccggcgcgccgcccggctgttcggcgagatcgacctgctgctgacgccgaccaaccaggtcgaggccttccccgccgactgggcctcgccgctgaacgatccgcagcggccgttcgagcacatcgtcttcaccgtgccgtggaatatgggcgaacagcccgcgctctcgataaactgcggcttcacggccgccggcatgccgatcggcctgcaactggtcgcgccgcgcttcgccgatacctggctgttgcgcatcggcaagacctacgaaggctggcgcggtccgatccacggctggccccggccgccggctga

SEQ ID NO: 12586 - DNA, 528 bp, Pseudomonas aeruginosa
agcatcccctgcacctgggcctggaagcgctcggcggcaccctgccgctgttgctgctcggcgtgccgcagacggtcgccgcgctgctcgccttcgccatcggcatccagttgctgctgcaacacagcaacgtcgacatgcgcatcggcgggttacgccatgtgttcgcctgggcaccgctgcatcgcctgcaccacatccgctacgggcgcgccggcgacgtcaacttcgcgctgttcttcagcgtctgggaccgcctgctcggcaccgccctccatcgtcccgactaccgcctggacagcaccgacatgggcatcggcgaccagcctgactatccccgcgactatgccggccagttgctcgcgccattccgcgacctgccacgcagcaggcacgtcccacagccgccggaaggattggggcgttcagccggccaggcgtaggtgcggcagcgacaggccggcgcggataccgagcaggctgcgtacgctgcgcgacaggtgcgcggcgtcggcaaagccggcgtga

SEQ ID NO: 12587 - DNA, 759 bp, Pseudomonas aeruginosa
tgcgcgtgctcgcgggtatcgccgttgaccccggcgaacagcgcgtggtcccgcgccagccagacctcgccctgccaatgccgctccgtcatcgcgtaccttccgtcaaccgttccgtggcgaaacggtgtcggctatggcgaccgccgtcaagcccgcaaggtcagcgtccgaaccagtcgcgccgatcgtcgaaggcgtgctcgatcagatcgagcaaggcacgcacctccacgcggttctccgcttccggctgcacgctcatccagacttcccgccgcatcggctcgtcgaagacctgcggcaacgccgccaggttgcgctccaggcgtccggcgtaatgcggcagcaggccgatgcaggcgccccagaggatcgcctgtagcagcaggtcgtggctctgtacctcgatcactcccgactggcgagccgccacccgccggttccagggtgccagggcggcgctggcggcctggccgtggagctgcgccagcaggtagtcgtccagctcgtcctcgctggccggccgcgtgcgctcgcgcgaatagcgcttgccgatgtgcggctggtactccagctcagcgatgcgcgccggtgcggcgaagtggccttccatcggcggatgcggctgccccggatcggcgatccagatggcgatctccgccggccctgcgctttccggccagccctcgcgcaactcggcgagggctacgcgcaggttggcgttcttgcgcaggtagccccacagctcgcgactga

SEQ ID NO: 12588 - DNA, 702 bp, Pseudomonas aeruginosa
ggcgaatccgcagttcgatcggctgcggcatgtgttccggcggcggcaggcgcaacgaacggtccatcagtgcgcgccgcagttcattctcgatcggctcggcgtcgctgcgcaggcaggcgagacggacgatccagccgcgttcatcgagccagacccgcaggtcgatgtcggtattcggcaactgccccgccgcgcgccgcgactccaggaaggccagcagccgcggcgcggtttcggcgtcttcgcccaggcgctgctggacctgctcgtcgagccatgcggcataggcgccccagagccgctggcgttcgtcgcggaaccgctcgggctcgccgaacagccagctgcgcaggtgccgccagcggctcgcgcgcggcccacgcctggcctccgggatgccgtccatcagtgcagttccgccagggtcttgccgagcaacgcgccgtcgatgctcagggtagcgttgttcaccaggccatccaggtaggccttggctatctgctcctggcgttgcgcgcgcaggctttcgcgcaggcgaccacggacctcgtcgagggtggcgaggcgggcgtcgcgacgctcggtcagcttgaccaggtggaaaccgttggcgccctggatcggctcggacaccgcgccgaccttcagccgttccagcgccggacggatcgccggcagcagttgcgcctgcgccagtaa

SEQ ID NO: 12589 - DNA, 1245 bp, Pseudomonas aeruginosa
ctcggcatcccagccgaggttcaggtcgagcagattgaactccgaggccaggccgacgtactgcgggttcggcgtgttcgccgggtcggccgggttgggcacgatgtcgcgcaggaggaacaccgtgttgcccttctgcatgaaggtcggacggctgccgtcggtgtcgcactccggatctccggcccagggccggcaggggctggaacgccgcccttcgatatcgtcgaagcggtagtaggccagcgcgccggtaaggctgtgctgcgggttgatcttccaggtggcgcccaattgcgcgccgtacatccacttgttgtcgctgtcttccttgtcgaaaccgttcgacgaggcggtgtccgagctgtactccacggggaacgcgccgaccgtgccgaacagcgagacatcgcggctcagcggctggttgaagatcgccgccacgccgtcgaagttgaggtcgttggaatacagcaggtcggtggacaggaacggattggcgatccgcccgccggtcaggctcaggcgctcgctgggcttccaggtcaggtagccctggtcgagccagaggtccttcttgccgaagccgccgccgagggtctgggtggtcgacaccgggttgttgtccgaaccggtgccgatgcggatgccggcgctccagctttccgacagcgccgccttgaggccgaaacgcgcgcgcaggcgcaccaggctgtcgcggtcctcgcgggtattgagcagcggcggcaggcccgagctggtattcgggttgacgtcatagggaccgtcgtcgttgagttcggcgaagtcggtgatctggttgctgttgccgttgccgaaggagcgcgactcgtagcgcaggcgcacgtcgccgtcgaagctgatgcgcgaggcccagtccgggaaggcgttgggctgcgcccaattctccgccttggcctgggtcattacctcggccttcacttcgtcgcggatctggtcgcgcaccacctgcgggatatagggtacgcggacctccccggggacagcggcaacggccgccgcgggcgccacggtctggcgcgcctgctgggcctgctgcgcctcggcctcggcctgcctgaacagcgcatcgggctgttgccttcttcaacacgccctgctgttccaataaggcggtatcaggttggatcgtgggcgttcctcccaaggggccccggggggtgggccttgccccttggcgcggcaaccgccgggaagcaatga

SEQ ID NO: 12590 - DNA, 2028 bp, Pseudomonas aeruginosa
cggcgttgcagatcggccacgccgctggcgttgtgcgacatgtgcagggtgccctcgcggcgcaactggcaatcgatgccgaggcgttcgatggtctccatcaccagcgccggcgcccgccccagcacggcgttgagcttttctccctgctcggcgccgagggtggcgaccacctcgtccgggggaatccaggtgccggcgttgatcaatccgacattacgtcccgacccgccgtggccgacctcgtacgcttccagcacgcacaccgaacggccggcctccagcaggtggagcgccgccgaaagcccggtgaaaccggcgccgatcacacatacgtcggcgcgctgctcgccgttcaggctcgccgctccggacaggcgaggcgtaaccacttcccacagacaccgttgctgcaaaccgcccatgcgcgactccgctgccagcctcattgccatgcggcgggagcccgccgcgccccgttcaatcgaaggtgatgccctgtgccagcggcagctcgcgggaatagttgacggtgttggtctgccgtcgcatgtaggccttccaggcgtccgagccggactcgcggccgccgccggtctctttctcgccgccgaacgccccgccgatttccgccccgctggtgccgatgttgacgttggcgatcccgcagtcactgcccgccgcgccctggaacagttccgcctcgcgcaggtcggtggtgaagatgcacgacgacagtccctggggaacctcgttgttcaggcgcagggcctcgtcgaaatcgcggtagccgaccacgtacaggatcggtgcgaaggtctccgtgcgcaccacttcggtctgtcccggcatctcgacgatggccggcgacacgtagtaggcatccggatagcgctcctgcaattgccgctcgccgccgaacacccgccccccctgctcgcgggctcgcgccagggcgtcctgcatggccaggtagctgcgttcgtcgatcagcggcccgaccaggttgccctccagcggatgaccgatacggaccctggaataggctgccttgaggcgctcgactatctcgtccttcaccgactcatgggcaatcaaccggcgcaaggtggtgcagcgctgcccggcggtgcccaccgcgccgaacaggatgccgcgcaccgccaggtcgaggtcggcgcttggcgccaggatcatcgcgttgttgccgcccagttcgaggatacagcgagcgaaacgcgccgccacccgcggcgccacttcgcgccccatgcgagtgctgccggtggcgctgaccagggcgacgcgacggtcgtccaccagcgcttcgccggcctcgcggtcgccgatcagcaattggctcaggtgcgccggcgcatcgctgccgaaggcccgcgcggcacgctcgaacagtgcctggcaggccagtgcggtgaggggggtcttctccgaaggcttccagaccacggaattaccgcagaccagcgccagcgcggtattccacgaccacaccgcgactgggaagttgaacgcgctgatcacgcctaccacgcccagcgggtgccaggtctcgcgcatgtggtggccgggacgctcggatgcgatggtaagaccgtacaactggcgcgagaggcccaccgcgaagtcgcagatatcgatcatttcctggacttcgccgaggccttcctgggtgatcttgcccgcctcccaggacaccagttcgccgagttcggccttgtgccgacgcaattcctcgccgaacagccgcaccagttcaccacggcgcggcgccggcacctggcgccaggcgcggaacgcctgttcggcgcgctcgaccttggcggcaacggcggcgcgcccctccagtcgcaccgcagccaggcgactgccgtcgatgggggtatgcacggcaagctcgccatcgcgaaaggcattggggtcgaggccgagactgcgcagcaatccgtcgatcatgtgaggttctcctggctgttcgtttccgctcgttttagtcggtttgcccggtag

SEQ ID NO: 12591 - DNA, 597 bp, Pseudomonas aeruginosa
caacaaacgacctttattcgccacgtcattccgagttttcatactggctccaagctgtcgcgatccgccgtgtttcccgtaccatgcacgccttcgccggccagcccccgcctacccgacatggacaagaaaaagctgttgcgcctgatcacggaaaagctcgccgcggacctggaagtcgccgtccgcgccgcgcagaccgcccatgagacggcaacccacgaagagaacgtcgccgagaacaagtacgacaccctcggcctggaagcggcctacctggccgccgggcagtcgcgccgggtcgaggagatccgccaggcgctgggcctgtaccgcaacctggtgctgcgcgatttcgacgaggaacagggcatccagctcaccgcgctggtcaccctgctgaacgccgacggcagccggcgaacagtgttcctcggccccgaggcggccgggctgaagatcgattgcgaaggtcgcgaggtgttggtcatcacgcctcgctcgccactgggccagagcctgatcggcaggcacccgggcgacgagaccggggcgaaggactccccccttgcggtggaaatcctcgccgtcgactga

SEQ ID NO: 12592 - DNA, 1050 bp, Pseudomonas aeruginosa
tcagttgcttgccggcgctcagccccatgccgccgtactccctgggccagccgggacacagccagccctggcgcgacaacagcaggtaccactcgcgggtttcctcgcgccccaggcgacggggcggattgcggatgcgctgcggatagttggcggcgatccactcacggaccatcaggcgaaaggcgttgtcatcgagactgtcgtagtcgctcatctcagtttcctctgaatacggggggacgcttggcgagaaaggccgccttgccctcggcgtggtcggcgctgagaaacaactggctctgcaactcgccctcccgctccagcaataggtcaaggccctcggcgagcaacgccttggtcatcgccaggggcaacggcgcctgctgctccacccgcccggccagctccagcgccatcgccaaggcgccgccagcggcgcagaggcggtcggccaggccgatgcgcagtgcctcctcggcctgtaccacctggccgaacatcaggatctgccgtgcccgcccccaaccgatgcgcgccggcaaggtatgcaactggccgaggtcggcgagcagcccgaccttgccgaagccggcggcgaagcgggcgccggcgccgcaaacgatgctgtcgcaggccagcgccacggacagcccggcccccaccgcccagccctcgaccgcggcgatcagcggcttgcccatgcgcaccatctgccgcaccagccgcgcgttgtcctgcattcgcgccctgccggcggccaactcggtcacccgcatgtcgcccaggtcgccgccggcgcagaacacctcttcgccaccggtcagcagcacgctgcggatcgatgggtcgcattcggccgcctccagggcccgcagcaattccatgcgcagcgccggcgacagtgcgttgcgccgggccgggttgtcgaagcgcagcaggcgcaccgtgccgcgcgtttcctgcaacaaaccgctcatcaggccacctcccgctgtagcagcgcggcgtagcgcgccttgtggaacgccagcgagccgtgggcattga

SEQ ID NO: 12593 - DNA, 582 bp, Pseudomonas aeruginosa
ggtactccagggttcgctcgaaggcgccatccatcagtccaaccagataggccgcgcaggccagcgctgcctcgtccagaacctgttccgttacctcgccggacaaccaccgtgccggcgcatcgcggaaacgcaggcgcgccaggtgagcgccatcctgggtcgcctcgcagagcagttccacgccatcggcatcgcgctcgaccagcgccaggccctgctcgcaggccaccagccaggcatcggcggcaccagccagatgtacgtgagcgacttcgccgtgcaaccgcccttgctgcatacgagggcgtcgccgcccatcgcggtaggcgatgcccgccggcaggaccagccgctcagcggccagcaacgcaacgcgctcgtcttccggcagcagcggcgccaccagcccggcctcgatcagcggctcgggcagcaggccgcgccccagcgcctccagcaacgccgcgtattcgctcatgcccaggccgctgccgcccaacgcttcatccaggcgcagcgccggccagcccatggcgcagacctcgcgccaggcctggcggtccaccccgctaccggtga

SEQ ID NO: 12594 - DNA, 1419 bp, Pseudomonas aeruginosa
actcctggaagctggcgggccgctgctccgccgctggctgtcgtggaaaagaactcatggatgtgcactccttccgcaggatcaggccttggccgcgcgccgctcggcggtatccacggcactgcccggcgcttgccgtcgggaagcgctctcggcatcgcgggactcgcggttcgggtcgtagagccggtccgcaatgaacagcgccgggatcagtccggtgagcacgtaggtgatgcccatcaccaggaaacccgcgccgatcgacacgtgggtggccagcaggccgatgccggcgggcgccaccgccgcgccgatacgccccaggttgtaggcggtgcccactgccgagccgcggacgcgggtggagaagctctcggtcatgtaggtggccagcaccccgaccggaacgccgtagatgaagccgaaggtgatgaggatccagaggatgttggagggcgagtggtagaacacgatcaacggcatgaaagcggcactgccgatggccccggcggcgaaggtcaggcgccgaccgaagagatcggcgcagacgccggcggcgaccttgccgaggatcatcgcgctgtaggtgccgaccatgtagccggtcatcgacttgaagttcatccccaactcgctctccaggtaggacggcatccagttgttggtgccgtagtagccgaacagcaggaagcaggaggtgaggctccagagcaggaacatgccgcgcgtttccggatcgcccagcatccgtcccagcgggccggcgccgccagcctcggcgtggctctgcggagccgcgccgggacgctggcgcccggcctgggccgcgagccaggacggcgactccggcacccagggccgcagggccaggcagaccagcgccggcgccacggcggtgaagaacaaggcgcgccagccgaactcggggatgatctgccccgccagcagggtcgccaccaggtagcccacggtccagccggcctgcatggcggcgaggatggtggtgcggtacctggttccgacgcactcggacatcaggatgttgcaggcgacgaacagcgagccgaggccgagcgaggcgacgaagcggatcagcgcgaactgccagtagttctgggtcagccccagcaacgcggtaccgatggagaacagcacgatggtccaggtcaccactcgcacccggccgaagcggtcgcagcaccagccgccatagataccgccgacggccatgccggcgagagtcaggctgccgagggagccggcttcgaagttgctcaggccgaattcggccttcaggctgttgaggctgtaggccaggaacatcaggtcgacgccgtcggcgagcaggccgaggaagcagaagacgaaggcgatcagcatggtgcgccgggaaatggccggcgccgggttcggtga

SEQ ID NO: 12595 - DNA, 522 bp, Pseudomonas aeruginosa
agcactccaccccgccctgcagttggcgcgccaccaggacgccatcgagacgcgcctgcggcgccttctcggcggcccggcgcaggagcagttggaaaccggcgcgtaccgcgtccgcatcgcttacgccaagcagcacgccgccgatttccgacttgtgctggatgtccgccgaggcgagcttcagcaccaccgggtatccgatgccctcggcgaaggcaaccgcctcttcggcactgcccagcaccgcctcggcggcggactcgataccggcgcgcgccagcaggcgcttggcctcggcttcgccgggcgtggaggcgggcaactgtagcccgccggcaggccggcgcaggcgcaacggccgggcgaaggcttcgccgagccgccccatggcctggatcgccactaccgcccgggtggggtcttcgaacagtgcgaagccggcctcctcgtagggtgccagctcctccccctcgcccatcaccgagaccacgaacagacgctcgggatgagcctccttga

SEQ ID NO: 12596 - DNA, 582 bp, Pseudomonas aeruginosa
ttcctacacgccgcccgtctccggcagcggatacctggccttgatctcctcgaccttggcggcccaggcgctgtagtccggctcggtaccggccttgatcgcagcgaattcagcctcggtcttgagcgggtcactctccaggcggtaggcatttgctcgcgccacggctgcggcatcgtactcagcctgcctgcgctcttgcgcctgctgttcggcggtctttaccttgctccagtcgatcatcgcggtaactccacaggtccatcggcatcgatcagcagcggttcagggaagcgagcagcggcactggcatcatcggccagcgggaaccgcagactcagctccagccggccggcacgtcgcactgcgggaccagcaaaccacttcgacccgatagcctcggccggcagttcaccgccgtccgggagcggagtgaagtcgaacgcctggccattcacgatgagcacatcgccatctctgctcagtgacaggcgctcgtcgctgcctggcagtggtgcgtacggtgacaacttgatgatcatcagaaccacctcccgatggcgacgaccctgttattcctag

SEQ ID NO: 12597 - DNA, 252 bp, Pseudomonas aeruginosa
tggcgctttttggtcacaacagacattttcgatctccagaaacaagaaaccccgccgaagcggggtctggcagcggtcgtgctagagctggtcttccgtgtaaaccccgcccgactcgacggcgccgccgatctctcgctcgccgtaaagcactgggtatgggttgccctgagcaatagtggtcatggcgccaccgaatccatagctcgggttattcccatcctcgttcttcgcggcggaagcctgagttga

SEQ ID NO: 12598 - DNA, 342 bp, Pseudomonas aeruginosa
cggggccagcatctgggcaacgccaccaagcgccaggccagcgccgccagccatcattgcaacgcctattgccgaggtggtgccgaacgtgaaatagcccgcaacgaccaacgccgctcccaggaccgtctgaaaaattccggaactcttgctgccttggatgactggcacgatgcggatgaccgactcgccggctccggccaggtcaagctcctcttcgcgaagatttcgccgccctacgaaaaccgcgaaccgcatcccgcgctcttctgcggttcgcatgaatttctcgaaaccatctaccatgctggccagggcaatggtggcctctcgcggacctga

SEQ ID NO: 12599 - DNA, 696 bp, Pseudomonas aeruginosa
aatgccagtggcagcatgtttgctctggcggtagcttcccgtgcttggatgagaccaggggccgaggaggcaagcggaatggaagacccaagaaccacaaactatagatacgacgcgggcccaaactctgccatgcgggcagaaatcgggcagatcgtggtcaatcacagcctgtgcgatgaaccgctcatgcggatattcggttttctaagcggactaagagcggatacccagtcggtcgtcgtagaatcattaaggctccgctcgacctcattagcagcaacggtcacaaagcttctcgaaacatcgccgttaccgatcgacataccggaaaggctgaatgtcgctctgtccacattcaagaagatgacggcgcagagaaacaagatcgtccattgggcctgggggttatcaccagagggcaaggacgaggcccctatctaccatccaacaaagaggaacagtgacggaacgccctactcagaaacgctaacgttgcttgaacttagaaaaatcgcgctcgacttaatgcaggtttactacctgctcggcattattgctgggctgttggaatgcggtgttccagatgaaattaaatcggcatcgctatccaagttcgacaagctcattgagaaggtgcgctcgtcaattttggaatatccagaggccgaggctgaagaactgccattatcctga

SEQ ID NO: 12600 - DNA, 456 bp, Pseudomonas aeruginosa
gtgccttccgaaacaggagcggcattgttgacgaagccggtctcgcggacgtactcgacggagttcgactcagtggtgccaggcgcaaccaggtcgcggatggtcagtcgacgctgcggagcggcaacgacaccgggacgacgatcaggagcaaccagggcaccgccagagctgtcgatggaggtgatggccgagcgcggcatggatacgcgatgcgaaccgcgcagggagctggttaccccctgctctttcaggctctctgcgaccatttggccggcggtcttcggtgcttcctcgccgccgtcacgcttctcgttggccagcatggcttgttccgcggcgctcagccgtgcttgcaactcaccctgcgttaccagaagtttgtcaacatcggctcgtgccgacttgctcatctcgccgaagttggcgatctgggtgttgacttgttcggcctga

SEQ ID NO: 12601 - DNA, 1131 bp, Pseudomonas aeruginosa
attcggtcatggctggcctcccggccggtagattggatcgggttaggcaacggccttggcggagtgagatgggaaggccttaacctcctcagccgagtaggttccgtctgcgttttcggtgacatagatgtcacgcccgacccgcagcgccttgttcagtgcgccctgggtcagtccaagcagcgcagcggccttggtctggcccttctgggcagaaaattctttgagaggaatgcggtgcataacccaggtctccatggtttatccatggacaaagtattgccggcggttatttcaaagtcaatgccggcggcgatggatacctatcgcctgcgggaatactcttcgcacatgagcgacaagaaacgtgaaatctcccagtgggagaaagaggaatgcgccaagctgaaagctgcgctggaagaattcaacgccgggaaatctcggaaggagagccttacccaggggaaaatcgccgaggctctcgacatgagccaggggtccgtgagctcctatctcaacgggtacaacgcgctcaatgcgaggtttgcttcgtacgttgcctcgcaaatcgggatccgtatcgagtcattcagtgaacggctggcagcggaagttggggagatggccaaggctgtgcatgcagaacccgcaaaggggaatgtcatttctgccgacttttcgaggcagagaacaaagaacgggttcattgtcgtaccccaatacgatatcgctgcctccatggggaaaggcttggcgcgcccagaatttgatgtcgtgatcgactcgattgtcgcaagcgtcgactatctatctcgcaacgtcagatattcagcaccagacaacctcgcgctaatcacgggctatggcgacagcatgcagcctacgttttcggacggagacatccttctagtcgataccggcatcactgagataaagatagatgccgtctacgttatggccctgaaggatgagctttacatcaagcggatgcagcgaagggcagatggcacctttctgatgatctcagacaacaacgcctacccaccaatcgaggtatccagcgccgaattaaaaagattccaggtgctcgctagggtcctgctggcctggaatgcgaagagactgtga

SEQ ID NO: 12602 - DNA, 393 bp, Pseudomonas aeruginosa
caacctgaagacgagccaacgggcgccgagttgatccggctattgagttccgttggacggtacgaaatgcgcaatgcgctcaccaccggctaccggcgtgagggtttgcgagaaacaccaagatttctcagatgcccttcgcaagaggggcatcgaagaagtcaacacgccctggagggcaagacgatgaatgaaaaggccttactggctttacgtcagtctcttcgaatcattcgcagggagagcgacgtacaccgagcgcgcatcgagtattacgaaacggtcgggatgttgcgcggattgcactacggcggagcgatcgactcctggcagctattagctctaaccgagctagcaggaagcgcatacatcaacgctggcaaaccctattaa

SEQ ID NO: 12603 - DNA, 201 bp, Pseudomonas aeruginosa
ggagtcgacccgatgacaatcattcacgaatgcgaccggtgcaacgcgcccggtcgcgtgatcgagacgtccgacggattccgctgcgagggttgctacgaggaggcgcaggagcaggtgcgcagcgaggcgagctgccccgagtgtgggcgcctgggggtgacggctacaggaatttgttacgcctgcgagaacacttga

SEQ ID NO: 12604 - DNA, 306 bp, Pseudomonas aeruginosa
gaacactgccacggttcgccggggcatcaccgaggaaaggacatgaagatcaacgaagacgaatgtcgcgccgcgggtctcgaccggaaagaggtccgccgaatcgctgccggcatcagtctatacgcccggcaagcggaagcgctgggtctgaccgttttcgggggcggcgcgggcgaccttcgtacccggagctgcaaccgccgggcaggctacatcgtggccactctcgatggttctttcgacggcggtgacggcgcccacgagtacgacgagaacggcctcctgcgcggcgagagctgctga

SEQ ID NO: 12605 - DNA, 627 bp, Pseudomonas aeruginosa
agcgcttcaaattctggtactcatcggtcgagccaatatggcgcggaacaagctggagcacctgagtcagttgctcgaaagcatctggatggtgaactacctactccgcgctctggccaaccaaaggctaatcagcctcaagcaacactcctccgcgatgcaactcactgcctctataggcaaacaggaaaacgcctggaaaggaaagttcgcaaccgcgccctggcgcatacacactggaggcgagatatgtacaagcacgcttcgatttctgatcttctcggaaagaccataaagcagatcaccggattggaagctggaagcggttctgtcgatttcgaatgtgaagacggatctctgtttcggatgtatcaccagcaggactgctgtgagagcgtttcgattgacgatatcgagggtgacgcaagcgaccttgttggccagccgttggtggttgccgaggacgtcattagcgaagacttcccggcgccgcctggggattacgtagaaagctacacatggaccttctaccgactggcaacagccaaaggcttcgtcgtgatccgctggcttggcgagtcgaacggctactactccgaatcggtcgatttcagccggatcaaatga

SEQ ID NO: 12606 - DNA, 654 bp, Pseudomonas aeruginosa
tcacgacgaaacggaggaggcgggaacaggggcgctctgcgagcgccgtgctatccctaccccgcactagaagtacggggtttcccgcgaaaactgatgagcattgactggaacacggcaccggagggtgcgactcattgggagccaacaggacctgatttctatgaaggatggatgaagaaagaagggactgactggttttattggagcgaatcaggacacaaatggataaacgggattttgacctgcgatgtgtccgctgagcgtgaggcgacattcgaggctagaccgcaagaggcctgggacggccagggcctgccgccggttgggacggtgtgtgagtggcacgagtctgatggctgggcttatacagaaagcaaggtggtcgcctatacagatgatgggctattcgtctgtatgcagaaacaaggccgtcggcctgaagtactgcggatagataattgcgatttccgccccatccgcacccccgagcagatcgccgcagccgagcgatgggctgcgattcagcagatgctggcctttgctgacgtgaagtacggcgccggcgaactgatgtccccgaaggagtacgtagagacagccgtggccgcgctctatgacgccggctatcgccgcaaggagtcatccacatga

SEQ ID NO: 12607 - DNA, 261 bp, Pseudomonas aeruginosa
tgcctgacgctgcattgcggcgcggcggaccattgcctggagaaagtcatgaggctgaccagcattccacgcatcaagagcatcaacctgagtcaaaaacgtttcgagcgccgccgtcgcctgtatgcacgaaagattcactgggagctattcggcgggcctctagggggggcatggctatgtacgcctggaaccctgaagttcagcattccaggctggagcggctactacgacggcgaaaacaagtgggtggaagcatga

SEQ ID NO: 12608 - DNA, 1431 bp, Pseudomonas aeruginosa
cctcgaaaccgaggcctggagaaagctcccatgaccgaatcaaagatttgcacctgcccctccggggacggctccctccgccatccatgcccggcacatccggcggtagagcaggcaggcggggatgaacgtgcagttgatggaaagccccgcgcgacccgatgcccggattgcggcgaaagcgatctgatgcccggcgacctttgcacctgcggatatgaaaccgatccggcagccggttacgcatgttccgaatgtgacggctcaggcgacggttatgtcggagaagtctgccgcgaatgcgacggcaccggctggttcgtaaccccggagcaggcccgcgccgccctggcgcaaccctccccggcgcaggcagaggcagaggcggagcggccggaggtggctgacttcaatccgtgccgctaccacgccgagaagattcggcagcgagcagatgaggcggccagcgcgtacgaagccggtcgcagcgcactcggctacatggaggacattgccgaatccgcgctcatcgtccgcaatggcttggatgaactgagcgcccagcacgagcgcatcgtcggggagctgcgggcgaagctgcaagccgctgaggaccgtgccgacaccctcgaacaccgcatgatgggcatgatgacccgccacttcgccgaggcatggcgcaaccgagacacgcagaaggcgctcgacggctatctgtctgctggtatcgcgcaactggagcaagagcgcgacgccgccctggccgaagtcgagcgcctgcgccagttcgaacgcatctgcgaagggctgccgcaagatgccatcgatggcggctggaccgtgcagggcattcgctgctatgccaagcgcttggaggatcaactgaagtccgccctggccagggtcgcggagctgacggccaaccgcaatcgctacggggtagacgcccactacttcaacaagaacctccagcgcatcctgcgcgacttcgagagcttcacgcccgacgaactcgctcgttccctgatcatcctggcgaaggtcgccgacgaaaaggtcgtggctcagcacagcgtgccggaggggttcatcgggcgcctgagtgaattcctcgcacagcgcggcgctaccgggaaagctctgctccgggaactgcgcgacatgctcgccgccgcaccggccaggggccagcacagcgtgccggaggagttcagcttcgagtatcgccaccccaatggcgagtgccacacggtaacggtaagccgggagcaggtgatcaatgagatgcccgacttcctgttcgaagcgctgtgcagcaagttctgcaactgcgagccggtgggcgagacgaacgttgtcgagtgtcgctgcgacgagtacgcggaggaattcaaactgctcgccgccgcgcccggcaaggaggggttgtga

SEQ ID NO: 12609 - DNA, 516 bp, Pseudomonas aeruginosa
gcgagcaggagggaggtaacgatgtcagcaatcatcagtgaatgcggccggtatcggtaccggctggagcgagattgctgcccgccttttgaggggagcaaggtgtacgcatattttggggtcaaccccagcactgcggacgccagcatcgacgatgcaacggtacgcaagtggcgcggcttcactctgcgcaacggaggtcaccggttcatcgtcggcaatgtgttctgctaccgcgccactgacgtgaaagagcttcgcaggcaggatgatccgtttggcccgctgagcacggaacacttccgcgccatcgtcgcagacgccgacattctggttccatgctgggggagcctctcaaaaatgccgcgtgatctgcggggcgcacctcaccagctccttcattggctgatccgatctggaaagccagtcatgtgcttcggagtaacaagctgtggacaacccaagcaccccctcatgcttggatacgacacacccatgaccgcgtggccgtcatag

SEQ ID NO: 12610 - DNA, 684 bp, Pseudomonas aeruginosa
tcgtcaaagcggcgagcgaataacccaacaacgaacccaaccgtatccgccccccggaggaccaaccgtggacaacgaaaacgaaaccctggtcgcgctgcttgtcatcgcgctgatcgtcttcggcatcttccggatagtcggggacttccagaacctatacgagcagaccgagttgaaaggacaggagttgagcagatggagcaagcagtgaacaggcgagaggtgacattcctctccgcagtggatgccagcaggatcgagacgccgagcaacgtgatcagcatcggcagcaagggtgattggtacgcctttgcctgcgatcacaagcgcgttctgcggctggagtttgatgatgtagacggatacgtgggaagcgatggctttcgagtgttcagccacattgacgccaagcagatccacgacttcgtgaacgagtgcggcgacgagtcgatcatcgttcactgccaagcaggcatgagccgatccgctgcggtcgccaagttcctggccgacaagcgcggctacacgctgaacctgtcgaagccttgcctcggcactacgcaattctacaaccgccacgtctacggaacgttgaacctcaacgacgccgaaagcatgagcgcctattacgcagagatggagctagccgaccggctgtgcggccatccaaaggagtcctga

SEQ ID NO: 12611 - DNA, 450 bp, Pseudomonas aeruginosa
tcgagccgcgatctacacagttggcgctatcggactcatagctgttcttgcgactgctctagcagaaaaaccaaaacccaaaaggtggtgggaataattatgatcgacaacgcagagctgcggagactggctgaagaagtgatccgaattgagcagaatgaggatgagccgatctccgctgcttgggagctattcgattccgccgccaaccccaataccatcctcgccctgctggacgagatcgacaggctcaaggcggagaacgaggcgctgcggggagcgctacatgccgttcaagccgaggtcgacgggaatctccgcccacttacccgcgacctcgtgaacatggtcagcggcttgaagaacggctgccacccgaatgacatctacgagcactgcgatgagatcgaaaggatcatcgaagtagctctggaaggagccaagccatga

SEQ ID NO: 12612 - DNA, 1359 bp, Pseudomonas aeruginosa
tcggcgtgttcgtgcgtgaccaggatcgcgtccagctgcgcggggctcagccccaggcgcgccagacgcttgatgatttcacgcagcgggaagccgcaatcgatcagtatccgggtgtcagaactgctcaccaaggccgaattgccccggcttccgctgcccagaaccgcgaaccgcattgcgcatgctctcctggagtttttccagtacgttttgcgcgacatcggccggcgcagaggtgttgatgtccttgtcgacggtgacctgcacggcgtcgctgacggtggtcaggcggacctggtagcgctgcgccttggcgtcttcctcttccttggtcttctcgccgccgccgaacaggcgactgaagaacccgggcttgtcttcgtcgggcttcttcgccccttcggcgatgttcacgtagtacacgccaaggctgcggttgaggtcgtcgacgcggatatcggcgttatccagggcacgcccgacactgacccaggagcggtcgaagtcggattgcaaggtcagcaccgggttgccgctgccgtccttgctcaactcgaaggtgccgggcgtgtcgtagatcgagttggctgccagcagggagaccgagccgccctgctcggcgctgcgcgccatgctcgcgaccatctcgtcgagcagcgccgcgtcgaggctcggcgccaccgacttgctcggccagctcgggctgctggtgtcaccggcggcgcgggtctggctgagcacgtagacctcgctggtattgctttgcacgccgggctcgatacgcacccgaacccgtgcctggccgtccggctcgacaccgctcacgcggctgctaaggcggcgtgccagcggcgcggaaagctgcgacagcgattgccagtcggaactgaactcgccggtctgcgggcgctcgtcggcgatgcggaaaccgttctcctcgaagaactgccgggccaccggccagacttccgccggcggacgctgggccacgacccagcggctatcaccgctgcgctgcaggctgtagtcgctgatgtcgccggcgttggccagcggctgcggacgcggaacctcgtactcaccctctttttcgtgggtggtggcgacgttcagcggaatcggcagcagcggatcgagcggcttgctgtgcaccccttcgggcaattgcatgggaggcgtttcgcgggcgccgaggtagtcgtcaccgcggtcgcggaaatagccctccggcccccacagccagccgcagccggaagtgttgccgataaccagggcgagggcggtcagtccagccagtcgcttcattgcgtggagctccttgatcaagccaatacgccggtctggcgcatggcctga

SEQ ID NO: 12613 - DNA, 273 bp, Pseudomonas aeruginosa
tacggcgtcaccagcaggcaggcgtcggcgccgccgcttttcgcggcctcggtcagcgccaccgcctcgcgggtggagttggcgccggtgccggcgatcaccgggatgcggcccttgacctggtcgaccacgcgacggatcacctggatgtgctcttccacgtccagcgtggccgattcaccggtggtgccgacggcgacgatggcgttggtgccttcctgcaagtggaagtccaccagcttggcgaggctgtcccagtccagtcgaccctga

SEQ ID NO: 12614 - DNA, 1308 bp, Pseudomonas aeruginosa
agcggtctgccaactgttcgacgtgatcaagctgaagaagctctacggcaaggaatacatgggcgtcgaccgcagcaccttcctgatcgacagggacggcgtactgcgccaggagtggcgcggcgtgaaggtgcccgggcatgtcgacgcggttctcgccgccgcccaagcgctcaacggcacctgagccccgccccgaaaaaaaggccgcatccgcggccttttgcatttttcatgcggccgatgctatcgcgtggctgccggagtctcgggaaggtccttgggccaggcatccagcaccgctttcaccagggtcgccagggggatcgcgaagaacacgccccagaagccccagagcccgccgaacagcaacaccgcgcagatgatcgccaccgggtgcaggttcaccgcctcggagaacagcagcggcaccagcacgttgccatccagcgcctggatgatcgcgtgggccaccatcaggtagatgaactggtcgctccagccccactggaagaaggcgatcatcgccaccggtacgctcaccaccaccgcgccgatgtacggcaccaccaccgacaggccgaccagcagggccagcagcgctgcgtagttgagccccaggtaggcgaaggcgatgtaagtcaccgcgccggtaatgacgatctcgatgaccttgccgcgaatgtaattggcgatctgctggttcatctcggcccagacctgtttcatcagcccgcgctcgcgcggcaggtagcggtggaaccaggtctggaagcgcttcttgtccttgaggaagaagaacaccaggatcggcaccagcaccaggtagatcatgacgttcaccaccaccggcaggctggccagcgacgaggtcagcgcccactggccgatctggccgaattcgccgcgcgcggtctcgatggccttgagcacctgctcctcgctgatcaggctgggatagcgctcgggcagcatcagcagcacgctctgccattcgccgagcatccgcggcagttcgttgaacagggtgaacaattgctgccagagcagcggcagcaggaccaccaggaacagcgccagcaagccgaggaacaggctgtagaccagccacacggcgaacaggtgcggcacccggaagcgttccagcatgccgaccacgccctggatcaggaaggcgatcaccatcgccgccagtaccggcgcgagcatcccgccgaaggcgaggatgacgctgaagccgagcaccagcatgatcgccagcaccactgcctcctcgtcggagaagtagcgctgcatccagtcgcgtaa

SEQ ID NO: 12615 - DNA, 624 bp, Pseudomonas aeruginosa
caacctcaggcaattgctggcgaaggcacccaacgacgtggcctacaacctggcccaggtcgagctggacatcaccgccaaccgccttccggatgccgatcagcggttgaagaagatgctcgcccagttccccagcagctacccgctgaaacaggtgcgcgccgacctgatgctgaagatgggcaagccgcaggaatcggagaagatcctcgacgacctgagcaaggcgcggccgctggacccggatgtctggaaccgcctggccgaggtgcgcagcctgaccaacaacgccatcggcgtgcaccaggcccgtgccgagtacctgtctctgaccggcgactaccaggccgccatcgagcagctcgatttcgccaagcgccgcgctggcggcaacttccaactggctgcgcgactcgacgctcgccagcaggaaattcgccaacaggaaaagatggtcaaggaaatgttccgctgagcggcatatccgaggaaaaacacccggcgaagctcatcgaaacagggggttgggcgaacaaccgcaccgcgcttactcgccctacgcagcgggacgccctcgccaggatcaggcgttcccggcctggcgcaggcgcgcggcctgggtga

SEQ ID NO: 12616 - DNA, 639 bp, Pseudomonas aeruginosa
cctggcgacgatcaagcaggacaacgcggaaatcgatatcgccatcaccatcgacgaggaactgaagatatcccgcttcaaccagtgcgtgctcggctacaccaaggcgttcgtcgtcgcccatccgcagcaccccttgtgcaatgcctccctgcacagcatcgcgagcctggccaattaccggcagatcagcctcggcagccgctccgggcagcattcgaacctgctgcggccggtcagcgacaaggtgctcttcgtggaaaacttcgacgacatgctgcgtctggtggaagccggcgtcggatggggcatcgcgccgcattatttcgtcgaggaacgcctgcgcaacggtaccctggcagtcctcagcgaactctacgaaccgggcggcatcgacaccaaggtgtattgctactacaacaccgcgctggaatccgagcgcagcttcctgcgctttctcgaaagcgcccgccagcgcctgcgcgaactcggccgccagcgtttcgacgatgcgccggcctggcaaccgagcatcgtcgaaacggcgcagcgccgctcaggcccgaaggcgctcgcgtaccgccagcgcgccgcaccagagtagagcgttctccagcagacgctggccgtgggtggtga

SEQ ID NO: 12617 - DNA, 372 bp, Pseudomonas aeruginosa
ccaccagcgagtggtagcgcgcgacgcgcaggtcagcgatgccgtcgaacagcgggtgacgctgatcgaaacgcagggacgtgctcttgccgtgcagcggcttcctcgcctcgcccaccgcgccaccggcggccagcgccagcgcctggtggccgaggcagacgccgagcaccggcaagcgcccgcgggcccaggcgagcaattccagcatgcagccggcgtcttccggccgaccgggccccggcgacagcaccagcagttcgcaaccgtcggccagcaataccgcctggatcgtcggcaacggcgtatcgttgcgcatcacccggacctccgcgccgagcaggcagaactgctcgaccaggttgtaggtga

SEQ ID NO: 12618 - DNA, 351 bp, Pseudomonas aeruginosa
ccaccactgcgccggcaccgtcgccgagcaggatcgacaggttgcggccgcggtccgaacagtccatgcgcttggacagcacctcgccgcagaccaccaggacatgccgtgccagcccggcgaggatctgcccgcgagccatctgcaagccgtacagcaacccgctgcactgtgcccggatatccagcaccgggatgtgccgcaggcccagcagcggctggatcaggcaggcctgggacgggtcgtggtggtccggcgacagggtgttcaccagcaacaggtcgatgtcctccggcagcagcccggcagcctcgatggcctggcgtgccgccggcaccatcagcgcgctga

SEQ ID NO: 12619 - DNA, 489 bp, Pseudomonas aeruginosa
gcttctcccgccagttccagggtcacgccctccaccaccatgccgaacggatcgaagctgatcagcagcagttcatccagacggtcgcgctgtgccgcgcgcagttgcgacgccagttcgaacggccccaggcaacgaccatcgggccgtccctggccgaaccattcctcgcgcacccagttcagttgcgggaagtccccggccagacgggtgaatccggcgcgtaccgcttcgggcaatccaggttgggccggcaggttgaggtgccccttgacgtcgcctacctggcgaatatcggtattcagcggaatgctcagcggcagccattcctgcgccggatcaccgcccagcgcaccgcgacggaacgcggccttgccggtcggccggcagagcagcgccagggcgccgtcggcaagggcgaagccggactcgctgtccacttccaatccctggctggattcgccgcgcacgaccaggacgttgcgatag

SEQ ID NO: 12620 - DNA, 615 bp, Pseudomonas aeruginosa
cgctccgccccgcctcgcctgccatttgcaggcttccctgttgaaatcccattgcgtagtacactgggcgagcctgccgaagaggacacctacatgccccatagctacaggaaaatggaatcgccggtcgggacgctgaccctggtagccagggacgatgcctttctggtcgcgattctttggcagcatgagcgtcccaaccgagtaccgctggacgagatgcggctctccgaggacagctccctcctggcggaaaccgaacgccagttgcgggaatatttttccggcaaacgttcccggttcgaactcccgctcgacttccaaggtaccgaatttcagaaaaaggtctggtccgccctgctcaccattccattcggcgagacccgcagctatacggaaatagccgtgcagatcggcagccccaacgcagtacgggcggttggagccgccaacggacggaacccactgtccattgttgcaccttgccatagggtgatcggagcctctggcggcctcaccggtttcgccggtgggttggccgccaagcagtggttgctgcgtttggaaacccgaggcaggacaccagacctgttgagcatgatcgaggacgagtga

SEQ ID NO: 12621 - DNA, 813 bp, Pseudomonas aeruginosa
aacagcggcataagccactattggcgcacacaggcatacgaggaagacgcagggaacacctggttgaaaaccagctctacagatcatcgagcggcgagggttctatctatggcaaatccattggacggcttgcacgacgcggaccacgcgaaggccgaaaaaacggaaggaaggatgccatcggtcagcgatcccagggcgcttgcccgtcttctggaattgatactgtccaccgcccaggccggtctcgccttctccaaggaccgcttcgacatcggacgctttcgcgcgctccagcatgccgttgccgaattcatcgccagcgaccagggggtagcgtacgaacgggtcgagaactggatcgctctggacagccactacccgaccccgaaactggacgtccgtgcgttgatcctcgactcgcaacagcgggttctgctggttcgggaggcctcggatagtcgctggaccctaccaggcggctggtgcgacgtaaacgagtcgccggcagatgcggtagttcgcgaaacccaggaagaaagcggactggaagttcgagcgatacgcctgttggcattgctggacaagcacaagcatccccaccctccccaactgccgcatgcgttgaaagccttcttcttctgccacgtcaccggaggcagtcttcaacaacaaacggacgaaacgtcggcggccgagtacttcccggtggacgccttgccgccgctttccgagcaccgggtactggcctcgcagatccagacgttatggcagcgaatccacgcggaaacgccagaggcgcttttcgactag

SEQ ID NO: 12622 - DNA, 600 bp, Pseudomonas aeruginosa
ccctccgcggtcgggaacaagacattcaaggacgaactcatgggcaaaccattccttcacgctcggcgctggctgctgccgctcaccttcatctgcacggcaacgactgcggtcgccgaaagcaccggcgactactggatcgtctacggcaagggcgaacgctacaacaacgaggtattcgtcgccaacgccaccggcatcttgcagcaacccaaaggtatccagtcggcgcagatcatccagctattcgaagaccagtcgatgccgacgctgacggcctacgaggtccagttcaagtgcaaggagcgcagggtccgcttcgacaacgcacgcgccatgcgccgcatcgacaacgtcatcaccaacgtgaaaaccgtcgacggctggatcgacccggggaaatacgattactggctgcaacgctcgttcgctttcgtctgcgccccggccatccgcgacaacaaccagatgttgccgctgggcaagatgcccattgcgcgcatggtgcagaccgtccaggcaatgttcgtcgaactgcagggcgtccaggccaagaaacagaccatgcgcgatctggatgcgatgctcggcaacgagtag

SEQ ID NO: 12623 - DNA, 273 bp, Pseudomonas aeruginosa
ccgcgaaaccgcgccatctcgtccagcgcccgtgtgacgcgaaagccgctgataccgtgctccaccaggatgccgaccgactccttggtgaagtcatcgaccaccgtcaggcatttgatccgccgcccggtgctcagtgcatcgaagacgaagtccatcgaccagacctggtttggtgcgctcggcaaactcagacgttcgcgctccaccgcgatgccatggcggcggcgccgccgtttcaccatcaagccggcagcgcggtacaggcgatag

SEQ ID NO: 12624 - DNA, 240 bp, Pseudomonas aeruginosa
tgccggtcaacgcgacctgatggcccagatcatcgacgtaaccatcccgtcgagcatgaacccgagcgtcaaggacgccatgcagtatgtgatgagccgctcggtttttttaagatgtcccgttcttcttcaaggcgacgcatttgggcccgcagccgcaggatttcgctcttggcttccaacagttcgctggcctgtttctccgacttgtcgggggtcacagcctttacccatttgtag

SEQ ID NO: 12625 - DNA, 690 bp, Pseudomonas aeruginosa
gtagagacgccgaagcgcgcggcgatttccgcgactgagtatccgcgctcgatgacctgcctaacggcttcggccttgaattccggggtgaatcgctggatgctcatggacttcctcctatgctcaaagcgtaggccgggaatgtctatcgtaccgggggtagtccacagcctctacggcgacgcgaaagcgcgctggacgatcaatgaatacgccgacctggagtgccccttctgcaaggtctacaccccgcggcttaagcgctgggtagacagccacacggacgtgaacctggtttggcgccatcttcccctgcagatgcatggcgaggcggcccgccaccaggctcgcctggtggagtgcgcggggatccaaggcggcgctaaagcattctggagcgctatcgatgcgatcttcgctcagtcggccggcaacgggggcgggctgcctggcggcacattggactttcctgatctggaccaggctcgactggagaaatgtgcgaaagacatgcacctggtggaccagttgatcaagacggacatcgacactgcacggtcgaacggcattacagcgaccccgaccctcgtcatccaggacaaccagacgggacgaagcgtgaagcttgaaggcatggccgacgagaccacgttgctgtcggcgatagactggctagccaaggatctctag

SEQ ID NO: 12626 - DNA, 258 bp, Pseudomonas aeruginosa
tatcagttagccacccccatacagggattatgccctctaggacatgagggagtcacccctaacgctgcaagcagcagttctggatacggacgggctgatggtttcctgctgccccatcgcaagcaatcctgtctgctgtctattccttcctcgagccgctaccagcccgcacctcttcatcgcttccccaaatgggccaccacgcccctggctatcggcttactcttggtactactcactagcgcgtgcctgacctaa

SEQ ID NO: 12627 - DNA, 1206 bp, Pseudomonas aeruginosa
catggtgccattgggcgcaacagtgggcgaatcgtccagagtggtgttcgacagcacccgcagattgccgcgctggaggtcctgggcggcgatctggaagttggtgtagccctgctggcggtggaccattaccagggtcttctcgtcggccgaaagtttcgggttggcgttgtagttgccgatgaaggttacccggtccacggcaccgctgttcacgttcatcttgtagatctgcggcttgccgccacggtccgaggtgaagtacagggtagagccgtccttgccccagaagggttcggtatcgatcgccaggttgttggtcaggcggcgcagggcgcggctgccaaggtccatgacgtagatttccgggttgccgtcgcgcgacagcacgaaggccaggcggttgccgtcaggggagaatgccggagcgccattcaggccctcgaaattggtgatctgctcacgacggccagtatcgacgtactggatgaagatacgcgggcgcttctgttcgaaggagacataggcgatacggcggccatcgggcgagaagcgcggcgacacgatgggctcgcgcgactgcagcagggtcaccgggcgggcgccgtcgtagtcggagcgctgcaaggtgtagcgggtgttgtcgaccgagaaacgctcggcggtgacatagagcatcttggtggagaacgcgcccttgataccggtgagcttctcgaacgactggtcggcgatgtagtgcgacatgtcgcggagctgatcggtgctgccggtcacgctgccggtcaggacctgctgctcggtgccgacatcgaacaatgcgtactgcacctgcaggcgtccgccggcaggcacgatgttgccgaccatcacgtagttgacgccaactgccttccagtcacggaagatcacttcgctggcctgcgccggctggctgatcatgttctgccggggcagcggctcgaagtagccggagttgcgcaggtcgttgccgatgatattggacatgtcttccggcaacacgttgcccccctggaagccgaacggcaccacggcgatgggaatggcacggtcgttaccgctggagatcaccagcgggtcggcagcctgcgcagcacctgccaccagggccagggcgaacagcgcaatgcgaatcagggtactcacagactcaaatcctccggtttaaagatgatgcggcgctga

SEQ ID NO: 12628 - DNA, 846 bp, Pseudomonas aeruginosa
cgatacaggctgtcgaaggtagcccgcggcaattgctgcatctcgggaatacggccgacgttgcgcaccgccgccaccgccgaactgtcgaaaggcttgtcgccactcgaacggctgacgctggcattggtgatggtaccgtccggcagcatttcgatcagtacttctacgctcattccattacgcgccgatggaggacgccgccactgctggctcaccaggttgacgatcaggtcgtcgagactgccggtgacctcgctgcccacctcgtcggccagggcctgctggcgctcggtcgtatccgaaagcaactcggccaatgcctgcgccttcttgtcctcggcagccttgcgggctgccgcggcagcggcggcggcctttttcttggcggcctcgacggcggctttcttcttcgccgcttccgcagcagccttcttcttggcctcctcggccgctttcttcttcgcgtcctcggctgcctttttcttggcgtcctcagcggcctttttcttggcctcgtcctcggcgcgcttcttggctatgtcagcctgcttcttctgttcggcggccttggcctcggcagctttcttggcttcatcggcctttttcgcctcggcggctttctgggcctcggcctttcgagcctcgtcagccttcttttgttccgccgctttcgcagcagcgacctgctgctgttccagcttttgttgctcgagtttctgctgctcgagcttcttctgttcgagctgctcgacttcgtattgcttggaggcggtcttcttcgcctcgccagcgatcttctggttggtctgtgtcgtcgcctggctcttcgacttgagctggtag

SEQ ID NO: 12629 - DNA, 423 bp, Pseudomonas aeruginosa
accatgcccttcagggcctggcggatcatttcttcgctggacaaatcctctcccggtacggctgcgacggcacgactggcttcctgtggcttgaagccgagggcgatcagcgcgctgactgcatcggcctcggcgcttgagactgtagcgctggcacggggttccatcaccaacggtgcaatcgtgggcatgttttcccaagccttgaagcggtccttcaactccaccagcaggcgctcggcggtcttcttgccaacaccggggatcttcaccagggtggaggtgtcctgtgcctggacgcaacgcaccagttcgtccacttccaggcccgacatcagcgccagggccagtttcggacccacgccgttgagccggatcagctcacggaacagctctcgctcgcgcttttcggcgaagccatag

SEQ ID NO: 12630 - DNA, 429 bp, Pseudomonas aeruginosa
ccagccataactcactccgtattgctctctcggcaggaggcgccgcaagcggcgcctccgcgggttgattcgaatcactcggccttcggctgctcgcgcaggcgaatgtgcagctcgcgcagggccttgccgtccacggaacccggtgcctgggtcatgacgtcgccagcgctctgggtcttcgggaaggcgatcacttcgcggatagacgatgcaccggtcatcagcatgaccaggcgatccaggccgaaggccaggccgccatgcggcggcgcaccgtacttgagcgcgtcgagcaggaagccgaatttctcttcctgttccgcctcgtcgatgcccagcacacggaacaccgcctgctgcatggacttgtcatggatacggatggaaccgccacccagctcggtaccgttgagcaccatgtcgtag

SEQ ID NO: 12631 - DNA, 483 bp, Pseudomonas aeruginosa
aaggagaacgccatggaaatcaatatcggaatcggcgaacaggatcgcgcagccattgccgagggcctgtcgcggctactggccgacacctacaccctctacctgaaaacccacaacttccactggaacgtcaccggcccgatgttcaacacgttgcacctgatgttcgaaggccagtacaccgaactggccgttgccgtggacgacatcgccgagcgcatccgggccctgggcttcccggcgcccggcacctacgccgcctacgcccgcctgtcgtccatcaaggaggaggaaggcgttccggaagccgaggagatgatccggcaactggtccagggccaggaagccgtggtgcgcaccgcccgcagcatcttcccgctgctggacaaggtcagcgacgaacccaccgccgacctgctcacccaacgtatgcaggtgcatgaaaagaccgcctggatgttgcgcagccttcttgccagctga

SEQ ID NO: 12632 - DNA, 738 bp, Pseudomonas aeruginosa
catgttgaaaatcgtccttctggtcacgggcgtcgccgccctattgctgtccttcattcccagcctaagaaccgaagccacacccttcctgcaacatcccgatgccatctacctggccattctgggcctgatcaacctgctcttcgctcccgtactgcaatcgtcacatccaacccgcccgctgcaggccggcgcagccgccctgctggtcctgggcgtcgtcctgcaggcactgatcctgctggcgccgctgccgaccatcgccgaccagccggcgatcgtcctgcccctgctaagcctggtgctggccacggctctgcaactggcgggcagcctgaaacccggcaagccggtctcgcgcagcgccagcgccccggcagccctcggcggcagccaggacagcggcaaccgggagaccggtaccgtgaagtggttcaacacctcaaaaggtttcggcttcatttcccgcgattcgggcgaggacatcttcgtccacttccgagcgattcgcggcgaaggccaccgcatcctcatcgaaggccagcgcgtggagttctcggtggtacaacgggacaagggcctgcaggcggaagacgtgatcgcctcccgccgctgaccgccgcgaaaaacagaaaacccgccgaacggcgggttttttgtgcattcaataatggggaggaggcgcttcgtcttcccccgcctcgcccaccagcccctggacgtcttccagacgcttga

SEQ ID NO: 12633 - DNA, 480 bp, Pseudomonas aeruginosa
tcacgagctcaacgaaatcaaggctgccaaccagccgctggtcgccagcccgctggtattcgcttcggaggccgagatccgtgccgccatcggcgccggccccggctcgctgggcccggtcaacctgccgatcgcctgcatcgtcgaccgctccgtcgccctgatgagcgatttcgccgctggcgccaacatcgaggacaagcactacttcggcgtgaactgggagcgcgacctgccgctgcccgaggtcgccgacctgcgcaatgtcgtcgaaggcgaccccagcccggacggcaagggcaccctggtgatcaagcgcggcatcgaggtcggtcatatcttccagcttggcaccaagtacagcgaagcgatgaagctgagcgtcctgagcgaacagggcaagccggtcaacctgatcatgggctgctacggcatcggcgtatcccgcgtggtcgccgccgccatcgagcagaaccatga

SEQ ID NO: 12634 - DNA, 1032 bp, Pseudomonas aeruginosa
cagcgagtcgcagaacctgccgatcggcgaactgatgtcgttcatcaccgaaaaactcagccgctgagcgtaacgatgcccaccggaagacccctgcgcctattcgccgccgccctgtgcggcggccttctgctgagcggctgcgccaaccagttgccgcagcgtagcgagcatgaggagcgcgtcgagcggaagctgctcgaacacaccctgcaagtcgatgtcggccagcccgatgtgctcgaactgccgcagcgccgggtccggatcaacgaccagaagtccttcgaggtcaccgagttcgaggtgacgcgccgttacgaccgctatacgccgtaccaggcctggcgggagatctacgagatcccgttgggcgcggtggcgctggtggccggcgtcggagcgaacatcgtcaacgtggtgaccttcggcagcgtaccggacaacatcacccacggctggatcaactacggactggccggggtgaatccgttcatgaacgtggaatccaacggtcgcgccgaacagaatctcgcgagcatcgacgagaaacagcgcgacaagcgcctggaatactccagcctgccctgggcggagcgtccggtcctggtcagttccggcaaggaactcaacgaactgcttaccgaccgtcatggcgtgctgcgcctcaacctgctcgacagccccttcgccgaacaggacatcagccgcatctcgcagatacacctttcggtgagcgacccacaggatggtacccgcgccgatgccagcctccgcgtcagccgcagcctgcgcggcaagctcctggaagctcacgccctgatctatgacgacctggaaggcgatgacgtccaccactgggtccatcgggtgaaacgcctcgcggagctgggcctggaagaagaagccagcgaactggaacagagcctgatcgagctcacgcgcaacgaccccgaactgcagcagcagttcatgcatgccctgctccgggatgccggtcgcctggccgcggaccctggcgagacgccctga

SEQ ID NO: 12635 - DNA, 390 bp, Pseudomonas aeruginosa
aatagccgtcacttcaccggccatgcgacccctgacatgagcgaactgatcctgttgcacaatccgcgctgctcgaaatcccgcgcagcgctcgaactgctcgaagcccgcggcctgcaaccgcaggtggtgcgctatctggaaaccccgccgagcgtcgccgagctgaaagcgatcctggccaagctcggcattcccgcccgccagttgctgcggaccggggaggacgaatacaaggccctcggcctggatgagcccagtcttggcgaagaggccatcatcgaggcaatggccaggcatccgaagctgatcgagcgtccggtgctggtcgcaggtgacaaggcggtggttggccggcctccggaaagagtcctggagatcctcgcttga

SEQ ID NO: 12636 - DNA, 480 bp, Pseudomonas aeruginosa
ccctgtgtcgcgcgctgggcaaacgcctggcggaaaccgccggcaagctggggagttgaaatggcccgtaagaacaaaccgctgcccgaagtagtgtggctgcagccgcgcctggcgctcagccgcgccatcagcctgggaagcttcgtcggcctggtcctgctcatcctcattcgcgacctgatctacgcggacgcccatggtgcggcgagctgggtgccctggctggtcctcgccttcaagctgctgccgctgctggtggtggcccccggactgctcatgggcagcgcgcgcgggcatgcctgggcctgctacgtggtcaacctgtatttcatcctcggcgtactcgccgccttcgatcccacgcagcgcctgttcggctgggccgaagtgctactcagcgtgaccttgttctgcgccgcgctgctctatacgcgctggcgattccagtacgaccgacgggtcgccggggaacgctga

SEQ ID NO: 12637 - DNA, 408 bp, Pseudomonas aeruginosa
cgagattgcgacagcagaggttgccgaagccattcggctccatggccattacatccttcccctggaaggctgttgaggccaatggacagctaccgcccgatcgcctgcgatctccatgactacctggagatcgcctgcctctaccgctaccggttgctcctcgaactcgaggacggtgttcgcttcgaagccgaggcgcgcacgacgcatacccgggccgttcggccaggcggcggcaaggaggaataccttgaggtggccgtcgaaggagcgactctgctgctgcgcctggatcgcctgttggcgattaccgccctcacggaagcggccttgttcggccgcatacgcctgagggaagaggcctgttccagagcatccggcatgccatcttcacaccttggaaactga

SEQ ID NO: 12638 - DNA, 234 bp, Pseudomonas aeruginosa
gctggatttgccttgatgcagatcaaccctggagcagaaaagatgagtgtgacagtgaccgagcgtgacgatgaccacaaatcccgcgagctgcgtgcgcttggccgccgctgctgggacgtgcatcagcagggactgctggttggcgtcttccataacgaggatgacgcccacgcctatcggatcaagctggagaaagaagaagaactgcgacagataggtaaatcggcctga

SEQ ID NO: 12639 - DNA, 1692 bp, Pseudomonas aeruginosa
ggtggagcaggtcgtcgagtcggtacatgggtatctcgggtcttcagtgaacggtccgggcattctgccctttccggaaacgaaaaggccacgggcagcctgcgagcgcccgtggcctgtttccacctcgcctcaaggcgtacggttgcgccgcgcctcgatgatgttgggcagttgcgagacgcgcgccagcaggcgtccaagagcgtccagaccgggaatctcgatggtcagttgcatggtcgcggtgttgtcttccttgttcgaacgggtattcaccgccagaacgttgatccgctcattgagcagcacctgggacacgtcgcgcaacaggccggaacgatcataggcacggatcgcgatatccaccggataggtgcgaaccggctccggcccccagctgacctggatcatccgctccggttcgcgtcccgccagttgcagcgcggtggcgcaatcctggcggtggatggtgaccccacggcccagcgtgatgtagccgacgatgggatctcccggcagcggctggcagcagccggccatctgcgtcaggagattgccgacaccctggatctgcacgtcgccgcgcttgccgtggccgatcttgctcggcttgcgcgggatcagttcgagttgctcgctgtcgcggtccggctcgaccagttgctgggcatagttgaccaggtgcgccaagcgcaggtcgccggcgccgagagcggcgaacatatcctcggcggtacgcacgttggccttctccgccagccggtcgaaatccaccggcggcagcgccaggcgcgacagctcgcgttcgatcagggccttgccggcagcgacgttctggtcccgcgcctgcagcttgaaccagtggacgatcttcgcccgcgcccgggaggtggtgacgtagcccaggttgctgttcagccagtcgcggctcggaccgctgtgcttgccggtgatgatctcgacctgctcgccggtctgcaggctgtagttcagcggcacgatgcgtccgttgatcttcgccccgcggcagttgtgcccgacttcagtgtggacccgataggcgaaatccagcggggtcgcgcccttgggcaggtcgatggcatggccgtcgggagtgaagacgtagaccctgtccggctcgatatcgacccgcagttgctccgccaggccaccgatgtcgcccagttcctcgtgccattcgagcacctggcgcagccaggagatcttttcctcgtaatggttggagctggccttgacgtcggtccccttgtagcgccagtgcgcgcagactccgagctccgcctcttcgtgcatggagtgggtacggatctgtacttccagcaccttcccctcggggccgatcactgcggtatgcagcgagcgatagccgttttccttggggttggcgatgtagtcgtcgaactccttgggaatgtgccgccagagggtatgcacgatgcccagcgcggtgtagcagtcgcgcatctccggaacgagcacgcgcacggcgcgaacgtcgtagatctggctgaagtccaggcccttgcgctgcatcttgcgccagatcgaatagatgtgtttcgcccgtccgctgagatcggcctgtacgccggtggccgcgagagcttccttcaactggctcatcacgttggcgatgtactgctcgcgatccagccggcgctcgtgtag

SEQ ID NO: 12640 - DNA, 714 bp, Pseudomonas aeruginosa
cagcttggcgatctgcttgtactggtcgggctcgaggtaacggaaggacaggtcctccagctcccacttgatatgcccgatgcccaggcggtgggccagcggcgcgtagatatcgaagacttcccgggcgacgcggtggcgcttttcctcgtcggcgttcttcaccgcgcgaatggcgcaggtgcgctcggccagcttgatcagggcgacgcgaacgtcgtcgaccatcgccaccagcatcttgcgcaggttctccacctgcgcctgggtacccagcaccatggaatggcgcggattgaggctggcgctgatcgcggccatgcgcagcacgccctcgatcagcttggccaccaccggcccgaaatgcttgttgaccgcttccagggtgatcttgccttcccgcacgcctcgatagatgaccgcggcgaccagggactcctgatccagcttgaggtccgcgaggatctcggcgatttccagtccggtctggaagctggacgtgccttccgcccaggagttctgtgcggcgatcgctcgctgctcggattcgcgagcgaactcgcaagcctccagcaagccctgacgatcgagcccggggacgaggttctggacgtggtccagccaggcctcgaggttgatactgccgtcggtgttgaccggctggtgcgctctcacctgtaccatcttgcctaccctttaccacggtgcgcgtag

SEQ ID NO: 12641 - DNA, 1431 bp, Pseudomonas aeruginosa
cccaccgatgactgcgccagccttcgaacgggctggtcggattacgcaggcatcctaacctgcctcgaacaaagccatggcctcgacatgtgcggtctgcggaaacatatcgaggattccggcgcgcttcagacgatagccctgcctggccatttcgccagcatcgcgcgccagggtcgccggattgcaggatacatagactaccctccgggcacccagagaactcatttcgcgtaccgcctcgaacgcgccgtcgcgcggcggatcgagcagcacagcggtaaaaccttgctccgcccagggcgcttcggcaagcgctttggacaggtcggcctggaaaaagtgcgcgttgccaaggccattggccagcgcgttggcgcctgcccgctcgaccatcgccgccacgccctccaccccgactacccgcgccacccggcgcgccagcggcagggagaaattgcccagcccgcagaacaggtcgaggacccgctcgtcggcggtcggcgccagccagtcaagggcctggcggatcatcgactcgttcaccggcgcattgacctggacgaagtctccgggtcggtatgccagagtcagttgccagtcacccaaggagtagcccagttcggcggccggctccaccggcaagggctgttccgcaccttgcagccagagctgggcctggtgtgcggagcagaaagcggccaggcgctggcgatcctcgtcgaccagggcagtcgtatgccgcaacagcaatgcactggccgtgccatggaagagctccacgtggccgatgctttccggcttgcggaagtcctgcagaagagcaggcagggcacgggcaatcgtttgcaaaggcggcaccaggaccaggcactcatcgaaggcgacgatctcctggctggccgaggcacggaagccgacatccagacgccgcgccatggcatcccagcgcacggcgatccgagcgcggcgccgatagccgaattcgggcccgaccagaggggcggcccattcttccggctcgatcccggcgaaacgctgcaactgctcctgcaaggtacgctgcttcagggccaactgctcgccgtgttccaggtgctgcagggtgcagccgccgcagcgacccgctacagtgcagggctcgcggcgacgcaggtcgctactgctgaacaggcgctcgctgcgcgcgtcgaccaccttgcttcgtgcgcccagcacccgggcctcaagttcctcgccaggcagcccgccgctgacgaaccaggtcatccccgcctcgtgggcgatacctcggccgtcatgggccaggcgctcgatggtcaggcgctgcttcttgcctaccggtatcgcgggaccgcgcgcaccaccgctgggctggaagcgcagcccgcccttatttctggccatggacatgctcagcgcgggtcatag

SEQ ID NO: 12642 - DNA, 264 bp, Pseudomonas aeruginosa
tcgtccaggcgcagcccgggggtgagcatggtgccggggcgcagttcgatattgtcctccacgtacagcgcacggatctccgccttgcttttcgggcttcgcgagccggccgcgggggtccccggcaagctatcgcttcccacgaagccctgcttgagcgaggacgggtcgttgagggtttccttgttccactccgcgcccaccgtcagcacctgctcgaacaacgcatgcaacggaaggttgagttcgccgctgaggcgatag

SEQ ID NO: 12643 - DNA, 504 bp, Pseudomonas aeruginosa
cgcaccgagttgcgcgagctgaccggcttgccgtcgaccaggatcagggtgttctccggccccatgccgcggatgtcgatctgccggttgttgccgcgctggccgctggaactgttgccggtgaggttgaccccgggcatggtgcggatgatctcggagagatcgttcaccggcgggcgcttcctgatgtcctcggcggtgatgatggatacccccggtgcctgcttgagctcctgttcggcggtgcccagcaccacctcgtcacccagctggaccaccgattcggcgcgttcgtccagttcttccaggcgctcgtcctcggccagggcctgcccgtccagcaggctcgatgaagcgaaaaggacggcagcggcgagatggccgcgacggaattgggggtacatgcgtgactactcctgtcgagggaaaacgggtagcaggcgagccacgagggatacgttgacgttttttctgaagcctgggtcgccggcgttgcgcgggtga

SEQ ID NO: 12644 - DNA, 3342 bp, Pseudomonas aeruginosa
cgacgagcgcgtactcggctgggtcgaactggaactgtcgcaccacgggactctgctgcgcggatatcgcagcctgttcaccagcctcttgctgatcgccgccggcctcggcgtcaccgccctcctcgccctgcgcatgagtcgcgcgatcaacgcgccgctggaactgatcagccagggcgtcgcccagctcaaggaaggccgcatggaaacccgcctgccaccgatgggcagcaacgagctggacgaactggcctccggcatcaaccgcatggcggaaacgctgcagagcgcccaggaggaaatgcagcacaacatcgaccaggccaccgaggacgtacggcagaacctggaaaccatcgagatccagaacatcgagctggacctggcgcgcaaggaggccctggaggcgagcaggatcaagtccgagttcctcgccaacatgagccacgagatccgcaccccgctcaacggcatcctcggtttcacaaacctgctgcagaaaagcgagctcagcccgcgccagcaggaatacctcacgaccatccagaaatcggcggaaagcctgctggggatcatcaacgagatcctcgatttctcgaagatcgaggccggcaagctggttctggaaaacctccctttcaatctccgcgacctgatccaggacgccctgaccatgctggctccggccgcccacgagaagcaactggaactggtcagcctggtctaccgggataccccgatccaattgcagggcgacccgcagcggctgaagcagatcctcaccaacctggtcggcaacgccatcaagttcacccagggcggcaccgtcgccgtgcgcgccatgctcgaggacgaaagcgacgaccgcgcgcagctgcggatcagcgtacaggacaccggtatcggcctctccgaggaggaccagcaagccttgttcaaggccttcagccaggccgacaactcactgtcgcgacaagccggtggcaccggcctgggcctggtgatctccaagcgcctgatcgagcagatgggcggcgagatcggcgtcgacagtacgccaggggaaggcgccgagttctggatcagcctgagtctgccgaaaagtcgcgacgacaacgaggagccgggcgcctcctgggccgcgggccaacgcgtggcgctgctcgaaccgcaggaactgacgcgccgctcgctgcaccaccagctcaccgacttcggcctggaagtgagcgaattcgccgacctcgacagcctccaggaaagcctgcgcaacccgccgcccggccagttgccgatcagcctggcggtgctcggcgtctcggccgcgatccatccgccggaagagctgagccagtcgttctgggaattcgaacggctcggctgcaagaccctggtgctttgcccgaccaccgagcaggcgcaataccacgcgaccctgcccgacgaacaggtcgaggccaagcccgcctgcacccgcaagctgcaacgcaagctgcaggagttgcttcaagtccgcccgacgcgcagcgacaagccccacgccatggtttccggacggccgccacggctgctctgcgtcgacgacaacccggccaacctgctgctggtgcagaccctgctcagcgacctcggcgcccaggtcaccgcggtggacagcggctacgcggccctcgaggtggtgcagcgcgagcgcttcgacctggtcttcatggacgtgcagatgcccggcatggacggccgccaggccaccgaggcgatccgccgctgggaggccgagcgggaagtcagcccggtgccggtgatcgcgctcaccgcacatgcgctttccaacgagaagcgcgcattgctgcaggccggcatggacgactacctgaccaagccgatcgacgagcagcaattggcccaggtagtgctgaagtggaccggactgagcctgggccagtcgctggccagcatgagccgtgcgccgcagctcggccagttgagcgtgctcgaccccgaggaagggctgcgcctggccgccggcaaggccgacctcgccgccgacatgctggcgatgctgctggcctcgctggcggcggaccgccaggcgattcgccaggcccgcgacaacgacgaccgcaccgctttgctcgagagggtccaccggctgcatggcgccacccgctactgtggcgtgccgcagttgcgcgcggcctgccagaccagcgaaaccctgctcaagcagaacgatccggcggcggccgcggccctggacgagctggacaaggccatcgaggccctggccgacactgcctcggccaccacccacctgtcctccaccagcctcgactccagcgaactctgaccatgcgcatcctgttcttcagcacccaggcctacgacagcgagagcttccaggccagcaaccaccggcacggcttcgaactgcacttccagcaggcccacctgcaggcggacacggcggtcctcgcccagggcttcgaagtagtctgcgccttcgtcaacgacgacctctcgcggccggtgctggaacgcctggcggccggcggcacgcgcctggtcgccctgcgctcggccggctacaaccacgtcgacctggccgccgccgaagcgctcggcctgccggtggtgcacgtcccggcctattcgccgcacgctgtcgccgagcacgcggtcggcctgatcctgacgctcaaccggcgcctgcaccgcgcctacaaccggacccgcgagggcgatttctcgctgcatgggctgaccggcttcgacctccacggcaaacgcgtcggagtgatcggcaccggacagatcggcgagaccttcgcccgcatcatggccggcttcggctgcgagctgctggcctacgatccctatcccaatccgcgcatccaagcactcggcggccgctacctgtcgctcgacgccctgctcgccgagtccgacatcgtcagcctgcattgcccgctgaccgccgacacccgccacctcatcgacgcgcagcgcctggcgacgatgaaacccggcgcgatgctgatcaataccggccgtggcgccctggtgaacgccgcggcgctgatcgaggcgctgaagagcggacaactgggctacctcggcctcgatgtctatgaagaggaagcggatatcttcttcgaggatcgctccgaccagcccctgcaggatgacgtgctggcacgcctgctgagcttccccaacgtggtggtgaccgcccaccaggccttccttacccgcgaggcgctggcggcgatcgccgacaccaccctggacaacatcgacgcctggcaggacgggacgccacgcaatcgggtccgggcctga

SEQ ID NO: 12645 - DNA, 705 bp, Pseudomonas aeruginosa
tcaaccctcccggccagtggctggcggtcgcccgcggcccggcattccgcgaactggcgatccatacctggcaggtcgactgcgaccagtgccaggctcgtctcgacttcgagttcgccgtggacgccagtctcggtcgcaaggccctggcgccggccgccgaagaacgcattcacgaactgggctggcgcagccgcgaagacaagcacctgtgcccgaaatgccagtaaggcgaacgctccgtccgaccgacggtctgtgaactatcgcccgtacgaaatgcgcaaaggaaacgccatgaaaccctctctcgccctcttcgcctccgccgccctggtcctgggcggttgcgccagccaggagaccaccctggaaaccgagcaggcctaccaggtcgactgggtcggcgcacaaccgacgatggactacagccacatcagcctgaccttcgacggccagggccgcgccttcggcaatggcggctgcaaccactggttcgccagctacaccctgcaggacgacctccttcagttcggcgccatcggcagcacccgccgcctgtgcgcggcggagatcatggagcaggaacggcgcttcctggccctgctgcagagcgtccagcactgggacatttcgccgtccgacgagctgcgcctgtggccggccgaaggcaagccgctgcgcctggtccccgagcacgactga

SEQ ID NO: 12646 - DNA, 894 bp, Pseudomonas aeruginosa
tcgccttcccgtgcgcctcagtccgtggctggcaggcgtgctggccatcgtcggcagcgcggcggtacagatactgctctacgccgaccgcaccctctacgacctgtacggattccacctcaacggtttcagcatcggcctgctggtctcgcccggcggcctctccagcctcggcagcggcgacggcaccctgctcagcgcaagcctggcggccctggccctgctctgcctgcaggtgctgctgtacagcgcctgccaggtcagccgcgagcgccttcccgcgctccctcggcgcgcctggcgctacctgttggcggccttcctctgcctggccctgggcgaacgcctggcctatgcgttcagctccctgcgcgactaccggccgatcctgctggccagcgaacgctatccgctttacctgccattgaccgtccgcagcctggcgcgaagcctgggcatccagccgacgcccacccagcgcgagctgctccagcagcagagcgacctgcactatccgctccggccgctggagatcagcgccccggcgcacccattgaacatcgtctggatcgtcgccgagtcgctccgcggggacatgctcgatccgcgctacatgcccaggctgtgggacttctccaaccgggcgatccgcctggacaaccactacagcagcggcaacctgacccagatgggcgtcttcggcatgttctacgggctgcacggcggctactgggacgccgtgctgaaggccggccagccgccggtgctcatggaggtactcaggcagcagaactaccagttccggatcaatgccgcgcaacgtttcagctatccgcccttcgaccgcagcgtgttcgtcaacctgcgcccccaggacctgcacgtgctggatag

SEQ ID NO: 12647 - DNA, 348 bp, Pseudomonas aeruginosa
atgctcggtaacggatacggaaaggacagacagatgctgaacgtcgaacaattgaagcgcagcgtgaaccggatggaactcgacgacatccgccaggcagtggacgaactgcagatggacggcctggtcaccgacggcaagacgccgttcacccgcgtgcacttcaacacctgcttcgccgagatcgaggcgctgttccagcgcgccggcttccaccggccgctcgatgtggtcggctaccagggcgagatctatgcgttgtacgacccctctcgctgggaggccgtggaagtgctgcgctggttgaaggaataccgcgaggaatcgcgtcacctgactccggcgtga

SEQ ID NO: 12648 - DNA, 2022 bp, Pseudomonas aeruginosa
atgcccgcctggatcatcgtcacccttcccccctcggaaatggtcggacagtgcaagccgccactatgcccacggcaagctgaaccatcgctgaacgaataccagcaaatggccttcggccacttcgccgacgcaactcctgcaaaacccggcggtcttctccctgtgacaggacgccgccccgcacagaaaaaatctgctgcgaccacttgggaactcgcccgagaggccatactctgtcgcgcaaattcccatgaggtggctgatgcgcaccgacgctcccgttccagaacatcccgctccacccagctctcccgcgtccccacaacgcatccggctgatcgatcggattaccgcctaccgccagcccatcggcctggtcttcaccttgctgctgttcggcctggcgctggtggcctgctaccacctgctacgggagatcgatcccggcgccctccacgatgccatcgccgacgtgcccaggccggcgctgctcggcgccctgagcgcgaccaccctcggcttcgtcatcctgctcggctacgagtggtcggccagccgcttcgctggcgtcacgctgcccatgcgcagcctggccaccggcggcttcagcgccttcgccatcggcaatgcggtaggcctgtcgctgctttccggcggctccgtacgctaccgactgtattcccggcatggcatcggcgctgccgaaatagcccggatgacgctatttgccagcctttccctgggctgcgcactgccggtgctggcggcactcgccgcactctgcgacctcgacgatgcggcgtcggcgctgcacctgccccgcgccctggtcgccgtcatcgcgatcgccgtcctgtcgctggctgtcggcctggtggcgttcctggcccggcaccgtctgccgggagaacggccgtcccccgacagcctgctggtccgcctcggccgccgcagcctgcgcctgccaggcctgcgcctatcgctgctgcaactgctgatcaccgccctcgacgtcgccgccgccgctaccgtcctttatctgttgctgccggaaaccccacccttcgcggcgttcctgctggtctacctgctcgccctggccgccggcgtgctcagccacgtaccgggcggagtcggggtgttcgaggcggtgctgctggccgcgttcgccggccaactgggcgccgcgccgctggccgcggccctgctcttgtaccgcttgatttatgtggtactgccactgctgctggcctgccttttgttgctgttcctcgaagcgcgccggttgtgggtgacgcgccaggcgatccgcgtcgcctcgggtttcgccgcaccgatcctggcgatcctggtcttcctctccggtgtcgtgctgctgttttccggcgccacaccggcgatcgacacccgcctggaacacctcggtttcctcattccacatcgcctgatcgatgcctcgcacctggtcgccagcctgatcggcgtgctctgcctcctgctcgcgcagggtttgcgccgacggctgtcggccgcctgggccctgaccctggtgctgttgctggtgggcgccctgctttcgctgctgaaaggcttcgactgggaggaagccagcctgctgagcctgaccgccgcgctgctcgccatgttccgccgctccttctaccgtcccagccggctgatggaagtacccttctcgccgctttacgtaggcgccagcatctgcgtggtcggcgcctcggtctggctgctgctgttcgccaaccaggacgtgcattacagcaaccagctctggtggcagttcgccctggacgccgacgccccgcgcgccctgcgcgccgccctcggcagttgcctgctgctcctggccctggcccttggctggctgctgcgcgcggcaccgccggcgatccgcgagccgaacgcggaagagctgcagcgcgcggcgcggatcatccgccactcggaccagccggatggcggcctggccctgaccggcgacaaggccctgctcttccatga

SEQ ID NO: 12649 - DNA, 573 bp, Pseudomonas aeruginosa
accgggccaggctccgctggacgagctgaaggcgatatcggacgcctggctgggcggcaagcaggtgcgcgagaaaggcttctccctgggccgcttcaccccggcgtacctgaacttcttccgcatcgccatcgtccgccaccagggcaagccggtggccttcgccaacctgctggaaaccgacagccgcgaactggcgagcctcgacctgatgcgcgtgcacccggacgcgccgaagctgaccatggagttcctcatgctcggcctcatcctccactacaaggcccagggccacgcgcgcttcagcctcggcatggtgccgctggccgggctccagccaaggcgcggcgcgccgttgacccagcgcctgggcgcgctggtcttccggcggggcgaacagttctacaatttccaggggctgcgacgcttcaaggacaagttccagcccgactgggaaccccgctacctggccgtgccagccgggctcgacccgctggtggccctggccgataccgccgcgctgatcgccggcggcctgactggattggtgaaacgctgatatgtctgtcgtga

SEQ ID NO: 12650 - DNA, 606 bp, Pseudomonas aeruginosa
tccagtacttccctccggaaaacggcgattgcagggcgcagcagtcccggctcgaagcggtcattgcccgcctcggcggcaagccgaacctggtcgccggcatcggcccgggctcgaccaccgcctggcgctggctcgccagccaggacgacgacaaggccaaggcgctctcggtcggcttcgacattgccctggccgagcgcgactgcgacgccccgctgccgcaccaggcgtcgcacggccagtggctgctggcctggaacgacaacccggacgacgacaccgcagtcttcgtccgcaagcagtcgagcgcggaaaccagcatcagcgactacgacaccccgctgtccgacgtgctcgcccatcagttgcgcctgcaactgcaaggcaacgccgaggccctgccggtactcgaggtccccgcggcgcaaccctcggacatcgtcaccctgttctattccggcgacggcggctggcgcgacctggacaaggactctgccgagcatatggccagcatgggctacccggtggtcggcatcgacaccctgcgctactactggcaacacaagagcccggaacagagcgccgccgacctctccaagctga

SEQ ID NO: 12651 - DNA, 654 bp, Pseudomonas aeruginosa
actgagcctgccgggggcattcaggctggcttcagcggagccgccgagaataccggccgacccgccgcagagcgggctcccgagagccgaagagaaggaaccgtgatgagctggaaaaacaccgaatcccgttatgggagcctgaccattgccctgcactggctgaccctgctgctgatcgccggggtctacgcctgtatcgaactgaagggcaatttccccaagggcagcgaaacccgcgaactgctcaagcaatggcacttcatgcttggcctgagcgttttcctgctggtctggttgcgcctgctggtgcgcctggccacccctaccccgcgcatagagcccgccatccccgcctggcaggcgacgctggccaggctgatgcactacgccctctacctgatgatgatcggcctgcccttcgccggctggctgatcctcagcgccgccggcaagccgataccgttcttcggcctggagctaccgccgctggtcgacaagaaccccgacctcgccgggcaaatcaaggaatggcacgaaaccatcggcaacgccggttatttcctgatcggcctgcacgccgccgcggcgctcttccatcacttcgtcagccgcgacaacaccctggtacggatgctgccgcaacggcgctga

SEQ ID NO: 12652 - DNA, 2043 bp, Pseudomonas aeruginosa
gaaacgcgcaaaaaaacgcgcccaatcgggcgcgcttttttgcagcggagcggatcagatctcgacctgggttcccaactcgatcacccggttgagcggcaggttgaaatagcgcaggttgccgttggcgttcttcagcaggaaggcgaacaacccctcgcgccagcgcgccatgccgatgcgcttggatggaatcaccgtctcccggctgaggaagtaggtggtgcgcatcgggctgaagtccagttcgttgagatggcacaggcgcaaggcagccgggatgtctggctcttccatgaagccgaagtgcaggatcacccggaagaacccgtcgccataggcctcgacctcgaaacggcgatccggcgaaacccgtgggctgtcttcgttgaccacggtgagcagcaccacctgctcgtgcagcacctggttgtgcaacaggttgtgcagcagcgcgtgaggcaccgcgtcggtacgcgcggtaaggaacaccgcggtcccctggacccggtgcggcggctgcacgcgcatgctggaaatgaacaccgagagcggcagcgagccctcgtcgagacgctccaccagcagttggcggccacgcttccaggtggacatcaggatgaagatgacgatacccgcgatgaccgggaaggcgccgccctggatcaccttgggcaggttggcggcgaagaacaggctgtccaccgcgagcatcacgcagaagaacgggacgcccagccacagcggccatttccacaggcgccagatcaccacgcccatcagcagggtggtgatcagcatggttccggtcaccgccacgccgtaggcagccgccagcgacgccgaggactcgaagccgagcaccagcaggaccacgccgaccatcagcgcccaattcaccccgccgatgtagatctgcccctgctcgtggctggaagtgtgctggatggtcatccgcggcacgtagccgagctggatcgcctggcgggtcagggagaaggcgccggagatcaccgcctgggaggcgatcaccgtggccagggtggacagcgccaccatcggcagcagcgcccagcccggcgccagcaggtagaaggggttgcgcgccgcctcggcgttggaaaggatggtcgcgccctggccgaagtagttcagcaccagcgccggcagcaccagcaggaaccaggcacgggcgatcggcttgcgaccgaagtggcccatgtcggcgtacagcgcctcggcgccggtcagcgccagtacggtggcgccgaggatggcgacaccgatgccgggatgcgagctgaagaaacgcacggcccatacagggttcatcgcctgcagcacttccggctgctggatcaccccgtagacgcccagcgccgccagggcgccgaaccagagcaccatgaccgggccgaacaggatgccgatccgcgcggtgccgtgcttctggatcaggaacaggccgatcagcacgataagcgccagcggtaccgtccagtgctccaggccgtcgaaggcgatctccagcccttctaccgccgacagtaccgagatcgccggggtgatcatgctgtcgccgtagaacagcgccgcgccgatcaggccggcaaccaccacgaaggtctgcagcctgccgaacggcgccgccgcccggcgcgccagggccgacagcgccatcaccccgccctcgccctggttgtcggcacgcaggacgaagatcacgtacttgatggaaacgacccagaccagcgaccagaagatcagcgacagcacgccaaggacgccatcgtggttggcctgcaccccgtagccgccgatgaagacctctttcagggtatacaagggactggtgccaatatccccatagcagactccaaccgccccgaccatcaggccgatggcagagctggaatgcccctccgaagtctcctcggcacgcgtcgctgcatcactcatgaaacgctttcccccggaaaaattcggcaaatgctgcgcccatgccgtccgcgatgcaagcgccgaggccacggactgctatga

SEQ ID NO: 12653 - DNA, 1443 bp, Pseudomonas aeruginosa
gtttttccagggccggaaaagagctgcacgggagactggaaaagccgcggcgctgccgctagaattgcgcactttttgatcagaggcgccagcaagcgcgcccgcctaccgaggttagccatgtccacccccactcccaaagtcggcttcgtcagtcttggatgccccaaggcgctggtcgactccgagcgcatcctcacccagctgcgcatggaaggctatgaggtcgttccgacctacgaagacgccgacgtcgtggtggtcaacacctgcggtttcatcgacagcgccaaggccgagtccctggaagtgatcggcgaagccatcgccgagaacggcaaggtcatcgtcaccggctgcatgggcgtggaagagcacgcgatccgcgacgtgcatccaagcgtgctggcggtcaccggcccgcaacagtacgagcaggtggttaccgcggtgcacgaagtggtgccgccgaagaccgaacacaacccgctggtcgacctggtcccgccgcaaggcgtcaagctgaccccgcgccactacgcctacctgaagatttccgaaggctgcaaccacagttgcagcttctgcatcatcccgtccatgcgcggcaagctggtcagccggccggtcggcgacgtgctgagcgaggccgagcgcctggtcaaggccggggtcaaggaactcctggtgatttcccaggacaccagcgcctacggcgtggacctgaagtacaagaccgacttctggaacggccagccggtcaagacccgcatgaaggaactctgcgaggcgctgagcagcatgggcgtgtgggttcgcctgcactacgtctacccgtaccccaacgtcgacgacgtgatcccgctgatggccgccggcaagctcctgccgtacctcgacatccccttccagcacgccagcccgaaggtgctcaaggccatgaagcgcccggccttcgaggacaagaccctggcccggatcaagcagtggcgcgagatctgcccggaactgaccatccgctcgaccttcatcgtcggcttcccgggcgaaaccgaagaagacttccagtacctgctcgactggctgacggaagcccagctcgaccgcgtcggctgcttccagtactcccccgtcgaaggcgctccggccaacgagctgggcctggagccggtgccggacgaggtcaagcaggaccgctgggaacgcttcatggcccaccagcaggcgatttccgccgctcgcctgcagctcaaggtgggcaaggaaatcgaagtgctgatcgacgaagtcgacgaacagggcgcggtcggccgctcctgggccgacgctccggaaatcgacggcaacgtgttcgtcgacagcgacgagctgaagccgggcgacaaggtccgcgtgcgcatcaccgatgccgacgagtacgacctctgggccgagctggtctga

SEQ ID NO: 12654 - DNA, 615 bp, Pseudomonas aeruginosa
gcccccctgaagagccccgccccgcggggctttttcatcgccaaccgttccggagagcacgatgctcaacaacgacgtactacgcagcctgcgctacctgctggatcttcccgacgcacatctggccgaactggccgccccgttcggcgagcaagtcgaagcggacctgctcgaggcttacctgaagaaggaagacgaagacggcttccaggcctgccccgaccgctacctggcgcgctgcctggacggactgatcatccagcgccgcggtcgcgacgagtcgcgtccgctaccgccgctggagctgccgttgagcaacaacatgatcctgaagaagctgcgggtcgccttcgaactcaaggaggaagacctccatgccatcctcgacagcgtcgacttcccggtctccaaacccgagctgagcgccctgtttcgcaagcccggccacagcaactaccggacctgcggcgaccagttgctgcgcaacttcctcaagggcctgaccctgcgcgtccgtggctgaacgcgcggagccactgctggcggttctgctccaggcgccgccctgcgccgacccctggttcctggagtgccgccaggatcgcgccggcctga

SEQ ID NO: 12655 - DNA, 1455 bp, Pseudomonas aeruginosa
tctgaccgccatgaaaaaagccgcccgtgggcggcttctcgcgtggcgctccggctacatcaggaagatcgtcgccaggccgaggaagatgaagaaaccgccgctgtcggtcatcgcagtgatcatcacgctggagcccatcgccggatcgcgtccgaaacgatgcagggtcatcgggatcagcactcccatcatcgccgccagcagcaggttcagggtcatcgcggcggtcatcaccacgcccagttcccagttgccgtaaagatagaaggccaccacgccgatcactccgccccacgccaggccgttgaccagcgcgacgccaagctccttgcgcagcaggcggttgcgactgttgctggtcggctgtacctggtcgagcgcgatggcgcggacgatcatggtgatggtctggttgccggaattgccaccgatgccggcaacgatcggcatcagcgcggccagcgccaccagtttctcgatggagccttcgaacaggccgatcacccgcgaggcgacgaaggcggtgatcaggttggtggccagccaggcccagcggttgcgcaccgacttccagaccgaggcgaagatatcttcttcttcacgcagaccggccatgttgaggacttcgctttcgctttcctcacggatcaggtcgaccatctcgtcgatggtcagacgaccgatcagcttgccgcccttgtccaccaccggcgcggaaatcaggtcgtaacgctcgaatgcctgggcggcgtcgtagccgtcctcgtccgggtggaaggtcaccgggtcggtggccatgacttccagcacttgcttgtccggatcgttgaccagcaggcgcttgatcggcagcacgcccttgagcacgccgtcgtagtcgaccacgaacagtttgtcggtatgcccgggcagttccttcaggcggcgcaggtagcgcagcaccacttccaggctgacgtcctcgcggatggtgaccatctcgaagtccatcagcgcgccgacctggtcctcctcgtaggacagcgccgaacgcactcgctcgcgctgctgcgcgtcgaggctttccatcagttcatggaccacgtcgcgcggcagttccggtgccaggtcggcgagttcgtcggcgtccaggtccttggtcgcggcgatgatctcgtggtcgtccatgtccgcgatcagggtttcccggaccgcgtcggagacttcgaggaggatgtcgccgtcgtcctcggacttgaccagttgccagaccgtcaggcggtcgtccagcggcagcgattcgaggatgtgggcgatgtcggcggggtgcagttcctccagcttgcgctggagttctacgagattctgccggtggacgaggttttccacccggtcatggtgctggccttcctgacgatgggtcaggtcttccaccaccttgtggcgatgcagcagctcgaccacctgcgctag

SEQ ID NO: 12656 - DNA, 828 bp, Pseudomonas aeruginosa
cggacaggcaccgacgcggcggatacaaccgccggccaggccggagcgaagtacgttcgttcaatgcaggcgcaggacccgcgccaggttgccgcgcgcctgcaacagcaggaccagcagcaccagcagtaccccgagcatccacggcgagaggtgctcggcacgatacaacccggccactattcccagcgcctggcagccggtgcacaacgccagcaggtaggcgcacagggaaacgccggggcggaaacgcgcgccggcgcggcgataggtgatcaggcgcatgcagatcgccgagcagaccagcacggtcagggtggacagcggatcaaccatcggacttgcctccccggcggcgcaacagcccgcgcatccagctgggcagttcgccgccacgcatccactcgagcatgccgatgccgccggtcacgcagagggtcgcggcgacgaaggcggccatgccgctggtctgggtcaatccgcggccgagcgcttcgattccggcgtaatagccgccgacccaggacaccagcaggtagccgaggcgggtcagggcgttgtagtcacgggcgaacacgacaaagaagatggcgccgccgaagcctcccagcaaggcgttgccatcgatacccggcaggtacatggccaggccgacgccagccattgcgctggcggcggaggccgcagagcttggctcggacatggatgactcccggaaatgcaaaggcccgccgaaaaggcgggcccggaacggccgaagcccgcatcggcgggcttcggccagaggaatttcaatcgtggagaatttatacctttatcgtcccatag

SEQ ID NO: 12657 - DNA, 2241 bp, Pseudomonas aeruginosa
gcgacgaaaggccgcgaaggcatccagtacttgtcctatggactcggcggaaacgtccaggtgggtgaccaggcgcaaacgcgccgccgcgctgatccgcacctcgcgctcggcgaggaagtcgcgcagcgcgaccgcccgctcgccgacatcgacatagaccatgttggtctgcaccggctccaccgcatagcccagttcgcgcagcccgtcgcccaggcgcgcggcgttggcgtggtcgtcggccaggcgtgccacctggtggtcgagggcgtacaggccggcagccgccaacaggccggcctggcgcatcccgccgccgaccatcttgcgccagcgacgggccttgccgatcagttctacgctgccgcaaagcaccgagcccaccggcgcaccgaggcccttggacaggcacaccgacaccgagtcgaagtgtcgggtgatctcgctggcgtctacgcccagcttcaccgccgcgttgtacaggcgcgcgccatccaggtgcagggccaggccacgcgcgcgagtgaaggcgcgcgccgcggccaggtagtcgagcggcagcaccttgccctgcatggtgttttccagggccagcaggcgggtcctggcgaagtggaaatcgtcggccttgatcgccgccgcgaccttgtccaggtggagcgatccgtcggcctcgccgtcgatcggctgcggctggatcgagcccagcaccgcggcaccgccgccctcgtatttgtaggtatgcgcctgctggccgacgatgtattcgtcgccgcgctcgcagtgggccatcaatccgagcaggttgctcatggtcccggtcggtacgaagagcgccgcggcgaagcccaggcgcgccgccagttcggcctccaggcggttgaccgtggggtcctcgccatagacgtcgtcgcccagttcggccgcggccatggcttcgcgcatgccggcggtgggctgggtgacggtgtcgctgcgcaggtcgatgacaggcacggagggctcctcggttcggcggaaaagcccgatcctacggcgctctaccgacagccacaagggaagtcgggaaatcttcccggccgcaacggaaacggagcgccgaagcgctccgtcatgatcgagagggaaggccgatacgcctcagagcttggccggcaccaccaggattccggcacgcaggccgttcttcacccgtggattggggaagatgatgcgcgcgccgacctcgtccaccacccagcgcgtgccgccgatatcctcggccagcaggtagcccggcgagagttcggtgaagttggccacgtcgtcgtcgaggtgcaggcggaagtggtcgctgtgcttgatcacctcgcgcgacacgctgaacagcttgaggccgtcgagccgggagccgtccggctgttcctcgctgccgtcgatcagcagctccaggctccgctccaggcgctccaggttgacctcctggttctctccgaacggacgtgccttgcccagttccagggtaaaggcctccgcgccgagctggccgtaggtgtaggcgctgaaggtgatgcccggcttgttctgcaacagcaccgcctcgatgccggcgtcgcgcaggcgggccagttcgctgcgggaatgctggcggccctcggcccaggggtagagggcgaactgctcgatcttcgagccgcggatcgcggtatgcaggtcgtagtgcaggtggactcgctcggtcttgctgaagaacacctgggccaggcgctccagctcggcggcacggaaggcctcgttgccgctgccctcctcgtggcgaccgttgaacaggcggttcatgtcctgttcgacgtagcgctcgccgcggcggatggcttcggggttgccgaacaggaagaggaccctggcggcaggcttgagggtgccagcggcgaccttgcggatcagccgttcgagcagttcgatgggcgcggtctcgttgccgtggataccggccgagagcaacaggtcgacgccgttatcgcgggcgccgatcggcgtgacttccagcgcgccctcggccagccagtgcaggcgggtgccgtcggcggtgagctggatcttctcggtcggctcgcggccggccagggtcaagtcgagcagtttgccgagggcgagcatgggatgtcctcagtcagtgggtgtggtcgcagccgcagtcggggccgtgctcgtggtcgtcgccctcttcgatcggctccatctccagttgcaggctga

SEQ ID NO: 12658 - DNA, 417 bp, Pseudomonas aeruginosa
tgggcgaaatgccgctcgtcgttgaacatcgccgccagcacgcggctggtggtgggatgctcgatggatcggtggaacttgcagttcaggttggccgcggtgaaatgcacgcggccatcggcggtgtcggcactcgggctgaccgtggcggcattggcggtccacatgctcgaagccgagctgcaggcggcgaggagaggcatcgcttccttcgccgcgcggcggatcacctcctcgtcgctgccggagaagcccaggctacgcagcgcagcggtatccgggcgggcttgcggagcgagtaccccctgcttgaaacccatctccatcagcgccttcatcttcgccaggccctgcttcgccgcttccttcgggttggacaccgcctggctgttgctttgcgaagcgacattgccgtag

SEQ ID NO: 12659 - DNA, 2538 bp, Pseudomonas aeruginosa
ctggctccttcagaccgctaccaggcgcacgctggcgccttcgccgacgcccagggcctcggcggcttcaacactcagggccaccggcttgccgggcgcccagtccaggtccagcacgaccgcgcggaagtcctgcaactggccgttggtgaccaggtatggacgcccgctcttcggcgcctcgccgatcttcaccggaaccacccggctctgggcgatcgagcgaatccccgaggtacgcgcgtgcagggtcgggccgccatcgaagatgtcgatgtagttgtcggtctcgaagccttcgcgcatcaggatatcgaaggtgatctgcgctcgcgggtggacctggcccatggactcctgggcggcatccggcaacagtggcacatagatcggatagtgcggcatcagttcggcgaggaaggtgcggctcttcagcccggagagcttttccgcctcgatgtagttcaggtcgaagaagttgcgcccgaccgcgttccagaacggcgattcgccctgctcgtcgctgtagccgacgatctccaccaccaccgcgtcggcgaagcgctccggatggctggccatgaacagcaggcgaccgcgcgagttgagttcggcgtagacgctctgcaccaggtcgcgctgtacgtagaaactggtcagcaggctgttgccggtaaggtcgtggcacagcgagaggacatggatcttgttgtggatcgacagcgagcgcgaggcgtgcacgaaggtttcgttgcggaagctgtagaacggttccgagaacccggccgaggcgacgatcgccgagcagccgaccagctcgccgctggcgctgtcctcgaggacgaagaaatagctttcctcgccgttgtagctcacctccgcggcgaacgaggcctcggaagcgaggatcttgtcgcgcaggcgttcggcgtcatccggcaaggacgtgacgcctaccgggctgtccgccgccagacgctgcacctgtggcaggtcggccgcttgggcggggcgcatcaccaacatggcgtcactcctttctcagacaacgatgattgccgcatccatgcgcgggaccgcggcaccttcctgtgccacggtttcgaacgtccagcagggaagatcccgcgccacgcacggcggcacggttcccggctccggcgcgggccgctccgggatgtcgcatcgggtgccccggcctgcgccggggccccgtgggttcgctcagccgcggaccagcttggccacggcgcgctcgaagcgctccaggccttcgtcgatctcggcgtcgtcgatcaccaggctcggcgcgaagcgcaccacgtccgggctggcctggagcaccatgaccgcctctttctcggcggcgttgagcacatccctggccttgcccttccactcgtcggtcagcgccgcaccgatcagcaggcccatgccgcggatctcgtcgaagatgccgtactcctggccgatcttctgcaggcgggacttgaagcgctcatgcttggccttcacgccatccagcacttccggggtattgatcacgtccagcgccgcctcggccaccgccgacgccagcgggttgccgccgtaggtggtgccgtgggtgccgaccgacaggtgcttggcgatctcgccggtggtcagcatcgcaccgatagggaagccgccgcccaggctcttggcgctggagaggatgtccgggaccacgccgtagtgcatgtaggcgaacagctcgccgacccggcccatgccgctctggacctcgtcgaagaccagcagcgcgttgtgctcgtcgcacagcttgcgcgccccttccaggtaggcctgctgcgccggcagcacgccgccctcgccctggatcggttccagcaccacggcgcaggtcttgtcggagatcgccgccttcagcgcttccaggtcgttgtagggaacgtgggtgataccctcgaacttgggcccgaagccatcggaatacttcggctggccgccgacgttgacggtgaacagggtgcgcccgtggaagctgttgctggcggcgatgatctcgtacttctgcgggccgtagacatcgttggcgtagcggcgagccagcttgaaggccgcctcgttggcttcggcgccggagttggcgaggaacacccgctcggcgaaggtggcgtccaccagcttgcgcgccaggcgcagggccggctcgttggtgaagacgttggaaacgtgccagatgcgctgggcctgctcggtgagcgccttgaccagcgccggatgcgcgtggcccagggaggtcacggcgatgccgccggcgaaatcgatcagttcgcggccgctttggtcccagacgcgcgatccctcgcctcgcaccggaatgaaggcggcgggggcgtagttggggaccatataccggtcgaaatcggcacgttctacctgcgcatggggagcggacatcggtgtttctcctgcctgaaggcggctatcgatgaaaggattgtagggattgggaccgggccggcattgccgccatgcgacaacttgttatag

SEQ ID NO: 12660 - DNA, 1281 bp, Pseudomonas aeruginosa
acgcgcgatgcactcgggtgcatacttcttctacgccgccccgcgggcgggaacagcagggaaacaagccatgcccatcgagggaatcgactaccgtctcgtcttcgcctccgacgtcaatccgcgcgacggcctcggcctggagtgctggcgcggcgaacagccgctgttcgaggtctttcgcgacgacgtcggccggcgtttcgtggtcaacctgttcgccagcgacgttccgctggaactgctggagacgatcattccgacggcccgtcgcgaactcggcgacttcccgaggcgatccacctcccggggcgtcgcaaagcccggctgaaaccgccgcgccgttggcgatcagccgcgttcgacgggagtgaaggtcgtctcgaaggcgctgccgccgcgccgctggttgcggtcctcgcgcggagtgacgccgaagaagttgcggtaggcgctggagaaatgcggcccggaagagaaaccgcaggacaggccgatctggatgatcgacttgctggtctgcatcagcatctgccgcgcgcggttcaggcgcagctccaggtagtactggctgggtacgcggttcaggtattgcttgaagatccgttccaactggcgccgcgaaacacacacatgctgggcgatctcatcggtggtcagtggctcctcgatattggcttccatcagcagtaccgcctgggtcagcttcggatggctggagccgaggcgattcttcagcgggatgcgctggcgctcgttgccttcgcgaatgcgctccaccaccagctcctccgagaccgcgccggccagttcagcgccatggtcgcgggacagcagcgccagcagcaggtcgagtaccgccatgccgccgcaggcggtcatgcggtcgcgatcccactcgaacaggtgattggtggcgatgaccttggggaagcgctcggtgaagtcatcgtgccaacgccagtgcaccgcggcgcgatagccgtcgagcaggccgagctgggccagcgggtagatgccggcggacagcgcgccgatcgccgctcccgaacgcgccagttgcttgagcgccaggcccagcgctggcgacaccgccgccggcgcctcgtcggcgaccaggaacagccgcgagcattgctccagcctaccgttccaggccgttcccggcaggcgccagccctcctcttcggccggcgcttcggcgagcaggaacagcggctcgtagagcacctcggggtgcaaccgccgggccgcccgcagggcttcctcggcaagcgatag

SEQ ID NO: 12661 - DNA, 423 bp, Pseudomonas aeruginosa
cgtcagcgcgcgggtggcgggccagaggaggaaaccgatgcgttggggttgggcagtcatgggagcagcttagccggcctctgcgatgaatgttacttgaggctgccggagaggaactgcttgaggcggtccgactgcgggttggcgaggacttccttcgggcagccgtgttcctcgaccaggcccttgtgcaggaacaccaactggttcgacacctcgcgggcgaaacccatctcgtgggtcaccaccaccatggtgcggccttcctgcgccaggtcctgcatgaccttcagcacttcgcccaccagttcggggtcgagcgccgaggtcggctcgtcgaacagcatcacttccggctccaccgccagcgcccgggcgatcgccacgcgctgctgctcgccgccgctcatgtgcgccgggtag

SEQ ID NO: 12662 - DNA, 1059 bp, Pseudomonas aeruginosa
agcacgcgctgcatgccctccagttccgaggtcgccggcggcagggcgtccagcgccgcgcgcagggcctggcggaccagcgcgacattggccgccggatcgctgccgagacgctcgccgacgctgtcgatcaccgcgtccagcaggtcggggaaatcgcgattgaagttgcgccccgctgctcatttcgaagcgcccctggtgcagcgcctggatcatctgcccgagaccgaccggattgcccaccggcaccagctggacggtgccgcgcaggcggccttccgcctccagcaggcgcaaccggctgcttcagctcccaggcggtgcgcatgcccggcagctcgtcggcgtgcaggctggactggatgtagaccttgcgcgcgccgcagccgaaggcggaacacgctcaggcgcttctcgcttcccagggtgctccacggcagcaggtggtcgatacgctccatgcggtcctccggatcaggatttgcgcggcgccaggtaggccagccagcggcgctcggcaagcttgaacaggcgcaccaggatgaaggtcaggcacaggtagaacaggccggcggtgatgaacgcctcgaacggcaggtagtactgcgagtagacggtccgcgcggcgccggtgatgtccaccagggtgacgatggacgccaggctggtggtctgcagcatcatgatcacttcgttgctgtactgcggcagggcgcgccgcagggccgacggcaggaggatacggcggtacatcttcaggcgcgacatgcccatcgccttggccgcctcgatctcgccatggggcgtggccttcaggctgccggcgaggatctcggcggtgtaggcgctggtgttgatggcgaacgccaggcaggcgcagaaggacgcgttcgacagccagggccacagcgcgctctcgcgcaccgcgtcgaactgcgccaggccgtagtagatcaggaacagctggaccagcatcggcgtgccgcggatcacgtaggtatagagccaggccgggaagttcaccagcggctgcttggagacccgcatcagcgctag

SEQ ID NO: 12663 - DNA, 522 bp, Pseudomonas aeruginosa
attgccaattccttctccttcaatggcttggccgctacgactcgcctcgactgctaccccgtgtcgcaccttggctgtgcgtggcgtttcctctcgccccaattatgcgcaggcgcgcatcaccgaagtgttaccgccgccccattcccggcgcgagcccattcgaaacgccctcctcctcggcccgcgccaaatgaaagaccccgcgcggctcgcaccgcgcggggtcgtttcggatcaggcggaagtcaggcggcctgcatcgagcgatgggtctcgatcaggtgctggaccacgcccgggtcggcaagggtggagatgtcgccgagggtgtcgtactcggccgcggcgatcttgcgcaggatgcgccgcatgatcttgcccgaacgggtcttcggcagtcccggcgcccactggatcacatccggcgtggcgatcggaccgatctcgcggcgaacccattgcttcagctcctggcgcagcgcctcgctcggctcgaccccggagttgagggtgacgtag

SEQ ID NO: 12664 - DNA, 1530 bp, Pseudomonas aeruginosa
cgagcgcacaccccacgaaccatacgaccatggtcttaccactgcgcgacagcgccgatagtagctataagccgcgccgatcgtagccttgcgccagcggcggagcgcgtcccgcgccccgccgccgcgacctcagctcatgcccagcaggcccggcagccacagcgagatcaacggcacgtaggtcaccaggatcaggaacagcagcaggatcatcagccacggcagcgccgcgcggatggtcgccccaagcggcatgccggtgaccgccgaagtgacgaacaggttgaggccgaccggcgggtgtaccaggccgatctccatgttcaccaccatgacgatgcccaggtggatcgggtcgatgcccagcttcatggcgatggggaagaagatcggcgccaggatcagcacgatcgccgagggctccatgaagctgccggcgaccagcagcaccacgttgaccatcagcaggaagccgatcggggtcaggccttcctgcaccacccattcggtgatctgctgggggatctgctcggtggtcaacacgtgggcgaagagcatggcattggcgatgatgaacatcagcatgatgctcagccgccccgactccagcagcaccttgggacagtcgcgcaggcgcatgtccttgtacacgaacagcgcgacgaaggccgaatacaccgccgccaccgccgccgcctcggtgggggtgaacagcccggaatacatgccgccgaggatgatcaccagcaacaacaggccccagcctgcacggcgtgcggcggccagccactcgcggaagctggcgcgcggctgcgccggcagcttcttgacccgcgcgacgatgtagatcaccaccatcaggatcaccccgagcagcagccccggaaccaccccggcgacgaacagcttgcccaccgaggtctcggtggcggcggcgtacaccaccatcacgatcgatggcgggatgaggatgcccagggtcccggcattgcagatgatccccgcgccgaaggcgcgcggatagccggagcggaccatgccggccacagcgatcgagccgaccgccgccactgtcgccggcgacgaaccggacagcgcggcgaacagcatgcaggcaagcaccgcagcgatcgccaggccgccgcggatatgcccgacgcaggcattggcgaagtcgatcaggcgccgcgccacgccaccggtggtcatgaacgcgccggagagcaggaagaacgggatcgccagcagggtgtaggcctcggaggtctcgaacagcttgatcgccagcgagcgcaccgaatccgggctgaacagcaggatcgtcagggcgccggacagccccagggagatggcgatgggcacgccgatgaacatgaacaggaacagcagcaggaacaggatcagcacggtcatggacggttctccccggcctcttcgccggccagtttggaggcctcggcggcctcgtcggcgaggcccagcccgagctggcgaccgcgcaacaggttgacgaggatttccaggtag

SEQ ID NO: 12665 - DNA, 441 bp, Pseudomonas aeruginosa
cgcagccggcgcgttcggagaattcgccattgctcaagcccgcgttcgcgtctgtcgaacgcgttcagccaccctccccggcccgctccagcaggcgtcgcgcgcgccccagcaccggcgcgtcgaccatctcgccgtcgaccacgaagacgccggcaccggaggcgccggcctctgccacccgacgcgcccactccagttccgcgggactcggcatcaatgtctggtggatcggctcgacctggctcggatggatgcacagcaacccgccgaagcccatgtcgcgagcgaagcgcactgcctcgaccagtccggcacggttctggatcgccggatagacgccgtccagcggcggcgccaggcctgccaggcgcgtttgcaggagcagtgcgtaacgggcgtgaccgagaatctgttcggctgcgttgctgccgctgttga

SEQ ID NO: 12666 - DNA, 1707 bp, Pseudomonas aeruginosa
tcagatcagcggcgctacggaaggcgcctggcgcaggccccaggcgcgctggatgaggatttccgcctcggcgtcggtggccgcgccggagaacgccagcaggcggcggaacttatcggccagttcgtcgcggctgagggtattgccgggatcgcccttgggttcgtcgatggcggcggtatggcgccgcccctggcgatcgagcacttcgacccgcccgagccagcgctgcggataggcggcatcgacctccgggtccaggcgcatctcgacccgctcgcggaacgctgcgacccgcgggtcgctcagcgcatgccgatggaactcgccgaggccggccttgccgtacacggcgatcaggcccagcacggtgcccatggagaacttcgcctggtgcacggtctgcggctcgaccacccggccgagcacgtcgatggcgccctggtggacccgcgcggtgaccgcggcgatctgcgagtgatcgagcccttcgcgctgcatcagcgccagcagcgcgtcggccgcgggatgggtatggcggcacgaggcgtggaacttgaacgaggtttccagcaacgcccagcggctgccgaggcgatccaccaggcgctcggggtcggcgtcgctggacatcccggcggccatcccctgctcgccttcgaggatgtgtcgcgcgccgctcaggccgtcggcggtgagataggcggcgagcagcccgtcggcggcggccttggcggtatgcaactgcttggaatcggcggcgtcgcggaggaactcccagagcccggcggcctgggttccggcgctgccgagcaggtcgacgaagcgctcgcggtcgaagtccatcagcttgcccaccgccactgccgcggcgagggtgccgaccgtggcagtggtatggaacacccggtagtgggaacggccgaggaattcgccgatgcggatgccggcctcgtagccggccaccgccgcgaggatcagctcggcgccgctgcggccgaggtcctgggccgcggccagggcagcagggaagaccaccgccgcggggtgcagcaccgagctgttgtgcaggtcgtcctgctccaccacgtgggaagccgcgccgttcaccagggcggcgaaatacggcgagctgcgccgccggctgggcaggatctgcgcgctaccgtcggccgggcccatgcgttcggcgtagcgctcgaacaatgggatcggatgctggcccttgccggccagcgccgagccgagccagtcgaggaacaattcttccatccgcgccaacaccgccggcggcaggtcctggtagcgcaggccggcgagaaagccggcgagttgctgggtgtagtcggtcatgaccaacgctctcttgtagttgtcccgaggcacacggcctacagcgggttgctcagttcgatcaggttcaggtcggggtcgcgcaggtacagcgagaggatcggcccgccggcgccggtgcgctgcaccgggccctcgaggatttccacggcctgctggcgcagttgctcggccaccgcctcgagtggcgtggcgacgatgaaacagaggtcggcggaccctggcgtaggtcgctcggccttgggttcgaattcgcccccggcctggtgcaggttgatcttctgcgcaccgaaggcgagggccttgcgacccgcgccgaaggtaacggcgcgcatgcccagcacgcgggtgtag

SEQ ID NO: 12667 - DNA, 960 bp, Pseudomonas aeruginosa
cgttttgagaatttgcaattacgcaatggcgcgttcggatttgccgaacgccatggagtgcccatgcatttcgatctcgccgacctgcgcctgttcatccatatcgccgagtcgcccagcctgacccagggcgcgcgccgcgccttcctttccccggccgccgccagcgcgcgggtcaaggcgctcgaaggccagcttggcagccgcctgctgtaccgcgacagccgcggcgtcgaactgaccccggcgggccagcgtctgctacagcacgcgcggctgatcatgcgccaggtggaatacctgaagagcgagttcaccgagtacggcagcgacgccgccgggcatatccgcatcttcgccaataccaccgcggtcaccgaattccttccggaaatcctcgccggcttcctcgccgctcgtcccggggtcaccgtcgacctgcaggaacgcctcagccgcgacattgtccgcggcgtgctggacggctccaccgacctcggcatcatcgccgggccggtggcggccaccggcctgcagatcctgcatttcagcaccgaccgcctggtgatggcggtgccccagggccatccgctggccggacaggccagggtacgcctacgcgacaccctgcagttccagcatatcggcctgcccgagggcaccaccctgcacgccttcctgtacgaacgggtggagcagatgggcgagcagctatcgctgcgcatccaggtctccagcttcgaggcgatctgccggatgatcgagggcggcgtcggcatcggcgtgatcccgcagtccgccgcgcgccgccacagccggacgatgaagctggcgaccatcgaactcgacgagccctgggcgatccgcgagcgcagcctgctggtacgcgacctggaagcactgccgagttgcctgcgggcgttgatcgaggagttgcagagggtgggagacagcctgtag

SEQ ID NO: 12668 - DNA, 2229 bp, Pseudomonas aeruginosa
cgacggcgtcgcctgggtcttcgtgttcaaggccctgctcaccgccagcctcgccctgtggctggcctatcgcctggagctgccgcagccgagcacggtgctggtgacggtcttcatcgtcatgcagacgcagagcgggcaggtcctggccaagagcttctaccgcatcgtcggaaccctgatcggcctcagcgtgatggtcactctgatcgccctgttcgcccaggagcgcgtgctgttcctcgcctgcctggcgctctgggtcggcctgtgcaccgccggcgccgcgcgctaccgcgatttccgcggctacgcctgcgtactcgccggctacaccgcgaccatgatcgggattccagccaccgcgcacccggaaggcgctttcatggcggcgctgtggcgggtcctggaaatatccctgggcatcctctgcaccggtaccgtcagcgccatcttcctgccgcagaccagcggcgccgccctgcgcaacacactctacgggcgcttccgcgacttcgccgggttcgccgccgaaggcctgcagggcagcctcgacggcgagcgcttcggcgagctcagcgcgcgcttcgtcgcccagtccgtgggcctggaaaacctgcgcagcgccactactttcgaagatccgcacatgcgcctgcgcagcggccggctgattcgcctgaacaacgaattcatggtcatgaccagtcgcttccacggcctccaccgcctactcgaacgcctgcgcgggcgcggggcgcagaatgtcctggaggtcctggcgccctgcctggcggagcttgccgggctgctcgcgccgattcgcgaacggacgcccaccgacgccgacgccgcgcgcctggccgaacgcatcgaggcctacaagccggaactgatgcagaacatccgccaggcccgccagcgcctggtggagcagcgccccggcgagaacgacctgctggatttcaacaccgccgccgaactggccttccgtttcaccgacgacctgcacaactacgccctgacccacgcttccctggccgaacaccaccatgcccgcgagcaatggaaggaaagcttcgtcgcccgcgccaacccggtcgccgcgctggtcgccggagcgcgcagcgcgctgatgatcggcctgctcggcacgttctggatccagacctcctggccccacggcggcaccttcgccctcaccgcggtactgatctcggcgctctcctcgacctcgccgaatcccggccggttgtcgctgcaactcaccctcgggaccctcgccggggcctgcaccgggctgttcgtgctgctctacctgctaccccacgtggacggtttcccgatgctgctctgctgcctgctgccggtcttcgcggtcggcgccctgctgctctggcggccgcagtggaacggctacggcgtcggcctactggtgtggttctgcttcgcctcgctgccggccaacatggcgcgctacgacgccctggccttcttcaacgaatacctggcactactcttgtcgatggtcctcgccacggtcgccgccatggtgatcctgccgccgaaccggccgtggatgtggaagcgcctggagcacgacctgcgcgagcgggtggtgttcgccatcagcggcaagagcaagggcctggtctccggtttcgaaagcggcacccgcgacctgctgaaccaggcctacaccttctccgccggccgcccggacgtgcaacgccggttgctgggctggatgttcctggtgctggaggtcggccaggcgatcatcgagctgcgcctcgaacagcaacgcctgccccaggagccctgctacgccgaacgcaccgcctggcgccgggcgatccgcctgatgggccgggcgctgatccggctgttcctgcaacccgggccgagcaaccgccagcgcgccctgcacgcggtgaaccaggcgatcatggcggtacgggcggcgccggagccgcgcgcaccgcagttcgatacctcgccgctgcgacgggtgctcagctacctgcacttcattcgcagcgccctgctcgacccgcaatcgcccctgggccaggaaagaaacccgtgagccggtcgcaaagccgcggcgcagaaggccacagggatattgttaccgatccgtacaaggttcttgtcttgactgagtctatatgtcgcagcctatcccaacttacaataaacccaacagccgaagttaactcccgttga

SEQ ID NO: 12669 - DNA, 1941 bp, Pseudomonas aeruginosa
cctacgaagattcgaacggccagaaacataccgtcgaatatcaggtctggggcaacggctgcactggcggctaaactctgctcgacctccgggtcgacctccgaaggatcgcgccacgaggggcagctcgcccatccggcgcgatcattgtgtactcggcggcgacaatcccgcccctcggcgaacatcctggctgtcctccccacgcctcatcgtgctgccgccctttcacaagggccgacgcctccaccgtttctttcccagcctgcaacaaaccggcaagcatgccgctcagccctcgctttgccccacgccatgctggcgcagcttgttcgccgccgtggtatgcgaaacgccgaggcgcttgcccaactggcggctgctcggatgttcgcggaacaggcgctccagcaccgccttctcgaagcgcccgacgatggcgtcgaggtctccttccagggaaaaatcccccagcggctgcggcgcgccgtagtccggcaggcggatgtgctcggccttgaccgttcccccttcgcacagcgaaaccgcctggaacagcacgttttccaattgccgcacgttgcccggccagtggtagcgttcgagacgttccagtgcctgcgcggaaagcttcggcaggccgcagccgatctgccggctggcctggtcgaggaaatgctcggcgagcggcgccaggccatccaggcactcgcgcagcggcgggatgtgcagcgagagcacattgagacggtgatagaggtcctggcggaattcgcccttggcgcagagttcggacaggtctacctgggtggcgcagatcacccgcacgtccaggtacacctcctcgtcgctgccgacccggcggaaacagccgtcctgcaggaagcgcaacagcttggcctgcaggcgcgggctcatctcgccgacgccgtcgaggaacagcgtgccgccggcggtaagctccagcaggccgagcttgccctccgggcgggcgccctcgaaggctcccggaccatagccgaacagctcggtctcggccatggattccggcaggccggcgcagttcaacgccatgaacggcgactgcccgcgcgggctggccaggtggcaggcgcgcgccagcagctccttgccggtgccggtctcgccctcgatcagcagcggcgcgtccagcggcgccatgcgccgcgcctcgcggaccaccgcggccattacccgcgaactctggaagatactgtcgaagccacgcagctcctgcttgcgcacatggtagatgcgctcgccgacgcgatccgcgcgatgcagggtcagcaccgctccagccagcgcctcgctctcgtcgtgctcggattgcagcggcgcgatgtcggcgaggaacacgtcgcccttcaccttcacccgcagcccgttgatccgcgccttgttggcgcgcaccagttcgggcaggtcgaggtcctccacatagcgcgacagcggaatccccggcacctcgtcgacgcgcacgccgagcaactgcgcggcggcacggttggcggcgacgatctgcccgcccatgtccaccgagagcaccgggaagtccagggcggcgagcagcgcgttgagttccaggtgccggcgctcgctgggcatcaggccgacgcgcttgacgccgaagacccccggcaccgcctccagcttgggccgcagcgactgcaactggaggttgatcatgttcggacagagcaggtagatggcgttgccctggtcgccgccgacttcgccgcgattgacgttgatgccgtagtcgaccagcaggttgaggatgtcgcggaggatgcctacacggttctggcagtgcactttgatacgcatggcgtggcccggtgttgtcgttctgatgggctcgcggccggttttttaactcccggccggaaatttccgtcaagaatatgtgacagttag

SEQ ID NO: 12670 - DNA, 1302 bp, Pseudomonas aeruginosa
ggcaacgacaacaacaaagaccccgcggccacaagccgctcatggagtccgtatgaaaacaacgcagtacgtggcccgccagcccgacgacaacggtttcatccactatccggaaaccgagcaccaggtctggaataccctgatcacccggcaactgaaggtgatcgaaggccgcgcctgtcaggaatacctcgacggcatcgaacagctcggcctgccccacgaccggatcccccagctcgacgagatcaacagggttctccaggccaccaccggctggcgcgtggcgcgggttccggcgctgattccgttccagaccttcttcgaactgctggccagccagcaattccccgtcgccaccttcatccgcaccccggaagaactggactacctgcaggagccggacatcttccacgagatcttcggccactgcccactgctgaccaacccctggttcgccgagttcacccatacctacggcaagctcggcctcaaggcgagcaaggaggaacgcgtgttcctcgcccgcctgtactggatgaccatcgagttcggcctggtcgagaccgaccagggcaagcgcatctacggcggcggcatcctctcctcgccgaaggagaccgtctacagcctctccgacgagccgctgcaccaggccttcaatccgctggaggcgatgcgcacgccctaccgcatcgacatcctgcaaccgctctatttcgtcctgcccgacctcaagcgcctgttccaactggcccaggaagacatcatggcgctggtccacgaggccatgcgcctgggcctgcacgcgccgctgttcccgcccaagcaggcggcctgacgagaaacgccgccgccgcggctgaccccgcggcggccttgtactatggtggacgggcacggcccgtgcgccgctcccacatgcgacaaccaaggactcccaccatgaccgcactcacccaagcccattgcgaagcctgccgcgccgacgccccgcacgtcagcgacgaagaactgcccgtgctgctgcggcagatcccggattggaacatcgaagtccgcgacggcatcatgcagctagagaaggtctacctgttcaagaacttcaagcatgccctggccttcaccaatgccgtcggcgagatatccgaggccgaaggccaccatccgggcctgctgaccgagtggggcaaagtcaccgtgacctggtggagccactcgatcaagggcctgcaccgcaacgatttcatcatggcggcgcgcaccgacgaggtagcgaaaaccgccgaggggcgcaaatga

SEQ ID NO: 12671 - DNA, 942 bp, Pseudomonas aeruginosa
gcaacgcacgtgagaaaccgtctcctgtcactggtcaccctgttcctgtccctcagcgttgccaccgcggtatccgcctccccgccgcccaaggccgggctgccgctgcaacaggagctggcgtcgggcagcgcgctggttaccgaccagaacaccggcaaggtactctactcgcgcaaccccgacctggtggtgccgatcgcctcaatcaccaagctgatgaccgccatggtcgtgctcgactcgaaactgccgctggacgaggtactgccgatcgccatcagcgagaccagcgaaatgcgcggggtgttttcccgggtgcgggtcggcagccagatcagccgccgggacatgctcctgctcgccctgatgtcctcggagaaccgcgccgccgccagcctcgcgcagaactatccgggcggcaagaacgccttcgtcaaggcgatgaacgccaaggcccacgccctgggaatgaagaacacccgctacgtcgagccgaccgggctgtcgctgcacaacgtctccaccgctcgcgacctcacccgcctgctggtggccagccggcaatatccgctgctcagtcagtggagcaccactccggagaagaccgtggccttccgcaaccccaactacaccctgggcttccgcaacaccaaccacctgatcaacaacaagacctggaacatccagttgaccaagaccggcttcaccaacgaggcaggccactgcctggtgatgcgcaccacgatcaaccgcagtccggtcaatctggtggtgctggacgccttcggcaaatacacccacttcgccgacgccacgcgcctgcgacgctggctggaaaccggccaggtcactgcgatcccggccgcggccaaggcctatcgcctgcaacgcgaccgcgagcgcggcctcggccagccggtggcccaggccgtacgctga

SEQ ID NO: 12672 - DNA, 927 bp, Pseudomonas aeruginosa
actcgacgaattcgaatccgtcggtaccgatgggattgtgctgttcgatcttggccacggcgttcatccggcctcctcgttgttcttgttgaatggaccgccgccggtccaggcggccggcgacatgggagatgccttcatctcaccccgtggcggcgcggcggacaagccgtcggcaggacccggcgcagggcctggcgcagggtttctggcaactattccttacgcgccggcggcatgcatggcgaacgcccggtcttcgtaaaattatctttacagcgcggtgcgaaaagctgccagcagcgctgtcacggctgcgatgaaagccggcgctgcatgatcggcgtcaagcggttaacctgcgtctttcctccgcgacggcattcccatggcacgacccgccccacccgacctgagcgacagtcgccggcccctgcgcggggtcgcccgcagatatcctgccgggcaccgcgtcgatgcccacgagcacgcctggggccaggtgctttatgcggtgtccgggatgatgtggctggagacgcccgacgaggccctgccggtcccgccgcaacgggcggtctggttgcctccgggcctgcgccatgcggtgcgggtcgcctccgagttgcagatgcgcaacatttacctgagcccggaactctcccgcggcctggaggaccgcaccctggtgctggtggtcggcccgctgctgcgcgagctgatcgtcagcctggtggagcaggaacggcagagcgaccccgactactatcgggcgctggccgatctcgccgtgctcgaactcggccgcgcgcgccgttccagcctccgcgtaccgctgccggacgcctccgacaggcgcctgctcgcgctgtgccaggcggtgatggccaatccctccctggacatcggcctggagcgcctggctga

SEQ ID NO: 12673 - DNA, 243 bp, Pseudomonas aeruginosa
cgattggccgatacatgttttttcggccaactagactggcaccatcgttcaccgtccctgtcagccgccatgaactacctgatctccctcggcatcggcctgctggtcggcgcgctctacgccgtcctcgacttccgctcgccggcgccccccgccatcgccctggtcggcctgcttggcatgcagctcggcgaacagcttttcccccttggccgcgacctgctgcagcagtggctgcactga

SEQ ID NO: 12674 - DNA, 624 bp, Pseudomonas aeruginosa
ccacgcgcagttcctgaccctgccggccgccggcgtcgcgctcaagccggaaagcctgagcttcgcccaggccgccagttgcggggtgccctacagcaccgcctgggacgccctgcaacgcagccaggtcaaggccggcacccggctcctggtaatcggcgccaacggcgcggtcggcaaggccgcgctggcgctggccaaggccctgggggccgaagcgatcggcgcgatgcggcgcgaggagcaacgccaggcgctggaaacgcagggcatcgccgcgctgctgctgggcgagccggccgaactggcggcacaggtggaagggatcttccccggcggggccgaggtgatcttcgatacgaccggtttctggctcgaggcggcggtcccggcgctggccgccttcggtcgcctggcgatcatcgccgcaccggccgacggccatgtgcgcctacccgcattgaacctgtaccgccgcggtggctcggtggtggggatcaactcgctgctctatggcgtggaagcctgcgcaggcttcctcgacgccttcggcaagctgttcgaccagggccgcctgccgctgccggacgggctgcgggaagtcccgctggagcagggcgttga

SEQ ID NO: 12675 - DNA, 1569 bp, Pseudomonas aeruginosa
aagttcggcaagcggctggtagccgttggtgagcaacgccagttggccgttgcgttcggccagcagggtcgggaacccggcgatgccgagatcctggacccaggcgaaatcggcggcggtggcgtcacgcgcctcgccgctgtcgaaggccgcggcgaactcgatgcgcggaagccccaccgcttccgccaggccggcgagcaccgccgcctgggtgacatcgcgaccctcggcgtagaacgcccgctggatcgcccttaccagcggccaggcgctttcctcgtcgaggctgcgcgccgccaccagggcccggcaggccggctcggtgtcatagacgaagccttcgggcaacgcgtcgtcgaagcggaacggctggccggtggtctgctgcacggtctgccagtggccgaggatgtagccgcgggtattcgggtcgagcgccgcgccgtggccggcgcgcaggccaccggctaccaggtggaaagcgacgccgtcggcgaccgcctgccgggacagcgcctcggcgaccggggcgaagccccagcaccaggagcacatggggtccatcacgtacagcaggcgggccttggccaaggttcagttctccagcgtggactggcgcggatcgcgaccgagcgggtgcggctggttgcgctgccgcgccagttcgatctgtttctgccgctcgcgagcgccggcgcgggtcttctcgctcagcgagtcccagcagtgcggacagctgatgccgggcacgtagtgctcggactggcggtcctccagcgaaaccgggttgcggcaggcgtggcactgatcgtactcgccctcgctaagatcgtggcgcacggtcacgcggttgtcgaatacgaagcagtcgccgcgccacaggctctgttcctgcggcacctcttcgaggtacttgaggatgccgcccttgaggtggaagacctcctcgaaaccggcgccgagcatgtagctggaagccttctcgcagcggatgccgccggtgcagaacatcgccaccttcttgtgccgcgccgggtcgtagtgggccttgatgtactcggggaactcgcggaacgacctggtcttcggatcgaccgcgccctcgaaggtgccgatcgccacctcgtagtcgttgcgggtatcgatcagcaggacttccggatcgctgatcagggcattccagtccttcgcctcgacatactggccgacctgcttgttcggatccacgccaggcacgccgagggtgacgatttccttcttcagcttgaccttggtgcggtagaagggctgttcgtcgcagtaggattccttgtgctcgatatcggccagccggggatcgctgcgcagccaggcgaacagcgcatcgatgccttcgcggctaccggagacggtgccgttgatgccttcctcggccagcagcaaggtgcctttcacaccgttgtcgagcagggtttgcagcaggggttcacgcagcgccacgtaatcgtcgagagtcacgaacttgtacagcgccgccacgacgatggatgtcatggggatatagcctccaggtggtcgcccgcgtaa

SEQ ID NO: 12676 - DNA, 690 bp, Pseudomonas aeruginosa
acctggtggtgccgatgggcgaacacaccttccatgcctgcagccgccagctcggcctgccgatcagcggctgcctgcagctcggccgccggcgctacgactgccaggcgggccagagctttgccgcgctggacttcggccgcggcgtctggccgctgcatacctactggacccgcgccgccttcgccgcccccggcggcatcgccggcaacttcggcaccggctggaccgaagccagcgacctgcgcgagaacgccctgtggttcggcggcaagctcagccgcgtgctcgacgacgtgcacatccgcgagcctcgcgacccgctggccgaatggcgcctggacagcgcctgcggtcgcgtcgagctgctcttccgtcccgaacagctgcaccaggcgcggcccagcgtcggcctgttctatgccaatacccgccagtggttcggccgtttcaacggcaccctgcgccacgacgacggcgactgcgtgccggtggacggcgccctcggctggatcggttcgacccgcgcgcgctggtgaggccggcggcgggcaatctatttccgacccgcagcgcggcgaaaaatgcccacgaggaagcgacggcagcggaacccaaggcgggagcgaaggcctaaactgccggatacgcaccctggagaacactcatgagccggaccgaaaccgatag

SEQ ID NO: 12677 - DNA, 1428 bp, Pseudomonas aeruginosa
cctgggcaccatcgaggtgcccgacgacgcctactggggcgcccagacccagcgttcgctggagaacttcgccatcggcggccagcgcatgccgctcgccgtgatccacgccctggcgctgatcaagaaagccgccgcgcgggtcaacgaccacctcggcgaactgccgccggaagtcgcccggctgatcgaacaggccgccgacgaagtcctcgcaggccgccacgacgaacacttcccgctggtggtctggcagaccggcagcggcacccagaccaacatgaacgtcaacgaggtgatcgctggccgcgccaacgaactggccggcaatccgcgtggcggcaagtcgccggtgcatcccaacgaccacgtcaaccgcgcgcagagttccaacgacagcttccccaccgccatgcacatcgccgccgccaaggccgtgcacgaacaattgctgccggccatcgccgagctttccggcggtctcgccgaacagtcggcgcggcacgccagcctggtcaagaccgggcgcacccacctgatggacgccacgccgatcaccttcggccaggaactctcggccttcgtcgcccagctcgactacgccgagcgcgccatccgcgcggcgctgccggcggtctaccagttggcccagggcggcaccgcggtgggcaccgggctcaacgcgccgaagggcttcgccgacgccatcgccgcggaaatcgccgccgaatcgggcctgcccttcgtcgccgcgccgaacaagttcgccgccctggccggccacgagccgctggtcatcctctccggcgccctgaagagcctggcggtggccctgatgaagatcgccaacgacctgcgcctgctcggttccggcccacgcgccggcttcgccgaggtgaagctgccggccaacgagccgggcagctcgatcatgcccggcaaggtcaacccgacccagtgcgaggcgctgtcgatgctggcctgccaggtcatgggcaacgacagcacgatttccttcgccgccagccagggccatctgcaactcaacgtgttcaagccggtgatcgtctacaacctgctggagtccatccgcctgctcgccgacggctgccgcaacttcaacaagcattgcgtcgccggcctggagccggacgcccagcgcatggccgacctgctggagcgcggcctgatgctggtcaccgcactgaacccgcacatcggctacgacaaggccgccgaaatcgccaagaaggcctacgccgaaggcaccaccctgcgcgccgcggcgctgcagctgggctacctggacgaagcgcagttcgacgaatgggtacggccggagcagatgctggaggccggccaccatggttgaaaccgccaagaccggcgccaccccgctggaaggcgacggcaagcgcatcctgctga

SEQ ID NO: 12678 - DNA, 747 bp, Pseudomonas aeruginosa
agctgggcgagctggccttcgacccgatcctccacgaaggctacgaacagagccaggtgctcgaacccgacctgctggaagcgcagcggcagatccactgggccgagcacctggtgttcgtctacccggtctggtggggcggcctgccggcgttgctgcagggcttcttcgaccgcgccctgcagccgggcttcgccttccgctaccgcggcacccaggacaaggactgggagcaactgctgggcgggcgcagcgccgacctgctggtctgccacgaccagccgctgtcgcggctgcgcttcctcaagggcccgccggcgcaccggcagatggtgcgcagcgtgctcggcgcctgtggcatcgccacccgccgcctggaagagttcgcgccgatgcgcagttccagcgaggaacagcgccagggctggctgcgtcgcgccgaacagctcggcagccaggtctagttcccttcccgcccggctgcggccgggcgcggacactgatcgttctgacaggtccgccaccttcccgccggcttcccttccccgcccccatggcggccctttgcctgcctctaccggctcacagtgcgggtgccgaccgctttgcattccgcgacatccatcaggaatgggtagcgaatctgaccggcccgtcacatttggtagggacctcaaaccggcaccgagggctaggatcagcccgcttcgaaatgaatccggttctggaaaaaaggacttgtcatga

SEQ ID NO: 12679 - DNA, 465 bp, Pseudomonas aeruginosa
cgaactctacgtgccgatcggtatgggttcgggcatctgcggcctgatcgccgcgcgcgacgcgctgggcctgaagacccgcatcgtcggcgtggtgtccgcccatgcgccggcctacgccctgtcgttcgaggccggcacggcgatcagccacccggtcgacacccgcctggccgacggcatggcgtgcagtacgccggacccgagcgcgctggaaatgatcctggccggcgccgatcgtctggtgcgggtcagcgacagggagatcggcgcggccatgcgcctgtgcttcaccagcacccacaacgtcgccgagggcgccggggtggcggcgctggccgccgcctggcaggagcgcgagcgcctgaaggggctgaaggtaggcctgatcctcagcggagcgaacgtcgaccgcgaggtattcgccgagcaactggccgccggcgactgagccggcgccgctag

SEQ ID NO: 12680 - DNA, 1413 bp, Pseudomonas aeruginosa
agcgtctggattctaggccggctagagcaattgctctattcgcagtccgccgtccttaagtcgtgttctgccggcacgccgctcggccccgatgtacgccgtcggcggatgcgtaaccggacgacccactgcccgcggccttccgaacggacaaagaaaagccccgccgaagcggggccttccttgcacgcagcactcagggctgtcttctcatcagagcgaatcgagatagcgctccacatccagcgcggccatgcagccggcgccggccgaggtgatcgcctggcggtagacgtggtcggccacgtcgccggcggcgaacacacccggtacgttggtcgcggtggcgttgccttcgcgcccgccgttgaccaccaggtagccgtccttcagggccagttgcccttcgaacagcgaggtattgggagtatggccgatggcgacgaacatgccatccacggcgatctcctcgctgccaccatcgcgggtcttcaggcgcacgccggtgacgcccatcgtgtcgccaagcacctcatcgacctcggcgttgagcttgagcactatcttgccttcggcgacccgcgcctgcagcttgtcctggagaatcttctcggcgcggaaggtttcgcgacgatgcaccagggtcacccggctggcgatgttggccaggtacagggcctcttcgacagcggtattgccgccgccgatcaccgccacttcgcggttgcggtagaagaaaccgtcgcaggtggcgcaggccgacacgcccttgcccatgaacgcctgctccgacggcaaccccaggtagcgcgcgctggcaccggtggcgacgatcagtgcgtcgcaggtgtaggtgccattgtcgccgcgcagggtgaacggcttgccggccaggtccacggcatgaatgtggtcgaagacgatctcggtctcgaagcgctcggcgtgctcctgcatccgctgcatcagtgccgggccggtcaggccgtggggatcgcccggccagttgtcgacctcggtggtggtggtcaactggccgccggcctgcatgccggtgatcagcagcggcttgaggttggcgcgcgcggcgtagacagccgcgctgtaaccggcgggaccggaaccgaggatgatcactcgggcgtggcggagggtatcgggcatctcgtcggactcctgccgacatcagcgtcggcgcgaataaaagcggggccaccaaagcacatggggaaggcttggaaggagcggtcgccccgggaaaaggtcggccgggcaaatttcgcgcccggcatcgggatcacagtgcctcggcgttctcggccaggtacgaggccacgccctcggcgatcgccttcatgcttttctggcccttgcgccagccggccgggcagacctcgccgtgttcctcggtga

SEQ ID NO: 12681 - DNA, 1455 bp, Pseudomonas aeruginosa
aataagcatgcgcccggtgtccgctgtcggcattgtcaggcgggcgtcagcgccctgacagccggcgtcgggcacactacgaatgccctcgggagcgtcggcgcaggccgcagccgagacctgcgccagcccttgcagaccggctcgacgctgccgaaccgactggccgccggtgcctccccacgcaggcggcctttttttacccgcctgccttgccgtccatgcaggatggccggcgctcacccccttcctgtccgctacgcccccctcgactccaccaccctggcactacagtggcaaccaggcgaagcaggctccggcccgctttcgatgaccaccgtccccagcccgcccagcggcggaaaacaagaagagggtcgccatgtcacgttccgcattcaccgcgctcttgctgtcctgcgtcctgctggcgctctccatgcctgccagggccgacgacctgccctaccgcttcggcctgggcaaggcggacatcaccggcgaagccgccgaagtcggcatgatgggttactcctccctcgaacagaagaccgccggcatccacatgcgccagtgggcgcgtgccttcgtgatcgaggaagcggccagcggacgtcgcctggtctacgtcaacaccgacctggggatgatcttccaggccgtgcacctgaaggtcctggcccggctcaaggcgaagtaccccggtgtctacgacgagaacaacgtgatgctcgccgccacccacacccactccggtccgggcggcttctcccactacgcgatgtacaacctgtcggtgctcggcttccaggaaaagaccttcaacgccatcgtcgacggcatcgtccgctccatcgagcgggcccaggccaggttgcagcccggccgcctgttctacggcagcggcgagctgcgcaacgccagccgcaaccgttcgctgctgtcgcacctgaagaatccggacatcgccggctacgaggatggcatcgacccgcagatgagcgtgctcagcttcgtcgacgccaacggcgagctggccggcgcgatcagttggttcccggtgcacagcacctcgatgaccaacgccaatcacctgatctccccggacaacaagggctacgcctcctatcactgggagcacgacgtcagccgcaagagcggtttcgtcgccgccttcgcccagaccaatgccggcaacctgtcgcccaacctgaacctgaagcccggctccggtcccttcgacaacgagttcgacaacacccgcgagatcggtctgcgccaattcgccaaggcctacgagatcgccggccaggcccaggaggaagtgctcggcgaactggattcgcgcttccgtttcgtcgacttcacccgcctgccgatccgcccggagttcaccgacggccagccgcgccagttgtgcaccgcggccatcggcaccagcctggccgccggtag

SEQ ID NO: 12682 - DNA, 546 bp, Pseudomonas aeruginosa
caccgaagacggtccaggcccgctggggctggaggaaggcaacaatccgttcctctcggcccttggcgggttgctcaccggcgtgccgccgcaggaactggtgcaatgccaggcggaaaagaccatcctcgccgacaccggcaacaagaaaccctacccctggacgccgacggtgctgccgatccagatgttccgcatcggccagttggaactgctcggcgcccccgccgagttcaccgtgatggccggggtgcggatccgccgcgcggtgcaggcggccagcgaagcggccggtatccgccatgtggtcttcaatggctacgcgaatgcctatgccagctacgtcaccacccgcgaggaatacgccgcccaggaatacgaaggcggctcgaccctctatggcccctggacccaggccgcctaccagcagttgttcgtcgacatggcggtggcgctgcgcgaacgcctgccggtggaaacctcggcgatagcgccggacctgtcctgctgccagatgaacttccagaccggagtagtggccgatga

SEQ ID NO: 12683 - DNA, 717 bp, Pseudomonas aeruginosa
cgtcatgagcagacctctaagcatcgccctgatcagcgaaacctacccaccggaagtcaacggcgtcgccaataccctgggtcgcctgcatgccggtctccagcagcttggccatcgggtccaggtggtgcgcccgcgccagcccggcgacgacggccggcgcagcgacgccgagctggtgctgacccgcggctggccgttgcccggctaccccggcctgcaatggggcatgtcgagcctgcacaagctgctgcgctgctggaagcgccagcgcccggacgtgctctacatcgccaccgaaggcccgctcggcttctctgccctgcgcgccgcgcggcgcctgggcatcccggcggtcagcggcttccacaccaacttccagcagtacagcgagcactacggcttcggtccgctgacccggctggtcaccggctacctgcgctggttccacaaccgcacgcagatgaccctggtgcccagcggcagccagcgcatggaattggcagcggcgcggtttcgaacgtctcaacctgctctcccgcggggtcgacagccaactcttccatccctcccggcgcgatcccgaactacgccggcgctggggcctgggcgaacaggacatcgccgtgctgcacgtcggccggctggcggcagagaagaacctcggcctgctcggcggcaccttccgcgcgctctgcgccgcccatccgcagctga

SEQ ID NO: 12684 - DNA, 690 bp, Pseudomonas aeruginosa
agctgcgcctggtactggtgggcgacgggccggagcgcaggcacctcgaacgggacctgcccgaagcgctgttctgcggcgtccagcgcggcgaaaccctggccgcccactacgcctcgggcgacctgttcctcttcccaagcctgtcggagaccttcggcaacgtggtcctcgaagcccaggccgccggcctcgcggtggtcgccttcgaccaggccgccgccggccagcacatccgccatgggcacaacggcgtgctcgccgcgccgggcgacaagagcggcttcgtcgaagtcgccagttggctgctggacgaccaggaacgcctgcgccgggtccgtctcaacgcccgccaacacgccagccggcaaggttgggacagtatcgtcgagcacttccagaactacctggaagacgcctgcgccagtccgctggtccagcccgctcggtcgaagcccgagcggccgccggcagaggatggcggggccttgccacgcagccgcgagtagctctcaggcaaaggctttcggcgtggcgatgaagcccaggctcatggccccggcgcccaggttgatgccgccggtagggctgagcatgcccaggtgcaagtggatgtcgcgctcgcggcaggcattctccagcgcggcgaagcccggcaggtcgcgcagcgcggtcggatcgccggcatag

SEQ ID NO: 12685 - DNA, 1305 bp, Pseudomonas aeruginosa
agtcagccggccgcacggcgggttttcggaaaaaatcacggccatgaaaaatcccaccccgaggggtgggatctgcttgccggcgctgcgccgggccggtgcgtcgcggacgcgccttcagaccaggctggccagggcctcgcggctgaacggcttgatgtcgccgatacgcccctcgcggaccttcaccgcccactccggatccaccagcagcgcgcggcccaccgcgaccaggtcgaactcgcccttgtccaggcgctccaccaggccgtcgatgctcgccggctgcgccacctcgtcggttttgccgaagaattgcaggaactcgctgccgtccaggccgacgttacccacggtaatggtcggcttgccggtcagctcgcgggtccagccggccaggttgagttccgagccttcgaactcgggaatccagaagcggcgggtcgagcagtggaagatatcgacgccggcctccaccagcggcgcgaggaactcgcgcaggccctccggggtttccaccaggcgcgcggaatagtcctgctgcttccattgggagaagcggaagatgatcgggaaatccgcgccgaccgccgcgcgcaccgcccgcaccagctcgacggcgaagcgcgagcgattggccaggctgccgccgtactcgtcgtcccgctggttgctgccttcccagaagaactggtcgatcaggtagccgtgggcgccgtggatctccaccccgtccatgccgatcgcctgggcgtcgcgggcggcctgggcgaaggcggcgatgacgtcctggatgtcggccttactcatgccgtggaccagcaccttaccgtccttggccttctccatcgggccgtagccgggcacgctggcgtccggctccacgcccaggcgccgaacgctgccgacgtgccagagctgcggaacgatgcgcccgccctcggcatgcaccgcgtcgaccacctgcttccagccggccagggcgtcctcgccatagaagcgcggcacgttcggatagccgttggcggccttgtggccgaccgttgtgccttcgctgacgatcaggccgacgccggcggcggcgcgccggcggtagtactcgacgaccttggcgttgggtacgccgccgggggaaaagttgcgggtcatcggtgccatcaccacacgggtgggcagttccagggcgccgaggcggaacggttggaacagggcttctacgggggcactcatggacggactcctgagagggaatgggaggttcgggcaggtatcaggcgcggagcagcagctccaggcgcgacatga

SEQ ID NO: 12686 - DNA, 834 bp, Pseudomonas aeruginosa
tcccgaccaacgaagagcggcagatcgccctcgacacgctggccctgctcgactgaactggatcgacgcccccgcccaaccaggcggcgtggccaaacgcacggcttaaggagcccagatgcataccttcttcatcgccccgaccggtttcggcgtcggcctcacctcgatcagcctcggcctgcttcgcgccctggaacgcgccgggctgaaggttggcttcttcaaacccatcgcccaactgcatcccggcgacctcggcccggagcgctccagcgaactggtggcgcgcacccacggcctggatacgccgaagccgctgccgctggcccaggtcgagcgcatgctcggcgacggccaactggacgaactgctcgaagagatcatcagcctctaccagcgcgccgccgccgacaaggacgtggtgatcgtcgaaggcatggtaccgacccgtcacgccagctacgccgcgcgggtcaacttccacctggcaaagagtctcgacgccgaggtgatcctggtctccgcgccggaaaacgagacgctcaccgaactgaccgaccgtatcgagatccaggcccagctgttcggcggcccgcgcgatccgaaggtgctcggggtgatcctcaacaaggtccgcggcgaggccgacgcggccaacgccgaggacggcgtggcggacttcgcccggcgcctcaccgaacactcgccgctgctgcgcgacgacttccgcctgatcggctgcattccctggcaggacgaactcaacgccgcgcgcacccgcgacatcgccgacctgctcagcgctcgggtgatcaacgccggcgactatga

SEQ ID NO: 12687 - DNA, 633 bp, Pseudomonas aeruginosa
gcagcgccgggtgcagaagatcgtgctatgcgcccgcgccgtgcccaacaccgtgcaactgctcaagcccggcgtgctggtggtgacccccggcgaccgcgacgacatcatcctcgccgccagcctggccgcgatgaacggcgtacccttggccggcctgctgctgtgcagcgacttcccgcccgacccgcggatcatggaactctgccgcggcgccctgcagggcggcctgccggtgctgtcggtggccaccggctcctacgacaccgcgaccaacctgaaccggatgaacaaggaaatcccggtggacgaccgcgagcgcgccgagcgggtcaccgagttcgtcgccgggcacatcgatttcgaatggctcaagcagcgctgcggcacgccgcgcgagctgcgcctgtcgccgccggcgttccgctaccaggtggtgcaacgcgcgcagaaggccggcaagcgcatcgtcctgcccgagggcagcgagccgcgcaccgtacaggcggcggcgatctgccaggcgcgcggcatcgcccgctgcgtgctgctggccaagccggaagaggtccaggcggtggcccaggcccagggcatcgtgctaccggaaggcctggagatcatcgaccctga

SEQ ID NO: 12688 - DNA, 969 bp, Pseudomonas aeruginosa
acggcgggaccacgccccgctccacgcgcccggccctggccgggcgcctacgtacaaggactccttgatgctgtcgtttctcccccatttcctgcgcggctccctggccggcctgctgctggtgtccagcaccctgtgctgggcctgcctgctgttcggcatgaccctggtcaagctgctcctgccgttcgccgccgctcagcgcctgtgcagcaagatcatgagcctgatcgccgaaggctggatcgcctgcaacaagggctggatgaacctggtccagcgcacccgctggaacgtccagggcctggagggcctggagtaccaacactcctacctggtcaccagcaaccaccagagctgggtcgacatcctcgtcctgcaataccagttgaaccgacgcatcccgctgctgcgcttcttcctcaagcaggaactgatctgggtcccgatcatcggcctgtgctggtgggccctcgatttccccttcatgaagcgctacagcaaggcctacctggccaggcacccggagaagaaaggccaggacctggcgaccacgcgcaaggcctgcgccaagttcagccgcatcccggtagcggtgttcaacttcctcgaaggcacccgtttcacccgcgccaagcacgacgagcagcagtcgccgttccgccacctgctcaagcccaaggccggcggtatcgccttcgtcctcgacgccatgggcgagcaattgaagaccctggtcaacgtgaccatccactacccggacggcagcccgaccttctggtgcctgctttccggacgcctgaaggacgtcgtggtgcgcttcgaggaactggagattccgcgccagttcgtcggcaagagctacgaccaggacgccggctaccgcgcggaattccagcaatgggtcaaccagctgtgggagcgcaaggaccagttgctcgacagcctgcaccgcgagtttcccggtaa

SEQ ID NO: 12689 - DNA, 813 bp, Pseudomonas aeruginosa
tcgatcccatggtccttcaccatcacagggagccgctatggccagcaccacccccgaaggtctggagatccgcccgcgtcatctggacttcgacctgcccgatccgatgccgcgccattggcacagcggcgacgctttcaagacccacatgttcaacgccatgtcggtgctgttccccgatggcgagcgcttcttcatcgactccgtgcgccactaccgcgaacgggtcgaggacccggcgctgaagcaacagatccgtggcttcatcggccaggaaggccaccacagccgcgagcacctggtctacagcgaccgcctgcgcgccctcggctacgacatcgaccgcctggaaggcggcgccaaacggcgcatccgcttcgcccagcagaaactgcacccgtcgcggcaactggcggccaccgcggccctggagcacctcaccgcgatcatggccgacggcctgctgagcaaccccaggtggctggaaggcgccgacccgaccatggcccgcctgtggcgctggcacgcactggaggaaaccgagcacaaggcggtggcctacgacgtgttcatgctggtcaacggcaaggccaggctgcgccgccgggcgatggtccagggcaccttcttcttcgccctcgacaccaccaagggcctggtccacatgctcaagcgcgacggcctgctgtggaacttcaaggtctggcgcgacggcatcaagtggctgtggggcaaggacggcgtgttccgctcgctggtgggcgtgtacctggacttttacaagaaggacttccacccctggcagcacaataa

SEQ ID NO: 12690 - DNA, 909 bp, Pseudomonas aeruginosa
gccgatccacgcgccccgcaaggaaagtccgtgccgaccctatcacgccgcctgctctggccgctggccatccttttactggttctcggccgcccgctcgcggccgccgacctctactacctcggccagcgcatcccggacatccagaagccctgggacagccacgactaccaggtgctgatcgacgccctgaagaagatcgaggaaacccagaagaacgccctgccgcgacgcagcggcgaattcaccgggccgctctacctgcgcatggtcagcgaggaaaacttccgcccgcagctgaacatctacagccccctggagatccgccagaacgaggcccgcgaagtactgttcaagctcaaggagctgatgcgcctgtacttcgatttccgcgccgccaaacagccctacggcgccgaggcgctgggcctgatgagctactcgctgcgcgagcagtcgatcctgttcaccctcaccgtcgaattctggatgaccctgtcccaggccgagcagcgcaaccccgcgcgcctgcagggcatgcaggaaaccaaggcggccgcggcgatgctcaccggcagcgccctcgactacctcggcctcaccgcccagttcgagcgccaggacttggtgctctactccgccgaactggccaaggaaatgcccgagctgttcatccacctgccctccccggtgcgcgcccagttgctggaacgcatcgccgctttcgccaaggaccacccttaccccgaggtccgcgacaacatgcgcgacctgcaaccggtgttgcaggcgatccaggccgacgtggaaaaacagctggcgcccgggcggaacgccaaggcaccggacaaacccctggacctgagcccgcctccggaggggaaacccagcggcgtcaaaggtttatga

SEQ ID NO: 12691 - DNA, 330 bp, Pseudomonas aeruginosa
cattttttcggtctgaaatcgagccacaggggtctacaaggaatattaaatctgtgtcggcttatacacagagacccacacatgccgacacatgcccctaagaagtacctgatcagccacgcctcgctgcagcattgctttgacaaaagccgctctggcctcgagaagctgcgcgaaagcgaccccagcttccctcgccccatcaagtttggcccgagcaaacaggctggcgtttacttcgtcgttgcagaagtggaagcctggctggaaagcaagatcagcgagcgtgatggaatcactcgggcgctctctgagagagatgagcaataa

SEQ ID NO: 12692 - DNA, 1710 bp, Pseudomonas aeruginosa
gcggccggatatcccgaatcggctgaaccgcgaattcgcgaccgagcatcccaatcaggtgtggtgtggcgacatcacctacgtctgggcgcaaggccgttggcactacctggccgcggtgctggatctgcatactcggcgggtgatcggctgggcgttctcggccaagccggatgccgaactggtgatcaaggccctggacatggcctacgaacagcgcggcaagccacagcaggtgctgttccattcagaccagggcagccagggtggattcaaccggtcgttgcaacacctttgatcgtggaggtgtttatggggcgacctgcagggtggatgcaggagttgacggggcgaggggcaatgcgctcgccaggtgccccgtcacttcgccgagagatcgagcggctattttgggaacagatcgcaaccgggatcacaagcgaaagggcggcagaggctattagcgtatcgtcagcggtaggcacacgctggttccgtcatcgcggcggaatgccattattcatgtcgaaccacatatcaggaaggtacttgtcgttcgctgagcgagaagagatcgggttgctccgggcgcaaagtgttggtgtgcgtgagattgctcgccgtcttggacgaagtccgtcgaccatttcacgggagctgactcgtaacgcagcaactcgtagcggccggctcgagtatcgcgcttcagtcgcgcagtggaaggcggagttggttgccaagagaccgaagccggcgagattggtgaccaacccgcaactgcgccattacgtgcaagagcgcttggaaggcaaggttcataacgctaatggccgtgagattgccggtcctctacaggcaccattcaagggacgaaataaaccacatcgtggtgaccgtaaatgggtcaatggttggtcagccgaacaggttgccaaccggctgcaaatcgactttccggatgacaagtccatgcgtatttctcacgaagccatatatcaggctctctacattcaagggcgaggcgctctcaagcatgaactggtgagttgcctgcgtactgggcgggcgttgcgcgtaccaagagccagggcgcaggccaaagcatgggcacatgtcagtgaggatgtcatgatttccagccgtcctgctgaggtggaggatcgtgccttaccagggcattgggagggtgatctgatcattggcctgaaccgatccgccatcgggacgctggtcgagcgctcaagccgatttaccatgctcgttcatctgcctcgcgaggaaggttacgggctgactccccggacgaagaacggccccgctcttgctggctacggtgctgtcaccatgaccaatgcattgaagagggccgtgactggcttacccgttcagctgtggcgatcattgacttgggatcgtggaaaggagttatcggatcacgtccgctttaccattgagtctggagtaaaagtcttctttgccgaccctcacagtccatggcagcgcggtacgaacgagaatacaaacggtcttctacggcaatatttcccgaaaggcaccgacctgtctcgttggagttaccaagatatccaagcagtagcccatacgctgaacactagacccaggaaaacgctcggctggaaaacacctgccgaggtactgaacgactatctaacatctattcagcaacccagtgttgcgagggccgattga

SEQ ID NO: 12693 - DNA, 438 bp, Pseudomonas aeruginosa
aactacaaatcaaaaatatcctcagactggatgcttgaaaaaacaccgttggcaacgtttcaattcccaccatatcttccgcatggatcagtgggaaaactcatgtcactacagtctgaaatgctcgtggagcagaaagtttccaacgcccagaaatccaccggcaccgcctatcttctgtggttcttcctgggcggtttcggcgcacaccgcttctacctggggaaaaccggcacggcggttacccaactgatcatcacactgatcggttgtttcaccctgttccccctgatcattaccggcatctggtggatcgtcgatgccttcctgattcccggcatcatccagggccatacggaacagactcgccgcgacgcccggctggaagttgcagcgctgcaggtagccggcgcttccgtgtcgcaccctcaagactga

SEQ ID NO: 12694 - DNA, 453 bp, Pseudomonas aeruginosa
cggttttgcccggacaaggtgccgctcgggcaaggtgcgaagcgcttcacaaaatgccaaacagagggcgagcgcatccaatcgccaacacgcaatcgccttgaatggccgcttcgattcctcgtcatgcggggatgccgtgctcggctccagcgcatcgccacccacaccggaaaccctatgccctaccgcgttctcctgctcatcctggccctgacgcccgccctcgcctcctccgccaccctggacgaacgcctgggcgaccttgaacacgccttcaagcccgacctcgacgggacgacaagcgcaaagccggccagcccgccgccggagcggttcaagctggcgccgctgggcagcgtggtgcgcaagaaagagtgcgcgacatcgagcctaccggacgagcagtccagctgcgcggcgctggagttctgcacggactgcgcacagtaa

SEQ ID NO: 12695 - DNA, 3126 bp, Pseudomonas aeruginosa
ggtcgcgcttttccagccatcgacccgcccgagcatcgtggccgggcgggtccgccacgaggacaggaccatgcagacatcccccgctccggccatcgtcgccggcggcgcctaccagccggtggtgctccacgccggcatcgcctacgtcagcggccagttgccgcgccagcacggcgagctgcgctggaccggcaaggtcggcagcgaactcgacctggaacaggcccgccaggccgcccggctctgcgcggcgcgctgcctgcaggcgctggaggaggcgctgggcggcctgcaacgggtcgagcggctgctcaaggtgaccggctacgtcgccagcgcggcgggtttcgtccagcagccggcggtgatcgatgccgccagcgaatatttcgacgaggtgctcggcgcgcgcggcggccacgcccgcgccgccgtcggcgtggccgagctgccgcgcggcgccgcggtggaggtggaactgatcgcggcggtgcggccatgagcgcgctcttccccgccgcccccgacgccttcggtgccgacgaactgctgcgcctgcgccgcgagaccccggcctggggcagctacgcgcacttcgcccatggctccgccagcctgccgccgcaggtgctctacgacgccctcgacagctggctggaagccgagcggcgctggggcgtgcagcgcgccgccgagcatttcgccgagcccttgctggcggtccgcgacagcgtcgcgcgagtgctcggcacccagccacggcacatcgccctgctcgactgcgccagccgcgcatggtcggtggcctttgccgcggccctggccgcccatccacggatacgggcgatcagcagcttcgacgaatacggttccaacagcctgtgcctgctcgccgcgcgccagcagcgcgggctggagctgcgcctgatcgacgcacgcggcgacgccgcacagctgttgcaacggctcgacgagcagttgcacgacctcgcccccggccagacgccgctgctgtcgctcagcgcggtgcccaccgggcatggcgcggctaccgcgctggagggcgtggccgagcgcatccgcgcccatgacgggctgttgttcctcgatgccagccatgcggtcggccagttgccgctggcggtggaggcgaccggctgcgacgtgctggtgttcccgccacgcaagtggctgcgcgggccaaagggactcggcgtgctctatctcggcgaacgtgccctggagcgcctggccctgcccgacgggctggacgtcggcggcgcgcaatggagcgacgccttcgccctgcaggcgcgggatgacgcgcggcgcttccgaatgcccggagttcaacccgggctgccgcctggcgctcaaggccagttgcgactacctgttgcagaccgatgtccggcgcatcgcccgacgcaaccgccagttgcgcgaacgcatcgcccagcagctctaccgccggctcggctggacgccgctggaacaagggccgcacgccagcgcgttgatgacctacgcggcccccgaactgagcggcgagcaatggctgaagcgcctccacgcgcgcggcgtgaacgcctcctacatcggcccgcagtatgcccgctgggcgctgcgcgagcaggcgctgccgggggtactgcgcctgactccgcactacctgaccgacgacggcgagatcgagcgcctcggcgaggccctggaggattgcctgcgacagcgcgccgccagttgagcgaccttgcgcgaatggcaacgttgcgccgccgtgccggcggttggcgcaacgccgggcgatttgcgcaaggtctttgtgccggcggcaacgagcgttgccgaatgcgccgcgcacggccgccgccatgcggtttaaatccctctcgtagaacaacgcataacgatcccgccagcgacatctttcacctgcctgagacaccgacgactttcgacgccctgggcagcctttcggtccgccgcggaccgctccgccctcaatggaatgatgaatggaggaaagacgaccatgaccggatcccggaaaaccctgattctcggatgcgcctccaccggcgccaagttcaccccgcgcaaccacgccgccaccggcgaccgcctgctcgacagcatctgcaccggcgccaccatccgcaccgcccctggcgaactgctggacgaagcgcgccaactctacgagatgggttgccgctactaccactatcacgcgcgcaacccgctgacccaggaacagaccaccgacaacgacatctaccaggcggtcagccgcgccctgcagaaccgcttccccgacctgatgttgagcttcggcgccagccgcaacggcagcgaggtgcaggagaacatccgccgcttcggcgagtgggagcgggtcagccactgcgccatcccgctgcacctgggcggtgcgcacttcgtgacgatccaggcggccatcgaattgcaggtgatctgcgagctggagaagcaaaggcgcaagctcgacctcgactatgcctccagcccggccttcctcgccgacctgcgcgactaccagccgtcgacggcgctggaaaaggccgagttgcagacccactccaccagcaagggcgccgactacggggtgacctcgccgatgacccagttccaggtctaccgcaacgccatccaggcgcgccagaagctcggcctgttccacgaggtggagtgggtgcagcatgtgcgcagctacgccatgacccgtttcgccgtggagcacccgcgcctgcgcctgggcggttccggccagttgaacgtgatcctgctgttcggcttctcgccacgcctgccgttcccggagacctaccagcagttccgcgcggtgatcgagagcgccaagagcctggagtacgacatcggcgaacccggcgtgcgcaagcgcaaggtcagcatcacggtcggcgcggcggtgatgccgcagcatgccgcgcagcacttccggccgctcgacgtcggccctcgcgccggcaccccgctctgcgcggtgcgccggctggccgcctatgccgcgcaggcggacagccaggtcgacgtgctgcgggtcggcatggaggacacgccctacgcggtggacgatga

SEQ ID NO: 12696 - DNA, 1452 bp, Pseudomonas aeruginosa
cggccaggtgacgctcagcgacaactgccagttgctgcgccaggctctcgacgaactgcgcgccaacggcgccgaggccgagctcgacggcgaacggatcttccagcgcatgggcatggaacgcaccctcggcgaatacctgtcgctgcagcgcctgcatccgctcggcgaagccaacttcaccctcgcacgggagttcgtccagtgaccgccgccctcgccgcgaacccaacccagcgctaccgctgggtcatcctgctgatcgccaccttcgcccaggcctgcgcctgcttcttcgtccagggcatcggcgcgatcgccgtgttcatccagaacgacctgcaactctcgtcgctacagatcggcctgctggtgtcggcggcgcagctggtgccgatcgtcggcctgctggtggccggcgagctgctcgaccgctactccgagcggctggtggtcggcctcggcacgctgatcgtcgcgctggccctctgcgcctcgctgtgggccaccgactacctgaccatcctgctgttcctggtggtcgtcggcgccggctacagcacggcgcagccgggcggcagcaagtcggtgtcacgctggttcgccaagacccagctgggcttcgccatgggcatccgccaggccgggctgccgctgggcggcgcgctgtccgccgcgctgctgccgtacctggcggggatctacggctggcgcagcgcattcctcgccggcggcctggtagcgttcctcggcgcgctggccttcatgctcttctaccgcaccccgccggacgcccccgcgcccggcgcgaaccccgccgaacgcgacctgggcgcggtggtgaagtcgcggctggcgatgatcaccgacccggcgatgaaaaacatcgtctgttccggggtggcgctgatctcggtgcagtacggcatcctggtgttcaccgtgctctacctgcacgagaccctggagatcggcatcggcatggccgcgaccctgctgttcgtcgcccagggcagcggcgtcgccgggcgcatcctgctggccgcctggagcgaccgctgccgcgccgggcgctacttcccggtgatggtctgcctcggcgcggtgatcctcggcctgctggcgctggtcctgctgcccctgcaatcaccgttggggatgggcctggtattggcctggctgggcttcttcggcttcggctggtacagtccctgggtggcctatgtggcggataccgcgccggtcggcaaaaccggcttcgccctcggcctggcgatggccatcaaccagttggcgatcgttctcgcgccgccggcgctggggctgctcaaggacttcagccacagcttcgtccccggctggctggcgctctgcctgatggcggcggtagcccttgtggtcaccgcctggagcggccgcggactgcccaccgcgctgccacagaagcactga

SEQ ID NO: 12697 - DNA, 732 bp, Pseudomonas aeruginosa
agcgatgacggccacggccgaggaggcacgatgcgcgcgatcctgttcgatgtgttcgtcaccctggtggactggcgttccagcctgatcgagcagttccaggcgttggagcgcgaactcggcgggaccctgccctgcgtggaactgaccgaccgctggcgccagcaatacaagccggcgatggaccgggtacgcaacggccaggcgccctggcagcaccttgaccagttgcaccggcagagtctcgaggccctggccggagagttcggcctggcgctggacgaggccctgctgcaacgcatcactggcttctggcaccgcctgcggccgtggccggacacgctcgccgggatgcacgcgctgaaggccgactactggctcgccgcgctgagcaacggcaacaccgcgctgatgctcgacgtcgcgcggcacgccgggctgccctgggacatgctgctgtgcgccgacctgttcggccactacaagcccgacccgcaggtctacctcggcgcctgccgcctgctcgacctgccgccgcaggaggtgatgctctgcgcggcgcacaactacgacctcaaggccgcgcgcgccctcggcctgaagaccgcgttcatcgcccggccgctggaatacggccccggccagtcccaggacctcgccgccgagcaggactgggacctgatcgccagcgacctgctggacctgcaccggcaactggcggcctcggcctga

SEQ ID NO: 12698 - DNA, 1425 bp, Pseudomonas aeruginosa
ccgacttcctccttcctgccccctgaaccgctcgcccaacccgcgcgccacggcgcgccgggaaaggcgcgcgcagcgccggcacgcgtccggcaggagcttcgtcatgtccgcgaaggataccccggccccccaggccgccgagcccggtcgcgcccagccggtcgaagtccccggcggcggccactggtggcgccgcctgctggccttcgccggccccggctacctggtcgcggtgggctacatggacccgggcaactgggccaccgacgtcgccggcggcgcgcaactgggctacctgctgctctcggtaatcctgctctccagcctgatggcgatgctgctgcaggcgctgtccgcgcgcctgggcatcgccagcggcctggacctggcccaggcctgccgcgaacgctactcgccggagcacctgccgcctgctgtggctggcctgccaaaacggcgatcatcgcctgcgacctggccgaggtgatcggcaccgccatcgccctgaatctgctgttcggcctgccgctggcctggggcgccttgctctgcgtgggcgacgcgctgctggtgctggtcctgatcggacgtggccagcggccgctggaggccttcgtggtggcgttgctgacactgatcttcgcctgcttcgcggtacagttgctgctctcgcgtcccgaactcggcgaggtgctccaagggttcttgccgagcccgcgggtgctcagcgacccggctgccctgtacctggcgatcggcatcgtcggcgcgaccgtcatgccgcacaacctctacctgcattcctcgctggtgcagagccgcgcctacccgcgcagccttgccggcaagcgccaggcgctgcgctgggcggtggccgacagcagcctggcgctgaccctggcgctgctggtcaacgcggcgatcctgatcgtcgccgccagcgtgttccaccgcaacgggcacaccgaggtggtcgatatcgagcaggcccacgcgctgctctcgccattgctcggcctggaactcgcctcgctgctgttcgccgtggcgctgctcgcgtccggcctcaactcgacggtcaccaccaccctggccgggcagatcgtcatggagggcttcctccgcctgcgcctggcgccctgggcgcggcgcctgctgacccgtggcgtcgcagtgctgccggtgctgctggtgaccctgctctacggcgaggatggcaccgcgcggctgctgatcttcagccaggtgatcctgtcgatgcagttgccgctggcagtgatcccgctgctacagttcgtttccgaccggcgcctgatgggcccgctggcgatcggcgccgggacccggtggctggcctgggcggtagcgctggcgatcgtcggcctgaacctgcaactgctggccgacttcgcgttcggctga

SEQ ID NO: 12699 - DNA, 555 bp, Pseudomonas aeruginosa
cagcacccggcacaaccgaactttaagttggccggacgccgtgcgggcgcaccccagagcctttcgcaccggtcgccgcccgctgcgtccggttgcgcggcgggcagaaacgacgaagcccggcgctggggccgggcttcgagggcgaccacgggaaacgtgatcatgggaaaaaactaccgcgagcgtcccgccgcgtgcaacaccgttcgtccgttggccgctctactttgcacttcttcacaaagttcaccaatagccatacagaccctcgccagagcggctactactctatccacgccaggtccgattgctcctccatctcctggcattcccggccactgtccacccccgcacagtggctttttttcgcctgcgcctagcgtcgtgccagcggcgcctcgtcccgcgccagcatcagcgccaggatgcagccgaggaggaacgcctgcagcgccaggcgagcggccagcagcgtcggcgggaaggatgggaacaggtcggggtgctgccacatgtagaggttggccggggtcacgcagagggtcaggatga

SEQ ID NO: 12700 - DNA, 564 bp, Pseudomonas aeruginosa
gcggcggaaacgcctggtcgagcgcccgcaggtcatcggcgctcagttccaggtcggccgccgctgcattctggcggatgtgagcggacgtcaccgccttcgggatcgcgatcaccccctgctccagtagccaggccagggcgacctgggcgctgctggcgtcgtggcgcgcggcgatctcgccgagcgccgggtgccgtagcagcctgccgccctgccccaccggacagtaggccatcaccggcatgccgcgctcctggcaccagggcagcaggtcgtattcgatgccgcgttcctccaggttgtacatcacctggttggtggcacaggcgctgccgtccagctcgtacatgtcgcccaggtcgaagttggacacgccccagcgcaggatcttgccctggtcgcgcaaccgctcgaaggcttcgatggtttcctccagcggataccggccctgccagtgcagcaggtagaggtcgatggtttcgcaaccgagccggcgcaggctgcgctcgcaggccgccggcagacccttgcggctggcgttgtgcgggtagaccttgctga

SEQ ID NO: 12701 - DNA, 789 bp, Pseudomonas aeruginosa
ccccacgcaatccaggcgatagctttcgcaaacattgtcgacacatcgacccggacagccagtaccatgacccagaacccgccccctctcgagattgcccatgacgacggcgagaccttgtcggaacacgtcttccgcaagatccagagcgccatcgtcagcggcgagatcgcgccgggcagcaagatctccgagccggagctggcgcgcacctacggcatcagccgcggcccgctgcgcgaggcgatccaccgcctggaaggcctgcgcctgctggtgcgggtgccgcatgtcggggcgcgggtggtgtcgctgagccacgccgagctgatcgagctctacgagatccgcgagtccctggaaggcatggcctgccgactggccgccgagcgcatgagccaggccgagatcgacgagttgcgtcgggtgctcgatacccacgagcgcgacgaggcgttccaggccgggcgcggctattaccagcaggaaggcgactacgacttccactaccggatcatccagggcagcggcaacgccaccctcacccgcatgctctgcggcgagctctaccaactggtgcggatgtaccgcatccagtactcgaccacgccgaaccggccgcgccaggccttcgccgaacaccaccgcattctcgacgccatcgccgaccgtgacggcgaactggccgagctgctgatgcgccgccacatcagtgcgtcgcgccgcaatatcgagcgccagctggaaccccagccggcgaagctcgcctccgcttcctccaccgtctaa

SEQ ID NO: 12702 - DNA, 1173 bp, Pseudomonas aeruginosa
aaccgagttgcagcatccagaaaaagttcaagaaaggagagagcaatggctgaagcaaaagtactgagtggcgccggcctgcgtggccaggtggccggtcagacagccctgtccaccgtcggccaggaaggcgccggcctgacctaccgtggctacgacgtccgcgacctggcggcggcggcgatcttcgaggaagtcgcctacctgctgctctacggcgaactgccgaacaagcaacagctcgacgcctacctgaagaagctccagggccagcgcgacctgccgcaggcgctgaaggaagttctcgaacggattcccaaggacgcccacccgatggacgtgatgcgcactggcgcctcggtcctcggcaccctggaaccggagctgagcttcgaccagcagcgcgacgtcgccgaccgcctgctcgccgccttcccggcgatcatgacctactggtaccgcttcacccacgaaggccagcgcatcgactgcaacagcgacgagccgaccatcggcgggcacttcctcgccctgctccacggcaagaagcccagcgagctgcacgtgaaggtgatgaacgtctcgctgatcctctacgccgagcatgagttcaacgcatccaccttcaccgcgcgggtttgcgcctcgaccctgtccgacctctactcctgcgtcaccggcgccatcggctcgctgcgcggcccgctgcacggcggcgccaacgaggcggcgatggaactgatcgaacgcttctcttcgccgcaggaagccaccgccgagttgctgaagatgctcgagcgcaaggacaagatcatgggcttcgggcatgccatctacaaggattccgacccacgcaacgaagtgatcaagggttggtcgaagcagctcgccgacgaggtcggcgacaaggtcctgttcgcggtttccgaggccatcgacaagaccatgtgggagcagaagaagctgttccccaacgccgacttctaccacgcctcggcgtatcacttcatgggcatcccgaccaagctgttcacgccgatcttcgtctgctcgcggaccagcggctggaccgcccacgtcttcgaacagcgcgccaacaaccgcatcatccgcccgagcgccgagtacaccggcgtcgagcagcgcgcgttcgtgccgctggagcaacgctga

SEQ ID NO: 12703 - DNA, 2406 bp, Pseudomonas aeruginosa
catcctcgggcagaccgcgctggtcgacctcgccggcctgcgcgacgccatcgccgacaagggcggcgacccggcccaggtcaacccggtggtgccggtgcaactgatcgtcgaccactcgctggcggtggaatgcggcggctacgaccccgaggccttcgccaagaaccgcgccatcgaggaccgccgcaacgaggaccgcttccacttcatcgactggaccaagcaggccttccgcaacgtcgacgtgatcccgccgggcaacggcatcatgcaccagatcaacctggagaaaatgtcgccggtgatccaggcgcgcgacggcgtggccttccccgatacctgcgtgggcaccgacagccataccccgcacgtcgacgccctaggcgtgatcgccatcggcgtcggcggcctggaagcggaaaacgtgatgctcggccgcgcctcctggatgcgcctgccggacatcgtcggcgtcgagctgagcggccgtcgccagccggacatcaccgccaccgacgtggtgctggccctgaccgagttcctgcgcaagcagaaggtggtcggcgcctacctggagttctacggcgaaggcgcctccagcctgaccctcggcgaccgcgcgaccatctccaacatggctccggaatacggcgccaccgcggcgatgttcgccatcgaccagcagaccatcgactacctgcgcctcaccggccgcgacgacgaacaggtcgccctggtggaggcctatgcgcgcaccgccggactctgggccgacagcctggtcgacgccgagtacgagcgggtactgaagttcgacctgtccagcgtggtgcgcaacatggccggcccgtccaatccgcacgccagggtcgccaccagcgaactggcggcgaaaggcatcgccggcaacctcgagcgggcccgcgccgaggaagccgagggcctgatgccggacggcgcggtgatcatcgccgcgatcaccagttgcaccaacaccagcaacccgcgcaacgtgatcgccgccggcctgctggcgcgcaacgccgaccgcctcggcctggtccgcaagccatgggtgaagacctcgctggcacccggctccaaggtggtcaccgaatacctgcgcgaagccggcctgctgccgcacctggaagccctcggcttcggcgtggtggcctacgcctgtacgtcttgcaacggcatgtccggcgccctcgacccggcgatccagcaggagatcgtcgagcgcgacctgtacgccaccgcggtgctctccggcaaccgcaacttcgacgggcgcatccacccctacgccaagcaggccttcctcgcctcgccgccgctggtggtggcctacgccatcgccgggaccatccgcttcgacatcgagcgcgacgtgctcggcgtggtggacggcaaggagatccgcctgaaggacctctggccgagcgacgaggagatcgacgcggtggtcagggcggcggtgaagcccgagcagttccgccaggtctacatcccgatgttcgacatcacccacggcgagcgcgagagggtcgacccgctctacgcctggcgcccgacgagcacttacatccgccgcccgccgtactgggaaggcgccctcgccggcgaacgcaccctgcgcggcatgcgcccgctggcggtgctgccggacaacatcaccaccgaccacctgtcgccgtccaacgcgatcctcgccgacagcgcggcgggcgagtacctggcgaaaatgggcctgcccgaggaggacttcaactcctacgccacccaccgcggcgaccacctcaccgcacaacgcgcgaccttcgccaacccgaagctgttcaacgagatggtgcgcaacgccgacggcagcgtgaagcagggttcgctggcgcgggtcgagccggaaggcaaggtgatgcgcatgtgggaagccatcgagacctacatggagcgcaagcagccgctgatcatcgtcgccggcgccgactacgggcagggttcttcgcgcgactgggcagccaagggcgtgcgcctggccggggtggaggcgatcgtcgccgagggcttcgagcgcatccaccgcaccaacctgatcggcatgggcgtgctgccgctggagttcaagccgggtaccacccgcctgaccctggggatcgacggcagcgagaccttcgacgtgctcggcgctcgccggccgcgcgccgacctgaccctggtcatccaccggcgcgacggggagcggctcgaagtgccggtgacctgccgcctggacagcgacgaggaagtctccatctacgaagccggcggcgtactgcaacgcttcgcccaggacttcctggaggcggccggcgcctgatggcgccggcgaaacaccctggtaggacggacgacgcgtag

SEQ ID NO: 12704 - DNA, 309 bp, Pseudomonas aeruginosa
tgggggccgaccgcgagcaactgctggccgccctctcccacgccttcgtcgacggccaggccctgcgcacctaccgtcacgcaccgaacgccggctcgcgcaagtcctgggccgctggcgacgcgacgagccgcggcgtgcgcctggcggacatcgccttgcgcggcgagatgggcatccccggcgtgctcagcgcgccgcaatggggtttctacgatgtcctgttcagccacaccagcaaggacctggcgaccaagcccgaggacaagcggcgcttcagcttcccccagggctacggcagctacgtga

SEQ ID NO: 12705 - DNA, 1545 bp, Pseudomonas aeruginosa
cgccaacggcgttattcgccggatgcaccggaccggatatcggcgcaacgaaaaaagggcctcgtccgaggccccttttcttttccggcgctacaccgctcaggacgccgcgcggcttaccgagccggtgccggcaggctccttcggcgccaggttgaaggcgtagtacaggacggtcagcagcaggatgaacggcgggccgatgtagagggcgatgcgggtgtcctcgaagaaggccatcagcaccaccaccatcaccaggaacgccagcgccaggtaggaactgaccgggtacagccacatgcggtattgcagcttgtcgcactcggccgggctgagcgtcttgcggaagcgcaactgggccagcaggatcatcgcccaggtccagatcgcgccgaaggtggcgatggaagtcacccagacgaataccttctccggcaccaggtagttcagcaacacgcccagcagcagcgccaggatcgacaggatcagcgcccggcgcggtacgccgctgcgcgaggccttgccgaagaaggccggggcctggcgatgctgggccaggctgtagagcatgcgcccggtactgaagatgccgccattgcaggacgacagcgcggcggtgatcaccacgaagttgatgatcccggcggcggtcttgatgcccatgcgctcgaaggtcatcacgaaggggctgccctgggtgccgatctcgttccacggatagagcgacatgatcacgaacagcgagccgacatagaacagcaggatgcgccagaacaccgagttgatcgcgctgggaatggtcttggtcgggttacgcgcttcgccggcggtgaggccgatcatttccaccccgaggtaggcgaacatcaccatctgcagcgacatcagcacgccctggatgccattgggcatgaagccgccgtgggcccagaggttggagatgccggtggcgatgccgtcgttgccgaagccgaaggcgatcatgccgatgccgaccaccaccatcgccaggatggtgaagatcttgatcagggcgaaccagaactcgaactcgccgaaggcacgcaccgcgatgaggttgatcgtgcccatgctcgccagggccgccagggcccagatccagcgcggcacgtcggggaaccagatacccatgtagacggcgacggcggtgatttcggcgacacaggtcaccagccagaggaaccagtagttccagccggtgatgaagcccgccagcgggcccaggtagtccttggcgtactggctgaaggaaccggccaccggattgtgtaccgccatctcgccgagggcgcgcatgatcaccaggatcgccaggccgccgaggatgtaggagatcatgatggccgggccggccatctggatggccttcgccgagcccaggaacaggccgacgccgatacaggcgccgagcgccatcaggcggatgtgtcgctcaccgagctcgcgcttcagggagccgtcttgaaccttctgttcgccgacagacgacatgggaacaacctcattttgttattgagatag

SEQ ID NO: 12706 - DNA, 627 bp, Pseudomonas aeruginosa
tgcgctacgccgaacaccggctgttcccgccctacgcggaaaaggcccaggccgggctggacatcgccgattgccgcggcgtgccgatctacgacttccgctatccgcaacggcgctacgcgaacttcgccagcctgccgccgctggtggtgcagagcctgctgttcatcgagaaccgcgacctgctcgatcacgaacgcccctacctcaacccggcggtggactggggtcgcttcacccaggcggcgctgtcgcaggtcggcaagatgctcggcttcagcgcgcactcctccggcggcagcaccctggcgacccagatcgagaaataccgccactctgccgaagggcgcaccggcagcatcggcgacaagctgcggcagatgctctcggccagcgtacgcagctatcgcgaaggcccggccaacttcgccgcgcgccaggacatcgtgctcacctacctcaactcggtgccgctgtcggcggcgccgggctacggcgaggtcaccggcctggccgatggcctgtgggtctggtacggcgccgactaccggcaggtcggcgaggcactcgacggcaaggccggactcgccgcccagggcctggccctgcgccaggtgctggcgctga

SEQ ID NO: 12707 - DNA, 1449 bp, Pseudomonas aeruginosa
accgcaccgccactttcgtcttctacatcggcccgcggcacttcggtaccctcaccgcctacgtcgacggcagcgagtcgagccagttcaagttcacctcggccctgccagtgcaggtactcaagggcatggcaccgctcctcagggactacctcgacccacgcaccgccacccgctgccaggtaccgttgtcgccgcaacagatcggccgcctgtagcggttcagcgcaccggccagtaccaggccggccggtccagctcgcgcagcccctggatgcgggtctcgccgaagtccttctccagccccagcgaatggcattccgggtgctcttcgagcgtcgcgacaagccgcgcggcgtgcgacaccaccagcacctgggagtgctgcgcggcctggccgaccaggcgcccgagggccggcagcaggtcgggatgcaggctggtttccggttcgttgagcaccagcagcgccggcggccgcggcgacaacagggcggcgatccacagcaggtatcgcagggtgccgtccgacagctccgcggtgcgcagcggccgcagcaggccgggctgctcgatcagcacttcgaagcgccctcccgggttgtcaatgtgcaggcggctgccgggaaaggcatcgtccaccgcctcgtccagcgccgccgcatcgccgatctcgcggatggtctgcagggccgcggccaggtcggcgccgtcggcgcccagcaccggtgtatgggtgccgatctgcggacaccgcgccggcgcctcggcgtcgctgcggaaatggtcgtagaagcgccaggagcggatccgctcgcgcaggccgagcagttccggcacctgtcgcgggtccaccgccgcgcccagcatgctgtcgaaggtggcgaggtgctgcgccgccacttcccagcgaccgccgccgccgcgtgcgcgcaacaacggcccgcgacggtcgacgaggacattggccgggcgcaggaacgggccggcccagatgcattcgcgcttgatcaccgggtcgagaccgaacttgctctggcttggctccggcaggccgaggtcgatgcaataaccgaaatcctccccggcgaagcccaggcgcaggttcaccgactgccggcgcacgctgccttcgatcggctgggcgccactgcgcatggcccggctgatgtcctccggtcccgcccacagggtcgatggcaggccgccctcgcgcgccagcgacgggatcacttcgccgcgcgcgctgtccgccagcaggcgcaaggcccggtagacgttggacttgccggcgccgttggcgccggtgatcaggttcaggcgccgcagcggcatcaccaggtcgcgcagggtgcggtagttggacaccgccagggtggtcagcatggctgctctcgaaggaacggaaacgcggccgattgtaggccaaatgccgcatcgcttacttga

SEQ ID NO: 12708 - DNA, 3525 bp, Pseudomonas aeruginosa
ggactcccctattgcttgtttttatccgggcccttgcgtgtgcaagcaacgggtagcgggcccttggttggcagaatggcgcttgtggcgtcactccgtgagcgcttgccggagcaagccggaaacgtgggtggcctcaaacgagtccgaacaggcccacgcctcacgatccctcccctgtcgggcagggaaaatcgtcctttatggtccgttccgggcacgcaccggaacggcggtcatttccctcggcgttcgctgcggcgaaccccggaaaccgacccgggcgccaaggcgcccgggaacggagtatcactcggcgtcggccagcgacagcagcgacgcgttgccgcccaccgcggtggtgttcaccgacgtggtgcgctcgctgacgaaacgcagcaggtagttcggcccgccggccttgggaccggtgccggacaggccgtggccgccgaacggttgcacgcccaccaccgcgccgatctggttgcggttgatgtagaggttgccgacccgcgccagctcttcgatgcgacgggcggtttcctcgttgcggctatggacccccatggtcaggccgaaaccggtggcgttgatcgcctgcacgaccttttccaggtcctgcgcggcataacgcaccacgtgcagcaccgggccgaagttctctttcttcagctcgtcgatgccgctgatctcgaacgcgacgggagcgacgaagtgaccgttcaggttgcccggcaccttggtctcggcgatcagcttgccggcggccttcagcgcggcgatgtgctgctccaggccggccttggcctcggcgtcgatcaccgggccgacgtcgctgacgcgcacgtcggtcgggccgaccttcagctcggccatggcgcccttgagcaactcgatcacccgctcggcgatgtcctgctgcacgtacatcacgcgcagcgcggagcagcgctggccggcgctggtgaacgcggattgtaccgcatccttgatcacctgttccggcaaagcggtggaatcgacgatcatcgcgttctgcccgccggtctcggcgatcagggtggcgatggcgccgggcttctcggccagttggcggttgatgatgcgggcggtgtcggtggagccggtgaaggccaccccggcgacccgcgcgtcacggcagaacacgccgccgagagtggcgccgtcgcccggcagcagggcgataacgtccttcggcaggccggcttcgaacatcagttcgacggtgcgcgcggcgatcaggctggtctgctcggccggcttggccagcacagtgttgccggccaccagcgcggcgctgatctggccgaggaagatcgccagcgggaagttccacgggctgacgcaggcgaagatgccgcggccttcgtagaacagctcgttgcgctcgccggtcgggccacgcagttcctcgcggaccaggcgctggcgggcctgctgggcgtagtagcggcagaagtcgaccgcctcgcggatctcgtcgataccgtcctgcaacgacttgccggcttccagggtgcacagcgccatcagctcgccgcgctgggcttccagcaggtcggcgagacgctcgaggatgccggcacgctcgtccaccggggtggcgctccagcgcggccaggccgcctgcaacacgtcgagggccttgccggcctgctcggcggacgcgtactggacgctgccgaccagcctctccaggtcgtacgggcaacgcacttcgtgggccgggccggagagcttctcgccgttgacgatcggcgcggcttgccactggcgggtcaggtgtggcttgtaggcgagctccagctcgttccactggttctggatgttcatgttgatgccctgggagtttttccgcccggcgccgaagatcgcctggggcagagggatacggtcgttggccagcgtcttgaactggcgcagttgggtaaccgggtgctggatcagcgtctccaccggcacgcgcgggtccaccagcttgtgcacgaaggaagagttggcgccgttctccagcaggcggcggaccaggtacggcagcaggtccttgtgcgcgccgaccggggcgtagatgcgcacgttgcggcggtacttctcgatcaccgtgtcgtacagcgcgtcgcccatgccgtgcaggcgctggaactcgaagtcgcgctcctcgccgccggcggccctggcttcgtcggccagggcgaggatggcggtcacggtgtgggcgttgtggctggcgaactgcgggtagatcaccccgcgggtgtgctcgctgagcaggtagcgggcgcaggccaggtaggaagtgtcggtgccttccttgcgggtgtagacggggtagccatcggcgccctgcacctggcactgcttgatctcgctgtcccagtaggcacccttcaccaggcgcagcgggatgcgtgcgccaagctcgcggccgagcagggtcagccataccagcaccggcaggcagcgcttggagtaggcctggatgaccaggccgaactcgccccagccggcgatggccgggtcgcgcatcagcttctcgtagagttcgagggacagctccaggcgatcggcttcctcggcgtcgatggtgatgccgacgttcagcttgcgcgcgcgcaccgccagttccaggacattggcgaacagctcgctgagcacccgctcgcgttgcgccacttcgtagcgcggatgctccgccgagagcttgatcgagatcgacggccgcggccccggaccgacctgcggctcggcgccgacggtgtcgatggcctggcggtagtcggccaagcatttctcggcgtcggcggcggtcagcgcggcctcgccgagcatgtcgaaggaataggtgtagccctgctcgcggcatggacgaccgttcttcagcgcttcggagatggtccggccaagcacgaactgcttgcccatcagcttcatcgccgggttcatcgcggcgcggatcaccggttcgccagagcgctgcaccagccggctgatgacgctcggggcgcggccgtcggtgcgttcgtcgatgttcaccaccttgccggtcatcaccaggccccaggcggcgaaattgaccagaacgttgtcgctctggccgagatggcgctgccagtcggcggcggacagcttgtcgcggatcagcgcgtcggcggtcgccgcgtcaggcacacgcaacagcgcctcggccagacacatcagcatcaggccttcctgggtgtccaggctgtattggcgcaggagtgcgtcgagggtatcgacggcgttgtcccggctgcgcacggtttcgatcagtgcgcgggcgttgcggcggatagcctcgatgccgtcgggaccggggtcggcgagctgcagcagttcgcccaggtaggcttcctcgtcgaccgcgtagttggcgctgatgacagggaagaattcggctgcggaccgggtctggtcctcgccctgcaagacgtgactggctttgaacatcacgccctcctcttgtggagccattgttattga

SEQ ID NO: 12709 - DNA, 2430 bp, Pseudomonas aeruginosa
  unsure (91): Identity of nucleotide at the above locations are unknown.
actctcatgtttcagtcagtcaggtgcctcatgagcgaccaggacgttaatcccgaacacatcagcgacgcgcagcccgccggcaccggcntggtgctgcccggccagaccctgccgaccaccctctacgtgatcccgatccacaaccgcccgttcttcccggcgcaggtgctgccggtgatcgtcaaccaagaaccctgggcggaaaccctcgaactggtggccaagaccgaccaccattcgctggccctgttcttcatggacaatcctccggaagacccgcgccacttcgacgtcaacagcctgcccgagcacggcacgctggtccgggtgcaccatgcctcgcgcgagggcggcaagctgcagttcgtcgcccagggcctgtcgcgggtgcgtatccggggctggatcaagcgccatcgtccgccgttcatggtggaggtggactatccgaagaccccgatcgatcccagtgacgaagtgaaggcctacggcatggccctgatcaacgcgatcaaggagctgctgccgctcaatccgctgtacagcgaggaactgaagaactacctgaaccgcttcagtcccaacgacccgtcgccactcaccgacttcgccgcggccctgaccaccgcgcccggcggcgaactgcaggaagtgctggacaccgtgccgatcctcaagcggatggagaaggtcttgccgctgctgcgcaaggaagtggaagtcgcgcgcctgcagaaggaactgtccgccgaggtcaaccgcaagatcggcgaacaccagcgcgaattcttcctcaaggaacagttgaagatcatccagcaggagctgggcatcaccaaggacgacaagagcgccgacgccgacgaattccgcgcccgcctggaaggcaaggtgctgcccgagcaggcgcgcaagcgtatcgacgaagagctgaacaagctgtcgatcctcgagagcggctcgcccgagtacgccgtcacccgcaactacctggactgggccacagccctgccctggggcgtgtacggcaaggacaagctcgacctcaagcatgcgcgcaaggtcctcgacaagcatcacgcgggcctcgacgacatcaaggatcgcatcctcgagttcctcgccgtgggtagtttcaagggcgagatcgccggctccatcgtgctcctggtcggcccgccgggagtgggcaagaccagcatcggcaaatccatcgccgagagcctcggccggccgttctaccgtttcagcgtcggcggcatgcgcgacgaggcggagatcaagggccaccgccgcacctacatcggcgccctgcccggcaagctggtgcaggcattgaaggaagtcgaggtgatgaacccggtgatcatgctcgacgagatcgacaagctcggcgccagctaccagggcgacccggcctcggcgctgctggaaaccctcgacccggagcagaacgtcgaattcctcgaccactacctggacctgcgcctggacctgtccaaggtgctgttcgtctgcaccgccaacaccctcgactcgatccccggaccgctcctcgaccggatggaagtgatccgcctgtccggctacatctccgaggaaaaactggccatcgccaagcgccacctgtggcccaagcagttggaaaaggccggcgtacccaagggccgcctgagcatcagcgatgccgcgctgcgcgcggtgatcgagggctatgcgcgggaagccggggtgcgccagttggagaaacagctcggcaagctggtgcgcaagtcggtggtcaaactgctggaggatcccgagtcgaaggtgaagatcggtcccagggacctcgaggactacctcggcatgccggtgttccgcagcgagcaggtgctttccgggatcggcgtgatcaccgggctggcctggaccagcatgggcggcgccaccctgccgatcgaggcgacccgcatccacacgctgaaccgtggcttcaagctcaccggccagctcggcgacgtgatgaaggaatccgccgagatcgcctatagctacatcggctcgcacctgaagaagtatggcggcgacccgaccttcttcgaccaggcgttcgtccacctgcacgtgccggaaggtgccacgcccaaggacggtcccagcgccggcgtcaccatggccagcgccctgctctccctggcgcgcaaccaggtgccgaagaaaggcgtggcgatgaccggcgaactgaccctgaccggccaggtcctgcccatcggcggggtccgcgagaaggtgatcgccgcgcgccggcagaagatcttcgagctgatcctgccggaagccaaccgcggccacttcgaagagttgcccgactatctcagggaagggctgaccgtgcatttcgccaagcgctacggcgacgtggccaaggtgctgttcccggcctga

SEQ ID NO: 12710 - DNA, 744 bp, Pseudomonas aeruginosa
ggactccatgctccgcgcctccttcgtcctgctcgccctgtcctgcgccgctcctctgctctcgctggccgaaccgttgcgcttcgcaggcgacgacggctgcccctacctgtgccctggcacgccgcagcggcccggctacctggtcgaggcgctcagccaggtccttcgggagccaccgcacttcgacagcctgccctggccgcgcgccgtgcagatggtccgcgacggccatcgcgacggcctggtcggcgcctatggactcgacggcctgcgggtcggcagcgagcccatcggctgggtcgggctggccttctatacccgccacgacagcgactggcactactccggcgatgcatccctgctcggccagcgcctgggcctcgcccagggctacgtgaacaatccgcgcttcgaagcctggcgcagccaggccggcgacgacgacctgcacctgcaggtcctcggcggcgagcgcgtgctgccgcgcaacctgcagaaactgctgctcggccgcatcgacgtgctattggaagaccgcgacatcatcgagcactacctggagcatcatccgcagctcgccggacagatccgccgcgccggcgaactacccgggcggcagccgctgcacgtcggcctcagcccgcacctgccggaggtcgacgcgcgtctcgcggaactcgacgaagggctacgccaactgcgtcgcgaaggcaccctgaaggtcctcggcgagcgctatag

SEQ ID NO: 12711 - DNA, 639 bp, Pseudomonas aeruginosa
attccggcaggcctttttggcgtcgtctattactcaatctacgacggcaccgaaaggaggcgcgtcatgggcaccgctcttcgttactcactgctctgggcatccactgtcttcgtttcctcctgcggcagcctgctgcccagcgaacgagcggaagtccaatcccccttcgtcgactacctcgatgccgaactgcgctattcccaggcgcaacccggcagcacgacccgttcgcagctgttcgggctgggtttcgatccattgacccagggcaacggccgcatgctgtcgttcatcgacgtgcggctcatgttcatccagccgaacatccccatcgattacctgccgggcggcctggtgcaatgcctggaagcgaaggaccgttgcatcggctacgccttcgatttcagcaagaccgacacccagcgggtcggcagcttctgggcggacgtgttcaacttccgcaagaaacgggagttgcagggctggtcgttcaaggcggtgttcgtcttcgtcaacgacgtgctggtgcacaaggtcagcaacggcgaaccgaacatccatcgcctggaagacaagaagaacccgctgggtccgctgcagggcgcgggagagtacttctccgacaagctcaggtga

SEQ ID NO: 12712 - DNA, 1839 bp, Pseudomonas aeruginosa
tcgccctgccatgatccagcacctcgccctcgacgccctccagcgacacctcgccggctctccgctgtacggctgggcgaccagcctgcccgcgcagatcgccgcgcgcatcgaggaaggccacggcgacctggcccgttggtggagcgcggtccagcgcctgccccaggtgcccgcaccgaaggtcgaactggcccagcgcttcgccctgcacagcgaccacgatgcggcgctgcaagcgcaggtgaaggaagcgctgcaagggctgattccctggcgcaaggggccgttcgacttcttcggcgtacaggtcgataccgaatggcgttccgactggaaatgggagcgtgtctcgccacatgtcgaactgcgtggcaaacgcgtcctcgacgtcggctgcggcaacggctactaccagtggcgcatgctcggcgccggcgcggaaagcgtggtcggggtcgatccgaactggctgttcctctgccagttcctagccgccaagcgctacctgccggagctgccggcctggcacctgccgctggccctggaagacctgccggagaagctcgaaggcttcgacacggtattctccatgggcgtgctctatcaccgtcgctcgcccatcgaccacctgctggcgctcaaggactgcctgaagcgcggcggcgaactggtcctggagaccctggtggtggaaggcgacgccagcaccgtgctggtgcccgaggaccgctacgcgcagatgcgcaacgtctggttcctgccctcggtggcagccctggagctctggctgcgccgcgccgggttcgccgacgcgcgctgcgtcgacgtcagcctgaccagcgtcgaggaacaacgctccaccgaatggatgcgtttccagtcgctgccggaattcctcgatccgcaggaccgttcgcgaaccgtcgaaggcctgccggcaccgatgcgcgccacgctggtggcgcgcaagccctgacagcgaatagggaaaagcccatcctcggatggtttttttttttgctttcatccgccccgcaggtcgacggcaagcggggcgcgattgcctcagcgcttggtcgccgcggccagcatcagcgctttcatctcggccaccgcctgcctgaagccgacgaagagggcgtgggcgacgatggcgtggccgatgttcagctcgttgatgccgtcgatggccgcgaccggctcgacattgtggtagtgcaggccatgcccggcgttgacgatcaggccgagggaacgcccgagggccacgccctcgcgtacccgctgcagctcacgggcctgctcctcggggtcttcggcgtcggcgtagcgaccggtatgcagttcgatagccggcgcgccgacccgggcggaggcctcgatctgccgcggatcgggatcgatgaacagcgacacttcgctgcccaccgcagccaggcgtcgcaccgcgtcgcggatgcgctgttcctggccggcgacgtcgaggccgccctcggtggtcagttcctcgcggcgctcggggaccaggcagctatgcgccggccggatctcctcggcgaaggcgagcatttcctcggtgacccccatctcgaagttcatccgcgtctgcagcacttccttgagcacccgcacgtcgcgttcctggatatgccggcggtcctcgcgcaggtgcacggtgataccgtcggcgccggcttcctcggcgtccagggcggccttcaccggatccggatagcgggtgccccgggcctggcgcagggtggcgacgtgatcgatgttcacgccgagcagaattcgagtggcttcagtcacggggtgactccttacggttcatga

SEQ ID NO: 12713 - DNA, 1878 bp, Pseudomonas aeruginosa
gtgtcatgggttctagctatccactttgagcacggcgaggaaggcttcctggggaatttccacgctaccgacctgcttcatccttttcttaccagccttctgcttctccagcagcttgcgtttacggctcacgtcgccaccgtaacacttggccagcacgttcttcctgagcgccttgaccgtcgagcgggcgatgatctgcccaccgatggctgcctggatcgccacgtcgaacatctgccgcgggatcagttccttcattttctccaccagctggcggcccttgtagggggcgttgtcgcggtggacgatcagggcgagggcgtcgaccttctcgccattgatcagcacgtcgagacgaaccaggttggacggctcgaaacgatcgaagctgtagtccagggaagcatagccgcggctggtggacttgaggcgatcgaagaagtcgagcaccacctcgttcatcggcaggtcgtagaccacctgcacctggccgctgaggaagtgcatgtcgcgctgcacgccgcgcttctcgatgcacagggtgatcacgttgcccaggtggtccttgggcaccaggatggtggcgcggcagatcggttcgcgcatttcctggatcgacgccaggtccgggagcttggacgggttgtcgacgtagatgatctcgccattcttctgcacgatctcgaagaccaccgtgggcgcggtggtgatcaggtccaggtcgtattcgcgctccaggcgctcctggatgatctccatgtgcagcatgccgaggaagccgcaacggaagccgaagcccagggcttcggagctttccggctcgtattgcagcgacgagtcgttgagggtcagtttctgcagggcgtcgcggaagtcctcgaaatcgtccgagctgaccgggaacaggcccgcgtagacctgcggcttgacccgcttgaagcccggcaggacctcgacgtccggcgtgttgttcagggtcagcgtatcgcccaccggcgcgccgtggatatccttgataccggcgatgatgaagcccacctcgcccgccttcaggtcgacggtctcggtgtgcttcggagtgaataccccgacgctgtccacctggtggaccttgccggtggacttcaccaggatcttgtcgcccttcttcacccggccgttcttcacccgtaccagcgagaccacgccaaggtagttgtcgaaccaggagtcgatgatcagcgcctgcagcggcgcctcgatctcgccttccggggcggggatggcggtcaccaggcgctccagcacctccagcacgcccatcccgctcttggcgctgcaggccacggcgtcggtggcgtcgatgccgatgatgctctcgatttcctctttcacccgctccggctcggcctggggcaggtccatcttgttcagcacgggcatcacttccagcccctgctcgatggcggtgtagcagttggcgacggactgcgcctcgacgccctggccggcgtccactaccagcagcgcgccctcgcaggcggccagcgagcggctgacttcgtaggtgaagtcgacgtggccgggggtatcgatgaagttgagctggtaggtcttaccgtcctgcgccttgtagtgcagggtcacgctgtgggccttgatggtgatcccgcgctcgcgctccaggtccatggagtccaggacctgggcctccatttcgcgatcggagaggccgccgcacatctggatgaagcgatcggccagcgtcgacttgccatggtcgatatgggcaatgatggagaaattgcggatatggctcaggtcgctcacggctcaacacactcgaaaagggcaagggcggcaatccgccgaaaaatagccggggagtttacctga

SEQ ID NO: 12714 - DNA, 879 bp, Pseudomonas aeruginosa
cggattgacgggcatgaaaaagggcggtggaaaccgcccttttttcgccagccggcttattcggccagcttgaaggtaatgaagctggcgcgtccctggcgcagcacccgcatcgaaaccgaacggttcttcggcagggccttggccacgtcggcgaagaccttggtcgaggtcaccgccttgttgtccaggtgggtgatgacatcgcccggacgcaggccgatgaccgcggccggaccgtcctggacttccttgatcaccacgccgccctggatatccaggctcttgcgctgctcggcggtcaggtcggcgacggtcacgcccaggcggttgctgctgcgctcggcgcccggagcgcccatcgaggcgatttcctcgtcgtcgtccggaaggctgcctaccgccatgctcagggacttgcgctggccgttgcgaatcacgtccaggttgatcttgtcgcccggcttcatgttgcccaccaggtgcggcaggtcggcggactcgttgatcgactggccgttcaggctgaggatcacatcgcccacctgcaggccacccttggccgccgggccgtcttccaccagttgcgccaccagcgcgccggacggcttgtcgaggccgaaggactcggcgagatccttgttcacttcctggatcaccacgcccagccagccgcgactgaccttgccggctttcttcaactggtcggcgacgttcagcgcgacatcgatcggaatggcgaaggacaggcccatgaagccgccggaacgggtgaagatctgcgagttgatgccgaccacttcgccctgcaggttcagcagcggaccgccggagttacccgggttgatcgccacgtcggtctggatgaagggtacgtag

SEQ ID NO: 12715 - DNA, 1239 bp, Pseudomonas aeruginosa
tgcactgggtgcgcccgtcgacccggaccacttcctggcgcgcgccgtcgagctggagcaggcgctcgcgaaccgcaccatcgctctccacgcgatgccagatctcatgggtggagaagctgccattgcgctcgtagacgaaggtgccttggaaactgttctggcgatcggcctcggcgagacgattcagccagtcggaagcgtcggcagcctgagtggcgggaaccgccatcaggctgccaagcaaaagcaacagggaggtggtgcgcatgtctctcctcagcggttttccaggctggctgcccgagcgtagggcagcgcgctctctgtaccactgacggcggattgttgcacgtgctgacgcaggtagatcggcagacgctgctcatgccagcgggtatcgctggacgaggagttggtgatcacctgcggcgccccctgctcttcgctgtagccggccagcacggccgggcctttcacctgaggcagggcgatctgcggggtggtcccctgttgcgccatctgcggcagggcgtcgttctggttgtacagacgcacgccggccagcaccgccagggtcaccgaggcagcgaccgccaggcgaccgaccatccgccacggtcccttctccgctttcggcggagcggcctcgtcggccagggcagcagagaccgccgcagcgatatccagcttcggcagggtaggctcacggtgcatgacggaccgcgccagctggtaacgcgaccaggtggaacgcagctcggcatcctcgccgcaagctgcgagcacccgccgcaactcgagttcatccgcttcgttatccatcacagcggacagagtttcgtgcagggcttcacgactcatagcgatacctctcttggcatttgccgctgtgtcaggcttctcgcaacaaaggctgcagagctttgtcgattgcttcacgagcgcggaagatccgcgaccgtaccgtccccaccggacactgcatcacggtggcgatatcttcgtaactcaaaccttcgaactcgcgcagggtcagggccgtgcgcaaatcctcgggcaactgctggatggtctggtgcacggtggcctcgatctcatcccgcaacatcgcccgttccggcgactcgatgtccttcagggcgtggtcgccctcgaagaactccgcatcctctgcggtcacatcgctgtccggtggccgacgcccgcgagcgaccaggtggttcttcgcggtgttga

SEQ ID NO: 12716 - DNA, 1293 bp, Pseudomonas aeruginosa
tcaacctgcaggcggtcggcggggtcagcttcaagaagggctgctataccggccaggaaatcgtcgcccgcatgcagtatctcggccgcctcaagcgccgcctgtatcgcctggcgctggacgcagacgaggtgccggcgcccggcaccgggctgttctcgccagtccattccaccagcgtcggcgaagtggtactggccgcccgtacgccggagaacagcgtggaattgctcgccgtgctgcaggacgacgccgtcgccgacggccggatcagcctcggaagcgccgaaggagcgccgctcgtcctcctcaatctgccttacacgctggacagcgaccgcgaaatccagcgctgaccgtaaactgtgcctcgccgtccgcggacggcccgccagtattcccatggccggtgcacgtagagcgtgctccggccattgcgttttcaaaggaaatgccatgagcaagcttgccgacaaagtccaacaggacctgatccgcgccatcgatcaggatgaactggtgctgccgaccctgcccgaggtggccctgcaggtccgtgaggcggcggaagacccggatgtcagcatccaggccctgagcaaggtgatcggcaacgacgcggcgctgaccgcgcgcatcatccgcgtggtgaacagtccgctgctgcgcagcccgaaggaaatcaccgacctgcagatggcgatcagccggctgggcatcaactacacctgcaacctggccaccggcctggccatggagcagatgttccaggccaccaccgacgtggtcgatcgcaagatgcgcgaagtctggaacaagagcaccgagatcgccggcatctgccacgtgctggcccgtcactacacccgcctggcgccggaccaggcgaccctggccggactggtgcaccagatcggcgtgctgccgatcctcacctacgccgaggatcacaacgagctgctgtcggactccatcagcctgagccatgtgatcgagcgcatccatccgctgatcggcgagcgcattctcaaggcctgggatttccccgcgccgatcgccgaggtcccgcgccagcacctggacttcgcccgcaactcgccgcgcgcggactataccgacctggtccaggtcgccaccctgcagagctaccttggcagcgagcatccctatacccgcctggactggagccagatcccggcgttcgccaagctcggcctcgagccgaccgtcgacatgaaggaagacgaggacctctccagcgccctggaagccgccaccagcatgctgcaatag

SEQ ID NO: 12717 - DNA, 1281 bp, Pseudomonas aeruginosa
cgcggtggtcgcccaacgcccgggcgacgccggcaccatcaccgccttctccagcggctcgctgctgaacctggcccagggcaagttcggccgcttcgacgagaacgcggtgaaatggctggccgccatcggcaccagctacggcgccatcgcggtgcgcaccgactcgccctacaagaacctcgacgacctggtgaaggcgctcaaggccgacccgagcaaggtggtgatcggctccggcggcaccgtcggcagccaggactggatgcagaccgcgctgatcgccaaggccgccgggatcaatccgcgcgacctgcgctacgtggccctggaaggcggcggcgagatcgccaccgcgctgctcggcgggcacatccaggtcggcagcaccgacatttccgactccatgccgcacatcctcagcggcgacatgcgcctgctcgcggtgttctccgaagaacgcctgccagaggcggcgatggccaacatccccaccgccaaggaacagggctacgacatcgtctggccggtggttcgcgggttctacctcgggccgaaggtcagcgacgaagactacgcctggtggaagaacgccttcgaccaactgctggcctccgaggacttcgccaagctgcgcgaccagcgcgagctgttccccttcgccatgaccggcgaggaactcgacggctacgtgaagcagcaggtccagcagtacaagcaactggccaaggacttcggcctgatccagtaagccagcccgcgcgcggccggaccccggccgcgccacgaggatcgtcccatgacccgttccaacctgtaccagcgcctgttcgccgggctctggctgctcgcctgcgtcggcctggcggtcgccggctggcgttaccaggcgccgttttcctacgaaccggtcggcccgcgcgcctacccgctgctctgcctggcgctgatgggcgccggcctggcgtggctgatcgcgcggccgacgccgatccgccacgccgaggacgaacaaccgctgggcggcgccgtgctgctcaaggtgctcgcctgcatcgccctgctgctggtgttcgccggcctgttcgaaacgctcggcttcatcctcagcgccgccctggtcggctcctgcatggccattctctacggcgcccggccaatccctgcggtggtcaccgcgagcctgctcgggatcggcctctactggctgttcgaccgcgccctggacgtcccgctgccgctgggcgttctcgacttcctgccgctgtgaggacttcgtga

SEQ ID NO: 12718 - DNA, 1104 bp, Pseudomonas aeruginosa
tgctgctgttgccgctggtccgcgcctggcgccgccgcgcggcccgtcgcgcgacagggctggccgatgcctgagcgcgtcacctggaggctgtactgggcgacgccgctggtgggcgcccttggcggctggctggcaagcctggtcggctggccgctgccgtggatgatcggctcgctgcttgcggtgatgctggtgcgttgcctggccgacctgccgctggccgaagtgccgggggcacgcaagtgcgggcaatggatcgtcggcatcggcatcggcctgcacttcaccccggcagtgatcgagcaagtgctggcgcatagcgtgatcatcgtcttcggcgccgtggccaccacgctttccagcgtgctggcgatcgccttcatgcgccgcagcggcgaggaccgcgccaccgcgttcttcgccagcatgcccggtggtgccagcgagatggtcaacctcgggcagcgccacggcgcggtgctcagccgcgtcgccgcagcgcagagcctgcgcctgttgctggtagtgctgctggtgccggcggcgttccagtacctgctcggcggcggccagccaggcccgcaccaggccgcgccggtggactggcactggctggccctgctgttcccggccggggcgctggtcgcgctgggctggcagaagttgcgccaacccaatccctggctgctcggcccgctgttgctggcggccggcgtcagcctcggcttcgacctgcatatcggcctgccggccggttccagcggcgtcggccaatggctgatcggcagcgccctgggttgccatttcaaccgcagtttcttccgcagcgctccagccttcgtcagtcgtaccctggtttgcacgctgtggatgatgttcgccgcggcgctcgccgccgagttgctcggctggctgaccaccctcgaccaccagtcgctgatgctcggcatgatgcccggcggcatcgccgagctgagcctgaccgccgaagccttgcagctctcggtgccgctggtcaccgccttgcaggtactgaggctattgctggtgctgttcctcgccgagccgtgcttccgctactggaggaagcgcgccggctga

SEQ ID NO: 12719 - DNA, 375 bp, Pseudomonas aeruginosa
cgccgaagatgggcctgtaccgcgaggaaatcttcggcccggtgctggcctgcctggaggtggaaagcctggaagaggccatcgccctggtcaacgccaacccctatggcaatggaacaagcctcttcacccgctccggcggcgccgctcggcgctaccagcacgcggtgcaggtcggccaggtgggtatcaacgtaccgatcccggtaccgctgccgttcttctccttcaccggctggaagggttccttctacggcgacctgcacgcctacggcaagcaggcggtgcgcttctataccgagaccaagaccgtcaccagccgctggttcgacgatgaaccgacgaccgacgaatcgtcggccggcccgaacatga

SEQ ID NO: 12720 - DNA, 897 bp, Pseudomonas aeruginosa
tccagtgagggacttcatgaacactgccgtcgaaccctacaaggcttcctccttcgacctgacccacaagctcaccgtggaaaagcacgggcacaccgcgctgatcaccatcaaccacccgccggccaacacctgggaccgcgactcgctgatcggcctccgccaactgatcgagcacctcaaccgcgacgacgatatttacgccctggtagtgaccggccaggggccgaagttcttctccgccggcgccgacctgaacatgttcgccgacggcgacaaggcccgcgctcgcgagatggcccgccgcttcggcgaagccttcgaggcgctgcgcgatttccgcggggtgtcgatcgcggcgatcaacggctacgccatgggcggcgggctggagtgcgccctcgcctgcgacatccgcatcgccgagcgccaggcgcagatggccctgccggaggccgcggtgggcctgctgccctgcgccggcgggacccaggcgctgccctggctggtgggcgaaggctgggccaagcggatgatcctctgcaacgagcgggtggatgcggaaaccgccctgcgcatcggcctggtcgaacaggtggtggacagcggcgaggcgcgcggcgccgccctgctgctggcggccaaggtggcacgccagagcccggtggcgatccgcaccatcaagccgctgatccagggtgcccgcgaacgcgcgccgaacacctggctgccggaggagcgcgagcgcttcgtcgatctgttcgacgcccaggacacccgcgaaggggtcaacgccttcctcgagaagcgcgatcccaagtggcgcaactgctgagccttcccatcgaacccggcgggctgcgccacagcccgcccgagccgagagccccgacatga

SEQ ID NO: 12721 - DNA, 885 bp, Pseudomonas aeruginosa
tggacgcctgccgcgagcaacccggcgaggtaccggccctggcgcgacgcttccttcgccgatgaataccgcctcgactaccgcatccatacctacccgaaacccttcatctgctgggcccacggctatgtgatgggtggcggcatggggctgatgcagggtgccgggattcgcatcgtcaccccgtccagccgcctggcgatgccggagatcggcatcggcctgtacccagacgtcggcgccagctggttcctcgcccgcctgcccggcaggctcggcctgttcctcggcctgagcgcggcgcagatgaacgcccgcgacgctctcgacctcgacctggccgaccgcttccttctcgacgaccagcaggacgccctgctcgccggcctggtgcagatgaactggaacgagtcgccccaggtgcaacttcacagcctgcttcgcgccctcgaacacgaggcccgcggcgaactgccggaggcccagttgctcccgcgccggccgcgcctggacgcactgctcgaccagccggacctggcgagcgcctggcaggcgctggtggcgctgcgcgacgacgccgacccgctgcttgcgcgtggcgcgaagaccctggccgagggctgcccgatgaccgcgcatctggtctggcagcagatcgagcgtgcgcgctacctgtcgctggccgaggtgttccgcctggaatacgccatgagcctgaactgcacgcgccatccggacttcgccgagggggtacgcgcaaggctgatcgatcgcgacaacgcaccgaactggcattggccgcaggtggaatcgatcccgcaggcggtgatcgaggcgcacttcgagccgacctgggagggcgagcatccgctggcggggctctga

SEQ ID NO: 12722 - DNA, 465 bp, Pseudomonas aeruginosa
tccgccgcgccgccctctgccgaaggaaggcgcgggcccgccacgtccatagcgtctaagctgtttcacagcatccccaagaggcctcgcggccgccacaggaggagctccatgaaacagatcgccttcatcggcctcggccacatgggcgcgccgatggccaccaacctgctcaaggccggctacctgctgaacgtcttcgacctggtgcagaagcgccgtcgacggcctggtcgccgccggcgccagcgccgcccgcagcgcccgcgacgcggtgcagggcgccgacgtgttcatcagcatgctgccggccagccagcacgtcgaaggcctgtacctcgaggaggatggcctgctcgcgcacatcgcccccggcaccctggtggctggaatgctggaccttcgcccggacctcggcgcgaagggtccaccccgccgcccgcgagcgcggcctggcgatgctag

SEQ ID NO: 12723 - DNA, 786 bp, Pseudomonas aeruginosa
agcagggctatgcggagcgggacttttccgtggtgcagaaattgttcgatccgacacaaggccaatagacaggcaggcgggtccgcgcccaggctggtcgattcgacgatgcgaggagcccgccttgaacgccctgctgctgcgttaccgtttccgcctgctgttcttttccaccgtgctgttcacggcgatcctcggcctgccgtcgagcaccaagccacgggtgctcggcagcctcctgctgctggtgctggccgggatgaacaccttgcgcagacgcagcccgctggtctacctgacggccttcttcggcctgttcagcctggccctgtacaccactgcggacttcagcagtccctactccagcctgccgcccggcctgctgcgcgggctgagcctgatcctgctgtacctgaccctgttcgccgcgctgttccgccgcgtcacccaggagcgcccggtgacccacgagctgctctacggactctgcgcgctctacctgcagatggcgctggccttcgctctcgcctactacatggtcgaacagatgcagcctgccagcttcatcgccagccatggcgcactcggcctggataccttcgtctactacagcctggtgaccctgaccaccgtgggctacggcgacatccaggcgatcaacccgctggcgcgcctgctggccggcagcgaaggagtgatcggggtcctgttcatcgccctcgccgtggcccgcagcctgaccctgatgagcgacagcgaggaggtctgattattaagctgggctaa

SEQ ID NO: 12724 - DNA, 297 bp, Pseudomonas aeruginosa
aacgctccggcgtgccgcgcctgctggttctcggcggcgccgggagcctggagatcgcccccggccagcgcctggtggacagcccggaattccccgagcagtggaagcagggcgccctcggcgccgccgacgccctcgaccaactgcgcggcgagcaacgactggactgggtgttcctcagcccggcgatgctcctcgaacccggccagcgcagcggcaagttccgcctcggcggcgaccaggttctgttcgacgccaagggcgagagccggatttccctggaagacctggcggtag

SEQ ID NO: 12725 - DNA, 1887 bp, Pseudomonas aeruginosa
ccatgctcgacgaggccgagcagccccgtcatcatcgccagcgcttcaccgtggcctactgaaaagaccaggcgcccctctcgggcgccttcgtcgtcagccttcggacttcgccgccggcgtgacgatatcgaaccagaagtcgaagtcgccgagcatgccgaacagttgccccagcaacagcggattgccggaactcttcagcttgccctcgaagaccaggcgtaccgccgatacctctttgagcagcagccggttgagatcggcgcggtcgatgctcacggtctgcccggcgtcctcgctctgcacgccgcgcaggttgttcaggtgcgagttcttcagttccagcaggtagttctcaccgatgtccggcaggcgcaggttgatgctcagcgccttgccctccgcagcgccggcgtccaggcgcacgccgagatagtcgaacagcaggccggtgtccatcgccgccagggcatcggcgctgccggccttcatcgtcggctggtcgcgcggtacgccgtggcgcagttcgtaggcggcgctgaggtagctgttgcgccagccggcgttctccgcctggtagccgagttgctccagggcgtcggcctgcagctcgcgcgcggcccgattatccggctcggcgaagaccagcctgttgaccacctcgaccacccaacggtattcgcccctggcgtacgacgcccgcgcttgctccaacaggcgctcggcgccgcccatgtattccacgtagcggcccgccgagtcctccgggctgagcgggtcgagggtcgccgggttgccgtcgtagtagcccaggtagcggttcagcacggcccgtgcgttatggctgaccgagccgtggtagccgcggtcgtaccattcctggtcgaggctgggcggcaggcgcaggcggttgtgcacctggccgatggtcacgccctggttggccaggtgcagggtctggtcgtgcaggtagccgtacaggtcgcgctgcttctccagcacctcgacgatctccgcgttgccccagcgcggccagttgtgcaccgcgaacatcacctcggcctgcctgccgaaacgatgcagcgcctggttgatgtacttgctccagcccagcgcatcacgtacctcggcgccgcgcagggtgtacaggttgtgcagggtaccgaccacgttctcggccatcagcagggccttctgccgcggcagccagatgttcatctccgccggcgactcggtgcccggcgtgttctggaaggtgaacggcacgccgtccagcaccaggtcctcgccctcgccttcgatcaggcgggtcggcgccagcaggctcagcggtccgcgcgccaatcccttgccgatggccatgtcgacctgcccctgcggccccttgggcagttgcgtgccgtactggtaggtggcgcggcgcatcatggcgttgccggccaggacgttctccttgatcgccgcctccatgaagccggccggagcgatgatctgcaccgcgccgctggcgacctgctgtggctctaccagaccgcgcacgcctccaaagtgatcggcgtgggcgtggctgtagatcaccgtacggatcggcctctcgcccagctcgcggctgaccagttcgtaggccgccctggcggtggccggggtggtcagggtgtcgaccacgatccagccgctgtcgccgcggatgaaggtgatgttggccaggtcgaagccgcgcacctggtagataccctcggcaacctcgaacaagccgtacttgagattgagcagggcctggcgttgcaggctgggattgatgctgtcgcgaggcttgccgtcgaggaggaagtcgtagccaccgagctgccaggcgacgctgccgtcggggttgcggatgagtaa

SEQ ID NO: 12726 - DNA, 1203 bp, Pseudomonas aeruginosa
ccgctccgggcgccggatcaggccgcggtcggcgcgctcgaagtcggcgcggtcggcgaagggcaattccgcttcgacccgccgctgggcctcgacggtgaaggcactgggcggtttgggcgcggtggtttcggcggcgccggcgagcagcggggcgagcgccaggagtgcaagcagacggctcatcggatactccgttttattgttgtgggcttcggctggcactatgccgagcggcacggcaataattccaatgcattccaggtccacattcgatgcagagtccgcatgagcgatctacgccagttccgccacttcgtcgccctcgccgagcacggccactatgcccgcgccgccgaagcggtgaatctcagccagccggcgctgtcacgcagcatccaggcgctggagggacagttgggttgcaccctggtggagcgcggcagccgcggcgtggccctcacggcccacggccggctggtgctggaacacgctcggcgcctgctggccgggcatcgcgcactgcacaacgcggtgagccagttggccaatctcgacagcggcgagctacgcctgggcggcggtcccttccccgccgcacggctgttgcccgaggcactggccggtttctccagcgcccacccacgcgtgcgcgtcgtactgctcatcgaagactggcagaccctacgccagcgcctgctggatgacgccgtcgaactcttcgtcgccgatatccgcgagctgcaaggcgatccgcagttgcgcatccacccgctacgcgagtatcccggcgtactcttctgccgccccggccatccgttgctgcgtctggtgaggccgagcgccgagcaactggccgactacccgctggccggcccgcgcctgcccgaggcagtccgcggcgacctggcgcgcctgctgcaacgcgaagaaccgctcggcatacagtgcgacgacgtgctgatgctcaagggcctggtcggctccagcgagctgatcagcctggcgccctgggacgtggttgccgccgacgtcgaggccggccgcctggcgctgctgccctggcccgccggctccgagcccgcccgcgccaagggctccgcctacggtctggtcagccgcgccggccgcagcctgtcgccggccgcggcagtgttcgtcgagcgggtgctggaacaggaccggcgcttcgccgccacctga

SEQ ID NO: 12727 - DNA, 822 bp, Pseudomonas aeruginosa
ctcatgggaacctcctcgtttcggtatcggcagagtgtgccgagcaaatgcgccaagagggtccgcactttcgactggaaagcacgacggcgcccgcaggcgccgcctttccttgcgcacctcagttgcgccagcgaggtgtcccgccctgctggccctggtgtcccggacgatcctgccgaccgtgttgttgccagcgttgcggagaatgcccgcgccattgcggctggccgccgcgctgccagttgcccggatgccgctcgccacgatgggccgggcgcgattcgtggtagcgctgctggtagcgatattgctcgcgccggtagtcgcggtggccatcgtagcggcgtggcgccgggtagtagcgttggtcgtagtagcgcgtcgagtagtagcgccgttcgctgcgccagccatcgtcatacacgcgatagcgcggcacttcgtaggcgtagccgtagggctggccgcgatagtggcgccaatcgccgtcatcgtagtcgtagtcatacaccgcgcagccacccaggctggcgagaagcagaagaagcgggactctcaggaatgtgcgccacatggcagcctcctgcggccccgctgccgaccggccggacgaccggcgacgccgcgaggcgcgcatacgacgtgaagactcgggaaatggaagtgggctcagcaccagcctttcttggcgtggcccggaggacaatggggcgggccgccgcgatcgtagccgtagtagccatcgtcgaacggatccagttcgacgtaggcgcccggcacccgaacgctgcaaccgctcatcaggaaggccgccagtag

SEQ ID NO: 12728 - DNA, 210 bp, Pseudomonas aeruginosa
cagcccgaacaatcgcatgaccatcagcattctccttcatcgcagaacgcagccgaaccacgcctggacaagatcccgatggagcgggaagccggttgcggcggttgcaacccggctgcaatagagaccgaaggaaaaaacggaaattccctgaatccgaccaacgacacgggcctccagaacgtgaccgcagccggcgtttctcggtag

SEQ ID NO: 12729 - DNA, 1122 bp, Pseudomonas aeruginosa
agtgcgcggaccaaggactgccggccccgccggaaccgctcaaggagcatgcatgcaacccatcgaccgcgcccaggcacagcagcgcgccaacgacatcctggtgttccagcgcgagctgcaacgcctcgaccaggagcaggcgttccgcctcgaaccggcccaggcccggcaactcgccgactatcacctggccctgctggacagctaccgcgaccgtttcgacatcgaccacgacctgcgcagccagcaactttcgctgggcatgcgggtagcctcgttcttcggcgccctggccttcgccgccagcgtgttcctgctgttctatcgcttctggggcctgttccccaccgtcgcccaggtggcgatcctgatcggcagcgccttcgccgcgttcttcgccacgctctgggtccaggccaaggacgcctcgggctacttcagcaagctggcggcgatggtcgcgttcgcctgcttcgtcctcgacctgaccatgctcgggcagatattcaacgtcacccccagcgacctggcgctggtgccctgggcgctctacgccctgctcctggcctacctgtgcaacgcccgcctgctgctggcggcggcgatcctctgcgtgatgggtttcatcgccgcgcgcgtcggtacctggggcggcggctactggctgagcgtaggcgagcgaccggagaacttcttccccgccgccgcgctgatcttcgccgtaccgctgtgcttcgagcagcgcaacttcagcggcttcgccgtgatctaccgggtgttcgccctgctcggcctgttcctgccgatgctggtgctggccaactggggctcaggcagctacctggcgttaccgtcggcgctcatcgaggggctctaccaggtcgccggcttcgtcgccgccgcccttgtgatctggctcggcgcgcgacgcaactgggcggacgtgagcaataccgggatcaccttcttcgtcatcttcctctacaccaagttcttcgactggtggtgggaagcgatgccgaagtacctgttcttcctggtgctcggcctcagcgccctgctgatcctgctggtcctgcgccgcctgcgcacgcccctgggcatcgccgcgaggactga

SEQ ID NO: 12730 - DNA, 819 bp, Pseudomonas aeruginosa
cgcatgaatcgcaaccgtcgcaacgccctgatcgccggcagcctcctgctgctggcggcgaacctggccgccctcggtggcgtcgcctggaaccggtccggcgaggccgaaagcaagctggtgctcagccagcgcgagctccagcgcaactggtcctacggtttctggagcgaagagaacagtggcgtcgaactgcgcctggagcttcgctcgccgagcagcgagccgcccagtgacctcgctcccccgctgccgcccgagcagatgcgcgccctcggtttcagcatcccggacgcgctcgacgaagagagcgtacggcgctaccgccgccaacaggaaaaacaggtgctgctggtcctggagctcgacggcccggcctatcgccgcgaagtacgcctggccgaggagcgcctggccgaggccagcgcccgtagcaaggccctgcccaaggacgaaatgctgtccagccagatggaagccgctcgccaccaactgaagcatgagcagggagaggccagccgactgttcatcgtcgacgccggcctcgacctgaccgccctgcgccagcgctaccccgagcgccagcgctacgccatcgtcaagggccgggtgcgtccctggtccgcggtcgacggaggcaggacgctggtcggcggctacatcagccgtaccgacctcgccgcgatcaacgtgccacgacaatggcacgcggtattcgccaaggtcgacgaacaaaactaccggctagcgccgctggaactgcacctcagcttcggccagcgcctggagccctggatcaccaacgccgttcgccgctga

SEQ ID NO: 12731 - DNA, 453 bp, Pseudomonas aeruginosa
ttataccgagagcttcgccggcatcgagatcccggtgctgttcatgaacggcgagctggacatctacaccacgccccacgaagcccgccagttcggccaactgatccgcggcgcggaattccacaccatccgcaatgccggccacttcatcgacgtcgagcacaaggccgcctggcaacagacccaggacgccctgctggccttcctccgcccgcagcgcacgcagccgctcaacccgatctaccgcccccagcccaacggcgccagcgtccccctcgccgccctcgccagctaaccgccaccgccacggggagccccgctcccctggcggaaaaacccagcgaaatcaacaaaaaccccgccccgggcttcacctgccgccgcgcatctggtaaaaaggcgccctggccgcaaaagccgtccgagcgggcgtcgtataatggcattacctga

SEQ ID NO: 12732 - DNA, 954 bp, Pseudomonas aeruginosa
tcatccgataaccgccacttcgtcatcccgcacgaggtgtcgccggttatctgccttcgccatggctcgcacgcgccttttcgcgcagtgcggccgcgttgtcacaccgatgattacaggttctaccgacatgaacgtttccaagccggaacaacggacgcttcacgccttggcccagggcggccatatcgccttccttcgcgacgcttcgggcaagatcacccgcgtcgagtgctacaaccgcgacggccacctgctgctcgactgcaccctggcggtgttctccaggctgaagaacaagggcctggtccactcccgccagggcaggccctaccggatatccatggccgggctgaaagtcgtgcgcccgcaggcggacaatcgctgacccccttccttttccattgcccccgccgggacaaggcgggggttccgaggagtgcttgcatgaatatttccatccgtgcggaaacgcccggcgacatcgacgccatcgcccgcctgaccgaagccgcgttccgcaacgaaacgcacagcagccataccgagcagtacatcgtcgacgccctgcgccgtgccggcgcgctgacgctttcgctggtggccgaagcgaacggccaggtgatcggccatatcgcggcctcaccagtgaccatcgatggcgaagcgggcgactggtacggcctcgcgccgctatcagtggcgcccgagcggcagcgccagggtctcggttcgcagttggtccggcgcctgctcaccgagttgcgactgctgcccgcgggtggctgcgtggtactgggcgaaccgacctactactcgcgcttcggctttcgggtggaaagcggcctggcgttgcccggcgttcccgccgaatacttccaggcacagtccttcagcgggcgcatggcgcaaggaatagtggccttccacgccgcattcgacgccagcggctga

SEQ ID NO: 12733 - DNA, 834 bp, Pseudomonas aeruginosa
ggaactgcaccaacaagccaacgcactccccttcgccttccgtcacggcaggcactattcggagcctttccaggcctggccgttcagcagtccggcctgctgaacgccgacgcggctgccagccgtcacgccaggctggcccgctatcccgccaggcgctacccttggcagtttcgacggacagggacgacggtcatgggcaactatttcgagagccccttcaggggcaagctgctctcggaacaggtcagcaacccgaacatacgggtggggcgctacagctactactccggctactatcacgggcattccttcgacgactgcgcccgctacctgatgccggaccgcgacgacgtggacaagctggtcatcggcagtttctgctcgatcggcagtggcgccgccttcatcatggccggcaaccagggacaccgcgccgaatgggcgtcgaccttccccttccacttcatgcacgaagagcctgccttcgccggcgccgtgaacggctatcagccagcgggcgacacgctgatcggccatgacgtctggatcggtaccgaggcgatgttcatgcccggcgtacgggtcggccacggagccatcatcggcagccgcgcgctggtgaccggcgatgtcgagccctatgccatcgtcggcggtaacccggcccggaccattcgtaagcgcttttccgatggcgatatccagaacctgctggaaatggcctggtgggactggccactggccgatatcgaggcagccatgccactgctgtgtgccggggatatccccgccttgtaccggcactggaaacagcgccaggccacggcctga

SEQ ID NO: 12734 - DNA, 1395 bp, Pseudomonas aeruginosa
atgaccgcgctgcacgacctcccgggaacccgcctgctggcactgttcgcccgccgggaactctcgcctggcgagtactacgagcatctgctggcccacatccagcgctgggaaccgcatctcaacgcgctgtatcgcttcgacccgcaacgggttcgcgaacaggccgcggcggccaccgagcgctggcgcaagggacagcccaaaggcccgctggacgggctgccggtaaccatcaaggagctgatcgccaccgctggcgaacctatcccattgggcagcgccgccaccgccctgcaacccgcgccctgcgacgcgccgccggccgctcggctgcgcgaagccggcgcgatcgtcctggccaagactacggttccagacttcggcatgctttcatccggcctctccagcttccacggagtcacccgcaatccctggaacctggccaacaataccggcggctccagttcgggcgcggcagcggcggccgccgccggctacggaccgctgcacctgggcaccgacatcggcggctcggtgcgactgccggcgggctggtgcggcctggtgggcttcaagccaagcctcgggcggatccccatcgacccttactacaccggtcgctgcgccggtccgatgacccgctgcatggacgactgcctgctgctgatgcgctacctcgcgcagcccgacgcccgcgacgccaccagcctgccgccggaagcgctggactggagcgccgagccgctgtcggtgcgcggcctgagggtcggcctgcaactcgaccccggctgcggcctgcagcccgacgcggaaatccgcgccgcgatcgaggccgcggcgcggctgttcgaggagcacggcgctcagctcaggatcgtcgaaccgctgatggaccggagcctgctcgacggcctgaacgacttctggcgcgcccgcctgtggagcgaactgctgctcctcgacgagacgcggcgggccagggtgctgccctatgtccacgcctgggccgagggcggcgcacgggtcagcggggtcgatgcggtgcgcggtttcaaccagaccttcgagatgcgccggcgcgccgcccggctgttcggcgagatcgacctgctgctgacgccgaccaaccaggtcgaggccttccccgccgactgggcctcgccgctgaacgatccgcagcggccgttcgagcacatcgtcttcaccgtgccgtggaatatgggcgaacagcccgcgctctcgataaactgcggcttcacggccgccggcatgccgatcggcctgcaactggtcgcgccgcgcttcgccgatacctggctgttgcgcatcggcaagacctacgaaggctggcgcggtccgatccacggctggccccggccgccggctgactga

SEQ ID NO: 12735 - DNA, 1857 bp, Pseudomonas aeruginosa
gtgtttcagtcgtcactccgagagggccttcgccatgcgctcccccacccgtcccccagcggccgccgatccggccagccgccgcagcgtctttgccgtggtcctcggcaacgccgtggaattcttcgacttcggggtctatgccaccttcgcggtgatgatcggacggactttcttcccctccgacagcgccttcgtcagcctgctcctgtcggtcaccgcgttcggcgtcggcttcgtcatccgccccctcggcgcgatccttatcggcgcctacgccgaccgcgccgggcgcaagccggcgatgctccttaccctgttcctgatggcgctgggcaccggcggcatcgcggtgctccccggctacgacagcatcggcccggccgcgccgctgctgctggtgctgacccgcctgctgcaaggcctggcctggggcggcgaggccgggccggcgaccacctacatcctcgaggcggcaccgccgcacaagcgcggcacctacgcctgctggcaggtcgtagcgcaaggcatcgcggcggtcgccgccgggctgatgggctacctgctcaccctctggctcgacgagcgccaactgcaggaatggggctggcggattcccttcgcggccggcctgctggtcctgccgatcggcctgtacatccgcctcaacctggccgagacctttgccggacgcggccgccaggccagcacccggagcctgctcggcgaattgttcggcaatcatcggcgagccctgctgctcggtctgctgatcctctccggaagcaccatcacccagtacttcctcaactacatgaccaccttcgcccttaccgagctacacctgccggcgggcatcgcgatgctctcgacgctggtcgccggcgccgcactggcgctctcggcgttgctcggcggcgtgctctgcgaccgctacgggcgccgcgccgtgctgatcctgccgcgcctggcgctgctcgcggtgctgttcccggcactgcaggcaatgacccgtcaccccgagccggcagtcttcctcgccgtcctcgccctgctctcggccctgcatggcatgagcggcgcggcgctgatcgtgctgctggtagaaagcttcccccgggcgctgcgctccaccggtttttccctggtctatgcgaccggcgtcgccgcgttcggcggcaccgcgcagatcgtggtgacctggctgatcggcgtcaccggcaatccgctgtcgccgctgggctacctgctgctggccaacctggtctgcctgggtggggcctggctggcccgcgagacctggccgggtcgcggggacatgggaggcgcgccgctggtgctgcgcgactgagaacttgcgcggttcgttcaagcgccgccggcctgtcgcgagcgacgctggggacctcattcatccggaggtcccaccatgcagttcttcctgcgctacgcctacgcgcccctcttctggtccggcttcatcggcctggcgacctggcaggtcggctatcgccaagcttcccacgcctggctggtcgccctgttcctcggggcgctcggcctgtcctttctcgccgaacgacgactgccctaccagccacgctggaaccggccgcacgccgaccgcctgcgcgatgtcctgcacgcgtcggtcaacgaaagcctgaacgcacttggcatcctcgccctgccactgctggccggagtcctgggcttctggccggtatggccgcaggcctggccgctgtggctgcaactgctgctggcgatcgtcctggccgatctcggcatcaccctggtgcactacgccagccaccgttcggcgctgctttggcggctgcacgcggtgcaccatag

SEQ ID NO: 12736 - DNA, 696 bp, Pseudomonas aeruginosa
ctatccccgcgactatgccggccagttgctcgcgccattccgcgacctgccacgcagcaggcacgtcccacagccgccggaaggattggggcgttcagccggccaggcgtaggtgcggcagcgacaggccggcgcggataccgagcaggctgcgtacgctgcgcgacaggtgcgcggcgtcggcaaagccggcgtgatgggccgcctcggtcaggctgcgcccctgcaaggccagggcgaaggccaggtacaggcggcgccagagcaccaggcggcgtaccgacaggccgacctggacggcgaacagccgctccagttggctcagcgaaagactggcgctgcgcgccagtctttccgcctcgacccgcgccgcgagttgctcgtcgagcgccgccagggccttttcgacgcggcggtcgagccgtcgacgaggcagccgcgcaagccgccccagcaacgcctcgggctcgccgggagcgtcctcgagaagctgacgcaggtcgtcgctgtcgaacgccagcggctcggcgtacagcgccagcaacggctgcgacgcttcgacgcaatgggcttgcagcgagggcaccagcaagcgccgggcctccagtacctggccagcgacgcgcacccgcagcggcgtctccgccagcagcaactggtgggcatagtgcgcgtgctcgcgggtatcgccgttga

SEQ ID NO: 12737 - DNA, 933 bp, Pseudomonas aeruginosa
gctgccttgaggcgctcgactatctcgtccttcaccgactcatgggcaatcaaccggcgcaaggtggtgcagcgctgcccggcggtgcccaccgcgccgaacaggatgccgcgcaccgccaggtcgaggtcggcgcttggcgccaggatcatcgcgttgttgccgcccagttcgaggatacagcgagcgaaacgcgccgccacccgcggcgccacttcgcgccccatgcgagtgctgccggtggcgctgaccagggcgacgcgacggtcgtccaccagcgcttcgccggcctcgcggtcgccgatcagcaattggctcaggtgcgccggcgcatcgctgccgaaggcccgcgcggcacgctcgaacagtgcctggcaggccagtgcggtgaggggggtcttctccgaaggcttccagaccacggaattaccgcagaccagcgccagcgcggtattccacgaccacaccgcgactgggaagttgaacgcgctgatcacgcctaccacgcccagcgggtgccaggtctcgcgcatgtggtggccgggacgctcggatgcgatggtaagaccgtacaactggcgcgagaggcccaccgcgaagtcgcagatatcgatcatttcctggacttcgccgaggccttcctgggtgatcttgcccgcctcccaggacaccagttcgccgagttcggccttgtgccgacgcaattcctcgccgaacagccgcaccagttcaccacggcgcggcgccggcacctggcgccaggcgcggaacgcctgttcggcgcgctcgaccttggcggcaacggcggcgcgcccctccagtcgcaccgcagccaggcgactgccgtcgatgggggtatgcacggcaagctcgccatcgcgaaaggcattggggtcgaggccgagactgcgcagcaatccgtcgatcatgtga

SEQ ID NO: 12738 - DNA, 432 bp, Pseudomonas aeruginosa
ggcaccggcttctgcgtcggcagcaaggtcaggttgaccccgaacggccgatcggtcagctcgcggcagcgggcaatctccgcagccagtgcctccgggctcggctgggtcaacgccgacagcgtcgccaggccaccggcgttggccaccgccgcagccatctcggcacggccgacccactgcatgccgccctgcatgatcgggtgttcgacgccgaaggtctcggtgaaacgggtcctgaacacgcccatggattgcctcctcggtcagatcgggtcccaggagaacacgtccgggctgcgcgccaggtccatgaagctgccgcgcaacgccggcatgccgtgctcggcgatgctctccggggtccagccgtgctcgctatgcacactgcgcagcggccggctctggctcatcaggaagagttcgtggtga

SEQ ID NO: 12739 - DNA, 1695 bp, Pseudomonas aeruginosa
ttggcctggccgaagttgccgatcagcccggaagtgctggtcatgtgtacgaaggcgccggcctgctgggtacggaagcgttcggcggcggcccggctgacgaagaagctgccgttgagatggacattgatcaccgacagccagtcgtcggcgctcatcttgtggaagatcgcatcgcgcaggatgccagcgttgttcaccacgatatccagacgcccgaaaccgtccatggcgcattcgacgatacgccgcgcgctgtcccagtcggcgacgctgtcggtgttgatcagaccttcgccgcctcgctggcggatcaggccaagggtctcttcggccggcgaggccgacccgccctcgccctgtagcgatacgccgatatcgttgatcaccacccgtgccccggaatcggccagggccagggcgatctcgcggccgatgccgccgcccgcgccggtaacgatcgcgaccttgccttcattgagtctgctgctcatgggtaatcctcttcgtcccgtggatgtcgttcggttgcgctcagcccgacaggccgaggacgctcttggccaggatgttgcgctggatttcgttgctgccgccgtagatggtggtcggccgcgactggatgaagatccccgccggatgcaactcggggtcttcggcgaagggctgcagcagggccgaatcctccccggcgacctccaggcccagctcgctgatgcgctggaacagttcggactggaagatcttcagcatggatacctccgggccgaggctctccccacgccgcaggcgttcggcgaaacgctcgtaaagcgccttgtggctgtccaggtccatgctcagcgcggcgaagcggcgcacgaacagagggtcgtgccacagtcccaggtgccgggccaggcgctccaggcgctggagagcgaaggtggactgcttgggcgaaccgaggaagatccgctcgaaaccgagcagcgccttggccatgctccaaccctggttgattccgccgaccaggctgtcatagggcacccgcacgtcgttgaaaaacacttcgcagaactcgccgtgcagctccaggttgaggatcggccgcacctcgatgcccgggctgtccatcggcaccagcaggaagctgatgccgtgctgcgccttggcgctgcgctcggtgcggaccagcaggaagatccagttggcctccgagcccatggtggtccaggtcttctgtccgttgatcacccactcgccgttttccaggcgcgcctcggtgcgcaggctggccaggtcggagccggcgttgggctcgctgtagccctggcaccagatgtcttcgccgctgagaatgcgcggcaggaagcgcgcccgttgcgcctcgtcgccatagcggatcaacaatgggccgagcatggtcacgccgctgtcgggcaggcgcgcgcagccgtactcctccatttcctccatcatgatcagttgcttgccggcgctcagccccatgccgccgtactccctgggccagccgggacacagccagccctggcgcgacaacagcaggtaccactcgcgggtttcctcgcgccccaggcgacggggcggattgcggatgcgctgcggatagttggcggcgatccactcacggaccatcaggcgaaaggcgttgtcatcgagactgtcgtagtcgctcatctcagtttcctctga

SEQ ID NO: 12740 - DNA, 711 bp, Pseudomonas aeruginosa
gaaacaactggctctgcaactcgccctcccgctccagcaataggtcaaggccctcggcgagcaacgccttggtcatcgccaggggcaacggcgcctgctgctccacccgcccggccagctccagcgccatcgccaaggcgccgccagcggcgcagaggcggtcggccaggccgatgcgcagtgcctcctcggcctgtaccacctggccgaacatcaggatctgccgtgcccgcccccaaccgatgcgcgccggcaaggtatgcaactggccgaggtcggcgagcagcccgaccttgccgaagccggcggcgaagcgggcgccggcgccgcaaacgatgctgtcgcaggccagcgccacggacagcccggcccccaccgcccagccctcgaccgcggcgatcagcggcttgcccatgcgcaccatctgccgcaccagccgcgcgttgtcctgcattcgcgccctgccggcggccaactcggtcacccgcatgtcgcccaggtcgccgccggcgcagaacacctcttcgccaccggtcagcagcacgctgcggatcgatgggtcgcattcggccgcctccagggcccgcagcaattccatgcgcagcgccggcgacagtgcgttgcgccgggccgggttgtcgaagcgcagcaggcgcaccgtgccgcgcgtttcctgcaacaaaccgctcatcaggccacctcccgctgtag

SEQ ID NO: 12741 - DNA, 1719 bp, Pseudomonas aeruginosa
cagcgcggcgtagcgcgccttgtggaacgccagcgagccgtgggcattgagcagtaccatggcgcggcgcaggaacaggccgatgtccgcctcgtcggtgtagccgatgccgccgtgcaactggatggcctggcgggtcaccagcagagccgcttccgaggcccgtacccgtgcgctggaaacctgccgctggcgctcgctttccgacgccccggcatcgatcgcggcggcggcctgctcgaccatggcgcgcgacagttcgatctggatcctcaggtcgaccatgcggtgctgcagcgcctggaaactaccgatctcgcggccgaactggcgacgtaccttgaggtactccagggttcgctcgaaggcgccatccatcagtccaaccagataggccgcgcaggccagcgctgcctcgtccagaacctgttccgttacctcgccggacaaccaccgtgccggcgcatcgcggaaacgcaggcgcgccaggtgagcgccatcctgggtcgcctcgcagagcagttccacgccatcggcatcgcgctcgaccagcgccaggccctgctcgcaggccaccagccaggcatcggcggcaccagccagatgtacgtgagcgacttcgccgtgcaaccgcccttgctgcatacgagggcgtcgccgcccatcgcggtaggcgatgcccgccggcaggaccagccgctcagcggccagcaacgcaacgcgctcgtcttccggcagcagcggcgccaccagcccggcctcgatcagcggctcgggcagcaggccgcgccccagcgcctccagcaacgccgcgtattcgctcatgcccaggccgctgccgcccaacgcttcatccaggcgcagcgccggccagcccatggcgcagacctcgcgccaggcctggcggtccaccccgctaccggtgaaacgaccgcggcgcacgcgggtcaggtcgccgtcgcgtggcaccagcgaagccgcgctgtcgcggatcatccgcagacgctgctcgcgctcgccggcccactcgtcttgctcactcatctgttcgccctcctgtcgatacgccgtccgcccgtccgtcatctgcacgggaggcgccggcttgtccgcgcggagcgaccgcgcaggccgtggtccggacgcgcgacggatggctcccgctgccgcgccgccggaaatccgttacggcttagccgcgcggtacctgaagctgcccgaggccatggcgatgacctcgccgtcctcgttgcagatttccgccgtgcagaagcagatcgtgcgggtccgtcgcaccaccctgccaaccgcacgaagctcgccgcgggcgctacccatgaagtgggtagccatgtcgatggtcaccatcgagcagtccggcaggcaggcacggatcgcctgggccatggcggcgtccagcaccgacatcaacaccccgccgtggaactgttgcaggtagttcatcagttccgggcgatgccccaggcgcacccgcgccaccccgtcggcatcggtccagcgctcgaggccgatgaactcctggaagctggcgggccgctgctccgccgctggctgtcgtggaaaagaactcatggatgtgcactccttccgcaggatcaggccttggccgcgcgccgctcggcggtatccacggcactgcccggcgcttgccgtcgggaagcgctctcggcatcgcgggactcgcggttcgggtcgtag

SEQ ID NO: 12742 - DNA, 825 bp, Pseudomonas aeruginosa
cccgccggcaggccggcgcaggcgcaacggccgggcgaaggcttcgccgagccgccccatggcctggatcgccactaccgcccgggtggggtcttcgaacagtgcgaagccggcctcctcgtagggtgccagctcctccccctcgcccatcaccgagaccacgaacagacgctcgggatgagcctccttgatccgccggaactgctcggccagacgcgcgccgatggaggcggcggtgccggcctgggtgaagaaggcgagcagcgaacggtagccaccgtcgaccaccatcgactcggtaaagtcgcgcaccagcgtcaggtcgttcagggcctgcgcggtgcagtccaccgggttgatcggcgaagcgaaggacagccgtgccttcagccgctcctgggccatgtccggcatcggcggcatcggcaggccgacttcctcggcgacatcgctgacgatgatcccggcgccgccgctgacggtgatcatgcggaggctgtcgcccaccggatagatacgcccgggtggcgaggtaggcgatgtccatcagttcctcggtggtcctggcgcggatcaccgcatagtcgcccagcacggcgtccagcacctagtcgtcgccggccagcgaagcggtgtgggacagcgccgcgcggctacccagggcgctgcgcccgaccttgtgcaggatcaccggcttgccggcgcgatgcgcggcctccagggcggcgaggaagctgtcgacgttgcggatggattcggcgtaggccatcaccacgtcgatctccggcgactccaccagccagccgatgctgtcgcccagggtga

SEQ ID NO: 12743 - DNA, 588 bp, Pseudomonas aeruginosa
ccgcctcggcggccgcacactgctcaccggcggttcgctcacgtaccaggcgctgggcttcggcatactgctccgcggcctgctgccgtccccgatccacagcctgcgcggcatcccgggcccgctgttcgccggccacgcgcagcgcggcaacctgccggacctgctctgccactgcggactccaactctccccgggaggcacggcaggcagccagatccgcgctcgcggcatccaactgcggccggtagtgtcgcgcgccgagccagacaccgccggcggtgccgaggccgaccagcaccaggcaggccagcgcgaccgataaagcgcgggcggagatcacgacagcaccctcttcgcccgctcccacagcgccaggcgctccgcctggccgttgagcccgccgttgatgcgccgagtgatggcggcgaactcgccgcggtcggccaggtcgttcaagccgtgactggcccaccaccaggccgccgagatcgccgcccactccggctgctcgagcagttcgggttcctgctccagcggctggcccagccccggtgccggcggcgcggtagttcgaccggccggtga

SEQ ID NO: 12744 - DNA, 1701 bp, Pseudomonas aeruginosa
acaacctcacttcaggtagaattctgccgccttgtaactatggatgaatgcaagccaatgaaacgctccgcctcgttaattgcttttctgctcctatcagcctccctgcacgccgctgaacaccctcaaaagtctcttgccgcgagatcagcggtagagctagcgccattccagtggtcttggatggatcctgtctcatacgatgaagcaggtcttcaaaaaacggcggccaaaaaagatccgcttcgaccattcttcttagcgttcagacttcttgtggagcacgaaaaaaccggggaagaaaaaagtctgaccagtgcaaagagagtactggacttcatgcttgatgaatatcagccagcaactagagaggcagatgggactcgatggttctatggctttgactatgaccgaggcatcaaggcgccttggtggtcaggaatggatggcttcttcggaccaatgacactgtttgcagggtggcaagccactggtgaagagcgctatcgagaagccgcattgaaaagcgcgaaactcatgattcgacagccaaccgaaggcggatctctttggagagatggtgactcctgctggatttcagaatactcctggaatgggataactagggataaagagtaccatgtgctaaatggccacctttgggggcttcaggcgctctatatgctagcagaagcatctggtgataaagccctaaacgaagcataccaatgcgcgcgcaagggtacgcttgacagactcccggagttctataactcgacaggaagttggacttggtaccagcttgtcccaaaggttataaacccaacacactataacatattagaaaccgcacagttcagagcgctgcatgcaataaccagagacaacgcttataaagacccggaacagcgcagaatcgcggcatttcaaaaagcatatcctctatacttaatcgaaacaaaaaaaggacttgaaatacagttctcaatgatgggggcgccaaatgcttactggacagatacttacccggttacagtaagctgtactgttggaaacaaaaccgtaagccaaaccaacaaagacgcctacagcaccaaaccaattcatgaacggatgatattacgacttccagtcaataaagttccgaaaaagtgctcagtatccgtgaaaagcagcatggatatcgccatgtacactcaaagtaagttcaaaacgatcaaatcaccagttgaagattttgtaaaattcacaccattaccatctatgcaagcctcaagtcttcaagaaggaattatacacatcaccacagagaaaggtgataccgcaaagcccggtgagggaagagtcatgtttgatgtaaaccgagatctatcagagtcagaaatgattggcatggtaatacatacaactgaggactctcagctaggaattgttcttgatggcgcaaacgaaaaacgggcaagcagctactaccccttaataaagtcaggaaaagacaatatagtaatcttcaacaagcttggatttgataaaggctcagagctagaaggccacatagctaaaattatgcttaggttctatacaaaacctaacgaaagggacagagacatagaaatcaaggaagtatcagttatcagaaatactgcaaaccttgaagatttcttaagacgcaaccagtcagcaaatttccatcagcagtaa

SEQ ID NO: 12745 - DNA, 195 bp, Pseudomonas aeruginosa
atttatcagaggcaccctgactcgacagaagattcttgcagccaacaaagacacatcgcccgaaaagcttcactggcatgcaggcagcaaggtgtaggagataacttcgtgctagagattttccaaaaggtatttccggacggagtgataccaagcacttacactcttgatatcccaaatatcaaccgcgaataa

SEQ ID NO: 12746 - DNA, 762 bp, Pseudomonas aeruginosa
tgcagcggagaggtcaggagcgacagcgccaggcatatcggtcggggtgtcaccacccccgccagcagcgccaagcatgctggtcttgaagtcgttgatgagttcattgcgctggcttctcggcattccgctgcgagccagggcggcatccattcggcgcttggccaagatggcttcgctgcggttgctgggagcgctggagatctcatcggactccaggaaggcatctgcccaccctttgtcgacggcttcgcgcccaccgatccaggtctcggcgtccatctgcttcacgatgtcgtcgatgtcgattcccgtgcgctgtgcgtaaatgtcagccagcgtcatgtcgaatggctccagccaatcggcgatctcgcggagatcattccgattgcccatggcgatcagccaggcgttgtggatcatcaggaaggcggcgcggccgatgtggatttcatcccccgccatggcgatgaaagaggcggcagaggcggccaggccgatgatgttcaccgtgaccttgcccttgtgctcgcgcagcaggttataaatagccaggccttcgaatacatcgccgccggggctgttgatattcacggtcacatcgacatcgctgcctatggcgcgcagagctccagcaatgcgttttgccgtgacaccttcaccggtccaccagtcgtagccaatcggttcgtagatggtgatcgtggagtccgggttatcgccagaagctgctcgaagctcaggacgccatgcatctag

SEQ ID NO: 12747 - DNA, 510 bp, Pseudomonas aeruginosa
ctccgggctcgggcaaggatcaacgccttcgctctggccgccctggtgcatgcggcggtaccggaacaagactcccgcagcgacatagcgcgccttctcgaacttcttcgtgtacatccttggcccagtttcgtacgcgactttgaaaacgatctcttcagcagcctccttttcgtcttcgccagccattgggctgtacatgtgattgccgaaaaccttcaggtgcgccgggagggtatcgatcgccttttgaatcatgccggcgagcgcctgatgaacagcccgaggcgtgctgatgtcgcgctcagtcctagtctgatggattcctggcacgaaggtgtgctggctgtaggagacggcttccccatcatcgtcgatttcggtgatacggcgccggacataaccgccagcctcgacaattccaagagcagctcgctccgccgcctcagccatgccgctgttccaaggggtatagaacgcatcgtgccaggcaatgcgcgcgctgtttag

SEQ ID NO: 12748 - DNA, 402 bp, Pseudomonas aeruginosa
tcgcgcggaaggacgctgcggacgaaccgtctgctcctgctgctcttcccggtcctgggcgcaactgacgaagcgcgcgaactcaccctggaactgcaacaggcagaagcccggctttgcgtgtcgacacttcacgacatcaagctcggtgataccgttctgtccacgctcagtgctcatatcccggtgagccatgatgatcacgtcggcgtcttgttcgatctcgccggaatcgcgcaggtcgctcatttttggcttggcgtcggcccgggtttcgatgctccgattgagctgagcaagcgcgacaattggaatgccaagctctttggcgagagccttgagccctcggcttatggcgccaagttcttggtttcggttctgatgacggtgactcggatctga

SEQ ID NO: 12749 - DNA, 255 bp, Pseudomonas aeruginosa
caggaagcgcatacatcaacgctggcaaaccctattaaggagactgaaatggctcaattcaacatcgattcccacctgagcgacggcaagagcctgcaatggcttgccctgccggacgccggtgaacagcctctggacgttgaggtgaaggttcgccaagcggcaatgaagaagttcggacagtccgtcttcttcaattgttgggagcacgtagttgcaagcaacggctacatcaccgtgcggatgcatgcgtga

SEQ ID NO: 12750 - DNA, 429 bp, Pseudomonas aeruginosa
gaggctgggatggccatgcacaccgagttgcagatccacaagaccgccgaagagttgctcagccttactcttagcttggtgcgcaatatcccgcgcgatctgaagcaggtcatcggctcgaagcttcgcgatgaagcgcttcaaattctggtactcatcggtcgagccaatatggcgcggaacaagctggagcacctgagtcagttgctcgaaagcatctggatggtgaactacctactccgcgctctggccaaccaaaggctaatcagcctcaagcaacactcctccgcgatgcaactcactgcctctataggcaaacaggaaaacgcctggaaaggaaagttcgcaaccgcgccctggcgcatacacactggaggcgagatatgtacaagcacgcttcgatttctgatcttctcggaaagaccataa

SEQ ID NO: 12751 - DNA, 354 bp, Pseudomonas aeruginosa
tccgctggcttggcgagtcgaacggctactactccgaatcggtcgatttcagccggatcaaatgactgcccggcaaggacgcgccattgcgcatacacacactggaggcaagatatggcagctggtgactactactcgtgcgacgtctgcgggggaaaatgcttctacgacgcgaacctgaactacgagtggccagataagaacggcaacgactcgtggggctaccacatccctgctgacgagatgatgctcggtacgaattgcaagctcgactactgcggcgacatcgctgctatctgtcgggactgccgggcgacacacgagattgttgtgcgagagaagagcagcgactga

SEQ ID NO: 12752 - DNA, 384 bp, Pseudomonas aeruginosa
tggtatggagaagaagtcatgaacaccgcattgaaatacgcccaggagcgctgggacaacgctctaccccccgacgatgacggcgaccgcgagtatgtcactgagcaagtcggcaagcttctgaactgcgaggacggtgattgcgtgccgttccatgaccggaaagagaggccctttatcgggccggagttcacggtctacggctttgccggattcgtcccggagtggctcgcagaggtagacagcaaagaatgcccgatgacccaactgctgcttgccgtgcgccgaggcgacctggagctagctcaacgcatctggttccgcgcattcgaagcaacgctgatcgagaacgctgaacgaatggttagggagagacgagtttga

SEQ ID NO: 12753 - DNA, 876 bp, Pseudomonas aeruginosa
agacagccgtggccgcgctctatgacgccggctatcgccgcaaggagtcatccacatgacagtcaccatcgacctgaccaaggccgcccaagtcctgatcttcggcggcttttttgtgggcagcgttctcgcgttcgcctgggcttttgtggggatggttacgccatgaagtttcctgacgatgttggaaagggcatttgcatcttcctttgcgacatcactgggaagatggctaagccatggttcgatgatgggtacacctgcatcttggttgatccgaagcatccacgcggggttacggtcagccagtgcggccggtggattaccattggagaaatcattgatcacccgactacatggtcggttatctccgctgcaatcagaaccaaccgcgtcgtcttcgtagcagggttccccccctgcaccgatcttgctgtaagcggcgcgcgctggtttgaagagaagcgcaaggctgatcctctttacgaaatgaaggccatgcacgtcgtttggcagtgccaggtgattggagagctttccggcggaaaatggttcgcagagaacccagtaagccgtatcagctcattctggcgccgtcctgaccacgccttccatccattccaatacaccggcttctgcgccgaagacaactacaagaagaagacctgcctatgggtcggaggaggcttcgtcatgcctgatccctaccgcgactactcgctcggcgcaccggacaacaggattcacacctgcgcacccggcgatgagcgcgccaacattcgcagcgagacgccaacaggcttcgccatagctgtgcatctcgccaatcgcggtccaagaaaaggacagctagatctcctggaggaagctgcatga

SEQ ID NO: 12754 - DNA, 564 bp, Pseudomonas aeruginosa
tggcgtcaagcgcattgctcgcgaattctccgagcagatcaagcgattcaccgaggagaaggcggcatgacccaactctacaagctcaccgagcagtttcttgaacttgcagccctggcagaaacggctgatgaaggcatggctgtggctgtccgggacaccatgcaagcaatcgggggagagttcgaagaaaaaggaaaggccctggcaacggtcgtcctgaacatggataccgacgtcgaagcgctcgaccgtgaaatagagcgactgaacgaccggaagagggcaataaaggctcgccaggactcgatgaaggaatacctgcgggaaaacatggaagcagccggcatcaagaagatcagttgccccctcttttccatcacctgcgttgaggggcgagagatcgccgtgatcgacgacgaaaagaagctgcccgacgaactggtcaaggtgaaggtcgaaaccagtcctgacaagaatgcaatcgcgcgggctttgaaagacggcaaggacgtacccggcgctcatttggagcgggcgaagtcttcaatcaggatcaagtga

SEQ ID NO: 12755 - DNA, 231 bp, Pseudomonas aeruginosa
cgacttcgacgacgacatcccattcagcccgctgccctatctagccggctcctgacccatgcaggagccaccatgtacatcaagaaagacgtcatcgaggtcatcaagtacgcggcgatgatggcggcctgctctcgccagtcctggggaatctaccccatgaaccagggctacaaggccatgcccttccgtggcgactatcaccgcgtcgtcgaagtctgccatccctga

SEQ ID NO: 12756 - DNA, 600 bp, Pseudomonas aeruginosa
aaaggcaatcgccttgtctggcctggagaaatgcgcatgaacaacgtacagcgattctggtgccatgaggcgcagaacatacggtgcgtcagggaatcagactacgccaagctcgaagccgaggcccaggcgctcagggaggagcgagacagccagcagcgcgtcgccatcaatgcgatggaagaactggcagccctgcgcacaagggtgttggctctacctgatgcgagcacggtgtacgcggcgctcgatgctcgggagcggttattcacaagccctgagaacattcaggtagcgctggaagctcaatcgcgcctcaacggcatgacggtcagcgaggggctattgcggggtatggccgcattcgcacaggagatcatcagcggagccctggaaggcggcagcttcgatggggcggacatccaggaaagtgccgaacgccatgggttgatcgccaagcagatgatgcgcgagccatgccgcggcccagaagagtactgcgcatgcgcctggtctacctcgttcccgactgaatgctaccggataacggcagagcttcgcgccctgctcagccaggacaaggagaacggcaatggctga

SEQ ID NO: 12757 - DNA, 306 bp, Pseudomonas aeruginosa
gatcgacgcgatcctgcgccaagccgacgagtacgcgaaaaccggacaggtgctagagcgcgagcaactgcgcgaaatgctcatgcacctgatcgtcaaagcggcgagcgaataacccaacaacgaacccaaccgtatccgccccccggaggaccaaccgtggacaacgaaaacgaaaccctggtcgcgctgcttgtcatcgcgctgatcgtcttcggcatcttccggatagtcggggacttccagaacctatacgagcagaccgagttgaaaggacaggagttgagcagatggagcaagcagtga

SEQ ID NO: 12758 - DNA, 600 bp, Pseudomonas aeruginosa
ctctggaaggagccaagccatgaccgacatcaacaagctgaaggagctggcggagcggtacatcgccaatccatccggagccggcggcgaagactccgcattccgtgccgccgccgagatcggcaagtctatgggaggtggggagtgagcgacgcacccattgaaccccatgaatacctctacggcgtgaaggtcgtccagatcgaggacttgagggtggcgcgtggacttacccgccgccccgtttcgtcctgccgtcaccggaagatggtctacgacgacaaggagcgccgcatctggtgcagcgattgtgaagcggaggtcgagccgtttgatgccttcatacacctggtgcaggtattcgacggcggcctgaaggacttgaacaggcgccgccgagagttgcatgaggcagagcagtttgcaatccgcagccgtgcggccaaggtgatcgacgaagcgtggcgcagcacgaagatggctccgctttgcccgcactgcaatgaggcgcttctcccggaagacgttgtaaagggagttgccacggcgtccaagcaactgatcatcgctcgccgcaacaagcagaaacaaccgaagtag

SEQ ID NO: 12759 - DNA, 333 bp, Pseudomonas aeruginosa
ggcctcttcctgaggcccgcccggctgggcaaccaatcctaccatcatgccctctccggcaatagctggggtggagaggtattgcctatggaacctgaaatcatccatgtgccagagcttgccaagctgctcgggcgaactgaatcatcaatccgcagcgcaatccaggcgcgccctgactggctgccgccgtacttcaagcaggggatcagagtgtgctggaggctggaaacggtgcgcaagttcctgcgtgagtacgaggcgggagagcacaaggctccgaaggtgggcaggccacggaaagaaccgcctcgcctgctgaagagggcctag

SEQ ID NO: 12760 - DNA, 942 bp, Pseudomonas aeruginosa
taccagcttgtacgaagaacgcgaagctttcttgaagattttttcgcgttctttcagatggttgcgcgcgttaggaggttaaagcggcacgcccaggcgcttggctacctcttcgtaggcttcgatcacatcgccgaggccctggcggaagcggtccttgtccatcttcttgcgggtttccttgtcccacagacggcagccgtccgggctaaactcatcgccgaggacgatctggccatggaacaggccgaactccagcttgaagtccaccagcagcagaccggcgtcgtcgaacagcttgttcagcacttcattgaccttgaaggaataggtcttcatctgcgccagctgctcgggagtggcccagccgaaggcctggacgtgggattcgttgatgaacggatcgcccagggcgtcgttcttcaggaacaactcgaaggtgggaggagtcagggcgatgccctcttccacgccgaggcgacgcaccaggctgccggcggcgaaattgcgcaccacgcactcgaccgggatcatgtcgagcttcttcaccaggcactcggtatccgacagcagcttgtcgaactgggtcggaatgccggcagcttccagcttctgcatgatgaaggcgttgaacttgttgttcaccgcgcccttgcgatcgagctgttcgatgcgcttgccgtcgaaggcggaggtgtcgttgcggaacagcaggatgagacgatcggcatcgtcggtctggtaaaccgacttggctttgccgcggtagagttcttcgcgtttttccatgatgggctccgcttacgggtaatagggcctaggcgatctcgcgccaatccaggcctgaatgctgatcggccacctgcagccagtccggatcgcacccgagagtgtcgacgaaggtttgccgggccagctgcggcgagttgttcttttcgctga

SEQ ID NO: 12761 - DNA, 1134 bp, Pseudomonas aeruginosa
caggcggcagacgtttccctcggcggcgcttttcgctacccttcccgctttaggtacggcccgtgccgccagcgtattccaggaaagttgaatgtccaccagccaaccccgcgaacaattccttctgatcagcgccctcggccccaatccgatggagctgaccaccctgctctgccgcgcctgcgtcgagagccgctgcgccgtggtcagcagccgcctgacccgccacggagagttcagcgccctggtgctgcagatctccggaagctgggatgccctcgcccgcctcgagggcagcctgccggccctcaccaagcgcggcgacatcaccctcagcatgacccgcagcaacgcccacgtgacccgcgcccaggcgttgccttacgtggcctatgtcagcgcggtgtatcgcccggacatcctcaacgaactctgccagttcttcatcgaccacaacatcgagctggagaacctgacctgcgacacctaccaggcgccgcacaccaacaccaccatgctcaacgccacgattaccgtgacgctgcccgccggcacccagatcagctggctgcgcgaccagttcctagacttcgccgacgccctgaacctggatgccctgatcgaaccctggcgcccccaacacccctgaggagccgagccatgccggtcgcaatcgacaaacccgtacccgacttcaccgcccccgcaaccagcggcaaggaggtgaccctgtccgcgctgaagggcaagcaggtcgtcctgtacttctacccgaaggacagcacccccggttgcaccaccgagggccagggcttccgcgaccagtacgcggcgttccagaaggccaataccgaggtcttcggcatctcccgcgacggcctgaagtcccacgagaacttcaagtgcaaacaggaattccccttcgagctgatcagcgacaaggatgaagcggtctgccaactgttcgacgtgatcaagctgaagaagctctacggcaaggaatacatgggcgtcgaccgcagcaccttcctgatcgacagggacggcgtactgcgccaggagtggcgcggcgtgaaggtgcccgggcatgtcgacgcggttctcgccgccgcccaagcgctcaacggcacctga

SEQ ID NO: 12762 - DNA, 1443 bp, Pseudomonas aeruginosa
gcctcctgcatgaatgtactgcgccctgccctgttgacgctcgcctgcatgctcgcttcgccggtcatgtcggacgatctgccctccctgggcgacgcatcttcctcgatcgtttcgccggagcaggagttccagctgggccgcgcctggctgagcatgctgcgcaaccaggtcgatgcgatctccgacccgcagctcaaggacttcgtcgaaagcagcgtctaccggctggccgaaaccagcgacctgcaggaccaccggctggccttcatcctcatccgcgacgcacagatcaacgccttcgccgcgcccggcggcgtgatcggggtcaacggcgggctactgctcaacgcccagaccgaaggcgagtatgccgcggtgctggcccacgaactcggccacctgatccagcgccacttcgcccgcggcatcgaggcacagcagcgcatgcaactgccggtgatggcagcgatgctcgccggcatcgtcgccgcggccgccggcgcaggggatgcgggtatcgcggcgatcgccgggacccaggcggcggcgatccagaaccagttgcgcttttcccggcagaacgagcaggaagccgaccgcgtcggcgtcaccaacatggttcgcgccggttacgatccgcgctcgatgccgaacatgttcgagcgcctggcgcggcagtatcgctacgacggcaagccgccggagttcctcctcacccacccggtcaccgaatcgcgtatcgccgacacccgcaaccgcgccgaacagtatccccagggcggcaaggaagacagcctgcgctaccagcagatgcgcgcgcgcacccagttgctcttcgaggaaaccccggggatggccggcaagcgcttccgcgccatgctcaacgacaatcccaagctggatgccgcgcgctacggactggccatctcgcagacgcgcatcggccagctcaacgatgcccgtgacaacctcaggcaattgctggcgaaggcacccaacgacgtggcctacaacctggcccaggtcgagctggacatcaccgccaaccgccttccggatgccgatcagcggttgaagaagatgctcgcccagttccccagcagctacccgctgaaacaggtgcgcgccgacctgatgctgaagatgggcaagccgcaggaatcggagaagatcctcgacgacctgagcaaggcgcggccgctggacccggatgtctggaaccgcctggccgaggtgcgcagcctgaccaacaacgccatcggcgtgcaccaggcccgtgccgagtacctgtctctgaccggcgactaccaggccgccatcgagcagctcgatttcgccaagcgccgcgctggcggcaacttccaactggctgcgcgactcgacgctcgccagcaggaaattcgccaacaggaaaagatggtcaaggaaatgttccgctga

SEQ ID NO: 12763 - DNA, 618 bp, Pseudomonas aeruginosa
gcggcatatccgaggaaaaacacccggcgaagctcatcgaaacagggggttgggcgaacaaccgcaccgcgcttactcgccctacgcagcgggacgccctcgccaggatcaggcgttcccggcctggcgcaggcgcgcggcctgggtgaagtcgagcatgcgcttgagcggacggaccgccctcgggatcaacgccgggtcgacgaagatttccccgctgccctcgcgcaggcaggccagggtccgctcgagcgtgttcatcgccatccacgggcagtgcgcacagctgcggcaggcggcgccgttgccggcggtgggggcctcgatgaaatccttgaccgggcacaactgctgcatcttgtagaagatgccgcgatcggtggcgacgatgaaggtcttgttcggcagggtctgcgcggccttgatcaactggctggtcgagcccacggcatcggccagcgcgaccacgctttccggcgattcggggtggaccaggaatggcggcgtccgggtagagcgccttcatgtcttccagctggcttggcgttgaactcctcgtggaagatgcaggcgccatcccagagcagcatgtcggccccgttctcgcgctggatgtag

SEQ ID NO: 12764 - DNA, 567 bp, Pseudomonas aeruginosa
cgtcccaggtggtggtccgggcgcccagaggatgggctcgccgttgtccatcaggtgttagacgatgtccaccgcgcaagtggaggtcacgacccagtcggcgcgtgccttcaccgccgcggaggtgttcgcatagaccaccacggtccgttccgggtgctggtcgcagaatgccgagaattcatccaccgggcagcccaggtcgagcgagcaggtcgcttcgagggtcggcatcagcacacgcttctcagggttgaggatcttcgccgtctcgcccatgaagcgcaccccggccacgaccaccgtctgcgccggatgctggttgccgaaacgggccatctccagcgaatcggatacgcaaccgccggtctcctcggccaacgcctggatcaccgggtcgcagtagtaatgcgccaccagtacagcattttgcgccttcagttcggccgcgatcgccgcgcgatgctcggcgctctcctgctcgctcaacacacggggttgcttggcggccaggtgggcctgtaccaggagtcgttcggaaatgtgcgtcatagtcgctacacctga

SEQ ID NO: 12765 - DNA, 1002 bp, Pseudomonas aeruginosa
gggatgcctattcataacctgaatcacgtgaacatgttcctccaggtcatcgcctccggttcgatttcctccgctgcgcggatcctgcgcaagtcgcacaccgcggtcagctcggcggtcagcaacctggaaatcgacctgtgcgtggagctggtccgtcgggacggctacaaggtcgaacccaccgagcaggcgcttcgcctgatccctaacatgcgcagcctgctgaactaccagcagctgatcggcgacatcgccttcaatctcaacaagggtccgcgcaatctccgggtgttgctggacaccgccatcccgccgtcgttctgcgatacggtgagcagcgtactgctcgacgatttcaacatggtcagcctgatacgcacctcgcccgccgatagcctggcgacgatcaagcaggacaacgcggaaatcgatatcgccatcaccatcgacgaggaactgaagatatcccgcttcaaccagtgcgtgctcggctacaccaaggcgttcgtcgtcgcccatccgcagcaccccttgtgcaatgcctccctgcacagcatcgcgagcctggccaattaccggcagatcagcctcggcagccgctccgggcagcattcgaacctgctgcggccggtcagcgacaaggtgctcttcgtggaaaacttcgacgacatgctgcgtctggtggaagccggcgtcggatggggcatcgcgccgcattatttcgtcgaggaacgcctgcgcaacggtaccctggcagtcctcagcgaactctacgaaccgggcggcatcgacaccaaggtgtattgctactacaacaccgcgctggaatccgagcgcagcttcctgcgctttctcgaaagcgcccgccagcgcctgcgcgaactcggccgccagcgtttcgacgatgcgccggcctggcaaccgagcatcgtcgaaacggcgcagcgccgctcaggcccgaaggcgctcgcgtaccgccagcgcgccgcaccagagtag

SEQ ID NO: 12766 - DNA, 717 bp, Pseudomonas aeruginosa
agcgttctccagcagacgctggccgtgggtggtgagaatcgactcgggatggaactgcaagcccagctgtcgattgcgcggatcggccatcgccatgatctcgccatcggcatcggccaggcagtcgaaaccttccggcaggcgactgaccaccagcgagtggtagcgcgcgacgcgcaggtcagcgatgccgtcgaacagcgggtgacgctgatcgaaacgcagggacgtgctcttgccgtgcagcggcttcctcgcctcgcccaccgcgccaccggcggccagcgccagcgcctggtggccgaggcagacgccgagcaccggcaagcgcccgcgggcccaggcgagcaattccagcatgcagccggcgtcttccggccgaccgggccccggcgacagcaccagcagttcgcaaccgtcggccagcaataccgcctggatcgtcggcaacggcgtatcgttgcgcatcacccggacctccgcgccgagcaggcagaactgctcgaccaggttgtaggtgaaggaatcgaagttatccaacagcgtgatgcgcatcgcgctctcccctttcgcgttcggcagcggccacggcggtcagcaccgccagcgccttgttgcgggtttcctcggcctccagccgtggatccgaatccagcaccacgccggcgcctgcccggacccgggcgataccttcgcggacctcggcggagcggatga

SEQ ID NO: 12767 - DNA, 339 bp, Pseudomonas aeruginosa
cctgggccggacagtcctcgctcaacggcgccagcaaggcgcgtccgttggagttcaacgcccgcagcaccacatcgcgcccccagcactcgatgcgcaggcagctggaaaggatcgccacgctacgccgcgcagccttgctgtccacgtcgaagcagtcgaacagcatccggttggcgccggccatgcgccagatcgacagcgcctccggcaccagcgtgcggtactccagactttcttccagtcgatagccaaccccgctcacgagccacctcctcgcgcccatgggcgactggcctgcgcgacgctagcgcgcaacggcatgttcatcatcggtaa

SEQ ID NO: 12768 - DNA, 258 bp, Pseudomonas aeruginosa
cctgcaggcgatgccgcggtcccagctccagccactcgccgtcggccaccgcgcgaaccggcagagcgtcccaggcacaggcctcgggcaaccgctgctccgcacgcaacagttgccggttcaagcgctcgaccacccgcaccgcgctttccgacttccaggcctggcaggtccgctcggacgccaggacctgtacgttcggcagccgcggacacaggtagggcagcaggccgcagtggtcgtagtgcttgtgggtga

SEQ ID NO: 12769 - DNA, 2280 bp, Pseudomonas aeruginosa
tccctccttcaaccagcgcccagctcgcctcaccgagacgcagcaggaacaccggcacctggacgtcccccaacaggcacaggtcatcatccagttgaccgggagccgaaagcctcaacatggccggttcacctcctcaggtttgcggtacagcgccgcgccccaggtcgcgccggagccgtaggtcaggaccagcacccgctgtcccggctggatgtccggccagaacatcgccagcgtgaccggggtcgaggccgaagccatgttgcccagacgatccacggtcaccgcgaacttgtgctggggaatgcccagttgctcctgcaccgcatcgaggatgcgcaggttcggttgatggcagatcacatggtcgatgtcgtccagggtcagctcatgggccgcgagcatttcgccggcgatccgtaccagggtctggctggcatgctcgaacatcggccggccgcgcatgaggaactcgcccccgccctcgcgcaggacattctcgtcgaggaaggtcggcgaggcactgcccggcgccgcagtcatcagcaggtcgaagtagttgccgtcggcgcccaggcgcaggtccagcaggccgtcgtcgaggctctcgccggcgctgaccaccactgcgccggcaccgtcgccgagcaggatcgacaggttgcggccgcggtccgaacagtccatgcgcttggacagcacctcgccgcagaccaccaggacatgccgtgccagcccggcgaggatctgcccgcgagccatctgcaagccgtacagcaacccgctgcactgtgcccggatatccagcaccgggatgtgccgcaggcccagcagcggctggatcaggcaggcctgggacgggtcgtggtggtccggcgacagggtgttcaccagcaacaggtcgatgtcctccggcagcagcccggcagcctcgatggcctggcgtgccgccggcaccatcagcgcgctgaccgcctgttccggctcgacgtgatagcgggtgcgcacgccggtacgttcgacgatgaactcgtccgacgtattgatgcgccctaccaggtcatgattgctgacctggcgtttcggcaggctgaaacccagcccggccaggatcggattacccatgtgcagccctcctcggacaccgtggttcaacatggcgatgcctcagcacaccagcacctcgcccaattgccagacctgggcggcgaacccccagccagtggctgcgccggccatgacgatacgatcgccggggcggatcttgccctcgcgcaggccggtcatcagggtgtacgggatggaaacggagatcatcacgccggtatcgcccatcgtcagttggtactgctcaggacgggcaccgatgccctcggcccaggccttgaccaggaacggcgctggctggtggaagacgaaataatcgatgtcatcgctgcccaggccggccttttccaacgcccggcgcatcgcgatcggcacgttggtcgggacgaagctggccatcttgttctggccgtcgctgaacaacgagaaatacagccgcggcttagcctcgccggtcgggttttccggcaggcgccagcgaccggtggccacttcatagaacgtagcgtcgctgtgttcggccgaagccagcaggtcgcagctgtcatcgtcgccgcgggtcagcagggccaccgcgcagccatcggcgaacagggtcgaggtacgcgaggtgaagtcgagcaggttggagatgtactcgctgcacaccaccagcactttctcggccttaccctggcggatcatgctcgctgccaggcgcaggttgagcaggaagctggcgcactccatctgcgaatccaatggcagcgcccgactcaggccgagctgcttggacagcacgttggccatgcgcgggtagagacgtccgcgcaggtccggcaggacatcgccggcgtcggtcatgatcggcgaggaagccgaacagatcagcatgtccacgctatccggcgcggtatcgctgctgcgcagcaggcgctcggcggcccggaccaccaggctgaactcgttctcgccgttccgcgggtcgaaatagccccgccgattgacgccccagaattgccaccaggactcgctgaggtccggtaccgcggcgaacaccggatcgtcgttttcgtagctgcgagccggaagttcacaggtgatcgctgccagtttgaccttatgcatgagcttctcccgccagttccagggtcacgccctccaccaccatgccgaacggatcgaagctga

SEQ ID NO: 12770 - DNA, 1749 bp, Pseudomonas aeruginosa
ccgccgcctcgtccagggcttcgcgaaccgccggcagcaagcgctgcatcagcatctcgtcgccctgggcgcgagggcgttcgcctcccagcggcccctccagacacacataggatgggggcaggttcacccccacagcctgaatcaacatgcccgttcctccggaaggttgtcgtgataaagggtgtcggccaggtggcgcagctcggcgcgcgccaacttgccgttgtcgttgcgcggcaaggccggcagcacatgcaattggctgggcagcatgtgcgagggaatctgttcggcgagatgctggtcgatgcgctgcgccagcaggatctggttgtcgtccagcggagtggccagggtgacgaacagggtcggacgcaagccgtcgtgcagccggcaggtaggaaccagaaccgcctcgctcacttccggcagatgacggcagatcgcctgctcgacctgggtcggcaccacccagcggccattcaccttgaacagatcgtcttcccgcccacagtgacggtaggcacccgactcgtcgcgctcgaacaggtcgccggtgcggtaccagccacctgcgaagcgcgcctgctgctcttcgctggcccgccagtaacccggactcagcccagggccacgcaccaacagcacgccttgctggccagtttcctcgatagtgtgcccttcgcggtccaccagccggcactcatagccaggcaacggcagcccggtgctgtcggcacgcgcctgccccgggcggttggcgaggaacacatggccgacctcggtagccccgatgccgtcgcagatctccagcccgtgcgcggcccagaattcgaactcgccgcgcggcagcggcgagccggcggaaaacgccaggcgcacgctgctcaacagctccctggcctgcggacgcagcgaggcatagatggccggcaccccaaacaggacccgggggcggaaggcgaccaggttctccagaacccgctccgggctcggccaggtatcgtcgagcagcgccgaggctccgctgaaccagggaaagaacaggctgttgcccatgccatagccgaagaacatcttgggaatcgaatacagccggtctcccgcctgcaatgccagcaactccgtagcgaacgcccggcagaaaccgagcgtgttgcgcaggctgtgcatcacccccttgggcgccccggtggaacccgaggtgtattgcaggaaacaggctgccgccgggtcctggcgatggaaggcactccaatcgaggtccgcaggaccgaccagcgcgtccagcgagaaatcgtcgagcaaagggcgtccggcggccgcacgcagggtcaacggcgccaaaggaccgctcagcgacggtgcatcggcttcacgcaccaccaggctggcctggcagtcggcagcgatatcggccagggcctgctcgcgggacttgggattgatcacggcgggaatggcgccgaccgcgatgcaggccaggaacaggcaggccagcgaaggcgagtcgttcaacgccagcaccacgcgatcgccgggcttgagcaggcgggccagttggctggcctgggagagaatgtaggtccggcattgcagccggctgagagtctggccccgatagtgataaacggcggtatcgggatcgaaatcgaggcggaacagaacctcggtcaggttggccaatgtggacatgacagaacgttccctcttcagcgatatgcatccggatcaggagatacctga

SEQ ID NO: 12771 - DNA, 777 bp, Pseudomonas aeruginosa
cccgactgcagcggggacatttcagatcgaggaccgacggcaactgagcgcaactcgttcgtaagtcaggtccttgttcctgggcggcaactgatagtcgacggaacaggagccatcgctccagcgaatggacaggcgcccctggtcctcgataccgaacaccagcaaacgggacaggttgtcgaccattcccacgacccgctcttccttgtcgtatgcctgtgcaccgaagggactctttcctccagagtccatgctcaggtcgaactgcacccgccgaccggactccgcggagaaacgcttggcgatcacggcgccccgggtcggcacggccatttgcgtgctgtcgctgatctcggtatcgcttccaagggtattggtatccaggttcacccagttgtaacgatagggttgcatgtaggggagcacggcatagccacggccgtcggtgcgaaccgaagagtagccgtcgaggccgacgccgccgacctccggaacctccaccaggccgaacgtttcccccaccggctggccgaaggtcactccccccgaatgcaccactaccgaaccgcttgctcccaggttgatctgcttgttgtcgcgcccctggctgtaattggcggacaacttggccttggacgtgtcccaacccaggccgacgctgccggagttgccgccgtccttgctgtagttggcctgtgcgctgtagttgaacgcattggcttcatccaggtatccggagataccggtgttcagactcgaatcaccatgctgtga

SEQ ID NO: 12772 - DNA, 1518 bp, Pseudomonas aeruginosa
gccatagaggtagctctcttcggacatgtcgtcgatatgctggctgagagtacggtagccttccgtggaatagcgatagcccaccacggtaaagctggtttcggtggcgttgatggtcttggaatagagaagccgcagactctgtccctggttgcgcccaccccgccgcgtgcgggactggctatgggtcacgtccgcagaaaaaccgcccaggggcgtgttgaagccgaggcccaggttggtggcattgtacttctccgcagcgagcaggccgccaaagccggtaaccctgtcggacaagccatacacagccgacccctggagcaggttgaccgacggctggccatcattatggtattcaccggcagccaggccatagcgcaggttccccttgcgggtcatgaccggcaggtaggaataggactgcttgaaggaccgctggcgtccgtccgcctcgatgatcttgacctccaggtcgccattggagccgctgggatagatgtcggtgatctcgaacgcaccgggcggtacgttggtggaatagatcacgaagccattctggctcacctcgaccgtcgcattggtttcagcgataccgcgcaccaccggggtatagctgatctcgttgtcgggcagcatgcctatatcggattgcagttgcacgccgcgcatacgcacgctctcgaaagcatccccctgagcggaggtatacaactcgccgagggacaaggtccccttcagggcacgaatgtcacgttccacataggtacggttgctactgaacttgttgcgcatgccggtacctccgctcagggaggagtcgttgcgcagacgccagccaaacaggttgaagccgttgcgcaggcccaggtagcgataatcgctgttctggccaaagttggtgttgcgcgtgaagttggcctggtagttggaaaacaacgcggtgacaccgtcatcccaaagagagggatccacatagccacgcgagtgccgctgtacatacagctgtggaatgctgaccagcagggaaaggctgttgacgtcgaactcgatggatgcaccggggatgagttcggcgacattcaggggcgtattgttttccagattatccggaatgagtttgtctcgcgtcagccgggcgatatcgaccccgatctccttgagcagccctatccggacgaccggacgaacgcttccggtttcgggatcggcactgaacacgacatcttcgcgccggatcatgatctggttcaaatgaatgtcgacgctgtaagtgccgggcgacaccgagttgccgttctcgaaatacttcagttcaacaggcgccccgccctcgttgttcaggaactcggcgttgaattccaccgcgaaagttacggcaggcaaagccaatcccaaggccatgagacaggaagacctggaatagacggacaactcgaagtcgaactttttcctaaatatggccacgcgaatattccttggactaatttccgacaaaacggaaacacccatccatag

SEQ ID NO: 12773 - DNA, 543 bp, Pseudomonas aeruginosa
cctgcacgccagcacgccgcagcaggatgtgcaggcggcgatagccaaagcgccggcgctcttgggccagttccaccagttgggcttgcagctcggtgttttgcacactggctcgcggctggtagcgcaacaccgagcgggacagcccgatcaactgacaggcacgacgctcggagatgccggttcgcgcctgcatctcctgcaccgcctcccgccgtgctgtcgggcttacccttttccccgagcgaccactttcagcgactcgatgtcgaggtgggcctcggcgagcaacttcttcaatcggctattttccagttcaagatccttcaaccgtttggcgtccgccacggtcataccgccaaacttggcccgccaggtgtagaacgaggcatcactgaagccgtgtcggcgacacagttccttcaccggtacaccggcctccgcctgcttgaggaagtcgagaatctgctcttcggtaaaacgctttttcactgccgtcttctgctcggaaaacggactctactaagttcggcgtggtactga

SEQ ID NO: 12774 - DNA, 1497 bp, Pseudomonas aeruginosa
atgtccaatgacaacgaagtacctggttccatggttattgtcgcacaaggtccagacgatcaatacgcatacgaggttccccctatcgatagcgcggccgttgccgggaatatgtttggcgacttaattcaaagagacatatatctacagaaaaacatttattatccagtccgatctatttttgaacaaggaacaaaagaaaagaaggagatcaacaagaaagtatctgttcaagtcgatggcttgctaaagcagatcactcaaggaaaaagggaggccacaaggcaagagcgagtcgatgtcatgtcggcagtcctgcacaagatggaatctgatcttgaaggatacaaaaagacctttaccaaaggcccattcattgactacgaaaagcagtcaagcctctccatctatgaggcctgggtcaagatctgggagaagaactcttgggaagaaagaaagaagtacccttttcagcagcttgttagagatgaactggagcgggcggttgcctactacaaacaagattcactctctgaagcggtaaaagtgctaagacaggagctcaacaagcaaaaagcgctaaaggaaaaagaggacctctctcaactggagcgggactacagaacccgaaaggcgaatctcgagatgaaagtacaatccgagcttgatcaagcgggaagtgctttgcctccattggtcagtccaacgccagagcaatggcttgaacgtgccacaagactggttacgcaagcaattgctgataaaaagcagctgcagaccacaaacaatactcttatcaagaattccccaacccctctagaaaagcagaaagccatctacaatggtgagctacttgtggatgagatagccagtctacaggcccgcttagttaagctgaacgccgaaacgacacgacgcaggacagaagcagaacgcaaagcggccgaggaacaagcgttgcaatatgctattaaatttactgccgacttttataaggaagtaactgagaaatttggcgcacgaacatcggagatggcgcgccaactggccgaaggcgccagggggaaaaatatcaggagttcggcggaagcaatcaagtcgtttgaaaagcacaaggatgcgttaaataaaaaacttagccttaaagataggcaagccattgccaaagcctttgattctctagacaagcagatgatggcgaagagccttgagaaatttagcaaaggctttggagttgtaggcaaagctattgacgccgccagcctgtaccaagagttcaagatatctacggaaaccggggactggaaaccattctttgtaaaaattgaaacactaactgctggtgcggccgccagttggcttgtgggtattgcatttgccacggcaacagccactcctataggcattctggggttcgcactggtaatggcagttaccggggcgatgattgacgaagaccttctagaaaaagcaaacaatcttgtaatatccatttaa

SEQ ID NO: 12775 - DNA, 507 bp, Pseudomonas aeruginosa
ggcatggcgactggcctgccattgtgtgccccatcatcaaagggggtttcaatgaccaggcagttgaccactctcacgctgtgcctactgctcgccagctgcacgacccacaaggccgagccggctaggccagcctttgacagcagccgcaatccagacctgctctctccggacctgtatccaaacggtgtgcagccggagaaagagcccgtagtgcgctacgggcgctacaccctggtcagcacccagcctgatgccggtcaacgcgacctgatggcccagatcatcgacgtaaccatcccgtcgagcatgaacccgagcgtcaaggacgccatgcagtatgtgatgagccgctcggtttttttaagatgtcccgttcttcttcaaggcgacgcatttgggcccgcagccgcaggatttcgctcttggcttccaacagttcgctggcctgtttctccgacttgtcgggggtcacagcctttacccatttgtagaggctgtgagtag

SEQ ID NO: 12776 - DNA, 969 bp, Pseudomonas aeruginosa
gcagcaaaagatccaggagctggaagcccggatcaaccggttggagcgggagaacgcgatattaaaaaaggctacagctctcttgatgtcggacgaactcgatcgtacgcgctgatagaccagttgagtgagcaggagtcggtggaagtggtctgttcagctttcgaagtggcgcggtcttgctactacgtccaccgtcttcgacggcggcgtgtcgatgctcgccgcgtggcgctgcgtagccaggtcaaccagttgttcagccagagtcggggctcggccggcagccgcagcatcctgggcatgctgcgcgaagagggcgtgaccatcggccgtttccgagtgcgtaggttgatgcgtgagctgggcctggtcagcaagcaaccgggctcgcacgcctacaaacaggccatggttgagcggccggatatcccgaatcggctgaaccgcgaattcgcgaccgagcatcccaatcaggtgtggtgtggcgacatcacctacgtctgggcgcaaggccgttggcactacctggccgcggtgctggatctgcatacccggcgggtgatcggctgggcgttctcggccaagccggatgccgaactggtgatcaaggccctggacatggcctacgaacagcgcggcaagccacagcaggtgctgttccattcagatcagggcagccagtacgccagccgcctgtttcggcaacggctctggcgctatcggatgcagcagagcatgagtcgccgagggaattgctgggataactcgccgatggagcgcctattccgcagtctgaagtcggagtgggtcccgtcaacgggttacctgacggcgcaggaggcccaacgggacatcagtcattacctgatgcaccgctacaactggatcagcccgcatcaattcaacgacgggttaccacctgcggtggccgaagaaaaactcaacccactgtccgggatgggttga

SEQ ID NO: 12777 - DNA, 678 bp, Pseudomonas aeruginosa
cgaacagcatggcgaagatcagaacgtgcaggaccaccgccaggacgacgggccagaaataactctcggaaggcgagcgctcgaactgttgcttcaagatcagggggcctcggtaatcaacccgacgttgggcacaccggcctgctgcaaggcacccatggcgccaaccaccgcaccatagttcaccgccttgtcgccgcggatgaatacctgggtgtccggacgggcactcatgatcttggtgactgcatcggtcatctgttccaacgacacggcactatcggtctgtttttcagtatccacttcgctgccgacgttccagtaataggaaccgtcggccttcaccgaaagggtcaggacctgcttgttgttgtcctgaggcaacgcctcgctggacaccttcggcaggtcgaccttgaccccctggttgagcatcggtgcggtcaccatgaaaatcaccagcagtaccagcatcacgtcgatgtaaggcaccacgttcatttccgcgaccggcttgcgcttgtgacgaacccttgccatatcggcttacctctcagtcgtcttagtcgtcgctggtgtgcaccttgcggtgcaggatggcctggaactcgtcggcgaaggtgtagtaacgaccgatcagcatctcagaacgtgcggagaagcggttgtaggcgatga

SEQ ID NO: 12778 - DNA, 1212 bp, Pseudomonas aeruginosa
aaccaagtcccggctttgccaatcggcaatcgcccacaaatgcaattaattaccatcttcagacgtgaacagatccgtcgtcacccccggccccaaccttttcggaatattcaggccaaagtgcaggtacgcatggcgtgttaccacgcgcccccgcggtgtccgcatgatgtagccctgctggatcagatagggctccagtacatcttcgatcgtgtgccgctcctcgctcaacgccgcagccaagttgtcgattcctacaggcccgccatcgaacttgtcgatcatggtcagcaacagacgacggtcgaggtggtcgaagccacgctcgtcgacatcgagcaggttcaatgccttgtcggcgatcacccgggtaatgtcgccctgcccccggacctcggcgaagtcgcgtacccggcgcagcaggcgattggcgattcgcggcgtaccgcgggcgcgcttggcgatttccgccgcgccctgcggctcgatctccaggccgagaatgccggccgaccgactgacgatggtcgccaggtcctcgacgttgtagaactccaggcgctggacgataccgaagcgatcgcgcagtggattggtcagcatgccggcacgggtggtcgcgccgaccagggtgaacggcggcaggtccagcttgatggagcgggccgcgggcccttcgccgatcatgatgtccagctggaaatcttccatggccggatacagcacttcttcgacgatgggcgaaagacggtggatctcgtcgacgaacaggacgtcgccggcctccaggttggtcagcaatgcggcgagatcgccgggacgctcgagcaccggcccggaagtactcttgatggaaacgcccatttcctgggcgatgatattcgccagggtcgtcttgcccagccccggcggaccgaagatcagcgtatggtcgagcgcctcctggcggccgcgcgcggcatggatgaacagctccatctgctcgcgcacgctgggctggccgatgtagtcggccagcttcagcgggcgaatggcgcggtccagctgctcatcgcgttcgcgaccggaaacggcggatatgaggcgatcaggctcgatcatcgggcgccacctagaccatgcccttcagggcctggcggatcatttcttcgctggacaaatcctctcccggtacggctgcgacggcacgactggcttcctgtggcttga

SEQ ID NO: 12779 - DNA, 645 bp, Pseudomonas aeruginosa
tcgttaccccatcaaggtgaactcattgacatgttgaaaatcgtccttctggtcacgggcgtcgccgccctattgctgtccttcattcccagcctaagaaccgaagccacacccttcctgcaacatcccgatgccatctacctggccattctgggcctgatcaacctgctcttcgctcccgtactgcaatcgtcacatccaacccgcccgctgcaggccggcgcagccgccctgctggtcctgggcgtcgtcctgcaggcactgatcctgctggcgccgctgccgaccatcgccgaccagccggcgatcgtcctgcccctgctaagcctggtgctggccacggctctgcaactggcgggcagcctgaaacccggcaagccggtctcgcgcagcgccagcgccccggcagccctcggcggcagccaggacagcggcaaccgggagaccggtaccgtgaagtggttcaacacctcaaaaggtttcggcttcatttcccgcgattcgggcgaggacatcttcgtccacttccgagcgattcgcggcgaaggccaccgcatcctcatcgaaggccagcgcgtggagttctcggtggtacaacgggacaagggcctgcaggcggaagacgtgatcgcctcccgccgctga

SEQ ID NO: 12780 - DNA, 1725 bp, Pseudomonas aeruginosa
cggccaaagatgcgtaccagtcagtatctgctttccacgctcaaagaaacccccgccgacgcggtggtaatcagccatcaactgctgcttcgcgccggcatgatccgtcgcctggcctcgggtctctacacctggctgccaatgggcctgcgggtactgcgcaaggtcgagaccatcgtccgcgaggaaatgaacgctgccggcgccctggaagtgctgatgccggcggtgcagccggccgagctgtggcaggagtcggggcgctgggagcaatacggccctgagctgctgcgcctgaaggaccgccacgagcgcgaattctgcgtaggcccgacccacgaagaagtgatcaccgacctcgcgcgcaacgagctgaacagctacaagcaactgccgatcaacttctatcagatccagaccaagttccgcgatgagatccgcccgcgcttcggcctgatgcgcggacgcgaattcatcatgaaggacgcctattccttccacctgagccaggactcgctgcagcagacctacgacgggatgtaccaggcgtacagcaagatcttctcccgcctcggcctggatttccgtcccgtgcaagccgacaacggctccatcggcggcagcggctcccatgagttccacgtgctggccaactccggcgaggacgatatcgtcttcagcgacagctccgactacgccgcgaacatcgagaaggccgaagccgtgccgcgcgagagcgcccgcggcagcgccaccgaggacatgcgcctggtcgacacgcccaacaccaagaccatcgcggccctggtggacggcttccagctaccgatcgagaaaaccatcaagaccctggtggtgcatggcgccgaagaaggcaccctggtcgccctgatcgtccgcggtgatcacgagctcaacgaaatcaaggctgccaaccagccgctggtcgccagcccgctggtattcgcttcggaggccgagatccgtgccgccatcggcgccggccccggctcgctgggcccggtcaacctgccgatcgcctgcatcgtcgaccgctccgtcgccctgatgagcgatttcgccgctggcgccaacatcgaggacaagcactacttcggcgtgaactgggagcgcgacctgccgctgcccgaggtcgccgacctgcgcaatgtcgtcgaaggcgaccccagcccggacggcaagggcaccctggtgatcaagcgcggcatcgaggtcggtcatatcttccagcttggcaccaagtacagcgaagcgatgaagctgagcgtcctgagcgaacagggcaagccggtcaacctgatcatgggctgctacggcatcggcgtatcccgcgtggtcgccgccgccatcgagcagaaccatgacgagcgcggcattctctggccaagcgcactggcgccgttccagatcgccctggtaccgctgaagtacgaaaccgagagcgtcaagcaggcgaccgacaagctctatgccgagctgaccgcagccggtttcgaagtgctgctggacgatcgcgacaagaagaccagccccggggtgaagttcgccgacatggagctgatcggcattccccaccgcatcgtggtcagcgaccgcggcctcagcgaaggcgtcctggaatacaagggccgccgtgacagcgagtcgcagaacctgccgatcggcgaactgatgtcgttcatcaccgaaaaactcagccgctga

SEQ ID NO: 12781 - DNA, 477 bp, Pseudomonas aeruginosa
gcctggatttatgagcagcaagcaaccctcgttgagctacaaggacgctggtgtggacatcgacgccggcgaagccctggtggaacgcatcaaaggcgtggccaagcgcaccgcacgcccggaagtgatgggcggcctcggcggcttcggcgccctctgcgaaatcccggccggctacaagcagccggtgctggtatccggcaccgacggggtgggcaccaagctgcgcctggcgctcaacctgaacaagcacgacagcatcggccaggacctggtggcgatgtgcgtcaacgacctggtggtctgcggcgccgagccgctgttctttctcgactactacgccaccggcaagctcaacgtcgacgtcgccgccaccgtagtcaccggcatcggtgccggttgcgaactggcgggctgttccctggtcggcggcgagaccgccgaaatgcccggcatgtacgaaggcgaagactatga

SEQ ID NO: 12782 - DNA, 1263 bp, Pseudomonas aeruginosa
cctggccggcttctgcgtcggcgtcgtggaaaaggccgagatcatcgacggctccagggtccaggccggcgacgcgcttatcgccctgccctcctccggcccgcactccaacggctactccctgatccgcaagatcatcgaggtttccggcgccgacatcgagcaggtccaactcgacggcaagccgctggccgacctgctgatggcgccgacccgcatctacgtcaagccgctgctgcaactgatcaagcagaccggcgcggtcaaggccatggctcacattaccggcggcggcctgctggacaacatcccgcgcgtcctgccggacaacgcccaggccgtgatcgatgtcgccagctggaaccgtccggcggtattcgactggctgcaggaacagggcaacgtcgacgagaccgagatgcatcgcgtactcaactgcggcgtcggcatggtcatctgcgtggcccagagcgacgccgagaaagccctggaagtcctgcgtgccgccggcgagcaaccctggcagatcggtcgcatcgaaacctgcggcgcggacgccgagcgcgtggtcctgaacaatctgaaaaaccactgatgccgaaactctgcaatgtcgtggtgctgatttccggctccggcagcaacctgcaggcgctgatcgacagcctccgggacggcgccacgccggcccggatccgcgcggtgatctccaaccgcgcggacgcctatggcctggaacgcgcacgccaggccggcatccagaccgaggtgctcgatcacaaggcctatgccgatcgcgaaagcttcgaccaggccctggcacaacggatcgatgcccatgaaccgcacctggtgatccttgccgggttcatgcgcatcctcagcgccgatttcgttcgccattaccaggggcgtctgctgaatatccatccctcgttgctgccgcgccacaaagggctgcatacccatcaacgcgccctcgaagccggcgaccgcgagcacggttgcagcgtgcacttcgtgacggaggaactcgatggggggccactggtcgtacaggcagtaatcccggtagagtcgcaagatacgccggaacgcctggccagacgggttcacgaggaagaacaccggatctacccgctggccatgcgctggttcgccgagggccgcttgcgcctgggcgaacagggcgccctgctggatggccaggccctgcctgccaccggccatcagattcgcaccaaggagattcgcaatgcgtaa

SEQ ID NO: 12783 - DNA, 297 bp, Pseudomonas aeruginosa
cttcggtgcggcgctcagcgatctgaaataaggagaacggccatggaggtgaagatcttcgacacccatgtgcgaacccgcgacggccgctacctgcacttcgatgtcctggtcacggaggagctgggggctcgcgccggcgagttcgctcgacgctggctcgccggaagaggcatagacgaggccgatatcagccaggggcattgcagctactgccatagcgagattgcgacagcagaggttgccgaagccattcggctccatggccattacatccttcccctggaaggctgttga

SEQ ID NO: 12784 - DNA, 963 bp, Pseudomonas aeruginosa
tatcgaaggcatggaaagcaaggcatgagcgtttctctcctggtaaaagtcactctggtgggcctgttcgtcgccagcgtcctgttcgtccatttccgtgggcgcgcgcgcttgcccttcctgcgccaactggtcaaccactccgcctggttcgccccctacaactcgctgatgtacctgttctccagcgttccctcgaagccctatctggatcgcagccgttttccggagctggacgaactgaagaacaattggcaaaccatccgcgaagaagccctcaacctgttcgacgagggttatatccgggctgccctgaacaacaacgaagccggcttcggctcgttcttcaagaaaggctggaagcgcttctacctgacctggtacgacggcccgctgccctccgcccagcagctctgcccgaagaccgtagagctggtgagccgcatccccaacgtcaagggcgcgatgttcaccctgcttcccggcggcagccacctgaatccgcaccgcgaccccttcggcggctcactgcgctaccacctcggcctgtccacgccgaattcggacaactgccgcatctacgtcgacggccagccctacgcgtggcgtgatggcgaagacgtgatgttcgacgaaaccttcgtccactgggtgaagaacgagaccgagcagacccgggtgattctcttctgcgatatcgagcggccgctccgctcccgcctgctgacccgcctcaatcgctggatcagcggcattctcgggcgtgcgaccgcaccgcagaacgtcgaaggcgaacgcgtcggcagcatcaaccaggcctactcggtcgccattcgcggcggcaatgccatcggcgcccaggtgaagcgcttcaaacgcgcctacccgaaggcctaccgaatcctccgcccggtgctggcggtgatcctgctggtcatcctctatcgttggatcttcggctga

SEQ ID NO: 12785 - DNA, 783 bp, Pseudomonas aeruginosa
caacgccggcagggcgacaggaacgtcatccagcagcgacaactgctgcggctccttggccttggcggcacgctcctcggccttcagttcttcccagcgctgcttgaccgccgcttcggccagcttcgccgcatcgggcttgccatagagatcgccatcgaggaatacgtgggggtgtcgacggatcagcttgcgggtgatgccgtccaccacctcgtcgaaagcgaagcgatcctcttcacgagccaactggctgtaatagaccacctggaacagcaggtcgcccagttcctcgcgcaattgcgggaaatccccctgctctatggcgtccgctacttcgtaggcttcttccagggtgtgcgggacgatggtcgcgtagctctgctggagatcccaggggcagccgaattcgggatcgcgcaggcgcgccatgaggtggagcaggtcgtcgagtcggtacatgggtatctcgggtcttcagtgaacggtccgggcattctgccctttccggaaacgaaaaggccacgggcagcctgcgagcgcccgtggcctgtttccacctcgcctcaaggcgtacggttgcgccgcgcctcgatgatgttgggcagttgcgagacgcgcgccagcaggcgtccaagagcgtccagaccgggaatctcgatggtcagttgcatggtcgcggtgttgtcttccttgttcgaacgggtattcaccgccagaacgttgatccgctcattgagcagcacctgggacacgtcgcgcaacaggccggaacgatcatag

SEQ ID NO: 12786 - DNA, 417 bp, Pseudomonas aeruginosa
actaccctccgggcacccagagaactcatttcgcgtaccgcctcgaacgcgccgtcgcgcggcggatcgagcagcacagcggtaaaaccttgctccgcccagggcgcttcggcaagcgctttggacaggtcggcctggaaaaagtgcgcgttgccaaggccattggccagcgcgttggcgcctgcccgctcgaccatcgccgccacgccctccaccccgactacccgcgccacccggcgcgccagcggcagggagaaattgcccagcccgcagaacaggtcgaggacccgctcgtcggcggtcggcgccagccagtcaagggcctggcggatcatcgactcgttcaccggcgcattgacctggacgaagtctccgggtcggtatgccagagtcagttgccagtcacccaaggagtag

SEQ ID NO: 12787 - DNA, 1185 bp, Pseudomonas aeruginosa
gcagaaggcagcaccaggcacaggcgcagccccggatcggcggcttccgcccataggcggccgccctggagcaccacggcgcgacgggcaatgctcagtcccaggccgaagcccttgccggtacgtgccgaagacagccgggtgaacgggcggaagatggtctccaactggtgctcggccacaccctcgccctggtcttccaggcaaagccaccagcaacttccttcgcgccgaccatgcaggcggatcacgccgccttccggcgaatgccggatggcgttgcgcagcaggttctccagggcctgggcaagtgcattgaggttgccacgcacgacacaatcctcgggcagatcgctgcggaaccgctcggcggcccagccgctttcgaagcgtgcgttctccaccagcaggtcccataacgccgggatggaaatgtcctccagcgccaataccgggcgttcggtgtccatccaggccagctccagggtgttgtccaccagttgctgcatgccctgtacctcctgctccaggcgctcgcgcaggagctgcgcggacagcgtgccctctgccgccacctgcaggcgcgccagcggcgtgcgcagctcgtgggagagatcgcggagcagttggcgctgcaacaccatgtgctcgtcgagtcgctcggccatatggtcgaacgcccgccccagatcgcccagctcgtcgctgcgccggctgatctctgcctgcgtacgcgccgtcaggtcgttgccgcgcagggcattggcctgcgctcgcaggcgtcccagcggcactatccagcgccgatacagcaacactcccagcagcagggccagcccggccggcaccaggccatgggtgaccaggcgcttggccggcgacaagccgggagggacgaactcggcgggaagacgcaggaccacccggccttgctccggatgttcggggaagcgcaggctgatgaacggccgcgacaacgagcgggagctcatcggccagtcgacgccccgcaggaaagtcaggcgctcggcttcctccgtggtgagcggacgactgcccagcgattgcaaccgtccgtcgagcacgaccacccagtccagcgcccgctggcgcggctcggccagccaacggtcgatgccctcgcggccatcgtcgagccaggcacgttcggctcgccgcgcataa

SEQ ID NO: 12788 - DNA, 2844 bp, Pseudomonas aeruginosa
actgcgcggggtaaacgtatggccggggagcgtcggccatcccgatctggctcgacggagagacgtgtgttcaaggatctcggcatcaaggggcgcgtactgctgctcaccctgctccccaccagcctgctggcgatggtgcttggcggttacttcacctgggtccagctgtccgacatgcgcgcccagttgatcgagcgcgggcaactgatcgccgaacaactggcgccgctggccgccaccgcgctggcgcgaaaggataccgccgtgctcaaccgcatcgccaacgaggcgctggaccaaccggacgtgcgcgcggtgaccttcctcgacgcccgccaggaacgcctcgcccatgccgggccaagcatgctcaccgtcgccccggccggcgacgccagccatctgagcatgtccaccgaactggacaccacgcacttcctgctaccggttcttggccgccaccacagcctgtccggcgccaccgagcctgacgacgagcgcgtactcggctgggtcgaactggaactgtcgcaccacgggactctgctgcgcggatatcgcagcctgttcaccagcctcttgctgatcgccgccggcctcggcgtcaccgccctcctcgccctgcgcatgagtcgcgcgatcaacgcgccgctggaactgatcagccagggcgtcgcccagctcaaggaaggccgcatggaaacccgcctgccaccgatgggcagcaacgagctggacgaactggcctccggcatcaaccgcatggcggaaacgctgcagagcgcccaggaggaaatgcagcacaacatcgaccaggccaccgaggacgtacggcagaacctggaaaccatcgagatccagaacatcgagctggacctggcgcgcaaggaggccctggaggcgagcaggatcaagtccgagttcctcgccaacatgagccacgagatccgcaccccgctcaacggcatcctcggtttcacaaacctgctgcagaaaagcgagctcagcccgcgccagcaggaatacctcacgaccatccagaaatcggcggaaagcctgctggggatcatcaacgagatcctcgatttctcgaagatcgaggccggcaagctggttctggaaaacctccctttcaatctccgcgacctgatccaggacgccctgaccatgctggctccggccgcccacgagaagcaactggaactggtcagcctggtctaccgggataccccgatccaattgcagggcgacccgcagcggctgaagcagatcctcaccaacctggtcggcaacgccatcaagttcacccagggcggcaccgtcgccgtgcgcgccatgctcgaggacgaaagcgacgaccgcgcgcagctgcggatcagcgtacaggacaccggtatcggcctctccgaggaggaccagcaagccttgttcaaggccttcagccaggccgacaactcactgtcgcgacaagccggtggcaccggcctgggcctggtgatctccaagcgcctgatcgagcagatgggcggcgagatcggcgtcgacagtacgccaggggaaggcgccgagttctggatcagcctgagtctgccgaaaagtcgcgacgacaacgaggagccgggcgcctcctgggccgcgggccaacgcgtggcgctgctcgaaccgcaggaactgacgcgccgctcgctgcaccaccagctcaccgacttcggcctggaagtgagcgaattcgccgacctcgacagcctccaggaaagcctgcgcaacccgccgcccggccagttgccgatcagcctggcggtgctcggcgtctcggccgcgatccatccgccggaagagctgagccagtcgttctgggaattcgaacggctcggctgcaagaccctggtgctttgcccgaccaccgagcaggcgcaataccacgcgaccctgcccgacgaacaggtcgaggccaagcccgcctgcacccgcaagctgcaacgcaagctgcaggagttgcttcaagtccgcccgacgcgcagcgacaagccccacgccatggtttccggacggccgccacggctgctctgcgtcgacgacaacccggccaacctgctgctggtgcagaccctgctcagcgacctcggcgcccaggtcaccgcggtggacagcggctacgcggccctcgaggtggtgcagcgcgagcgcttcgacctggtcttcatggacgtgcagatgcccggcatggacggccgccaggccaccgaggcgatccgccgctgggaggccgagcgggaagtcagcccggtgccggtgatcgcgctcaccgcacatgcgctttccaacgagaagcgcgcattgctgcaggccggcatggacgactacctgaccaagccgatcgacgagcagcaattggcccaggtagtgctgaagtggaccggactgagcctgggccagtcgctggccagcatgagccgtgcgccgcagctcggccagttgagcgtgctcgaccccgaggaagggctgcgcctggccgccggcaaggccgacctcgccgccgacatgctggcgatgctgctggcctcgctggcggcggaccgccaggcgattcgccaggcccgcgacaacgacgaccgcaccgctttgctcgagagggtccaccggctgcatggcgccacccgctactgtggcgtgccgcagttgcgcgcggcctgccagaccagcgaaaccctgctcaagcagaacgatccggcggcggccgcggccctggacgagctggacaaggccatcgaggccctggccgacactgcctcggccaccacccacctgtcctccaccagcctcgactccagcgaactctga

SEQ ID NO: 12789 - DNA, 1995 bp, Pseudomonas aeruginosa
catccatttcattcccgcttgaccaccacgtccctaggcttccgcatcctcgcccggagacgcttgatgttcgccccacccagcaccgagacactcaaccgcttctttctgttgtcgtggctggtggtgctctggcaggtgctgcgcctgcaggacgggatcgtcttcgacgacgcctggctgccgctctggagcgtcgctgccagcctgagctacgccttcctttatatagtcccggtgtacctcgcctgccgactgctcctgcatttccatgatcgccttcccgtgcgcctcagtccgtggctggcaggcgtgctggccatcgtcggcagcgcggcggtacagatactgctctacgccgaccgcaccctctacgacctgtacggattccacctcaacggtttcagcatcggcctgctggtctcgcccggcggcctctccagcctcggcagcggcgacggcaccctgctcagcgcaagcctggcggccctggccctgctctgcctgcaggtgctgctgtacagcgcctgccaggtcagccgcgagcgccttcccgcgctccctcggcgcgcctggcgctacctgttggcggccttcctctgcctggccctgggcgaacgcctggcctatgcgttcagctccctgcgcgactaccggccgatcctgctggccagcgaacgctatccgctttacctgccattgaccgtccgcagcctggcgcgaagcctgggcatccagccgacgcccacccagcgcgagctgctccagcagcagagcgacctgcactatccgctccggccgctggagatcagcgccccggcgcacccattgaacatcgtctggatcgtcgccgagtcgctccgcggggacatgctcgatccgcgctacatgcccaggctgtgggacttctccaaccgggcgatccgcctggacaaccactacagcagcggcaacctgacccagatgggcgtcttcggcatgttctacgggctgcacggcggctactgggacgccgtgctgaaggccggccagccgccggtgctcatggaggtactcaggcagcagaactaccagttccggatcaatgccgcgcaacgtttcagctatccgcccttcgaccgcagcgtgttcgtcaacctgcgcccccaggacctgcacgtgctggatagcccggagcctgcctggcagcgcgacgcccggaacaccgacgacctgctgcgcttcgtcgatcgccgactacccgaccggccgttcttcgcctgcctgttcctcgagtcgagccacgccaactacagcttccgcgacgagaccgcgaaaatccgcccctatctggtcaacttcaactacctgaccaccgatttccaggcgcagatgccgctgatcaagaaccgctacctgaatgccgtgcgcgaagtcgatacacagatcggccgcctgctgcagcacctggaaaaccagcacctgctggaaaacaccgcggtagtggtgctcggcgaccatggggaggagttcatggaacgctcgcgctggggccacaataccgagttcaatcgctatcagaccggcaccgtcgccgtgctgagcattcccggacaggcgccccgtgccgtccgcggcatcaccagccacatcgacctgcccgcaacgctcctgccgctgctgggcgtacacaatccgccccgcgactactcgctgggacaggacctgctcgcagcggactaccatcgcgactatgcggtgagcgccgataccacgcgcatcgcctacctgggcgaaggcttcaaggtgagcttcccactgcgtggcgcggaccgtcaccacggtccggtgagcgatggcgacgaccgcccgctcgacgtggaacaacaggaagccatacgcggcccactccgtgcagcacgcctggaactgctgcaggatctcggccgcttcagcgccttgccggtaggggaagagccgtcgccgcggaacctcgcgacttcgttgacgccatga

SEQ ID NO: 12790 - DNA, 1101 bp, Pseudomonas aeruginosa
ggagcatcagaacagcctgagttgttcgtgggcgccctgcaggtcgagcaggcgcacgccgacgccgatcaggcgcaccggacgattgccacgggcaaaggcctggccgagcaattgccggtagctctccaggtcgcgcccggcgccggactgttccaccgtggtctgggtgaaattgtgaaacttcagtttcacgaacggcttgtccggccgataactgccatccaggcgttgcaggcgtccgtccagctcctcgagcagggtcggcagttcctccaggcaagccgccaggtccggcaggtcgcgatcgaaggtacattcgacgctcaccgactggcgccggctgtcgacttccaccggtcgctcgtcgataccatgggccaacccccacaggcgttcgccgaagctgccgaactcgcgcaccagactcagcttgctgccctggcgcaggtcggcgcaggtgcggatgcccatccgcgccaggcgctccgccgtgaccttgccgacgccatgcaacttggccaccggcaactcggcgacgaacccgtcgacctgctccggggtaatcacgaacagcccgtccggcttgcgccagtcgctggcgatcttggccaggaacttgttcggcgcgacgcccgccgaaacggtgatgtgcagctcctcggccacccggcggcggatgtcctgggcaatccgcgtggcgctaccggcgaaatgcggcgaagcgctgacgtccaggtaggcctcgtccagcgaaagcggctcgatcagatcggtataatcgcggaagatcgcatggatctgcttcgacaccgcccggtagacatcgaaacgcgggcgcaccaccagcagatcgggacacagcttgagcgccgtgcgcatggccatcgccgagcgcacgccataggctcgcgcctcgtagctgcaagtggcgaccactccgcgcttgtccggcgaaccgccaaccgccagcgccttgccgcgcaggctggggtcgtcgcgcatctcgagggcggcatagaaacagtcgcagtctatatggatgattttccgcaccggaatctcgctacaagccccgccgggcctgccccggagcgctga

SEQ ID NO: 12791 - DNA, 2742 bp, Pseudomonas aeruginosa
caggacgccgccccgcacagaaaaaatctgctgcgaccacttgggaactcgcccgagaggccatactctgtcgcgcaaattcccatgaggtggctgatgcgcaccgacgctcccgttccagaacatcccgctccacccagctctcccgcgtccccacaacgcatccggctgatcgatcggattaccgcctaccgccagcccatcggcctggtcttcaccttgctgctgttcggcctggcgctggtggcctgctaccacctgctacgggagatcgatcccggcgccctccacgatgccatcgccgacgtgcccaggccggcgctgctcggcgccctgagcgcgaccaccctcggcttcgtcatcctgctcggctacgagtggtcggccagccgcttcgctggcgtcacgctgcccatgcgcagcctggccaccggcggcttcagcgccttcgccatcggcaatgcggtaggcctgtcgctgctttccggcggctccgtacgctaccgactgtattcccggcatggcatcggcgctgccgaaatagcccggatgacgctatttgccagcctttccctgggctgcgcactgccggtgctggcggcactcgccgcactctgcgacctcgacgatgcggcgtcggcgctgcacctgccccgcgccctggtcgccgtcatcgcgatcgccgtcctgtcgctggctgtcggcctggtggcgttcctggcccggcaccgtctgccgggagaacggccgtcccccgacagcctgctggtccgcctcggccgccgcagcctgcgcctgccaggcctgcgcctatcgctgctgcaactgctgatcaccgccctcgacgtcgccgccgccgctaccgtcctttatctgttgctgccggaaaccccacccttcgcggcgttcctgctggtctacctgctcgccctggccgccggcgtgctcagccacgtaccgggcggagtcggggtgttcgaggcggtgctgctggccgcgttcgccggccaactgggcgccgcgccgctggccgcggccctgctcttgtaccgcttgatttatgtggtactgccactgctgctggcctgccttttgttgctgttcctcgaagcgcgccggttgtgggtgacgcgccaggcgatccgcgtcgcctcgggtttcgccgcaccgatcctggcgatcctggtcttcctctccggtgtcgtgctgctgttttccggcgccacaccggcgatcgacacccgcctggaacacctcggtttcctcattccacatcgcctgatcgatgcctcgcacctggtcgccagcctgatcggcgtgctctgcctcctgctcgcgcagggtttgcgccgacggctgtcggccgcctgggccctgaccctggtgctgttgctggtgggcgccctgctttcgctgctgaaaggcttcgactgggaggaagccagcctgctgagcctgaccgccgcgctgctcgccatgttccgccgctccttctaccgtcccagccggctgatggaagtacccttctcgccgctttacgtaggcgccagcatctgcgtggtcggcgcctcggtctggctgctgctgttcgccaaccaggacgtgcattacagcaaccagctctggtggcagttcgccctggacgccgacgccccgcgcgccctgcgcgccgccctcggcagttgcctgctgctcctggccctggcccttggctggctgctgcgcgcggcaccgccggcgatccgcgagccgaacgcggaagagctgcagcgcgcggcgcggatcatccgccactcggaccagccggatggcggcctggccctgaccggcgacaaggccctgctcttccatgagagcgacgacgctttcctcatgtacgcccgccgcggtcgcagcatgatagccctgtacgacccgatcggcccggccatgcagcgcgccgaactgatctggcaattccgcgacctctgcgaactgcaccatgcccgcccggtgttctaccaggtgcgtgccgagaacctgccgttctacatggacattggcctgaccgccctcaagctcggcgaagaagcgcgagtcgacctgctgcgcttcgacctggagaacaagggcaaggaaatgaaagacctgcgctacacctggaaccgcggccagcgcgacggcctggccctggagttccatgaaccgggccaggctccgctggacgagctgaaggcgatatcggacgcctggctgggcggcaagcaggtgcgcgagaaaggcttctccctgggccgcttcaccccggcgtacctgaacttcttccgcatcgccatcgtccgccaccagggcaagccggtggccttcgccaacctgctggaaaccgacagccgcgaactggcgagcctcgacctgatgcgcgtgcacccggacgcgccgaagctgaccatggagttcctcatgctcggcctcatcctccactacaaggcccagggccacgcgcgcttcagcctcggcatggtgccgctggccgggctccagccaaggcgcggcgcgccgttgacccagcgcctgggcgcgctggtcttccggcggggcgaacagttctacaatttccaggggctgcgacgcttcaaggacaagttccagcccgactgggaaccccgctacctggccgtgccagccgggctcgacccgctggtggccctggccgataccgccgcgctgatcgccggcggcctgactggattggtgaaacgctga

SEQ ID NO: 12792 - DNA, 933 bp, Pseudomonas aeruginosa
tatgtctgtcgtgaaacgtcactggcgccgttttctggtcgccgccctggtgctgatcgtcggtgccgccctgctgctctggagccgaccggcggcccaggcgaaactggaagccctggacctcgacgacggcggccacgccacccttgccgaacccggcgagaagccgcgctcgcgggtggtggtgatcgccgcccccgaacagcaactgaacgacgcccagatgctgaacctggctcacgacagcgccgcccgggtgatccagtacttccctccggaaaacggcgattgcagggcgcagcagtcccggctcgaagcggtcattgcccgcctcggcggcaagccgaacctggtcgccggcatcggcccgggctcgaccaccgcctggcgctggctcgccagccaggacgacgacaaggccaaggcgctctcggtcggcttcgacattgccctggccgagcgcgactgcgacgccccgctgccgcaccaggcgtcgcacggccagtggctgctggcctggaacgacaacccggacgacgacaccgcagtcttcgtccgcaagcagtcgagcgcggaaaccagcatcagcgactacgacaccccgctgtccgacgtgctcgcccatcagttgcgcctgcaactgcaaggcaacgccgaggccctgccggtactcgaggtccccgcggcgcaaccctcggacatcgtcaccctgttctattccggcgacggcggctggcgcgacctggacaaggactctgccgagcatatggccagcatgggctacccggtggtcggcatcgacaccctgcgctactactggcaacacaagagcccggaacagagcgccgccgacctctccaagctgatgcaacactaccgcgagaagtggggcgcgaaacgtttcgtcctggccggctactcgttcggcgctga

SEQ ID NO: 12793 - DNA, 513 bp, Pseudomonas aeruginosa
agagccccgccccgcggggctttttcatcgccaaccgttccggagagcacgatgctcaacaacgacgtactacgcagcctgcgctacctgctggatcttcccgacgcacatctggccgaactggccgccccgttcggcgagcaagtcgaagcggacctgctcgaggcttacctgaagaaggaagacgaagacggcttccaggcctgccccgaccgctacctggcgcgctgcctggacggactgatcatccagcgccgcggtcgcgacgagtcgcgtccgctaccgccgctggagctgccgttgagcaacaacatgatcctgaagaagctgcgggtcgccttcgaactcaaggaggaagacctccatgccatcctcgacagcgtcgacttcccggtctccaaacccgagctgagcgccctgtttcgcaagcccggccacagcaactaccggacctgcggcgaccagttgctgcgcaacttcctcaagggcctgaccctgcgcgtccgtggctga

SEQ ID NO: 12794 - DNA, 642 bp, Pseudomonas aeruginosa
acgcgcggagccactgctggcggttctgctccaggcgccgccctgcgccgacccctggttcctggagtgccgccaggatcgcgccggcctgaccatcctcgtccgcgacctcgccaaccagcgcacctggcgcgtcgagttcgtcgaagtcgaaggcctgcgccagctcgacgctgccgacctgctggaattctggccagcctgtgcggcatccgagggttggctgtaccgggtcgagcaaggcggctggctggaccaggaatgccgtcgcgagggcttcgtcgcccgcgagaccaaggccgtcgacgagtatttcgtcaatggcggcgatcgctgcctgagcgtgctgtcctggtcgccaccgaaggtttccccgctgatctgaccgccatgaaaaaagccgcccgtgggcggcttctcgcgtggcgctccggctacatcaggaagatcgtcgccaggccgaggaagatgaagaaaccgccgctgtcggtcatcgcagtgatcatcacgctggagcccatcgccggatcgcgtccgaaacgatgcagggtcatcgggatcagcactcccatcatcgccgccagcagcaggttcagggtcatcgcggcggtcatcaccacgcccagttcccagttgccgtaa

SEQ ID NO: 12795 - DNA, 465 bp, Pseudomonas aeruginosa
aaggccaccacgccgatcactccgccccacgccaggccgttgaccagcgcgacgccaagctccttgcgcagcaggcggttgcgactgttgctggtcggctgtacctggtcgagcgcgatggcgcggacgatcatggtgatggtctggttgccggaattgccaccgatgccggcaacgatcggcatcagcgcggccagcgccaccagtttctcgatggagccttcgaacaggccgatcacccgcgaggcgacgaaggcggtgatcaggttggtggccagccaggcccagcggttgcgcaccgacttccagaccgaggcgaagatatcttcttcttcacgcagaccggccatgttgaggacttcgctttcgctttcctcacggatcaggtcgaccatctcgtcgatggtcagacgaccgatcagcttgccgcccttgtccaccaccggcgcggaaatcaggtcgtaa

SEQ ID NO: 12796 - DNA, 747 bp, Pseudomonas aeruginosa
gtccatgggggtgttccaagggccctctcggggcagatacggataatgataacactccgcttgcgttttgcgcgttacaaaatggcggcaagaacaagcgcttgcggcacaaagttcatcgtcactcgacgcctgactgcgacgccggaaatttcactcaggacactcggccccgcggaaaaaggcaacgcgttagcctgcactcacccttatccgacccggagtgccgcccatgcgttccctgtccctccttctcctcctctcgctggcgtccacctgcgaggccgctgcggtattccgctgcgaagacgccagcggccatgtcagcttcacccaactcggttgccccgccgggcaggccggcgagaccgtcgtggcggacaacccgccgccgggaggcaggagcgtcacgccgatggccgagacgaagacgaaaaaggcgtccatcggccggaaaagcgtgccgctcgcggtgatcggagaaagagaagatcgctgcggcagacgcctggacgagaaggaacgccgcaaggcgatcgtggagcagcggataatggcgggaatgacccgctccgatgtggagcgggcgctgggcaagccggaccgggtcagcgggaacaatgcggaggtgcgttatcagtacaaggccgacaagcgacggggagcgagaagcgtgagcttcgatcaggagggatgtgtgaagggaagagaaggtaccgggtggagcgagtcgatcccgggagctaa

SEQ ID NO: 12797 - DNA, 3147 bp, Pseudomonas aeruginosa
aagttcctgccgaacggtcaaaaacgacaaaaggcgcggggttgccgcgcctttcgcctgccagcgtcactcaccctgtcgcgccggcgcgtcgagctcgaacgccgtgtgcagggcacgtaccgccagttccaggtacttctcttcgatcaccacggaaaccttgatttccgaggtggagatcatctggatgttgatgctttccttggccagcgcctcgaacatgcggctggccacgccggcgtgcgaacgcatgccgacgccgacgatggaaaccttggcgatgttggtgtcgccgatggcttcgcgcgcgccgatgttggcggcggtctgcttgaggatttccagggcgttcaggtaatcgttgcgatgcaccgtgaaggtgaagtcggtggtgttatcgtgcgccacgttctgcacgatcatgtcgacttccacattggcggcactgatcggcccgaggatcttgaaggccacgccgggggtatcgggtacgccacggatggtcagcttggcttcgtcgcggttgaaggcgatgccggagatgatcggctgttccatggattcctcttcatcatcgatagtaatgagggtgcccggaccctcctggaagctgtgcagcacgcgcagcggaacgttgtacttgccggcgaactcgaccgcccggatctgcagcaccttggaaccgaggctggccatttccagcatttcctcgaaggtgatcttgtccagccgacgggcctgcggcactacgcgcggatcggtggtgtagacgccgtcgacgtcggtgtagatttggcattcgtcggccttcaacgccgccgccagggccaccccggtggtatcggaaccgccgcggcccagcgtggtgatgttgccgttgccgtcgacgccctggaaaccggcgaccaccactaccctgccggccttgaggtcggcgcggatgtgggtgtcgtcgatgtgcaggatgcgcgccttggtgtgcgcactgtcggtgaggatacgcacctggttgccggtataggagaccgccggcacgccgcgcttgatcagggccatgctgagcagggcgatggtcacctgctctccggtcgagaccatgacgtccagttcgcgcggaaccggctgctccatgatctggttggccaggccgatcagacggttggtctcgccgctcatggcggataccaccacgacgacgtcatcgcccgcttcgcggaatttcttcaccttctcggccacctgctcgatacgctcgacggtgccgacggaggtccctccaaacttctgtacgatcaaagccatttcaaaccgcctgattccgtgaagggcgcccttttgaacctgccacattctttcgctacccggactggcggggcgcaccgccggccgggcatcaaggggcgctggccgcccggccccgcatcgctctggcgcggggccggcatggcatcagagcccttgctcgacgaagcgctgggccagggccagggcctcgtccaatttcgctgcatcggtgccgccgccctgggccatatccgggcgtccgccacctttgccaccaactgccgccgcggcttgcttcataagctcgccggccttcagttggccggtcaggtcctgggtcacgcctgcgaccagtacgaccttcccgtccagctcgccgccgagcaggatcactgcgcggccgagcttgttcttcaactggtcgaccagcgccagcagcgccttgccgtccagaccatcgaggcgcgcggcgagtaccttcgcgcccttgatttccaccgccgccgccgaaaggtcgtcgccggccgcgctggcagccttggccttgagctgttccagctccttctccagcgagcggttgcgctccagcagggcgccgagcttgtccagcaggttgtcgcggctgcccttgaccaggctggcggcttccttgagctgctcctcggcaccgttcaggtaggccagcgccgccgcgccggtgaccgcctcgatacggcgtacgccggcagccacgccaccctcgctggtgatcttgaacaggccgatgtcgccggtgcgggatacgtgggtgccaccgcacagctcgacggagaaatcgccgcccatgctcagtacgcgcacctggtcgccgtacttctcgccgaacagcgccatggcgcccttagccttggcggtgtcgatatcggtttcctcggtctcgacctcggtgttgcgacggatttcggcgttgacgatatcctccagggccttcagttgttccgccttgatcgcctcgaagtggctgaagtcgaaacgcaggcgctggctgtccaccagcgagcccttctgttgtacgtggtcgcccagtacctggcgcagcgcggcatgcagcaggtgggtcgcggagtggttgagcgcggtggcctggcgtaccgaagcgtcgacctcggccttgaccgcgccgccgacgctcaggttgccccgggcgaccacgccatggtgcaagtgcgcgccgccagccttggtggtatcgcgcacgtcgaagcgcacgccagccgcctcgaggtagccactgtcgccgacctggccgccggactcggcgtagaacggcgtctggtcgaggaccacgacgccctcctcgccctcctccaggcgctcgacggcctggccgtccctgaacagcgcgacgatctgcccggcgccggagacgccctgatagccgaggaagcgggtctcgccgtcgaccttgaccaggctgttgtagtccatgccgaaggcgctggaagcgcgggcgcgctcgcgctgggcctccatctcgcgctcgaagccgtcctcgtcgatggtcagctcgcgctcgcgggcgatgtcattggtcaggtcgaccgggaagccataggtgtcgtacagcttgaacaccacgttgccgggaatcacgctgccctgcagttcggcgaggtcctgttcgaggatcttcagggccttgctccagggtcttggcgaactgttcttcctcggtcttcagcacgcgctcgatgtgtgcctgctgttgcttcagctcggggaaggcatcgcccatctcggcgaccagcgctgcgacgatcttgtggaagaaggtgcccctggcgcccagcttgttgccgtggcggcaggcgcggcggatga

SEQ ID NO: 12798 - DNA, 360 bp, Pseudomonas aeruginosa
cccagttcgcgcagcccgtcgcccaggcgcgcggcgttggcgtggtcgtcggccaggcgtgccacctggtggtcgagggcgtacaggccggcagccgccaacaggccggcctggcgcatcccgccgccgaccatcttgcgccagcgacgggccttgccgatcagttctacgctgccgcaaagcaccgagcccaccggcgcaccgaggcccttggacaggcacaccgacaccgagtcgaagtgtcgggtgatctcgctggcgtctacgcccagcttcaccgccgcgttgtacaggcgcgcgccatccaggtgcagggccaggccacgcgcgcgagtgaaggcgcgcgccgcggccaggtag

SEQ ID NO: 12799 - DNA, 474 bp, Pseudomonas aeruginosa
acaggtaggacttcaccgcgtcctccaccgcgacctggtcgcgcggcacgcagatggcgcggaagcggccgccgcggcggcccagcttgtcgtgcagttcggcaaggaccttctcggtatcgaggaaggcgtcctcgtgatggaacagcacctcgccattgcccaccgagatcacatcgttgtggaacacgccctggtcgatcaccgccgggttctgttgagcgtagaccactccggcctcgctcagcccgtgcagacgcgcgacggcctggcaggcttccagggtctggcgcgccggatagcgttgcggcgccgggaagcgactgtcgaaggcgctgcgaccgaagacgaagaactccacgccggcatcgccatagtccttgcagaagcgcgtgtggttggccgcgccttcgtcgccgaactggctcactgccggcagcgccgcgtgatgggcgaaatgccgctcgtcgttga

SEQ ID NO: 12800 - DNA, 1068 bp, Pseudomonas aeruginosa
gctgatcccgggagtcagggtggcaggaagggacacgctggggctttccagcgaggcgaccggataggcgcagtaatcggcggcgtagtaggcgctcggccggtggttgccggacgcgccgataccgccgaacggcgcgctgctggcggcgccggtgagctgcttgttccagttgacgatgccggcgcggctttccacgaggaactgctcgaaacgctcgcgggaatccgacagcaacccggcggccaggccgtactgggtggcgttggcttcacggatcgccgcagcgaaatcggagtagcggatcacttgcaacagcggcccgaagaactcttcgtccggtcgctcggccaccgcgctgacgtcgaggatgcccggggtcagcagggcggcgccgtcgatcggctgggtcatcgccagcagcggctgtgcgcccttgccgatcaaatgctcctgggccttgagcaggtgctcggcggcgctcagcgaaatcaccgcgcccatgaacggcgccggctgttcgtcgaagcgaccgacccgcagggtagcgctgaccgccaccaggcgcgccagcagtgcgtcgccccaggcgccctgcggcaccagcaggcggcgggcgcaggtgcaacgctggcctgcggagatgaaggcggactggatgatggtgtagacggcggcgtcgaggtcggcgacctcctccaccaccagcgggttgttgccgcccatctccagcgccaggattttctgcggctggccgccaaactggctgtgcagcaggttgccggtgcgactggacccggtgaagaacagaccgtcgagcccacggtgggcggccagcgcgacgccggtttcgcgaccgccctggaccaggttgagcacgccggccggcaggccggcctggatccaggccttgagcgtcagctcggcgaccttcggggtcagctcgctgggcttgaacaccacgcagttaccggccagcagcgccgggacgatatgcccgttgggcaggtggccggggaaattgtagggaccgaatactgccaccacgccatgcggcttgtgccgtag

SEQ ID NO: 12801 - DNA, 1740 bp, Pseudomonas aeruginosa
cacggcggtagcgtcggccagcggaccggatttctcgccagtgcgctcgcggaacgcctgcaccgagatcgccaccttgttgaccatgctggtcacttcggtggccgactcccacagcggcttgccggtttcctcgccgatcactcgggccagctcgtcggcgcgggacttgagggtcgcagcgaagcgctcgagcaactcgatgcgctgctccagcgggcgccgcgcccaggccgggaaggcctcgcgggcggcgcgcacggcagcgtcgacctgggtgacgtcagcgccgcgcccggaccagaccacgccctggccaaccgggtcgagggactccagggtctcgccctggcccgccagccactggccggcaatgtaatgggtactcatcatcgactcctcgggcgccctcgccgggacgcctccatcaggctttcaaccgcgcttctgcgccgacagcggcaccgcgcgtaccgaggcgccggccgacaggcgcaggcgcttggcagtcagcggatcgaccaccagggtgccggcggcggcccgcgccggcgcggcggtgatgcgacagtcttcgcgcttgcggttgtggatcaggtagggctcggcgtcgtcgccgggagtgcccaccgccagcaccaggttctggctctcggcgatggcgcggatcttgtcggtctcggcctcgatcgccgggccggcgtcgaagatgtcgacgtagccctggtagctgaagccctcggccttgagcatggccagcgccggctcggtgttcggatggacgcggccgatcaccccgcgcgcctcctcggagaggaagcaggtatagagcgggaacttcggcatcagctcggcgatgaaggccttgttgccgaccccggtgaggtagtcggcctgggagaattccatcttgaagaagtgccggccgaggctttcccagaatggcgaacgcccctcctcgtcggacatgccgcgcatctcggcgatcagcttgtcgccgaacaggtgacggaattcggcgatgaacaggaagcgcgcgcgcgacagcagcttgccgttgaggccgctgcggtggtcggcgtggaggaacagcgagcacagctcggaattgccggtcaggtcgttggccaggaacagcgtggggatctcgcgatggatgttgagttcctgcgaggcgctcacggtgaggccgacccggtagttgtaccagggttcgcgaagccccaccgctccggcgatggcggagatgccgacgaccttgccggcgtcgtcctcgaggacgaacaggtagtcggcgtcgccgcgttcggcctcgccgcggaaggccttctcggcccagctgacgcgatgctgcaggcgctgctcgttggccggcagggtggtcaggccggtgccggtgctgcgcgccagctcgatcagggccggcaggtcggcgctggtaacaggacgtacgatcatgactggctccttcagaccgctaccaggcgcacgctggcgccttcgccgacgcccagggcctcggcggcttcaacactcagggccaccggcttgccgggcgcccagtccaggtccagcacgaccgcgcggaagtcctgcaactggccgttggtgaccaggtatggacgcccgctcttcggcgcctcgccgatcttcaccggaaccacccggctctgggcgatcgagcgaatccccgaggtacgcgcgtgcagggtcgggccgccatcgaagatgtcgatgtag

SEQ ID NO: 12802 - DNA, 723 bp, Pseudomonas aeruginosa
ctcacctccgcggcgaacgaggcctcggaagcgaggatcttgtcgcgcaggcgttcggcgtcatccggcaaggacgtgacgcctaccgggctgtccgccgccagacgctgcacctgtggcaggtcggccgcttgggcggggcgcatcaccaacatggcgtcactcctttctcagacaacgatgattgccgcatccatgcgcgggaccgcggcaccttcctgtgccacggtttcgaacgtccagcagggaagatcccgcgccacgcacggcggcacggttcccggctccggcgcgggccgctccgggatgtcgcatcgggtgccccggcctgcgccggggccccgtgggttcgctcagccgcggaccagcttggccacggcgcgctcgaagcgctccaggccttcgtcgatctcggcgtcgtcgatcaccaggctcggcgcgaagcgcaccacgtccgggctggcctggagcaccatgaccgcctctttctcggcggcgttgagcacatccctggccttgcccttccactcgtcggtcagcgccgcaccgatcagcaggcccatgccgcggatctcgtcgaagatgccgtactcctggccgatcttctgcaggcgggacttgaagcgctcatgcttggccttcacgccatccagcacttccggggtattgatcacgtccagcgccgcctcggccaccgccgacgccagcgggttgccgccgtag

SEQ ID NO: 12803 - DNA, 444 bp, Pseudomonas aeruginosa
ggattgggaccgggccggcattgccgccatgcgacaacttgttatagcgccaacccgggaatttccgcggctttcggaaatgcgacagaaagcatcgggaaggcgcagtgtaaacgcgcgatgcactcgggtgcatacttcttctacgccgccccgcgggcgggaacagcagggaaacaagccatgcccatcgagggaatcgactaccgtctcgtcttcgcctccgacgtcaatccgcgcgacggcctcggcctggagtgctggcgcggcgaacagccgctgttcgaggtctttcgcgacgacgtcggccggcgtttcgtggtcaacctgttcgccagcgacgttccgctggaactgctggagacgatcattccgacggcccgtcgcgaactcggcgacttcccgaggcgatccacctcccggggcgtcgcaaagcccggctga

SEQ ID NO: 12804 - DNA, 783 bp, Pseudomonas aeruginosa
agcggaaggctgtcccagatgacggagaaatcgaagatcacgatagggccccttgactcacagttccgcggttttcacgccgaccgaatagcggcgttcgagcaggcgcagcaacagcagcgacacgctggtcaccagcaggtacaggccggccacggcgaggtagtaggtgaacggctcgcgggtcgcatcggaggcctgcttggccttgaacatcatgtcctgcaggccgaccacggaaatcagcgcggtggccttgaccagcaccagccagttgttggtgaagccggggatcgccaggcggatcatctgcggcacctggatgcggaagaacacctggcggtggctcatgccgtaggcgtagccggcctcgccctggcccttgggaatcgccatgaaggcgccgcggaaggtctccgagagataggcgccgaagatgaagccgagggtgccgacgccggacacgaagggattcaggtcgatgtagtcgtcgtagccgagttgcggggcgacccagttcagcaggccctggccgccgtagaagatcagcaggatcagcaccaggtcggggatgccgcgcactaccgtggcgtacaggtcgccgcaccaggccagccagcgcaccggcgacaggcggaaggccgcgcccagcaggccgaggacgatggccaggagcatggaaagcagggccagctggagagtcagccaggcgccatcgacgatggtcgcaccgtagccagtgatcatcaaaacggtacctctatgcagctaatgcagcgctaa

SEQ ID NO: 12805 - DNA, 666 bp, Pseudomonas aeruginosa
gtcaccaggatcaggaacagcagcaggatcatcagccacggcagcgccgcgcggatggtcgccccaagcggcatgccggtgaccgccgaagtgacgaacaggttgaggccgaccggcgggtgtaccaggccgatctccatgttcaccaccatgacgatgcccaggtggatcgggtcgatgcccagcttcatggcgatggggaagaagatcggcgccaggatcagcacgatcgccgagggctccatgaagctgccggcgaccagcagcaccacgttgaccatcagcaggaagccgatcggggtcaggccttcctgcaccacccattcggtgatctgctgggggatctgctcggtggtcaacacgtgggcgaagagcatggcattggcgatgatgaacatcagcatgatgctcagccgccccgactccagcagcaccttgggacagtcgcgcaggcgcatgtccttgtacacgaacagcgcgacgaaggccgaatacaccgccgccaccgccgccgcctcggtgggggtgaacagcccggaatacatgccgccgaggatgatcaccagcaacaacaggccccagcctgcacggcgtgcggcggccagccactcgcggaagctggcgcgcggctgcgccggcagcttcttgacccgcgcgacgatgtag

SEQ ID NO: 12806 - DNA, 231 bp, Pseudomonas aeruginosa
ccggagcggaccatgccggccacagcgatcgagccgaccgccgccactgtcgccggcgacgaaccggacagcgcggcgaacagcatgcaggcaagcaccgcagcgatcgccaggccgccgcggatatgcccgacgcaggcattggcgaagtcgatcaggcgccgcgccacgccaccggtggtcatgaacgcgccggagagcaggaagaacgggatcgccagcagggtgtag

SEQ ID NO: 12807 - DNA, 618 bp, Pseudomonas aeruginosa
agttcgccgagaagcgttcgtcgtcggccagttccgggcggcgcaggaccttgtcgcagaaggcccgccactcgcgctcgttctgcaggccgagcatcaccgtgccgccgtcgccggcggggaatggcccataggggtagatggtcgagtgcgaagcgccggcgcgcggcggcggcggcgcgtcctggtaggcgtagtacatcgggtagcccatccactccaccaggctctccagcatcgacacgtcgatgcggctgccctcgccggtgcgctcgcgcagcagcagggccgaaaggatgctgctgtaggcgtacatgccggcggcgatatcggcgatcgaacagccggccttggccatctcgttcggcccggcgccgccggtcaccgaaaggaagccgccctcgctctggatcagcaggtcgtaggccttcttcttctcgtagggaccgccttcgccgtagccggagatatcgcagacgatcagtcgcgggaagcgctcgcgcaacgcctcgtaggacaggcccaggcgcgcggcggcgcccggcgcgaggttctgcaccagcacgtcggcgccggccagcagcttctccagcaacggcagcgcctcggcctgcttga

SEQ ID NO: 12808 - DNA, 1212 bp, Pseudomonas aeruginosa
gcaccaggtggtcgagacggtcgatctgcatgggcggctcccgcttcagaacgagcgcggcagttcgagcaggtgctcggccacgtaggacaggatcaggttggtggagatcggcgccacctggtacaggcgggtctcgcggaacttgcgctcgacgtcgtactcgcaggcgaagccgaagccgccgtgggtctgcaggcaggcgttggccgcctcccaggaagctttcgccgccaggtacttggccatgttcgcgctggccccggcgttgagcccggcgtcgtactcctggcaggcgcgccagcgcatcaggtcggcggcctccacttcgatgtgcgcctcggcgatggggaactgcacgccctggttctgccctatcggccggccgaagaccacgcggtcgcgggcatagtggctggccttgtcgatgaaccagcggccgtcgccgatgcattcggcggcgatcagggtgcgctcggcattgaggccgtcgaggatgtagcggaagcccttgccttcctcgccgatcaggctatcggcggggatctccaggttgtcgaagaacagctcgttggtctcgtggttgaccatgttggcgatcggctgcacggtcaggcccttgccgatggcctcgcgcaggtcgacgaggaagatcgacatgccttcggacttgcgcttcacctcggccagcggcgtggtgcgcgccagcaggatcatcaggtcggagtgctggatccgcgagatccacaccttctgcccgttgatcacatagcggtcgcccttgcgcacggcggtggtcttgatcttggtggtatcggtgccggtggtcggctcggtcacccccatcgactgcaggcgcagctcgccgctggccagcttcggcaggtagaagcgcttctgcgcctcgctgccgttacgcagcaacgtgaacatgttgtacatctgcccgtgcacggtgccggagttgccgccgcagcggttgacttcctccaggatcaccgaggcctcggccaggcccagaccggaaccgccgtactcctccgggatcatcgccgagagccagccggcgtcggtcagggccttgacgaaggcctcgggaaaaccgcgctgctcatcgatgcggcgccagtaggcggcgtcgaattcggcgcagagggcacgtacaccctcgcggatcgcgttcagctcttcgctgttcggattcatcggtga

SEQ ID NO: 12809 - DNA, 264 bp, Pseudomonas aeruginosa
agagcgagttcaccgagtacggcagcgacgccgccgggcatatccgcatcttcgccaataccaccgcggtcaccgaattccttccggaaatcctcgccggcttcctcgccgctcgtcccggggtcaccgtcgacctgcaggaacgcctcagccgcgacattgtccgcggcgtgctggacggctccaccgacctcggcatcatcgccgggccggtggcggccaccggcctgcagatcctgcatttcagcaccgaccgcctggtga

SEQ ID NO: 12810 - DNA, 1230 bp, Pseudomonas aeruginosa
tcgaggagttgcagagggtgggagacagcctgtagggcggataacgcccctggcgttgtccgcggggctccggagaatcggcggacaaccgccaggcggttatccgccctacgactcccgacaagccggggtgcgatcgtcgcgaagggcgccgcccaccactcccgctcagttcgccaacccaccgctctccgccaggctgtgctcgtccgcggcgagcatcgccggcatgtgctcgcggaggaactcgacccaggtgcggatcttcgcatccaggtactgccgcgaggggtagagggcgtagacgttgagatggaacaggctatagcgcggcaacacccgcaccaggctgccgtccttcaggccgttgaccgccgcgtacaccggcagcgcgccgatacccatgccggagaccaccgcctcggtcatggcgtcggcggtgttgacttggaaatgcgtctggttgatgcaggccagttcctggccgtcgggaccgtcgaacagccagcggtccagcgacatcaccgagttcaccaggcgcaggcaacggtgcgcggacagctccgccggcagcttggggaagccatgcgcggcaatgtagcccggcgaggcgcagaggatgctgtaggtctggccgatgcacttggagacgaaaccggagtccggcagctcgggggcgatcaccacggaaatgtcgtagccttcgtcgagaatgtcggtgatccggttggccagggtcaggtcgaagccaacctccgggtaggtctcgcaatattgcgagatggccttgatcaggtagtgctggccgatgccggtcatcgcgtggaccttcagcgtgcccgacggccgcgcatgggcgtcgcccgcctcagcctcggcctcctcgatgtaggcgagtatctgctgggcgcgcatcaggtagcgctgcccggcttcggtcagcgcgatgcgccgggtggtgcgatgcagcaggcgggtctgcaggtgggcctccagcttggccaccgcacgggagacataggcggtcgtcaggtccaggcgctgggcggcggcagtgaaactgccggtctccgcgacgctgacgaacgcgcgcatattgaacaggatatccatcacggccctctaggctctgacgcttatggcgcgtctcttttccacgcaacccggaggacaccccaaggcggcgcagattctgtcacgagtcaacccacctattattgccttttgtga

SEQ ID NO: 12811 - DNA, 2298 bp, Pseudomonas aeruginosa
caaaaatttttcacctatccgagctcttatccgcaagcgcgggcgctcctagaattcccagccgtttcggcctcccctcgccgtcgttcaggattcgcagcagtgccccgcgccacccggaaaggtctccccctggttccaccggctcccctcgcgttctttcccagccccgacgaattgcgccgcgccctgctcgaatgggcgcgtagcgacggcgtcgcctgggtcttcgtgttcaaggccctgctcaccgccagcctcgccctgtggctggcctatcgcctggagctgccgcagccgagcacggtgctggtgacggtcttcatcgtcatgcagacgcagagcgggcaggtcctggccaagagcttctaccgcatcgtcggaaccctgatcggcctcagcgtgatggtcactctgatcgccctgttcgcccaggagcgcgtgctgttcctcgcctgcctggcgctctgggtcggcctgtgcaccgccggcgccgcgcgctaccgcgatttccgcggctacgcctgcgtactcgccggctacaccgcgaccatgatcgggattccagccaccgcgcacccggaaggcgctttcatggcggcgctgtggcgggtcctggaaatatccctgggcatcctctgcaccggtaccgtcagcgccatcttcctgccgcagaccagcggcgccgccctgcgcaacacactctacgggcgcttccgcgacttcgccgggttcgccgccgaaggcctgcagggcagcctcgacggcgagcgcttcggcgagctcagcgcgcgcttcgtcgcccagtccgtgggcctggaaaacctgcgcagcgccactactttcgaagatccgcacatgcgcctgcgcagcggccggctgattcgcctgaacaacgaattcatggtcatgaccagtcgcttccacggcctccaccgcctactcgaacgcctgcgcgggcgcggggcgcagaatgtcctggaggtcctggcgccctgcctggcggagcttgccgggctgctcgcgccgattcgcgaacggacgcccaccgacgccgacgccgcgcgcctggccgaacgcatcgaggcctacaagccggaactgatgcagaacatccgccaggcccgccagcgcctggtggagcagcgccccggcgagaacgacctgctggatttcaacaccgccgccgaactggccttccgtttcaccgacgacctgcacaactacgccctgacccacgcttccctggccgaacaccaccatgcccgcgagcaatggaaggaaagcttcgtcgcccgcgccaacccggtcgccgcgctggtcgccggagcgcgcagcgcgctgatgatcggcctgctcggcacgttctggatccagacctcctggccccacggcggcaccttcgccctcaccgcggtactgatctcggcgctctcctcgacctcgccgaatcccggccggttgtcgctgcaactcaccctcgggaccctcgccggggcctgcaccgggctgttcgtgctgctctacctgctaccccacgtggacggtttcccgatgctgctctgctgcctgctgccggtcttcgcggtcggcgccctgctgctctggcggccgcagtggaacggctacggcgtcggcctactggtgtggttctgcttcgcctcgctgccggccaacatggcgcgctacgacgccctggccttcttcaacgaatacctggcactactcttgtcgatggtcctcgccacggtcgccgccatggtgatcctgccgccgaaccggccgtggatgtggaagcgcctggagcacgacctgcgcgagcgggtggtgttcgccatcagcggcaagagcaagggcctggtctccggtttcgaaagcggcacccgcgacctgctgaaccaggcctacaccttctccgccggccgcccggacgtgcaacgccggttgctgggctggatgttcctggtgctggaggtcggccaggcgatcatcgagctgcgcctcgaacagcaacgcctgccccaggagccctgctacgccgaacgcaccgcctggcgccgggcgatccgcctgatgggccgggcgctgatccggctgttcctgcaacccgggccgagcaaccgccagcgcgccctgcacgcggtgaaccaggcgatcatggcggtacgggcggcgccggagccgcgcgcaccgcagttcgatacctcgccgctgcgacgggtgctcagctacctgcacttcattcgcagcgccctgctcgacccgcaatcgcccctgggccaggaaagaaacccgtga

SEQ ID NO: 12812 - DNA, 261 bp, Pseudomonas aeruginosa
aggtcctggcggaattcgcccttggcgcagagttcggacaggtctacctgggtggcgcagatcacccgcacgtccaggtacacctcctcgtcgctgccgacccggcggaaacagccgtcctgcaggaagcgcaacagcttggcctgcaggcgcgggctcatctcgccgacgccgtcgaggaacagcgtgccgccggcggtaagctccagcaggccgagcttgccctccgggcgggcgccctcgaaggctcccggaccatag

SEQ ID NO: 12813 - DNA, 927 bp, Pseudomonas aeruginosa
ggaaaactttacgaaaacgccgattcctccccgttgcccggtccctatccggggctgcacggaccgtcccgacgcggtatcgataaggcaacgacaacaacaaagaccccgcggccacaagccgctcatggagtccgtatgaaaacaacgcagtacgtggcccgccagcccgacgacaacggtttcatccactatccggaaaccgagcaccaggtctggaataccctgatcacccggcaactgaaggtgatcgaaggccgcgcctgtcaggaatacctcgacggcatcgaacagctcggcctgccccacgaccggatcccccagctcgacgagatcaacagggttctccaggccaccaccggctggcgcgtggcgcgggttccggcgctgattccgttccagaccttcttcgaactgctggccagccagcaattccccgtcgccaccttcatccgcaccccggaagaactggactacctgcaggagccggacatcttccacgagatcttcggccactgcccactgctgaccaacccctggttcgccgagttcacccatacctacggcaagctcggcctcaaggcgagcaaggaggaacgcgtgttcctcgcccgcctgtactggatgaccatcgagttcggcctggtcgagaccgaccagggcaagcgcatctacggcggcggcatcctctcctcgccgaaggagaccgtctacagcctctccgacgagccgctgcaccaggccttcaatccgctggaggcgatgcgcacgccctaccgcatcgacatcctgcaaccgctctatttcgtcctgcccgacctcaagcgcctgttccaactggcccaggaagacatcatggcgctggtccacgaggccatgcgcctgggcctgcacgcgccgctgttcccgcccaagcaggcggcctga

SEQ ID NO: 12814 - DNA, 1065 bp, Pseudomonas aeruginosa
aaaaagtcttgtgggccgccgggacacgcaaaggagcgctcccctctcctctgcgcgccggcgccccatcgatcactcggtgaccggcttcacccgcaggcccggcatcggccgcggggctcccttgagtcggtagcaggcccacatcaccagcagccagaccgggatggcatagaccgagacctggatgccggggatcagcaacatgacgccgaggatgaacaccacgaaggccatgcacaggtagttgccgtacggataccagaacgcgcggaagtgcgtgcgggtgccctggcggtccatctgcgcgcggaacttcaggtgcgccatgctgatcatcgcccagttgatcaccaacgccgccaccaccagcgacatcagcagctccagcgcctggtgcgggatcacatagttcaccaccaccgcgaggaaggtcaccagcgccgataccaccagggcgcataccggtacgccgcgcttgtcgaccctggccagcgcgcgcggggcatcgccctgctcggccaggccgagaagcatgcggccgttgcaataggtgccgctgttgtacaccgacagtgcggcggtgagcaccacgaagttcagcaggtgcgcggcggtgccgctgccgatcatcgagaagatctgcacgaacgggctgccgctgtaggcatcgccggaagcgttgagggtctgcagcaggctgtcccagggcgtcagcgagagcagcacgatcagggcgccgatgtagaagatcaggatgcgatagatcacctggttgatcgccttcgggatcaccgtcctcggcttgtccgcctcggccgcggtgaagccgagcatttccaggccaccgaaggagaacatgatgatcgccatggccatcaccagtccgctcactccgttggggaagaaaccgccgtgtgcccagaggttgctcaccgaagcctgcggaccgccgctgccgctgaacagcaggtagcagccgagcaggatcatgccgatgatcgccaccaccttgatgatcgcgaaccagaactcggcttcgccgaaggccttgacgttggttag

SEQ ID NO: 12815 - DNA, 429 bp, Pseudomonas aeruginosa
gttgatcgcgttgacgacgacgaagaacaacgccgccgtggcccaggtcggcacctccggccaccagtagtggatgtacttgccgaccgcggtcagttccgacatcccgaccaggatgtacagcacccagcagttccagccggagaggaagccggcgaagccgccccagtacttgtgcgcgaagtggctgaaggagccggcgaccggctcctcgacgatcatctcgccgagctggcgcatgatcatgaaagcgatgaagccggcgatggcgtagccgaggatcatcgacgggcccgccgacttgagcaccccggccgagccgaggaacaggccggtgccgatggcgccgccgagggcgatcaactggatgtgacgattcttcaggccgcgcttgagctcgcccgaatgcggatgttggccgtccattga

SEQ ID NO: 12816 - DNA, 1398 bp, Pseudomonas aeruginosa
cgtgaatgggccgccaggctcgtggctcggcggtgcgggcaaggctggcgcgatcggcgccgctggaacggaaacgcggagcgcaaggaaaaccgccagccccggaacaggctggcggcagcgggatcagatcacgccgcggcgaatctgatcttcctcgatggactcgaacagggccttgaaattgccctcgccgaaaccctggttgcccttgcgctggatgatctcgaagaagatcgggccgatcaccgtgtcggtgaagatctgcagcaggatgccgtcgtcgcccggggcgccgtcgatcagcaggttcagttcgcgcagttgctcgagcggctcgccatgcccggcgacgcgggtgtcgaccttctcgtagtaggtgtccggggtcgacatgaacttcacgccgttgtcgcgcagcttgcgcacggtggcatagatgtcgtcggtggtcagggcgatgtgctggatgccttcgccatggtattcgcggatgaattcctcgatctgcgaggtatcgtcggccgattcgttgatcgggatgcggatcttcccgcaaggtgcggtcatggcgcgggagaacaggccggtgagcttgccttcgatgtcgaagtagcgaatctcgcggaagttggcgatgcgctcgtagaaaccggaccagacgtccatctggccgcgcttgacgttgtgggtcaggtggtcgatgtaggtcaggccgaccgagttgtcgttggcgctgcggccttcgatgaactcgaagtcgacgtcatagatgctgcggtcgccgtagcggtcgacgagatacagcagcgaaccgccgatgccttccaggcaggggatgttcagctcgccgaagttggcgtggctgcccaccagcttggcaccctgggattcggcgtaggcggcggcctgggaagcgttcttcacccggaaggccatggcgcaggcgctcgggccgtgcttgagggcgaattcgtggacatgcccggtcgggctgccgttgagcacgatgttgatatcgttctgctggaacaggaagacttccttggaacgatgcttggcggtttcggtgaagcccatcatgttgaacagctggcgcagctgctcgatgcccttggcgtcgggggcggtgaactcgacgaattcgaatccgtcggtaccgatgggattgtgctgttcgatcttggccacggcgttcatccggcctcctcgttgttcttgttgaatggaccgccgccggtccaggcggccggcgacatgggagatgccttcatctcaccccgtggcggcgcggcggacaagccgtcggcaggacccggcgcagggcctggcgcagggtttctggcaactattccttacgcgccggcggcatgcatggcgaacgcccggtcttcgtaa

SEQ ID NO: 12817 - DNA, 819 bp, Pseudomonas aeruginosa
cctgcgtctttcctccgcgacggcattcccatggcacgacccgccccacccgacctgagcgacagtcgccggcccctgcgcggggtcgcccgcagatatcctgccgggcaccgcgtcgatgcccacgagcacgcctggggccaggtgctttatgcggtgtccgggatgatgtggctggagacgcccgacgaggccctgccggtcccgccgcaacgggcggtctggttgcctccgggcctgcgccatgcggtgcgggtcgcctccgagttgcagatgcgcaacatttacctgagcccggaactctcccgcggcctggaggaccgcaccctggtgctggtggtcggcccgctgctgcgcgagctgatcgtcagcctggtggagcaggaacggcagagcgaccccgactactatcgggcgctggccgatctcgccgtgctcgaactcggccgcgcgcgccgttccagcctccgcgtaccgctgccggacgcctccgacaggcgcctgctcgcgctgtgccaggcggtgatggccaatccctccctggacatcggcctggagcgcctggctgaagacgccggggccagcgtgcggaccctctcgcgcctgttccagcgcagcctgggcatgggctttgccgactggcggcggcaggtgcagctggcgaccgccgccgccgcactgatcgatggccgtccggtggcaggcatcgcccatgccctgggatatacgccgagcgccttcagcgacatgttccgccgcgagctgggcgtctctcccaccgagtacagggccgagcatcaccagccgttccagccttga

SEQ ID NO: 12818 - DNA, 1146 bp, Pseudomonas aeruginosa
tctccctcggcatcggcctgctggtcggcgcgctctacgccgtcctcgacttccgctcgccggcgccccccgccatcgccctggtcggcctgcttggcatgcagctcggcgaacagcttttcccccttggccgcgacctgctgcagcagtggctgcactgatcgccgcgacgacacggagcccccgatgaaagcactgcaattcgaccgtaccggcgacctcgccgccctcgagctggtggacatgcccgacccgcttcccgccgccgatgaggtgcgggtggaaatccgcgccgccgggctgaatccgagcgacgtgaagaacgtcctcggccgcttcccctataccaccctgccccgggtaccgggccgcgacttcgccggggtggtggtggagggaccgaaggctctgctcggccaggcggtctggggcaccgggcgggagccgggattcttccgcgacggtagccacgcgcagttcctgaccctgccggccgccggcgtcgcgctcaagccggaaagcctgagcttcgcccaggccgccagttgcggggtgccctacagcaccgcctgggacgccctgcaacgcagccaggtcaaggccggcacccggctcctggtaatcggcgccaacggcgcggtcggcaaggccgcgctggcgctggccaaggccctgggggccgaagcgatcggcgcgatgcggcgcgaggagcaacgccaggcgctggaaacgcagggcatcgccgcgctgctgctgggcgagccggccgaactggcggcacaggtggaagggatcttccccggcggggccgaggtgatcttcgatacgaccggtttctggctcgaggcggcggtcccggcgctggccgccttcggtcgcctggcgatcatcgccgcaccggccgacggccatgtgcgcctacccgcattgaacctgtaccgccgcggtggctcggtggtggggatcaactcgctgctctatggcgtggaagcctgcgcaggcttcctcgacgccttcggcaagctgttcgaccagggccgcctgccgctgccggacgggctgcgggaagtcccgctggagcagggcgttgagcagtaccgggcagtgaacgaaggcacctgcgagaagatcatcctggtgccttga

SEQ ID NO: 12819 - DNA, 1317 bp, Pseudomonas aeruginosa
ggttgggtagatgtgtccgtgggacccgacattctgcgcctaagttcgaaatccgctcaagcgcggcgccgaatatcgggagaatcctatccggcgcccgcccgctccatgccgtctactatcagttctgtagtgggtacttgccgccttccttccgcagccggcatgcttgcgtcagcctgtcacatggatgtgttagatgaacggaaccgccgccgataccctcgccgtatcgcccccgcccctgcgcaacctctgcgacggccacggccggctcgatccccgggcggtcggctggtccgcccggccgcgggtgctctgccacatccccggccacttcggccggcgcaagcgctggaaccactggtgcatcgtcagccccggctggatgctctcgctgaccatcgccgacctcgactacctgacctacggcgccgcctatttcctcgacctggacagcggccaggcggtagcgcacacgcagatccgcttcttcggcctcggctgccagttgcccgacgagccgcaggccagccatgccttcgagcatccccgcctgcaattgcgcttcgacgaacagcccgggcgcctgcgcgtcaccggccaggccccggacctcggtggcctgccgctggagctggcgctggaagtgcgacgaccgtcgcacctggagtcggtgaacctggtggtgccgatgggcgaacacaccttccatgcctgcagccgccagctcggcctgccgatcagcggctgcctgcagctcggccgccggcgctacgactgccaggcgggccagagctttgccgcgctggacttcggccgcggcgtctggccgctgcatacctactggacccgcgccgccttcgccgcccccggcggcatcgccggcaacttcggcaccggctggaccgaagccagcgacctgcgcgagaacgccctgtggttcggcggcaagctcagccgcgtgctcgacgacgtgcacatccgcgagcctcgcgacccgctggccgaatggcgcctggacagcgcctgcggtcgcgtcgagctgctcttccgtcccgaacagctgcaccaggcgcggcccagcgtcggcctgttctatgccaatacccgccagtggttcggccgtttcaacggcaccctgcgccacgacgacggcgactgcgtgccggtggacggcgccctcggctggatcggttcgacccgcgcgcgctggtgaggccggcggcgggcaatctatttccgacccgcagcgcggcgaaaaatgcccacgaggaagcgacggcagcggaacccaaggcgggagcgaaggcctaa

SEQ ID NO: 12820 - DNA, 1425 bp, Pseudomonas aeruginosa
actgccggatacgcaccctggagaacactcatgagccggaccgaaaccgatagcctgggcaccatcgaggtgcccgacgacgcctactggggcgcccagacccagcgttcgctggagaacttcgccatcggcggccagcgcatgccgctcgccgtgatccacgccctggcgctgatcaagaaagccgccgcgcgggtcaacgaccacctcggcgaactgccgccggaagtcgcccggctgatcgaacaggccgccgacgaagtcctcgcaggccgccacgacgaacacttcccgctggtggtctggcagaccggcagcggcacccagaccaacatgaacgtcaacgaggtgatcgctggccgcgccaacgaactggccggcaatccgcgtggcggcaagtcgccggtgcatcccaacgaccacgtcaaccgcgcgcagagttccaacgacagcttccccaccgccatgcacatcgccgccgccaaggccgtgcacgaacaattgctgccggccatcgccgagctttccggcggtctcgccgaacagtcggcgcggcacgccagcctggtcaagaccgggcgcacccacctgatggacgccacgccgatcaccttcggccaggaactctcggccttcgtcgcccagctcgactacgccgagcgcgccatccgcgcggcgctgccggcggtctaccagttggcccagggcggcaccgcggtgggcaccgggctcaacgcgccgaagggcttcgccgacgccatcgccgcggaaatcgccgccgaatcgggcctgcccttcgtcgccgcgccgaacaagttcgccgccctggccggccacgagccgctggtcatcctctccggcgccctgaagagcctggcggtggccctgatgaagatcgccaacgacctgcgcctgctcggttccggcccacgcgccggcttcgccgaggtgaagctgccggccaacgagccgggcagctcgatcatgcccggcaaggtcaacccgacccagtgcgaggcgctgtcgatgctggcctgccaggtcatgggcaacgacagcacgatttccttcgccgccagccagggccatctgcaactcaacgtgttcaagccggtgatcgtctacaacctgctggagtccatccgcctgctcgccgacggctgccgcaacttcaacaagcattgcgtcgccggcctggagccggacgcccagcgcatggccgacctgctggagcgcggcctgatgctggtcaccgcactgaacccgcacatcggctacgacaaggccgccgaaatcgccaagaaggcctacgccgaaggcaccaccctgcgcgccgcggcgctgcagctgggctacctggacgaagcgcagttcgacgaatgggtacggccggagcagatgctggaggccggccaccatggttga

SEQ ID NO: 12821 - DNA, 1464 bp, Pseudomonas aeruginosa
aaccgccaagaccggcgccaccccgctggaaggcgacggcaagcgcatcctgctgatcgtcggctcgcccaagcgcaagagcttctgccacctgctcgccgaatgctacgcccagggcgcgcgcagcaaggatcacgtggtgcgcgaactgaagctgggcgagctggccttcgacccgatcctccacgaaggctacgaacagagccaggtgctcgaacccgacctgctggaagcgcagcggcagatccactgggccgagcacctggtgttcgtctacccggtctggtggggcggcctgccggcgttgctgcagggcttcttcgaccgcgccctgcagccgggcttcgccttccgctaccgcggcacccaggacaaggactgggagcaactgctgggcgggcgcagcgccgacctgctggtctgccacgaccagccgctgtcgcggctgcgcttcctcaagggcccgccggcgcaccggcagatggtgcgcagcgtgctcggcgcctgtggcatcgccacccgccgcctggaagagttcgcgccgatgcgcagttccagcgaggaacagcgccagggctggctgcgtcgcgccgaacagctcggcagccaggtctagttcccttcccgcccggctgcggccgggcgcggacactgatcgttctgacaggtccgccaccttcccgccggcttcccttccccgcccccatggcggccctttgcctgcctctaccggctcacagtgcgggtgccgaccgctttgcattccgcgacatccatcaggaatgggtagcgaatctgaccggcccgtcacatttggtagggacctcaaaccggcaccgagggctaggatcagcccgcttcgaaatgaatccggttctggaaaaaaggacttgtcatgaaacactactcagccaccctggcactcctgccactcaccctcgccctgttcctgccccaggcagcccatgcccacggctcgatggaaacgccgcccagtcgggtctacggctgcttcctcgaaggtccggagaatcccaagtcggccgcctgcaaggccgccgtcgccgccggcggcacccaggcgctgtacgactggaatggcgtcaaccagggcaacgccaacggcaaccaccaggcggtggtccccgacggccagctctgcggcgccggcaaggcactgttcaagggcctgaacctggctcgcagcgactggcccagcactgccatcgcgccggacgccagcggcaacttccagttcgtctacaaggccagcgcgccgcacgcgacccgctacttcgacttctacatcaccaaggacggctacaaccccgagaagccgctggcctggagcgacctggaacccgcgccgttctgctcgatcaccagcgtcaagctggagaacggcacctaccggatgaactgcccgctgccccagggcaagaccggcaagcatgtgatctataa

SEQ ID NO: 12822 - DNA, 996 bp, Pseudomonas aeruginosa
gctggtccgaccaccagcacggggaaaccacgcatgcctttttctctcgccgccctccaacaggccgccgccatcgtccaccagagcctgccgccgacgccgcagatacgctggccgctgctatgcgaggcactgggttgcgaagtgtggatgaagcacgagaaccacctgccggtgggggccttcaaactgcgcggcggcctggtgtatttccaccacctggcgcaccagggcgagcggccggccgccgtgatcagcgcgacccgcggcaaccacggccagtcggtggccttctcggcgagccgctacggcatccagccgatcatcgtcgtgccgcacggcaacagccgcgagaagaacgcggcgatgcgcagccttggcgcggagctgatcgagcacggcgaggacttccaggcctcccgcgaatacgccgccgagcgcgcccggcgcgaaggcctgcacctgattccggcgttccatccctggctggtggccggggtcgccagctacagcctggagttgttcgccgcgctggccgaccttgacgaactctacgtgccgatcggtatgggttcgggcatctgcggcctgatcgccgcgcgcgacgcgctgggcctgaagacccgcatcgtcggcgtggtgtccgcccatgcgccggcctacgccctgtcgttcgaggccggcacggcgatcagccacccggtcgacacccgcctggccgacggcatggcgtgcagtacgccggacccgagcgcgctggaaatgatcctggccggcgccgatcgtctggtgcgggtcagcgacagggagatcggcgcggccatgcgcctgtgcttcaccagcacccacaacgtcgccgagggcgccggggtggcggcgctggccgccgcctggcaggagcgcgagcgcctgaaggggctgaaggtaggcctgatcctcagcggagcgaacgtcgaccgcgaggtattcgccgagcaactggccgccggcgactga

SEQ ID NO: 12823 - DNA, 786 bp, Pseudomonas aeruginosa
aagcggggccaccaaagcacatggggaaggcttggaaggagcggtcgccccgggaaaaggtcggccgggcaaatttcgcgcccggcatcgggatcacagtgcctcggcgttctcggccaggtacgaggccacgccctcggcgatcgccttcatgcttttctggcccttgcgccagccggccgggcagacctcgccgtgttcctcggtgaactgcagggcctcgaccaggcgcaccatctcgtccacctcgcgccccagcggcagattgttcaccacttggtgctggaccaccccggcgcggtcgatcaggaacgaagcacgcaaggccacgccgtcctcgtgctcgatgccgtaggcgcgggtgatctcgtgcttgacgtcggcgaccatggtgaactcgaccgcaccgatgccgcccttctccaccggcgtgctgcgccaggcgtgatgggtgaactgcgagtcgatggagacaccgaccacctcgacgcccagctcgcggaacttatccatgcggttgttgtgggcgatgatttccgaggggcagacgaaagtgaagtcgagcggccagaagaacagtacgacgtacttgccgcgcaggctggaaagctggaaggcatcgacgatggaaccgtcgccgaggaccgcggcggcagtgaaatcgggggcttgcttgttgaccagtacgctcatcgcgaggctcctagaaggttgggttgcgcccggcgacgccaggctcccggaagaatatgcagcgcaggttacccagccacgacgatgcattga

SEQ ID NO: 12824 - DNA, 2280 bp, Pseudomonas aeruginosa
cgcgccggcgaagggcgcgatcctcgccggctacttcctcgaccgggaacgcctggccaacctccgcgaacagatgcaggccgacctgcaaccgatgcccaacatcgccaccgactccacctggaagccgctgcgcagccgcagcggcagtacccacaaccaggccctgctcagcccacggcggttcatcggcgaacatgtccagcaggtctcggtgcagtacctgagttccagcggcgagccgcagctgcgcttcgacatcaccaagaaacgcctgctctacatccagggcgagaaggccatcaacttcttcctcggcgcctccctgctggtcgcgctgggcgctttcctggtcggctacctggccctggagctgtgggtcctgcgccgggtccaacggctcaaccgggaggtcgccgaagtcggacgcaacgcccactcgatacgcctgagcgacttcggcaacgacgagctgggacaactggcgggcgagatgaaccagatgctcgagcgcctggaacacagcgaggcgcgcgaccgggcgatcctccagtcgatgcgcgacggctacttcgaaatggacgtcgacggcgtgatcctcaccgtcaaccccgcgctctgccaactgctcggccagacgcgcgaaacgctgatcggccatccctactacgaactgctcggcgaagacgacctggcgcgtgcccgccaacccttccagcgcgccatgcagagcggcgcaggcaagaccttcgccatccccctgcagcgcgccgacggcagcctcggctacttcgaggccacggtttcgctgatccacgacctgcagggcgaactacggggctaccgcggcatcgtccgcgacgtcagcgaccagatcgcctaccagcagcaattgctggaaatggcctaccgcgacccgctgaccggcctgggcaaccgcaaggccttcgacgaacagctcggccaggcgttgcttcgcgccggctccggcggaagcgaactggcgctgctgtacctggacctggaccgcttcaaggaggtcaacgaccgcttcggccacgacatcggcgatgccctcctcaggaccgtcgccgaacgggtacgcagcaccctgcggcagccggacaaggcctaccgcctgggcggcgacgaattcgccgtgctcctcgaggacagccaggaaaacaatccgcagcgcctcgcagaacgcctgctggcggcgctggtccaaccgatcgcgctgaatggcgaacgcatcgacttcgtcaccccgagcatcggcatcgctctctacccgcggcatgccggcgatgccgaaggactggtccgtgccgccgacagcgccatgtacgaggccaagcgccagcgcaaccactattgcctgtaccaggcgccagcctgaaatgcgcggtcaaacaggctctgtcgcgggctttcgccagtctgctaaggtttcagcccgcatcccatcggagaaccattccctatgccagccctgagcggcccgcaatacctcggcgaaggcctgaagctgatcatgcgtcccggcctgcgcctgttcgtgctgatccccctgaccctcaacctgctggtgttcgccctgctgatcggcttcgcgatgcagcagttcagccactgggtcgacctgctgatgcccagcctgcccgactggctgagcttcctgcagtacatcgtctggccgttgttcgtcctgctggtgctggtgatcgtgttcttcaccttcaccatggtcgccaacatcatctccgcgccgttcaacggcttcctctcggaaaaggtcgaggtggtggttcgcggccgcgacgacttcccgccgttcagctgggccgaactgctggcgatgatcccgcgcaccatgggtcgcgagatgcgcaagctcgcctacttcctgccgcgcgcgctggtgctgctggtgctgagcttcgtgcccggggtcaacctgatcgccacgccgctgtggatcctcttcggcatctggatgatggcggtgcagtacatcgactatccggcggacaaccacaagctcggctggaacgagatgctcgcctggctgcgcagcaagcgctgggcgtgcatgggtttcggcggggtgacctacctggcgctgctgatcccgctggtcaacctggtcatgatgcccgccgccgtcgccggcgccaccctgttctgggtccgcgaggaaggcgagaaggcgctggtgaaataagcatgcgcccggtgtccgctgtcggcattgtcaggcgggcgtcagcgccctga

SEQ ID NO: 12825 - DNA, 2061 bp, Pseudomonas aeruginosa
ccaccgtccccagcccgcccagcggcggaaaacaagaagagggtcgccatgtcacgttccgcattcaccgcgctcttgctgtcctgcgtcctgctggcgctctccatgcctgccagggccgacgacctgccctaccgcttcggcctgggcaaggcggacatcaccggcgaagccgccgaagtcggcatgatgggttactcctccctcgaacagaagaccgccggcatccacatgcgccagtgggcgcgtgccttcgtgatcgaggaagcggccagcggacgtcgcctggtctacgtcaacaccgacctggggatgatcttccaggccgtgcacctgaaggtcctggcccggctcaaggcgaagtaccccggtgtctacgacgagaacaacgtgatgctcgccgccacccacacccactccggtccgggcggcttctcccactacgcgatgtacaacctgtcggtgctcggcttccaggaaaagaccttcaacgccatcgtcgacggcatcgtccgctccatcgagcgggcccaggccaggttgcagcccggccgcctgttctacggcagcggcgagctgcgcaacgccagccgcaaccgttcgctgctgtcgcacctgaagaatccggacatcgccggctacgaggatggcatcgacccgcagatgagcgtgctcagcttcgtcgacgccaacggcgagctggccggcgcgatcagttggttcccggtgcacagcacctcgatgaccaacgccaatcacctgatctccccggacaacaagggctacgcctcctatcactgggagcacgacgtcagccgcaagagcggtttcgtcgccgccttcgcccagaccaatgccggcaacctgtcgcccaacctgaacctgaagcccggctccggtcccttcgacaacgagttcgacaacacccgcgagatcggtctgcgccaattcgccaaggcctacgagatcgccggccaggcccaggaggaagtgctcggcgaactggattcgcgcttccgtttcgtcgacttcacccgcctgccgatccgcccggagttcaccgacggccagccgcgccagttgtgcaccgcggccatcggcaccagcctggccgccggtagcaccgaagacggtccaggcccgctggggctggaggaaggcaacaatccgttcctctcggcccttggcgggttgctcaccggcgtgccgccgcaggaactggtgcaatgccaggcggaaaagaccatcctcgccgacaccggcaacaagaaaccctacccctggacgccgacggtgctgccgatccagatgttccgcatcggccagttggaactgctcggcgcccccgccgagttcaccgtgatggccggggtgcggatccgccgcgcggtgcaggcggccagcgaagcggccggtatccgccatgtggtcttcaatggctacgcgaatgcctatgccagctacgtcaccacccgcgaggaatacgccgcccaggaatacgaaggcggctcgaccctctatggcccctggacccaggccgcctaccagcagttgttcgtcgacatggcggtggcgctgcgcgaacgcctgccggtggaaacctcggcgatagcgccggacctgtcctgctgccagatgaacttccagaccggagtagtggccgatgatccctatatcggcaagtccttcggcgacgtgttgcaacaacccagggaaagttatcgcatcggcgacaaggtgaccgtcgctttcgtgaccggacatccgaagaatgacttgcgcaccgagaagactttcctggaagtggtgaatatcggcaaggatggcaaacagacacccgtgaccgttgccaccgataatgactgggatactcaataccgctgggagagagtgggtatatctgcctcgaaagcgactatcaactggtccattccaccagggaccgagcccggccattactacatcaggcactacggcaacgcgaagaacttctggacccagaagatcagcgaaatcggcggctcgacccgctccttcgaggtgctcggcaccactccctag

SEQ ID NO: 12826 - DNA, 792 bp, Pseudomonas aeruginosa
agtgtggctgttacgcagcagccagggctggtacgacctcagcgtgaccgccagcaatacggaagccaactatctccgccgcctggccggacacgtcgagaccggcaagccgagcaggagcgatccattgctcgacatcgcagcgacctgaagcgaggagtccatcgcatgagacctaccctgacctggaccttgctggccctgctgctctgcggcacggccatcggcgccgtcctgttgctttacccatcggagccggcgcccgtcgcgcccttcgcgtctcccccgcaggccacaccggcggcaaaaccttccattccttcccgagcccccgagatgaatacagccaccgctcccgacaacctggaacagcaactcggcgagttcggccgcaacgccgggcagatgtccgagatcgaacgcaagcaggccgccgaaggcctgatcgaacagctcaagcgcgaggtggcggtcggcgccgatccgcgccagaccttcgaggagatccagcgtctgacgccctatgtggaggccgatgccaggcgccgcgaggcgctcgacttcgagatctggatggcgctcaaggacaacgcctccgtccagcagcaagcgccgacgcctggcgaggaagagcaactgcgcgaatacgcgcaagagtcggacaaggtgatcgccgaggtgctcgccagcgtcgacgacgaggagcagcgtcacgccgccatcgacgaacgcctcaaggccctgcgcaagcagatcttcggcgaggagaatccacgcctgctgcaacgctga

SEQ ID NO: 12827 - DNA, 1341 bp, Pseudomonas aeruginosa
aatccacggcgccccgacaggggcgccgtcacgcaagcgtcaccaaaacttcacatccgctacacggcgtcggtcgacactgacgtcatgagcagacctctaagcatcgccctgatcagcgaaacctacccaccggaagtcaacggcgtcgccaataccctgggtcgcctgcatgccggtctccagcagcttggccatcgggtccaggtggtgcgcccgcgccagcccggcgacgacggccggcgcagcgacgccgagctggtgctgacccgcggctggccgttgcccggctaccccggcctgcaatggggcatgtcgagcctgcacaagctgctgcgctgctggaagcgccagcgcccggacgtgctctacatcgccaccgaaggcccgctcggcttctctgccctgcgcgccgcgcggcgcctgggcatcccggcggtcagcggcttccacaccaacttccagcagtacagcgagcactacggcttcggtccgctgacccggctggtcaccggctacctgcgctggttccacaaccgcacgcagatgaccctggtgcccagcggcagccagcgcatggaattggcagcggcgcggtttcgaacgtctcaacctgctctcccgcggggtcgacagccaactcttccatccctcccggcgcgatcccgaactacgccggcgctggggcctgggcgaacaggacatcgccgtgctgcacgtcggccggctggcggcagagaagaacctcggcctgctcggcggcaccttccgcgcgctctgcgccgcccatccgcagctgaagctgcgcctggtactggtgggcgacgggccggagcgcaggcacctcgaacgggacctgcccgaagcgctgttctgcggcgtccagcgcggcgaaaccctggccgcccactacgcctcgggcgacctgttcctcttcccaagcctgtcggagaccttcggcaacgtggtcctcgaagcccaggccgccggcctcgcggtggtcgccttcgaccaggccgccgccggccagcacatccgccatgggcacaacggcgtgctcgccgcgccgggcgacaagagcggcttcgtcgaagtcgccagttggctgctggacgaccaggaacgcctgcgccgggtccgtctcaacgcccgccaacacgccagccggcaaggttgggacagtatcgtcgagcacttccagaactacctggaagacgcctgcgccagtccgctggtccagcccgctcggtcgaagcccgagcggccgccggcagaggatggcggggccttgccacgcagccgcgagtagctctcaggcaaaggctttcggcgtggcgatga

SEQ ID NO: 12828 - DNA, 735 bp, Pseudomonas aeruginosa
agcggcgcaagacaggaaaggaagcggcgggacgcgaacgcgtcccgcgggagatcaacccagggccttctcgatggcttgcaccagggccgggtcgtccggcgccgtgcgcgggctgaaacgcgccagcacgcgaccgtcgggaccgagcaggaatttctcgaagttccaggtgatgtcgccgggaaactccgcgccctcgcccgccagcaggcgatagagcggatgccgcgcgctgccgttgacctcgaccttggcgctcatcgggaagctgacgccatagttcaggctgcagaaggactggatatccgcctcgctgcccggctcctgcccggcgaactggttgcagggcacgccgagcaccgcgaaaccgcgctcgcggtaggtctggtagagattctccaggccggcgtactggggtgtcaggccgcatttggaggcgacattgaccaccagcagcaccttgcccttgaacggggaaagcggcaggtcctgtccatccaacccctgcagggtgagatcgtgaaaggcactcatgacgtactccttgcgcattcagcgacacaacgtgccaagccccgcaccgggcaagaaccctggctgcggcgcatccccagggacggggtaaagagcccaggcatggcgcatgacgcgaaaggcgcccacaggcgcctttcgctataccagcttagcagttccgccggcggacggcccaggccatcaatcggcgaatga

SEQ ID NO: 12829 - DNA, 738 bp, Pseudomonas aeruginosa
gcatggcgtgcgccgctacggtttccacggcaccagccaccgctacgtcagccaccgcgccgcggaaatggccgggttggcggtcggcgacagcagttggctcagcgcccacctcggcaacggcagttcgacctgcgccatcgtcaacggccagagcctcgacaccagcatgggcctgaccccgctggaaggcctggtaatgggcacccgcagcggcgacgtcgaccccaacctgcacagccacctggcgcggaccctgggctggagcctggagcgcatcgactcgatgctgaacaacgaaagtggcctgctcggcctctccgacctgtccaacgacatgcgcaccctggagcaggagcgcgagcagggccaccccggcgcggccctggcgatcgaggtgttctgctaccgcctggccaagtccctggcggcgatgagctgcgccctgccgcaactggacggggtgatcttcaccggtggcatcggcgagaactcgccgctggtgcgcgccaagaccgccgcccacctgcggctgttcgacctgcgcctcgaccaggaggccaacgcccgctgcgtgcgcggcgtcgccgggccgatccaggccgcggggcatccgcgggtactggtgatcccgaccaacgaagagcggcagatcgccctcgacacgctggccctgctcgactgaactggatcgacgcccccgcccaaccaggcggcgtggccaaacgcacggcttaa

SEQ ID NO: 12830 - DNA, 2124 bp, Pseudomonas aeruginosa
ggagcccagatgcataccttcttcatcgccccgaccggtttcggcgtcggcctcacctcgatcagcctcggcctgcttcgcgccctggaacgcgccgggctgaaggttggcttcttcaaacccatcgcccaactgcatcccggcgacctcggcccggagcgctccagcgaactggtggcgcgcacccacggcctggatacgccgaagccgctgccgctggcccaggtcgagcgcatgctcggcgacggccaactggacgaactgctcgaagagatcatcagcctctaccagcgcgccgccgccgacaaggacgtggtgatcgtcgaaggcatggtaccgacccgtcacgccagctacgccgcgcgggtcaacttccacctggcaaagagtctcgacgccgaggtgatcctggtctccgcgccggaaaacgagacgctcaccgaactgaccgaccgtatcgagatccaggcccagctgttcggcggcccgcgcgatccgaaggtgctcggggtgatcctcaacaaggtccgcggcgaggccgacgcggccaacgccgaggacggcgtggcggacttcgcccggcgcctcaccgaacactcgccgctgctgcgcgacgacttccgcctgatcggctgcattccctggcaggacgaactcaacgccgcgcgcacccgcgacatcgccgacctgctcagcgctcgggtgatcaacgccggcgactatgagcagcgccgggtgcagaagatcgtgctatgcgcccgcgccgtgcccaacaccgtgcaactgctcaagcccggcgtgctggtggtgacccccggcgaccgcgacgacatcatcctcgccgccagcctggccgcgatgaacggcgtacccttggccggcctgctgctgtgcagcgacttcccgcccgacccgcggatcatggaactctgccgcggcgccctgcagggcggcctgccggtgctgtcggtggccaccggctcctacgacaccgcgaccaacctgaaccggatgaacaaggaaatcccggtggacgaccgcgagcgcgccgagcgggtcaccgagttcgtcgccgggcacatcgatttcgaatggctcaagcagcgctgcggcacgccgcgcgagctgcgcctgtcgccgccggcgttccgctaccaggtggtgcaacgcgcgcagaaggccggcaagcgcatcgtcctgcccgagggcagcgagccgcgcaccgtacaggcggcggcgatctgccaggcgcgcggcatcgcccgctgcgtgctgctggccaagccggaagaggtccaggcggtggcccaggcccagggcatcgtgctaccggaaggcctggagatcatcgaccctgacctggtgcggcagcgctacgtcgaaccgatggtcgagctgcgcaagggcaaggggctgaacgcgccgatggcggagcagcaactggaggacagcgtggtcctggcgaccatgatgcttgccctggacgaggtcgacggcctggtctccggcgccatccacaccaccgccagcaccatccgcccggcgctgcaactgatcaagaccgcgcccggctacaacctggtgtcgtcagtgtttttcatgttgttaccggaccaggtgctggtctacggcgattgcgcggtgaatcccgatccttcggccagtgacctggccgagatcgccgtgcagagtgccgcgtcggcgcaggctttcggcatcccggcacgggtcgcgatgatcagctactccaccggcgactccggttccggggtggatgtcgacaaggttcgcgaggccacccgcctggcgcgcgagcagcgccccgacctgttgatcgatggacccttgcagtatgatgccgccgccatcgccagcgtcggccgccagaaggcgccgaacagcccggtggccgggcaggccacggtgttcatcttccccgacctgaacaccggcaacaccacctacaaggcggtgcagcgcagcgccgattgcgtcagcgtcgggccgatgctgcaaggcctgcgcaaaccggtgaacgacctgtcgcgcggcgcgctggtggaagacatcgtctacaccatcgccctcaccgccatccaggcggacgcccaggccccggcctga

SEQ ID NO: 12831 - DNA, 1041 bp, Pseudomonas aeruginosa
aggaacgccgcccagtgggcggcactggcttcggccaggcacgaggatgtgccatgtgaacggcgggaccacgccccgctccacgcgcccggccctggccgggcgcctacgtacaaggactccttgatgctgtcgtttctcccccatttcctgcgcggctccctggccggcctgctgctggtgtccagcaccctgtgctgggcctgcctgctgttcggcatgaccctggtcaagctgctcctgccgttcgccgccgctcagcgcctgtgcagcaagatcatgagcctgatcgccgaaggctggatcgcctgcaacaagggctggatgaacctggtccagcgcacccgctggaacgtccagggcctggagggcctggagtaccaacactcctacctggtcaccagcaaccaccagagctgggtcgacatcctcgtcctgcaataccagttgaaccgacgcatcccgctgctgcgcttcttcctcaagcaggaactgatctgggtcccgatcatcggcctgtgctggtgggccctcgatttccccttcatgaagcgctacagcaaggcctacctggccaggcacccggagaagaaaggccaggacctggcgaccacgcgcaaggcctgcgccaagttcagccgcatcccggtagcggtgttcaacttcctcgaaggcacccgtttcacccgcgccaagcacgacgagcagcagtcgccgttccgccacctgctcaagcccaaggccggcggtatcgccttcgtcctcgacgccatgggcgagcaattgaagaccctggtcaacgtgaccatccactacccggacggcagcccgaccttctggtgcctgctttccggacgcctgaaggacgtcgtggtgcgcttcgaggaactggagattccgcgccagttcgtcggcaagagctacgaccaggacgccggctaccgcgcggaattccagcaatgggtcaaccagctgtgggagcgcaaggaccagttgctcgacagcctgcaccgcgagtttcccggtaacgccaaggcgtag

SEQ ID NO: 12832 - DNA, 843 bp, Pseudomonas aeruginosa
gacgaagagcgccgaccagcgcccataaaaaagcccgccgaatggcgggctttttcgtccaggccgcgatcagtactgcggctgggtctgcgccgggccctgggcgcccggaaccggtcgcaggttgacctcgacgcgccggttctgcgcgcgaccgtcggcagtggagttgctcgcgatcggctggtccgggcccatgccgcgggtgctcaggcgggtgccgtcgacgccctgggcggtcaggtagccggccacgctctgcgcacgacgctgggacaggtccatgttgtgctggcggctgccggtgctgtcggtgtagccgacgatctcgatggtgttctggttgtactgcttgaacgagttcgccaggttgttcagcggcgcgtagaagctcggggcgatgttcgccgaatcggtggcgaaggtgatgttgcccggcatgatcagcttgatgtcgtcaccttggcgctgcacttccacgccggtgccttccatctgccgacgcagctcggcttcctgcttgtcggcgtagtagccataacccgcggcggccgcgccggcaacggcagcgccgatcagcgcgcccttgccacggttgttgtggtcgatcgcagcgccggcgacggcgccggccagcgcacccagtccgccgtacttggccgtcttgctcatgccaccctggctttggctttgcgtgtcgtaggggttgttgttggcacaaccggcgagcagcgccagtgcggtgacggctgcggccagaggcaggcaacgggaggtgaacatgggaaaactactcctcgaggtactgaaacgcccctgcgtgaggggcggccgatatcttag

SEQ ID NO: 12833 - DNA, 738 bp, Pseudomonas aeruginosa
agcatagccaggtggcaaaattcccgatgctcggaaaaatccttttcagcccctgacgaaggggttctcgcgcatctcttcgcccagcgtggtgtccgggccatggccggcgaccaccgtggcgtcctcgtcgaggctgtacagacgctgcctgatcgaacgctggatcgccgccgagtcgccgccccacaggtcggtgcggccgatgccacggcggaacagggtgtcgccggcgatcagcagcttcgcccgggggaaccagaaactcatcgagcccggcgtatgccccggcgtgtgcagtgccactccgcaaccgcaggccagttcctcgtcgtcggccagccagcggtccggggccggcaccggcgtgtagggcacgccgaacagttggcactgcatctccaggttgtcccagaggaactggtcgtccttgtgcaggtgcaggctggcgccggtgcgcttcttcatctcgccggaggcgaggaagtgatccaggtgcgcgtgggtatggatgatgctgaccacctgcaggccgaggcggtcgaggcgctgcaggatcagttcgtggtcgccgcccggatcgacgacgatggccttcctggtcagcggatcgccaatgatggtgcagttgcactgcaaaggcccgacgggaaaggtttcgcggatcagcgcgggggatgtcgacatgcaagactccgatcacggtcggcgcggcaagcgcgccatggatttctatga

SEQ ID NO: 12834 - DNA, 1002 bp, Pseudomonas aeruginosa
gccaccggcaccagttcggcggtgaaattgagcggttgtttcatggctgtttattgttctgaccgctggccggatatgaccggaaagttggcagaagataaccttgtgaggctatcccccgcaagcgatagtcgatcccatggtccttcaccatcacagggagccgctatggccagcaccacccccgaaggtctggagatccgcccgcgtcatctggacttcgacctgcccgatccgatgccgcgccattggcacagcggcgacgctttcaagacccacatgttcaacgccatgtcggtgctgttccccgatggcgagcgcttcttcatcgactccgtgcgccactaccgcgaacgggtcgaggacccggcgctgaagcaacagatccgtggcttcatcggccaggaaggccaccacagccgcgagcacctggtctacagcgaccgcctgcgcgccctcggctacgacatcgaccgcctggaaggcggcgccaaacggcgcatccgcttcgcccagcagaaactgcacccgtcgcggcaactggcggccaccgcggccctggagcacctcaccgcgatcatggccgacggcctgctgagcaaccccaggtggctggaaggcgccgacccgaccatggcccgcctgtggcgctggcacgcactggaggaaaccgagcacaaggcggtggcctacgacgtgttcatgctggtcaacggcaaggccaggctgcgccgccgggcgatggtccagggcaccttcttcttcgccctcgacaccaccaagggcctggtccacatgctcaagcgcgacggcctgctgtggaacttcaaggtctggcgcgacggcatcaagtggctgtggggcaaggacggcgtgttccgctcgctggtgggcgtgtacctggacttttacaagaaggacttccacccctggcagcacaataacctgcacctcatcgagcagtaccgcgaccagttcgaaccggaaccgaaggccgcctga

SEQ ID NO: 12835 - DNA, 717 bp, Pseudomonas aeruginosa
gcagcaaaagatccaggagctggaagcccggatcaaccggttggagcgggagaaagcgatattaaaaaaggctaccgctctcttgatgtcggacgaactcgatcgtacgcgctgatagaccagttgagtgagcaggagtcggtggaagtggtctgttcagctttcgatgtggcgcggtcttgctactacgtccaccgtcttcgacggcggcatgtcgatgctcgccgcgtggcgctacgcagccaggtcaaccagttgttcagccagagtcggggctcggccggcagccgcagcattctgggcatgctgcgcgaagagggcgtgaccatcggccgtttccgagtgcgtcggttgatgcgtgagctgggcctggttagcaagcaaccgggctcgcacgcctacaaacaggccacggttgagcggccggatatcccgaatcggctgaaccgcgaattcgcgaccgagcatcccaatcaggtgtggtgtggcgacatcacctacgtctgggcgcaaggccgttggcactacctggccgcggtgctggatctgcatactcggcgggtgatcggctgggcgttctcggccaagccggatgccgaactggtgatcaaggccctggacatggcctacgaacagcgcggcaagccacagcaggtgctgttccattcagaccagggcagccagggtggattcaaccggtcgttgcaacacctttga

SEQ ID NO: 12836 - DNA, 1218 bp, Pseudomonas aeruginosa
agcgcgcacgctccattttttatgcatccacatttatcaaaatgttttggtgttaaatccagaaggggggtagggcgaaagcacgattcacttgctaagcgcattagtttgagaatctcagtggatggcaaagtaaggccaaagccctcctatagacggcgacagaggctgagtgaaatggacaacacccaatacgcccaacgtttgctaagcctgctcgcgcaaggcgccaccttatgcgccaccgacagaaaaaaggcatttccacttctgcaacgggcatcggctctgctatggaggcttgagcctgggcgctctccagtgacgacaatcacactggagcacaagctgaacttgccaatagagcaatggctccccgaggccatacgggcggactattccggccccctgctctgctccaacatggcctcgcagacctgtaacgaaatgatgctggagctcaacgcccggcagctttgggaaaccatccaggcccgcgtaaaccgagtcaagcaagcgtgccggctgcggtccgatggtgacacgctctatcgcaactttcgcctgttcctcattgagcacggcgtcatcgccccctcccaggcccgcgacgtattcgtcccactgaacctctctctcagtgacttctacgagcccatcccgcttcacctgcggcataacgggttgctgtacctgtgcccggaatgccactggcccctgaacactcaacggcatgaggtgagctgcgactctgcctggtgccgggacaagaaaagcctctttctcagagacggcacgaagctcgtgaaccgcgtgaataacagccaccttgagggccaggatgcccaggaaaggctcatgctgaatccagccttatggaaattcacgctgcagccgggattgctggaactgtccctggcacacgccctgaccgagagaggttacgaagtagaactttggcctaacgtcgatcgaacagatcttcgtgtccgtataggccaaagcactcaggatatcgacgcaaaggtgtgggtatcggcccacgaactcgccaaacacatcgaacagattccgtcccacttgcctcgctggatcgtgatccccgactaccagaagcagaacatacctctactccgagagcactgtcctatgggtgtgcgcgtgttcactcagagccaatgcgtacaggaggtgcagaagcatgcgtcccctttctga

SEQ ID NO: 12837 - DNA, 2463 bp, Pseudomonas aeruginosa
aagtgtcaaccggctcaaggaagacggcgactgggaacagttcgagcgtcaccatgcaggcatcgcatcggcggttcagcaatacattcttcgatcaagaaaggagtccgtatgaaaacgcttgagctgcgcaccagccttttcagattcgacccgacacaactggggcgggcctaccgagtcgtgattggagagcattacctcgatgcttggcaagcgctcaaaggactggcaaagaagccgcacccaggcttgcctatcatcgctttagaagaaatgctgaccgtcctctctggtggccctgtgaaggtcaatctttccccgcaaaaggacggtggcgtatcggcgattcttctactcaaacctcttccgatcgacaccatcaacgagacgctacggctatggtcgatggatgtattgaggatctggaacgagcgactcgaaggctttgagggcaagctcgctgtcaccgacctcgtaccccttgagaccagcctcctcgtgacaccaggtgatatttcatcactggcatacaccgtcattccgtggctagttggccaggcgatgatccgcaaccccatgcaggccagcaaaccaatcacgctttatcaggcatcggacgcaacgcttttggcatgggacgatcccgttgtttcggagaacgatatccgctacgccagcgccgtacatgccattgagcccaagctggttttgttgcgcggacgagccgagccttaccttcagttacgtgtgaagctgagccaggtcatgccaaatcttgttgggacgaaaaagcatgcctgggtaaaagttggcgatcagatcgtgaaggctaagctcaagacccagccacatgaagggggatggaaaaccacgtacgagcatccgatcgaagacttactgggatttatgggcgtttcgtcttttccatctattcaggaaggcgacatccccatcgacagcgacttcaggcccatctatgccatccctccgtccaacccactgatagcatcaggacccgggccattgttcctggatcaggccggctttcacctgctggacaacctacctggaacatctccgttgttggccagaaaggccgtaggtagtttgcgagaggaaaaagcacaggccaccggcgaggtggtcacgttgccggtgatggtgcttgcagcccactccgaggtaatgctgcggcttcatgcggccagtggaacactcggtgaggacagtcagttcttcaaggaggtgatgcccccactggtaacactgactcggctggatgtgcctgatgcggggcgcatgctcgcgggacaacacgacctgctagtcctcagggcatggctatctaatcatgtattgcccgcagcttcgcaagcccactgcggtggccccaaggtgatgatcgtcgaaacctgcgcttctgcagcgaaattggaaggcgctcaggaccccaagcatttgatccggcaagttctggcagagcacggcattgcgacgcaattcatcatgcacatcgatcccgatgaacaactgaagaaaaagcgcaagggcaaagaggatgatcgcgacttcaaggccaccaacaccattatcgaggctatccgcctgagcggctaccttcccgcgccgataccaaaatccaaagcttcgccggagaagaccactgtagtttccgtcctgcttgatcgcatccaggaaaaaggcccggcagtgcttcttcctgtcatcacccgcgcggtgttgggggagcccaacactgagattttctggttcgagtcaggcccggactccgggggcaagtggttcagttataacgagggcgtctcggccatacatgcattcgccacgctgcttacatctgaccagctcaccaggctggtgactcaagccctgctggtacccaccaaagttgctgacgccccactgatcgcatgcctcgacagtggccttcgtacattctacaaggggctccaggacagtccaggcgagggccttcccccggtacctgaaggcgccgccatcgtacgaattcgcgcagacctggacgttgcccaaatgagcgggaatcagtcactgtcacctgataccccccactacataggcaccaaggtcggcatattccagtccaatgagagcttggacgtctattacttcgtcgctccgtccaaacagtacggctccgtccggtcgcaacgcaacaacacccgctatgagatctccgagaaagacttgcgagatccgtggcagcagctcggtgtcacggaaatcacgattatacgtgccggatcgttcgctcacccgacagctactgccgagcaagttgcactgctttgccgcaacgctccgctgtgggccgggtatcttcgcttgcccggtcccatgcacttgggcaagcaggtcgccgcagatcatcccattctggagcggttgcgcaagactgaggctaaccgctcggattga

SEQ ID NO: 12838 - DNA, 360 bp, Pseudomonas aeruginosa
cggggaatttttcagccactcggtggaattgctaggtttcttgtaggagcgttgcatgcaacatgcccacgcgctcgccaagttactgcacctcgccgtcatctgtcagtcatgcagtcaagccgttcgctcaggatgagccggcgctaccgactctccaaaccatttactaatagcctgttcgacttgcctgcgtggcagatactcctgctcaaggcgcccccgctcctgtgcaaggagataccgatagaaatcagcttcgtcggtcatcaatccttcgggagccaattcctgagctttagctggctcgacgaccgcgcttcccaaggagtgctggtcaaacagctcccggtccattag

SEQ ID NO: 12839 - DNA, 186 bp, Pseudomonas aeruginosa
aacccaatgactggtttcttcaaaggcatccagaaaagtcgtcagaccttgctcggacgccgcgccttcgaagcgctcatcgaggagtttcgtcagcaagatagcgtttcgctcgaaaaacttggtgtccactccgtgctctgcaagcaggcgcaatgggcggccttgagcgcagcccggagatag

SEQ ID NO: 12840 - DNA, 732 bp, Pseudomonas aeruginosa
gcaggcgtcttatatccctggaaagcgaaacctaaaacagagattccaaaacacgataaaccggcctccacagacgctcgaaggacaagaaaaatgaaaaaggaaccgaaaggagcaaaaaacaggatagtcatcgccaaagatgagaagaacgttctgacctgcaccagcgaagggttcgaatatacgccagacatcgtcaagaacgtctacgggaagagcagccgacccgcactggaagactggttcctgacggaacttgatttctttcgcaggtattaccctggatacgagattttcaccctcggctccagttgtgtcttcggcgaaaagttcgtgaactacctgaccatctgcgaattcgacatagacagtacctacgccttcgactgtctcaagaaggccctgagggagtccgaccaggccattcggcggaaactctccgccatgtggaaatgggacatggccgccaggaaggactggagcatcgtcttcatggtcgggcacatggacttcgcctacttcctccagcacaggaaggagttccagggggatgcccataagcgcttcatgagtacattcaccacggcggagacgaaaatcacctctcgcgactacaaggtcatgcatgacggcgcgatcctgcccttcgacgaaacggccctgtcgccggaagacaggttcattttcgagaactatcaaaagataaagttcgaaaccacgccactatga

SEQ ID NO: 12841 - DNA, 903 bp, Pseudomonas aeruginosa
ccgcaacggcgtgccctgttccgggcgcttccagctcatcgaccacgaaacgggcaagcccgtcgccggacgccgggtcagggtctggtcgagtggcggctggaatgcgttcgacaccacggatgccgacggcatgacctcctggatcgagcgccccaccgcggagaccctctacatcgacctggtgcagaggggcgacgcatgagcgaccagcccagcctgtcccggggaggcatgagccccgaaggcaggaccaaccccgtcggcaccctggaacccaggctcgatccgcaggacaagaaggtgctgtgctcggcggtctgccattgcagcagcacgcctaacctcagccagaatggcaaaagcctcaagcaggcgtgcgtggcacagcggctgggagagttggacgaagttctccagggacgcagcccctacaagcccgaggtcagctacgacatgaccaagaacccaccgcagccgattctcgatagccagaccggtaacagtccacatggctggataccgggatggatcagcaagtattgggatgaagatccggagcatccgccgttcaagccagggaaaggaatgattcgcaggcccgacgtgatcatcgttcagaatcccaacaggccgccaacccaggacaatatcaaacaggtggtggagatgaagtttccgcctgacccacataatagggaacaacttgaggattatgcagcgattgccggcaacaagaacaagattgttgaaatgaagccctccgactgcgactgtggccaggaaaatcaacgatccaaggtgccagtagagcaagtagggtgggccgccgccatcgcaggtggggtgatgttcgtcttgacccgaggccgttcccctcgcccgatgattcccgcctattga

SEQ ID NO: 12842 - DNA, 1047 bp, Pseudomonas aeruginosa
aagcgccgggcggcgggcaggtcgtggacggggatggcgaggtggaagggcatcaggctcatggcgcggttcctctgtgggtgtgccgggattatttgccgtgccgatttcgatggaaagcgcataatatttcgcctgagcaacacttttttcgaggcttggatgatccgcgaactccgcaccctggtcgccgtggcgcgccggggctccttcgccgcggcgggggaacaggtggggctgacgcagtcggcggtgagcgcgcagatccgcgcgctggaacgcagcgtcggcgtcgagttgttcaagcgcacgccgcgcgcggcacacctgaacgaggtcgggaggcaggcggtgcgtacggccgagcagatcctcgcgctgttcgacggcatcggccagggcgacagcccgcgcggacgcctgcgcatcggtgcggtgaacacggcgcagaccgggctgctgccggaggtgctcaagcgcctcgccgaacaggcgccacacatcgagccgcaggtgatgccgggcgtctcgctgcacctgctggaccaggtggacgccgccgaactggacctggcgatcctcatccgcccgccgttcaacctgccgcgcgggctctccgcgcaacgggtcgagcgccagccgttcgtgctgatcgcgccgccgcaatgcactgcgacggatgcgctggaattgctgcgcacgcaaccgttcatccgctacgaccatgtgtccttcggcggtcgcctggtgggcgatttcctcgaggcgcaacagctcaggccacgccaggtgatggagctggatgagatcgacgcgatcgcgcggatggtggagaacggtctcggcgtggcgctgctgccccgggccgggctgtggctacgcgagccggcgcgggtacgggtgatcgaactgggcgcgctggaattccagcgcgagctggtgatggtcagccgcagcggttcggcgcaggacgacctggtcggtgaattccgccgcgccctgctggccgagacggcggctcaggaggccgcgccgaccaccgcgtag

SEQ ID NO: 12843 - DNA, 1038 bp, Pseudomonas aeruginosa
tcgcagtcgacgctgaacttggcgctgcggaagtccgcctgcaggcgcggaatccagtgcgggaagaacaccgaggagaggatgtgcggggcgcagaaacgaatgcgccgctgggcgtcttcgtcgcgctcgcggatcgactggcgcaggttgtccagggcgcgcaccgcgtcctgcgccacgccttgcaactggcggccggcctcggtcagttcgagggcgtgcttgtggcgctcgaacaccggcgcgccgagccactgttccagggtctggatacgccggctgagcccggacacggagacatggcactcctgcgccgcacggctgaagctcttgatccgacagaggacgaggaagtccttgagcatcaccaggtcgatcatcgttgcgcgttcctcaacggtcgggcgttttcagtctacttcgcgcggcggtgcctgttgcaaggctaaagttcggtttgttttgccgatttggcaagcagctcgtcgactcccgcaaaacagaccgggaaaagcggcccacagtagtgaggtcgcgcttttccagccatcgacccgcccgagcatcgtggccgggcgggtccgccacgaggacaggaccatgcagacatcccccgctccggccatcgtcgccggcggcgcctaccagccggtggtgctccacgccggcatcgcctacgtcagcggccagttgccgcgccagcacggcgagctgcgctggaccggcaaggtcggcagcgaactcgacctggaacaggcccgccaggccgcccggctctgcgcggcgcgctgcctgcaggcgctggaggaggcgctgggcggcctgcaacgggtcgagcggctgctcaaggtgaccggctacgtcgccagcgcggcgggtttcgtccagcagccggcggtgatcgatgccgccagcgaatatttcgacgaggtgctcggcgcgcgcggcggccacgcccgcgccgccgtcggcgtggccgagctgccgcgcggcgccgcggtggaggtggaactgatcgcggcggtgcggccatga

SEQ ID NO: 12844 - DNA, 819 bp, Pseudomonas aeruginosa
tcgacgcacgcggcgacgccgcacagctgttgcaacggctcgacgagcagttgcacgacctcgcccccggccagacgccgctgctgtcgctcagcgcggtgcccaccgggcatggcgcggctaccgcgctggagggcgtggccgagcgcatccgcgcccatgacgggctgttgttcctcgatgccagccatgcggtcggccagttgccgctggcggtggaggcgaccggctgcgacgtgctggtgttcccgccacgcaagtggctgcgcgggccaaagggactcggcgtgctctatctcggcgaacgtgccctggagcgcctggccctgcccgacgggctggacgtcggcggcgcgcaatggagcgacgccttcgccctgcaggcgcgggatgacgcgcggcgcttccgaatgcccggagttcaacccgggctgccgcctggcgctcaaggccagttgcgactacctgttgcagaccgatgtccggcgcatcgcccgacgcaaccgccagttgcgcgaacgcatcgcccagcagctctaccgccggctcggctggacgccgctggaacaagggccgcacgccagcgcgttgatgacctacgcggcccccgaactgagcggcgagcaatggctgaagcgcctccacgcgcgcggcgtgaacgcctcctacatcggcccgcagtatgcccgctgggcgctgcgcgagcaggcgctgccgggggtactgcgcctgactccgcactacctgaccgacgacggcgagatcgagcgcctcggcgaggccctggaggattgcctgcgacagcgcgccgccagttga

SEQ ID NO: 12845 - DNA, 1446 bp, Pseudomonas aeruginosa
atccctctcgtagaacaacgcataacgatcccgccagcgacatctttcacctgcctgagacaccgacgactttcgacgccctgggcagcctttcggtccgccgcggaccgctccgccctcaatggaatgatgaatggaggaaagacgaccatgaccggatcccggaaaaccctgattctcggatgcgcctccaccggcgccaagttcaccccgcgcaaccacgccgccaccggcgaccgcctgctcgacagcatctgcaccggcgccaccatccgcaccgcccctggcgaactgctggacgaagcgcgccaactctacgagatgggttgccgctactaccactatcacgcgcgcaacccgctgacccaggaacagaccaccgacaacgacatctaccaggcggtcagccgcgccctgcagaaccgcttccccgacctgatgttgagcttcggcgccagccgcaacggcagcgaggtgcaggagaacatccgccgcttcggcgagtgggagcgggtcagccactgcgccatcccgctgcacctgggcggtgcgcacttcgtgacgatccaggcggccatcgaattgcaggtgatctgcgagctggagaagcaaaggcgcaagctcgacctcgactatgcctccagcccggccttcctcgccgacctgcgcgactaccagccgtcgacggcgctggaaaaggccgagttgcagacccactccaccagcaagggcgccgactacggggtgacctcgccgatgacccagttccaggtctaccgcaacgccatccaggcgcgccagaagctcggcctgttccacgaggtggagtgggtgcagcatgtgcgcagctacgccatgacccgtttcgccgtggagcacccgcgcctgcgcctgggcggttccggccagttgaacgtgatcctgctgttcggcttctcgccacgcctgccgttcccggagacctaccagcagttccgcgcggtgatcgagagcgccaagagcctggagtacgacatcggcgaacccggcgtgcgcaagcgcaaggtcagcatcacggtcggcgcggcggtgatgccgcagcatgccgcgcagcacttccggccgctcgacgtcggccctcgcgccggcaccccgctctgcgcggtgcgccggctggccgcctatgccgcgcaggcggacagccaggtcgacgtgctgcgggtcggcatggaggacacgccctacgcggtggacgatgacggccaggtgacgctcagcgacaactgccagttgctgcgccaggctctcgacgaactgcgcgccaacggcgccgaggccgagctcgacggcgaacggatcttccagcgcatgggcatggaacgcaccctcggcgaatacctgtcgctgcagcgcctgcatccgctcggcgaagccaacttcaccctcgcacgggagttcgtccagtga

SEQ ID NO: 12846 - DNA, 540 bp, Pseudomonas aeruginosa
tcgccagcgacctgctggacctgcaccggcaactggcggcctcggcctgaccgacttcctccttcctgccccctgaaccgctcgcccaacccgcgcgccacggcgcgccgggaaaggcgcgcgcagcgccggcacgcgtccggcaggagcttcgtcatgtccgcgaaggataccccggccccccaggccgccgagcccggtcgcgcccagccggtcgaagtccccggcggcggccactggtggcgccgcctgctggccttcgccggccccggctacctggtcgcggtgggctacatggacccgggcaactgggccaccgacgtcgccggcggcgcgcaactgggctacctgctgctctcggtaatcctgctctccagcctgatggcgatgctgctgcaggcgctgtccgcgcgcctgggcatcgccagcggcctggacctggcccaggcctgccgcgaacgctactcgccggagcacctgccgcctgctgtggctggcctgccaaaacggcgatcatcgcctgcgacctggccgaggtga

SEQ ID NO: 12847 - DNA, 681 bp, Pseudomonas aeruginosa
cagcctgccgccctgccccaccggacagtaggccatcaccggcatgccgcgctcctggcaccagggcagcaggtcgtattcgatgccgcgttcctccaggttgtacatcacctggttggtggcacaggcgctgccgtccagctcgtacatgtcgcccaggtcgaagttggacacgccccagcgcaggatcttgccctggtcgcgcaaccgctcgaaggcttcgatggtttcctccagcggataccggccctgccagtgcagcaggtagaggtcgatggtttcgcaaccgagccggcgcaggctgcgctcgcaggccgccggcagacccttgcggctggcgttgtgcgggtagaccttgctgaccaggaagacctcttcgcggcgtcccgcgatagccgcgccgaccacgtcctcggcgccgccctcggcgtacatctcggcggtatcgatcagcgtcatccccagctcgatgccttcgcgcagcgccgcgacctcgcgcttgcgttcgccgggctgctcgccgatatgccaggtaccctgaccgatggcggcgacctcctggccatcgatcagcgtgagcgttttcatgcagcgtctcctgtggtgaatggacggggcctcatgcccagggatcatagctgccgaagctccagacgtggccctccggatcgcggcaagtga

SEQ ID NO: 12848 - DNA, 3027 bp, Pseudomonas aeruginosa
ccagcagccccgaccaggtatgcaggccggacatcgattgacgcaggttcatggacgcgctccgtagtcgaggccgagccaggccaggccgcccagcgccaggctggccagcgccagcacccagcaggcgcgccaggcgctgcgcgcggcgaaggcgtagacgatggccgcgacccacacggcgaagcagccgaggctgccgaacgagacccggtcgggacgcggcagcggcaggtagatgctcaggcaggcggtgaccgcataggccagcgcgtagccaagcaggaccgcgacgaggatgcggccggtgacggacagtccgccggccagggcctggctggtcatggggtggcgtcccgggtggaaacagggccttgcatcgtcgctacctcgtctggctggcacggcgacgccgcgctcgcgggtggcgaggcggtcgtcgattcggaaggtttgcgactgtatctcaattacgttcgcatttgtacttgctccggacgaccgccaggtcgcgtcgcgccagggattgccggggtccgacgagtgcgggtcgtatcccgtcgcattcgtccgccgcgccatacgtccatctccgctctgcgcaagcgcgccgagcttggtaatatcggctgtttgcggtttcggctggtctcgccgaaggacataccggatgacttcaccctccgccccagacacccagctcagcctggccatcgacccggcccggccgtatgcgcggctgaccctcggcagccacgtgcacagcggctacgacctgcgcagcggacgcatgcagagcatttcccggcaccgtgcggcgctggccttcatctatgccggcgaggcggtttccgggcgtcccggcagcgagccacgggaggcccagcggcgtatcgaacggcgtccggcgcacgagcaggaataccgcgagaccctgcgccgcctcggcttcaagccggcgacccggcgcagcgacgcgctcgaggagagcgccggcgagatgttcgaactgcccggcgacaacgcctggctgcacttcatgcaggacgacctgccgcgcctgcgccagcaaggctggttcatcgacatccgcgccgacttcgcctacgacctgacgcccatcgacgcctggtacgccgaggtcgaggaagccgacgaccgccagtggttcgagctggaactgggcatccaggtcgccggccagcgggtcagcctgctgccggcgctgaccgaactgatccgccgcagtccggccctgctcgatccgcgcgccctcgcccggcacgccgacgaagagcaactggtgctgcgcctggaactcaacccgccgctgcgcgtggcgctgcccttcggccgcctgaagccggtgctggcggcgctttccgacttctacctgggcgaccccgaaccgcagcgcaagctgcgcctgggcgcaccggacgcggcgcgcctggccgatctcgacgagttgccgctggcctgggaaggcggcgacaacctgcgcgacttcgcccgccgcctacgcagtttccaggctcgtccggcgaccccgccgcaaggcctgcgcgccgaactgcggccctaccagctcgaaggcctgagctggatgcagaccctgcgcgaactcgacagcggcggcgtgctggccgacgacatggggctgggcaagaccttgcagtcgctggcccacgtgctcctggaaaagcaggccgggcggctcgacacgccggcgctggtggtgatgcccaccagcctgatccccaactggctggacgaggccgagcgcttcgcccccgatctgcgcgtgctggccctgcacggcgccggccggcgccgcgacttcgcccgcatcgacgagcacgacctggtgctgaccacctatgccctgctgccacgcgacgccgccgagctgggcaagcggcggttccacctgctgatcctcgacgaggcgcagaacatcaagaacgccaccaccaaggccgccgtcgccgcccgcgagctggcggcacggcatcgcctgtgcctgaccggcacgccgctggagaaccacctcggcgaactctggtcgctgttccatttcctgatgcccggctggctcggcgacgcccgccagttcgcccaggactaccgcacgccgatcgagaagcacggcgacgaggcacgcctcagtcacctggccgcgcgcctgcggccgttcctgctgcgacggaccaaggaacaggtggcctcggaactgccgccgaagagcgagttcacccagttcgtcgaactcagcgaggcgcaacgcgaactctacgagaccgtgcgcctggcgctggaccgcaaggtccgcgaggagatcgcccggcgcggcctggcgcgcagccgcatcgtgatcctcgaggcgctgctcaagctgcgccaggtctgctgcgacacgcgcctgctgcaacgccaggaagacggcgcgcgcagcggccgggcgctcagctcgggcaagctggcctacctgctcgacatgctcgacgaactgatcgccgagggtcgccgggtcctgctgttctcgcagttcacctcgatgctcgcgctgatcgaggacgccctgcgccagcgcggcgtcgactacgtcctgctgaccggcgagacccgcgaccgccgcgccccggtacagcgcttccagagcggcaaggtgccggtgttcctgatcagcttgaaggcaggcggggtcggcctcaacctgaccgcggcggacaccgtgatccactacgatccctggtggaacccggcggtggagaaccaggccagcgaccgcgcctaccgcatcggccaggacaagccggtgttcgtctaccggctgatcgcccgcggcacggtggaagagaagatccagcacctgcagcaggaaaaggccgccctcgccgacggcctgttcagcgaaggcaacggcgacggctggaagctcgacgaggccgatatcgacgcgctgttcgcgcccttgcccaaggcgctctgagggccgcccggattcagcgcgcgacgccgcggtag

SEQ ID NO: 12849 - DNA, 999 bp, Pseudomonas aeruginosa
tgcgccgccacatcagtgcgtcgcgccgcaatatcgagcgccagctggaaccccagccggcgaagctcgcctccgcttcctccaccgtctaagaggtccgtgatgagccagacgtcccttacccccggccagcgcttccgcgaagccgtggccaccgaacacccgctgcaggtggtcggcaccatcaacgccaaccacgccctgctggccaagcgcgccggcttcaaggccatctacctgtccggcggcggtgtcgccgccggttccctgggcctgccggacctgggtatcagcggcctcgacgacgtgctcaccgacgtgcgccggatcaccgacgtctgcgacctgccgctgctggtggacgtcgacaccggcttcggctcctcggcgttcaacgtcgcccgcacggtgaagtcgatgatcaagttcggcgccgccgcgatgcatatcgaggaccaggtcggcgccaagcgctgcggccataggccgaacaaggagatcgtctcgcagcaggagatggtcgaccgcatcaaggccgccgtcgatgcccgcagcgacgactccttcgtgatcatggcgcgcaccgacgcgctggccgtggaaggcctgcaggccgccatcgaccgcgcctgcgcctgtgtcgaggccggtgccgacatgatcttcccggaagccatgaccgaactggccatgtacaaggaattcgccgccgcggtgaaggtgccggtgctggccaacatcaccgagttcggcgccaccccgctgttcaccaccgacgaactggcctccgccgacgtgtccctggtgctctacccgctgtcggccttccgcgccatgaacaaggcggcggagaacgtctacaccgcgatccgtcgcgacggcacccagaagaatgtgatcgataccatgcagacccgcatggagctgtacgatcgcatcgattaccacagcttcgagcagaagctcgacgcgctcttcgcgcagaagaagaacgcctga

SEQ ID NO: 12850 - DNA, 429 bp, Pseudomonas aeruginosa
tcaagggttggtcgaagcagctcgccgacgaggtcggcgacaaggtcctgttcgcggtttccgaggccatcgacaagaccatgtgggagcagaagaagctgttccccaacgccgacttctaccacgcctcggcgtatcacttcatgggcatcccgaccaagctgttcacgccgatcttcgtctgctcgcggaccagcggctggaccgcccacgtcttcgaacagcgcgccaacaaccgcatcatccgcccgagcgccgagtacaccggcgtcgagcagcgcgcgttcgtgccgctggagcaacgctgatccacgccgtccggcgcgccgaacgcgagcgcgccggacggttgccgcacccagaattcgaaaggccggcgtgggctgcgccacggcgcgagcgacacgcttccgaacaccccgtgattga

SEQ ID NO: 12851 - DNA, 2616 bp, Pseudomonas aeruginosa
gtccgagccatgaacagcgcacaccgcaaaccgctccccggcacccgcctggactacttcgacgcccgcgaggcggtcgaggcgatccagcccggtgcctacgccaagctgccctatacctcccgcgtgctcgccgagaacctggtgcgccgctgcgacccggcgaccctggaggcttcgctgcgccaactggtcgagcgcaagcgcgacctcgacttcccctggtacccggcgcgggtggtctgccatgacatcctcgggcagaccgcgctggtcgacctcgccggcctgcgcgacgccatcgccgacaagggcggcgacccggcccaggtcaacccggtggtgccggtgcaactgatcgtcgaccactcgctggcggtggaatgcggcggctacgaccccgaggccttcgccaagaaccgcgccatcgaggaccgccgcaacgaggaccgcttccacttcatcgactggaccaagcaggccttccgcaacgtcgacgtgatcccgccgggcaacggcatcatgcaccagatcaacctggagaaaatgtcgccggtgatccaggcgcgcgacggcgtggccttccccgatacctgcgtgggcaccgacagccataccccgcacgtcgacgccctaggcgtgatcgccatcggcgtcggcggcctggaagcggaaaacgtgatgctcggccgcgcctcctggatgcgcctgccggacatcgtcggcgtcgagctgagcggccgtcgccagccggacatcaccgccaccgacgtggtgctggccctgaccgagttcctgcgcaagcagaaggtggtcggcgcctacctggagttctacggcgaaggcgcctccagcctgaccctcggcgaccgcgcgaccatctccaacatggctccggaatacggcgccaccgcggcgatgttcgccatcgaccagcagaccatcgactacctgcgcctcaccggccgcgacgacgaacaggtcgccctggtggaggcctatgcgcgcaccgccggactctgggccgacagcctggtcgacgccgagtacgagcgggtactgaagttcgacctgtccagcgtggtgcgcaacatggccggcccgtccaatccgcacgccagggtcgccaccagcgaactggcggcgaaaggcatcgccggcaacctcgagcgggcccgcgccgaggaagccgagggcctgatgccggacggcgcggtgatcatcgccgcgatcaccagttgcaccaacaccagcaacccgcgcaacgtgatcgccgccggcctgctggcgcgcaacgccgaccgcctcggcctggtccgcaagccatgggtgaagacctcgctggcacccggctccaaggtggtcaccgaatacctgcgcgaagccggcctgctgccgcacctggaagccctcggcttcggcgtggtggcctacgcctgtacgtcttgcaacggcatgtccggcgccctcgacccggcgatccagcaggagatcgtcgagcgcgacctgtacgccaccgcggtgctctccggcaaccgcaacttcgacgggcgcatccacccctacgccaagcaggccttcctcgcctcgccgccgctggtggtggcctacgccatcgccgggaccatccgcttcgacatcgagcgcgacgtgctcggcgtggtggacggcaaggagatccgcctgaaggacctctggccgagcgacgaggagatcgacgcggtggtcagggcggcggtgaagcccgagcagttccgccaggtctacatcccgatgttcgacatcacccacggcgagcgcgagagggtcgacccgctctacgcctggcgcccgacgagcacttacatccgccgcccgccgtactgggaaggcgccctcgccggcgaacgcaccctgcgcggcatgcgcccgctggcggtgctgccggacaacatcaccaccgaccacctgtcgccgtccaacgcgatcctcgccgacagcgcggcgggcgagtacctggcgaaaatgggcctgcccgaggaggacttcaactcctacgccacccaccgcggcgaccacctcaccgcacaacgcgcgaccttcgccaacccgaagctgttcaacgagatggtgcgcaacgccgacggcagcgtgaagcagggttcgctggcgcgggtcgagccggaaggcaaggtgatgcgcatgtgggaagccatcgagacctacatggagcgcaagcagccgctgatcatcgtcgccggcgccgactacgggcagggttcttcgcgcgactgggcagccaagggcgtgcgcctggccggggtggaggcgatcgtcgccgagggcttcgagcgcatccaccgcaccaacctgatcggcatgggcgtgctgccgctggagttcaagccgggtaccacccgcctgaccctggggatcgacggcagcgagaccttcgacgtgctcggcgctcgccggccgcgcgccgacctgaccctggtcatccaccggcgcgacggggagcggctcgaagtgccggtgacctgccgcctggacagcgacgaggaagtctccatctacgaagccggcggcgtactgcaacgcttcgcccaggacttcctggaggcggccggcgcctga

SEQ ID NO: 12852 - DNA, 2289 bp, Pseudomonas aeruginosa
cgtcgactacctctacggccaggtctccatcgacaagcccttcgtcgactggagcggcaactgcggcaacctctccaccggggccggcgccttcgccctgcacgccgggctggtggatccggcgcggataccggaagacggcatctgcgaggtgcgcatctggcaggccaatatcggcaagaccatcatcgcccacgtgccggtgagcggcggccaagtccaggaaaccggcgacttcgagctggacggagtgaccttcccggcggccgagatcgtgctggagttcctcgacccgtccgacgacggcgaggacggcggcgccatgttccccaccggcaacctggtggacgatctggaggtgccgggggtcggtaccttcaaggcgaccatgatcaacgccgggattcccacggtgttcgtcaatgccgaggagatcggctaccgcggcaccgagctgcgcgaagagatcaacggcgacccgcagcaactggcgcgcttcgaacggatccgcgtcgccggcgccctgcgcatgggcctgatcaagacccccgaggaagccgcgacccgccagcacacgccgaagatcgccttcgtcgccccgccccgcgactaccgcaccgccagcggcaagctggtggcggccggcgatatcgacctgctggtccgcgcgctgtccatgggcaagctgcaccacgcgatgatgggtaccgcggcggtggccatcggcaccgccgcagccattcccggcaccctggtgaacctcgccgccggcggcggcgaacgcagcgcggtacgcttcggccatccctccggcaccctgcgagtgggcgccgaggccagccaggcgaacggcgaatggacggtgaccaaggcgatcatgagccgcagcgcgcgaatcctcatggaaggctgggtgcgcgtacccggcgacgccttctgaaccgacctatccttgccccggccttccgccaccgcgaaaggccggggccgtcttgcagccacgacaagaaaaaccatccccgaaccagcctgacccaagaggaaacccaccacttacgaaccactggagtacgcgatgagtgccaacgtcgatctcaaccaacgtcccgactacgacgccgtcctgcaggacatcgccgactacgtgctggactaccgcatcgattccacggaggccctggacaccgcccgcaactgcctgatggataccctcggctgcggcctgctggcgctgcgcttcccggaatgcaccaagcacctcggcccgctggtcgagggcaccctggtcccgcacggcgcgcgggtgccgggcacctccttccggctcgacccggtcaaggccgcctgggacatcggctgcatcgtccgctggctggactacaacgacacctggctggccgccgagtggggccatccctcggacaacctcggcggcatcctcgccgtcgccgaccacctctcgcagaaacgcctggccaacggcgaagcgccgctgagcatgcgccaggtactggaagcgatgatcatggcccacgagatccagggcgtgatcgccctggagaactcgttcaatcgcgtcggcctcgatcatgtgctgctggtcaaggtcgcgtccaccgccgtctgcgccaagctgatgggggccgaccgcgagcaactgctggccgccctctcccacgccttcgtcgacggccaggccctgcgcacctaccgtcacgcaccgaacgccggctcgcgcaagtcctgggccgctggcgacgcgacgagccgcggcgtgcgcctggcggacatcgccttgcgcggcgagatgggcatccccggcgtgctcagcgcgccgcaatggggtttctacgatgtcctgttcagccacaccagcaaggacctggcgaccaagcccgaggacaagcggcgcttcagcttcccccagggctacggcagctacgtgatggaaaacgtgctgttcaagatcagcttccccgccgaattccacgcgcagaccgccgccgaggccgccgtgcgcctgcatccgctggtgaaggaccgcctgcaacggatcagccgcatcgtcatcaccacccacgagtcggcgatccgcatcatttccaaggtcggcccgctggccaaccccgccgaccgcgaccattgcctgcagtacatgaccgccgtgccgctgatcttcggcgacctggtggccgagcactacgaggacgccttccacgccgcccacccgctgatcgatcgcttgcgcgagaaaatggagatcgtcgaggagccgcgctacagccgtga

SEQ ID NO: 12853 - DNA, 501 bp, Pseudomonas aeruginosa
cgacggaaggtgcggttgaaactgcgcaggctggtatgcagcaacccggcccagcgttcggcgctggcgcggatgtcgggctcgacgaggaacgcctcgcagagcgccagccagcgcggctcgggcggcaagggcacgtgcagcggcagcgtctcggccgccgccagctcatggagcaacagcgtcgccaacgcgccgtcgcgaccttcggtgtcgtattctaggggcatgtccaccgccgccagcaacagttgccgcagcagcggcgacaccgccagcacctggcagtgcgccggcatcgccatggcgctgccgggctcgatgtacaggctgcgggtgctcaccccgagcattcgcacctcgtgctcgacgcccggcggaatccacactgcgcgctgtggcggcaccacccagccggcgtcgccggtacgcacctgcatcaccccgctggcaccgtacagcaattgcgcgcgacgatgccgatggcgcggcagcaggtag

SEQ ID NO: 12854 - DNA, 849 bp, Pseudomonas aeruginosa
gctggccttccgctctcgctccggaaacccgccatgttctatctcctgctctttctctgcggctgcctcaccggggtcagcgccgtgttgttcggctttggcggcggcttcgtggtggtgccgctgctctatcacctgctgcaactcggtcgcgccgccgacgacccgctggcccaggcggccatgcaggtcgcggtggccacctcgacctgcgtgatgatcgtcaacgccgccctcgccacctatcgccaccggcgcgccggtagcctgctgcgcgcctatgtctggccgctgggcgcgtacatcggtgtcggcgcggtgcttggcgcggcgctggtcggcctggccagcggcgacttcattcgcctggccttcgtcgcctacctcgccatcaccatcctcgactgcctgttgcgtcgcggcttcctcagccgcgccgaggagcgccaggcgcggccgctgggcgtcggcgagacgcgcctgggcggaacgctgatcggtgcgatcgccaccttcctcggcgtcggaggcagcgtgatgaccgtaccactgctgcgccgctgcgggctgagcatgacccaggcgacctccatggccaacccgctgagcctgccggtggctcttggcggcacccttacctacctggtcctggccggctaccaggagcaaggcctgggccgaggcttcgtcggctacatcgacctgctggccttcgccaccctggccggcggcggctggctcggcatccgcctggcgaccccgctgatcgggcggcttcccgatgcgctgcatgcacgggtgtacgtcggcctgctggcggcggtgatgctgagcatgctggcgggctga

SEQ ID NO: 12855 - DNA, 192 bp, Pseudomonas aeruginosa
tgccccagcctgggtagggcgaataacgccaacggcgttattcgccggatgcaccggaccggatatcggcgcaacgaaaaaagggcctcgtccgaggccccttttcttttccggcgctacaccgctcaggacgccgcgcggcttaccgagccggtgccggcaggctccttcggcgccaggttgaaggcgtag

SEQ ID NO: 12856 - DNA, 4431 bp, Pseudomonas aeruginosa
ggaagcggatttcgccaacggcgcggcccctgcgcgataccgcacagcgggcgacgacggggcgtcataggttccaggactgcacaccggaagaggctgtccgctctcgtggagcgaacgtgggcattgcgggagtcgactacaactgaggtcgggccggagttttacacaagatttcaaggccgtcatgccccgcgatggggcaactggaccaaaggcgtaaggaccgccaacgctgaatggattcactccctgggccgcgcgcgcagcagcagggacagcggccggccgagccgggagtggacggtttcgcgctggccttgcaggcgccagctgcgctcgagcagccggctgcgctgcatggggtcagcgcaggggttcgcggcagcggagatcgcggtaggggccgtcgagcctgacccagccgtctcccggcgaggtctgcatgcaggcgacctggccgtcgagcttgctctgccatttgtagaagggcgccggcgcggcctgcgccgcgaggccggagaaacccgccaggacgacaccgacgagaaggggaaaaagtgtgcgcatcgacattccggacccgaaacacaaggaactcagacagacactctaacccctgcgccacgccgctccaatcctcggtcgtccgattgccaccggggagattttccttgcacgaatgacagcagggttgcagcgggacaactagacttccccccaggtgcggatgaattgcgcagctacaggcggtgcgagcatgggtgcatcagaacgatccacgaacgacccttccgagctgcaaccctgcagtctccctgcctccgcttctcctcgaaaaagccgtctccgccaacgcctgatgctgatcggcttcgccttgccgatcctcgccgcggtgggcatcgtggtacttcacgaagcgcacacctcgcggctgcaggcacgcgagctggcacgctatgccgcgaccctggactacgaggtgcgccagggtcccagcgaggccatcctgttcccggcggacggccccttcgaccgccgcctcggctaccagttgctgccttcgttcatgcagcgcctgtacgaccgcgactacgccatcacccgccaggcgcacttctccccggcactgatgcgctacgccgaacaccggctgttcccgccctacgcggaaaaggcccaggccgggctggacatcgccgattgccgcggcgtgccgatctacgacttccgctatccgcaacggcgctacgcgaacttcgccagcctgccgccgctggtggtgcagagcctgctgttcatcgagaaccgcgacctgctcgatcacgaacgcccctacctcaacccggcggtggactggggtcgcttcacccaggcggcgctgtcgcaggtcggcaagatgctcggcttcagcgcgcactcctccggcggcagcaccctggcgacccagatcgagaaataccgccactctgccgaagggcgcaccggcagcatcggcgacaagctgcggcagatgctctcggccagcgtacgcagctatcgcgaaggcccggccaacttcgccgcgcgccaggacatcgtgctcacctacctcaactcggtgccgctgtcggcggcgccgggctacggcgaggtcaccggcctggccgatggcctgtgggtctggtacggcgccgactaccggcaggtcggcgaggcactcgacggcaaggccggactcgccgcccagggcctggccctgcgccaggtgctggcgctgatgatcgcccaccgccggccttccttctatctggcgccgcgcggccgcgacgagctggaccggatgaccgacagccacctgcgggtcctgacccaggccggcgtcatcgaggcgccgttacgcgatgcggcgctggcacagaagctggcgttccgcgacccccgcagccagccgacggtgcaaccgctgccgaccaacaagggcgtgaccctggctcgcacccgcctggccgggatgctcggcgtgccactgtacgacctcgaccgtctcgacctgcgggccaataccaccctccagcacgagttgcaggaaagcgtcaccgcctacttgcagaaactcgccgacccggactacgccgcccagctcgggctgatcggcgaacgcctgctgaccccgacctcgacccgctcggtacgctacagcttcaccctgttcgaacgtacgccgagcggcaaccaggtgcgggtgcagaccgacaacaccgaccagcccttcgacatcaacgaaggcagcaagctggagttgggctccaccgccaagctacgggtgctggccagctacctggagaccgtcgcgcagatccaccgcgactatggcggcatgagcgtcgccgagctgcgcaaggtggaagtggagccgctcgatttcatcctccgctggggcatcgactacctggtcgccagccgcgaccgcgatctttccgcgatgctccaggcggccatggaacggcgctattcggccagcccctacgagagcttcttcaccggcggcgggctgcacaccttcaacaacttccgcaaggaagacaacggccgccggccgatgctgctggaagccctgcgcgaatcgatcaacctgcccttcgtgcgcctgctgcgcgacctgatccgccacgatatctaccagaacgccgggagcaaggtgcagttgctggccgacgacaaggacccgcgccgcgccgactacctcgaccgtttcgtcgacaaggaaagccaggtctacctgcgccgcttctgggtcaagtaccgcgacaaggacgccaaccagcgcctggagaccttcctcgacggcctgcgtccctggccggtgcggctggccgcgatccaccgctacctgcagccacaggccgacctggcgagcttcagcgccttcctccgcgaacgcctgccccgcggcagcctgaccgacaagcgcgccgccgagctgtacgagcgctacggcccgggcaagttcaacctcaacgaccagggctacgtcgcccgcgtgcacccgctggagctatggctgctcggctatctgcagaagcagccgcaggcgaccttcggcgaggcggtggcggccagcggcgccgagcgcaaggaggtctacggctggctgttcaagtcgcggcacaagaacgcccgcgacaagcgcatccgcatcctgctggaggtggaggccttcctcgacctgcaccagcaatggaagaaactcggctatcccttcgatcacctggtgccctcctacgccaccgccctgggcagctccggcgaccgcccggcggcgctggccgaactgatggggatcatcgtcaacgatggcgtgcgcatgccgaccctgcgcctggagcacctcgacttcgccctgggtacgccctacgagacgcgcttcgccccggaagccaccctcggccagcgggtgatgacctcggaggtcgccacgaccctgcgcaacgcgctgtcccaggtggtcgacgccggcaccgcgcggcgcctgcaaggcaccttcagccgtccggacggcgcgccactggtgatgggcggcaagaccggcaccggcgacaaccgcctgcagaccttcagcgccggcggccacgtgcgcagttcgaaggcactgaaccgcaccgccactttcgtcttctacatcggcccgcggcacttcggtaccctcaccgcctacgtcgacggcagcgagtcgagccagttcaagttcacctcggccctgccagtgcaggtactcaagggcatggcaccgctcctcagggactacctcgacccacgcaccgccacccgctgccaggtaccgttgtcgccgcaacagatcggccgcctgtagcggttcagcgcaccggccagtaccaggccggccggtccagctcgcgcagcccctggatgcgggtctcgccgaagtccttctccagccccagcgaatggcattccgggtgctcttcgagcgtcgcgacaagccgcgcggcgtgcgacaccaccagcacctgggagtgctgcgcggcctggccgaccaggcgcccgagggccggcagcaggtcgggatgcaggctggtttccggttcgttgagcaccagcagcgccggcggccgcggcgacaacagggcggcgatccacagcaggtatcgcagggtgccgtccgacagctccgcggtgcgcagcggccgcagcaggccgggctgctcgatcagcacttcgaagcgccctcccgggttgtcaatgtgcaggcggctgccgggaaaggcatcgtccaccgcctcgtccagcgccgccgcatcgccgatctcgcggatggtctgcagggccgcggccaggtcggcgccgtcggcgcccagcaccggtgtatgggtgccgatctgcggacaccgcgccggcgcctcggcgtcgctgcggaaatggtcgtag

SEQ ID NO: 12857 - DNA, 963 bp, Pseudomonas aeruginosa
gcaatagttgttcagggtgaattcagttcacccatggagattccaatgttcgcttccctgccgctgaccgcgttgcgcaccttcgaatcggcggcccgccagtcgagcttcaaggccgccgccgaggagcttgcggtaacgccaaccgcggtttcccaccagatccgttcgctggaagcctggctcggcgttccgctgttccagcgcctgccacggaaagtgcgcctgaccgactgcggcgaacggctgttccgcagcctgcacggggccctgctggaaatttcgcagagcgtcgacacgctgcgtccgcagcgcagcgtaggcaacctgacggtctccaccaccccggccttcgccgccctctggctggtgccgcgtctcggccgcttctacgccgcgcacccgcagatcaacctgcgcctggacaccaactgcgaagtcctcgacctgcaccaggacgccagcatcgacctggtgatccgctacagtctcgaagaccatccgaacttctacggtctctgcctgttcgacgaatgcttcgcggtctacggctcgccggcccaggtcgccctggccgcagaacggcagccgaccctgatcagcgtgcgctggcacaactccaggctctacgcccacggctgggaggcctggtgcgcgcaggccggcgaagactggatggagggccagccggtgatccgccagtacgacgaggagcactatgccctgcaggcggccatcgccggccagggactggtgctggccagttcgatcctggtttcggaaagcgtcgccagcggcctgctgcaaccctacagagcggatatcagtgtcgacggcgccggctacagcgcgctatgcgtgcccggacgggaacgtcatccgccggtgaaggcattcttcgaatggctgaggctggaggcacgacagtcggggcacgcttgccggctggagcgggacgcctga

SEQ ID NO: 12858 - DNA, 2073 bp, Pseudomonas aeruginosa
gcggcgcggcgggacagggacaacgcggctgccgttatccgtcctgcgcggagaggcgcagcagccgccggaaaaaacgacggcccgcaccttgcggggcgggccgtctccatgcgcgggcgctttacccgcccgcaggctcgatcagcgctgggttaccggagcggcggagccctggtgcgcctcgcggtactcctgctccgcatcgtcgaagcgcttgagcatgctcgtcgaaggcgccttgccgagcaggctgaagacgacgatggcgacgctggcgaagaggaagccggggatgatctcgtacaggccggtccagcccaacaggttcttccacaggatcaccgtcgccgcgccgacgatcatgccggccagcgcgccgttgcgggtcatccgcttccacagcagggagaacagcaccagcgggccgaaggcggcgccgaagccggcccaggcataggacaccaggccgagcacgcggttttccgggttggaggccagccagatggcgatcaccgccaccagcagcaccatggcgcgaccgacccagaccagttccagctggctggcgcccttgcgcaggaaggccttgtagaagtcctcggtgagcgccgaggagcagaccagcagctggcagctcagggtgctcatgaccgcggcgaggatggcggacagcaacacgccggcgatccacgggttgaacaggatcttggccagctcgatgaatacccgctcggggttctcgctgaccgcgccggcctgctccggatgcgcctggaagtaggcgatgccgaagaagcccacggccacggcgccaccgaggcagaggatcatccaggtcatggagatgcggcgcgcggccgggatcgatttcaccgagtcggcggccatgaagcgcgccaggatgtgcggctggccgaagtagcccaggccccaggccatcagcgagatcacgccgatgaaggaggcgcccttgagcatgtcgaagctggtcgcgtccttcagctcgatggcggtgaaggtcggctcgacgccgccggtggcgagcatcacgatcaccggggtgaggatcagcgcgaagatcatcagcgaggcctgcacggtgtcggtccagctcaccgcgaggaagccaccgatgaaggtgtaggcgatggtcgccgcggcgccggcccacagcgcggtctcgtaggagaggccgaaggtgctctcgaacaggcgcgcaccggcgacgatgccggaagcgcagtagatggtgaagaacaccaggatcaccagggccgagaagatccgcagcaggcggctgttgtcctcgaagcggttggtgaagtagtcgggcagggtcagcgcgttgccgttgtgctcggtctgcacccgcaggcggccggcgacgaacagccagttgaggtaggcgccgacgatcaggccgatggcgatccagctttcggacaggccggacaggtacaccgcgccgggcaggcccatcagcagccagccgctcatgtcggaggcgccggcggacagcgccgtgacgaagctgccgaggctgcggccaccgaggatgtagtcggagaagttgttggtggagcgatatgccgccaggccgatcaggaccatggccgcgatgtagatcacgaaggtgatcagcgtgggcgtattgacactcatagggactcccctattgcttgtttttatccgggcccttgcgtgtgcaagcaacgggtagcgggcccttggttggcagaatggcgcttgtggcgtcactccgtgagcgcttgccggagcaagccggaaacgtgggtggcctcaaacgagtccgaacaggcccacgcctcacgatccctcccctgtcgggcagggaaaatcgtcctttatggtccgttccgggcacgcaccggaacggcggtcatttccctcggcgttcgctgcggcgaaccccggaaaccgacccgggcgccaaggcgcccgggaacggagtatcactcggcgtcggccagcgacagcagcgacgcgttgccgcccaccgcggtggtgttcaccgacgtggtgcgctcgctgacgaaacgcagcaggtag

SEQ ID NO: 12859 - DNA, 675 bp, Pseudomonas aeruginosa
ccgttcaggttgcccggcaccttggtctcggcgatcagcttgccggcggccttcagcgcggcgatgtgctgctccaggccggccttggcctcggcgtcgatcaccgggccgacgtcgctgacgcgcacgtcggtcgggccgaccttcagctcggccatggcgcccttgagcaactcgatcacccgctcggcgatgtcctgctgcacgtacatcacgcgcagcgcggagcagcgctggccggcgctggtgaacgcggattgtaccgcatccttgatcacctgttccggcaaagcggtggaatcgacgatcatcgcgttctgcccgccggtctcggcgatcagggtggcgatggcgccgggcttctcggccagttggcggttgatgatgcgggcggtgtcggtggagccggtgaaggccaccccggcgacccgcgcgtcacggcagaacacgccgccgagagtggcgccgtcgcccggcagcagggcgataacgtccttcggcaggccggcttcgaacatcagttcgacggtgcgcgcggcgatcaggctggtctgctcggccggcttggccagcacagtgttgccggccaccagcgcggcgctgatctggccgaggaagatcgccagcgggaagttccacgggctgacgcaggcgaagatgccgcggccttcgtag

SEQ ID NO: 12860 - DNA, 519 bp, Pseudomonas aeruginosa
ccctgctcgcggcatggacgaccgttcttcagcgcttcggagatggtccggccaagcacgaactgcttgcccatcagcttcatcgccgggttcatcgcggcgcggatcaccggttcgccagagcgctgcaccagccggctgatgacgctcggggcgcggccgtcggtgcgttcgtcgatgttcaccaccttgccggtcatcaccaggccccaggcggcgaaattgaccagaacgttgtcgctctggccgagatggcgctgccagtcggcggcggacagcttgtcgcggatcagcgcgtcggcggtcgccgcgtcaggcacacgcaacagcgcctcggccagacacatcagcatcaggccttcctgggtgtccaggctgtattggcgcaggagtgcgtcgagggtatcgacggcgttgtcccggctgcgcacggtttcgatcagtgcgcgggcgttgcggcggatagcctcgatgccgtcgggaccggggtcggcgagctgcagcagttcgcccaggtag

SEQ ID NO: 12861 - DNA, 2157 bp, Pseudomonas aeruginosa
atacgccgatccgaccccgtcgcccttcctccgggaagggcctgggttcgctttggcctgaaaaaagtccgacccatgaccatggagcccgcaatgtcctcttccggccttttcccttcccgtccgctctggcctctcacgccactggcgctggcctgcctgatcgtttcgggggaaacgctcggcgccgacggccgccccagcgaattgccctcccaggtgatcaccgccaacccgctgggcaacgaatctcccgccacgcccagcagcgtgctcgaaggcgacgagctgaccctgcgacagaaaggcagcctcggcgaaaccctcaacggcctgcccggggtgtcctccacctacttcggaccgggcgccagccgaccggtgatccgcggcatggacggtgatcgcatccgcctgctgcgcaacggcatcggtgcgctcgacgcctcgtcgctgtcctacgaccacgcggtgccggaagaccccaacagcgtcgagcgcctggaagtggtacgcggcccggccgccctgctctacggcggcaatgccatcggcggggtggtgaacagcttcgacaaccgcatccccagcgaacccgtcgacggcatccacggcagcggcgaactgcgctacggcggcgccaacaccacccgtagccgctccggcgcactggaggccggcgacggcaacttcgccctgcacgtggacgccgccagccgcgagttcaacgacgtcaggattcccggctacgcccattccagccgccagcggcagatcgacggcgacaccggcaagcatcgggtgcagaacagcgacggccgccaggacggcggcgccgtcggtggctcctatcactgggagcacggttacgccggcctctcctacagcggctacgacagcaactatggctcgccggccgaggacgacgtgcgcctgaagatgcagcaggaccgctacgccttcgcctccgagatccgcgacctcgaaggcccgttcacctcgctgaagctggacgccgcctataccaagtacgagcacaaggaaatcgaggatggcgagaccggcaccaccttcaagaacgaaggctacgaaggccgcatcgaggcccgccaccgcccgctcggcccgctgaacggggtggtcggcgcgcagttcgccaacagccgcttctccgccctcggcgaggaagccttcgtgccgcacacggaaaccgacagcgccgcgctgttcgccctggaggaatggaagctcagcgaccgcctcgacctcagcttcggcgcccgcctggagcacacccgcgtggaccccgacgccaagggcaacgagcgcttcgccgagaacgacggttcacagagcttcaccaccggcagcctgtccaccggcgcggtgtacaagctgacgccgatctggtcgctggccgccaccctcagctacaccgagcgcgcaccgaccttctacgagctgtacgccaacggtccgcacgccgccaccggcacctacgaggtaggcgatgccgacgcggacaaggaaaaggcggtctccaccgacctcgccctgcgcttcgacaacggcgtgcacaagggcagcgttggggtgttctacagccgcttctccaactacatcggcctgctcgccagcggtcgccatcgcaacgaggaaggcgaagtggtcgccgccagcgatgacgaggcgctgccggaatacctctacagcggcgttcgcgcggacttctacggcgtcgaggcgcaggaccgcatccacctgctggaaagcccgtacggcaacttcgacctggaactctccggggactacacccgagccaagaacaaggacaccggcgaaccgctgccacgcatcgccccgctgcgcctgaacaccgcgctgatctgggagttgcagcagtggcaggcgcgggtcgacgtcgaacacgccgcctcgcagcaccgcgtgccggaggaagaactctccaccgacggctacaccaccctcggcgccagcctcggctacaacttcgacctcggcgagagccgctggctggccttcgtcaagggcaccaacctgaccaaccagaccgtgcgctacgccagttcgatcctgcgcgaccgggtgccggcggcgggacgcggcatcgaggcgggggtgaaggtggcgttctga

SEQ ID NO: 12862 - DNA, 405 bp, Pseudomonas aeruginosa
acaagctgtcgatcctcgagagcggctcgcccgagtacgccgtcacccgcaactacctggactgggccacagccctgccctggggcgtgtacggcaaggacaagctcgacctcaagcatgcgcgcaaggtcctcgacaagcatcacgcgggcctcgacgacatcaaggatcgcatcctcgagttcctcgccgtgggtagtttcaagggcgagatcgccggctccatcgtgctcctggtcggcccgccgggagtgggcaagaccagcatcggcaaatccatcgccgagagcctcggccggccgttctaccgtttcagcgtcggcggcatgcgcgacgaggcggagatcaagggccaccgccgcacctacatcggcgccctgcccggcaagctggtgcaggcattga

SEQ ID NO: 12863 - DNA, 1422 bp, Pseudomonas aeruginosa
ccgtgcatttcgccaagcgctacggcgacgtggccaaggtgctgttcccggcctgagccggcggcggatggccgaccggttcggccgtccgccgcgccaaccttggcactcgggcgccagcagggtttatgctggcgccctttccattcgagccgaggagcgctgcatgtccttttccccctcccgtctgctgctgccattgtccatcgtggtcctggccggctgcgccgggcaacagaagccggtggtcaccctggacgacgccgacgactgttcgccgctgaagctgacgcaaggccaggaactggtgctgaccctgccgagcaatcccaccaccggcttccgctgggaactgcgcaaccctgctgccagcgtgctcaagcgccttggcccggaggtctacagcaattccgaagaagacagcggcctggttggcagcggcggcgaatcgacctggcgcttccgcgtcgccgccagcggcgacgaccgcctggaactggtctaccggcggccctgggaaaaggacgcggaaccggcggaaagcttttcctgcgcgatccaggtgcgctgaaaccgctgcccgcggcggacacattctgtacgaagaccgacgtcctgcgccgtggcgacctggcctatcctgacaggccccgtcgccctgaggactccatgctccgcgcctccttcgtcctgctcgccctgtcctgcgccgctcctctgctctcgctggccgaaccgttgcgcttcgcaggcgacgacggctgcccctacctgtgccctggcacgccgcagcggcccggctacctggtcgaggcgctcagccaggtccttcgggagccaccgcacttcgacagcctgccctggccgcgcgccgtgcagatggtccgcgacggccatcgcgacggcctggtcggcgcctatggactcgacggcctgcgggtcggcagcgagcccatcggctgggtcgggctggccttctatacccgccacgacagcgactggcactactccggcgatgcatccctgctcggccagcgcctgggcctcgcccagggctacgtgaacaatccgcgcttcgaagcctggcgcagccaggccggcgacgacgacctgcacctgcaggtcctcggcggcgagcgcgtgctgccgcgcaacctgcagaaactgctgctcggccgcatcgacgtgctattggaagaccgcgacatcatcgagcactacctggagcatcatccgcagctcgccggacagatccgccgcgccggcgaactacccgggcggcagccgctgcacgtcggcctcagcccgcacctgccggaggtcgacgcgcgtctcgcggaactcgacgaagggctacgccaactgcgtcgcgaaggcaccctgaaggtcctcggcgagcgctataggctttctttcgaatga

SEQ ID NO: 12864 - DNA, 777 bp, Pseudomonas aeruginosa
cccagggcaacggccgcatgctgtcgttcatcgacgtgcggctcatgttcatccagccgaacatccccatcgattacctgccgggcggcctggtgcaatgcctggaagcgaaggaccgttgcatcggctacgccttcgatttcagcaagaccgacacccagcgggtcggcagcttctgggcggacgtgttcaacttccgcaagaaacgggagttgcagggctggtcgttcaaggcggtgttcgtcttcgtcaacgacgtgctggtgcacaaggtcagcaacggcgaaccgaacatccatcgcctggaagacaagaagaacccgctgggtccgctgcagggcgcgggagagtacttctccgacaagctcaggtgattcgcctgcgcgcatgggtgaatcgtcgccgcgcagttgggcgacgctcatccctcggctacaattcggccccctgaaaagccgtgatgcccgaggtcacccgcgtgagcgagtccgatcgcctgttcgcccaaccccagcaacgtgtcgccgacttcgtgttcaacgaagacgtggtgcgcgtgttccccgacatgatcaagcgctccgtgccgggctaccccaccatcgtcgagaacatcggcgtactcggcgcgcagttcgcccagccgaacagcgtgctctacgacctcggctgctcgctcggcgcggtcacccagtcgctgcgccgccacgtccgcaacgacggctgccgggtgatcggggtggacaactcgcacgcgatgatcgagcgctgcagtga

SEQ ID NO: 12865 - DNA, 1047 bp, Pseudomonas aeruginosa
acggctgctggccgccggcttcagccgggtcagccaatggttccagtgtctcaacttcgcatcgatgatcgccctgccatgatccagcacctcgccctcgacgccctccagcgacacctcgccggctctccgctgtacggctgggcgaccagcctgcccgcgcagatcgccgcgcgcatcgaggaaggccacggcgacctggcccgttggtggagcgcggtccagcgcctgccccaggtgcccgcaccgaaggtcgaactggcccagcgcttcgccctgcacagcgaccacgatgcggcgctgcaagcgcaggtgaaggaagcgctgcaagggctgattccctggcgcaaggggccgttcgacttcttcggcgtacaggtcgataccgaatggcgttccgactggaaatgggagcgtgtctcgccacatgtcgaactgcgtggcaaacgcgtcctcgacgtcggctgcggcaacggctactaccagtggcgcatgctcggcgccggcgcggaaagcgtggtcggggtcgatccgaactggctgttcctctgccagttcctagccgccaagcgctacctgccggagctgccggcctggcacctgccgctggccctggaagacctgccggagaagctcgaaggcttcgacacggtattctccatgggcgtgctctatcaccgtcgctcgcccatcgaccacctgctggcgctcaaggactgcctgaagcgcggcggcgaactggtcctggagaccctggtggtggaaggcgacgccagcaccgtgctggtgcccgaggaccgctacgcgcagatgcgcaacgtctggttcctgccctcggtggcagccctggagctctggctgcgccgcgccgggttcgccgacgcgcgctgcgtcgacgtcagcctgaccagcgtcgaggaacaacgctccaccgaatggatgcgtttccagtcgctgccggaattcctcgatccgcaggaccgttcgcgaaccgtcgaaggcctgccggcaccgatgcgcgccacgctggtggcgcgcaagccctga

SEQ ID NO: 12866 - DNA, 405 bp, Pseudomonas aeruginosa
cgaccggtatgcagttcgatagccggcgcgccgacccgggcggaggcctcgatctgccgcggatcgggatcgatgaacagcgacacttcgctgcccaccgcagccaggcgtcgcaccgcgtcgcggatgcgctgttcctggccggcgacgtcgaggccgccctcggtggtcagttcctcgcggcgctcggggaccaggcagctatgcgccggccggatctcctcggcgaaggcgagcatttcctcggtgacccccatctcgaagttcatccgcgtctgcagcacttccttgagcacccgcacgtcgcgttcctggatatgccggcggtcctcgcgcaggtgcacggtgataccgtcggcgccggcttcctcggcgtccagggcggccttcaccggatccggatag

SEQ ID NO: 12867 - DNA, 1809 bp, Pseudomonas aeruginosa
  unsure (1486): Identity of nucleotide at the above locations are unknown.
cagttcggagccctggaacagcccgggttgcagttgcgccaccggctccaggccggcctctggcaaaagctggtacaacgcctgcggctcgatcgggcgcccatcgatgtcgacatcgagagcgaaaccatagcccagttgctccagcaggcgccattcgaacgcgcgcagcagcggttcgatgggtcgccccgccgccagcagcggcagggtcgcggcgtagtgggcgaagatttccggctgcgggtcttccgccggcaacaggcggatcaacagctcgttgagatagagaccgctgaacagcgcctggccattgagcaggttgggaatgccggcgctttccaggcgggccacggtcttcagttcgccgcgcccgcgccactccgcttccagcggcacgaatggccgcgccagggcgccggccttgccgcgggcgccgcgcaggaccgcgcgcaggcgacccaacggggtgaagaagtccaccagggcgctggtttccttgtacggccggctatgcagcacgtaggtggcttgggcggcggcgaaggacatggcgggtcgaccgggcgcgagaggaatggcgcccggctggcgccgggctgccgggaacggtcagaggtcgccgtagcccagcgagcgcagggcacgctcgtcgtcggaccagccgcccttgaccttgacccagaggttgagcatgaccttggagtcgaacagtacttccatgtccttgcgcgcgttctggccgatgcttttgatccgctcgcccttgtcgccgatgatgatcttcttctgcccctcgcgctccaccaggatcagcgcatggatatgcaggatgcgaccttcctgcttgaactcctcgatctccacggtgatctggtagggcagctcggcgccgagctggcgcatgatcttctcgcggaccagctcggcggccaggaagcggctgctgcggtcggtgatctggtcttcggggaagaagtgctcgctttccggcagacgctcggcgaccagcttctccagcacgtccaggttggtcccgtgctgcgccgagatcggtactacctcggccttcggcaactgctgggtgagccattcgaggtgcggcagcaggtcggccttctcctcgatgcggtcggtcttgttcaccgcgatcagcaccgggcaactgacgtactgcacgcgctccaggaccatctggtcctcttcggtccagcgggtgcggtcgaccacgaagatcaccacgtcgacatccttcaatgccgcgctggcggtacggttcatgtagcggttgagggccttctcgccgctcttgtgcaggccgggcgtatcgacgtagacggcctgcacctcgccctcggtcttgatcccgagcatgttgtgacgggtagtctgcggcttgcgcgaggtgatcgccagcttctgcccgaggatgtggttgagcagggtggacttgcccacgttggggcggcccacaatcgccacgtanccgcaacggctgccggcggggatgtcgtcgtgcatgtcagtcatggccattctccacgcccagagccaccagcgcggcggccgcggccacctgctcggcgatgcggcggctgccgccgtgcccgtgggtcttgtcgctcagcagggccacttcgcaatcgacgaagaaggtccggcaatggggttcgccctggatatccaccacctcgtagcgcggcaggtcgcagccacgcgactgcaggaactcctgcaggcgggtcttggggtccttgttggtgtccaccggggtcagctcgcgcagttgcggtccgagccaggcgatga

SEQ ID NO: 12868 - DNA, 987 bp, Pseudomonas aeruginosa
cgccatcgggcaaggccctgcggcggcgttcgcggaagtgaaagcggggctgccctcgggagcagccccgcttcgcgattattcagcaggagcgcccttccgcgtggcgaacctgcgcacaggtcagtgaatcacgccgacccgggagaagttcggcaggttgctcatcttcggatcgggccagctcatccatacagcgaaggccttgccgacgatattgcggtccggaaccatgcccagcagatccttggggatcttcggatcgttccagtagcggctgtcgttggagttgtcgcggttgtcgcccatcatgaagtagtggccggcgggaatggtccactggcggtcgggctcaatgcgatagcggctcatttccttgcggatcaggtgctcggcctggcccagcttctcctggtacagggtcacgctgcccagggtgcccggttcctcgccgaccagtttctccgccaccagctcgccgttgacgtacaggcgcttttccttggtgtagcgcacggtgtcgccgggcaggccgaccacgcgcttgatgtagttgatgttcggttcgctgggatagcggaacaccatgacatcgccgcgctgcggatcaccgatcgggatcaccttggtgtccagcaccggcaggcggataccgtaggcgaacttgttgaccaggatgaaatcgccgacctcgagggtaggtttcatcgaccccgagggaatctggaacggctcgaccaggaaggaacgcagcaccagcacgatgaacagcaccgggaagaacgacttgccgtactccaccagcagcggttccttgttgagcttctccagcactgccggatcgggctcgttcacctgcccttcgtaggaagagatcgcggcccgccgacgcggcgcgaacagcaccaggtcgaccagggccagggcgccgcatacagccacggcgatgaccagcaacaacgggaaattgagtgtcatgggttctag

SEQ ID NO: 12869 - DNA, 1308 bp, Pseudomonas aeruginosa
tcagaggttcgacaaggcccgcccgggtcgccagcaatgctgccacgaaaaacccgagcagagggaaaagatagaagaggacggaggcgcgcaacaacaggtcttcatgaattcctaggacgaccgcatcgccgacccgcaggctcaggtcgctcaacgcgcgcacccgggcacgccccgcgccgacgcccaggcgctgcatcagcccctggccgcaaccggcattggccgagcaggacgagcaggtactgcggcgcacggtctcgacccataccgctcccggctcggtcgccaccactcgcccctgctcctcgatcatttttgggcggcggcctcgggccggatggacagcgccacccgctcggcggtgcccagcggcacttcgccgacgacggtcaccatctggccgccgtcatcggtctgcaggcgcttggaaaccaccacggtcgggccgagctggctgcgcgcgtcgccaaccatggcaccgtgcagcggctcgatgaacaccgagaatcgtgccaggccatcgccataggtcaggcaggcgaccggatcgggggtgaccggactgcgacgcatgaaactgcgggtcagggtgaaacctggcggcagccattccgagcgccaggccacggtcttctcgccgtcggccttggccgggccgacgacctggcattcggcgcccgcctgcaactggtcttcggcaggtgccgcgccggtattcaactgggtgaactggaagcgctcgagcaactgccccttctcgttcagcagcagcgacttcaacggcaggccggtgtcgcggtccaggtgcagctcgaagccgtagcgatgctggtcgcgcggagtcaccgcaaggaccactgccgggcggccggcgacacgggattcgccgaccaggcgcaggtcgtaccaggaagccagctgggagggatcgaacttgcgcaccggccacagctgggcatcggccagttggtcggcaaggccgccgctgatgcactgggtgcgcccgtcgacccggaccacttcctggcgcgcgccgtcgagctggagcaggcgctcgcgaaccgcaccatcgctctccacgcgatgccagatctcatgggtggagaagctgccattgcgctcgtagacgaaggtgccttggaaactgttctggcgatcggcctcggcgagacgattcagccagtcggaagcgtcggcagcctgagtggcgggaaccgccatcaggctgccaagcaaaagcaacagggaggtggtgcgcatgtctctcctcagcggttttccaggctggctgcccgagcgtag

SEQ ID NO: 12870 - DNA, 1728 bp, Pseudomonas aeruginosa
cgcctgccgatgacaggcccgcagctcatccgccggaccggcagcgggggtgcgctattgtgccgccaggcccttctatatactagggctccaccacggggaaatgcgggcatgagccaacattatcaacacgatgtactggtcatcggcagcggcgccgccggcctgagtctggccttgacccttccggaacacctgcgcatcgccgtcctcagcaagggcggactgtcgcagggctcgacctactgggcccagggcggcgtggccgccgtgctggacgataccgacaccgtggaatcccacgtcgaggacaccctggtcgccggtggcggcctgtgccgcgaggatgcggtgcgcttcaccgtggagcatagccgcgaagcgatccagtggctgatcgaacagggggtgcccttcacccgcgacgagcagcacaaccacgaggaaggcagcttcgaataccacctgacccgcgaaggcgggcacagccaccggcgcatcatccatgccgccgacgccaccggcgccgcgatcttcaataccttgctggcccaggcccggcggcgaccgaacatccagttgctgtcgcagcgggtggcggtcgacctgatcaccgagcgcaagctaggcctgccgagcaagcgctgcctgggcgcctacgtgctgaatcgggaaagcggcgaagtcgataccttccgtgcccgcttcaccgtgctggcctccggtggcgcgagcaaggtctacctttataccagcaatcccgacggcaactccggcgacggcatcgccatggcctggcgcgccggctgccgggtcggcaacctggagttcaaccagttccacccgacctgcctgtaccacccgcaggccaagagtttcctcatcaccgaggcattgcgcggcgaaggcgccctgctccgcctgcccaatggcgagcgtttcatgccgcgcttcgacccgcgtggcgagctggcgccccgggacatcgtggcccgcgccatcgaccatgaaatgaagcgtctggggatcgactgtgtctacctggacatcagccacaagccggccgagttcatcaaggcgcacttccccaccgtctacgagcgctgcctggacttcggcatcgacattacccagcaaccgatcccggtagtgccggccgctcactatacctgcggcggcgtgctcgtcgaccagcacgggcataccgacgtgccgggcctctacgccatcggcgaaaccaccttcaccggcctgcacggcgccaaccgcatggccagcaattcgctgctggaatgcttcgtctatgcccgctctgccgccgccgacatgctccagcgcctgcccggcacgcccgtgccggaaagcctgccgagctgggacgccagccaggtcaccgactccgacgaggacgtgatcatcgcgcacaactgggacgaactgcggcgtttcatgtgggactacgtcggtatcgtgcgcaccaacaagcgcctgcagcgcgcccagcaccgggtacgcctgctgctcagcgagatcgacgagttctacagcaactacaaggtcagccgcgacctgatcgagttgcgcaacctggcactggtcgccgaactgatcatccgctcggccatgcagcgccgcgaaagccggggcctgcactacacgctggattatccggacctgctgcccgaagcccgcgacactatcctggtgccgcccatctacggcgactga

SEQ ID NO: 12871 - DNA, 564 bp, Pseudomonas aeruginosa
agcgcaggcggacacgcaggcgccgatggctgtcggcgcccaatgcatcggccgggatacagcagccaaggatgcgccagcggcccggcaggcgcacgcgcagtacgatcagccagggcaacgccaggctgtcagggcgcaattgcaccgcttgccagccgcttccggcgctccacagctgccagccccgctcgtcatggcgcacgccgcggaaggcccgcgagccgcgcagcagtacctggcggtacagcccccaggcaccgtaggccaggcagaccagcgcaagcggcggcttcagccagaccggcagcgccgccagcaggatcgacagcagcgccagggcccacagtgccaggctcgccgccagcaggatcggagagacccgccagcggcattcgaacggctcaatccggctggacacggtccaggatcatccgcaccatccgccgcaggtcggcgtcttccggctcgccgcgctgcatgaaccaaccgaacatgtcctggtcctcgcactccagcagcttgcggaagcgcgcctggtcctcggcgtccaggcccgggtaa

SEQ ID NO: 12872 - DNA, 984 bp, Pseudomonas aeruginosa
cgccgccaagttcctccagggccagctgacctgcaacctcgcctacctcaacgacgagacctccagcctcggcggccgctgcaacatcaagggccgcctgctatcgagcttccgcatcctgcccgagggcgacggcctgctgctggcgatggccggcgagctgctcgaggcccagttggcggacctgaagaaatacgccgtattctccaaggccagccttgccgacgagagcgcagcctggctccgcataggcttgcgcgacgccagcgaggcactgcgcgccctggggatagacaccccggcggagagcggcaggatcgcccgccacggcgacctgctcgccgtcgccctgggcgacgcccgcgtcgagctatgggttccggcgcaacgcgccgaggcggtgcttgccacgctccgcgagcacagccgcgaggcgccgctcgacgattggctgctcggccaggtgcgcgcaggcatcggccaggtgttcggcgctacccgcgagctgttcatcccacagatgatcaacctgcaggcggtcggcggggtcagcttcaagaagggctgctataccggccaggaaatcgtcgcccgcatgcagtatctcggccgcctcaagcgccgcctgtatcgcctggcgctggacgcagacgaggtgccggcgcccggcaccgggctgttctcgccagtccattccaccagcgtcggcgaagtggtactggccgcccgtacgccggagaacagcgtggaattgctcgccgtgctgcaggacgacgccgtcgccgacggccggatcagcctcggaagcgccgaaggagcgccgctcgtcctcctcaatctgccttacacgctggacagcgaccgcgaaatccagcgctgaccgtaaactgtgcctcgccgtccgcggacggcccgccagtattcccatggccggtgcacgtagagcgtgctccggccattgcgttttcaaaggaaatgccatga

SEQ ID NO: 12873 - DNA, 330 bp, Pseudomonas aeruginosa
acagtccgctgctgcgcagcccgaaggaaatcaccgacctgcagatggcgatcagccggctgggcatcaactacacctgcaacctggccaccggcctggccatggagcagatgttccaggccaccaccgacgtggtcgatcgcaagatgcgcgaagtctggaacaagagcaccgagatcgccggcatctgccacgtgctggcccgtcactacacccgcctggcgccggaccaggcgaccctggccggactggtgcaccagatcggcgtgctgccgatcctcacctacgccgaggatcacaacgagctgctgtcggactccatcagcctga

SEQ ID NO: 12874 - DNA, 1485 bp, Pseudomonas aeruginosa
aggaagacgaggacctctccagcgccctggaagccgccaccagcatgctgcaataggcccgccctactccaccgggaagcgcacccgcaccagcaagccgcccagttcgccctggtcgagctggatctgcgcccggtgcgcccggcagacctcgccgacgatcgccagccccaggccgctgccggggctgtcgccgcgccggtagaagcgctggaagacccgctcgcggtcggcggcgggaattcccggaccatcgtcttccacttccagcacgcctccctccagcaccctgaggatcacgttgccgccctgcggggtgtgcgccagcgcgttgtccagcaggttgctgagcaattcgttgagcagcgtcggttcaccctggatccacaccggcccggcgctttccagcgccagcgaggctccccgcgcataggccagcggcgccagcgccaggcccagttcccgggccagggcggtcaggtcgatacgctcggcgccaccctcggcaatggcctgggcgccgctttcgatgcgcgccagggagagcagctggttggccaggtggatcaggcggtcggtgttcttcgccgtggtctccagggtcgaacgccaggcttccggctcctgctcgcgcaggcccagttccaggcgcgccttgagcgccgccagcggcgtgcgcaactcgtgggcggcatcggcgatgaagtgcgactgccgctcgaacaggctgcgcaggcgctgggtgaagtggttcagcgactccaccagcggccgcaattcatgctggacctcgagcatcggcaacggccgcaggtcgtccggctggcgctcttccacctcgcggcgcaggcgatccagcggacgcagcgcggcgctcaccgccagccacaccagcaccagcgcgccgacgccgaggacgcccaggcgcagcagggtatcggtcatcaggctgcgcgccatgcgctcgcgggcgccttcggtctccgccacgcggatctccgccatgccgctcatgctcggttcgctgaccggttgcagcaggctcaccacgcgtacgtcgacgccctggtagacgccgtcgtagaacttggccagggccgggtagtcgtcggtgcgcagggcatcggcgggtgccgccggaagattctcgtagccggagatcatccgtccgtggatgtcgttgacctggtagaagatccgcccggcgctgtcgtaggcgaaggtatccagtgccacgtaggggacgtcggcgcgcagggtgccgtccttctcgtagagcccgtcggcgatcgcccgcgccgaggccagcaaggtccggtcgtaggcggtgtcggccacctcgcgaccgttccagtaggcgctcaggccgctcgccaggagcaccagcagcaggagcagggccagccacagcagcagccttccgcgcaggctgccggcatcagtcacccagcgcctccagcaggtagccgaggccgcggaaggtga

SEQ ID NO: 12875 - DNA, 1332 bp, Pseudomonas aeruginosa
gatcagtcgatggacggcgcagatcgtccgccaaaacgccctgcagcgtggtgctcggcgtacaagaacaagaatcggagaccactgcatgtcgacttccctgccgcaggccgcaaggtctgtacgttcgtcccgcagcaccaccctgaccaccaccgccgtcgtgctcgccagcatcgcgcccctgggcaacgccgccggcttcctcgaagacagcaaggccagcctggaaacccgcaacttctacatgaaccgcgacttccgcgacggccccggccagtccaagcgcgaggagtgggcgcaaggcttcatcctcaacctgcagtccggctacacccagggcaccgtcggcttcggcctcgacgccatgggcatgctcggcgtcaagctcgactccggccgcggccgcagcggtaccggactgctgccgaaggattccgacggccgcgcgccggacacctactcgaaactgggcctgaccgccaaggtcaaggtctcgcagagcgagctgaaggtcggcacgctgattccgaagttgccatcggtacaaccgaacaacgggcggatcttcccgcagatattcgaaggcgcgctgctcacctcgaaggagatcaaggacctcggcttcaccgccgggcgcctggaaaagaccaagatccgcgactccagcgactccgaggacctcgcgctgaacgacaagaacggccgcttcgccggggtcagcgccgatcacttcgacctcggcggactggactacaagctcaccgaccaactcaccgccagctatcactacagcaacctgcaggacgtctaccgccagcacttcgtcggcctgctgcacagctggccgatcggtcccggcgaactgaccagcgacctgcgcttcgcccgcagcaccgacagcggctcggccaaggccggcggcatcgacaacaagtcgctcaacggcatgttcacctacagccttggcaaccatgccttcggcgcggcctggcagcgaatgaacggcgacgacgccttcccctacctggaaggcagcaacccgtacctggtcaacttcgtccaggtcaacgacttcgccggccccaaggagcgctcctggcaactgcgctacgactacgacttcgtcggcctcggcattcccggcctgaccttcatgacccgctacgtcaagggcgacaatgtcgaactcgccgggcagcgcggcgaaggccgcgaatgggaacgcaacaccgaactgcagtacgtgttccagagcggcgcgctgaagaacctcggaatccgctggcgcaacgcgaccttccgttccaatttcacccgcgacatcgatga

SEQ ID NO: 12876 - DNA, 1053 bp, Pseudomonas aeruginosa
gaaccgcctgatcgtcagctataccctgccgatctggtaagccagaacaagaactccacaggagcaccgatgatgatgaaactgtcttttcgtcccctcgccttggttgccgccggcctgctgctggccggcgccgccgtggccgaacccaagcgtcccgaatgcatcgccccggcgtcccccggcggcggtttcgacctcacctgcaagctggcccagagcgccctggtcgaggccaagctgctgagcaagccgatgcgcgtcacctacatgcccggcggcgtcggcgcggtcgcctataacgcggtggtcgcccaacgcccgggcgacgccggcaccatcaccgccttctccagcggctcgctgctgaacctggcccagggcaagttcggccgcttcgacgagaacgcggtgaaatggctggccgccatcggcaccagctacggcgccatcgcggtgcgcaccgactcgccctacaagaacctcgacgacctggtgaaggcgctcaaggccgacccgagcaaggtggtgatcggctccggcggcaccgtcggcagccaggactggatgcagaccgcgctgatcgccaaggccgccgggatcaatccgcgcgacctgcgctacgtggccctggaaggcggcggcgagatcgccaccgcgctgctcggcgggcacatccaggtcggcagcaccgacatttccgactccatgccgcacatcctcagcggcgacatgcgcctgctcgcggtgttctccgaagaacgcctgccagaggcggcgatggccaacatccccaccgccaaggaacagggctacgacatcgtctggccggtggttcgcgggttctacctcgggccgaaggtcagcgacgaagactacgcctggtggaagaacgccttcgaccaactgctggcctccgaggacttcgccaagctgcgcgaccagcgcgagctgttccccttcgccatgaccggcgaggaactcgacggctacgtgaagcagcaggtccagcagtacaagcaactggccaaggacttcggcctgatccagtaa

SEQ ID NO: 12877 - DNA, 519 bp, Pseudomonas aeruginosa
gccagcccgcgcgcggccggaccccggccgcgccacgaggatcgtcccatgacccgttccaacctgtaccagcgcctgttcgccgggctctggctgctcgcctgcgtcggcctggcggtcgccggctggcgttaccaggcgccgttttcctacgaaccggtcggcccgcgcgcctacccgctgctctgcctggcgctgatgggcgccggcctggcgtggctgatcgcgcggccgacgccgatccgccacgccgaggacgaacaaccgctgggcggcgccgtgctgctcaaggtgctcgcctgcatcgccctgctgctggtgttcgccggcctgttcgaaacgctcggcttcatcctcagcgccgccctggtcggctcctgcatggccattctctacggcgcccggccaatccctgcggtggtcaccgcgagcctgctcgggatcggcctctactggctgttcgaccgcgccctggacgtcccgctgccgctgggcgttctcgacttcctgccgctgtga

SEQ ID NO: 12878 - DNA, 1395 bp, Pseudomonas aeruginosa
  unsure (680),(828): Identity of nucleotide at the above locations are unknown.
ggacttcgtgatggaaaccttgaactacctcggccagggcttcggcgtcgcgatgacgccgaccaacctgatcaccgcgctgatcggcaccctgatcggcaccatcgtaggcctgctgccaggcctcggtccgatcaacggcgtggcactgctgatcccggtggcattcgccctcggcctgccgccggaaaccgcgctgatcctgctcgccgccgtatacctgggctgcgaatacggcgggcggatcagctcgatcctgctcaacatccccggcgaagcctcgaccgtgatgaccaccctcgacggctacccgatggcacgcaagggcctggccggcgtggccctgtcgctgtcggcctggagttcgttcattggcgctttcatcgccacctgcgggatggtcctgttcgccccgctgctggccaagtgggcgatcgccttcggtccggcggaatatttcgtgctgatggtgttcgccatcgtctgcctcggcgggatggccggcgaccgcccgctgaagaccctgctggcggcgctgctcgggctgttcctgtcgagcgtcgggatcgacgccaacagcggcgtgtaccgcttcaccggggacagcatccacctcgccgacggcatccagttcgtggtcctggtgctgggcctgttctcggtcagcgagatcctcatgntggtggagaagacccaccacggccaggaggcggtgaaagccaccggacgcatgctgttcaacttcaaggaggccgccagcgtattcatggtcaacatgcgatgcggtctgctaggtttcgtcatgggcgaatggcccggcgccggggngaccctggcaagcgcggtggcctatatgaccgagaagaagctggccggtgccaagggcgagttcggcaagggcgacatgcgcggcctggccgctcccgagaccgccatcggcgcctccgcctgcggcgccatggtgccgatgctgaccctcggcgtgcccggctcgggtaccactgcggtgatgatcggcgccctgaccctgtacaacatcactcccggcccgctgttgttccagcagcaaccggacatcgtctggggcctgatcgcctcgctgttcatcgccaacgtcatgctgatcatcctcaacgtgccgatggtccgcgtattcacccgcatcctcgcggtgccgaactgggccctggtgccggccatcgcgatcatcaccgggatcggcgtgtacggcgtgcatgcgaccaccttcgacctgttcctgatggtcggcatcggcgtgatcggctatatcctgcgcaagctcgacttcccgctctcgccgctgctgctgggcttcatcctcggtggactgatggagcaaaacctgcgccgcgcgctgtcgatctccaacggtga

SEQ ID NO: 12879 - DNA, 405 bp, Pseudomonas aeruginosa
ggccctggcgacgcagcgccagcagcgcatcgaactccgccagcaggcgtggctgcatgcccaggcgcaggcgcggggcgctgcccagcggacgcaggaaatcctccgccagtccgccttcgaaatgtacccagtagatgctccagggccgctgcgagtcggcgccgtaggcatgttcccggcccttgggcaggaccagcaggtcgccgccgccgacctcgacgcgctcgccggcacactccagccagccgcgtccggcccggcagtagatcaacaggttgtcgtccggcgcgcgccgctgcatgtggtggccatgcgcctccggatagtaaccgagggccagcgggtagcaggcctggccgagcggatggcgggccagggcgcgacgcaggcggggcggcgtga

SEQ ID NO: 12880 - DNA, 1563 bp, Pseudomonas aeruginosa
atcccaagatcgtccatcccttgcgcaagatcgtcaatccacaggcggcttgcggccggctataacgactcaaaacaacatcccggtccaccgggaagcggaggcgacgatggccaaggcaatcccccaactgatcgacggcgaatggcgcggcagccgttcccgcgagctggtcgaagtcaccgatccggcgacccaggacgtcctcgcgctggcgccgaaggccaccgccgacgagatcgagcaggccatcgccagcgcccagcgcgccttcgagacctggcgcgaagtcccggctcccgagcgagcgcggttgatgctgcgctaccagcacctgctcaaggaacaccacgacgaactcggcgaactgctggcccgggagaccggcaagaacctcgccgatgccaagggcgacgtgtggcgcggcatcgaggtggtcgaacacgccgccaacgtggccagcctgatgatgggcgagacggtggaaaacgtcgcccgcgagatcgacaccgccagttggatccagcccctcggcgtgtgcgccgggatcaccccgttcaattttccggcgatgatcccgctgtggatgttcccgctggccatcgcctgcggcaacaccttcgtcctcaagccctccgaacaggatccgctgacacccaaccgcctcgccgagctgttcctcgaggccggcgcgccgaagggcgtgctgcaggtgattcatggcggccgcgagcaggtcgatgccctccttacccacccggacatccgggcgatttccttcgtcggctcggtcgccgtcggccagcacgtgtaccgcaccggcaccgcgcacctgaagcgggtgcaggccttcgccggggcgaagaaccacatggtgatcctccccgacgcgaacaaggcccaggttctcggcaacctggtcggcgccagttgcggcgccgccggccagcgctgcatggcgatcagcgcggcggtgttcgtcggcgcggcgcgcgagtggattcccgaactggccgagcggatggccgccctgcgccccggccactggcaggacccggacgccgcctatggtccgctgatcagcccgcaggcgcgccagcgcgtgctgcgcctgatcgccgaaggcaaggcggaaggcgccgagtgcctgctcgacggctcgcagtgccaggtcgaaggctatcccaacggcaactggctcggtcccaccctgttccgcgcagtgacgccgaagatgggcctgtaccgcgaggaaatcttcggcccggtgctggcctgcctggaggtggaaagcctggaagaggccatcgccctggtcaacgccaacccctatggcaatggaacaagcctcttcacccgctccggcggcgccgctcggcgctaccagcacgcggtgcaggtcggccaggtgggtatcaacgtaccgatcccggtaccgctgccgttcttctccttcaccggctggaagggttccttctacggcgacctgcacgcctacggcaagcaggcggtgcgcttctataccgagaccaagaccgtcaccagccgctggttcgacgatga

SEQ ID NO: 12881 - DNA, 1257 bp, Pseudomonas aeruginosa
accgacgaccgacgaatcgtcggccggcccgaacatgaccatccatctcaagtgacccgaggacctatggatttcgacctcaccgaagaacaacgcctgctggtggagagcgcccgcgccttcgcccgccacgaactggcgccgaaggcggccgactgggaccgcgaccatcacttcccggtggaagtcatccgcgccgccgccgaacagggctacctcggcctgtacatcgccgaggaagacggcggcctgggcctgtcgcggctgtccacttcgctgatcttcgagcaactggccgccggctgcgtggccactaccgcctacatcagcatccacaacatggccgcctggatgctcgcctcgttcggcgacgcggcgctgaagggaggcctggctgcccggcctgatcggcggcgagtcgctcgcctcctattgcctgaccgagcccgatgccggctccgacgccgcgcgcctgcgcacccgcgcccgccgcgagggcgacgaatacgtgctggacggcagcaagtgcttcatttccggcgccggcagcacccaggtgctgatcgtcatggcgcgcaccggcgaggacggcgccaggggcatctcctgcttcctggtgccggccgacgcgcccgacatccgctacggccgcaacgaggacaagatgggctggcgcgcgcagccgacccgcaccatcaccttcgaaggcgtgcgcatccccgccggcaaccgcatcggcccggagggccagggcttcgtctatgccatgaaaggcctcgacggcggccgcctgaacatcgccagttgttccctgggcgccgcccaggcggcgctggagcagtcgatgcgctacgtcgaggagcgcgagcagttcggcaagccgctggcgaccttccaggccttgcagttcaagctcgccgacatgctcaccgaactcaccgccagccgccagatggtccgcctcggcgcccatcggctggaccgcggcgacgccgaggcgaccctgtactgcgcaatggccaagcgcttcgccaccgaccgctgcttcgatgtctgcaacgaggccttgcaactgcacggcggctacggctatctcaacgattatccgctggagcgctgggtacgcgacacccgcgtgcaccagatcctcgaaggcaccaacgaaatcatgcgggtgatcgtcgcccgccgcctgctggagcagggcggcatgctcgatcgcctgctgtgaacgccgcgaaccatcgcatccgatag

SEQ ID NO: 12882 - DNA, 858 bp, Pseudomonas aeruginosa
tgccgggacgccccggcccatgatccagtgagggacttcatgaacactgccgtcgaaccctacaaggcttcctccttcgacctgacccacaagctcaccgtggaaaagcacgggcacaccgcgctgatcaccatcaaccacccgccggccaacacctgggaccgcgactcgctgatcggcctccgccaactgatcgagcacctcaaccgcgacgacgatatttacgccctggtagtgaccggccaggggccgaagttcttctccgccggcgccgacctgaacatgttcgccgacggcgacaaggcccgcgctcgcgagatggcccgccgcttcggcgaagccttcgaggcgctgcgcgatttccgcggggtgtcgatcgcggcgatcaacggctacgccatgggcggcgggctggagtgcgccctcgcctgcgacatccgcatcgccgagcgccaggcgcagatggccctgccggaggccgcggtgggcctgctgccctgcgccggcgggacccaggcgctgccctggctggtgggcgaaggctgggccaagcggatgatcctctgcaacgagcgggtggatgcggaaaccgccctgcgcatcggcctggtcgaacaggtggtggacagcggcgaggcgcgcggcgccgccctgctgctggcggccaaggtggcacgccagagcccggtggcgatccgcaccatcaagccgctgatccagggtgcccgcgaacgcgcgccgaacacctggctgccggaggagcgcgagcgcttcgtcgatctgttcgacgcccaggacacccgcgaaggggtcaacgccttcctcgagaagcgcgatcccaagtggcgcaactgctga

SEQ ID NO: 12883 - DNA, 1518 bp, Pseudomonas aeruginosa
acgtcttcgacctggtgcagaagcgccgtcgacggcctggtcgccgccggcgccagcgccgcccgcagcgcccgcgacgcggtgcagggcgccgacgtgttcatcagcatgctgccggccagccagcacgtcgaaggcctgtacctcgaggaggatggcctgctcgcgcacatcgcccccggcaccctggtggctggaatgctggaccttcgcccggacctcggcgcgaagggtccaccccgccgcccgcgagcgcggcctggcgatgctagacgcgccggtgtccggcggtactgccggcgcggcagccggcaccttgaccttcatggtcggcggagacgccgaagccctggagaaggcccggccgctgttcgaggccatgggtcgcaacatcttccatgccggccccgacggcgccggccaggtcgccaaggtgtgcaacaaccaactcctcgcggtgctgatgatcggtaccgcagaagccatggccctgggcgtggccaacggcctcgaggcgaaggtgctggccgagatcatgcgccgcagctccggcggcaactgggcgctggaagtctacaacccctggccgggggtgatggagaacgctccggcgtcgcgcgactacagcggcggcttcatggcccagttgatggccaaggacctcggcctggcccaggaagccgcccaggccagcgccagcagcacgccgatgggcagcctggcgctgagcctgtaccgcctgttgctgaagcagggctatgcggagcgggacttttccgtggtgcagaaattgttcgatccgacacaaggccaatagacaggcaggcgggtccgcgcccaggctggtcgattcgacgatgcgaggagcccgccttgaacgccctgctgctgcgttaccgtttccgcctgctgttcttttccaccgtgctgttcacggcgatcctcggcctgccgtcgagcaccaagccacgggtgctcggcagcctcctgctgctggtgctggccgggatgaacaccttgcgcagacgcagcccgctggtctacctgacggccttcttcggcctgttcagcctggccctgtacaccactgcggacttcagcagtccctactccagcctgccgcccggcctgctgcgcgggctgagcctgatcctgctgtacctgaccctgttcgccgcgctgttccgccgcgtcacccaggagcgcccggtgacccacgagctgctctacggactctgcgcgctctacctgcagatggcgctggccttcgctctcgcctactacatggtcgaacagatgcagcctgccagcttcatcgccagccatggcgcactcggcctggataccttcgtctactacagcctggtgaccctgaccaccgtgggctacggcgacatccaggcgatcaacccgctggcgcgcctgctggccggcagcgaaggagtgatcggggtcctgttcatcgccctcgccgtggcccgcagcctgaccctgatgagcgacagcgaggaggtctga

SEQ ID NO: 12884 - DNA, 1050 bp, Pseudomonas aeruginosa
ttattaagctgggctaacgagtgcatccccctcgcagcggtttatcccggcgagcgcagggcggatgatgctgatcgacgccgctctgcggcatttctcgaacggaaggtgcagcatgaaaatcgccctgatcggcgccaccggtcacgtcggccactatttcctcaacgaagccctgcaacgcggccacgcggtaaccgccctggtccgcgacccgagcaagctggcggcgcgcgacggcctcggcgtagtgcaggcggacgtcagcgacccggcccaggtggccagcgccgtggcaggccacgaggtggtcatcagcgctttcaacggcggctggggcagcgccgacctccgcgcccgccacgccgccggcagccaggccattctcgacggcgtgaaacgctccggcgtgccgcgcctgctggttctcggcggcgccgggagcctggagatcgcccccggccagcgcctggtggacagcccggaattccccgagcagtggaagcagggcgccctcggcgccgccgacgccctcgaccaactgcgcggcgagcaacgactggactgggtgttcctcagcccggcgatgctcctcgaacccggccagcgcagcggcaagttccgcctcggcggcgaccaggttctgttcgacgccaagggcgagagccggatttccctggaagacctggcggtagccatgctcgacgaggccgagcagccccgtcatcatcgccagcgcttcaccgtggcctactgaaaagaccaggcgcccctctcgggcgccttcgtcgtcagccttcggacttcgccgccggcgtgacgatatcgaaccagaagtcgaagtcgccgagcatgccgaacagttgccccagcaacagcggattgccggaactcttcagcttgccctcgaagaccaggcgtaccgccgatacctctttgagcagcagccggttgagatcggcgcggtcgatgctcacggtctgcccggcgtcctcgctctgcacgccgcgcaggttgttcaggtgcgagttcttcagttccagcaggtag

SEQ ID NO: 12885 - DNA, 705 bp, Pseudomonas aeruginosa
ccagcgcgacgagccagaacatcgccagggcgcccttggcgaacgacagaaaatgactcatgggaacctcctcgtttcggtatcggcagagtgtgccgagcaaatgcgccaagagggtccgcactttcgactggaaagcacgacggcgcccgcaggcgccgcctttccttgcgcacctcagttgcgccagcgaggtgtcccgccctgctggccctggtgtcccggacgatcctgccgaccgtgttgttgccagcgttgcggagaatgcccgcgccattgcggctggccgccgcgctgccagttgcccggatgccgctcgccacgatgggccgggcgcgattcgtggtagcgctgctggtagcgatattgctcgcgccggtagtcgcggtggccatcgtagcggcgtggcgccgggtagtagcgttggtcgtagtagcgcgtcgagtagtagcgccgttcgctgcgccagccatcgtcatacacgcgatagcgcggcacttcgtaggcgtagccgtagggctggccgcgatagtggcgccaatcgccgtcatcgtagtcgtagtcatacaccgcgcagccacccaggctggcgagaagcagaagaagcgggactctcaggaatgtgcgccacatggcagcctcctgcggccccgctgccgaccggccggacgaccggcgacgccgcgaggcgcgcatacgacgtga

SEQ ID NO: 12886 - DNA, 1152 bp, Pseudomonas aeruginosa
ccgcagccggcgtttctcggtagagtgcgcggaccaaggactgccggccccgccggaaccgctcaaggagcatgcatgcaacccatcgaccgcgcccaggcacagcagcgcgccaacgacatcctggtgttccagcgcgagctgcaacgcctcgaccaggagcaggcgttccgcctcgaaccggcccaggcccggcaactcgccgactatcacctggccctgctggacagctaccgcgaccgtttcgacatcgaccacgacctgcgcagccagcaactttcgctgggcatgcgggtagcctcgttcttcggcgccctggccttcgccgccagcgtgttcctgctgttctatcgcttctggggcctgttccccaccgtcgcccaggtggcgatcctgatcggcagcgccttcgccgcgttcttcgccacgctctgggtccaggccaaggacgcctcgggctacttcagcaagctggcggcgatggtcgcgttcgcctgcttcgtcctcgacctgaccatgctcgggcagatattcaacgtcacccccagcgacctggcgctggtgccctgggcgctctacgccctgctcctggcctacctgtgcaacgcccgcctgctgctggcggcggcgatcctctgcgtgatgggtttcatcgccgcgcgcgtcggtacctggggcggcggctactggctgagcgtaggcgagcgaccggagaacttcttccccgccgccgcgctgatcttcgccgtaccgctgtgcttcgagcagcgcaacttcagcggcttcgccgtgatctaccgggtgttcgccctgctcggcctgttcctgccgatgctggtgctggccaactggggctcaggcagctacctggcgttaccgtcggcgctcatcgaggggctctaccaggtcgccggcttcgtcgccgccgcccttgtgatctggctcggcgcgcgacgcaactgggcggacgtgagcaataccgggatcaccttcttcgtcatcttcctctacaccaagttcttcgactggtggtgggaagcgatgccgaagtacctgttcttcctggtgctcggcctcagcgccctgctgatcctgctggtcctgcgccgcctgcgcacgcccctgggcatcgccgcgaggactgacgcatga

SEQ ID NO: 12887 - DNA, 195 bp, Pseudomonas aeruginosa
ccgccctgcgccagcgctaccccgagcgccagcgctacgccatcgtcaagggccgggtgcgtccctggtccgcggtcgacggaggcaggacgctggtcggcggctacatcagccgtaccgacctcgccgcgatcaacgtgccacgacaatggcacgcggtattcgccaaggtcgacgaacaaaactaccggctag

SEQ ID NO: 12888 - DNA, 828 bp, Pseudomonas aeruginosa
cgccacccaggcttgctggtgcttcaccacggagatcgatgcggccgtgctggagcggattcccgccgagctgcgccgccgcgcctgcctctgcccacgctgcgcgcaactgctgccgcccgacgccgacgactgatgcgcctggaccgcttcctcgccaacctgcccgaactcagccgccgcgacgcgcagatgctgatcgccggtggacgcttgcgcgtggacggccaggtggtgcgcgacggcacccacgaggtgcgggtgttcagccgggtggaactggacgagcggctgctccaggctggcaagccggcgcgctactacatgctgcacaaaccgatgggctgcgtcagcgccacccgcgacccgcaacacccgaccgtcctcgacctgttcccggaagacctgcgcgacgacctgcacattggcggtcgtctcgactacaacaccaccggcctgatgctgctgaccaacgatggccagtggtcgcgccgcctgaccctgccgggcagccggcgcgacaaggtctactacgtggaaaccgaggcgcccatcgaccaacgctacgtggatgccttcgccgccggcctccacttccgcttcgaagacctggtcaccctccccgcgcagctcgaaccgatcggcccacgctgcgcccgcctgaccctgcacgaaggccgctatcaccaggtcaagcgcatgttcggccacttcgacaacaaggtgctgcgcctgcaccgcgagcgcatgggcgatatttgtctcgacccgcagttgccgccgggtgcctggcgccccctgaatgctgaagaaatctgttcggtgtga

SEQ ID NO: 12889 - DNA, 1179 bp, Pseudomonas aeruginosa
aaccccgccgcccgccgcctgtccaccgaaagaggccggaccgcaggggtttggccggccgtcgcgagcgacgctaagctgaatggcatctgtcggagcgacagcctttcccgcatggagcaagagaaagcgccaatgaaaagatcccttgccgtactgctgctggccttcgccgtcggcagcctccacgcggcgcccgccagcccagcgaacgcgcctttgccgccggccgacatcaaggcgcggctgaagagcatgaagcccggcgagtacctctggtacccggaggtttccccgcagggaccagtgaccatcgtggtcagccttaccgaacagaaggcctacatctaccgcaacggtatcgccatcggggtcagcaccctcagctccggcaagaagggccgggagaccccgaccggagtgttctcgatcctgcaaaagagcgtcgaccacaagtccgacctctacaacagcgcgcccatgccctacatgcagcgcctgacctgggacggcatcgccctgcacgccggcaacctgcccggctatcccgcctcccacggctgcatccgcctgcccatggcgttcgccaagaaactctacggcatcaccggattcagctccaccacggtaatcatttccaacgccagcagcgcgccgaaggaagtcgaccaccccggcctgctggcaccgacggtagcggacgggcgaccggtgacgctgccggtggagcccggagaaatcgcctggaacgaccccggcgcggaacgcggtccgttgtcggtgctgatcagccgcgccgaccagcgcgcctatgtctatcgcggcggccagcgcatcggcaccgcaccggtgcagttgccggcacgcccgcagaccggcatggcggtgttctcgctgctggaaaagccgaccccggaagaaatcagcgagacctcgccgaacctgcgctggtcggtggtccaggtgagcaacccgggacagggcctgacaccctccgagcaactgggcaagatccgcatggacccgaccttcgtccgcgaaatgctcggtgccatggacgtcggcagcaccctggtgatcaccgactgggcctcgacccgggacacccacagcgactccgatttcacggtgatcgccacggaaacaccgaacaatccgacgaaatcgcttaaaaagtag

SEQ ID NO: 12890 - DNA, 1011 bp, Pseudomonas aeruginosa
cattcaactgtcattgggaggcgctttcatctgcccatgagcattttgtattcgccgcgacaagcaaggtcgccgcgttcccatcgaacgattccaggaggaagcgacatgaggccggaaacagccatcatcgagatccacgggcaatacaggattcacaccgagttctacggcaacccctcggcgcagcagaccatcatcctggtcaacggctcgctgtcgaccacagcgtccttcgcccagaccgtgaagtacctgcagccgcattacaacgtggtgctctacgaccagccgtatgccggccagtccaaaccccataacgaaaaccgcacgccgatcagcaaggagtgcgaggccaggatcctgctggaactgatcgaacgcttccgtgccgacgtagtgatgtcgttctcgtggggcggcgtcgccaccctgctggccctggcgcagcgtcccggacggatccgcagggcggtggtcaactcattctcgcctcagctcaacccggccatgctcgactacctgcatcgcggcctcgactacctcgccgcctgcgatcgcacccaggtcggcaacctggtcaacgaaaccatcggccgctacctgccacagttgttcaagcgctacaacttccgccacgtcagcagcctggacgagcacgaataccaccagatgcacttccatatccgcgaagtgctgcgcctgaacgccgatagttataccgagagcttcgccggcatcgagatcccggtgctgttcatgaacggcgagctggacatctacaccacgccccacgaagcccgccagttcggccaactgatccgcggcgcggaattccacaccatccgcaatgccggccacttcatcgacgtcgagcacaaggccgcctggcaacagacccaggacgccctgctggccttcctccgcccgcagcgcacgcagccgctcaacccgatctaccgcccccagcccaacggcgccagcgtccccctcgccgccctcgccagctaa

SEQ ID NO: 12891 - DNA, 570 bp, Pseudomonas aeruginosa
aagcgcggaccgccgcggggcgaggcgaactccctcacaaaggcgcaagcgtcgcacagcggcatggcgacgcaggcagttccttgccgtcgcttcgccagcttcgttagactgccgcatcgcggcacgctttcgtggctgcgcccctccccgatccgaggcttgcatgttggagatagtagtcatccgataaccgccacttcgtcatcccgcacgaggtgtcgccggttatctgccttcgccatggctcgcacgcgccttttcgcgcagtgcggccgcgttgtcacaccgatgattacaggttctaccgacatgaacgtttccaagccggaacaacggacgcttcacgccttggcccagggcggccatatcgccttccttcgcgacgcttcgggcaagatcacccgcgtcgagtgctacaaccgcgacggccacctgctgctcgactgcaccctggcggtgttctccaggctgaagaacaagggcctggtccactcccgccagggcaggccctaccggatatccatggccgggctgaaagtcgtgcgcccgcaggcggacaatcgctga

SEQ ID NO: 12892 - DNA, 537 bp, Pseudomonas aeruginosa
  unsure (207),(271): Identity of nucleotide at the above locations are unknown.
tggccttccacgccgcattcgacgccagcggctgagccggaacgacagcagccgctatgtcgccccctggtcgcgggctcaatcgaactgggtgcccttctggatcagttccaccttgtagccgtccgggtcttcgaggaaggcgatcacgctgcgtccgtgctgcatcggcccggcctcgcgggtgacccgatagcccagcgcctnggcccgggcgcaggtgacggcggcatcctcgacctcgatggccaggtggccgtagccgtcgccntgggtgtagccgtcccggtcccagttgtgggtcaactccagggcagcggccgcgcgctcgtcctggtagccgacgaaggccagggtgaagcggccttcgggatagtcccggcgccgcagcaggcgcatgtccagggcgcgggtgtagaactccagcgcggcctcgagatcggccacgcggagcatgctgtgcaggattcgcatggaaattctccgtggaatccggcggcgagccgccggagcggggatcaaccctcgatgcggtag

SEQ ID NO: 12893 - DNA, 885 bp, Pseudomonas aeruginosa
tcagcaaatcgctcacttaaagagaatgatgtgaaactctctcaactcggattcttctgcgcagtggtcgaacgcggcaccatcgcagccgcggccgaacagttgcattgcgtgccgtcgaacatcactacccgcttgcgcgaactcgaaggacaactcggcatagccctgttcaatcgcgaaaggaatcgcctgctggtcacccccgagggccgcctgttgtaccgccatgcccggcgcctgctggcgctggccgacgagaccgccgcgctgttcgccggcgaccaggcgcacggcgcgctaagggtcggcgcactggacgtggccctggccaatcatctgccccagcgcctggcccgctaccgccgcgagtcgccgggcgttgaactgcacatccgcccggagcattcgctgctgctcgagcgcctgctgatggagggagagctggacctgatcgtcaccgacggccccatcgaacacccgttgctggccagccgcctggccttccgcgagcgcctgttgcgggtcactcccgccgacctgccggcacccactcccgaggacctcgccagcctcgaactctatgtgttcggccacacttgccactaccgccgccaggtcgaccgctggctggcggaaagcggtatccagccgcgtgcaaccctggaaatcgagtcctacccaagcctcttcgcctgcatcgaggccggtctcggcttcgcctgcgttccggagagcttcgttgcacgcatgccctccgcgcgacggggtttccatgccgaaccggtagccggcctggactccagcgatatccatttcgtctggcgcaaacagcaagcctcgccgctgatccagggcttcatcgacagcatcggcgccgactga

SEQ ID NO: 12894 - DNA, 852 bp, Pseudomonas aeruginosa
atacccctcaaccctgcgtgcgggctccatgcccgagcgccttggcgagatttgcccatagagccatcacttatgactgcgacagacagaacgcccccgccattgaaatggctctgcctcggcaaccgtgatgcgaacgacggattcgagctcttcgcccatggcatctatgcgaggaacggcgcgttggtcggcagcaagctctccctgcgcgaacggcgccagcgcgtcgacctgtcggccttcctttccggcgcaccgccgctgcttgccgaggcggcggtcaagcacctgctggcacgcctcctgtgcgtgcaccggcacaacaccgacctcgaactgctcggcaagaacttcattcccctgcatgccagcagcctgggcaacgccggggtctgcgagcggatcctggcctcggccaggcaattgcagcagcaccaggtcgaactctgcctgctgctagccatcgacgagcaggaacccgcctcggcggagtacctggcgtccctcgcccggctacgcgacagcggcgtgcgcatcgcgctgcacccgcaacgcatcgataccgacgctcgccagtgcttcgccgaggtcgacgccggcctctgcgattacctgggcctggacgcgcgcctgcttgcccccggcccgctgacgcgtaacctgcgccagcgcaagagcatcgagtacctgaaccggctgttggtggcacaggacatccagatgctttgcctcaacgtcgacaatgaggaactgcaccaacaagccaacgcactccccttcgccttccgtcacggcaggcactattcggagcctttccaggcctggccgttcagcagtccggcctgctga

SEQ ID NO: 12895 - DNA, 234 bp, Pseudomonas aeruginosa
acgccgacgcggctgccagccgtcacgccaggctggcccgctatcccgccaggcgctacccttggcagtttcgacggacagggacgacggtcatgggcaactatttcgagagccccttcaggggcaagctgctctcggaacaggtcagcaacccgaacatacgggtggggcgctacagctactactccggctactatcacgggcattccttcgacgactgcgcccgctacctga

SEQ ID NO: 12896 - DNA, 1533 bp, Pseudomonas aeruginosa
actgcggcttcacggccgccggcatgccgatcggcctgcaactggtcgcgccgcgcttcgccgatacctggctgttgcgcatcggcaagacctacgaaggctggcgcggtccgatccacggctggccccggccgccggctgactgaagccggcggccgctcgtcgctcggctccaggcctgagtgtttcagtcgtcactccgagagggccttcgccatgcgctcccccacccgtcccccagcggccgccgatccggccagccgccgcagcgtctttgccgtggtcctcggcaacgccgtggaattcttcgacttcggggtctatgccaccttcgcggtgatgatcggacggactttcttcccctccgacagcgccttcgtcagcctgctcctgtcggtcaccgcgttcggcgtcggcttcgtcatccgccccctcggcgcgatccttatcggcgcctacgccgaccgcgccgggcgcaagccggcgatgctccttaccctgttcctgatggcgctgggcaccggcggcatcgcggtgctccccggctacgacagcatcggcccggccgcgccgctgctgctggtgctgacccgcctgctgcaaggcctggcctggggcggcgaggccgggccggcgaccacctacatcctcgaggcggcaccgccgcacaagcgcggcacctacgcctgctggcaggtcgtagcgcaaggcatcgcggcggtcgccgccgggctgatgggctacctgctcaccctctggctcgacgagcgccaactgcaggaatggggctggcggattcccttcgcggccggcctgctggtcctgccgatcggcctgtacatccgcctcaacctggccgagacctttgccggacgcggccgccaggccagcacccggagcctgctcggcgaattgttcggcaatcatcggcgagccctgctgctcggtctgctgatcctctccggaagcaccatcacccagtacttcctcaactacatgaccaccttcgcccttaccgagctacacctgccggcgggcatcgcgatgctctcgacgctggtcgccggcgccgcactggcgctctcggcgttgctcggcggcgtgctctgcgaccgctacgggcgccgcgccgtgctgatcctgccgcgcctggcgctgctcgcggtgctgttcccggcactgcaggcaatgacccgtcaccccgagccggcagtcttcctcgccgtcctcgccctgctctcggccctgcatggcatgagcggcgcggcgctgatcgtgctgctggtagaaagcttcccccgggcgctgcgctccaccggtttttccctggtctatgcgaccggcgtcgccgcgttcggcggcaccgcgcagatcgtggtgacctggctgatcggcgtcaccggcaatccgctgtcgccgctgggctacctgctgctggccaacctggtctgcctgggtggggcctggctggcccgcgagacctggccgggtcgcggggacatgggaggcgcgccgctggtgctgcgcgactga

SEQ ID NO: 12897 - DNA, 984 bp, Pseudomonas aeruginosa
gaacttgcgcggttcgttcaagcgccgccggcctgtcgcgagcgacgctggggacctcattcatccggaggtcccaccatgcagttcttcctgcgctacgcctacgcgcccctcttctggtccggcttcatcggcctggcgacctggcaggtcggctatcgccaagcttcccacgcctggctggtcgccctgttcctcggggcgctcggcctgtcctttctcgccgaacgacgactgccctaccagccacgctggaaccggccgcacgccgaccgcctgcgcgatgtcctgcacgcgtcggtcaacgaaagcctgaacgcacttggcatcctcgccctgccactgctggccggagtcctgggcttctggccggtatggccgcaggcctggccgctgtggctgcaactgctgctggcgatcgtcctggccgatctcggcatcaccctggtgcactacgccagccaccgttcggcgctgctttggcggctgcacgcggtgcaccatagcgtgcagcgcctgtacggtttcaacgggctgatgaagcatcccctgcacctgggcctggaagcgctcggcggcaccctgccgctgttgctgctcggcgtgccgcagacggtcgccgcgctgctcgccttcgccatcggcatccagttgctgctgcaacacagcaacgtcgacatgcgcatcggcgggttacgccatgtgttcgcctgggcaccgctgcatcgcctgcaccacatccgctacgggcgcgccggcgacgtcaacttcgcgctgttcttcagcgtctgggaccgcctgctcggcaccgccctccatcgtcccgactaccgcctggacagcaccgacatgggcatcggcgaccagcctgactatccccgcgactatgccggccagttgctcgcgccattccgcgacctgccacgcagcaggcacgtcccacagccgccggaaggattggggcgttcagccggccaggcgtag

SEQ ID NO: 12898 - DNA, 516 bp, Pseudomonas aeruginosa
cccggtacagcgccggtacagccagttgcgccttgttcgcctggtaggcggcctgcagttcggcatcgctggggtagtcctcgggcaccgtgctcaccgactccaggtaggtacgcaggacgatctgccgcgccgccgcatcgatcaacgtcttcacctgcggacgctgttgccagtcctgggcgctggcctgttcgtagagcgccttctcggccagtcgcgcacgcatccagcgttccagtgcgtcgcggttctcgctcaactgcgcgcgggtttccgccggcacctcggccagcagcgccttcagttcgtccggcgccacctgcaaggcgccgaggcgggccaccgcgggctccgcggcggcgctggcagatggcttggcaagcgcggcctgggcctggcccgcgccgccgtcctcgcgctggccacagccggcgagaagggcaagcgcgaacgccaggacaccgcaacgaaatgccggccgcatcggctcaggcctcgccatcgacgggttga

SEQ ID NO: 12899 - DNA, 219 bp, Pseudomonas aeruginosa
tgcgcgaggcccagtccgggaaggcgttgggctgcgcccaattctccgccttggcctgggtcattacctcggccttcacttcgtcgcggatctggtcgcgcaccacctgcgggatatagggtacgcggacctccccggggacagcggcaacggccgccgcgggcgccacggtctggcgcgcctgctgggcctgctgcgcctcggcctcggcctgcctga

SEQ ID NO: 12900 - DNA, 1563 bp, Pseudomonas aeruginosa
agaaggcaacagcccgatgcgctgttcaggcaggccgaggccgaggcgcagcaggcccagcaggcgcgccagaccgtggcgcccgcggcggccgttgccgctgtccccggggaggtccgcgtaccctatatcccgcaggtggtgcgcgaccagatccgcgacgaagtgaaggccgaggtaatgacccaggccaaggcggagaattgggcgcagcccaacgccttcccggactgggcctcgcgcatcagcttcgacggcgacgtgcgcctgcgctacgagtcgcgctccttcggcaacggcaacagcaaccagatcaccgacttcgccgaactcaacgacgacggtccctatgacgtcaacccgaataccagctcgggcctgccgccgctgctcaatacccgcgaggaccgcgacagcctggtgcgcctgcgcgcgcgtttcggcctcaaggcggcgctgtcggaaagctggagcgccggcatccgcatcggcaccggttcggacaacaacccggtgtcgaccacccagaccctcggcggcggcttcggcaagaaggacctctggctcgaccagggctacctgacctggaagcccagcgagcgcctgagcctgaccggcgggcggatcgccaatccgttcctgtccaccgacctgctgtattccaacgacctcaacttcgacggcgtggcggcgatcttcaaccagccgctgagccgcgatgtctcgctgttcggcacggtcggcgcgttccccgtggagtacagctcggacaccgcctcgtcgaacggtttcgacaaggaagacagcgacaacaagtggatgtacggcgcgcaattgggcgccacctggaagatcaacccgcagcacagccttaccggcgcgctggcctactaccgcttcgacgatatcgaagggcggcgttccagcccctgccggccctgggccggagatccggagtgcgacaccgacggcagccgtccgaccttcatgcagaagggcaacacggtgttcctcctgcgcgacatcgtgcccaacccggccgacccggcgaacacgccgaacccgcagtacgtcggcctggcctcggagttcaatctgctcgacctgaacctcggctgggatgccgagctacccaacgacttcaagctgcgggtggccggcaactacgtgcacaacctgggctacgacgagggcgacatgcgcaagcgcgccggcggtgtggcgcaaatcgccaacaacctcggctccgacggcgacatcaagagcggggcgaacgcctggatgctccagttcaccctgggcaacgccctggacatgcgcgacgccggcgactggcaggtcttcgccgcctacaagtacatccagccggatgccctgccggacggtttcaacgattccaccttccaccttggcgggaccaacgccaagggctacatcctcggcgccagctatggcttcgacaagcgcgtctacggtaccgcgcgctggctcagctccgacgaggtctacggcgcaccgttctccatcgacgtcctgcaactcgaggtcaacacgcgcttctga

SEQ ID NO: 12901 - DNA, 729 bp, Pseudomonas aeruginosa
gcgctcctcgaggcagaccatgaagaggcagaccatgaacacgcgacctttctcattaccgatctgggcccaggcgctgctcgccggggccgccttcgccgcctacgccagccaggcggcctacgccgacagcctggaggaacgcctgcgcgcccagttgcgcagcaccacccagcaactccaggcgctgcagaccgaacaggcccaggccaccgcggcgaaagccgcgctggaaagccagcgcgatgcggcgctggcccaggtcaagcaactgagcgccgagctggcccgggccaagggccaggccgagcagctctcggcccagcaacaaggcttgcacgaccgggcgcggcagatggtcgaggcgagcaacgagcaactgggcaagtacaagcaggcctacgacgagttgctggtcatggcgcgagccaaggaggccgagcggcagaagctcgacctggcgttccgcgagcacgaccagcagttgcagcagtgcaccgcgaagaatcgggagatgtatggcgtggccaaggagatcctcggcgcctacgagaacgtcagcgtcgccgaggtgatgaagatccgccaaccgttcgccagcggtgcgcgggtgaaattcgaagagatggcgcagaagctcggcgacgacctctacaagacccaggtcgagaaccgccaggcggcgctcgcccagtgaaatccgacagcaaaccaggaacccggacatga

SEQ ID NO: 12902 - DNA, 1113 bp, Pseudomonas aeruginosa
tcgtcgccggcggcgtcagcccggccaacctgcgtagccatatcgaactgtgggatcgcctgctgcaggagttcatcgcctacctgcgcgactacagccgcctggccgcggagcaacagggcatggcgcaggatgccggtcaacccgtcgatggcgaggcctgagccgatgcggccggcatttcgttgcggtgtcctggcgttcgcgcttgcccttctcgccggctgtggccagcgcgaggacggcggcgcgggccaggcccaggccgcgcttgccaagccatctgccagcgccgccgcggagcccgcggtggcccgcctcggcgccttgcaggtggcgccggacgaactgaaggcgctgctggccgaggtgccggcggaaacccgcgcgcagttgagcgagaaccgcgacgcactggaacgctggatgcgtgcgcgactggccgagaaggcgctctacgaacaggccagcgcccaggactggcaacagcgtccgcaggtgaagacgttgatcgatgcggcggcgcggcagatcgtcctgcgtacctacctggagtcggtgagcacggtgcccgaggactaccccagcgatgccgaactgcaggccgcctaccaggcgaacaaggcgcaactggctgtaccggcgctgtaccgggtcagccagatcttcatcgccgcctctgcggccggcgggcttgccgaagcgcgcaagcgcgcccaggaactctaccggcaggccgcggacggcgacttcgccgaactggcgcgcaagcattccgacgacccgcagaccgcccgcaacggcggcgacatcggtgggttactggcgcaggcgcaactgctgccggcgatccgtccggcgctggaacggctgaaggtcggcgcggtgtccgagccgatccagggcgccaacggtttccacctggtcaagctgaccgagcgtcgcgacgcccgcctcgccaccctcgacgaggtccgtggtcgcctgcgcgaaagcctgcgcgcgcaacgccaggagcagatagccaaggcctacctggatggcctggtgaacaacgctaccctgagcatcgacggcgcgttgctcggcaagaccctggcggaactgcactga

SEQ ID NO: 12903 - DNA, 342 bp, Pseudomonas aeruginosa
tggacggcatcccggaggccaggcgtgggccgcgcgcgagccgctggcggcacctgcgcagctggctgttcggcgagcccgagcggttccgcgacgaacgccagcggctctggggcgcctatgccgcatggctcgacgagcaggtccagcagcgcctgggcgaagacgccgaaaccgcgccgcggctgctggccttcctggagtcgcggcgcgcggcggggcagttgccgaataccgacatcgacctgcgggtctggctcgatgaacgcggctggatcgtccgtctcgcctgcctgcgcagcgacgccgagccgatcgagaatgaactgcggcgcgcactga

SEQ ID NO: 12904 - DNA, 864 bp, Pseudomonas aeruginosa
cggaaggtacgcgatgacggagcggcattggcagggcgaggtctggctggcgcgggaccacgcgctgttcgccggggtcaacggcgatacccgcgagcacgcgcactatgcccaccagttgctgctggcggagacgccgctgcgggtgcgcgtcgctggccaggtactggaggcccggcgcttgctggtgccctcgctgcaagcccattgcgtcgaagcgtcgcagccgttgctggcgctgtacgccgagccgctggcgttcgacagcgacgacctgcgtcagcttctcgaggacgctcccggcgagcccgaggcgttgctggggcggcttgcgcggctgcctcgtcgacggctcgaccgccgcgtcgaaaaggccctggcggcgctcgacgagcaactcgcggcgcgggtcgaggcggaaagactggcgcgcagcgccagtctttcgctgagccaactggagcggctgttcgccgtccaggtcggcctgtcggtacgccgcctggtgctctggcgccgcctgtacctggccttcgccctggccttgcaggggcgcagcctgaccgaggcggcccatcacgccggctttgccgacgccgcgcacctgtcgcgcagcgtacgcagcctgctcggtatccgcgccggcctgtcgctgccgcacctacgcctggccggctgaacgccccaatccttccggcggctgtgggacgtgcctgctgcgtggcaggtcgcggaatggcgcgagcaactggccggcatagtcgcggggatagtcaggctggtcgccgatgcccatgtcggtgctgtccaggcggtagtcgggacgatggagggcggtgccgagcaggcggtcccagacgctga

SEQ ID NO: 12905 - DNA, 378 bp, Pseudomonas aeruginosa
ggcaaagcatctggatgtcctgtgccaccaacagccggttcaggtactcgatgctcttgcgctggcgcaggttacgcgtcagcgggccgggggcaagcaggcgcgcgtccaggcccaggtaatcgcagaggccggcgtcgacctcggcgaagcactggcgagcgtcggtatcgatgcgttgcgggtgcagcgcgatgcgcacgccgctgtcgcgtagccgggcgagggacgccaggtactccgccgaggcgggttcctgctcgtcgatggctagcagcaggcagagttcgacctggtgctgctgcaattgcctggccgaggccaggatccgctcgcagaccccggcgttgcccaggctgctggcatgcaggggaatga

SEQ ID NO: 12906 - DNA, 591 bp, Pseudomonas aeruginosa
gtcggttcgcccagtaccacgcagccacccgcgggcagcagtcgcaactcggtgagcaggcgccggaccaactgcgaaccgagaccctggcgctgccgctcgggcgccactgatagcggcgcgaggccgtaccagtcgcccgcttcgccatcgatggtcactggtgaggccgcgatatggccgatcacctggccgttcgcttcggccaccagcgaaagcgtcagcgcgccggcacggcgcagggcgtcgacgatgtactgctcggtatggctgctgtgcgtttcgttgcggaacgcggcttcggtcaggcgggcgatggcgtcgatgtcgccgggcgtttccgcacggatggaaatattcatgcaagcactcctcggaacccccgccttgtcccggcgggggcaatggaaaaggaagggggtcagcgattgtccgcctgcgggcgcacgactttcagcccggccatggatatccggtagggcctgccctggcgggagtggaccaggcccttgttcttcagcctggagaacaccgccagggtgcagtcgagcagcaggtggccgtcgcggttgtagcactcgacgcgggtga

SEQ ID NO: 12907 - DNA, 582 bp, Pseudomonas aeruginosa
gaattgcccgatatcgggcggcggggcggaaggttgcgggccaccctgatcgcatacctgaaaagttggcggcgtaatctccgcgattttcaggcgagggcgcgtcgtgttgaagttattggtcgtggttgcttccctgttcatcggcggaggcatggccatgggagagcctggggggcggatgggttttccgctgtcgcagcggtcgttccgggagcgaaccccgaagcgcaactggacgaggagccccaggaggtcagcgaagcgccggcctatcgcgtggatgacctcaccttcctgtacctcacccatgaggtctatctggaaccctacgtttcctgccgtccgaaagtcctgggcgaacgttcgtatgtcgcctgctggaacgaaacctactccggccgctccccgctgaacttctgggaatacgacgggggtgacttccttgccctcaacgacccggcacgtgtgttggccgagggaaagttcgccagcgagcagcacatcggcgaagcgcccctgccgctgcctctggatatcgatctggaccagttggaacgggcctactcgctgatgatgtaa

SEQ ID NO: 12908 - DNA, 660 bp, Pseudomonas aeruginosa
cgatggctggcgcagcgaacggcgctactactcgacgcgctactacgaccaacgctactacccggcgccacgccgctacgatggccaccgcgactaccggcgcgagcaatatcgctaccagcagcgctaccacgaatcgcgcccggcccatcgtggcgagcggcatccgggcaactggcagcgcggcggccagccgcaatggcgcgggcattctccgcaacgctggcaacaacacggtcggcaggatcgtccgggacaccagggccagcagggcgggacacctcgctggcgcaactgaggtgcgcaaggaaaggcggcgcctgcgggcgccgtcgtgctttccagtcgaaagtgcggaccctcttggcgcatttgctcggcacactctgccgataccgaaacgaggaggttcccatgagtcattttctgtcgttcgccaagggcgccctggcgatgttctggctcgtcgcgctggtcaacctggcctacccgctgggcgagttgcatcgaccgatcctgctgttgtccggcgtgctggtgctggtccatgccgccgagatcctgctgctcaacgggcgtctcaaggcgcgcccggcaccttggctggagcgccttcaggtgctgctgttcggcgtcctgcacctgcgtagcctcggctga

SEQ ID NO: 12909 - DNA, 519 bp, Pseudomonas aeruginosa
tcggccagttgctcggcgctcggcctcaccagacgcagcaacggatggccggggcggcagaagagtacgccgggatactcgcgtagcgggtggatgcgcaactgcggatcgccttgcagctcgcggatatcggcgacgaagagttcgacggcgtcatccagcaggcgctggcgtagggtctgccagtcttcgatgagcagtacgacgcgcacgcgtgggtgggcgctggagaaaccggccagtgcctcgggcaacagccgtgcggcggggaagggaccgccgcccaggcgtagctcgccgctgtcgagattggccaactggctcaccgcgttgtgcagtgcgcgatgcccggccagcaggcgccgagcgtgttccagcaccagccggccgtgggccgtgagggccacgccgcggctgccgcgctccaccagggtgcaacccaactgtccctccagcgcctggatgctgcgtgacagcgccggctggctgagattcaccgcttcggcggcgcgggcatag

SEQ ID NO: 12910 - DNA, 663 bp, Pseudomonas aeruginosa
acagcacggtggaaaagaacagcaggcggaaacggtaacgcagcagcagggcgttcaaggcgggctcctcgcatcgtcgaatcgaccagcctgggcgcggacccgcctgcctgtctattggccttgtgtcggatcgaacaatttctgcaccacggaaaagtcccgctccgcatagccctgcttcagcaacaggcggtacaggctcagcgccaggctgcccatcggcgtgctgctggcgctggcctgggcggcttcctgggccaggccgaggtccttggccatcaactgggccatgaagccgccgctgtagtcgcgcgacgccggagcgttctccatcacccccggccaggggttgtagacttccagcgcccagttgccgccggagctgcggcgcatgatctcggccagcaccttcgcctcgaggccgttggccacgcccagggccatggcttctgcggtaccgatcatcagcaccgcgaggagttggttgttgcacaccttggcgacctggccggcgccgtcggggccggcatggaagatgttgcgacccatggcctcgaacagcggccgggccttctccagggcttcggcgtctccgccgaccatgaaggtcaaggtgccggctgccgcgccggcagtaccgccggacaccggcgcgtctag

SEQ ID NO: 12911 - DNA, 969 bp, Pseudomonas aeruginosa
agtccctcactggatcatgggccggggcgtcccggcactatcggatgcgatggttcgcggcgttcacagcaggcgatcgagcatgccgccctgctccagcaggcggcgggcgacgatcacccgcatgatttcgttggtgccttcgaggatctggtgcacgcgggtgtcgcgtacccagcgctccagcggataatcgttgagatagccgtagccgccgtgcagttgcaaggcctcgttgcagacatcgaagcagcggtcggtggcgaagcgcttggccattgcgcagtacagggtcgcctcggcgtcgccgcggtccagccgatgggcgccgaggcggaccatctggcggctggcggtgagttcggtgagcatgtcggcgagcttgaactgcaaggcctggaaggtcgccagcggcttgccgaactgctcgcgctcctcgacgtagcgcatcgactgctccagcgccgcctgggcggcgcccagggaacaactggcgatgttcaggcggccgccgtcgaggcctttcatggcatagacgaagccctggccctccgggccgatgcggttgccggcggggatgcgcacgccttcgaaggtgatggtgcgggtcggctgcgcgcgccagcccatcttgtcctcgttgcggccgtagcggatgtcgggcgcgtcggccggcaccaggaagcaggagatgcccctggcgccgtcctcgccggtgcgcgccatgacgatcagcacctgggtgctgccggcgccggaaatgaagcacttgctgccgtccagcacgtattcgtcgccctcgcggcgggcgcgggtgcgcaggcgcgcggcgtcggagccggcatcgggctcggtcaggcaataggaggcgagcgactcgccgccgatcaggccgggcagccaggcctcccttcagcgccgcgtcgccgaacgaggcgagcatccaggcggccatgttgtggatgctga

SEQ ID NO: 12912 - DNA, 2532 bp, Pseudomonas aeruginosa
gtcctcgggtcacttgagatggatggtcatgttcgggccggccgacgattcgtcggtcgtcggttcatcgtcgaaccagcggctggtgacggtcttggtctcggtatagaagcgcaccgcctgcttgccgtaggcgtgcaggtcgccgtagaaggaacccttccagccggtgaaggagaagaacggcagcggtaccgggatcggtacgttgatacccacctggccgacctgcaccgcgtgctggtagcgccgagcggcgccgccggagcgggtgaagaggcttgttccattgccataggggttggcgttgaccagggcgatggcctcttccaggctttccacctccaggcaggccagcaccgggccgaagatttcctcgcggtacaggcccatcttcggcgtcactgcgcggaacagggtgggaccgagccagttgccgttgggatagccttcgacctggcactgcgagccgtcgagcaggcactcggcgccttccgccttgccttcggcgatcaggcgcagcacgcgctggcgcgcctgcgggctgatcagcggaccataggcggcgtccgggtcctgccagtggccggggcgcagggcggccatccgctcggccagttcgggaatccactcgcgcgccgcgccgacgaacaccgccgcgctgatcgccatgcagcgctggccggcggcgccgcaactggcgccgaccaggttgccgagaacctgggccttgttcgcgtcggggaggatcaccatgtggttcttcgccccggcgaaggcctgcacccgcttcaggtgcgcggtgccggtgcggtacacgtgctggccgacggcgaccgagccgacgaaggaaatcgcccggatgtccgggtgggtaaggagggcatcgacctgctcgcggccgccatgaatcacctgcagcacgcccttcggcgcgccggcctcgaggaacagctcggcgaggcggttgggtgtcagcggatcctgttcggagggcttgaggacgaaggtgttgccgcaggcgatggccagcgggaacatccacagcgggatcatcgccggaaaattgaacggggtgatcccggcgcacacgccgaggggctggatccaactggcggtgtcgatctcgcgggcgacgttttccaccgtctcgcccatcatcaggctggccacgttggcggcgtgttcgaccacctcgatgccgcgccacacgtcgcccttggcatcggcgaggttcttgccggtctcccgggccagcagttcgccgagttcgtcgtggtgttccttgagcaggtgctggtagcgcagcatcaaccgcgctcgctcgggagccgggacttcgcgccaggtctcgaaggcgcgctgggcgctggcgatggcctgctcgatctcgtcggcggtggccttcggcgccagcgcgaggacgtcctgggtcgccggatcggtgacttcgaccagctcgcgggaacggctgccgcgccattcgccgtcgatcagttgggggattgccttggccatcgtcgcctccgcttcccggtggaccgggatgttgttttgagtcgttatagccggccgcaagccgcctgtggattgacgatcttgcgcaagggatggacgatcttgggattcagactaccgagtcgcgccgccgtgaagcgttccgtacagacctccgcctggcccctgcccaaccagggggtgcgtttcatcacgccgccccgcctgcgtcgcgccctggcccgccatccgctcggccaggcctgctacccgctggccctcggttactatccggaggcgcatggccaccacatgcagcggcgcgcgccggacgacaacctgttgatctactgccgggccggacgcggctggctggagtgtgccggcgagcgcgtcgaggtcggcggcggcgacctgctggtcctgcccaagggccgggaacatgcctacggcgccgactcgcagcggccctggagcatctactgggtacatttcgaaggcggactggcggaggatttcctgcgtccgctgggcagcgccccgcgcctgcgcctgggcatgcagccacgcctgctggcggagttcgatgcgctgctggcgctgcgtcgccagggcctcagcctgccgcacttcatccatgccgcgcacctgttgcagggcctgctcacctcgctggcggtgcgtccggcgcgggccagcctgaaatccggacgggtgctggacatcgacgcggtgcaggcgctgatgcgcgcgcacctgcacgacagcctcaacctcgacgagctggcggcgcagttcaagctgtcgcgcttccatttcgccaagacctatcgcgccctgaccggccaggcgccgatccaggatttcatccagatgaagatggcccatgcctgccgcctgctcgacgagggcgcgctggaggtgcggcagatcgccgagcagctcggctacgccgatccctattacttctcgcggctgttccgcaaggtggtgggcatggcgcccagtcactaccgggcgctgcaccagggctag

SEQ ID NO: 12913 - DNA, 1743 bp, Pseudomonas aeruginosa
  unsure (1706): Identity of nucleotide at the above locations are unknown.
cggaagcacggctcggcgaggaacagcaccagcaatagcctcagtacctgcaaggcggtgaccagcggcaccgagagctgcaaggcttcggcggtcaggctcagctcggcgatgccgccgggcatcatgccgagcatcagcgactggtggtcgagggtggtcagccagccgagcaactcggcggcgagcgccgcggcgaacatcatccacagcgtgcaaaccagggtacgactgacgaaggctggagcgctgcggaagaaactgcggttgaaatggcaacccagggcgctgccgatcagccattggccgacgccgctggaaccggccggcaggccgatatgcaggtcgaagccgaggctgacgccggccgccagcaacagcgggccgagcagccagggattgggttggcgcaacttctgccagcccagcgcgaccagcgccccggccgggaacagcagggccagccagtgccagtccaccggcgcggcctggtgcgggcctggctggccgccgccgagcaggtactggaacgccgccggcaccagcagcactaccagcaacaggcgcaggctctgcgctgcggcgacgcggctgagcaccgcgccgtggcgctgcccgaggttgaccatctcgctggcaccaccgggcatgctggcgaagaacgcggtggcgcggtcctcgccgctgcggcgcatgaaggcgatcgccagcacgctggaaagcgtggtggccacggcgccgaagacgatgatcacgctatgcgccagcacttgctcgatcactgccggggtgaagtgcaggccgatgccgatgccgacgatccattgcccgcacttgcgtgcccccggcacttcggccagcggcaggtcggccaggcaacgcaccagcatcaccgcaagcagcgagccgatcatccacggcagcggccagccgaccaggcttgccagccagccgccaagggcgcccaccagcggcgtcgcccagtacagcctccaggtgacgcgctcaggcatcggccagccctgtcgcgcgacgggccgcgcggcggcgccaggcgcggaccagcggcaacagcagcattaccaccaccagcgcccaggttaccaggctgatcgggctcgaccagaggatgcccagttcaccgttggagatcgacagcgcgcggcgcaggttttgctccatcagtccaccgaggatgaagcccagcagcagcggcgagagcgggaagtcgagcttgcgcaggatatagccgatcacgccgatgccgaccatcaggaacaggtcgaaggtggtcgcatgcacgccgtacacgccgatcccggtgatgatcgcgatggccggcaccagggcccagttcggcaccgcgaggatgcgggtgaatacgcggaccatcggcacgttgaggatgatcagcatgacgttggcgatgaacagcgaggcgatcaggccccagacgatgtccggttgctgctggaacaacagcgggccgggagtgatgttgtacagggtcagggcgccgatcatcaccgcagtggtacccgagccgggcacgccgagggtcagcatcggcaccatggcgccgcaggcggaggcgccgatggcggtctcgggagcggccaggccgcgcatgtcgcccttgccgaactcgcccttggcaccggccagcttcttctcggtcatataggccaccgcgcttgccagggtcnccccggcgccgggccattcgcccatgacgaaacctag

SEQ ID NO: 12914 - DNA, 888 bp, Pseudomonas aeruginosa
  unsure (111): Identity of nucleotide at the above locations are unknown.
cagaccgcatcgcatgttgaccatgaatacgctggcggcctccttgaagttgaacagcatgcgtccggtggctttcaccgcctcctggccgtggtgggtcttctccaccancatgaggatctcgctgaccgagaacaggcccagcaccaggaccacgaactggatgccgtcggcgaggtggatgctgtccccggtgaagcggtacacgccgctgttggcgtcgatcccgacgctcgacaggaacagcccgagcagcgccgccagcagggtcttcagcgggcggtcgccggccatcccgccgaggcagacgatggcgaacaccatcagcacgaaatattccgccggaccgaaggcgatcgcccacttggccagcagcggggcgaacaggaccatcccgcaggtggcgatgaaagcgccaatgaacgaactccaggccgacagcgacagggccacgccggccaggcccttgcgtgccatcgggtagccgtcgagggtggtcatcacggtcgaggcttcgccggggatgttgagcaggatcgagctgatccgcccgccgtattcgcagcccaggtatacggcggcgagcaggatcagcgcggtttccggcggcaggccgagggcgaatgccaccgggatcagcagtgccacgccgttgatcggaccgaggcctggcagcaggcctacgatggtgccgatcagggtgccgatcagcgcggtgatcaggttggtcggcgtcatcgcgacgccgaagccctggccgaggtagttcaaggtttccatcacgaagtcctcacagcggcaggaagtcgagaacgcccagcggcagcgggacgtccagggcgcggtcgaacagccagtagaggccgatcccgagcaggctcgcggtga

SEQ ID NO: 12915 - DNA, 477 bp, Pseudomonas aeruginosa
gcagcacggcgccgcccagcggttgttcgtcctcggcgtggcggatcggcgtcggccgcgcgatcagccacgccaggccggcgcccatcagcgccaggcagagcagcgggtaggcgcgcgggccgaccggttcgtaggaaaacggcgcctggtaacgccagccggcgaccgccaggccgacgcaggcgagcagccagagcccggcgaacaggcgctggtacaggttggaacgggtcatgggacgatcctcgtggcgcggccggggtccggccgcgcgcgggctggcttactggatcaggccgaagtccttggccagttgcttgtactgctggacctgctgcttcacgtagccgtcgagttcctcgccggtcatggcgaaggggaacagctcgcgctggtcgcgcagcttggcgaagtcctcggaggccagcagttggtcgaaggcgttcttccaccaggcgtagtcttcgtcgctga

SEQ ID NO: 12916 - DNA, 2325 bp, Pseudomonas aeruginosa
ggtcgaaaccgccgccgggggacgccggggcgatgcattcgggacgcttgggttcggccacggcggcgccggccagcagcaggccggcggcaaccaaggcgaggggacgaaaagacagtttcatcatcatcggtgctcctgtggagttcttgttctggcttaccagatcggcagggtatagctgacgatcaggcggttctcatcgatgtcgcgggtgaaattggaacggaaggtcgcgttgcgccagcggattccgaggttcttcagcgcgccgctctggaacacgtactgcagttcggtgttgcgttcccattcgcggccttcgccgcgctgcccggcgagttcgacattgtcgcccttgacgtagcgggtcatgaaggtcaggccgggaatgccgaggccgacgaagtcgtagtcgtagcgcagttgccaggagcgctccttggggccggcgaagtcgttgacctggacgaagttgaccaggtacgggttgctgccttccaggtaggggaaggcgtcgtcgccgttcattcgctgccaggccgcgccgaaggcatggttgccaaggctgtaggtgaacatgccgttgagcgacttgttgtcgatgccgccggccttggccgagccgctgtcggtgctgcgggcgaagcgcaggtcgctggtcagttcgccgggaccgatcggccagctgtgcagcaggccgacgaagtgctggcggtagacgtcctgcaggttgctgtagtgatagctggcggtgagttggtcggtgagcttgtagtccagtccgccgaggtcgaagtgatcggcgctgaccccggcgaagcggccgttcttgtcgttcagcgcgaggtcctcggagtcgctggagtcgcggatcttggtcttttccaggcgcccggcggtgaagccgaggtccttgatctccttcgaggtgagcagcgcgccttcgaatatctgcgggaagatccgcccgttgttcggttgtaccgatggcaacttcggaatcagcgtgccgaccttcagctcgctctgcgagaccttgaccttggcggtcaggcccagtttcgagtaggtgtccggcgcgcggccgtcggaatccttcggcagcagtccggtaccgctgcggccgcggccggagtcgagcttgacgccgagcatgcccatggcgtcgaggccgaagccgacggtgccctgggtgtagccggactgcaggttgaggatgaagccttgcgcccactcctcgcgcttggactggccggggccgtcgcggaagtcgcggttcatgtagaagttgcgggtttccaggctggccttgctgtcttcgaggaagccggcggcgttgcccaggggcgcgatgctggcgagcacgacggcggtggtggtcagggtggtgctgcgggacgaacgtacagaccttgcggcctgcggcagggaagtcgacatgcagtggtctccgattcttgttcttgtacgccgagcaccacgctgcagggcgttttggcggacgatctgcgccgtccatcgactgatcctaagacgccaagctttcgccaggctttcagcaatccccggtggcagagaagccatttaccggagggttttccccggtacacttcgcctcttgtgccctcatccggtggtggagaaccgtccatgcgcatccttctggtggaagatcatccgcagctcgccgaaagcgtggtccaggcgctcaagggcgccggctggacggtagacctgctgcaggacggggtggccgccgacctggctctggccagcgaggagtacgccctggcgatcctcgacgtcggcctgccgcggatggacggcttcgaggtgctggcgcgcctgcgcgggcgcggcaagaccctgccggtgctgatgctgactgcgcgcggcgaggtgaaggaccgggtgcacggcctcaatctcggcgccgacgactacctggcaaagcctttcgaactgtccgagctggaggcgcgggtcaaggccctgctgcgccgcagcgtgctcggtggcgaacagttgcagcgctgcggcgccctggtctacgacctcggcacccggcgcttcagcctcgacgagcagccgctgaccctgacctcgcgggaacaggcggtgctggaagcgatgatcgcccgtccggggcgggtgatgagcaaggagcaactggccgcccaggtcttcggcctggacgaggaggccagcgccgacgccatcgagatctacgtccaccgcctgcgcaagaagctggaaggcggcgccgtgcgcatagtcaccttccgcggcctcggctacctgctggaggcgctgggtgactga

SEQ ID NO: 12917 - DNA, 660 bp, Pseudomonas aeruginosa
tgccggcagcctgcgcggaaggctgctgctgtggctggccctgctcctgctgctggtgctcctggcgagcggcctgagcgcctactggaacggtcgcgaggtggccgacaccgcctacgaccggaccttgctggcctcggcgcgggcgatcgccgacgggctctacgagaaggacggcaccctgcgcgccgacgtcccctacgtggcactggataccttcgcctacgacagcgccgggcggatcttctaccaggtcaacgacatccacggacggatgatctccggctacgagaatcttccggcggcacccgccgatgccctgcgcaccgacgactacccggccctggccaagttctacgacggcgtctaccagggcgtcgacgtacgcgtggtgagcctgctgcaaccggtcagcgaaccgagcatgagcggcatggcggagatccgcgtggcggagaccgaaggcgcccgcgagcgcatggcgcgcagcctgatgaccgataccctgctgcgcctgggcgtcctcggcgtcggcgcgctggtgctggtgtggctggcggtgagcgccgcgctgcgtccgctggatcgcctgcgccgcgaggtggaagagcgccagccggacgacctgcggccgttgccgatgctcgaggtccagcatga

SEQ ID NO: 12918 - DNA, 405 bp, Pseudomonas aeruginosa
attgcggccgctggtggagtcgctgaaccacttcacccagcgcctgcgcagcctgttcgagcggcagtcgcacttcatcgccgatgccgcccacgagttgcgcacgccgctggcggcgctcaaggcgcgcctggaactgggcctgcgcgagcaggagccggaagcctggcgttcgaccctggagaccacggcgaagaacaccgaccgcctgatccacctggccaaccagctgctctccctggcgcgcatcgaaagcggcgcccaggccattgccgagggtggcgccgagcgtatcgacctgaccgccctggcccgggaactgggcctggcgctggcgccgctggcctatgcgcggggagcctcgctggcgctggaaagcgccgggccggtgtggatccagggtga

SEQ ID NO: 12919 - DNA, 444 bp, Pseudomonas aeruginosa
accgacgctgctcaacgaattgctcagcaacctgctggacaacgcgctggcgcacaccccgcagggcggcaacgtgatcctcagggtgctggagggaggcgtgctggaagtggaagacgatggtccgggaattcccgccgccgaccgcgagcgggtcttccagcgcttctaccggcgcggcgacagccccggcagcggcctggggctggcgatcgtcggcgaggtctgccgggcgcaccgggcgcagatccagctcgaccagggcgaactgggcggcttgctggtgcgggtgcgcttcccggtggagtagggcgggcctattgcagcatgctggtggcggcttccagggcgctggagaggtcctcgtcttccttcatgtcgacggtcggctcgaggccgagcttggcgaacgccgggatctggctccagtccaggcgggtatag

SEQ ID NO: 12920 - DNA, 660 bp, Pseudomonas aeruginosa
tcgatggcgcggatcaggtcctgttggactttgtcggcaagcttgctcatggcatttcctttgaaaacgcaatggccggagcacgctctacgtgcaccggccatgggaatactggcgggccgtccgcggacggcgaggcacagtttacggtcagcgctggatttcgcggtcgctgtccagcgtgtaaggcagattgaggaggacgagcggcgctccttcggcgcttccgaggctgatccggccgtcggcgacggcgtcgtcctgcagcacggcgagcaattccacgctgttctccggcgtacgggcggccagtaccacttcgccgacgctggtggaatggactggcgagaacagcccggtgccgggcgccggcacctcgtctgcgtccagcgccaggcgatacaggcggcgcttgaggcggccgagatactgcatgcgggcgacgatttcctggccggtatagcagcccttcttgaagctgaccccgccgaccgcctgcaggttgatcatctgtgggatgaacagctcgcgggtagcgccgaacacctggccgatgcctgcgcgcacctggccgagcagccaatcgtcgagcggcgcctcgcggctgtgctcgcggagcgtggcaagcaccgcctcggcgcgttgcgccggaacccatag

SEQ ID NO: 12921 - DNA, 462 bp, Pseudomonas aeruginosa
tcctggaccgtgtccagccggattgagccgttcgaatgccgctggcgggtctctccgatcctgctggcggcgagcctggcactgtgggccctggcgctgctgtcgatcctgctggcggcgctgccggtctggctgaagccgccgcttgcgctggtctgcctggcctacggtgcctgggggctgtaccgccaggtactgctgcgcggctcgcgggccttccgcggcgtgcgccatgacgagcggggctggcagctgtggagcgccggaagcggctggcaagcggtgcaattgcgccctgacagcctggcgttgccctggctgatcgtactgcgcgtgcgcctgccgggccgctggcgcatccttggctgctgtatcccggccgatgcattgggcgccgacagccatcggcgcctgcgtgtccgcctgcgcttcagtcgccgtagatgggcggcaccaggatag

SEQ ID NO: 12922 - DNA, 549 bp, Pseudomonas aeruginosa
cggcggccagatggtgaccgtcgtcggcgaagtgccgctgggcaccgccgagcgggtggcgctgtccatccggcccgaggccgccgcccaaaaatgatcgaggagcaggggcgagtggtggcgaccgagccgggagcggtatgggtcgagaccgtgcgccgcagtacctgctcgtcctgctcggccaatgccggttgcggccaggggctgatgcagcgcctgggcgtcggcgcggggcgtgcccgggtgcgcgcgttgagcgacctgagcctgcgggtcggcgatgcggtcgtcctaggaattcatgaagacctgttgttgcgcgcctccgtcctcttctatcttttccctctgctcgggtttttcgtggcagcattgctggcgacccgggcgggccttgtcgaacctctgatcatcgtgtccgggctggcgggtttgctggcggcctggctattggtgcgtcggcatgctcgtcgtcatgccgatgatccagcctcgcagccggtggttctgcgagcgctgatttccgggccgtccgattcggcctga

SEQ ID NO: 12923 - DNA, 1428 bp, Pseudomonas aeruginosa
tcgatgcataccctaaaacgctgtatggctgcgatggtggccttgctggccttgagcctggcgatgacggcccgggcagaactgccggacttcacgcctttggtcgaacaggcgtcgccggcggtggtgaatatcagtacgcggcagaagctgccggatcgcgccatggcgcgcgggcagctgtctatccccgacctcgaagggctgccgccgatgttccgcgacttcctcgaacgcagcatcccgcaggttccgcgcaatccgcgcggccagcagcgcgaggcgcaatcgctgggttccggcttcatcatctccaacgacggctacatcctcaccaacaatcacgtcgtggccgatgccgacgagatcctggtgcgcctgtccgaccgtagcgagcacaaggccaagctggtcggcgcggacccgcgcagcgacgtggcggtgctgaagatcgaggcgaagaacctgccgaccctgaaactgggcgattcgaacaagctgaaagtgggcgaatgggtcctggccatcggttcgccgttcggcttcgatcactcggtcaccgccggtatcgtcagtgccaagggtcgtagcctgccgaacgagagctacgtacccttcatccagaccgacgtggcgatcaacccgggtaactccggcggtccgctgctgaacctgcagggcgaagtggtcggcatcaactcgcagatcttcacccgttccggcggcttcatgggcctgtccttcgccattccgatcgatgtcgcgctgaacgtcgccgaccagttgaagaaagccggcaaggtcagtcgcggctggctgggcgtggtgatccaggaagtgaacaaggatctcgccgagtccttcggcctcgacaagccgtccggcgcgctggtggcgcaactggtggaagacggcccggcggccaagggtggcctgcaggtgggcgatgtgatcctcagcctgaacggccagtcgatcaacgagtccgccgacctgccgcacctggtgggcaacatgaagccgggcgacaagatcaacctggacgtgattcgcaacggccagcgcaagtccctgagcatggcggtaggcagccttccggacgacgacgaggaaatcgcctcgatgggcgctccgggcgccgagcgcagcagcaaccgcctgggcgtgaccgtcgccgacctgaccgccgagcagcgcaagagcctggatatccagggcggcgtggtgatcaaggaagtccaggacggtccggccgcggtcatcggcctgcgtccgggcgatgtcatcacccacctggacaacaaggcggtgacctcgaccaaggtcttcgccgacgtggccaaggccctgccgaagaaccgttcggtttcgatgcgggtgctgcgccagggacgcgccagcttcattaccttcaagctggccgaataa

SEQ ID NO: 12924 - DNA, 762 bp, Pseudomonas aeruginosa
aaaacgcgagccactgatcagcaacatcgacctggtggtccacttcgacaaagaattccgtgtacgcatgccgtgagtaattcgctggaccgactcgagcgcaagctcggctataccttcaaagaccgggacctgatggtcctggccctgacccatcgcagctacgccgggcgcaacaacgagcgcctggagttcctcggtgacgccattctcaacttcgtcatcggcgaggcgctgttccaccacttcccgcaggctcgcgaaggccagctttcgcgcctgcgcgcgcgactggtcaagggcgagaccctggccctgctggcgcgcggcttcgaggtgggcgactacctgcggctgggctcgggcgagctgaagagcggcgggttccgccgcgagtcgatcctcgccgatgcgatggaagccctgatcggcgccatctacctggataccggcatggactccgcgcgcgagcggatcatcgcctggctcggaccgcaactgcgcgagctgaccccggtggacaccaacaaggaccccaagacccgcctgcaggagttcctgcagtcgcgtggctgcgacctgccgcgctacgaggtggtggatatccagggcgaaccccattgccggaccttcttcgtcgattgcgaagtggccctgctgagcgacaagacccacgggcacggcggcagccgccgcatcgccgagcaggtggccgcggccgccgcgctggtggctctgggcgtggagaatggccatgactga

SEQ ID NO: 12925 - DNA, 642 bp, Pseudomonas aeruginosa
ccggccgtacaaggaaaccagcgccctggtggacttcttcaccccgttgggtcgcctgcgcgcggtcctgcgcggcgcccgcggcaaggccggcgccctggcgcggccattcgtgccgctggaagcggagtggcgcgggcgcggcgaactgaagaccgtggcccgcctggaaagcgccggcattcccaacctgctcaatggccaggcgctgttcagcggtctctatctcaacgagctgttgatccgcctgttgccggcggaagacccgcagccggaaatcttcgcccactacgccgcgaccctgccgctgctggcggcggggcgacccatcgaaccgctgctgcgcgcgttcgaatggcgcctgctggagcaactgggctatggtttcgctctcgatgtcgacatcgatgggcgcccgatcgagccgcaggcgttgtaccagcttttgccagaggccggcctggagccggtggcgcaactgcaacccgggctgttccagggctccgaactgttatccatggccgacgccgactggagcgcccccggcgccctggcggcggccaagcgcctgatgcgccaggcgctcgctccccatctgggcggccggccgctggtcagccgcgagctgttcatgaaccgtaa

SEQ ID NO: 12926 - DNA, 1425 bp, Pseudomonas aeruginosa
gcgccagcaggtggtcgatgggcgagcgacggtgatagagcacgcccatggagaataccgtgtcgaagccttcgagcttctccggcaggtcttccagggccagcggcaggtgccaggccggcagctccggcaggtagcgcttggcggctaggaactggcagaggaacagccagttcggatcgaccccgaccacgctttccgcgccggcgccgagcatgcgccactggtagtagccgttgccgcagccgacgtcgaggacgcgtttgccacgcagttcgacatgtggcgagacacgctcccatttccagtcggaacgccattcggtatcgacctgtacgccgaagaagtcgaacggccccttgcgccagggaatcagcccttgcagcgcttccttcacctgcgcttgcagcgccgcatcgtggtcgctgtgcagggcgaagcgctgggccagttcgaccttcggtgcgggcacctggggcaggcgctggaccgcgctccaccaacgggccaggtcgccgtggccttcctcgatgcgcgcggcgatctgcgcgggcaggctggtcgcccagccgtacagcggagagccggcgaggtgtcgctggagggcgtcgagggcgaggtgctggatcatggcagggcgatcatcgatgcgaagttgagacactggaaccattggctgacccggctgaagccggcggccagcagccgttcacggtgttcctcgaaggtgtcggggagcatgacgttttccagcgcgctgcgcttctgcgcgatctccagctcgctgtagccgttggcacgcttgaaggcgatgtgcaggtcggtgagcagcgcgtgctcctgcgcatcggcgaagcgcagtttctccgagaggatcagcgcgccgccgggcagcagtgcctggcggatcctgcgcagcaggccgaggcgctggtcgggggcgacgaactgcagggtgaagttcatcgccaccagcgaggtgggttgcaggtccagggcgagaatgtcggcctcgatcagctcgaccggcagcagctcctggtacatggcgtcctgggcatgcaggtattcactgcagcgctcgatcatcgcgtgcgagttgtccaccccgatcacccggcagccgtcgttgcggacgtggcggcgcagcgactgggtgaccgcgccgagcgagcagccgaggtcgtagagcacgctgttcggctgggcgaactgcgcgccgagtacgccgatgttctcgacgatggtggggtagcccggcacggagcgcttgatcatgtcggggaacacgcgcaccacgtcttcgttgaacacgaagtcggcgacacgttgctggggttgggcgaacaggcgatcggactcgctcacgcgggtgacctcgggcatcacggcttttcagggggccgaattgtagccgagggatga

SEQ ID NO: 12927 - DNA, 798 bp, Pseudomonas aeruginosa
gcgcctcgaccaggtagccgggccgctgcggcgtgccagggcacaggtaggggcagccgtcgtcgcctgcgaagcgcaacggttcggccagcgagagcagaggagcggcgcaggacagggcgagcaggacgaaggaggcgcggagcatggagtcctcagggcgacggggcctgtcaggataggccaggtcgccacggcgcaggacgtcggtcttcgtacagaatgtgtccgccgcgggcagcggtttcagcgcacctggatcgcgcaggaaaagctttccgccggttccgcgtccttttcccagggccgccggtagaccagttccaggcggtcgtcgccgctggcggcgacgcggaagcgccaggtcgattcgccgccgctgccaaccaggccgctgtcttcttcggaattgctgtagacctccgggccaaggcgcttgagcacgctggcagcagggttgcgcagttcccagcggaagccggtggtgggattgctcggcagggtcagcaccagttcctggccttgcgtcagcttcagcggcgaacagtcgtcggcgtcgtccagggtgaccaccggcttctgttgcccggcgcagccggccaggaccacgatggacaatggcagcagcagacgggagggggaaaaggacatgcagcgctcctcggctcgaatggaaagggcgccagcataaaccctgctggcgcccgagtgccaaggttggcgcggcggacggccgaaccggtcggccatccgccgccggctcaggccgggaacagcaccttggccacgtcgccgtag

SEQ ID NO: 12928 - DNA, 318 bp, Pseudomonas aeruginosa
tcgggcaactcttcgaagtggccgcggttggcttccggcaggatcagctcgaagatcttctgccggcgcgcggcgatcaccttctcgcggaccccgccgatgggcaggacctggccggtcagggtcagttcgccggtcatcgccacgcctttcttcggcacctggttgcgcgccagggagagcagggcgctggccatggtgacgccggcgctgggaccgtccttgggcgtggcaccttccggcacgtgcaggtggacgaacgcctggtcgaagaaggtcgggtcgccgccatacttcttcaggtgcgagccgatgtag

SEQ ID NO: 12929 - DNA, 909 bp, Pseudomonas aeruginosa
atggggccccgggggcgggtttcaatccctgtccgttcaaggatgttgccgaaggtttccacgcagcacgcggtacgcgggtaccacttgcggcaaggtgctgggcagcgtcgggcaagtcgagtagagtgcgcaaaaattgagcagttgccgttcatgttcgacacccgcctcatccgtctgcccgaccagtcgcacacccacgcccacgagcatcaccaactggtgatgtcgctggccgggcgcgccgaattcgaggtcaacggctgtggtggggaagtctgccggatgcgcgcctgcctggtgccgggcgaggcgggccacgtgttcgccggggtgggcgacaaccgcatgctgatcatcgacctgggcgaggacaacccgaccccggaagaccccgacctgctcgcgcgcctgttcgaggcgccgcgctacccgaccctggacgccgacttccagaacctgctcagctacgccggcgccgaactggcccgctacggcagcgacccgctgctgacccgtgccctcggcggagtgctgatccgcgccctgcacctgcgcctgttcggcgagcagcagcccctggcggccagcgggccgctcgacctggagcgcctggacgcgcatatcgtgcggaacctggcgcggcgcatcacggtcgccgaactggcccaggtcgcctgtctcagcccgagccatttccacgcgcagttcaaggacagcgtcggcctgaccccgcaccagtacctgctcaaggtccgcctcgactgcgccgcgcggttgctgcgggaaagccgcctgcctctggtgcggatcgccgaggaatgcggattctccagccagagcgcgctgaccacggcgatgcgccgctacctggggctgacgccgaagtcgctgcgcaagggctga

SEQ ID NO: 12930 - DNA, 618 bp, Pseudomonas aeruginosa
cgaaggccagccagcggctctcgccgaggtcgaagttgtagccgaggctggcgccgagggtggtgtagccgtcggtggagagttcttcctccggcacgcggtgctgcgaggcggcgtgttcgacgtcgacccgcgcctgccactgctgcaactcccagatcagcgcggtgttcaggcgcagcggggcgatgcgtggcagcggttcgccggtgtccttgttcttggctcgggtgtagtccccggagagttccaggtcgaagttgccgtacgggctttccagcaggtggatgcggtcctgcgcctcgacgccgtagaagtccgcgcgaacgccgctgtagaggtattccggcagcgcctcgtcatcgctggcggcgaccacttcgccttcctcgttgcgatggcgaccgctggcgagcaggccgatgtagttggagaagcggctgtagaacaccccaacgctgcccttgtgcacgccgttgtcgaagcgcagggcgaggtcggtggagaccgccttttccttgtccgcgtcggcatcgcctacctcgtaggtgccggtggcggcgtgcggaccgttggcgtacagctcgtagaaggtcggtgcgcgctcggtgtagctga

SEQ ID NO: 12931 - DNA, 1551 bp, Pseudomonas aeruginosa
gggagtccctatgagtgtcaatacgcccacgctgatcaccttcgtgatctacatcgcggccatggtcctgatcggcctggcggcatatcgctccaccaacaacttctccgactacatcctcggtggccgcagcctcggcagcttcgtcacggcgctgtccgccggcgcctccgacatgagcggctggctgctgatgggcctgcccggcgcggtgtacctgtccggcctgtccgaaagctggatcgccatcggcctgatcgtcggcgcctacctcaactggctgttcgtcgccggccgcctgcgggtgcagaccgagcacaacggcaacgcgctgaccctgcccgactacttcaccaaccgcttcgaggacaacagccgcctgctgcggatcttctcggccctggtgatcctggtgttcttcaccatctactgcgcttccggcatcgtcgccggtgcgcgcctgttcgagagcaccttcggcctctcctacgagaccgcgctgtgggccggcgccgcggcgaccatcgcctacaccttcatcggtggcttcctcgcggtgagctggaccgacaccgtgcaggcctcgctgatgatcttcgcgctgatcctcaccccggtgatcgtgatgctcgccaccggcggcgtcgagccgaccttcaccgccatcgagctgaaggacgcgaccagcttcgacatgctcaagggcgcctccttcatcggcgtgatctcgctgatggcctggggcctgggctacttcggccagccgcacatcctggcgcgcttcatggccgccgactcggtgaaatcgatcccggccgcgcgccgcatctccatgacctggatgatcctctgcctcggtggcgccgtggccgtgggcttcttcggcatcgcctacttccaggcgcatccggagcaggccggcgcggtcagcgagaaccccgagcgggtattcatcgagctggccaagatcctgttcaacccgtggatcgccggcgtgttgctgtccgccatcctcgccgcggtcatgagcaccctgagctgccagctgctggtctgctcctcggcgctcaccgaggacttctacaaggccttcctgcgcaagggcgccagccagctggaactggtctgggtcggtcgcgccatggtgctgctggtggcggtgatcgccatctggctggcctccaacccggaaaaccgcgtgctcggcctggtgtcctatgcctgggccggcttcggcgccgccttcggcccgctggtgctgttctccctgctgtggaagcggatgacccgcaacggcgcgctggccggcatgatcgtcggcgcggcgacggtgatcctgtggaagaacctgttgggctggaccggcctgtacgagatcatccccggcttcctcttcgccagcgtcgccatcgtcgtcttcagcctgctcggcaaggcgccttcgacgagcatgctcaagcgcttcgacgatgcggagcaggagtaccgcgaggcgcaccagggctccgccgctccggtaacccagcgctgatcgagcctgcgggcgggtaa

SEQ ID NO: 12932 - DNA, 2022 bp, Pseudomonas aeruginosa
aatacgacaccgaaggtcgcgacggcgcgttggcgacgctgttgctccatgagctggcggcggccgagacgctgccgctgcacgtgcccttgccgcccgagccgcgctggctggcgctctgcgaggcgttcctcgtcgagcccgacatccgcgccagcgccgaacgctgggccgggttgctgcataccagcctgcgcagtttcaaccgcaccttccgtcgctacaccggcctcagcttcggtgcctggaagcaacgcgcctgcgtggtgcaggcactggcgcggctggccggcggcgaaacggtcaccgccatcgccctggactgcggctaccagagcccggcagccttctcgaccatgttccgccgggtcctcggccagccgcccagcgcctttcaggcgggcgcgctcagatcgccaggaggtccatgaagcggttcaccggcgtggcttccagcgatgcctggtggctgcacaggtcgaagatcctctggcagcgctgcggcgggaagcgcgtggccaggttggccttgaacttctcctgcagcagcgggatgccttcggcgcgccggcggcgatggccgagcgggtactccacggcgacctggccggtgctgctgccgtcgtcgaagaacacttccacggcgttggcgatggagcgcttgtctgcctccaggtattcacggctgtagcgcggctcctcgacgatctccattttctcgcgcaagcgatcgatcagcgggtgggcggcgtggaaggcgtcctcgtagtgctcggccaccaggtcgccgaagatcagcggcacggcggtcatgtactgcaggcaatggtcgcggtcggcggggttggccagcgggccgaccttggaaatgatgcggatcgccgactcgtgggtggtgatgacgatgcggctgatccgttgcaggcggtccttcaccagcggatgcaggcgcacggcggcctcggcggcggtctgcgcgtggaattcggcggggaagctgatcttgaacagcacgttttccatcacgtagctgccgtagccctgggggaagctgaagcgccgcttgtcctcgggcttggtcgccaggtccttgctggtgtggctgaacaggacatcgtagaaaccccattgcggcgcgctgagcacgccggggatgcccatctcgccgcgcaaggcgatgtccgccaggcgcacgccgcggctcgtcgcgtcgccagcggcccaggacttgcgcgagccggcgttcggtgcgtgacggtaggtgcgcagggcctggccgtcgacgaaggcgtgggagagggcggccagcagttgctcgcggtcggcccccatcagcttggcgcagacggcggtggacgcgaccttgaccagcagcacatgatcgaggccgacgcgattgaacgagttctccagggcgatcacgccctggatctcgtgggccatgatcatcgcttccagtacctggcgcatgctcagcggcgcttcgccgttggccaggcgtttctgcgagaggtggtcggcgacggcgaggatgccgccgaggttgtccgagggatggccccactcggcggccagccaggtgtcgttgtagtccagccagcggacgatgcagccgatgtcccaggcggccttgaccgggtcgagccggaaggaggtgcccggcacccgcgcgccgtgcgggaccagggtgccctcgaccagcgggccgaggtgcttggtgcattccgggaagcgcagcgccagcaggccgcagccgagggtatccatcaggcagttgcgggcggtgtccagggcctccgtggaatcgatgcggtagtccagcacgtagtcggcgatgtcctgcaggacggcgtcgtagtcgggacgttggttgagatcgacgttggcactcatcgcgtactccagtggttcgtaagtggtgggtttcctcttgggtcaggctggttcggggatggtttttcttgtcgtggctgcaagacggccccggcctttcgcggtggcggaaggccggggcaaggatag

SEQ ID NO: 12933 - DNA, 1269 bp, Pseudomonas aeruginosa
gtcggttcagaaggcgtcgccgggtacgcgcacccagccttccatgaggattcgcgcgctgcggctcatgatcgccttggtcaccgtccattcgccgttcgcctggctggcctcggcgcccactcgcagggtgccggagggatggccgaagcgtaccgcgctgcgttcgccgccgccggcggcgaggttcaccagggtgccgggaatggctgcggcggtgccgatggccaccgccgcggtacccatcatcgcgtggtgcagcttgcccatggacagcgcgcggaccagcaggtcgatatcgccggccgccaccagcttgccgctggcggtgcggtagtcgcggggcggggcgacgaaggcgatcttcggcgtgtgctggcgggtcgcggcttcctcgggggtcttgatcaggcccatgcgcagggcgccggcgacgcggatccgttcgaagcgcgccagttgctgcgggtcgccgttgatctcttcgcgcagctcggtgccgcggtagccgatctcctcggcattgacgaacaccgtgggaatcccggcgttgatcatggtcgccttgaaggtaccgacccccggcacctccagatcgtccaccaggttgccggtggggaacatggcgccgccgtcctcgccgtcgtcggacgggtcgaggaactccagcacgatctcggccgccgggaaggtcactccgtccagctcgaagtcgccggtttcctggacttggccgccgctcaccggcacgtgggcgatgatggtcttgccgatattggcctgccagatgcgcacctcgcagatgccgtcttccggtatccgcgccggatccaccagcccggcgtgcagggcgaaggcgccggccccggtggagaggttgccgcagttgccgctccagtcgacgaagggcttgtcgatggagacctggccgtagaggtagtcgacgtcatggcccggctggctgctcttcgagaggatcacgcacttgctggtgctggaggtggcgccgcccatcccgtcgatgtgcgcggcataggggtcgggactgccgatcacccgcatgaacagccggtcgcgcgcctcgccggggacccggcaggattccggcaggtcttccaggcggaagaacacgcccttgctggtgccgccgcgcaggtaggtggcggggatgcggatctggggtgggtgggccatgcgtcgtcgtcctcggcaatcgaattcaggggcagcggctgcgttcgacagccgctgccggtcgtcggcggatga

SEQ ID NO: 12934 - DNA, 624 bp, Pseudomonas aeruginosa
cctgggccgggtcgccgcccttgtcggcgatggcgtcgcgcaggccggcgaggtcgaccagcgcggtctgcccgaggatgtcatggcagaccacccgcgccgggtaccaggggaagtcgaggtcgcgcttgcgctcgaccagttggcgcagcgaagcctccagggtcgccgggtcgcagcggcgcaccaggttctcggcgagcacgcgggaggtatagggcagcttggcgtaggcaccgggctggatcgcctcgaccgcctcgcgggcgtcgaagtagtccaggcgggtgccggggagcggtttgcggtgtgcgctgttcatggctcggactcaatcacggggtgttcggaagcgtgtcgctcgcgccgtggcgcagcccacgccggcctttcgaattctgggtgcggcaaccgtccggcgcgctcgcgttcggcgcgccggacggcgtggatcagcgttgctccagcggcacgaacgcgcgctgctcgacgccggtgtactcggcgctcgggcggatgatgcggttgttggcgcgctgttcgaagacgtgggcggtccagccgctggtccgcgagcagacgaagatcggcgtgaacagcttggtcgggatgcccatgaagtga

SEQ ID NO: 12935 - DNA, 1515 bp, Pseudomonas aeruginosa
cctacgtctaccgcggcgtcgcgcgctgaatccgggcggccctcagagcgccttgggcaagggcgcgaacagcgcgtcgatatcggcctcgtcgagcttccagccgtcgccgttgccttcgctgaacaggccgtcggcgagggcggccttttcctgctgcaggtgctggatcttctcttccaccgtgccgcgggcgatcagccggtagacgaacaccggcttgtcctggccgatgcggtaggcgcggtcgctggcctggttctccaccgccgggttccaccagggatcgtagtggatcacggtgtccgccgcggtcaggttgaggccgaccccgcctgccttcaagctgatcaggaacaccggcaccttgccgctctggaagcgctgtaccggggcgcggcggtcgcgggtctcgccggtcagcaggacgtagtcgacgccgcgctggcgcagggcgtcctcgatcagcgcgagcatcgaggtgaactgcgagaacagcaggacccggcgaccctcggcgatcagttcgtcgagcatgtcgagcaggtaggccagcttgcccgagctgagcgcccggccgctgcgcgcgccgtcttcctggcgttgcagcaggcgcgtgtcgcagcagacctggcgcagcttgagcagcgcctcgaggatcacgatgcggctgcgcgccaggccgcgccgggcgatctcctcgcggaccttgcggtccagcgccaggcgcacggtctcgtagagttcgcgttgcgcctcgctgagttcgacgaactgggtgaactcgctcttcggcggcagttccgaggccacctgttccttggtccgtcgcagcaggaacggccgcaggcgcgcggccaggtgactgaggcgtgcctcgtcgccgtgcttctcgatcggcgtgcggtagtcctgggcgaactggcgggcgtcgccgagccagccgggcatcaggaaatggaacagcgaccagagttcgccgaggtggttctccagcggcgtgccggtcaggcacaggcgatgccgtgccgccagctcgcgggcggcgacggcggccttggtggtggcgttcttgatgttctgcgcctcgtcgaggatcagcaggtggaaccgccgcttgcccagctcggcggcgtcgcgtggcagcagggcataggtggtcagcaccaggtcgtgctcgtcgatgcgggcgaagtcgcggcgccggccggcgccgtgcagggccagcacgcgcagatcgggggcgaagcgctcggcctcgtccagccagttggggatcaggctggtgggcatcaccaccagcgccggcgtgtcgagccgcccggcctgcttttccaggagcacgtgggccagcgactgcaaggtcttgcccagccccatgtcgtcggccagcacgccgccgctgtcgagttcgcgcagggtctgcatccagctcaggccttcgagctggtagggccgcagttcggcgcgcaggccttgcggcggggtcgccggacgagcctggaaactgcgtag

SEQ ID NO: 12936 - DNA, 1854 bp, Pseudomonas aeruginosa
cgacgatgcaaggccctgtttccacccgggacgccaccccatgaccagccaggccctggccggcggactgtccgtcaccggccgcatcctcgtcgcggtcctgcttggctacgcgctggcctatgcggtcaccgcctgcctgagcatctacctgccgctgccgcgtcccgaccgggtctcgttcggcagcctcggctgcttcgccgtgtgggtcgcggccatcgtctacgccttcgccgcgcgcagcgcctggcgcgcctgctgggtgctggcgctggccagcctggcgctgggcggcctggcctggctcggcctcgactacggagcgcgtccatgaacctgcgtcaatcgatgtccggcctgcatacctggtcggggctgctggtcagctggctgctgttcgtcatcgtcttcgccggcagcctggccagcttcgacaaggagctgacccgctggatgcagccggacgtgcacctgcccggcgcgcagtcgctgggcgccgaccaggtgcgcgactggttgcgccagcgcgcccccgatgcccatgcctggtggatgctgccgccgagcgagcgggcgccctactggaacgccggctgggagccgcgcgacggcagcgagttcaaggtctttcagctggacgcggtgagcggccagccgctgccgaagacagtcggcggcgagttcttcttcaccctgcactacgacctgcacgccggcatggtcggcctgtacatcgtcggcatcgccgggatgctgatgctggtggcgctggtcagcgggaccatcgtgcaccggcggatcttcaaggacttcttcaccctgcgcccgcaggcggcgcggcagcgcgcctggctcgacgcgcacaacgtgctgggggtgatcggcctgccgttccacctgatgatcgcctacaccggcctggtgatcttcatcgtctactacatgcaggcgggcctgcaggtggtctaccagaacgatggcgagcgcttcttccatgaagtgcagggctcctacgaacgcgaggaagtcggccgcccggcggggccgccggcgtccatcgacggcctgatcgtcgaggccggcaaggtctggggcgacggcggcgcgccgggctggatcagcgtccaccatccctatgacgaggcggccaccgtggacatccgccggcgcgacgcctcgcgcatcctcgacgaccagcgcacggtcaacttcgatgcctccagcggcgaactgctgcatgcccagccgtcctatgcgcccggctacgccacctacggctggctgaccggcctgcacatgatccagtggggcggccagttggtgcgctggatgtacctgttgctcgggctgtccggggcgatgatgatcttcggcgggttgcaggtctggctggccaagcgcgaggtccgcggcagtcgtggcgttggtctggtgcgggcgctgaacctggcggtctgcggcggcctgccgctggccagcctggcgctgctgtggggcaaccgcctgctgccgacgcaactggccggccgcgacacctgggagatccgcgtgttttgcgccagttgggcgctggtcgcgctgtgggccatcgtccgccgcaacagcgggaccctcggtcgcacgcaactgcgcctcgccgccgtgctggcgctgggcctgccgctgctcggcctgctgcgtagcccggaaggcaacctgttggccagcctgcagcgcggcgactgggtgctggccggcgtcgacctcagcctgctgggcctcggcctgctctgcgcctggctaggttggcgacgtcggcaagcgtcgagcaagcccgtccggcgacgcctgaacgtccaggaggtggcctga

SEQ ID NO: 12937 - DNA, 636 bp, Pseudomonas aeruginosa
tgctggcggccggcacgctggtcctgctgctcgcctggcggccacgctgggcattgccttgcgccgccggagtgccgttgctcggcggggtgctggcgctgctgcgctgaagggcgcgccgcccatccgtgcctcgggggcggtccggtccagcgtctatgctggtggtcgtgctttcccccggaggtatgcgccatgcacacgcccgccagcaacaccgtcgccagcgtcattccctgcctgcgttaccgcgatgcgccggccgccatcgactggctgtgccggacctttggcttccagcgcaagctggtggtgcccggcgaggacggacaggtgctccacgccgagttgacctacgccagcccgaacggcgccaacggtatgctgatgctcggctcgagcgtccgcgacaacgcctacggtcggctgatgcggcacgtcgacgaagccggcggcaatacccagagcctctacctggtggtcgccgatcccgacgccctgttccgcagcgcccaggccgccggcgccgagatcgtcatcgacatcaaggacgaggactacggcggtcgcggcttcacttgccgcgatccggagggccacgtctggagcttcggcagctatgatccctgggcatga

SEQ ID NO: 12938 - DNA, 810 bp, Pseudomonas aeruginosa
agcctgattgacttcagtttggtacgcagtcccggattgtatgtctttcgacgaagaaaggccaggacattttttgagcagatgtcgccccggcggcgggaatgtttgagcatttgtttcggcggacgcctgccaaccgggcaaaggttatgggcctggcgtcggcggcgcgtggcaggattgccgttccatcgccgcgcccaggttatccatgccgtcgcccgctcgcacgctgctcgtggccttcgtgtccgcctggttcctgctgggtgggctgggccatttcgtcttcaccgatttcttcgtcggcatcgtcccgccctacgtgccctggccgctggcggcggtgtgggtcagcggggtcttcgaactgctcggcgccgccgccctgctggtgccggcatggcgccggctggcggcgtgcgggctgttcatcctgaccctctgcgtgaccccggccaacctctacatgtggcagcaccccgacctgttcccatccttcccgccgacgctgctggccgctcgcctggcgctgcaggcgttcctcctcggctgcatcctggcgctgatgctggcgcgggacgaggcgccgctggcacgacgctaggcgcaggcgaaaaaaagccactgtgcgggggtggacagtggccgggaatgccaggagatggaggagcaatcggacctggcgtggatagagtagtagccgctctggcgagggtctgtatggctattggtgaactttgtgaagaagtgcaaagtagagcggccaacggacgaacggtgttgcacgcggcgggacgctcgcggtag

SEQ ID NO: 12939 - DNA, 882 bp, Pseudomonas aeruginosa
ccggggtccgcgtttccttggccggcccctgaacctcatcgctgcatcgacgtccctagctacaggcgagcctgtggccgggggctttccatcatccgcaaaaaggtgaaaaccatgctgaccatcgactacaacagctatcgcaccactaccccctacggcaaacgcgtgcgcttcctggtgctgcactacaccgcgctcgacttcgccgcctcggtcaaggcgctgaccaccggcgccgccagcgcccactacctgatcccggcgccgcatgaccccagctacaaggccgccggcttcaagggccagcgcatcttcaacctggtcgccgaggaagaccgcgcctggcacgccggcgtcagcggctgggcgcgccgcgacaacctcaacgacacctccatcggcatcgagatcgtcaacctcgcccgcgacgacgacggcgtgttcaccttccccgactacgagcgctcgcagatcaacgcactcaagcaactggcgaagaacatcctgcagcgctacccggacatgaccccgaagaacgtggtcggccactccgacatcgccgtcgggcgcaagtccgacccgggtccgaagctgccttggaaggaactctacgaggccggtatcggcgcctggtacgacgacgccacccgcgatcgctatcgcgaaggcttcgagcgcgacggcctgccgccgcgcgccgacctgctggaggcgttccgcctgtacggctatgcgctgccggcgacggtcgacgatgcctacttcaccagcctgctgcgcgctttccagatgcatttccgcccggagaactacgacggcgcgctggatgtggagacggcggcgatcctctacgctctgaacgagaaatacccggcctga

SEQ ID NO: 12940 - DNA, 690 bp, Pseudomonas aeruginosa
aggttgtgcggcatgacggtcgcgccgacgatgccgatcgccaggtacagggcagccgggtcgctgagcacccgcgggctcggcaagaacccttggagcacctcgccgagttcgggacgcgagagcagcaactgtaccgcgaagcaggcgaagatcagtgtcagcaacgccaccacgaaggcctccagcggccgctggccacgtccgatcaggaccagcaccagcagcgcgtcgcccacgcagagcaaggcgccccaggccagcggcaggccgaacagcagattcagggcgatggcggtgccgatcacctcggccaggtcgcaggcgatgatcgccgttttggcaggccagccacagcaggcggcaggtgctccggcgagtagcgttcgcggcaggcctgggccaggtccaggccgctggcgatgcccaggcgcgcggacagcgcctgcagcagcatcgccatcaggctggagagcaggattaccgagagcagcaggtagcccagttgcgcgccgccggcgacgtcggtggcccagttgcccgggtccatgtagcccaccgcgaccaggtagccggggccggcgaaggccagcaggcggcgccaccagtggccgccgccggggacttcgaccggctgggcgcgaccgggctcggcggcctggggggccggggtatccttcgcggacatga

SEQ ID NO: 12941 - DNA, 531 bp, Pseudomonas aeruginosa
ccttgcgcttgcgcacgccgggttcgccgatgtcgtactccaggctcttggcgctctcgatcaccgcgcggaactgctggtaggtctccgggaacggcaggcgtggcgagaagccgaacagcaggatcacgttcaactggccggaaccgcccaggcgcaggcgcgggtgctccacggcgaaacgggtcatggcgtagctgcgcacatgctgcacccactccacctcgtggaacaggccgagcttctggcgcgcctggatggcgttgcggtagacctggaactgggtcatcggcgaggtcaccccgtagtcggcgcccttgctggtggagtgggtctgcaactcggccttttccagcgccgtcgacggctggtagtcgcgcaggtcggcgaggaaggccgggctggaggcatagtcgaggtcgagcttgcgcctttgcttctccagctcgcagatcacctgcaattcgatggccgcctggatcgtcacgaagtgcgcaccgcccaggtgcagcgggatggcgcagtggctga

SEQ ID NO: 12942 - DNA, 420 bp, Pseudomonas aeruginosa
actacgtggtggcgttgctcgacgaaggcgaggcggtgtcgcgccgcctgggcatcgacagcgaagccgagttccagcgcctggagcttggccacgaacaactggtggcggtctgcgcgccggacgccgccggccagccgttgttcaacctcgaccgcctgcagaccgaagcgctatcgttcctcggctactccgaggaatgccacctgggctgggccctggaaccgctgctgcgcgacagcggcctgttcctccagcgccatcacagctccagccagaccgaggggctgcgcttcttcgcccagtcgcgcctgggcgtcgcctggctgccgcataccctggtccgcgaggacctcgccagccgtcgcctggtgcgcgccggcggccagcgcttcgacgtgccgttgcgctacaccctga

SEQ ID NO: 12943 - DNA, 327 bp, Pseudomonas aeruginosa
tcgatggttaagaaattctccgaccttcgggcgcaaatgtcgcctgaggcacaggcccgcgtcgaggccaaggcccaggaactgttggctgaaatgcccctgaatgagttgcgccaggctagaggcttgtcgcagaagatgctgtctgaagtgctgcacgtgcagcagccggcaattgccaaaatggagcggcgtacggatatgtacatctccaccttgcgcagccacatcgaagccatgggcggccagctggaagtgatcgcacgcttcccggatggcgcggtgaaaatcagcaacttcgctgatatcgaagaggcgggcgcctaa

SEQ ID NO: 12944 - DNA, 4131 bp, Pseudomonas aeruginosa
gcaacgctggcgcttcaatctgccttatgtcggactcgaccacgaggcactcaaggacatcgattgggagttgtgagcatggcaggggtcttcgatcgaattgcaggcgcctctggtgccgacgaaacggagctgacggtggagcccatggcgttggatgacggcatggatgatgaacagcctctcatgagcgccgctgtacaggtcgatgagcgccggacgccgcaacgggtacgggaggccgtacaggaaatgctcaagtacggtctgctggaagagagtcacaagcccaacctgtatcgctcagcgctttccaatatcgaggcggtcgacagaatcctggagccgctcgaccttgccatgggggtcgacgaggttcgggggctggtgttcgttatcgttcgccagggcgaggtggccgagcaggatgactggtcgcaccccctagtgcgtcggcaaaggctgaatctggagcagtctctgctgatagccatcctgcgccagcagttcatcgcctacgaacaggaaagcggtacgggcgccagtcaggcatcggtagtggtcgatgagctgattccccaattgcaggtttacctgggcgagctgggcagtgaggcaaaggagcgcaatcgcatcatcacgctgctggatcagctcaaggggcatggcctggtgtcggctttggacgcccatgatcgcgtcatcatccgtcccatcattacccacttggctaacccggagaacctgcgggcactcgtggcatggctgcgagagcaggtagaagggcccggcgaccccggctgccgatggcgaggaggatatggcatgaagcaggcactcctttggcgtgacagcgagaccttcattctcaccagcatcgagctctataactggggcggctttcagggctatcaccgtgccgagatcgacccctccggtaccgccgtgatcggcccgacggggagcggtaaaacgacactggtggacgctctgatgaccttgctgtgcgccaatccgcgctacaacctggcatccacgggcgggcatgaaagcgaccgcgacctggtgtcctatgtccggggagttaccggccccggggacggaggtatagagcagtctcatatcgctcgccagggtaagacagtaaccgcaattgcggccacgctcgagcgtgatggtgcgcaggtacgactgggggccgtgctctggttcgaaggcacaagctcctcggcatcggatctgaaaaaactgtggctgttaagcgagtcccccgagcagactctggagcattggctcagccagcatcacgcaggcggtatgcgggctttgcgtcagatggagaaggatgggacgggtatctggccttatcccagcaagaaagctttcttggccaggctgagggattacttcgaggtcggtgaaaacgcattcaccttgctcaaccgcgctgccggcctgaagcagctcaatagcattgacgagatctttcgcgagttggtgctggatgaccgttccgccttcgagcgggccgccgaggtcgccggcagcttcgatgatctaaccgacattcaccgagaactggaaacggctagaaagcagcagcgctcattgcaaccggtcgccgatggctgggagcgttaccaggtcttgcaagaacagctgcacgataagcaggctctcgaaggtatcctcccggtttggttcgccgagcaggggtatcgactgtggttggctgaaaccaacaggctcgagaaggagtacaaaaaggccgaactggatcaggagcaatgcaaaagtcagcttgaggcccagaaaggtgtggtcgatcaacatcgccagcgctacctgcgagtagggggcgcagggatagatcaattgcgcgagcgcatcgctgattgggtgagggagtgcgataagcgcagcctgaaagccgagcaataccaactcttggccaaaggccttggactagcggatgagttatcggccgctgctctcaaggagaatcagcagcatatcgcggcacgcctggaaatactggaccaacaaattactgacgcgcgccaaaaggcgttcgacgcaggcctcgtccagcaggaactcaatggtcgcctacagaccttacagcaggagggtgctgaggttgagaaacggccaggctcgaacctgcccgggcaatttcatgctttccgaagcgatctggcgcaggcgcttggtgtcaatgagtcggccctgcctttcgttgccgagctggtgcaggtcaagcccgaggagctggactggcgtggcgccatcgagcgggcaatcggtagccaccggctacgcatcctggtgccgcaggactcatcccaggccgcactgcgttgggtgaatcaacggcacaaccgcttgcatgtgcgcttgttggaggtacaggagccgacgtcgcgccccgtgttcttcgacgatggttttacccgcaagctgaccttcaaggagcatccgtaccgagaagccataaaggcactgctggcggacaatgaccgccactgcgtcgaaagcccggagcaattacgtcatacccctcatgccatgacggcccaggggctgatgtcgggcaaagaacgcttcttcgacaagcaggaccagaagcgtctggacgaagactggctgaccggcttcgataaccgtgaccgtctggccttcctggctgagcagattcgcgaggtcaatgagcagctcgagccagccaagctcgccttggatgctgcccagggcgacgttcgtcagttggagactcaagcttcgctgctgaatcgtgtcaaagaactgcagttcgaggatattgatctgccgggtgcccagagtcagctggagtcgctgcgtacgcaactggccaccctgacgcgccccgattctaaccttgccatgatcaaggtcgagctggatgcggccgaggccctgcaggagtctctggatcaacagctccgccaactgatcgaacagtacgttcagttaaaaactcagtttgaccaggccgcatccgctacccgtaaggcctataacagcgcggagaaagggctgaacgatacgcagcgtgaactggcgcaagcgcatttcccgactctgaccgcggatgacctcggcgatattgtcgagctggagcgcaagcatacgcgtgagcttcaagggcagctcaaagcgcttggcgagaaactgggcgatcagaaatcagagcttgccaaacgtatgtctgatgccctcaaggtagacaccggggcgcttgcagaggtcgggcgagagctggtggatgtccccaggtatctggagcgtctgcgtgtgctgaccgaggaagccttgccagagaaactcaagcgcttcctggaatacctcaatcgctcctcggatgacggcgtcacccaactgctcagctatatcgaccatgaagtctcgatgatcgaggaacgcctggatgacctgaatagtacgatgcagcgtgtcgactttcagcccggacgctatctgcgcctggttgcaggcaaggtcatccatgaaagcctgcgcaccctgcagcgcgcccagcgccaactgaactcggcgcgtttcatcgatgatgaaggcgagagccattacaaggcattgcaggatcttgtggggttgctcaaggacgcctgcgaacacagcaggaatcagggagccaaggcgcttctggatccgcgcttccgcctggagttcgcagtatcggtgatcgatcgagaaagcaggaatgtcatcgaaacccgaacaggttctcagggcggtagcggtggcgagaaggagatcattgcctcctacgtgctgaccgcttccctgagctatgcgctttgtcccgacggcagcagccggccgttgttcggcaccatcgttctcgacgaggcgttctcgcgcagctcccatgcggttgcaggtcggatcatcgctgcgttgagggaattcggcctgcacgctgtcttcatcacgcccaacaaggaaatgcgcctgttacgccaccacacgcgttcggcagtcgtcgttcatcggcgcggcctggagtccagtctggtttccctgagctgggaagctttggatgagcatcatcaacagcgcatcaaggccatgcatgaagtcgcccactga

SEQ ID NO: 12945 - DNA, 660 bp, Pseudomonas aeruginosa
tctttcgtcatcacaacacggaagatcgccatggatagaagctcgccagatggaccccttatgccgttggggcggtacttcagtgacaacctcagcgccgtgctggcggttgctggcaaggagcgtgagaaccgcacggtaggctcgccagggccgatgaccgcaacccagattcaccggaaaacgggcgtcgcccgcagcacgctacgtgcactgaagtcacagcgcggcgaaagtgccgccaatccggacctcgacacgctcgatcgcctcgccgctgcattgggtgttcctcctgctttcctgctcatgcggccgcaggactggttcgcgctgggccaagcactgggcgccagcggtgactatctggccgccgccatgaaactgcatagcgccggccaactggacaacggaagcccggtcgagaaggtgttgcgcgaatgcaaggttcaccctgatgcccgaccgatgggtgttggttcatctccagaggttgcacgtgccaacgcaagggatgaatggcgccggcgtagctgcctcaagttcggtgccctgatgcttcgtccaggtcgtgcccaccaatctcgtgttgcactcgccgcgatagcaggtgcgttggtgagcgccagcacgccgaacgatccgaacatcgacgactaa

SEQ ID NO: 12946 - DNA, 966 bp, Pseudomonas aeruginosa
atggagctttcgatggctgagctaaatgtgatcttcgatgttccggaggcgattgccgaggggctgaaaaacggtgtttacgaacgtatcggtggcgtcatccgcagagtaggtgacaagcagatcgtgatgtggttgcaggaaggtgttctgctggaacgcgatacggccgagcaactgctcaaacagggggccgagcaggtccagttgctgcgccagcaggctgagcagctgcagctgctcggtgtacagcagcagatgatcatggggctgcaggtggccaatctggccgttagtgtcgctggctttgcgctaacgctttacaagttacagggtatcgagaacaagcttaaacacatggatggcaagctcgatgacatccggcagggtgtggagtggctggatgccagacagatgattggccgactggcccctctgcatgcctccctgcagcatctacgcgaagccgggctgtatcgcaacaccacactgatgcatcagcaactgggtattgccagcagccagctcgcagagagccacagttattttggcgggctgctgcagcatgtgggtgagcgtgcgcttgagtatctacagcctggtgagtttggggccgcttaccgtgggtgggtgatgtcggctcaggggcgggtacaggtgctggctcggctaggtgaaatggatgtggctgcgcagctcgccaatgacttcaaggagcgtcacgctgggttcggtcggcagctgcagcagagcctgagcaatccagcgctgcgcctcagggcgggtcggcagggcgagaccaatcatgctcgtttgctgaatatcgctgagcaggctgtcggtgcgcacgagatcatccgcggtaacgtaatgcagttggagttcatgcgcgatgagcaactggatctaccggttctcaatagcccggcaggatatcaagggttggcgttctgccgagtgggctga

SEQ ID NO: 12947 - DNA, 1143 bp, Pseudomonas aeruginosa
ggttggcctgcctccctctttgcattcctagcgcgggccttcatggccaacgctgcacttccttcaggacagttgcctgcgctgctggcgcgaggctttatggagtcatcggacatggatctccaaggtcatctgctttacatcgacatcacccagatttgtggaatcggctgtgccttctgtatgtacgccgacaagcacaaggcgggcatcagcatggagctatcaacgttggcgcgggaaaacctcgcccggttgatcaatgccccagaggtcaagcgcatctccgtcagtggcgaaggcgagccgctcaacaacgccaaagtgttccacgagatcctcggattgtccgaaggtggcaagtgcttcgaattcatcactagtgggttctacccacatgacaagatggcggacttctatgacgccgccaatcgcatcgtctcgggcaatggcgacacctgtaacatccgcctgagcgccgacagccaccatatcgagaaggtcaaatggcgggctcatggcttcagtctggactatctgaggcgccggcggccgtccgggctgagcttctcgttccgttcgatcgacaccgatcgcgacttcactcgcgagtatctgaagtccgagctggctcgctggggagtagaggcaaccatcgagccgcggagtgtgctggaagacgtcctggttgcgggtggtgagtgcttcggcatcgactacaagaacctggtgcaccccgctcctggaatcgccccgggttatctagacatgcaggggtacatcgaggcgatcgagtccaaagtcaacaaacgcttcactttcggcagtctgaacaagccgccgcaggctaacggtttggatgtcacggtgaagcctagtggtgacttgtacttgtacggtatcgagaaccagcgcctaggcaacatccactttgatcgggtcgactggcaacggttggtcgcccacgtgcgggagacaccgttgacccgagcactctatacgcaccccttgaccgagttgctggcgcgcctggagagcaccgacctgctgcgttcgatcattgccaaggcgaacaacccctactggctggtgaaggagctggcaggtcatgccgggttgctcgaacaatgggaggttgcatga

SEQ ID NO: 12948 - DNA, 966 bp, Pseudomonas aeruginosa
ccaccacccagctaccgctgtacgagatcgccctgctgctcggcttcaacgattcgtcgaacttccgccgggcgtttcgcaagtggaccggcaagctgcccagcgactaccgcgaagcgccctgagccgacgccggcgatcctcggcagcggatggatgtgccatgcttggcgtttcatagaaatccatggcgcgcttgccgcgccgaccgtgatcggagtcttgcatgtcgacatcccccgcgctgatccgcgaaacctttcccgtcgggcctttgcagtgcaactgcaccatcattggcgatccgctgaccaggaaggccatcgtcgtcgatccgggcggcgaccacgaactgatcctgcagcgcctcgaccgcctcggcctgcaggtggtcagcatcatccatacccacgcgcacctggatcacttcctcgcctccggcgagatgaagaagcgcaccggcgccagcctgcacctgcacaaggacgaccagttcctctgggacaacctggagatgcagtgccaactgttcggcgtgccctacacgccggtgccggccccggaccgctggctggccgacgacgaggaactggcctgcggttgcggagtggcactgcacacgccggggcatacgccgggctcgatgagtttctggttcccccgggcgaagctgctgatcgccggcgacaccctgttccgccgtggcatcggccgcaccgacctgtggggcggcgactcggcggcgatccagcgttcgatcaggcagcgtctgtacagcctcgacgaggacgccacggtggtcgccggccatggcccggacaccacgctgggcgaagagatgcgcgagaaccccttcgtcaggggctgaaaaggatttttccgagcatcgggaattttgccacctggctatgctctaagatatcggccgcccctcacgcaggggcgtttcagtacctcgaggagtag

SEQ ID NO: 12949 - DNA, 534 bp, Pseudomonas aeruginosa
cgacatcaagctgatcatgccgggcaacatcaccttcgccaccgattcggcgaacatcgccccgagcttctacgcgccgctgaacaacctggcgaactcgttcaagcagtacaaccagaacaccatcgagatcgtcggctacaccgacagcaccggcagccgccagcacaacatggacctgtcccagcgtcgtgcgcagagcgtggccggctacctgaccgcccagggcgtcgacggcacccgcctgagcacccgcggcatgggcccggaccagccgatcgcgagcaactccactgccgacggtcgcgcgcagaaccggcgcgtcgaggtcaacctgcgaccggttccgggcgcccagggcccggcgcagacccagccgcagtactgatcgcggcctggacgaaaaagcccgccattcggcgggcttttttatgggcgctggtcggcgctcttcgtcctacgccttggcgttaccgggaaactcgcggtgcaggctgtcgagcaactggtccttgcgctcccacagctggttga

SEQ ID NO: 12950 - DNA, 1254 bp, Pseudomonas aeruginosa
agaaggtatgcatctgggctccttaagccgtgcgtttggccacgccgcctggttgggcgggggcgtcgatccagttcagtcgagcagggccagcgtgtcgagggcgatctgccgctcttcgttggtcgggatcaccagtacccgcggatgccccgcggcctggatcggcccggcgacgccgcgcacgcagcgggcgttggcctcctggtcgaggcgcaggtcgaacagccgcaggtgggcggcggtcttggcgcgcaccagcggcgagttctcgccgatgccaccggtgaagatcaccccgtccagttgcggcagggcgcagctcatcgccgccagggacttggccaggcggtagcagaacacctcgatcgccagggccgcgccggggtggccctgctcgcgctcctgctccagggtgcgcatgtcgttggacaggtcggagaggccgagcaggccactttcgttgttcagcatcgagtcgatgcgctccaggctccagcccagggtccgcgccaggtggctgtgcaggttggggtcgacgtcgccgctgcgggtgcccattaccaggccttccagcggggtcaggcccatgctggtgtcgaggctctggccgttgacgatggcgcaggtcgaactgccgttgccgaggtgggcgctgagccaactgctgtcgccgaccgccaacccggccatttccgcggcgcggtggctgacgtagcggtggctggtgccgtggaaaccgtagcggcgcacgccatgctcacggtagagggcctccggcagggcgtagcggtaggcgtactccggcaggctctggtggaaggcggtgtcgaacacggcgacgtggggcagcttgggaaacagcgtcatcgctgcctcgatgccttgcaggttggccgggttgtgcagcggcgccagcggcgcggtggcccggatcgcctcgaccacccggtcgtcgatgcgcgtggcatgggtgaacagctcgccgccatgcaccacccggtggccgatgccgtggagcttgccgcccgcggcgttctgcaccatcggcagcaactgggcgagggcggcgcggtggtcggcgttgggaatcatcaggctgtcgctgtcgccgccgcgcttccagcgcagcaccgcatcgcggctgcccaggcgctcggcgaggccgtgcaggggaaacagggagtgggcctcgttgaccagggcgaacttgatcgacgaactgccgcagttgatcaccagtatgttgcgtga

SEQ ID NO: 12951 - DNA, 603 bp, Pseudomonas aeruginosa
aaatcaatcacccgcgacggcgctcgcgcgccccgttcatcaggggcgcggtcgctttcggggctattgatgcgtacacttacgcattcatcttctttatcgaaaaggtttcgaaccatgcagatcgcggccaacaaggcggtttccatcgactataccctgaccaacgacgccggggatgtcatcgacagttccgctggtggcgcgccgctggtctacctgcacggtgccggcaacatcatcgtcggcctggagaaggccctggaaggcaagaacgtcggtgacgaactgagcgtcgccatcgagccggaagacgcctatggcgaatacagcgccgaactggtcgcgaccctgacccgcgagatgttcgaaggcgtcgacgaactggaagtcggcatgcagttccacgcctcggctccggacggcggcatgcagatcgtcaccatccgcgacatcgacggcgacgacgtgaccgtcgacggcaaccatccgctggccggccagcgcctgaacttcaaggtcaaggtagtcgacgtgcgcgaggccaacgccgaggaaatcgcccacggccacatccatggcgaaggcggtcaccaccactga

SEQ ID NO: 12952 - DNA, 405 bp, Pseudomonas aeruginosa
ccgcttcagcccgcgcgagcgggtgctgcgctactacggcgagctgctggagcacttcgcccgccaggaaaagcccgaataccactgcttcatcggcagcctgagcttcgagatggccgagctgtcgccgccgatcgcggccaaggtcgagtcgatcctgcaggcttccgcgcgaatcctccaggactgtctggagcaggcgcgcgaggccggcgaactggccgccgacgaggactgcgcgagcctggccggcttcatcggcttcgcctggcagggcgccctggcgcgcttcaaggtcggcaccggcctcgctccgctgaatgctttcatgtcgcgcctggagctgctgctccgcgcctgatacctgcccgaacctcccattccctctcaggagtccgtccatga

SEQ ID NO: 12953 - DNA, 1035 bp, Pseudomonas aeruginosa
cttcaaagtccgaaacgggcattgtatgaccgccaacacaacaataggccgagaaacggccagaggagcgaatccatgcgtatcggcctggtggtcgacgcgacctgcgacctgccgcccgaattcctcgccgcccacggcatccgcgtgatgccgatcgggatccgcctgggcgagcagcggctcatcgatcgacgcgaccccgacaccaccctgagcttctaccgcgaccacctgcccaaggtcggtagcaaggacggcagccagccgctctccgccgccgagttgcaacaatggttcctcgacgaactggtgaccgacttcgactacgtggtctgcctcaccgtcgacagcctgcgcagtccgatcttcgagcacgccacccaggcttccttcggcctgctccagcactaccacgagcgccgccacgcggccggcatcgccggtcccttcaccctgcgcgtactcgacagccactcggtgttcgccggcatcgcctgcctggcggccgagggcacgcgcctgctggcgcagggcagccaccccaacgcgctgcgtacgcgcctcgaacagctcagccagcagacctgcacctacctggtcgccgatgacctgggccacttgcgccggcgcggcttccagaagggtgatcgcagcggtttcgtcgaccgggtcaagggcgcggcgctggggttgggctcgctgctcgacgtcaagccggtgttcagcctggccgatggcgaggacaaaccggtggcgctctcgccgagcttcgagaagtcggcggagaagctgttcggctatgccctggcgcgggtacaggcgggtgagctgctggcaccgcaactgggtctcagctatgccggcgatccgaccgcgctgcgcgacctgccgggcttcgccgcgctggagaatgcctgccgcgagcgcgacatccacttgcacctgggcatgctcagccctaccggcggcatcaacctgggcgccggggccatgagcctgggcttcatcgccacgccgaaagcctttgcctga

SEQ ID NO: 12954 - DNA, 1323 bp, Pseudomonas aeruginosa
cagccacacttcactgatcgcctggttcggttcgagttcatagcgacggctgccctcccgggtataggccgggttcggcgtcaccgtcacgctgcacggcaggcggccgagattgcggatgttcaactgcaggttgccgttgcgttgataggtgaccgatacctcgggccgcgccatctgcgcggcgagatgcaggttgccgtggaactcgcggaagaagccgttggggccgtgcacctcgaaggcgtagcggccgttggcgtcgagcaggtcgtcgagttcgtcgttgagggtccggcccagttcctctccgctttcctggaccaccggatagctggtcacggtatagaagcgcggattgccgacttcccgcggctgcacctggaataccgcagcggagtgtccctgcggattgcccggcaggctcatgccgtcgttgcccagggtcaggcgcagcttgccggcggcgatgtcgagggccagcgtggcgtgcaactggtagggcaccgcgagggtagggcgctggcccttttcctggccgggcaggctcttgggctcgtaggaccagtacttgggactgggccggtagaactgctgccagtaggcgtcctccttgcgcgcgtcgctctgcgggacgttggtcaggtcgggggcgacctgggtatcgcctgcgccctggaagtcgaacagcgaagtcaggtcgccgcagacggcacgccgccagggcgagatgttttcctcgacgacgccgaagcggcgttcgaggaagcgcagcaccgaggtatggtcgaacacttcggcgctgaccttgccgcccttcgaccagggcgagatggcgatcagcgggacgcggtggccgagcccgatgggcagcccgctggatgcctcgatctcgccggcggtgctgaccgtggaaaggccgacgccatccttccacggcggcaccggggcgctggcgtggtcatagaagccgtcgccctcgtcgtagttgaggatgaacacggtcctggcccagacctcggggttgctggtcagcgcctcgagcacccgggtcacgtagtactcgccgaacgaggggccccaccagggatgctcgcagtagcagtagggcgcgacgatccacgacacctgcggcagcgtgttctcctgcacatccttgcgcaactggtcgacgccgcgggcgagcatggcgcgctgccagaggtccgaatcgcgcggagcgttcttgaagttcctgaaccaggcgagggcgttgcagtcatagttgttctgctcctggagccggtatttccagtaggcgtcgacgtacaggtaccagagtga

SEQ ID NO: 12955 - DNA, 846 bp, Pseudomonas aeruginosa
caatgccgacagcggacaccgggcgcatgcttatttcaccagcgccttctcgccttcctcgcggacccagaacagggtggcgccggcgacggcggcgggcatcatgaccaggttgaccagcgggatcagcagcgccaggtaggtcaccccgccgaaacccatgcacgcccagcgcttgctgcgcagccaggcgagcatctcgttccagccgagcttgtggttgtccgccggatagtcgatgtactgcaccgccatcatccagatgccgaagaggatccacagcggcgtggcgatcaggttgaccccgggcacgaagctcagcaccagcagcaccagcgcgcgcggcaggaagtaggcgagcttgcgcatctcgcgacccatggtgcgcgggatcatcgccagcagttcggcccagctgaacggcgggaagtcgtcgcggccgcgaaccaccacctcgaccttttccgagaggaagccgttgaacggcgcggagatgatgttggcgaccatggtgaaggtgaagaacacgatcaccagcaccagcaggacgaacaacggccagacgatgtactgcaggaagctcagccagtcgggcaggctgggcatcagcaggtcgacccagtggctgaactgctgcatcgcgaagccgatcagcagggcgaacaccagcaggttgagggtcagggggatcagcacgaacaggcgcaggccgggacgcatgatcagcttcaggccttcgccgaggtattgcgggccgctcagggctggcatagggaatggttctccgatgggatgcgggctgaaaccttagcagactggcgaaagcccgcgacagagcctgtttga

SEQ ID NO: 12956 - DNA, 579 bp, Pseudomonas aeruginosa
ccgcgcatttcaggctggcgcctggtacaggcaatagtggttgcgctggcgcttggcctcgtacatggcgctgtcggcggcacggaccagtccttcggcatcgccggcatgccgcgggtagagagcgatgccgatgctcggggtgacgaagtcgatgcgttcgccattcagcgcgatcggttggaccagcgccgccagcaggcgttctgcgaggcgctgcggattgttttcctggctgtcctcgaggagcacggcgaattcgtcgccgcccaggcggtaggccttgtccggctgccgcagggtgctgcgtacccgttcggcgacggtcctgaggagggcatcgccgatgtcgtggccgaagcggtcgttgacctccttgaagcggtccaggtccaggtacagcagcgccagttcgcttccgccggagccggcgcgaagcaacgcctggccgagctgttcgtcgaaggccttgcggttgcccaggccggtcagcgggtcgcggtaggccatttccagcaattgctgctggtaggcgatctggtcgctgacgtcgcggacgatgccgcggtagccccgtag

SEQ ID NO: 12957 - DNA, 1380 bp, Pseudomonas aeruginosa
ttcgccctgcaggtcgtggatcagcgaaaccgtggcctcgaagtagccgaggctgccgtcggcgcgctgcagggggatggcgaaggtcttgcctgcgccgctctgcatggcgcgctggaagggttggcgggcacgcgccaggtcgtcttcgccgagcagttcgtagtagggatggccgatcagcgtttcgcgcgtctggccgagcagttggcagagcgcggggttgacggtgaggatcacgccgtcgacgtccatttcgaagtagccgtcgcgcatcgactggaggatcgcccggtcgcgcgcctcgctgtgttccaggcgctcgagcatctggttcatctcgcccgccagttgtcccagctcgtcgttgccgaagtcgctcaggcgtatcgagtgggcgttgcgtccgacttcggcgacctcccggttgagccgttggacccggcgcaggacccacagctccagggccaggtagccgaccaggaaagcgcccagcgcgaccagcagggaggcgccgaggaagaagttgatggccttctcgccctggatgtagagcaggcgtttcttggtgatgtcgaagcgcagctgcggctcgccgctggaactcaggtactgcaccgagacctgctggacatgttcgccgatgaaccgccgtgggctgagcagggcctggttgtgggtactgccgctgcggctgcgcagcggcttccaggtggagtcggtggcgatgttgggcatcggttgcaggtcggcctgcatctgttcgcggaggttggccaggcgttcccggtcgaggaagtagccggcgaggatcgcgcccttcgccggcgcgctaccctggttgttgctgataggcacgctgaccagcagggtcggcaggttgtcgaccagcagcagctcgctcaggctgtggtcggtgcgtccgcgaaagtccagcgcgccgaggcggatggcgcgttgctgcagtgcctcgagcagggcctggtcgctcgccgagggggcgccgaagagcacgcgctggtcgggcgcgggcggggaccactgcttcagttgcaggtgaccccggtcgtcgaggaacaggacgaagtcgaatcccaggtcgtcgagcatctcgtggtcgaggttttcctgttcgaaggtctcgttggggcgctggatgaagtcgtagctggcatcccaccaggcgtaggtgcgaacgatgtccaggtggcgcttcaactcgaagtccagccggttgtgcaggacggtggcgccctcttgcaggcgttgctggtcctctcggtcgaaacggctcagcaggatgctttccgacaagagccagataccgccgagactggcggccagcaacggcaggaacagccagagcaggcgtgtgcgtaa

SEQ ID NO: 12958 - DNA, 495 bp, Pseudomonas aeruginosa
agcaattgctctagccggcctagaatccagacgcttcatccttcccacgacaacacaatagaaggagcgtcatccatgtttctcagccctagcgcgatctgcctgctcggcctgatcgcctggaccctgttgctggtcttcctgctggtcagccagcgcggcctgctggtactcggcgggcggatggcggtgaacgccttcgccgccgatggcagcaacacgcctggcggtttcggccagcggctggtgcgagtccatgccaactgcgtggagaacctgccgctgctggccggcgcgctgctctacgcgatcgccagcgggcagagcagcctgaccgacccgttggcgccactggtgctcggcgcccggctgttccagtcgctgatgcacctggtcagcacctccgcgctgttcgtctggctgcgttttgccggcttcttcgtgcagttgctggtgctcgcctggtggctgctgctcctcgcggggctggcctag

SEQ ID NO: 12959 - DNA, 1278 bp, Pseudomonas aeruginosa
acaggcacacgtagccagggtttcgccgggggactgtaccgttgcgcggattcgccgtctcgcggcgggtgcctggcggcgaaaacgactgccgcccggagcgggcggcagtcgagggcgttacagcagggtccaggcgtcctgccaggccatgcccttgcccggggcgtagtagaggtcccagcccttgcaccagccggagttcgggtagggcttgcactggtagcgcttgccatcggcaccgcgcactacggtcccggcgtcgtattgctgcaggccttgcggatagtcgaagtcgaccttgccgtcgccgcccggttgctcgccgccgccctcgaccggcagttcgatgtcgatctggaagcggtagccggcctggcgcacgtagacctggttgtcctgcgagctggccaccgggctgaccgccccgtaggcatccagcacgccgatgttgaccagggtggagtcctggttgaccttctgcgccagcgccagcggccattgcttggcaccgttggcgccctgggccagggtcaggctgtgacgctgggcgtcgcggccctgggcatcgaacagacgcagggtgacggtagcaccggctggcaggtcctgctgcgcgcgcaggttgcccagcgcttgccaggggttggcgacggcgccgctgaagctcacgtcgatgcaggcgtagaaggcttccgggctgtccgagcgctgccagacgttatagatcacatgcttgccggtcttgccctggggcagcgggcagttcatccggtaggtgccgttctccagcttgacgctggtgatcgagcagaacggcgcgggttccaggtcgctccaggccagcggcttctcggggttgtagccgtccttggtgatgtagaagtcgaagtagcgggtcgcgtgcggcgcgctggccttgtagacgaactggaagttgccgctggcgtccggcgcgatggcagtgctgggccagtcgctgcgagccaggttcaggcccttgaacagtgccttgccggcgccgcagagctggccgtcggggaccaccgcctggtggttgccgttggcgttgccctggttgacgccattccagtcgtacagcgcctgggtgccgccggcggcgacggcggccttgcaggcggccgacttgggattctccggaccttcgaggaagcagccgtagacccgactgggcggcgtttccatcgagccgtgggcatgggctgcctggggcaggaacagggcgagggtgagtggcaggagtgccagggtggctga

SEQ ID NO: 12960 - DNA, 1224 bp, Pseudomonas aeruginosa
gtgttctccagggtgcgtatccggcagtttaggccttcgctcccgccttgggttccgctgccgtcgcttcctcgtgggcatttttcgccgcgctgcgggtcggaaatagattgcccgccgccggcctcaccagcgcgcgcgggtcgaaccgatccagccgagggcgccgtccaccggcacgcagtcgccgtcgtcgtggcgcagggtgccgttgaaacggccgaaccactggcgggtattggcatagaacaggccgacgctgggccgcgcctggtgcagctgttcgggacggaagagcagctcgacgcgaccgcaggcgctgtccaggcgccattcggccagcgggtcgcgaggctcgcggatgtgcacgtcgtcgagcacgcggctgagcttgccgccgaaccacagggcgttctcgcgcaggtcgctggcttcggtccagccggtgccgaagttgccggcgatgccgccgggggcggcgaaggcggcgcgggtccagtaggtatgcagcggccagacgccgcggccgaagtccagcgcggcaaagctctggcccgcctggcagtcgtagcgccggcggccgagctgcaggcagccgctgatcggcaggccgagctggcggctgcaggcatggaaggtgtgttcgcccatcggcaccaccaggttcaccgactccaggtgcgacggtcgtcgcacttccagcgccagctccagcggcaggccaccgaggtccggggcctggccggtgacgcgcaggcgcccgggctgttcgtcgaagcgcaattgcaggcggggatgctcgaaggcatggctggcctgcggctcgtcgggcaactggcagccgaggccgaagaagcggatctgcgtgtgcgctaccgcctggccgctgtccaggtcgaggaaataggcggcgccgtaggtcaggtagtcgaggtcggcgatggtcagcgagagcatccagccggggctgacgatgcaccagtggttccagcgcttgcgccggccgaagtggccggggatgtggcagagcacccgcggccgggcggaccagccgaccgcccggggatcgagccggccgtggccgtcgcagaggttgcgcaggggcgggggcgatacggcgagggtatcggcggcggttccgttcatctaacacatccatgtgacaggctgacgcaagcatgccggctgcggaaggaaggcggcaagtacccactacagaactga

SEQ ID NO: 12961 - DNA, 312 bp, Pseudomonas aeruginosa
ttcgcgatgagcatgcgtgaccgtatccagaccgccctgcagcccctcgatccgcaacacgtcgaggtgctcgacgagagccacatgcacagccgcgggctggagacccacttcaaggtggtgctggtcagcccgcagttcgccgggttgaacgcggtgaagcggcaccagaaggtatatgccaccctcggtgggttgatgggcgagttccacgccctggcgctgcataccttcacccctgaggagtggagccaggctgcggtgccggcctcgccgacctgccgcggcgggagcaagcacgacataccctga

SEQ ID NO: 12962 - DNA, 2085 bp, Pseudomonas aeruginosa
gggcgatccagcgggcgttctacgccgagggtcgcgatgtcacccaggcggcggtgctcgccggcctggcggaagcggtggggcttccgcgcatcgagttcgccgcggccttcgacagcggcgaggcgcgtgacgccaccgccgccgatttcgcctgggtccaggatctcggcatcgccgggttcccgaccctgctggccgaacgcaacggccaactggcgttgctcaccaacggctaccagccgcttgccgaactttcacccttgctcggccgctggctggaacggggccggcatgagtgagcgcggagaccgcctgagctgggcggagattcgtcgactcgcactgcgccataagaaagccctgttgttcgccaacctggtggcggtgctggccaccctctgcaccgtgccgattcccttgctgctgccgctgctggtggacgaagtgctgctcggcaagggtgacggcgcgctgcgtttcatggaccgcctgttgcccgccgactggcaggtggcgttcggctacatcggcctgatgctggcggcgacccttctgttgcggggggcggcgctggtgttcaacgtgctccaggcgaagctgttcgcgcggctgtccaaggacatcgtctaccgcatccgcctgcgtctgatcgagcgcctccggcatatcgccctgggcgaatacgaaaccctcggcggcgggtcgatcagcgcccacctggtcaccgacctggataccctggacaagttcgtcggggaaaccctcagccgcttcctggtcgccttgctgacgctgctcggcaccgccgcgatcctggtctggatgcactggcagctggccttgctgatcctgctgttcaacccgctggtgatctggtccacggtgcagctgggcaagcgcgtcaagcatctcaagaagctcgagaacgacagcaccgcgcgcttcacccaggcgctcaccgagaccctcgaggcgatccaggaagtccgcgccggcaatcgccagggctatttcctcggccgcctcggccaccgcgcccaggaggtccgcgactacgccgtggcctcgcaatggaagagcgacgccgccgggcgcgccagcggcctgctgttccagttcggcatcgacgtgttccgcgccgcggcgatgctcaccgtgctgctctcggacctgtcgatcggccagatgctcgcggtgttcagctacctctggttcatgatcggtccggtcgaacagctgctcggcctgcaatacgcctactacgccgctggcggcgcgttgcagcggatcaacgagttgctggcgcgggccgacgagccgcgctacccgccgctgcgcgatccgttcgccggccgcacgaccgttggcatcgaggtgcgcgggctggatttcgcctacggcgaggacaaggtcctggagcagttggacctgaacatcggcgccggcgagaaggttgccctggtcggcgccagcggcggcggcaagagcacgctggtgcaactgctgctcggcctctacagtgcgcagcgcggcagcatccgctacggcggggtgcccctggaggaaatcggcctggactgcgtgcgcgaacatgtcgcggtggtcctccagcatccggcgctgttcaacgacagcgtgcgggccaacctgaccatgggccgcgaacgcagtgaccaggcctgctggcgggctttggagatcgcccagttggccgacggcgtgcggcgcctgccgcaggggctggacaccgtggtcgggcgttccggggtgcgcctgtcgggcggtcagcggcagcgcctggcgatcgcccggatgatcctcgccgagcccaaggtggtgatcctcgacgaggccacctcggccctcgacgccgctaccgagtacgccctgcaccaggcgctcggggacttcctcgaaggccgcaccacattgatcgtggcccatcggctgtcggcggtgaagcaggccgaccgggtcctggtcttcgatggcgggcatatcgccgaagacggcgatcaccagcaactgatcgccgaaggcggcctctacgcccggctctacggacatctgcaacagatgtga

SEQ ID NO: 12963 - DNA, 2469 bp, Pseudomonas aeruginosa
atggtagatggaatgaggcagaaccggactctcgacaagccccgcctgctcggcctggtatggcccttcatcgtcgtggtgctgctgcaggccatgctggcgggcggcagtctctacgtcctctccgcggtgcgcagctatgtcggcggcgaaagcctctggtcgaagggccagaaggatgccatctactacctcaccctctatgccgactcacgcgccgacgaagacttccgccgctacgaggaggccatcgcgatccccctcggcgaccgcgagatgcgccttgccctggaccagcccgacccggacatcgaggcggcccgccagggcatcctcaagggcggcaaccatgccgacgacgttaccgcgatcatctggctgtaccgcaacttccacgacttcagttacttcgagcgcgccatcgagctgtggctggtgggtgacaagtacgtcatggaactgatcgacgtcgccggcaagatgcgcgcgggcatcggcgccgggcaggccagcgccgagcaggtgcaacagtggaagaccgagatccacgcgatcaacgagaaggtcacgccggcggccaaggccttcagcgacgcccttggcgagggctcgcgggccttgctcaggctgctgctggtggccaacctgaccaccgccagcgtgctcatcctcctggcgttcctgcggacccggcagcaactgatgcagcgccaggaagtggagaacgccctcgatgccgagcgcgaacgggcccagatcaccctggcctcgatcggcgacggagtgatcaccgccgacacccaggggggcatttcctacctcaacccggccgccgagcagatgaccaactggacgctggacaaggcccgcggcctgcccctggcgtcgctgttccggatcgtcgacgaaagctcgcgggaggagggcatgctgctgatcgagcagatcctcagcggcgagatcgacggcggtcgcgagcattccaagctggttctgcgtcacgacggcagcagcgtgccggtgaccctggtgggcgcgccgatccaccgtggcggcgagatcaccggggtggtcctggtgcttcacgacatgacccgcgagcgccagtacatggcgcgcctgtcctggcaggcgacccacgatgcgttgaccgggctgaccaaccgccgcgagttcgagtatcgcctgcagatagcgctggaacgcctggagcgcaacagcgggcggcacgccctgatgttcctcgacctggaccagttcaagctggtcaacgacacctgcggccacgccgccggcgacgaactgctgcgccaggtctgtaccctgctgcaacaaggcttgcgcgagggcgacacgctggcgcggctgggcggcgacgagttcggcatcctgctggagaactgtccggcggaaaaagccgtggagatcgccgaccatctgcgcaagaccatccaggacctgcacttcacctggagcgggcagccgttcaactgcaccgtcagcgttggcctggtgcacctgctgccgggtatctcgaccctcgaggaggcgctgcgctccgccgatatggcctgctacatggccaaggaaaagggccgcaaccgggtccaggtgttccatcaggacgacgtcgaactatcgatgcgcttcggcgagatgacctgggtccagcgcatccacctggcgctggaggaagaccgcttcagtctctatgcccagcccatcgtgccgctgggcgaaggtgcggaggagggcttgcacgtcgaactgctgctgcgcctgcgcgacgagggcgggcgcctggtgccgccgctgagcttcatacccgccgccgagcgctacggcctgatgacgctgatcgatcgctgggtggtggagaatgccttccgcacccttgtcgagcgcgcccaggaccctcgcgccgagccgatcggcacctgcgccatcaacctctccggcgcgaccatcggcgacgagtcgttcctgcagttcctcaccgagctgttcgcccgttaccgcattccgccgcagacgatctgcttcgaggtcaccgaaaccgtggcggttgccaacctggccagcgccatccgcttcatcaacgagctcaaggacaccggttgtcgtttctccctggacgatttctgcgctggcatgtcgtccttcatctacctcaagcacccgccggtggattacctgaagatcgatggcagcttcgtcaaggacatgctcgaggatcccatcgatcgcgccatggtccaggtgatcaaccatatcggccacgtgatgggcaaacgtaccatcgccgagttcgtcgagaccgtcgaagtcatggaagcgctgcgcgagatcggcatcgactatgcccagggcctggccatcggcgcgcccctgccgttcagtcgccagcctccgggcgcagggctggatgcccagggcctgtggccgagcctcggacagaacctccggtag

SEQ ID NO: 12964 - DNA, 474 bp, Pseudomonas aeruginosa
gcgcgacgccggcggccggcagggtcaggaactgcgcgtggctaccgtcgcggaagaatcccggctcccgcccggtgccccagaccgcctggccgagcagagccttcggtccctccaccaccaccccggcgaagtcgcggcccggtacccggggcagggtggtataggggaagcggccgaggacgttcttcacgtcgctcggattcagcccggcggcgcggatttccacccgcacctcatcggcggcgggaagcgggtcgggcatgtccaccagctcgagggcggcgaggtcgccggtacggtcgaattgcagtgctttcatcgggggctccgtgtcgtcgcggcgatcagtgcagccactgctgcagcaggtcgcggccaagggggaaaagctgttcgccgagctgcatgccaagcaggccgaccagggcgatggcggggggcgccggcgagcggaagtcgaggacggcgtag

SEQ ID NO: 12965 - DNA, 417 bp, Pseudomonas aeruginosa
cgatcagctcgcgcagcagcgggccgaccaccagcaccagggtgcggtcctccaggccgcgggagagttccgggctcaggtaaatgttgcgcatctgcaactcggaggcgacccgcaccgcatggcgcaggcccggaggcaaccagaccgcccgttgcggcgggaccggcagggcctcgtcgggcgtctccagccacatcatcccggacaccgcataaagcacctggccccaggcgtgctcgtgggcatcgacgcggtgcccggcaggatatctgcgggcgaccccgcgcaggggccggcgactgtcgctcaggtcgggtggggcgggtcgtgccatgggaatgccgtcgcggaggaaagacgcaggttaaccgcttgacgccgatcatgcagcgccggctttcatcgcagccgtga

SEQ ID NO: 12966 - DNA, 1515 bp, Pseudomonas aeruginosa
ttcaatggacggccaacatccgcattcgggcgagctcaagcgcggcctgaagaatcgtcacatccagttgatcgccctcggcggcgccatcggcaccggcctgttcctcggctcggccggggtgctcaagtcggcgggcccgtcgatgatcctcggctacgccatcgccggcttcatcgctttcatgatcatgcgccagctcggcgagatgatcgtcgaggagccggtcgccggctccttcagccacttcgcgcacaagtactggggcggcttcgccggcttcctctccggctggaactgctgggtgctgtacatcctggtcgggatgtcggaactgaccgcggtcggcaagtacatccactactggtggccggaggtgccgacctgggccacggcggcgttgttcttcgtcgtcgtcaacgcgatcaacctaaccaacgtcaaggccttcggcgaagccgagttctggttcgcgatcatcaaggtggtggcgatcatcggcatgatcctgctcggctgctacctgctgttcagcggcagcggcggtccgcaggcttcggtgagcaacctctgggcacacggcggtttcttccccaacggagtgagcggactggtgatggccatggcgatcatcatgttctccttcggtggcctggaaatgctcggcttcaccgcggccgaggcggacaagccgaggacggtgatcccgaaggcgatcaaccaggtgatctatcgcatcctgatcttctacatcggcgccctgatcgtgctgctctcgctgacgccctgggacagcctgctgcagaccctcaacgcttccggcgatgcctacagcggcagcccgttcgtgcagatcttctcgatgatcggcagcggcaccgccgcgcacctgctgaacttcgtggtgctcaccgccgcactgtcggtgtacaacagcggcacctattgcaacggccgcatgcttctcggcctggccgagcagggcgatgccccgcgcgcgctggccagggtcgacaagcgcggcgtaccggtatgcgccctggtggtatcggcgctggtgaccttcctcgcggtggtggtgaactatgtgatcccgcaccaggcgctggagctgctgatgtcgctggtggtggcggcgttggtgatcaactgggcgatgatcagcatggcgcacctgaagttccgcgcgcagatggaccgccagggcacccgcacgcacttccgcgcgttctggtatccgtacggcaactacctgtgcatggccttcgtggtgttcatcctcggcgtcatgttgctgatccccggcatccaggtctcggtctatgccatcccggtctggctgctggtgatgtgggcctgctaccgactcaagggagccccgcggccgatgccgggcctgcgggtgaagccggtcaccgagtgatcgatggggcgccggcgcgcagaggagaggggagcgctcctttgcgtgtcccggcggcccacaagactttttctaggggcgcctgtcgttga

SEQ ID NO: 12967 - DNA, 444 bp, Pseudomonas aeruginosa
cgcggcaggtgccgaattcctacagtggcagcgccattttttctcgttagagggatttccatgaaaaaagcgctctggctgcttctggctgccgttcccgtggtcctggtcgcctgcggcggcagcgaagacgacaagcacaccgcccaggtcgattacctggccctgccgggggatgccaagctggatacccgcagcgtcgactacaagtgcgagaacggtcgcaagttcaccgtgcagtacctgaacaagggcgacaacagccttgccgtggtgccggtcagcgacaactcgacgctggtcttcagcaatgtgatttccgcctccggcgccaagtacgccgccggccagtacatctggtggaccaagggcgaggaagccaccctctacggcgactggaagggcggcgagcccaccgacggggtcgcctgcaaggagcgttga

SEQ ID NO: 12968 - DNA, 1509 bp, Pseudomonas aeruginosa
ccgcaacgcggttatccgccgcctcggcgggagtgcgcggcattcgctggggcgaaaaaaagccggccatcacagccggctcagggtaaccgtgagggttcagtccgcgcagacctgggcgatggcttgcgccaggcggtcgaggcggcgcgcgtctataccggcgacgttggcccggccgctggacaccaggtaaacggcgtgctcgtcgcgcagccgagcgacctgctgcgggctcagtccggtataggaaaacatcccgcgttgcgcgccgacatgggcgaagcgctcggccaggccgtgcggcgccagggcttcgaccaggccgatgcgcaggctggcgatgcgcgagcgcatgccttcgacctcttcctgccaaagtcccttcaactcgctgtcgccgaggatcgccgcgaccacctcggcgccatgcgccggcggggtcgaccagaggtttcgggcgaggaaggccagttggctacgcaggtcggtgagcttctcggcgttctgcgcgcagacgatcagcgccccgacgcggtcgcggtacaggccgaagttcttcgagcaggaactggtgaccagcacctccggcagttcgccggcgaacaggcgtaccgcccaggcgtcttcctcgagaccgtcgccgaagccctggtaggcgaagtcgatcagcggcagcagctcgcggcgacgcaccacgtcgagcaccctgcgccagtcgtcgtggctcaggtcgaaaccggtcgggttgtggcagcaggcatgcagcagcaccacgtctccctggggaatgcgctccaggccagcaagcatcgcctcgacatccaggcggttgtcggcgctgacgtaggggtagtgggaaaccttcaggccggcggcggcgaacagggtctcgtggatcggccaggtcgggtcgctcagccagatgccgcggccgggcaggcaatgggcgatgaagtcgccggccaggcgcaaggcgccggtgccgccgggcgtctgggtggcgtcggcgcgttgctccagcaacagcggcgaggcggcgccgagcgccagttccgccaggcgcgcggcgaacagcgcatcgccgtggccgccgacgtagctcttggtggtttcctgctcgaccaggcgctgctcggcgagtttcaccgagcgcaggatcggggtcaggccctgggcatccttgtagacaccgacgccgaggtccagcttgtccgcgcgcggatcgttgcggtaggcgtcgagcaggcccaggatcgggtcgcccggtacgcgggcgaccttggcgaaatgactcatttgcgcccctcggcggttttcgctacctcgtcggtgcgcgccgccatgatgaaatcgttgcggtgcaggcccttgatcgagtggctccaccaggtcacggtgactttgccccactcggtcagcaggcccggatggtggccttcggcctcggatatctcgccgacggcattggtgaaggccagggcatgcttgaagttcttgaacaggtag

SEQ ID NO: 12969 - DNA, 327 bp, Pseudomonas aeruginosa
cagaatctgcgccgccttggggtgtcctccgggttgcgtggaaaagagacgcgccataagcgtcagagcctagagggccgtgatggatatcctgttcaatatgcgcgcgttcgtcagcgtcgcggagaccggcagtttcactgccgccgcccagcgcctggacctgacgaccgcctatgtctcccgtgcggtggccaagctggaggcccacctgcagacccgcctgctgcatcgcaccacccggcgcatcgcgctgaccgaagccgggcagcgctacctgatgcgcgcccagcagatactcgcctacatcgaggaggccgaggctga

SEQ ID NO: 12970 - DNA, 1251 bp, Pseudomonas aeruginosa
cctgttccatctcaacgtctacgccctctacccctcgcggcagtacctggatgcgaagatccgcacctgggtcgagttcctccgcgagcacatgccggcgatgctcgccgcggacgagcacagcctggcggagagcggtgggttggcgaactgagcgggagtggtgggcggcgcccttcgcgacgatcgcaccccggcttgtcgggagtcgtagggcggataaccgcctggcggttgtccgccgattctccggagccccgcggacaacgccaggggcgttatccgccctacaggctgtctcccaccctctgcaactcctcgatcaacgcccgcaggcaactcggcagtgcttccaggtcgcgtaccagcaggctgcgctcgcggatcgcccagggctcgtcgagttcgatggtcgccagcttcatcgtccggctgtggcggcgcgcggcggactgcgggatcacgccgatgccgacgccgccctcgatcatccggcagatcgcctcgaagctggagacctggatgcgcagcgatagctgctcgcccatctgctccacccgttcgtacaggaaggcgtgcagggtggtgccctcgggcaggccgatatgctggaactgcagggtgtcgcgtaggcgtaccctggcctgtccggccagcggatggccctggggcaccgccatcaccaggcggtcggtgctgaaatgcaggatctgcaggccggtggccgccaccggcccggcgatgatgccgaggtcggtggagccgtccagcacgccgcggacaatgtcgcggctgaggcgttcctgcaggtcgacggtgaccccgggacgagcggcgaggaagccggcgaggatttccggaaggaattcggtgaccgcggtggtattggcgaagatgcggatatgcccggcggcgtcgctgccgtactcggtgaactcgctcttcaggtattccacctggcgcatgatcagccgcgcgtgctgtagcagacgctggcccgccggggtcagttcgacgccgcggctgtcgcggtacagcaggcggctgccaagctggccttcgagcgccttgacccgcgcgctggcggcggccggggaaaggaaggcgcggcgcgcgccctgggtcaggctgggcgactcggcgatatggatgaacaggcgcaggtcggcgagatcgaaatgcatgggcactccatggcgttcggcaaatccgaacgcgccattgcgtaattgcaaattctcaaaacgctag

SEQ ID NO: 12971 - DNA, 960 bp, Pseudomonas aeruginosa
gtccgctttcgccccctggatcggtcgccaggaagaaacccacgatcaattgagccgcaacctggtcaagcgcatcgccgccaccttcggcgagccgaccccggcccacggcgaagcgctgccgccgctctggcactgggcgttcttccaggacccggtggaggccgccggcctcggcgtcgacggccacccggcgcgcggcggtttcctgccgccggcggacgatcgcaaccgcatgtgggccggcgggcgcctggagttccaccagccgctgcgggtcggcggcgaggccagccgcacctcgaccatcctccgggtcgaggagaagcacggtcgcagcggcgcgctgctgttcgtcaccctgcgccacgactaccgccaggacggccaactggcgctgagcgaagagcacgacatcgtttaccgcgaaccgaccccgcccaagctcggcggtaccgaggccttgcccgagggcgactggcgcgaggcgctggagcccgatccggtgttgctgttccgctactcggcggtgactttcaacggccaccgcattcactacgactggccctatgtcaccgatgccgaaggctatccgggcctggtggtgcacggtccgctgatcgccaccctggccctgcgcgcgttctgccgggccaatccgcaggcgcgcctgcgtcgcttcgcctatcgcggcctgcgcccgctgatctgtcccgagccgttcgaggtcggcggccgcctgctcgctgccggcaaggccgaggtatgggtcggcaatggcgccggcctggcccagcgcggcgacgtggaattcgactgaaagggccccagcgcccatccaacgacaagaatcgaggagtcaccgatgaatccgaacagcgaagagctgaacgcgatccgcgagggtgtacgtgccctctgcgccgaattcgacgccgcctactggcgccgcatcgatga

SEQ ID NO: 12972 - DNA, 882 bp, Pseudomonas aeruginosa
cctgatcggcgaggaaggcaagggcttccgctacatcctcgacggcctcaatgccgagcgcaccctgatcgccgccgaatgcatcggcgacggccgctggttcatcgacaaggccagccactatgcccgcgaccgcgtggtcttcggccggccgatagggcagaaccagggcgtgcagttccccatcgccgaggcgcacatcgaagtggaggccgccgacctgatgcgctggcgcgcctgccaggagtacgacgccgggctcaacgccggggccagcgcgaacatggccaagtacctggcggcgaaagcttcctgggaggcggccaacgcctgcctgcagacccacggcggcttcggcttcgcctgcgagtacgacgtcgagcgcaagttccgcgagacccgcctgtaccaggtggcgccgatctccaccaacctgatcctgtcctacgtggccgagcacctgctcgaactgccgcgctcgttctgaagcgggagccgcccatgcagatcgaccgtctcgaccacctggtgctcaccgtccgcgacatcgacgccagcatcgatttctacacccgcgtgctgggcatgcgcgccgttaccttcggcgcgggtcgcaaggccctcgccttcggtgcgcagaagatcaacctgcaccaggccgggggcgaattcgaacccaaggccgagcgacctacgccagggtccgccgacctctgtttcatcgtcgccacgccactcgaggcggtggccgagcaactgcgccagcaggccgtggaaatcctcgagggcccggtgcagcgcaccggcgccggcgggccgatcctctcgctgtacctgcgcgaccccgacctgaacctgatcgaactgagcaacccgctgtag

SEQ ID NO: 12973 - DNA, 1263 bp, Pseudomonas aeruginosa
tctgatcaaccgaaccagccgcacctcgtcttcgacggacgagggcagggagtccgacccatgacacaatcccaccgaccgcgcccgctcgacggcatcaccgtggtcagcctggagcacgccatcgccgcgccgttctgcacccgccaactggccgatctcggcgcgcgggtgatcaagatcgaacgccccggcgtcggcgatttcgcccgcggttacgacgagcgggtcaacggcctgtcgtcgcacttcgtctggaccaatcgttccaagcagagcctcagcctcgatctcaagcaggccgaggcgctgccgttgctggagaagctgctggccggcgccgacgtgctggtgcagaacctcgcgccgggcgccgccgcgcgcctgggcctgtcctacgaggcgttgcgcgagcgcttcccgcgactgatcgtctgcgatatctccggctacggcgaaggcggtccctacgagaagaagaaggcctacgacctgctgatccagagcgagggcggcttcctttcggtgaccggcggcgccgggccgaacgagatggccaaggccggctgttcgatcgccgatatcgccgccggcatgtacgcctacagcagcatcctttcggccctgctgctgcgcgagcgcaccggcgagggcagccgcatcgacgtgtcgatgctggagagcctggtggagtggatgggctacccgatgtactacgcctaccaggacgcgccgccgccgccgcgcgccggcgcttcgcactcgaccatctacccctatgggccattccccgccggcgacggcggcacggtgatgctcggcctgcagaacgagcgcgagtggcgggccttctgcgacaaggtcctgcgccgcccggaactggccgacgacgaacgcttctcggcgaacttcaagcgctcggccaaccgcgaggagctgcgtgcgctgatcgtcgaagccttcgccgccttgccggccgccgaggtggtggcgcgcctggaacaggcgcagatcgccagcgcccacgtcaacgacatggccggggtctgggcgcacccgcagttacaggcgcggcaacgctggacctccatcgacagcccggccgggcgcctgccggcgttgttgccgccggccagcagcagcgccttcgttccgcgcatggatgcggtgccggcgctgggcggcgacagcgacgcgctgcttgccgaactgggctgtaccgcggccgatatccagcgcctgcgcgcgaccggaacggtatga

SEQ ID NO: 12974 - DNA, 942 bp, Pseudomonas aeruginosa
ggaggcggacatgaaccgacagatcgtgcgcagcgcgctgttcgtcccggcgacccgcccggagcggatccccaaggcccttgccagcggcgccgaccgggtcatcgtcgacctcgaggatgcggtggaggaggggctgaaggtcgaggcgcgggccaatctccggcgtttcctcgtcgatacgccggaagcccgggtgctggtgcggatcaacgcggcggagcatcccgggcatgccgacgacctggcgctgtgccgcgaccacgccggagtgatcggcctgctcctgccgaaagtggagagcgccgcccaggtgcgccacgccgccgtggccagcggcaagccggtctggcccatcgtcgagagtgcccgcggccttgccgcgctgggcgagatcgccgccgccgcgggggtcgagcggctgtccttcggcagcctcgacctggccctggacctcgatctcaacagcggcagcaacgcagccgaacagattctcggtcacgcccgttacgcactgctcctgcaaacgcgcctggcaggcctggcgccgccgctggacggcgtctatccggcgatccagaaccgtgccggactggtcgaggcagtgcgcttcgctcgcgacatgggcttcggcgggttgctgtgcatccatccgagccaggtcgagccgatccaccagacattgatgccgagtcccgcggaactggagtgggcgcgtcgggtggcagaggccggcgcctccggtgccggcgtcttcgtggtcgacggcgagatggtcgacgcgccggtgctggggcgcgcgcgacgcctgctggagcgggccggggagggtggctgaacgcgttcgacagacgcgaacgcgggcttgagcaatggcgaattctccgaacgcgccggctgcgtcaggctcgtcgatacctcgaaagcacaacaacaatctga

SEQ ID NO: 12975 - DNA, 1005 bp, Pseudomonas aeruginosa
ggtcacgaaatgttcaagacgatggtacgggcgctgttgtgcgccctggcgatcggtggctcctgcctggcgaatgccgcgcagccgatcgtcatcaagttctcccacgtggtcgcggaaaacacgcccaaaggccagggcgcgctgctgttcaagaaactcgtcgaacagcgcctgggcggccgggtcgaggtagacgtctatcccaactcgtcgctgttcggcgacggcaaggaaatggaggcgctgctgctgggcgacgtgcagatgctggcgccgtccctggccaagttcgagcagtacacgcgcaaggtgcagatcttcgacctgccgttcctcttcgacgacatccaggcggtcgaccgcttccagcgcagcccgcaggggcgcgccttgctgaccagcatgcagggcaagggcatcctcggcctggcctactggcacaacgggatgaagcagctctccgccaatcgcccgttgctggagccggaagacgcgcgcgggctgaaattccgcgtgcaggcgtccgacgtgctcaacgagcagttccgccagctccgcgcgatctcccggaagatgtccttcgccgaggtctaccagggcttgcagaccggcgtggtgaatggcaccgagaacacctggtcgaactacgagagccagaaggtcaacgaggtacagaagtatttcaccgagtccaaccacggcttggtggactacatggtgatcaccaacgcgaagttctggaatggccttccggcggacatccgcgaagaactgcagcggatcatggacgaggtcaccgtgcaggtgaacctcgaggccgagcgcctcaaccgcgacgcccgccagcgcatcctcgccagtggcgccagcgagatccataccctgagcccgcagcagcgcgccgactggcgccaggcgatgcagccggtatggcagaaattccgcggcaatgtcggtgccgatctgctccaggccgccgaagcttccaaccgtcccgattga

SEQ ID NO: 12976 - DNA, 687 bp, Pseudomonas aeruginosa
cccgtccggccccgcccggccgggcggggcatcgtggagaacgctgcgatgaatcgactcgtgcgcgtctggaaccgcttcgaggagggcgctatcgccttcctgctggcggcgatgacgctggtgaccttcctctatgtggtgatgaccaacgtcttcaccctgttctacgacctcggcgaccgcctgccgacactgcgggctccgctgtactcgatgggcgacgcgatcctcggggtagcccaggatatgtcctggagcaacgcgctgaccaaggcgctgttcggctggctgatcttcctcggcatcgcctacggcgtacgcaccgccggccacctcggggtggatgccctggtgcgcctggcgccgcgtcccttgcagcgcctgatcgggatactcgcctgcctctgctgcctgggctacgccgggctgttcatggtcgccagctacgactgggtgaagaccctgttcgtcgccggcatcggcgccgaggacctcgaccacttcggcatcctccaggcctacatcgcggtggtggtgccggtcggcttcggcctggtgctgctgcgctacctggaaatcctcgtcaacctgttgcgcggtcgccagctcgggctgggcctcgccgacgaggccgccgaggcctccaaactggccggcgaagaggccggggagaaccgtccatga

SEQ ID NO: 12977 - DNA, 2040 bp, Pseudomonas aeruginosa
gaccatggtcgtatggttcgtggggtgtgcgctcgctacaactgggcacaacagaaacaacactcacgtaccgaggttaaagccatgtctgcggcatccctgtaccccgtgcacccggaagcggtggcacggaccttcaccgacgaagccacctacaagacgatgtaccagcagtccgtcgtcaaccccgacggcttctggcgcgagcaggcccagcggatcgactggatcaagccgttcgagaaggtcaagcagacctccttcgacgaccatcacgtggacatcaagtggttcgccgacggcaccctcaacgtgtcgcacaactgcctcgaccgtcacctcgccgaccgcggcgaccaggtggcgatcatctgggaaggcgacgatcccgccgaccaccaggaaatcacctaccgccagctccacgagcaggtctgcaggttcgccaacgccctgcgcgggcaggacgtgcaccgcggcgacgtagtgaccatctacatgccgatgatccccgaggccgtggtcgccatgctcgcctgcacccgcatcggcgcgatccactcggtggtcttcggcggcttctcccccgaggccctggcaggacgcatcatcgattgcaagtcgaaggtggtgatcaccgccgacgaaggcgtgcgcggcggcaagcgcactccgctgaaggccaatgtcgacgacgccctgaccaacccggaaacctccagcgtgcagaagatcatcgtctgcaagcgtaccggtgcggagatcaagtggaaccagcaccgcgacgtctggtacgacgacctgatgaaggttgccggcagcacttgcgcacccaaggaaatgggcgccgaggacccgctgttcatcctctacacctccggctccaccggcaagccgaagggcgtgctgcataccaccggcggctacctggtgtacgcctcgctgacccacgagcgggtcttcgactaccgtccgggcgaagtctactggtgcaccgccgacatcggctgggtcaccggccacacctacatcgtctatggcccgctggccaacggcgccaccaccattctgttcgagggcgtgccgaactaccccgacgtgacccgcgtggcgaaaatcatcgacaagcacaaggtcaacatcctctacaccgcgccgaccgcgatccgcgcgatgatggccgaaggcaaggcggcggtggccggtgccgacggttccagcctgcgtctgctcggttcggtgggcgagccgatcaacccggaagcctggcagtggtactacgagaccgtcggccagtcgcgctgcccgatcgtcgacacctggtggcagaccgagaccggcgcctgcctgatgaccccgctgccgggcgcccacgcgatgaagccgggctccgcggccaagccgttcttcggcgtggtaccggcactggtggacaacctcggcaacctgatcgagggcgccgccgagggcaacctggtgatcctcgactcctggccgggccaggcgcggaccctgttcggcgaccatgaccgcttcgtcgacacctacttcaagaccttcaagggcatgtacttcaccggcgacggcgcgcgccgcgacgaggacggctactactggatcaccgggcgggtcgacgacgtgctcaacgtctccggccaccgcatgggcaccgccgaggtggaaagcgcgatggtcgcccacccgaaggtcgccgaggcggcggtggtcggcatgcagcacgacatcaaggggcagggcatctatgtctacgtcaccctcaactccggggtcgagccgagcgaggcgctgcgccaggagctgaagcaatgggttcgccgcgagatcggtccgatcgccacgccggatgtgatccagtgggcgccgggactgccgaagacccgttcgggcaagatcatgcggcgcatcctgcgcaagatcgccgcggccgagtacgacaccctcggcgacatctccacccttgccgacccgggcgtggtccagcacctgatcgagacccatcgctcgatgcaggccgcctga

SEQ ID NO: 12978 - DNA, 921 bp, Pseudomonas aeruginosa
aatgccgctcaccccagctggcgccctgtccacgagaaggcgccatgcgcaagagccggtgatcacgcatatccgtcggcagcctgggcaaggttctatttctcctgccaatcgatgccatccccttcgaaggagttccagatgaagaagctcgcacttctcggcgccctggcgctgtccgtgctctccctgcccactttcgccgccgacaagccggtgcgcatcggcatcgaggcggcctacccgccgttctcgctgaagaccccggacggccagttggcaggcttcgacgtggatatcggcaatgccctctgcgaagagatgaaggtgcagtgcaagtgggtcgagcaggagttcgacggcctgatcccggcactcaaggtgcgcaagatcgatgcgatcctctcgtcgatgaccatcaccgacgagcgcaagcgttcggtcgacttcaccaacaagtactacaacaccccggcgcgcttcgtgatgaaggaaggcgccagcctcaacgatcccaaggccgacctgaagggcaagaaggccggcgtgctgcgtggcagtaccgccgaccgctacgcctccgccgaactgaccccggccggcgtcgaagtggtgcgctacaactcccagcaggaagccaacatggacctggtggccggtcgcctcgacgcggtggtcgccgactcggtgaacctcgaggacggcttcctcaagaccgatgccggcaagggctacgccttcgtcggtccgcaactgaccgatgccaagtacttcggcgaaggcgtcggcatcgccgtgcgcaagggcgatagcgagctggccggcaagttcaacgcggccatcgacgcgctgcgcgccaacggcaagtacaagcagatccaggacaagtacttcagcttcgacgtctacggttcgaactga

SEQ ID NO: 12979 - DNA, 336 bp, Pseudomonas aeruginosa
ccttcatcctggtgcgcctgttcaagcttgccgagcgccgctggctggcctacctggcgccgcgcaaatcctgatccggaggaccgcatggagcgtatcgaccacctgctgccgtggagcaccctgggaagcgagaagcgcctgagcgtgttccgccttcggctgcggcgcgcgcaaggtctacatccagtccagcctgcacgccgacgagctgccgggcatgcgcaccgcctgggagctgaagcagccggttgcgcctgctggaggcggaaggccgcctgcgcggcaccgtccagctggtgccggtgggcaatccggtcggtctcgggcagatga

SEQ ID NO: 12980 - DNA, 834 bp, Pseudomonas aeruginosa
gcagcggggcgcaacttcaatcgcgatttccccgacctgctggacgcggtgatcgacagcgtcggcgagcgtctcggcagcgatccggcggccaatgtcgcgctggtccgccaggccctgcgcgcggcgctggacgccctgccgccggcgacctcggaactggagggcatgcagcgcgtgctctatcgccacgcctgcgacgccgacctggtgctcgacctgcattgcgacttcgaggccgccatccatctctataccctgccgcaacaatggcccaccttcgcctccctggccgcacgcctgggcgccgctgtcgggctgctcgccgaggagtccggcggcggttccttcgacgaggcctgctcggtgccgtggctgcgcctgtcgcgcctgtatccgcgcgccgagctgccgctggcctgcctggcgaccaccgtcgaactcggcggccaggccgacaccaccgtgcagcaggccgaggccaacgccgcggcgatcctggccttcctcgccgagcagggcttcgtcgagggcgaatggccggcggcgcccgaagcctgctgcgaaggcttgcccttcgagggcaccgaatacgtccacgccccgcataccggcgtggtgagtttcctgcgccggccgggcgaatgggtggaggcgggcgaaccgctgttccaggtcatcgatcccctggccgaccgtgccagcaccgtgtgcgccggggtttccggcgtgcttttcgccatcgaacggatgcgctacgcgcagccgggactctggctggccaaggtggccggtcgtcaaccgatccgtcagggacgcttgctcagcgactga

SEQ ID NO: 12981 - DNA, 783 bp, Pseudomonas aeruginosa
ttagccgagaacacacacatgtacaaactggaagtccaagacctgcacaagcgctacggtagccacgaggtgctcaagggcgtctcgctggcggcgaaagcgggcgacgtgatcagcatcatcggctcgagcggttccggcaagagcacctttctgcgctgcataaacctgctggaacagccgcacgccggcaagatcctgctcaacggcgaggagctgaagctggtgcctggccgcgacggcgcgctgaaggccgccgactcccgccagttgcagcgcatgcgctcgcgcctgtcgatggtgttccagcatttcaacctgtggtcgcacatgagtgccctggagaacgtcatcgaggcgcccgtgcatgtgctcggcgtgtcgaagaaggaagccatcgagaaggccgagcactacctggccaaggtcggcgtggcgcaccgcaaggacgcctacccggcgcacatgagcggcggcgagcagcagcgcgtggcgatcgcccgggcgctggcggtggagccggaagtgatgctgttcgacgagccgacctcggcgctcgaccccgaactggtgggcgaagtgctgaaggtcatgcaggacctggcgcaggaaggccgcaccatggtggtggtgacccacgagatgggtttcgcccgcgaggtgtcgaaccagttggtgttcctgcacaagggcctggtcgaggaacacggctgcccgaaggaagtcctcgccaacccgcagtcggaccgcctcaagcagttcctctccggcagcctcaagtaa

SEQ ID NO: 12982 - DNA, 1050 bp, Pseudomonas aeruginosa
cggtctgaaggagccagtcatgatcgtacgtcctgttaccagcgccgacctgccggccctgatcgagctggcgcgcagcaccggcaccggcctgaccaccctgccggccaacgagcagcgcctgcagcatcgcgtcagctgggccgagaaggccttccgcggcgaggccgaacgcggcgacgccgactacctgttcgtcctcgaggacgacgccggcaaggtcgtcggcatctccgccatcgccggagcggtggggcttcgcgaaccctggtacaactaccgggtcggcctcaccgtgagcgcctcgcaggaactcaacatccatcgcgagatccccacgctgttcctggccaacgacctgaccggcaattccgagctgtgctcgctgttcctccacgccgaccaccgcagcggcctcaacggcaagctgctgtcgcgcgcgcgcttcctgttcatcgccgaattccgtcacctgttcggcgacaagctgatcgccgagatgcgcggcatgtccgacgaggaggggcgttcgccattctgggaaagcctcggccggcacttcttcaagatggaattctcccaggccgactacctcaccggggtcggcaacaaggccttcatcgccgagctgatgccgaagttcccgctctatacctgcttcctctccgaggaggcgcgcggggtgatcggccgcgtccatccgaacaccgagccggcgctggccatgctcaaggccgagggcttcagctaccagggctacgtcgacatcttcgacgccggcccggcgatcgaggccgagaccgacaagatccgcgccatcgccgagagccagaacctggtgctggcggtgggcactcccggcgacgacgccgagccctacctgatccacaaccgcaagcgcgaagactgtcgcatcaccgccgcgccggcgcgggccgccgccggcaccctggtggtcgatccgctgactgccaagcgcctgcgcctgtcggccggcgcctcggtacgcgcggtgccgctgtcggcgcagaagcgcggttgaaagcctga

SEQ ID NO: 12983 - DNA, 696 bp, Pseudomonas aeruginosa
ctgcgtggtgttcaagcccagcgagctgaccccgaaggtcgccgagctgacgctcaaggcctggatccaggccggcctgccggccggcgtgctcaacctggtccagggcggtcgcgaaaccggcgtcgcgctggccgcccaccgtgggctcgacggtctgttcttcaccgggtccagtcgcaccggcaacctgctgcacagccagtttggcggccagccgcagaaaatcctggcgctggagatgggcggcaacaacccgctggtggtggaggaggtcgccgacctcgacgccgccgtctacaccatcatccagtccgccttcatctccgcaggccagcgttgcacctgcgcccgccgcctgctggtgccgcagggcgcctggggcgacgcactgctggcgcgcctggtggcggtcagcgctaccctgcgggtcggtcgcttcgacgaacagccggcgccgttcatgggcgcggtgatttcgctgagcgccgccgagcacctgctcaaggcccaggagcatttgatcggcaagggcgcacagccgctgctggcgatgacccagccgatcgacggcgccgccctgctgaccccgggcatcctcgacgtcagcgcggtggccgagcgaccggacgaagagttcttcgggccgctgttgcaagtgatccgctactccgatttcgctgcggcgatccgtga

SEQ ID NO: 12984 - DNA, 1620 bp, Pseudomonas aeruginosa
agccaacgccacccagtacggcctggccgccgggttgctgtcggattcccgcgagcgtttcgagcagttcctcgtggaaagccgcgccggcatcgtcaactggaacaagcagctcaccggcgccgccagcagcgcgccgttcggcggtatcggcgcgtccggcaaccaccggccgagcgcctactacgccgccgattactgcgcctatccggtcgcctcgctggaaagccccagcgtgtcccttcctgccaccctgactcccgggatcagcctatgaatgcccatgaagtgaatttcgacggcctggtcggcccgacccacaactacggcggcctgtcctacggcaatgtcgcttcgcaaagcaacagccaggcggtgtccaacccgaaggaagcggcgaagcagggcctggcgaagatgaaggcgctgatggagatgggtttcaagcagggggtactcgctccgcaagcccgcccggataccgctgcgctgcgtagcctgggcttctccggcagcgacgaggaggtgatccgccgcgcggcgaaggaagcgatgcctctcctcgccgcctgcagctcggcttcgagcatgtggaccgccaatgccgccacggtcagcccgagtgccgacaccgccgatggccgcgtgcatttcaccgcggccaacctgaactgcaagttccaccgatccatcgagcatcccaccaccagccgcgtgctggcggcgatgttcaacgacgagcggcatttcgcccatcacgcggcgctgccggcagtgagccagttcggcgacgaaggcgcggccaaccacacgcgcttctgcaaggactatggcgatgccggcgtggagttcttcgtcttcggtcgcagcgccttcgacagtcgcttcccggcgccgcaacgctatccggcgcgccagaccctggaagcctgccaggccgtcgcgcgtctgcacgggctgagcgaggccggagtggtctacgctcaacagaacccggcggtgatcgaccagggcgtgttccacaacgatgtgatctcggtgggcaatggcgaggtgctgttccatcacgaggacgccttcctcgataccgagaaggtccttgccgaactgcacgacaagctgggccgccgcggcggccgcttccgcgccatctgcgtgccgcgcgaccaggtcgcggtggaggacgcggtgaagtcctacctgttcaacagccaactgctgtcgaaggccgacggttcgatgctgctggtggtaccggaggagtgtcggaacaacccgcgggtctggaactacctggaccagctcaccggcgacgacggtccgatccgcgaagtgaaggtcttcgacctcaagcagagcatgcagaacggcggcggtccggcttgcctgcgcttgcgcgtggcgctgcaggaacgggagctggcggcggtgaatccgggggtgatcatgagcgccggcctgtacgacacgctggtagcctgggtcgaccggcactaccgcgaccgcctgagcgagaccgacctggccgacccccaactgctgctggagtgccggacggcattggatgaactgacgcagatccttaaactgggctcggtttattccttccaactcgattga

SEQ ID NO: 12985 - DNA, 1278 bp, Pseudomonas aeruginosa
tgcggccctttgccggcgattcgtggccgccaattttccgtggaagaacctatgaaaagcgctgaaatccgtgaagccttcctccgcttcttcgaagagaagggacacacccgtgtcgcttccagttcgctgatcccggcgaacgatccgaccctgctgttcaccaacgcgggcatgaaccagttcaaggactgcttcctcggcctggaaaagcgcgcctacacccgtgcgaccaccagccagaaatgcgtgcgcgccggcggcaagcacaacgacctggaaaacgtcggctacaccgcgcggcaccacaccttcttcgaaatgctgggtaacttcagcttcggcgactatttcaagcgcgacgccatccattacgcctgggagttcctcaccggcgagaaatggctgaacctgcccaaggaaaagctctgggtcaccgtctacgccaccgacgacgaggcctacgacatctggaccaaggaagtcggcgtgcccgccgagcgtatggtgcggatcggcgacaacaagggcgcgccctatgcgtccgacaacttctgggcgatgggcgataccggaccttgcggtccctgcaccgagatcttcttcgaccatgggccggagatctggggcggcccgcccggttcgccggaagaggacggcgaccgctacatcgagatctggaacaacgtgttcatgcagttcaaccgcaccgcggacggcgtcatgcacccgctgccggcgccgagcgtggacaccggcatgggcctggagcgcgtcagcgcggtactccagcacgtgcactcgaactatgagatcgacctgttccagaacctgttgaaagcctccgccgaggccatcggctgcgccaacgacgacgcgccgtcgctgaaggtggtagccgaccacatccgttcctgcagcttcctgatcgccgacggcgtactgccgtccaacgagggtcgcggctacgtcttgcggcggatcatccgccgcgcctgccgccacggcaacaagctgggcgccaggggcaccttcttccacaagatcgtcgcagcgctggtcgccgagatgggcgatgccttccccgagctgaagcaacagcaggcacacatcgagcgcgtgctgaagaccgaggaagaacagttcgccaagaccctggagcaaggccctgaagatcctcgaacaggacctcgccgaactgcagggcagcgtgattcccggcaacgtggtgttcaagctgtacgacacctatggcttcccggtcgacctgaccaatga

SEQ ID NO: 12986 - DNA, 771 bp, Pseudomonas aeruginosa
gggcgccatggcgctgttcggcgagaagtacggcgaccaggtgcgcgtactgagcatgggcggcgatttctccgtcgagctgtgcggtggcacccacgtatcccgcaccggcgacatcggcctgttcaagatcaccagcgagggtggcgtggctgccggcgtacgccgtatcgaggcggtcaccggcgcggcggcgctggcctacctgaacggtgccgaggagcagctcaaggaagccgccagcctggtcaagggcagccgcgacaacctgctggacaagctcggcgccctgctggagcgcaaccgctcgctggagaaggagctggaacagctcaaggccaaggctgccagcgcggccggcgacgacctttcggcggcggcggtggaaatcaagggcgcgaaggtactcgccgcgcgcctcgatggtctggacggcaaggcgctgctggcgctggtcgaccagttgaagaacaagctcggccgcgcagtgatcctgctcggcggcgagctggacgggaaggtcgtactggtcgcaggcgtgacccaggacctgaccggccaactgaaggccggcgagcttatgaagcaagccgcggcggcagttggtggcaaaggtggcggacgcccggatatggcccagggcggcggcaccgatgcagcgaaattggacgaggccctggccctggcccagcgcttcgtcgagcaagggctctgatgccatgccggccccgcgccagagcgatgcggggccgggcggccagcgccccttga

SEQ ID NO: 12987 - DNA, 714 bp, Pseudomonas aeruginosa
tggccgggttgtatcgtgccgagcacctctcgccgtggatgctcggggtactgctggtgctgctggtcctgctgttgcaggcgcgcggcaacctggcgcgggtcctgcgcctgcattgaacgaacgtacttcgctccggcctggccggcggttgtatccgccgcgtcggtgcctgtccgtcatccatccatcctgaaaaaggagttcgccatgtccagtgcaaccgtgcgcctggatcacgccgccctgcgcgaaacgttgcggcagttgttcggcctgcccgccggcagcgtcatcgatgccgatcaactgctggccccgccggccatccccttcatgaccttgcgcctggagtcctcgagcctgcttggcaaggtgcggcgggagttttccgccagtggtgagcaggagtccctgctggccagttgcgagagcatctttcgcctgacctggcatggtcccgaggcgcaccagtacctgcaggatgcccgctgcctgctgcagtcaggcaatgccggcgagcgcctgcgcgtgctgaaggccagcctgctgcgcctgacacccatcgaaaacctgtccgtcgtgcaggatggccaggcgctggggcaggctcgtttcgaccttgttctcgctcacgaacacgtgctgctcgtcgacctcgagcgcaccgctcccgggcaggcctccgggggggcgggtggaacggcttcctag

SEQ ID NO: 12988 - DNA, 678 bp, Pseudomonas aeruginosa
gcatcgtgctctccggaacggttggcgatgaaaaagccccgcggggcggggctcttcaggggggctcagaccagctcggcccagaggtcgtactcgtcggcatcggtgatgcgcacgcggaccttgtcgcccggcttcagctcgtcgctgtcgacgaacacgttgccgtcgatttccggagcgtcggcccaggagcggccgaccgcgccctgttcgtcgacttcgtcgatcagcacttcgatttccttgcccaccttgagctgcaggcgagcggcggaaatcgcctgctggtgggccatgaagcgttcccagcggtcctgcttgacctcgtccggcaccggctccaggcccagctcgttggccggagcgccttcgacgggggagtactggaagcagccgacgcggtcgagctgggcttccgtcagccagtcgagcaggtactggaagtcttcttcggtttcgcccgggaagccgacgatgaaggtcgagcggatggtcagttccgggcagatctcgcgccactgcttgatccgggccagggtcttgtcctcgaaggccgggcgcttcatggccttgagcaccttcgggctggcgtgctggaaggggatgtcgaggtacggcaggagcttgccggcggccatcagcgggatcacgtcgtcgacgttggggtacgggtag

SEQ ID NO: 12989 - DNA, 1422 bp, Pseudomonas aeruginosa
tcgcgatcaggcgtcgggagcgttctcgcggtcgcggatggcctggagcatcttcttcgccagggacaggtagtcctcgtcgaagtggtggccgcccggcagttcgagcttctcgccgacggcctgggattgggtacagccgctttcgtccttttcttcggcgccatagatgcagaacaccttggctgccggcaacctggccatttccgggccggtggcggcttcctcgccggccttgcccagccagccttccacttcgatctcgaagctgccggtccgcgccagcgccagcagcagcatggctttcacttgctgctggtcctttccgggcaggcggttgtagatcgccggcaggatgtcagcgccgaacgagtagccggccaggacgaaacgtttcgcgccccacttctcgcggtagtgttgcatcagcttggagaggtcggcggcgctctgttccgggctcttgtgttgccagtagtagcgcagggtgtcgatgccgaccaccgggtagcccatgctggccatatgctcggcagagtccttgtccaggtcgcgccagccgccgtcgccggaatagaacagggtgacgatgtccgagggttgcgccgcggggacctcgagtaccggcagggcctcggcgttgccttgcagttgcaggcgcaactgatgggcgagcacgtcggacagcggggtgtcgtagtcgctgatgctggtttccgcgctcgactgcttgcggacgaagactgcggtgtcgtcgtccgggttgtcgttccaggccagcagccactggccgtgcgacgcctggtgcggcagcggggcgtcgcagtcgcgctcggccagggcaatgtcgaagccgaccgagagcgccttggccttgtcgtcgtcctggctggcgagccagcgccaggcggtggtcgagcccgggccgatgccggcgaccaggttcggcttgccgccgaggcgggcaatgaccgcttcgagccgggactgctgcgccctgcaatcgccgttttccggagggaagtactggatcacccgggcggcgctgtcgtgagccaggttcagcatctgggcgtcgttcagttgctgttcgggggcggcgatcaccaccacccgcgagcgcggcttctcgccgggttcggcaagggtggcgtggccgccgtcgtcgaggtccagggcttccagtttcgcctgggccgccggtcggctccagagcagcagggcggcaccgacgatcagcaccagggcggcgaccagaaaacggcgccagtgacgtttcacgacagacatatcagcgtttcaccaatccagtcaggccgccggcgatcagcgcggcggtatcggccagggccaccagcgggtcgagcccggctggcacggccaggtagcggggttcccagtcgggctggaacttgtccttga

SEQ ID NO: 12990 - DNA, 693 bp, Pseudomonas aeruginosa
tccgatcgatcagccggatgcgttgtggggacgcgggagagctgggtggagcgggatgttctggaacgggagcgtcggtgcgcatcagccacctcatgggaatttgcgcgacagagtatggcctctcgggcgagttcccaagtggtcgcagcagattttttctgtgcggggcggcgtcctgtcacagggagaagaccgccgggttttgcaggagttgcgtcggcgaagtggccgaaggccatttgctggtattcgttcagcgatggttcagcttgccgtgggcatagtggcggcttgcactgtccgaccatttccgaggggggaagggtgacgatgatccaggcgggcattcatgtcggcgccggagtcgtgctgggcgtggccgctggatggtggctgggggattgggaacagtcgttgcaggtcaaggactcggtggcgcgggtcgattgcctgttgtacggcgccctgctggtggtattgctccgccacgacggttggttgcgccgcctgggcctgctgggcctggggctgttctgcggttccctgctggtctattcggtgaatccggcaagcctgttcgctgcgaaagagtcctggagccttgcgcggatctccatgcgggccttcggtccgctggtgatgctggtcgtggggatggcctgcgcgcgcctggcacacgagttgcgctga

SEQ ID NO: 12991 - DNA, 594 bp, Pseudomonas aeruginosa
ccgaccacatcgagcggccggtggaagccggcgcgctggaacagcgcctcgatctcggcgaagcaggtgttgaagtgcacgcgggtgaacggcgtcttgccgtcggtgaccaggccgtccatctgcagttcgtccactgcctggcggatgtcgtcgagttccatccggttcacgctgcgcttcaattgttcgacgttcagcatctgtctgtcctttccgtatccgttaccgagcattcatcgaaggctgagcttgctgtacgaatatacagttaaatgtgcgatgatgcgagcgaacggagggcgaggcgatgcagtggaacaggaggggcggaatgcaaaaagccccggcgctatcgctagtgccggggcttttcgaatgtggttgcgggagctggatttgaaccaacgaccttcgggttatgagcccgacgagctaccagactgctccatcccgcgtctgtgtgggcgcattctacggactctcgtcgggctgtcaatcgatttttcgaaaaaagtgttttttcttcaaatgcttagcgcttgcccaatgttagaattcagcgctccggggcaggcccggcggggcttgtag

SEQ ID NO: 12992 - DNA, 411 bp, Pseudomonas aeruginosa
gcagggtttcgctggtctggcaggccgcgcgcaactgcggcacgccacagtagcgggtggcgccatgcagccggtggaccctctcgagcaaagcggtgcggtcgtcgttgtcgcgggcctggcgaatcgcctggcggtccgccgccagcgaggccagcagcatcgccagcatgtcggcggcgaggtcggccttgccggcggccaggcgcagcccttcctcggggtcgagcacgctcaactggccgagctgcggcgcacggctcatgctggccagcgactggcccaggctcagtccggtccacttcagcactacctgggccaattgctgctcgtcgatcggcttggtcaggtagtcgtccatgccggcctgcagcaatgcgcgcttctcgttggaaagcgcatgtgcggtga

SEQ ID NO: 12993 - DNA, 909 bp, Pseudomonas aeruginosa
acacacgtctctccgtcgagccagatcgggatggccgacgctccccggccatacgtttaccccgcgcagtttagcgggtcgcggaaggggaatctgcaccgatgtgcgcagcccggcggattcggcttgcgacgaagcggaaagatcgtgaatactggcacgattgctaatcaatcttatttggctgccatgttcccatccctgacgcccgacccccgactgctggccatcgaggacgatccgacactgggcgcacatctgttccagcacctcaatggcagcggtttcgaggtgacctggtgccgagacggggaagaggggttggcggctgcgcgcagcggcggctatgacctgatcctgatggacatcatgctgcccgggcgcgatggcctcgagattcttcgccaactccgccaggagcaggcgctgccggtgatcctgatgtcagccctgggcgccgagcaggaccgcatcgccgggttcagccagggcgccgacgattatctgccgaagcctttcagcctggccgagctgcgggtacgcatcgatgccatcctgcgtcggatcgccctggagcgggggggcgcgccgggccgctgcgccgaaccgctggcgcggccctcgctgcaattctctgccgatgtctgcgatgtcagccttggcgagcggttcgccggcctgacgccgaccgaataccgcctgctggaaaccttcctcgccgcggaaggcgagaccctgaccaaggccttcctttaccagcatgtcctgcaccgcggtcatacccagcatgatcgcagcctggacatgcacgtcagtcacctgcggcgcaagctgcaacgcctcggttacgccggtcaccagttgcataccgtctggggcaagggttacgtcctgacaccggcgccatga

SEQ ID NO: 12994 - DNA, 2235 bp, Pseudomonas aeruginosa
tcacgcatgtacccccaattccgtcgcggccatctcgccgctgccgtccttttcgcttcatcgagcctgctggacgggcaggccctggccgaggacgagcgcctggaagaactggacgaacgcgccgaatcggtggtccagctgggtgacgaggtggtgctgggcaccgccgaacaggagctcaagcaggcaccgggggtatccatcatcaccgccgaggacatcaggaagcgcccgccggtgaacgatctctccgagatcatccgcaccatgcccggggtcaacctcaccggcaacagttccagcggccagcgcggcaacaaccggcagatcgacatccgcggcatggggccggagaacaccctgatcctggtcgacggcaagccggtcagctcgcgcaactcggtgcgctacggctggcgcggcgaacgcgacacccgcggcgacagcaactgggtgccgccggaggaggtcgagcgcatcgaggtcctccgtgggcccgcggcggcacgctacggttccggcgcggcgggcggggtagtcaacatcatcaccaagcgcccgaccgatcgtttgcgtggttccatgacggtgttcaccaacattccggaaagctccaaggatggcgccacgcgccgcgccaacttcagcctcagcgggccgctgaccgaagccttgagcttccgcgcgtacggcagcgcgaacaagaccgattcggacgataccgacatcaacctcggacataccgtcaacccgagccgtaccgtggccggacgcgaaggggtacgcaatcgcgatctcagcgggatgctgtcgtggcaggtgacccccgaccaggtcgtcgatttcgaagcgggcttcagccgacagggcaacatctatgccggcgatacccagaacaacaacggcaccgccaatacccagggactcgccgacgagggtgcggagaccaaccgcatgtatcgcgagaactacgccatcacccacaacgggacctggtcgttcggcacttccaggttcgtcgcccagtacgactccacccgcaacaaccgtctggaggaggggctggccggttccgtcgaggggcagatcggcgccgaccgttcgttcagcaccagcaagctggagaactatcgcctcagcggcgaactcaaccttccgttgcatgcgttgttcgagcaggtgctgacggtgggcgcggagtggaacaaggaaaccctcaacgacccgtcctcgctcaagcagggcttcgtgggaagcgatagcttgccggggacccccgcggccggctcgcgaagcccgaaaagcaaggcggagatccgtgcgctgtacgtggaggacaatatcgaactgcgccccggcaccatgctcacccccgggctgcgcctggacgatcacagcgacttcggcctgaactggagcccgagcctgaacgcttcccagacgctcggcgaatacttcacggtcaaggccggtatcgcacgggccttcaaggcgcccaacctgtaccagagcaacccgaactacctgctctatacccgtggcaacggctgcccgatccagaccagcagcggcggctgctacctggtcggcaacgagaacctggacgccgagaccagcgtaaacaaggaactgggcatcgagttccggcgcgatggctgggtcgccgggctcacctacttccgcaacgactacaagaacaagatcgtcgcgccgctggacgtcatggggcagaccgggaccggtaacaacatcctgcaatggagcaacgcgaagaaagcagtggtcgagggcctggaaggcaacctgctggtccccctgcacgaggacctgagctggagcaccaacctgacctatatgctgcaatccaaggacaaggacaccggcaacccgctttcggtgatccccgagtacaccctgaactcgaccctggactggcaggccagcgagcgtctttccacccaactgaccagcaccatctacggccgccaggagccgccgaagcatggcaccagccgcaacacgccggtggtctcgcgaaaagaggtgggtacctatggcatctggggcgtcagcgccggctacaccttcagcgagaacctgagcgtacggggcggggtaagcaacctcttcgacaagcgcctgtaccgccagggcaactccttcgacgccggcgcggcaacctacaacgagccgggtcgcgcctactacgtttcgatgaccacctcgttctga

SEQ ID NO: 12995 - DNA, 1149 bp, Pseudomonas aeruginosa
tcgccgcggccaacgtgctttcaccggcaggcgcaacgcctgtcggacctttctttggcgttggtcaggcatcggctgtccaacgccaggttttctcttcggacgcctctggtcatcgcatcgcatgccgtttcgggcggtctttcggctgaatcggcatgcatgaccggatattgcggtgctagggtccggccccagtttcccggtatcatgctcagcctttaccgtcagtgccgaacgagtgcctccatgaccgtgcagtacccgactatcgccgactgcgttggcaatacccctctggtgcgtctgcagcgccttcccggggaaacctccaataccctgctggtgaagctcgaaggcaacaacccggcgggatcggtgaaggaccgcccggccctgtcgatgatcacccgtgccgaactgcgcggcgacatccgccccggcgatacgctgatcgaggctacttccggcaacaccggcatcgccctggccatggcggcggcgatcaagggttacaagatgatcctgatcatgccggacaactccacggccgaacgcaaggcggcgatgaccgcctatggcgccgagctcattctggtcagcaaggaagagggcatggagggcgcgcgcgatctggccgacaagctgcagcgcgaaggccgcggcaaggtcctcgaccagttcgccaatggcgacaacccggaagcccattaccacagcaccggcccggaaatctggcagcagaccggcggcagcatcacccatttcgtcagctccatgggcaccaccgggaccatcatgggcgtctcgcgctacctcaaggagcagaacccggcggtgcagatcgtcggcctgcaacccatggagggctcggccatcccgggaatccgacgctggccgcaggaatacctgccgaagatctatgacgccagtcgcgtcgaccgggtcgtcgacatgcaccaggacgaagccgaggacatcatgcgccggctggcccgcgaggaaggcatcttctgcggcgtgtcctccggtggggcggtggcggcgatgctgcgcctgtcccgcgaactggagaatgccgtgctggtggcgatcatctgcgaccgcggcgaccgctacctgtcttccggcgtctatgacccgcgctga

SEQ ID NO: 12996 - DNA, 543 bp, Pseudomonas aeruginosa
cgaatgagcatgtcattgcgtgaccagttgctgaaagccgggctggtcaatgagaaacaggccaagcaggccaccaagcagaaacagaaacagcagcgtctggagcacaagaaccaggtcgacaaggacgactcccagcgccaggcggcggagcaggccaaggcggaaaagctggcgcgcgaccaggaattgaaccgccagcagcaggaaaaagccgagaagaaggccaaggccgcgcagatcaagcaacttatcgaagggacgcgcctgcccaagctggaaagcgacgactactacaatttcgtcgacgccaagaaggtcaagcggatcgcggtcaacgacctgatccgcgacaagctgagccgaggcagcctggctatcgtcagctatgacggacgctacgagatcgtgccccgggatgcggcggtgaagatccaggagcgcgatccgcggcgggtggtgctgctcaacgtacagagccaggagccggacgaagacgatccctacaaggactatgtggtgcccgacgatctcatgtggtga

SEQ ID NO: 12997 - DNA, 1485 bp, Pseudomonas aeruginosa
acccggcaaggatcaccaggtgcggttcatgggcatcgatccgttgtgccagggcctggtcgaagctttcgcgatcggcataggccttgtgatcgagcacctcggtctggatgccggcctggcgtgcgcgttccaggccataggcgtccgcgcggttggagatcaccgcgcggatccgggccggcgtggcgccgtcccggaggctgtcgatcagcgcctgcaggttgctgccggagccggaaatcagcaccacgacattgcagagtttcggcatcagtggtttttcagattgttcaggaccacgcgctcggcgtccgcgccgcaggtttcgatgcgaccgatctgccagggttgctcgccggcggcacgcaggacttccagggctttctcggcgtcgctctgggccacgcagatgaccatgccgacgccgcagttgagtacgcgatgcatctcggtctcgtcgacgttgccctgttcctgcagccagtcgaataccgccggacggttccagctggcgacatcgatcacggcctgggcgttgtccggcaggacgcgcgggatgttgtccagcaggccgccgccggtaatgtgagccatggccttgaccgcgccggtctgcttgatcagttgcagcagcggcttgacgtagatgcgggtcggcgccatcagcaggtcggccagcggcttgccgtcgagttggacctgctcgatgtcggcgccggaaacctcgatgatcttgcggatcagggagtagccgttggagtgcgggccggaggagggcagggcgataagcgcgtcgccggcctggaccctggagccgtcgatgatctcggccttttccacgacgccgacgcagaagccggccaggtcatagtcttcgccttcgtacatgccgggcatttcggcggtctcgccgccgaccagggaacagcccgccagttcgcaaccggcaccgatgccggtgactacggtggcggcgacgtcgacgttgagcttgccggtggcgtagtagtcgagaaagaacagcggctcggcgccgcagaccaccaggtcgttgacgcacatcgccaccaggtcctggccgatgctgtcgtgcttgttcaggttgagcgccaggcgcagcttggtgcccaccccgtcggtgccggataccagcaccggctgcttgtagccggccgggatttcgcagagggcgccgaagccgccgaggccgcccatcacttccgggcgtgcggtgcgcttggccacgcctttgatgcgttccaccagggcttcgccggcgtcgatgtccacaccagcgtccttgtagctcaacgagggttgcttgctgctcataaatccaggcctatagggataattcggagatcggccggccgcccaggcgtgcaacgctgtttgccggttttgaaggcgcgcgattttatcaggcttgccacgcagcggccatctcggttgccgctggacggactgctgtttaaggtatag

SEQ ID NO: 12998 - DNA, 1101 bp, Pseudomonas aeruginosa
gtccacttgcgcggccttcacagctcgtcgccgccgttcccatccgttcgtcgagagccctccatgcgcatagcccgactcttcgttctctgttttttcctgctaggcttgcccgtcttcgcggcaacggtccccaatctctaccaggtccacgagccggtttcgtcgcagcagcccggggagcgcgatgccggactggtgcgagccctgcagaccctgctggtgcgcctgaccggcaatccgcaggcgccgcagaacccggcattggcggggtacctgaaggatccgcagcaactgatcagccagtacgccttcgaaaatggtccgccgctggcgctggtggtcgatttcgatccgaccgccaccggtaatgcgctgcgggccgccggcctgccgagctggggcgccaaccggccggcggtgctggcctggtggctgaacgaaagcgccgatggcagctccctggtcggtgacaaccaggcctcggccgaaccgctcaagcgtgcggcgcagaaccgcggcttgccgttgcgcctgcctctggcggatctcgacgaacagatcgtcggtaccccggaaaacctcaccgccgcccaacccgatgccctgcgcgcagcctctgagcgttatgccgccgatgccttgctggcagtggacgccaaggaggcggacggcaaatggcaggcgcaatggcggctgtggatgggcgattcgcgagagcaaggccaggctgaaggcgctacgcccgacgcgttggcagacagcgtgatgctggccgtcggcaaccgcctgtccactcgtttcgttgccacgccggaagcggcgaccggcctgaccctccaggtccagggcgcgacactggcacgctatgccgagttgcaacgcctgctcgatccgttcggcgcgcgtctggtaggcgtgcggggcgatcgcctcgactattccgtgaaggccagtcccgagcaattgcgtgcccagctgggcctggcgcagttgcaggaaatcccggccgacagcgtaccgctggatgcctccggccagcccgcagcgcccagcgcggcggtgccgtcgtcgacccaactgaatttccgctggcagtga

SEQ ID NO: 12999 - DNA, 810 bp, Pseudomonas aeruginosa
ttttgcttgcctagttgctcattgtgcggccttgccgaggcgtataaactttgcagcccttacggtgactcctgcggcgttttcggattgtccgcccagcctggcatgaaacctattcagcttcccctcagtgtgcgtctgcgcgacgacgccaccttcgccaactactatcccggtgccaatgccgcggcactgggatatgtcgagcgtttgtgcgaagccgaggctggctgggcggaaagcctcatctacctctggggacacgacggcgtcggccgcagccacctgttgcaggcggcctgcttgcgtttcgagcagttcgaagagcgaaccatctacctgccgatggccgatctggtgcagtacggcccggaaatcttcgacgatctcgagcagtgcgagctggtctgcatcgacgacctggatgtgctggttggcaagcgagaatgggaagaggggctgttccacctgttcaatcgactgcgtgataccggtcggcgcctgctgctggcggcatcgaagtcgccccgggagcagcaggtcaagctgccggacctgaagtcccgcctcaccatggcgctgatcttccagttgcacggtctttccgacgaggacaagcttcgtgccctgcaactgcgggcatcccgtcgtggcctgcatctgaccgatgaagtcggtcgtttcatcctcaaccgcggttcgcgcagcatgaactctctgttcgatctgctggagcaactggatcgcgcttcgctccaggctcagcgcaagctgaccattcctttcctcaaggaaaccctcggctggtaa

SEQ ID NO: 13000 - DNA, 630 bp, Pseudomonas aeruginosa
ctgagtggtctcctggccgccgtgcaggctggcggtggaggtgaagaccgctgccggcttgccgaccaggccgccggtcagccacaggctactggtaccgtcgaggaagtatttcagcggggaagccatgttaccgaagcgggtcgggctgccgagggccaggcccgcgcagttcttcaggtcctccagggtcgcgtacagcgccccctccgcggggatgtccggggcgaccgcttcgcattcggtggataccgcgggaaccgtgcgtacgcgcgcctcgaagccgccctgttcgacgccacgggcgatctgccgggccatttccgcggtagcgccatggcgactgtagtacagcaccaggatgtagggactgctcaagcgaggatctccaggactctttccggaggccggccaaccaccgccttgtcacctgcgaccagcaccggacgctcgatcagcttcggatgcctggccattgcctcgatgatggcctcttcgccaagactgggctcatccaggccgagggccttgtattcgtcctccccggtccgcagcaactggcgggcgggaatgccgagcttggccaggatcgctttcagctcggcgacgctcggcggggtttccagatag

SEQ ID NO: 13001 - DNA, 1320 bp, Pseudomonas aeruginosa
ccgcctcgtcgaccaggactgaacccgtcggcgcgaagtaccgccccgagaggcgaagaaccggcgcgacttcaaggagagggcatgcgcgaacatttcaacgatggggtcgagttcgctcgcttcctcgctcatcgcttcgtcaccgacaaggctcccaacagcgcggcggcgctgacctacaccacgttgttcgcggtagtgccgatgatgacggtgatgttttccatgctttcgctgattccggcattccatggcatgggcgagtcgatccagactttcatctttcgcaatttcgtgccttccgctggagaagcggtggaaacctacctgaagagtttcaccacccaggcccggcacctgacctgggtcggggtggtctttctggcagtcaccgccttcactatgctggtgaccatcgagaaagccttcaacgagatctggcgggttcgccagccacgccgcggtgtcgggcggttcctcctctactgggcgatcctcagcctgggcccattgttgctgggggccggcttcgccgtgaccacctacatcacttcgctgtcgctgctccatggcccggacgcgttgccgggcgcggagacgctgctggggctgatgccgctggcgttcagcgtggcggccttcaccctgctctattcggcggtcccgaacgcccgggtcccggtgcgccatgccctgatgggcggcgtgttcaccgcggtactgttcgaagccgcgaaaaccctgttcgggctgtacgtaagcctgtttcccggctaccagttgatctacggtgccttcgccaccgtgcctatcttcctgctgtggatctatctttcctggatgatcgttctgttcggcgcggtgctggtctgcaatctctcttcttcccgtctctggcggcggcgctcgctgcccaagctgatcgtcctgctcggcgtgctgagggtgttccaccagcgccagcagcttggacagtcgctgcgcctgacccacttgcatcgtgcgggttggctgttgcccgaggatgagtgggaggaactgctggactttctcgagaaggagcagttcgtctgtcgcgccggcggaggcgagtgggtgctgtgccgggatcttggcgcctacagtctgcatcgcttgctgaatcgctgcccctggcccatgcctagccgagagcgcatgcctgcgaatctggacgaggcgtggtatccgccgttccagcaggccatggagcgcttgcaggtggagcaggaggcgctgttcggagaaagcctggcccactggctggcggacggaacctcgggagcgaaggtgacgtaa

SEQ ID NO: 13002 - DNA, 279 bp, Pseudomonas aeruginosa
tcacttcttcgtgggtcgggcctacgcagaattcgcgctcgtggcggtccttcaggcgcagcagctcagggccgtattgctcccagcgccccgactcctgccacagctcggccggctgcaccgccggcatcagcacttccagggcgccggcagcgttcatttcctcgcggacgatggtctcgaccttgcgcagtacccgcaggcccattggcagccaggtgtagagacccgaggccaggcgacggatcatgccggcgcgaagcagcagttgatggctga

SEQ ID NO: 13003 - DNA, 546 bp, Pseudomonas aeruginosa
gcgtggaaagcagatactgactggtacgcatctttggccgttatgtcggttgtatcgggaggaatggctgggcattgtacggtgccggtctggctgcgtacagggcgccggccatcgatgatgaggagtcagcaggcaatgaacgcggcgcaggtacaggcgttgatccgcatggggctgcccatggccgaggacatcgattttcgtgtcgagcgtctcgacgaacgacatgcgctggcgcgcataccttttcacggcaagctggtgcgtcccggtggaacgctgtccggcccgaccatcatggcgctggccgacgcggcgatgtacgcggtcattctcgggcgtctcggggcggtcgagatggccgtgacctcgaacctgaacatcaacttcctcagcaagcccaggcccgaggacctgttggccgaggcgagcatcctcaagctggggcggcgccaggtcgtctgcgaggtcggggtgttttcgcagagtaatgaggaagacctggtggcccatgtcaccggtacctacgcccttcctttatag

SEQ ID NO: 13004 - DNA, 1971 bp, Pseudomonas aeruginosa
tccccgccttcaatgcgaagtgggcccggatgcgggtgcttcgccgttgccgttcaccgggcagcgcgggagatgtccttccgggggcgtaccgatggttccggtgctcggtcagggccggcgagagcccggcaatggtcgccaggcagccggcggctccacagaatccaagacttacgagaagcgaaccacaccatgatgcgcagccactattgcggccaactgaacgagagcctggacggccaggaagtcaccctttgcggttgggttcaccgccgccgcgaccatggtggagtgatcttcctcgatgtgcgcgatcgcgaggggctggcccaggtggtgttcgatccggaccgtgcggaaaccttcgccaaggccgaccgggtgcgcagcgagttcgtggtgaagatcaccggcaaggtgcgcctgcgccctgaaggcgcgcgcaacccgaacatggcgtctggctccatcgaggtactgggctacgaactggaagtgctgaaccaggccgagactccgccgttcccgttggatgaatattccgatgtgggcgaggaaacgcgcctgcgctaccgcttcatcgacctgcgtcgtccggagatggccgccaagctgaagctgcgtgcgcgcatcaccagcagcattcgccgctacctggacgacaacggcttcctcgacgtcgagaccccgatcctcggccggccgacgccggaaggcgcgcgcgattacctggtgccgagccgtacctacccgggccacttcttcgccctgccgcagtcgccacagctgttcaagcaactgctgatggtcgccggcttcgatcgctactaccagatcgccaagtgcttccgtgacgaggacctgcgtgccgaccgccagccggaattcacccagatcgacatcgagaccagcttcctcgacgagagcgacatcatcggcatcaccgagaagatggtacgccagctgttcaaggaagtgctggatgtcgagttcgacgagttcccgcacatgccgttcgaagaggccatgcgccgctacggttcggacaagcccgacctgcgcatcccgctggagttggtggacgtcgccgaccagttgaaggaagtggagttcaaggtcttctccggtccggccaacgatccgaaggggcgtgtcgccgccctgtgtgtaccgggcgccgcctccatgccgcgcagccagatcgacgactacaccaagttcgtcggcatctatggtgccaagggcctggcctacatcaaggtcaacgagcgcgccaagggcgtggaaggcctgcagtcgccgatcgtgaagttcatccccgaggccaacctgaacgtgatcctcgatcgcgttggcgcggtcgacggcgacatcgtgttctttggcgccgacaaggccaagatcgtttgcgatgccctgggcgcgctgcgtatcaaggtcggccatgacctcaagctgctcacccgggagtgggcgcccatgtgggtcgtggacttcccgatgttcgaggagaacgacgacggctcgctgtccgcgctgcaccacccgttcacctcgcccaagtgcaccccggctgagcttgaggccaatccgggcgcggcactttcccgcgcctacgacatggtgctcaacggtaccgagctgggtggcggttccatccgtatccatgacaagtccatgcagcaggcggtgttccgtgtgctgggcatcgacgaggcggaacaggaagagaaattcggcttcctgctcgacgcgctcaagtacggtgcgccgccgcatggcggcctggccttcggcctggatcgcctggtcatgctgatgaccggtgcatcgtctatccgcgaagtgatcgccttcccgaagacccagagcgctggcgacgtcatgacccaggcaccgggttccgtggacggcaaggccctgcgcgagctgcacattcgcctgcgcgagcagccgaaggccgagtga

SEQ ID NO: 13005 - DNA, 750 bp, Pseudomonas aeruginosa
gttatggctggtcattctaaatgggccaacatcaagcaccgcaaagagcggcaagatgccaagaaaggcaagatctttaccaagctgatccgtgagctgaccgtcgctgcaaggcagggcggcggcgtcccggcggacaacccgcgtctgcgcctggccgtggacaaggcgctgaccgccaacatgacccgcgataccatcgatcgtgccattgcgcgcggcgtcggctccaacgatgccgacaacatggtcgagctttcctatgaaggttatgcgccgagcggcgtagcgatcatcgtcgaggcgatgaccgacaaccgcaaccgtaccgctgccgaagtgcgtcatgccttcagcaagtgtggcggcaacctgggcaccgatggttcggtcgcctacatgttcgagcgcaagggacagatcagcttcgctcccggcgtggacgaggaagcgctgatggacgcggccctggaggctggcgccgatgacgtggtagtcaacgacgatggctccatcgacgtgttcaccaccttcgccgacttcatttcggtgaacgaggcgctggccgccgccggattcaagggcgacgaagccgaagtcaccatgatcccttcgaccaccgcgaccctggacctggaaaccgcgcagaaggtgctcaagctgatcgacatgctcgaggacctggacgacgtgcagaacgtctattccaatgccgatatcccggacgacgtgatggcgcagctcggctga

SEQ ID NO: 13006 - DNA, 564 bp, Pseudomonas aeruginosa
tgcgttcgaaccccgcttccggcttttagtatccagcttatgactttgattctagggattgacccgggctcgcgcatcaccggcttcggcgtggtgcgggaaacggcgcgcggttgcgaatacgtggcgtccggatgtatacggaccggtaatggccccttgcacgagcgtctacacgtggtgtttcgcagcgtccgcgaggtgatccgcacccatggcccgacggccctgagcatcgagcaggtgttcatggcgcgcaacgccgattcggccctgaagctggggcaggcgcggggggcggccatcgtcgcggcaatggaggaggggttgagcgtggcggagtacaccgcctcgcaggtcaagcaggcagtcgtggggaccggcggtgcagacaagcagcaggtgcagatgatggtcatgcatctgttgaagctgacccagaaaccgcagatagatgcttccgacgccctggccatcgccctgtgtcatgcccatacccaacagagtctggtcccccatggcctggtgggcgcacgccgacgtggcgggcgcctgcgtctttga

SEQ ID NO: 13007 - DNA, 510 bp, Pseudomonas aeruginosa
cgaccctctatcggttgcattcggttgggcgagccggtgaccttgcatacccatctggttgtgcgtgaggatgcgcacttgctctatggcttcgccgaaaagcgcgagcgagagctgttccgtgagctgatccggctcaacggcgtgggtccgaaactggccctggcgctgatgtcgggcctggaagtggacgaactggtgcgttgcgtccaggcacaggacacctccaccctggtgaagatccccggtgttggcaagaagaccgccgagcgcctgctggtggagttgaaggaccgcttcaaggcttgggaaaacatgcccacgattgcaccgttggtgatggaaccccgtgccagcgctacagtctcaagcgccgaggccgatgcagtcagcgcgctgatcgccctcggcttcaagccacaggaagccagtcgtgccgtcgcagccgtaccgggagaggatttgtccagcgaagaaatgatccgccaggccctgaagggcatggtctag

SEQ ID NO: 13008 - DNA, 993 bp, Pseudomonas aeruginosa
gcagctggaccgcgccattcgcccgctgaagctggccgactacatcggccagcccagcgtgcgcgagcagatggagctgttcatccatgccgcgcgcggccgccaggaggcgctcgaccatacgctgatcttcggtccgccggggctgggcaagacgaccctggcgaatatcatcgcccaggaaatgggcgtttccatcaagagtacttccgggccggtgctcgagcgtcccggcgatctcgccgcattgctgaccaacctggaggccggcgacgtcctgttcgtcgacgagatccaccgtctttcgcccatcgtcgaagaagtgctgtatccggccatggaagatttccagctggacatcatgatcggcgaagggcccgcggcccgctccatcaagctggacctgccgccgttcaccctggtcggcgcgaccacccgtgccggcatgctgaccaatccactgcgcgatcgcttcggtatcgtccagcgcctggagttctacaacgtcgaggacctggcgaccatcgtcagtcggtcggccggcattctcggcctggagatcgagccgcagggcgcggcggaaatcgccaagcgcgcccgcggtacgccgcgaatcgccaatcgcctgctgcgccgggtacgcgacttcgccgaggtccgggggcagggcgacattacccgggtgatcgccgacaaggcattgaacctgctcgatgtcgacgagcgtggcttcgaccacctcgaccgtcgtctgttgctgaccatgatcgacaagttcgatggcgggcctgtaggaatcgacaacttggctgcggcgttgagcgaggagcggcacacgatcgaagatgtactggagccctatctgatccagcagggctacatcatgcggacaccgcgggggcgcgtggtaacacgccatgcgtacctgcactttggcctgaatattccgaaaaggttggggccgggggtgacgacggatctgttcacgtctga

SEQ ID NO: 13009 - DNA, 771 bp, Pseudomonas aeruginosa
agccacgtgctatccccgaaacgttgcgtgcggcttttgccggaagcccggattctttttcagcaggagattaaagtggaaccgaacgtcgtcgaccatacctccatgtggagcctgatcagcaacgccagtatcgtggtgcagctggtcatgctgaccctcgtggccgcctcggtcacatcctggatcatgattttccagcgcggtaacgccatgcgcgccgccaagaaggcactggatgccttcgaagaacgcttctggtcgggcatcgacctgtccaagctgtaccgccaggccggtagcaatccggacccggactccggcgtcgagcagatcttccgtgccggcttcaaggagttttcccgtctgcgccagcagcccggcgtcgatcccgatgcggtgatggagggcgtggcgcgcgccatgcgtgtggccatctcccgtgaggaggagaaactcgaagccagcctgccattcctggcaaccgtcggttccaccagcccgtacgtcggcctgttcggtaccgtctggggtatcatgaactccttccgtggcctggccaccgtgcagcaggcaaccctggccaccgtcgccccgggtatcgccgaagcgctgatcgctaccgccatcggcctgttcgccgcgatcccggcggtcatcgcctacaaccgcttctccgcacgttctgagatgctgatcggtcgttactacaccttcgccgacgagttccaggccatcctgcaccgcaaggtgcacaccagcgacgactaa

SEQ ID NO: 13010 - DNA, 1224 bp, Pseudomonas aeruginosa
tgccgtgtcgttggaacagatgaccgatgcagtcaccaagatcatgagtgcccgtccggacacccaggtattcatccgcggcgacaaggcggtgaactatggtgcggtggttggcgccatgggtgccttgcagcaggccggtgtgcccaacgtcgggttgattaccgaggccccctgatcttgaagcaacagttcgagcgctcgccttccgagagttatttctggcccgtcgtcctggcggtggtcctgcacgttctgatcttcgccatgctgttcgtcagctgggcgtttgctccggagcttcctccctccaagccgatcgtgcaggccacgctctaccagctcaagtcgaagagccaggcgacgacacagaccaaccagaagatcgctggcgaggcgaagaagaccgcctccaagcaatacgaagtcgagcagctcgaacagaagaagctcgagcagcagaaactcgagcaacaaaagctggaacagcagcaggtcgctgctgcgaaagcggcggaacaaaagaaggctgacgaggctcgaaaggccgaggcccagaaagccgccgaggcgaaaaaggccgatgaagccaagaaagctgccgaggccaaggccgccgaacagaagaagcaggctgacatagccaagaagcgcgccgaggacgaggccaagaaaaaggccgctgaggacgccaagaaaaaggcagccgaggacgcgaagaagaaagcggccgaggaggccaagaagaaggctgctgcggaagcggcgaagaagaaagccgccgtcgaggccgccaagaaaaaggccgccgccgctgccgcggcagcccgcaaggctgccgaggacaagaaggcgcaggcattggccgagttgctttcggatacgaccgagcgccagcaggccctggccgacgaggtgggcagcgaggtcaccggcagtctcgacgacctgatcgtcaacctggtgagccagcagtggcggcgtcctccatcggcgcgtaatggaatgagcgtagaagtactgatcgaaatgctgccggacggtaccatcaccaatgccagcgtcagccgttcgagtggcgacaagcctttcgacagttcggcggtggcggcggtgcgcaacgtcggccgtattcccgagatgcagcaattgccgcgggctaccttcgacagcctgtatcgtcagcgccgcatcatctttaaaccggaggatttgagtctgtga

SEQ ID NO: 13011 - DNA, 564 bp, Pseudomonas aeruginosa
actgacggtcgccaacggttacaaacttatacactggggttcattaggagttacatgatggaaatgctgaaattcggcaaatttgctgcgctggctctggccatggctgtggctgtgggttgctcctccaagggcggcgatgcttccggtgaaggtgccaatggcggcgtcgacccgaacgcaggctatggcgccaacagcggtgccgttgacggcagcctgagcgacgaagccgctctgcgtgcgatcaccaccttctacttcgagtacgacagctccgacctgaagccggaagccatgcgcgctctggacgtacacgcgaaagacctgaaaggcagcggtcagcgcgtagtgctggaaggccacaccgacgaacgcggcacccgcgagtacaacatggctctgggcgagcgtcgtgccaaggccgttcagcgctacctggtgctgcagggtgtttcgccggcccagctggaactggtttcctatggtaaagagcgtccggtcgctaccggccacgacgagcattcctgggctcataaccgtcgcgtcgagctgaagaagtaa

SEQ ID NO: 13012 - DNA, 234 bp, Pseudomonas aeruginosa
ggagtagtcgaagtcatggaacgcttgctcgagagcatttacatcaatgcccggccggcgatggagttgaggcttagcctcaccagctccggccgcaagagaattgtaaaggttgtggatggggaggaggtcgaggttctgtcaggtgaagtgcagggcatcctggaggcccaaaagagggatgttggaatcctcgccgatttcttagccaagagtctcttggcgcgacgctag

SEQ ID NO: 13013 - DNA, 354 bp, Pseudomonas aeruginosa
aggctgtggactacccccggtacgatagacattcccggcctacgctttgagcataggaggaagtccatgagcatccagcgattcaccccggaattcaaggccgaagccgttaggcaggtcatcgagcgcggatactcagtcgcggaaatcgccgcgcgcttcggcgtctctactcacagcctctacaaatgggtaaaggctgtgacccccgacaagtcggagaaacaggccagcgaactgttggaagccaagagcgaaatcctgcggctgcgggcccaaatgcgtcgccttgaagaagaacgggacatcttaaaaaaaccgagcggctcatcacatactgcatggcgtccttga

SEQ ID NO: 13014 - DNA, 951 bp, Pseudomonas aeruginosa
ccgattgaagaagttgctcgccgaggcccacctcgacatcgagtcgctgaaagtggtcgctcggggaaaagggtaagcccgacagcacggcgggaggcggtgcaggagatgcaggcgcgaaccggcatctccgagcgtcgtgcctgtcagttgatcgggctgtcccgctcggtgttgcgctaccagccgcgagccagtgtgcaaaacaccgagctgcaagcccaactggtggaactggcccaagagcgccggcgctttggctatcgccgcctgcacatcctgctgcggcgtgctggcgtgcaggtcaaccacaagcggatctatcgcctgtaccgcgctgccggcttgatggtgaaacggcggcgccgccgccatggcatcgcggtggagcgcgaacgtctgagtttgccgagcgcaccaaaccaggtctggtcgatggacttcgtcttcgatgcactgagcaccgggcggcggatcaaatgcctgacggtggtcgatgacttcaccaaggagtcggtcggcatcctggtggagcacggtatcagcggctttcgcgtcacacgggcgctggacgagatggcgcggtttcgcggctacccgaaagcgatccgcaccgaccaggggcccgagttcaccggcaaggcactcgatcaatgggcctatcagcgcgacatcaagctgaagctgattcagcctggtaagcccacgcagaatgccttcatcgagtcgttcaacggtaagttccgggacgaatgcctcaatgagcactggttctgttcgctggccgaagcgagaatccgcatcgcggcctggcggcgggattacaacgaacaccgaccgcacagcgcgattggcaatctcgccccggcagaatttgctgcaagttggcgaactcgccagcagcagctgaagcaggaaaaattaatatcaaccccagggcctactaactag

SEQ ID NO: 13015 - DNA, 657 bp, Pseudomonas aeruginosa
agttcaaaaatcgcaacactttcactgtcaaaaggaagctcaatcgtgtccatttccatgaaaagcattctggctgccgcagtagccagcctggtcgtcggcaatgccatggcggcagacggcaccatcaatttcaaaggtgaaatcaccgcggccgcttgcagcatcactggtggtgccggcaccaccgttggcggtgctgcgggcaaccagaccatcgacgtaaaccttggcaagatcagcatcgactcgctgggcggcaccgcgggcggcagcatcgctggtggtaccagcctgaacctgaacctggactgtggcaagaccggtaccggcctgaccaccgtcaagctgaagttcaacccgatgtctgggagcactattgacccgaacaatgagagcctgctgaaaaccgtcggcaccgccaccggtgtcggcatcggtatctatggatccgatggcaagctgctgaacctgtcggcgaacgagaccatcgatgctcccctggattccaaggtacaaaaagatggcgaaggcaatgacatcactgtctacagtgccaagctgaatctgcgtgccgcttatgtcaaatccggctccgtagctcctacggctggtagtgccgacggctccctgccgttcaccctggaatacaactaa

SEQ ID NO: 13016 - DNA, 771 bp, Pseudomonas aeruginosa
gttctgctacgtgggcggggtatgtatataccccgttccatgaggtacgagttcatcatgaaatatccattttcttccagagttatctggggtggcatccttttgcttttttccaccctggccaatgcgggaatcacactgggaggaacccgggtcgttctgcaggcgcctgccaaggaggctgcgatcctggtcaggaaccaggcttccaaggacgtgatgattcaatcctgggtagaggctgataatggggcagataaacgtgaggttccgtttgtcatcacgcctgccctcagtcgtttgggaggcaacaagcagcaaaccctgcgtatcctgtttcaaggggaaggcttgccgagcgacagggaatccgtattccgcctgaacgtccaggaaattccgcaaaaatctgcctcggctaatacgttgcagatagctttgcgccagcgtatcaaggtcttctaccgtcccgataacttgtcgggaacttccgccgaagcgcctggaaagttgaactggcgtcttgtccgtcagggtggaaagtcggttgtcgaagtttccaacgatactgcgtttcatgtctctttagccagcgtgaaattaaaagctggcaatgcctactatgttgttgatgccgacatggtcgcgccgaagtcgagtcgccgattcgaaatcaagggaactccatccggcgtttctggaaatgtcgagttccagagcgtaaatgactatggcggactcgataaacactccagctccttatccgactga

SEQ ID NO: 13017 - DNA, 1008 bp, Pseudomonas aeruginosa
agccaatgcgttcaactacagcgcacaggccaactacagcaaggacggcggcaactccggcagcgtcggcctgggttgggacacgtccaaggccaagttgtccgccaattacagccaggggcgcgacaacaagcagatcaacctgggagcaagcggttcggtagtggtgcattcggggggagtgaccttcggccagccggtgggggaaacgttcggcctggtggaggttccggaggtcggcggcgtcggcctcgacggctactcttcggttcgcaccgacggccgtggctatgccgtgctcccctacatgcaaccctatcgttacaactgggtgaacctggataccaatacccttggaagcgataccgagatcagcgacagcacgcaaatggccgtgccgacccggggcgccgtgatcgccaagcgtttctccgcggagtccggtcggcgggtgcagttcgacctgagcatggactctggaggaaagagtcccttcggtgcacaggcatacgacaaggaagagcgggtcgtgggaatggtcgacaacctgtcccgtttgctggtgttcggtatcgaggaccaggggcgcctgtccattcgctggagcgatggctcctgttccgtcgactatcagttgccgcccaggaacaaggacctgacttacgaacgagttgcgctcagttgccgtcggtcctcgatctgaaatgtccccgctgcagtcgggtcaagtcaaaaggcgaggatttttccggtgaacaccgggcgcgagggcaagcggcagctcactcgtcctcgatcatgctcaacaggtctggtgtcctgcctcgggtttccaaacgcagcaaccactgcttggcggccaacccaccggcgaaaccggtgaggccgccagaggctccgatcaccctatggcaaggtgcaacaatggacagtgggttccgtccgttggcggctccaaccgcccgtactgcgttggggctgccgatctgcacggctatttccgtatag

SEQ ID NO: 13018 - DNA, 1407 bp, Pseudomonas aeruginosa
gtgccggctggtggaccgcgaagggcacactatcgaggaaactggccagcaaggcgtgctgttggtgcgtggccctgggctgagtccgggttactggcgggccagcgaagagcagcaggcgcgcttcgcaggtggctggtaccgcaccggcgacctgttcgagcgcgacgagtcgggtgcctaccgtcactgtgggcgggaagacgatctgttcaaggtgaatggccgctgggtggtgccgacccaggtcgagcaggcgatctgccgtcatctgccggaagtgagcgaggcggttctggttcctacctgccggctgcacgacggcttgcgtccgaccctgttcgtcaccctggccactccgctggacgacaaccagatcctgctggcgcagcgcatcgaccagcatctcgccgaacagattccctcgcacatgctgcccagccaattgcatgtgctgccggccttgccgcgcaacgacaacggcaagttggcgcgcgccgagctgcgccacctggccgacaccctttatcacgacaaccttccggaggaacgggcatgttgattcaggctgtgggggtgaacctgcccccatcctatgtgtgtctggaggggccgctgggaggcgaacgccctcgcgcccagggcgacgagatgctgatgcagcgcttgctgccggcggttcgcgaagccctggacgaggcggcggtcaagcccgaggagatcgacctgatcgtcggcctcgccctgtctcccgaccatctgatcgagaaccgcgacatcatggcgccgaagatcggccatccgttgcagaaggtcctcggcgcgaatcgcgcgcatgtcttcgacctcaccgactcgagcctggcccgcgccctctacgtggtcgataccctcgccagcgaccagggctatcgcaacgtcctggtcgtgcgcggcgaatccagccagggattggaagtggacagcgagtccggcttcgcccttgccgacggcgccctggcgctgctctgccggccgaccggcaaggccgcgttccgtcgcggtgcgctgggcggtgatccggcgcaggaatggctgccgctgagcattccgctgaataccgatattcgccaggtaggcgacgtcaaggggcacctcaacctgccggcccaacctggattgcccgaagcggtacgcgccggattcacccgtctggccggggacttcccgcaactgaactgggtgcgcgaggaatggttcggccagggacggcccgatggtcgttgcctggggccgttcgaactggcgtcgcaactgcgcgcggcacagcgcgaccgtctggatgaactgctgctgatcagcttcgatccgttcggcatggtggtggagggcgtgaccctggaactggcgggagaagctcatgcataa

SEQ ID NO: 13019 - DNA, 672 bp, Pseudomonas aeruginosa
cctggtagggcgcatcaatacgtcggacgagttcatcgtcgaacgtaccggcgtgcgcacccgctatcacgtcgagccggaacaggcggtcagcgcgctgatggtgccggcggcacgccaggccatcgaggctgccgggctgctgccggaggacatcgacctgttgctggtgaacaccctgtcgccggaccaccacgacccgtcccaggcctgcctgatccagccgctgctgggcctgcggcacatcccggtgctggatatccgggcacagtgcagcgggttgctgtacggcttgcagatggctcgcgggcagatcctcgccgggctggcacggcatgtcctggtggtctgcggcgaggtgctgtccaagcgcatggactgttcggaccgcggccgcaacctgtcgatcctgctcggcgacggtgccggcgcagtggtggtcagcgccggcgagagcctcgacgacggcctgctggacctgcgcctgggcgccgacggcaactacttcgacctgctgatgactgcggcgccgggcagtgcctcgccgaccttcctcgacgagaatgtcctgcgcgagggcgggggcgagttcctcatgcgcggccggccgatgttcgagcatgccagccagaccctggtacggatcgccggcgaaatgctcgcggcccatga

SEQ ID NO: 13020 - DNA, 921 bp, Pseudomonas aeruginosa
ggaggtgaaccggccatgttgaggctttcggctcccggtcaactggatgatgacctgtgcctgttgggggacgtccaggtgccggtgttcctgctgcgtctcggtgaggcgagctgggcgctggttgaaggagggatcagccgggatgccgaattggtttgggcggacctgtgccgctgggtcgccgacccgtcccaggtgcactactggctgatcacccacaagcactacgaccactgcggcctgctgccctacctgtgtccgcggctgccgaacgtacaggtcctggcgtccgagcggacctgccaggcctggaagtcggaaagcgcggtgcgggtggtcgagcgcttgaaccggcaactgttgcgtgcggagcagcggttgcccgaggcctgtgcctgggacgctctgccggttcgcgcggtggccgacggcgagtggctggagctgggaccgcggcatcgcctgcaggtcatagaggcccacggccacagcgacgatcacgtggttttctacgacgtgcgacgccgacgcctgttctgcggcgatgccctgggcgagttcgacgaggcagagggggtgtggcggccgctggtgttcgacgacatggaggcttacctggagtccctggaacgtctgcagcgtctgccgaccctgctgcaactgatcccgggacacggcggcctgctgcgggggcggctggccgcggatggggccgagtcggcctataccgagtgtctgcgcctgtgccggcggttgctctggcgccagtccatgggcgaatccctcgacgaactgagcgaggagctgcaccgcgcctggggtgggcagagcgtcgacttcctgcccggcgaactgcacctggggagcatgcgccggatgctggagattctctcccgccaggcgctgcctctggactga

SEQ ID NO: 13021 - DNA, 1614 bp, Pseudomonas aeruginosa
cgtcgcgcaggccagtcgcccatgggcgcgaggaggtggctcgtgagcggggttggctatcgactggaagaaagtctggagtaccgcacgctggtgccggaggcgctgtcgatctggcgcatggccggcgccaaccggatgctgttcgactgcttcgacgtggacagcaaggctgcgcggcgtagcgtggcgatcctttccagctgcctgcgcatcgagtgctgggggcgcgatgtggtgctgcgggcgttgaactccaacggacgcgccttgctggcgccgttgagcgaggactgtccggcccaggtcacctgcttgcgtgacggcgacaccctgcactggcgcttcccccaggaagagtcgcatgcggacgagtggcgacgcctgcatggcctgtccagcctggaggcgctgcgccgcgtgctcggaacgctgggcgacgcggaggggcccgcgctgctgggcggcttgttcagcttcgacctggccgagcagttcgaacccttgccggcgccggccgaacctgcgcggcattgcccggactacctgttcctggtgccggagttgctgctggacatcgatcacctggcgcgccggacttcgctgcaggcgttcgtccacgatccggccgggcacgaccggttggccgccagcctgcgccagtgtgccgacgaattccatggcgccgtggaggaggcttccgagtcgccggtggcaggcgtacgggccggcaactaccaggtcgacctggacgatgcgagctttgcccgccaggtagagcgcctgcaggcccacgtgagggccggcgacgtgttccagatcgtaccgtcgcgcagcttcagcatgccgtgtgcggacccctggcgggcctatcgccagttgtgcctgcgcaaccccagcccgtaccgcttcttcctcgatgcgggggacttctgcctgttcggcgcttcgccggagtcggcattgaagtacgacgcggagagtcgcgaggtggaactctatcccatcgccggcacccgcccgcgcggacgcgatgcccggggcgccatcgatgcggaactggacaatcgcctggaagcggagttgcgcctggacgccaaggagatcgccgagcacatgatgctggtcgacctggcgcgcaacgatctggcgcgggtctgccgcagcggtacgcggcaggtgcgcgacatgctcaaggtcgatcgctacagccacgtgatgcacctggtctcgcgcgtggctggcgaactgcatggcgaactggatgcgctgcatgcctaccgtgcctgcctgaacatgggcaccctggtcggtgcgccgaaggtccgtgccatgcagttgctgcggcagtacgaggatggctatcgcggcagctacggtggcgcgatcggcattctcgacagcgccggcaacctcgataccagcatcgtcatccgctccgccgaggtccgcgaaggtatcgcccgggtccgggcaggcgccggcgtggtgctggattcggatccacggctggaggccgaggaaacccgcaacaaggcgctggcggtgctgaccgccgtggccgctgccgaacgcgaaaggggagagcgcgatgcgcatcacgctgttggataa

SEQ ID NO: 13022 - DNA, 900 bp, Pseudomonas aeruginosa
tttcgcggcaggagcggttgcatgattgcgggcagtatggtggcactggtcacccccttcgatgctcagggtcgactggactgggacagcctcgccaagctggtggacttccacttgcaggaaggcaccaacgccatcgtcgccgtcggcaccaccggtgaatcggccacgctggacgtggaagagcacatccaggtgatccgtcgcgtggtcgaccaggtcaagggccgcatcccggtgatcgccggcaccggcgccaactccacccgcgaggcggtggcgctgaccgaggccgcgaaaagcggcggcgccgacgcctgcctgctggtgacgccgtactacaacaagccgacccaggaaggcatgtaccagcacttccgccatatcgccgaagccgttgcgatcccgcagatcctctacaacgtaccgggccgcacctcctgcgacatgcttccggagaccgtcgagcgcctgtccaaggtgccgaacatcatcggcatcaaggaggccaccggcgacctgcaacgcgccaaggaagtcatcgagcgcgtcggcaaggacttcctcgtctattccggcgacgacgccacggccgtcgagctgatgctgctgggtggcaagggcaacatctccgtgaccgccaacgtcgcgccgcgcgccatgagcgacctgtgcgccgccgccatgcgcggcgacgccgcagccgcgcgcgccatcaacgatcgcctgatgccgctgcacaaggcgctgttcatcgaatccaaccccattccggtgaagtgggccctgcatgagatgggtctgatccccgagggcatccgcctgcccctgacctggctcagcccgcgttgccacgagccgctgcgtcaggccatgcgccagaccggcgtattggcttga

SEQ ID NO: 13023 - DNA, 867 bp, Pseudomonas aeruginosa
ccaccgtcagcgacgccgtgcaggtcaccgtcgacaaggacatcaacacctctgcgccggccgatgtcgcgcaaaacgtactggaaaaactccaggagagcatgcgcaatgcggttcgcggttctgggcagcggaagccggggcaattcggccttggtgagcagttctgacacccggatactgatcgattgcggcttcccgctgcgtgaaatcatcaagcgtctggcgcgcctggggctgagccccgcgcagctggacgcgatcctggtcacgcacgaacacgccgatcacatccatggcgtcgaactgctggcgcggcattaccaaatcccggtctatctcagtgcgggtaccctgagcggcatgcgccgcccggtgcaccccgccgagctgttgagggccggccagcgcctggcgatccgcgggctggaagtgcaggtggttggcgtctcgcacgacgcccgcgagcctacccagttcgtgctgtccgatgggcagcggcgcttcggcatgctcaccgatctgggaatggccacggccgaggtgctggagtgctatcgtgcggtggatgctctggtggtcgaggccaaccacgacagcacgatgcttgccggtggcccgtatccctattttctcaaggcccgcgtaggcggttcgcgagggcacttgaacaaccatcagtccgcagaactggtgaagcagctggattggggccgcatgcagcacctggtgctggcccatctcagcgaaaagaacaactcgccgcagctggcccggcaaaccttcgtcgacactctcgggtgcgatccggactggctgcaggtggccgatcagcattcaggcctggattggcgcgagatcgcctag

SEQ ID NO: 13024 - DNA, 1149 bp, Pseudomonas aeruginosa
cgcatggctaaccgtgcgtacaaataccgtttctatccgacttctgagcaggcgcaattgctagctcagacgttcggctgtacgcgcttcgtctacaactatgtcctacgctggcgaaccgatgcgttcttccagcggcaggagaaggtcgggtatctggaggccaacgcggcactcaccaggctcaagcgctccggcgagtttccgtggctgaacgaggtctcctgcgtccccttgcagcagtgccttcgccaccagcagtccgccttcaaaaacttcttttcaggccgcacgaagtaccctgcgtacaaaagcaagaagcatcggcagtccgctgagttcacccggtcggcgttcagctaccgggacggcaagctgtacctggccaagtccaggactcctcttgatatacgctggagcagaccgcttccgagcgagccttccaccgtcaccgtttcgagggactccgcaggccgctactatgtgtcttgcctctgcgagttcgagttcgaggctctgcccgtcacgccgaagatgatcggtatcgacctgggcctgaaagacctgttcgtcaccagcgatggcgaacggatcggcaatccccgccataccgcgaaatacgcagctcgcctagctaaggcgcagcgtaggcttagcaagaagaagctcggctcgaagaaccgctccaaggcccggctgaaagtggcccgtattcacgcaaaaatctccgactgccgcatggaccgcttgcacaagctgtcccgcagactgattaacgagaaccaagtggtctgcgtcgaatccctagccgtaaagaacatgatccgcaatccgagactgagtaaatccattgccgatgtcggctggggagagtttgcgcgacaattggagtacaaaggtgaatgggctggccgacaggtcgtcgccatcgaccgctggtatcccagttcgaagcgctgttcctgctgcggccatacccttgtgcgcttacccttggatatccgtagctggacatgccaggaatgcggcaccgaacatgaccgcgacgtgaacgcagcgatcaacattagagccgccgggctggcggtgttagcccttggagagaatgtaagcggcatcggtcaagtaccgctgtccagttctctgtga

SEQ ID NO: 13025 - DNA, 204 bp, Pseudomonas aeruginosa
agtcgggagggaagggaagcttggaacgaaaagccccgcagtgcggggctagatccttgccggttggacctgcgcgattactgcagggggcggcccgctttgagttctgaggtaaaggccgtgctgtatcccgccatcatcatcgaagttttccttgatgacatcaaagaactgatcgtcagcgtgctcgaattttcggaatag

SEQ ID NO: 13026 - DNA, 210 bp, Pseudomonas aeruginosa
agaggttcgagccgtgctcgaactgcacagggcgaagtgactatgcgccctcgtctcacgaactctgactacgccgcaatggctaacgctgctgaagagctggcgggtatggggtcgagtgagtggaggcgcagatacaacaaagccctgagcgactactacagggctttgtcggtgcgcaagccagttgcagctggcttgcgcgtatag

SEQ ID NO: 13027 - DNA, 891 bp, Pseudomonas aeruginosa
agaactggaccgaattccgggcagagatggaggaaatcgcaaatggctagggcccgcaacatcaaacccggaatcatggcaaacgaagacctagcagagctagatcctctcgctcgcctgctgttcatctacctctggatgttggccgatcgggaagggcgccttgaggatcgcccgaaacggatcaaggccgaggcacttccctacgacaacgtagacgctgacttgatgctggatgatctggccaaggcagggttcatccatcgctatgaggctgccggggtcaagctgattcaggttcttaactttgccaagcatcagacacctcatgtccgtgagcaggccagttctctcccgggcgttgacgcagaacacccaaagagagaacaaggcacaaccaaggaagtgcctggtcacaaccaaggctgtgctgagcaatcgccaagatcgcctgattctctgattccggattctctgattccagaggaagagcatgtcgacgctgacgcctcgacccattccgctccgcagcaagcagcagagcaagagcctggctccggccagaccgcacagctgttccagattgatcgcatcccttacgagaagatccgcgacctgtacaaccagatcctcggtggaaagctcaagcgctgcatgggagtgacggaggctcaccggaagcacatccgcgccgcgtacaacctcaagctcgatggcgggttcccggtccgtgacggtggactgtcgttttgggaagggctgttcaacgacgttctggattgccccttcatgctgggcaacaacaaccgggggtggcgcgcagacttcgagttcctgacaaccgccagcaagatccagcgcttcatggagggcaagtacgatgccgcatga

SEQ ID NO: 13028 - DNA, 228 bp, Pseudomonas aeruginosa
agagcctgcaaggggagggcgagtgacatggatatcgtagacatcgccaacgattacgccgagcgtgaactcgctgaacgcctgtactcccgagtcaagtacgtcggcgagagcctgtccgaatgtgaagactgcggcgaggagatcccggtagcgcggcgttcgatcatccctggcgttcgtaaatgccgggactgcgctgaacgggctgagcggagggctgtgtaa

SEQ ID NO: 13029 - DNA, 423 bp, Pseudomonas aeruginosa
aattctaaggcccaggcaacgacctgggcttttctgcatctggagtacgtgaatatggccgagccgagtggtgcggtagcagtcgccggcttggtcggtattggtgcgtctgcgttgatccctggcattgatgccaatgcagtgatcggggcttttgctggggctatcttcttcgtggtgtatgccaaggacatctcggcctgggctcgccttggttacttcgctgcgtcctggatcgttggctactacgtcgccggcgaattcatcgggcgggagtgggcaagaacatcgggcctggtcgcctttggtggggcattgttctgcgtcgcagtgggcaccagcttgctggagtgggtgcagggggggaagacgcctggttggctccgcttcatagcggaccgctttggaggtcgtaatggttga

SEQ ID NO: 13030 - DNA, 384 bp, Pseudomonas aeruginosa
tgggtgtttcgccctgagcgtgatgctcgatgcactccacggctacagactgaatcctgtctccccttggctgaccctggtgctggcgatcctgctcggccttgtctgccgcgctcgggggaacctggcccacattctgagggtgtactgatggatgctccgcttctgctgaagaacaccggcacgtgcctgatcttgtgtgacgccaacgggaagccgctccctggccagctttcgttgagcgtcagcaacgacggccccatcccaaccgtcacggtcacgctcgcactcgttaacaagtgggtgaggctctgcggcgaagagatggagtcgcgcatctcatacgattcgtatcttgagacaattaagggaaggcgcagctga

SEQ ID NO: 13031 - DNA, 1248 bp, Pseudomonas aeruginosa
cctctccgctgcactacgggcagcacaagacatcaccaaattcctccaaggagaatcgcaatgagcgacttcgaaaaacaaatcggcgaactgaacgccagcctcaagcaggtcggcgaccagatcaaggctcaggccgaacaagtcaacacccagatcgccaacttcggcgagatgagcaagtcggcacgagccgatgttgacaaacttctggtaacgcagggtgagttgcaagcacggctgagcgccgcggaacaagccatgctggccaacgagaagcgtgacggcggcgaggaagcaccgaagaccgccggccaaatggtcgcagagagcctgaaagagcagggggtaaccagctccctgcgcggttcgcatcgcgtatccatgccgcgctcggccatcacctccatcgacagctctggcggtgccctggttgctcctgatcgtcgtcccggtgtcgttgccgctccgcagcgtcgactgaccatccgcgacctggttgcgcctggcaccactgagtcgaactccgtcgagtacgtccgcgagaccggcttcgtcaacaatgccgctcctgtttcggaaggcactcagaagccgtactccgacctcaccttcgagctggaaaacgcgccggttcgcaccatcgcccacctgttcaaggcaagtcgccagatcctggacgacgcatcggccttgcagagctacatcgatgcgcgtgctcgttacggcctgatgctggtcgaagaaggtcaactgctctacgggaacgggaccggcgccaacctgcacggcatcattccgcaggcacaggcctacgctccgccgagcggcgtagtggtgactgccgagcagcgaatcgaccgcatccgcctggcgatccttcaggcgcaactggccgagttcccggccagcggtatcgtgctcaaccccatcgactgggcgctgatcgagttgaccaaggacgccgagaaccgctacatcatcggcagcccgcagaacggcaccactccgaccctctggcgtctgccggtggtggaaacccaggccatcactcaggacgagttcctgaccggtgcgttctctctcggcgcccagatcttcgaccgcatggacatcgaggttctggtttccaccgagaacgacaaggacttcgagaacaacatggtcaccatccgcgccgaggagcggctggccttcgcggtctatcgccccgaggctttcgtgactggttcgctgaccgccagctga

SEQ ID NO: 13032 - DNA, 534 bp, Pseudomonas aeruginosa
acgaccaggagtcgaaacttggccgagaaggcatcaccagctttgcgttccggagagtccatggctgacggcgttgagttcagcatcaccgggcttgaaggcgtgctcgagaaactcagaactcttggcccgcgcctccaaaagaacggcctgagaaaagcagcccgcagggcgatgaacattgtcagggatgccgcacgagaaaaggcgcgacttgtcgatgatcccgaaacaccagagaaaatctggaagaacatcatcactcaagagtccgccaagcaggggcggcgtgaagggggggtggtgatgaaggttggagtgcgcggcggcgctggtcgaaaccagtacagcaaggatgcaagcggaaatcctggtggcgacaccaggcactggcgctatctggagttcggcaccaagtactcgccggcgaagccattcatgcggcctgctctgtctcaaaacattgagcccgttactgaaaaattcatatccgagcttgatggcgaaatagacaaggctctaagggggaggtga

SEQ ID NO: 13033 - DNA, 276 bp, Pseudomonas aeruginosa
ataggggcctcgtccttgccctctggtgataacccccaggcccaatggacgatcttgtttctctgcgccgtcatcttcttgaatgtggacagagcgacattcagcctttccggtatgtcgatcggtaacggcgatgtttcgagaagctttgtgaccgttgctgctaatgaggtcgagcggagccttaatgattctacgacgaccgactgggtatccgctcttagtccgcttagaaaaccgaatatccgcatgagcggttcatcgcacaggctgtga

SEQ ID NO: 13034 - DNA, 894 bp, Pseudomonas aeruginosa
cccggctctcgatcggtgcggcggccgctggagcagttgcaagctgcgcggcaacaccaaccgcttcggcggttctttgggggcaagtttgatcgtttcgtcgaggtaagcatgcgcatcagtcaaaagctccagtgtcagatcctggcgcacgccgaaagcgtctacccgagcgaggcgtgtggcgtattgctcaagaccgatagcggccgagaatacgctccttgtggcaacctggcggtcagtgatcgcgaaaacttcgtcatggatcaccgggactacgcagcagcagaggaccgcggcgaagtaattgccgtcatccatagccatcctgacaaggctccgatcccgagcatggcagaccgggtcagttgtgagcttcacggattgccgtggggaatcatcgggctgccgggtggggaaatgacctggttcaaaccatcaggttatcgtgccccgttgcttggccgagagttttcccacggcttgctcgactgttggggcgcctgccgggattggtacgagcgagaagctgggttgacgctgccgaacttcgagcgcaaggacctttggtgggaggtcaaggacggatcgagcctgtacgaggacaattacgagagtgccggtttctatcgcgttgacgacctgcgccgtggtgacatgctggtgtttcaggtgcccactccagggaggccttgttatcacccgaaccatgccgcgatctatctcggtgccgatccttgtttacgaagtgaagaggctccagcactgggcggctcgggcccgttcatctatcaccacatggcgggtcgcgcggccacacgtgaaatctacggctggtccatggccaacagggtccggctgatccttcgccacaaggacttcccccaatga

SEQ ID NO: 13035 - DNA, 3864 bp, Pseudomonas aeruginosa
ccactattgctcagggcaacccatacccagtgctttacggcgagcgagagatcggcggcgccgtcgagtcgggcggggtttacacggaagaccagctctagcacgaccgctgccagaccccgcttcggcggggtttcttgtttctggagatcgaaaatgtctgttgtgaccaaaaagcgccatcagcctttgcgtggaagcaaggggggcagctccaagccgaagcagccgcacatcgcccagaacggcgtcgcatcgctgtccactgctcggatcgtgtatctcctgagctgggggccgattgttggcccagtcaatggacttaagtcgatcaagcttgacggtactccgatccaggcagaagacggcacgctgaactaccccgacgtgaagtggcagtttcgaccgggcgagttaaatcaggagcgactggaaggtgtagcggagtccagcaacgagattgcggtgggccagaccttgctcagcacgcagccctacatctacaccgtcacgaacgccacggcggatgcggtacgcgtgcgcctgtcctggcccaacctgcaggcgcaggattcgtccgggaacatcaatggggtgcgtattgagtacgcgatcgatgtcgccacggatggcgctccttaccagaccgtactcagcacgtttgtcgaccggaagaacgttacgacttactaccgttctcatcggatcaacctgccggcaggagggcactgggcggttcgcgtgcggcggatcacgccggaggcgaacagctctctggtccaggacaccatggtgctgactgcgatagctgaagttgtcgacagcaaccaggagtttccgctcaccgccgttggctgcgtggagtatgacgcccagcagttcgggggcgactttccgaagttctctgcgctcatgcgcgggcggatcgtgcgggttccgatgaactatgaccctgagactcggacctattttaccggcggccccggtaccacgaatggcgtttgggacggcaccttcaaggaggcttattccaacaatccggcctgggttttctatgacctggtgttgaacccctattacggcctgggtgagcgcatcgaccagagcatggtcaaccgttgggccctctatcgcattgcgcagtactgcgaccagttggttccggatgggaagggcggtcaagagcctaggttcacttgcaacctctatcttcagaagcaagaggaggcgtatgccgttcttcaggatctcgctgcaatctttcatgggttggcgttctgggatggtagccagatcactgtcaacgccgacatgcctcaggacccggtttacacctataccacgtcgcagattctgaacgatggtgtggttgcgtattcggggacgcggacgcgagaccgccattcgctggcgatggtctcttgggacaacccggccaatgcgttcgagacagacaaggaggcggtcttcgacgaggatgcgattatcgagcttggcgggatcgtcagggaggtatcggtcggggctctcggctgcaccagccagggtcaggcgcaacgggcggggcagtgggcgcttatgactgagcagttgcagactcgtggggccgtctggaaggttggcctggatggattcatcccgcggcctggacaggtggtggctctggcagaccccatgcttgccggtcgtgcgaatggcggcaggatctcggcggtatctggacgagcaatcaccgtagaccgagatgtggatctcccggtcggcgcgcggctgcgagtcaacctgcccagtgggcgctcggaagccagggcgattcaaggtcatgacggacgcgtcataacggtggtggccgacttcagtgaacagccttcccccgagagcggttgggcgatcgactacgacgacctggccctgatgcagttctacgtcaagaacgtgaccagaccaagttgggagcaattccagcttgaggttatccagcacgagcccggcaagtttgatgcgatcgatcacggggcgatcatcgattctcggccgatcagcgtcctgccgtccggggtgcaggatccgcctgcacgcgtattgatctcgcagcacatcgcggtcgagcaaggcctggcggtcacgatcatgaccatcgcctgggacgcggcaccggacgcggtagcgtacgacgtagagtggcgctggggctcgcgcgagtgggtcagggttccgcgtacgggggagctgatggtggaagtgcgtggggtatacaccggccagtaccttgcgcgcgtgcgggctgtgaactccatgaacgtgtcgtcgatcccagcgaactcggtgttgaccaacatcaccggtaagaccggcgcgccgccggcgctggcgttcctgcgtaccaccagcggaccgtggaagatcggcctggagtggggattcccggccagtggcgcggcggacaccgcctacaccgagatccaacagtcggttaccccgggcggcagcgaacagaacgcaactgccctgggcttgttcgcgtacccgaccgacacccacacgctgacctcgctggcggccggcgctcgcctggccttccgcgggcggctgatcgaccggacaggcaacgtcggcccctggtcggcctgggtcgacggtatcagctcgacggatgcgagcgagtacaacgaactgatcaccaaggagtacgtcgagtccgcgctgggcgagcagttcttcgccgacatcgatcagatgcaggtcgatatcagtggcctgcagggccagatcgataatctgtccgatgtgctggcctacgacccgacgaagacctacgcgaagaacgatatcgtgcgggtcggcaaccggctgtatcaggcaaagcaggcggtgccgctcaacgcctcgccgccgaacgcgtcctactgggccgacatcggacagtcgatcgagacggccaacggcctggcccagcaggtggccaccaacaccgcggatatcaccgagctcgacggtaaggtcgaagcggcggcttcgagcctggatgttctgcaggctgccgcccgccgggagccggcgaccggagagaaggccgatgcgctgaagggctgggacaccattgctcgagccgccaccgaagtcaccgtgcgggcgaacgaggacgaagcgcaggcgaagcggacgagcttgcttgaagcgcggactgtgacggcggagggcaggatcgcaaccgtcgagtcggtcgttgcgtcgaacaatgccgtaaccgtccaacgcctggatcagctatccggccaggttgcgagcaacgcctcggccatcagcaccgaacagaccgtccgcgccaacgcggacagcgccctggggcagcggatggataccgtcagtgcgcgcaccgataccaacgaggcgaacatccagaccacatctcaagcggttacctcgctggatggaaacgtcaaggcgctctacagcgtgaagctccaggcgcatgccaatggccagaagtacgccgctggctggcaactgggcttcgacagcggtacgagcgtgacgaccatggcgttccaggctgatcggttcctctggttcaacagttccagcgggcagaccgtggcgcctgtctcgatcgtcggcggccagatgttcatcaacaacgcgatgatccaggagggctcgatcaccaacgcgaagatcggcaacgtgattcagtcgaccgccctcggtgccaacggcgagccgctgtggaagttggataagggcggcgcgttcacaatgaacagcgcaacgtcgggagggtttatgcgtcagacggcagaggcaataaaagtgtatgacggaaacttggtgcttcgagtccagatcgggaatcttgatgtatga

SEQ ID NO: 13036 - DNA, 333 bp, Pseudomonas aeruginosa
cagggtcgtcgccatcgggaggtggttctgatgatcatcaagttgtcaccgtacgcaccactgccaggcagcgacgagcgcctgtcactgagcagagatggcgatgtgctcatcgtgaatggccaggcgttcgacttcactccgctcccggacggcggtgaactgccggccgaggctatcgggtcgaagtggtttgctggtcccgcagtgcgacgtgccggccggctggagctgagtctgcggttcccgctggccgatgatgccagtgccgctgctcgcttccctgaaccgctgctgatcgatgccgatggacctgtggagttaccgcgatga

SEQ ID NO: 13037 - DNA, 1035 bp, Pseudomonas aeruginosa
ttacaaggcggcagaattctacctgaagtgaggttgtctatgcccatcaccgagcagcaactgctgcatatcctcccgaacgccggccctcgagccggcgtttttgttggtgcgctgaaccgcgggatgacgcgcttcggtatcacgtcgcctgtgcgcgcggcggcgttcctcgcccaagtcggccacgaaagcggccagttgacccgcttggtggagaacctcaactacagtgcccgtggcctggctgcgacctggccgagccggtacctcggcgccgacggccagcccaacgccctggcgcagcgcctggcgcgcaacccccgagccatcgccaacaacgcctacgcctcgcgcaacggcaatggcgacgaggcatcgggcgacggctggcggtaccgcgggcgcgggctgctacagatcaccggccggtcgaactaccgcgccgccggcaccggggctgggccagccgctggagcaggaacccgaactgctcgagcagccggagtgggcggcgatctcggcggcctggtggtgggccagtcacggcttgaacgacctggccgaccgcggcgagttcgccgccatcactcggcgcatcaacggcgggctcaacggccaggcggagcgcctggcgctgtgggagcgggcgaagagggtgctgtcgtgatctccgcccgcgctttatcggtcgcgctggcctgcctggtgctggtcggcctcggcaccgccggcggtgtctggctcggcgcgcgacactaccggccgcagttggatgccgcgagcgcggatctggctgcctgccgtgcctcccggggagagttggagtccgcagtggcagagcaggtccggcaggttgccgcgctgcgcgtggccggcgaacagcgggcccgggatgccgcgcaggctgtggatcggggacggcagcaggccgcggagcagtatgccgaagcccagcgcctggtacgtgagcgaaccgccggtgagcagtgtgcggccgccgaggcggtcattgatcaggagttgggtctatga

SEQ ID NO: 13038 - DNA, 408 bp, Pseudomonas aeruginosa
agaagagcgacgacctacagaccaaggtccgcgcgctgctcgccgaacgcttgcagcggatcggttacgaggcgcagctcctggctgcgaaccgggcctgtcaggattaggagtagactacggccttttcctacggagcagggcatgctggtcattcgattcaggggctggtcggtgaaactcgaccaccaggtgggcagcgctggcaagttcggcatctggtcgttccacggctcggagagcagctacgtgccggacatgcagacgattctccggcatgctgctattcggcctgcggagccgaaagaaggcggggaggtcgaggtattcatctgtgattcgcgcatgccgcaggatgagtggcggcctgtcggtagcggcgttgcggcctacgagtcggaccgctga

SEQ ID NO: 13039 - DNA, 1026 bp, Pseudomonas aeruginosa
tatagtatcccggcgcttgaaggcgccgcggatgtgtggccgagctgcatggcacggtttccttccgacgggcagccaggttatcggtttgtgccgagtcccggatccggggctggggaagaagaaatgcgtccgctcgtttccgtcgtttgcccctgtttcaatatctcgaaatatctggacgaggcgatcgccagcatctacgcgcagggttatcccaatctcgagttgatcgtggtggatgacggatccacggacgacacctatgagcgtctcgccatgctccgcgagcttcacggtttccagctctaccgccaggctaaccgaggggtgagcgatgcgctcaatcacggtttgcgtcatgcgcggggggagttcgtgatgactcccgacctcgacgacattgtcctgcctggagcgctcgacacgcgcgtcgactacttgcttgcgcaccccgaggtcgggtgcgtgggcggtttcaatatctgtatcgacagtgccggtaacgaagtggcgcgagacggtttcagcgagggttgtgtggagcgttgggggttcgatgcagcattggccgagaccctggtggtcatgccgctgacggcgctctaccgcatggacgcgatgaagcgggcggatttcttcgacccgtcgattcgcgtgcaggatttccagatcaccctcaggatcgcggcgcagggctatgaaattcatcgactaccggcctacatggggcgttatcgccggcatggaagcggtctgtccggcaggtacaagctcaattacgaggcggatatgcaagccatcgagccttatcgggctcacccgaattatcgccgggcccggcaactgatcctgaacaaggcgctgaagaaggctgttgtccaggatgggcgatatgcctggcagctgttccgctcggtgccgctgcgggcgtgggaccgggtgacgctgaagcgattctggcgcttcctccgttatctgccggtcctcgggttgaaaggtggtaccgacgtcgcgggtcgataa

SEQ ID NO: 13040 - DNA, 1353 bp, Pseudomonas aeruginosa
tctcgagtgggttcccgccagcggcctgggtacgctctacgcgatcactgtcaatcgctcccgcggcggcaatcacaatgtcgcgctggtcgacctggacgagggcgtgcgcatgatgtcgcggatcgacgggcaccagagcctgccgatcggcacccgtgtgcaggcgcgcatcgtcgagcaggatggtgccaatgtcgtggtgttcgttccccaccaggagggacgaccatgagcgcagccatccgtggcaagaccgccatcgtcggcatcggtagcgccggcgtcggcgaggcgccgggctacagcgccatcgaactgctcggccaggcgtcgctcaaggccattgccgatgccggcctgaagctttccgacatcgacgcgatcttcgccgccaccagctcccatgcctttcccaccttgtcggtcgccgaatacctcggcatccgcccgaaattcgtggatggcaccaatatcggcggctccagtttcgagctgcacctgctgcaggccactttggcactggaggccggtctctgcgacgctgcgctgatctgctacggctccaaccagcgaaccgccggcggccgcctggtatcgatgagcgagccacaatggcacgagacgccctacaagccgcgccacccgatcaccgcctatgccctggcggccagccggcacatgcaccagtacggcaccacacgcgagcagctcgccgaggtggcggtctctgcccggcaatgggccaacctgaatcccgaggcgttcgcccgcgggccgttgagcgtcgatgacgtccttgccgcgcggatggtcagcgacccgctgagtgccgccgactgctgcctggtcaccgacggcggcggcgcctgcgtggtagtgcgcgccgagcgcgcccgcgacttgcccaatgcgccggtgtacttccttggcgcggccggagcgcagtggcatcgctcgatcgtgtcgatgcccgacctcaccgtgacggcggcctcggaaagcgctccgcgagccatgcagatggccggtgtgcggcacgccgacatcgacctggtgatgctctacgacgcctttaccatcaacaccctgctgttcctcgaggacctgggattctgcgccaagggcgagggcggcccattcgtccagggcggacgcatcgcgcccggcggcgagttggcggtgaacaccaacggtggcgggctgtcctgcgtgcatccggggatgtacgggatgttcctgatcatcgaggcggtgacccagctccgccgccagggccggcgagcggcagtggggccaaggccgacgtggcgttgctgcacggcaacggcggcacgctgtccagccaggtaa

SEQ ID NO: 13041 - DNA, 987 bp, Pseudomonas aeruginosa
  unsure (29),(37): Identity of nucleotide at the above locations are unknown.
ccgcgttgctcggtaccggcgacacgctntagacccntggccgacaggcattccgggcgctgccgtggcggcgtcccgcgggcccgctcgcccgcgagaaggttgtcgtgccggccacagacaaacggatcaggtgaacccatgtcagcgaaccactcgcaacaggtcatcgacgctccccgtttcgccagtcttactccattgatcgaaccacgctcggtcgcggtgatcggcgcttccagcgacccgacccgcatcggtggccgacccatcgcctacatgctgcgccatggctatgccgggcaaatcctcccggtcaatccgaaccgtgctgaaatccaggggctaccggccttcgccagcgtcgcggagctgccgcaggcaccggacgcggccattgtcgcggtgcctgcgcctcaggtgctggagaccgtccgggcactgggccgccagggggtgcgcagtgccatcgtgttctcttccggattcagcgaggtcggcgaggccggcgcggcgatgcaggatgcggtggtagccgctgcccgcgagtacggtatgcgtctgctcggtccgaatgcgctgggcgcgttcaacagtaacctcggttactacgcgttcttctccaccagcctggaacgtggcgtaccgctgcccggccgggtaggcatcgccacccagtccggcgcctacggcgcgcacctgctcggcatggcgcgccagcgccgcctgggaacccctatctgcgtggccaccggtaacgaggccgacgtcaccctgggcgacagcatcggctggctggtggagtcgccggagatcgacgtggtgatggcctacgccgaatccatccgcaacgtcgacagcttcctcgccgccctggaggccgcgcatcgcgccggcaagccggtgatcctgcacaaggtcgggcgcagcgccctgggtagccgcgcggcgctgtcccacaccgcttcgctggccggcgacgactag

SEQ ID NO: 13042 - DNA, 1077 bp, Pseudomonas aeruginosa
gtgctggacgccgtgctgggcgactatgcggtgatccgcgccaggaccaccgaggaactgatggacatcgcctacctcgccacccgggcgtatctatccggtgggcgacagcctccgcatgatcaccgtcagcggcggcgccgggatcatcgtcagcgatgtcgccgaggaagtcggcctgccgatgccgccgatgccggacatggcccaggagcggctgaaggcacggctgtccttcgcttcgccgatcaacccggtggactgcaccgcgcaggccctgaacgacctgacgctggtgcgcgactttaccgagtcgatggtggtcgacggtggctaccgttcgctgctcgccttcttcacccaggccggcaccgccgcctccatcggcgcgcgtctggccgagcagttccggcggatcaaggaggctcatcccgagcgtctgttcgtggtctcggtgatgggcgagggggaggagctggcaccctacgaggaggccggcttcgcactgttcgaagaccccacccgggcggtagtggcgatccaggccatggggcggctcggcgaagccttcgcccggccgttgcgcctgcgccggcctgccggcgggctacagttgcccgcctccacgcccggcgaagccgaggccaagcgcctgctggcgcgcgccggtatcgagtccgccgccgaggcggtgctgggcagtgccgaagaggcggttgccttcgccgagggcatcggatacccggtggtgctgaagctcgcctcggcggacatccagcacaagtcggaaatcggcggcgtgctgcttggcgtaagcgatgcggacgcggtacgcgccggtttccaactgctcctgcgccgggccgccgagaaggcgccgcaggcgcgtctcgatggcgtcctggtggcgcgccaactgcagggcggggtggagtgcttcatggggatccagcgcgatccgctgttcggcccggtggcgttgttcggcctgggcgggatcttcgtcgaagtgctgcaggacgtggtgttccgccgctgcccgttcgaggtcgacgaagccgaggcgatgatccgtag

SEQ ID NO: 13043 - DNA, 507 bp, Pseudomonas aeruginosa
acaagggcgccgacaagggcgcgctgctctacagcgagaaggtgctcagcgacgcgctcagcggcgaggtgctggctgtcgcccgcagcaccaccttccttcgcggcgacggcggcttcggtggttcccggcaggtgccggaaacgccgcatcgcttgcctgaacggacacccgacctgcgactcgacctgccgacccgtccggagcaggccctgtactaccgcctcaacggcgacgacaacccgctccacgcggagcccgcggcagcgctgcgggccggcttcccgcggccgatcctgcatggcctgtgcaccctcggcgtggcattccacgcggtgttgcgcgggctcgccgactaccgcgcggggcaactgggacatctgcaggtgcgtttctcggctccggtgtttcccggcgagaccttgcgtaccgagatgtggagcgacggctcgttccgcactcgcgtcgtcgagcgcgatgtggtggtgctggacaacggccgggtag

SEQ ID NO: 13044 - DNA, 414 bp, Pseudomonas aeruginosa
tgtccgagtgcgtcggaaccaggtaccgcaccaccatcctcgccgccatgcaggccggctggaccgtgggctacctggtggcgaccctgctggcggggcagatcatccccgagttcggctggcgcgccttgttcttcaccgccgtggcgccggcgctggtctgcctggccctgcggccctgggtgccggagtcgccgtcctggctcgcggcccaggccgggcgccagcgtcccggcgcggctccgcagagccacgccgaggctggcggcgccggcccgctgggacggatgctgggcgatccggaaacgcgcggcatgttcctgctctggagcctcacctcctgcttcctgctgttcggctactacggcaccaacaactggatgccgtcctacctggagagcgagttggggatga

SEQ ID NO: 13045 - DNA, 1089 bp, Pseudomonas aeruginosa
tttccaggcgctgcagcaccgcatggtcgacctgaggatccagatcgaactgtcgcgcgccatggtcgagcaggccgccgccgcgatcgatgccggggcgtcggaaagcgagcgccagcggcaggtttccagcgcacgggtacgggcctcggaagcggctctgctggtgacccgccaggccatccagttgcacggcggcatcggctacaccgacgaggcggacatcggcctgttcctgcgccgcgccatggtactgctcaatgcccacggctcgctggcgttccacaaggcgcgctacgccgcgctgctacagcgggaggtggcctgatgagcggtttgttgcaggaaacgcgcggcacggtgcgcctgctgcgcttcgacaacccggcccggcgcaacgcactgtcgccggcgctgcgcatggaattgctgcgggccctggaggcggccgaatgcgacccatcgatccgcagcgtgctgctgaccggtggcgaagaggtgttctgcgccggcggcgacctgggcgacatgcgggtgaccgagttggccgccggcagggcgcgaatgcaggacaacgcgcggctggtgcggcagatggtgcgcatgggcaagccgctgatcgccgcggtcgagggctgggcggtgggggccgggctgtccgtggcgctggcctgcgacagcatcgtttgcggcgccggcgcccgcttcgccgccggcttcggcaaggtcgggctgctcgccgacctcggccagttgcataccttgccggcgcgcatcggttgggggcgggcacggcagatcctgatgttcggccaggtggtacaggccgaggaggcactgcgcatcggcctggccgaccgcctctgcgccgctggcggcgccttggcgatggcgctggagctggccgggcgggtggagcagcaggcgccgttgcccctggcgatgaccaaggcgttgctcgccgagggccttgacctattgctggagcgggagggcgagttgcagagccagttgtttctcagcgccgaccacgccgagggcaaggcggcctttctcgccaagcgtccccccgtattcagaggaaactga

SEQ ID NO: 13046 - DNA, 1620 bp, Pseudomonas aeruginosa
acaacgaggttccccagggactgtcgtcgtgcatcttcaccaccgacctgcgcgaggcggaactgttccagggcgcggcgggcagtgactgcgggatcgccaacgtcaacatcggcaccagcggggcggaaatcggcggggcgttcggcggcgagaaagagaccggcggcggccgcgagtccggctcggacgcctggaaggcctacatgcgacggcagaccaacaccgtcaactattcccgcgagctgccgctggcacagggcatcaccttcgattgaacggggcgcggcgggctcccgccgcatggcaatgaggctggcagcggagtcgcgcatgggcggtttgcagcaacggtgtctgtgggaagtggttacgcctcgcctgtccggagcggcgagcctgaacggcgagcagcgcgccgacgtatgtgtgatcggcgccggtttcaccgggctttcggcggcgctccacctgctggaggccggccgttcggtgtgcgtgctggaagcgtacgaggtcggccacggcgggtcgggacgtaatgtcggattgatcaacgccggcacctggattcccccggacgaggtggtcgccaccctcggcgccgagcagggagaaaagctcaacgccgtgctggggcgggcgccggcgctggtgatggagaccatcgaacgcctcggcatcgattgccagttgcgccgcgagggcaccctgcacatgtcgcacaacgccagcggcgtggccgatctgcaacgccgtcacgcgcagtggacgcgccgcggcgctccgctggagttgctgaccggcgcggcttgccacgaggcctgcggcacccggcgaatcagcgcggcgttgctcgaccgacgcgccggcactctcaatcccatggcctattcgcgcggactggccaccgccgtcgtacagcggggcggccaactgtaccagcgctcgccggtgctcgccctggagcggcagggcgcgctgtgggcggtgcgcagtagcgcgggggcggtactggcggaacaggtggtgatcgcctccaacgcctataccgagggcgagtggaccaacctgaggcggcacttctttcccggctactactaccaggtggcttcggcgccgctgcacggcgccgcggccgagcgcatcctgcctcacggccagggttcctgggacaccaggacggtgctcagcagcatccgtcgcgatgcccagggtcgcctgttgctgggaagcctcggcaatggcgcgaacaagcccgcctggttcctgcggcaatgggccgatcgaatccagagccattactttcccgacctgggccaggtcaactgggagtacagctggacgggttgcatcgccttcacccccgatcatctgatgcgcctgttcgagcctgcggaaggcttgctggcggtgaccggctacaacggacgcggcgtgaccaccggtacggtagtgggcaaggcgttcgccgactacttgctgagcggcgagcgagcgacattgccgttgccgttcagtgacatgaagcccgtccccgcggccaggctgcgcagttgcgcctacgagatgggtttttctctctatcacgccggtcaatgcttgcgcgtggttctctag

SEQ ID NO: 13047 - DNA, 399 bp, Pseudomonas aeruginosa
tttgttgtaaacacacatgaggaggtcgtcatgagcgctctcatcaaggaacgtcccagcgccgatgccgtcctggccaaggccgtcctggccgcgcgcgagcaattggggctgacgcagctcgaactggccggcatcgtcggcgtcgatcgcagcgccatcagccgctggaagacccagggcctgcgggtggacagcaagaccggcgagctggctctgctgctggtgcgagtctatcgcgcactgtatgccctgttcggcgggcagcaggaggacatgcgccacttcctgcgcactcccaaccatcacctggcgggcgagccgctggcactgatgggacaggtgcagggcctggttcatgtgctggaatacctcgatgcgatccgcggcaaggtctga

SEQ ID NO: 13048 - DNA, 753 bp, Pseudomonas aeruginosa
gcgagatctggcgacagtgcaagggtgagcggcatatccgaccgctcccaggggcgcctggtgcggttggtggagagccaggagcaggtggcgaccctgcaattggtcgacaccctggaagaacaggcgttgctcgaggaactgctcgagtcgagcaagccgccggtgccggcggatgccgagccattgcattacctgttgaagaccccgttccgttatccgcccttgcgctgggggtcgcggtttggccgtcgccacgagccaagcctgttttacgccgcgctgaagctggaaacggccatggccgaaagcgcgtattaccgttgcgtcctgtggagtggcatggtggtgccgccaccgagcgggaggattctgtccgagcacgcttcgttcgaggcgggctggaaggtggagcggggaatccgtctgcaggcgccgcctttctccgatcacgaggctgcgctgaccgacatcgccgaataccgcgctccccaggaactgggaagtgccatgcgcagcgccggggtgcaggcattcgaataccgttcggcgcgttgcccggagcgcggctgcaatgtcgccctgttcacgcccgcggccttcaccgaaaagcgtcctcgcaacctgacgccctggctgtgcgaaaccacggccggttacgtggccttcaagccggcgcatgtgccggggtcgccgaaaatcttctcctgggagctgttcctggtggacggaaagttgccgcatccggcgtga

SEQ ID NO: 13049 - DNA, 396 bp, Pseudomonas aeruginosa
gccgcgatgtctcgctgttcggcacggtcggcgcgttccccgtggagtacagctcggacaccgcctcgtcgaacggtttcgacaaggaagacagcgacaacaagtggatgtacggcgcgcaattgggcgccacctggaagatcaacccgcagcacagccttaccggcgcgctggcctactaccgcttcgacgatatcgaagggcggcgttccagcccctgccggccctgggccggagatccggagtgcgacaccgacggcagccgtccgaccttcatgcagaagggcaacacggtgttcctcctgcgcgacatcgtgcccaacccggccgacccggcgaacacgccgaacccgcagtacgtcggcctggcctcggagttcaatctgctcgacctga

SEQ ID NO: 13050 - DNA, 1152 bp, Pseudomonas aeruginosa
acctcggctgggatgccgagctacccaacgacttcaagctgcgggtggccggcaactacgtgcacaacctgggctacgacgagggcgacatgcgcaagcgcgccggcggtgtggcgcaaatcgccaacaacctcggctccgacggcgacatcaagagcggggcgaacgcctggatgctccagttcaccctgggcaacgccctggacatgcgcgacgccggcgactggcaggtcttcgccgcctacaagtacatccagccggatgccctgccggacggtttcaacgattccaccttccaccttggcgggaccaacgccaagggctacatcctcggcgccagctatggcttcgacaagcgcgtctacggtaccgcgcgctggctcagctccgacgaggtctacggcgcaccgttctccatcgacgtcctgcaactcgaggtcaacacgcgcttctgagcgctcctcgaggcagaccatgaagaggcagaccatgaacacgcgacctttctcattaccgatctgggcccaggcgctgctcgccggggccgccttcgccgcctacgccagccaggcggcctacgccgacagcctggaggaacgcctgcgcgcccagttgcgcagcaccacccagcaactccaggcgctgcagaccgaacaggcccaggccaccgcggcgaaagccgcgctggaaagccagcgcgatgcggcgctggcccaggtcaagcaactgagcgccgagctggcccgggccaagggccaggccgagcagctctcggcccagcaacaaggcttgcacgaccgggcgcggcagatggtcgaggcgagcaacgagcaactgggcaagtacaagcaggcctacgacgagttgctggtcatggcgcgagccaaggaggccgagcggcagaagctcgacctggcgttccgcgagcacgaccagcagttgcagcagtgcaccgcgaagaatcgggagatgtatggcgtggccaaggagatcctcggcgcctacgagaacgtcagcgtcgccgaggtgatgaagatccgccaaccgttcgccagcggtgcgcgggtgaaattcgaagagatggcgcagaagctcggcgacgacctctacaagacccaggtcgagaaccgccaggcggcgctcgcccagtga

SEQ ID NO: 13051 - DNA, 708 bp, Pseudomonas aeruginosa
ccgacaccgtttcgccacggaacggttgacggaaggtacgcgatgacggagcggcattggcagggcgaggtctggctggcgcgggaccacgcgctgttcgccggggtcaacggcgatacccgcgagcacgcgcactatgcccaccagttgctgctggcggagacgccgctgcgggtgcgcgtcgctggccaggtactggaggcccggcgcttgctggtgccctcgctgcaagcccattgcgtcgaagcgtcgcagccgttgctggcgctgtacgccgagccgctggcgttcgacagcgacgacctgcgtcagcttctcgaggacgctcccggcgagcccgaggcgttgctggggcggcttgcgcggctgcctcgtcgacggctcgaccgccgcgtcgaaaaggccctggcggcgctcgacgagcaactcgcggcgcgggtcgaggcggaaagactggcgcgcagcgccagtctttcgctgagccaactggagcggctgttcgccgtccaggtcggcctgtcggtacgccgcctggtgctctggcgccgcctgtacctggccttcgccctggccttgcaggggcgcagcctgaccgaggcggcccatcacgccggctttgccgacgccgcgcacctgtcgcgcagcgtacgcagcctgctcggtatccgcgccggcctgtcgctgccgcacctacgcctggccggctga

SEQ ID NO: 13052 - DNA, 573 bp, Pseudomonas aeruginosa
atgaggtccccagcgtcgctcgcgacaggccggcggcgcttgaacgaaccgcgcaagttctcagtcgcgcagcaccagcggcgcgcctcccatgtccccgcgacccggccaggtctcgcgggccagccaggccccacccaggcagaccaggttggccagcagcaggtagcccagcggcgacagcggattgccggtgacgccgatcagccaggtcaccacgatctgcgcggtgccgccgaacgcggcgacgccggtcgcatagaccagggaaaaaccggtggagcgcagcgcccgggggaagctttctaccagcagcacgatcagcgccgcgccgctcatgccatgcagggccgagagcagggcgaggacggcgaggaagactgccggctcggggtgacgggtcattgcctgcagtgccgggaacagcaccgcgagcagcgccaggcgcggcaggatcagcacggcgcggcgcccgtagcggtcgcagagcacgccgccgagcaacgccgagagcgccagtgcggcgccggcgaccagcgtcgagagcatcgcgatgcccgccggcaggtgtag

SEQ ID NO: 13053 - DNA, 1011 bp, Pseudomonas aeruginosa
ctcggtaagggcgaaggtggtcatgtagttgaggaagtactgggtgatggtgcttccggagaggatcagcagaccgagcagcagggctcgccgatgattgccgaacaattcgccgagcaggctccgggtgctggcctggcggccgcgtccggcaaaggtctcggccaggttgaggcggatgtacaggccgatcggcaggaccagcaggccggccgcgaagggaatccgccagccccattcctgcagttggcgctcgtcgagccagagggtgagcaggtagcccatcagcccggcggcgaccgccgcgatgccttgcgctacgacctgccagcaggcgtaggtgccgcgcttgtgcggcggtgccgcctcgaggatgtaggtggtcgccggcccggcctcgccgccccaggccaggccttgcagcaggcgggtcagcaccagcagcagcggcgcggccgggccgatgctgtcgtagccggggagcaccgcgatgccgccggtgcccagcgccatcaggaacagggtaaggagcatcgccggcttgcgcccggcgcggtcggcgtaggcgccgataaggatcgcgccgagggggcggatgacgaagccgacgccgaacgcggtgaccgacaggagcaggctgacgaaggcgctgtcggaggggaagaaagtccgtccgatcatcaccgcgaaggtggcatagaccccgaagtcgaagaattccacggcgttgccgaggaccacggcaaagacgctgcggcggctggccggatcggcggccgctgggggacgggtgggggagcgcatggcgaaggccctctcggagtgacgactgaaacactcaggcctggagccgagcgacgagcggccgccggcttcagtcagccggcggccggggccagccgtggatcggaccgcgccagccttcgtaggtcttgccgatgcgcaacagccaggtatcggcgaagcgcggcgcgaccagttgcaggccgatcggcatgccggcggccgtga

SEQ ID NO: 13054 - DNA, 798 bp, Pseudomonas aeruginosa
  unsure (606),(670): Identity of nucleotide at the above locations are unknown.
aaggccaccctagcatggacctcgcgatcgcttccaaccccatttcacgaggaaagattccatgacctaccacgtactggttcagttcgacgttccctccgacaagcgcgaagcgttcgccgcggcaggcctgttcgatgccaatggctcgttgcagaacgaaccgggcaccctgcgcttcgaggtgatccgcgacgagaacaaccgcaaccgcttctacctcgacgaggtgtacgaagacgaggcggcgttcctccagcattgccgcaacgaaaccatcgcgcgcttctacgaactgatcgacagctacgccttcggtccgcttttcctgttcaagggctaccgcatcgagggttgatccccgctccggcggctcgccgccggattccacggagaatttccatgcgaatcctgcacagcatgctccgcgtggccgatctcgaggccgcgctggagttctacacccgcgccctggacatgcgcctgctgcggcgccgggactatcccgaaggccgcttcaccctggccttcgtcggctaccaggacgagcgcgcggccgctgccctggagttgacccacaactgggaccgggacggctacacccanggcgacggctacggccacctggccatcgaggtcgaggatgccgccgtcacctgcgcccgggccnaggcgctgggctatcgggtcacccgcgaggccgggccgatgcagcacggacgcagcgtgatcgccttcctcgaagacccggacggctacaaggtggaactgatccagaagggcacccagttcgattga

SEQ ID NO: 13055 - DNA, 708 bp, Pseudomonas aeruginosa
gcaggcgccggaccaactgcgaaccgagaccctggcgctgccgctcgggcgccactgatagcggcgcgaggccgtaccagtcgcccgcttcgccatcgatggtcactggtgaggccgcgatatggccgatcacctggccgttcgcttcggccaccagcgaaagcgtcagcgcgccggcacggcgcagggcgtcgacgatgtactgctcggtatggctgctgtgcgtttcgttgcggaacgcggcttcggtcaggcgggcgatggcgtcgatgtcgccgggcgtttccgcacggatggaaatattcatgcaagcactcctcggaacccccgccttgtcccggcgggggcaatggaaaaggaagggggtcagcgattgtccgcctgcgggcgcacgactttcagcccggccatggatatccggtagggcctgccctggcgggagtggaccaggcccttgttcttcagcctggagaacaccgccagggtgcagtcgagcagcaggtggccgtcgcggttgtagcactcgacgcgggtgatcttgcccgaagcgtcgcgaaggaaggcgatatggccgccctgggccaaggcgtgaagcgtccgttgttccggcttggaaacgttcatgtcggtagaacctgtaatcatcggtgtgacaacgcggccgcactgcgcgaaaaggcgcgtgcgagccatggcgaaggcagataa

SEQ ID NO: 13056 - DNA, 525 bp, Pseudomonas aeruginosa
cgaagtggcggttatcggatgactactatctccaacatgcaagcctcggatcggggaggggcgcagccacgaaagcgtgccgcgatgcggcagtctaacgaagctggcgaagcgacggcaaggaactgcctgcgtcgccatgccgctgtgcgacgcttgcgcctttgtgagggagttcgcctcgccccgcggcggtccgcgctttcattatcgggggaggcgggggtatccatgtttcgcacggcgctgatgctgttcatgtcttcgttggcaattcctgccgtcgcctcgatgagatgcggcacgcatctggtggacgagggcgacagcgtcgagcaagtcctggaaaggtgcgggcaaccgctgagcaggatcgtcaacgagcctgccctgcgcaacaacggcgtgcccaagttgaatgccgcacgcaccgaattctgggtgtatggccccagtggaggcgtctaccgacacttgcgcttcatcgatggcaagctggtcgagattcggctcgagcggaagtga

SEQ ID NO: 13057 - DNA, 2031 bp, Pseudomonas aeruginosa
acaacttgccgactactttttaagcgatttcgtcggattgttcggtgtttccgtggcgatcaccgtgaaatcggagtcgctgtgggtgtcccgggtcgaggcccagtcggtgatcaccagggtgctgccgacgtccatggcaccgagcatttcgcggacgaaggtcgggtccatgcggatcttgcccagttgctcggagggtgtcaggccctgtcccgggttgctcacctggaccaccgaccagcgcaggttcggcgaggtctcgctgatttcttccggggtcggcttttccagcagcgagaacaccgccatgccggtctgcgggcgtgccggcaactgcaccggtgcggtgccgatgcgctggccgccgcgatagacataggcgcgctggtcggcgcggctgatcagcaccgacaacggaccgcgttccgcgccggggtcgttccaggcgatttctccgggctccaccggcagcgtcaccggtcgcccgtccgctaccgtcggtgccagcaggccggggtggtcgacttccttcggcgcgctgctggcgttggaaatgattaccgtggtggagctgaatccggtgatgccgtagagtttcttggcgaacgccatgggcaggcggatgcagccgtgggaggcgggatagccgggcaggttgccggcgtgcagggcgatgccgtcccaggtcaggcgctgcatgtagggcatgggcgcgctgttgtagaggtcggacttgtggtcgacgctcttttgcaggatcgagaacactccggtcggggtctcccggcccttcttgccggagctgagggtgctgaccccgatggcgataccgttgcggtagatgtaggccttctgttcggtaaggctgaccacgatggtcactggtccctgcggggaaacctccgggtaccagaggtactcgccgggcttcatgctcttcagccgcgccttgatgtcggccggcggcaaaggcgcgttcgctgggctggcgggcgccgcgtggaggctgccgacggcgaaggccagcagcagtacggcaagggatcttttcattggcgctttctcttgctccatgcgggaaaggctgtcgctccgacagatgccattcagcttagcgtcgctcgcgacggccggccaaacccctgcggtccggcctctttcggtggacaggcggcgggcggcggggtttcacaccgaacagatttcttcagcattcagggggcgccaggcacccggcggcaactgcgggtcgagacaaatatcgcccatgcgctcgcggtgcaggcgcagcaccttgttgtcgaagtggccgaacatgcgcttgacctggtgatagcggccttcgtgcagggtcaggcgggcgcagcgtgggccgatcggttcgagctgcgcggggagggtgaccaggtcttcgaagcggaagtggaggccggcggcgaaggcatccacgtagcgttggtcgatgggcgcctcggtttccacgtagtagaccttgtcgcgccggctgcccggcagggtcaggcggcgcgaccactggccatcgttggtcagcagcatcaggccggtggtgttgtagtcgagacgaccgccaatgtgcaggtcgtcgcgcaggtcttccgggaacaggtcgaggacggtcgggtgttgcgggtcgcgggtggcgctgacgcagcccatcggtttgtgcagcatgtagtagcgcgccggcttgccagcctggagcagccgctcgtccagttccacccggctgaacacccgcacctcgtgggtgccgtcgcgcaccacctggccgtccacgcgcaagcgtccaccggcgatcagcatctgcgcgtcgcggcggctgagttcgggcaggttggcgaggaagcggtccaggcgcatcagtcgtcggcgtcgggcggcagcagttgcgcgcagcgtgggcagaggcaggcgcggcggcgcagctcggcgggaatccgctccagcacggccgcatcgatctccgtggtgaagcaccagcaagcctgggtggcgctagcgggatag

SEQ ID NO: 13058 - DNA, 1743 bp, Pseudomonas aeruginosa
gccccagttggccagcaccagcatcggcaggaacaggccgagcagggcgaacacccggtagatcacggcgaagccgctgaagttgcgctgctcgaagcacagcggtacggcgaagatcagcgcggcggcggggaagaagttctccggtcgctcgcctacgctcagccagtagccgccgccccaggtaccgacgcgcgcggcgatgaaacccatcacgcagaggatcgccgccgccagcagcaggcgggcgttgcacaggtaggccaggagcagggcgtagagcgcccagggcaccagcgccaggtcgctgggggtgacgttgaatatctgcccgagcatggtcaggtcgaggacgaagcaggcgaacgcgaccatcgccgccagcttgctgaagtagcccgaggcgtccttggcctggacccagagcgtggcgaagaacgcggcgaaggcgctgccgatcaggatcgccacctgggcgacggtggggaacaggccccagaagcgatagaacagcaggaacacgctggcggcgaaggccagggcgccgaagaacgaggctacccgcatgcccagcgaaagttgctggctgcgcaggtcgtggtcgatgtcgaaacggtcgcggtagctgtccagcagggccaggtgatagtcggcgagttgccgggcctgggccggttcgaggcggaacgcctgctcctggtcgaggcgttgcagctcgcgctggaacaccaggatgtcgttggcgcgctgctgtgcctgggcgcggtcgatgggttgcatgcatgctccttgagcggttccggcggggccggcagtccttggtccgcgcactctaccgagaaacgccggctgcggtcacgttctggaggcccgtgtcgttggtcggattcagggaatttccgttttttccttcggtctctattgcagccgggttgcaaccgccgcaaccggcttcccgctccatcgggatcttgtccaggcgtggttcggctgcgttctgcgatgaaggagaatgctgatggtcatgcgattgttcgggctgctactggcggccttcctgatgagcggttgcagcgttcgggtgccgggcgcctacgtcgaactggatccgttcgacgatggctactacggctacgatcgcggcggcccgccccattgtcctccgggccacgccaagaaaggctggtgctgagcccacttccatttcccgagtcttcacgtcgtatgcgcgcctcgcggcgtcgccggtcgtccggccggtcggcagcggggccgcaggaggctgccatgtggcgcacattcctgagagtcccgcttcttctgcttctcgccagcctgggtggctgcgcggtgtatgactacgactacgatgacggcgattggcgccactatcgcggccagccctacggctacgcctacgaagtgccgcgctatcgcgtgtatgacgatggctggcgcagcgaacggcgctactactcgacgcgctactacgaccaacgctactacccggcgccacgccgctacgatggccaccgcgactaccggcgcgagcaatatcgctaccagcagcgctaccacgaatcgcgcccggcccatcgtggcgagcggcatccgggcaactggcagcgcggcggccagccgcaatggcgcgggcattctccgcaacgctggcaacaacacggtcggcaggatcgtccgggacaccagggccagcagggcgggacacctcgctggcgcaactga

SEQ ID NO: 13059 - DNA, 966 bp, Pseudomonas aeruginosa
aacggagtatccgatgagccgtctgcttgcactcctggcgctcgccccgctgctcgccggcgccgccgaaaccaccgcgcccaaaccgcccagtgccttcaccgtcgaggcccagcggcgggtcgaagcggaattgcccttcgccgaccgcgccgacttcgagcgcgccgaccgcggcctgatccggcgcccggagcggttactcatccgcaaccccgacggcagcgtcgcctggcagctcggtggctacgacttcctcctcgacggcaagcctcgcgacagcatcaatcccagcctgcaacgccaggccctgctcaatctcaagtacggcttgttcgaggttgccgagggtatctaccaggtgcgcggcttcgacctggccaacatcaccttcatccgcggcgacagcggctggatcgtggtcgacaccctgaccaccccggccaccgccagggcggcctacgaactggtcagccgcgagctgggcgagaggccgatccgtacggtgatctacagccacgcccacgccgatcactttggaggcgtgcgcggtctggtagagccacagcaggtcgccagcggcgcggtgcagatcatcgctccggccggcttcatggaggcggcgatcaaggagaacgtcctggccggcaacgccatgatgcgccgcgccacctaccagtacggcacgcaactgcccaaggggccgcaggggcaggtcgacatggccatcggcaagggattggcgcgcggaccgctgagcctgctggcgccgacccgcctgatcgaaggcgagggcgaggacctggtgctggacggcgtgccgttcaccttccagaacacgccgggcaccgagtcgccggcggagatgaacatctggctgccgcggcagaaggccctgctgatggccgagaacgtggtcggtaccctgcacaacctgtacaccctgcgcggcgccgaggtacgtga

SEQ ID NO: 13060 - DNA, 762 bp, Pseudomonas aeruginosa
tcagacctcctcgctgtcgctcatcagggtcaggctgcgggccacggcgagggcgatgaacaggaccccgatcactccttcgctgccggccagcaggcgcgccagcgggttgatcgcctggatgtcgccgtagcccacggtggtcagggtcaccaggctgtagtagacgaaggtatccaggccgagtgcgccatggctggcgatgaagctggcaggctgcatctgttcgaccatgtagtaggcgagagcgaaggccagcgccatctgcaggtagagcgcgcagagtccgtagagcagctcgtgggtcaccgggcgctcctgggtgacgcggcggaacagcgcggcgaacagggtcaggtacagcaggatcaggctcagcccgcgcagcaggccgggcggcaggctggagtagggactgctgaagtccgcagtggtgtacagggccaggctgaacaggccgaagaaggccgtcaggtagaccagcgggctgcgtctgcgcaaggtgttcatcccggccagcaccagcagcaggaggctgccgagcacccgtggcttggtgctcgacggcaggccgaggatcgccgtgaacagcacggtggaaaagaacagcaggcggaaacggtaacgcagcagcagggcgttcaaggcgggctcctcgcatcgtcgaatcgaccagcctgggcgcggacccgcctgcctgtctattggccttgtgtcggatcgaacaatttctgcaccacggaaaagtcccgctccgcatag

SEQ ID NO: 13061 - DNA, 762 bp, Pseudomonas aeruginosa
acgctatggacgtggcgggcccgcgccttccttcggcagagggcggcgcggcggatcagagccccgccagcggatgctcgccctcccaggtcggctcgaagtgcgcctcgatcaccgcctgcgggatcgattccacctgcggccaatgccagttcggtgcgttgtcgcgatcgatcagccttgcgcgtaccccctcggcgaagtccggatggcgcgtgcagttcaggctcatggcgtattccaggcggaacacctcggccagcgacaggtagcgcgcacgctcgatctgctgccagaccagatgcgcggtcatcgggcagccctcggccagggtcttcgcgccacgcgcaagcagcgggtcggcgtcgtcgcgcagcgccaccagcgcctgccaggcgctcgccaggtccggctggtcgagcagtgcgtccaggcgcggccggcgcgggagcaactgggcctccggcagttcgccgcgggcctcgtgttcgagggcgcgaagcaggctgtgaagttgcacctggggcgactcgttccagttcatctgcaccaggccggcgagcagggcgtcctgctggtcgtcgagaaggaagcggtcggccaggtcgaggtcgagagcgtcgcgggcgttcatctgcgccgcgctcaggccgaggaacaggccgagcctgccgggcaggcgggcgaggaaccagctggcgccgacgtctgggtacaggccgatgccgatctccggcatcgccaggcggctggacggggtga

SEQ ID NO: 13062 - DNA, 1398 bp, Pseudomonas aeruginosa
agggtttcgggtaggtatggatgcggtagtcgaggcggtattcatcggcgaaggaagcgtcgcgccagggccggtacctcgccgggttgctcgcggcaggcgtccactagcttgcgcacgtcgccgccggcgcaaaaggccttggcgccgttgccgcgcaacagcacgcaggcgatgccggcgtcctcggcccaggcgtcgagtttcgccgccagggtctcgatcatcggcagggacagggcgttcagactcttttccgcatccagggtggcaatgccgatgcggaagccatgcaggctcgggcgttcttcgaaaagcacgttcatgtcggggctctcggctcgggcgggctgtggcgcagcccgccgggttcgatgggaaggctcagcagttgcgccacttgggatcgcgcttctcgaggaaggcgttgaccccttcgcgggtgtcctgggcgtcgaacagatcgacgaagcgctcgcgctcctccggcagccaggtgttcggcgcgcgttcgcgggcaccctggatcagcggcttgatggtgcggatcgccaccgggctctggcgtgccaccttggccgccagcagcagggcggcgccgcgcgcctcgccgctgtccaccacctgttcgaccaggccgatgcgcagggcggtttccgcatccacccgctcgttgcagaggatcatccgcttggcccagccttcgcccaccagccagggcagcgcctgggtcccgccggcgcagggcagcaggcccaccgcggcctccggcagggccatctgcgcctggcgctcggcgatgcggatgtcgcaggcgagggcgcactccagcccgccgcccatggcgtagccgttgatcgccgcgatcgacaccccgcggaaatcgcgcagcgcctcgaaggcttcgccgaagcggcgggccatctcgcgagcgcgggccttgtcgccgtcggcgaacatgttcaggtcggcgccggcggagaagaacttcggcccctggccggtcactaccagggcgtaaatatcgtcgtcgcggttgaggtgctcgatcagttggcggaggccgatcagcgagtcgcggtcccaggtgttggccggcgggtggttgatggtgatcagcgcggtgtgcccgtgcttttccacggtgagcttgtgggtcaggtcgaaggaggaagccttgtagggttcgacggcagtgttcatgaagtccctcactggatcatgggccggggcgtcccggcactatcggatgcgatggttcgcggcgttcacagcaggcgatcgagcatgccgccctgctccagcaggcggcgggcgacgatcacccgcatgatttcgttggtgccttcgaggatctggtgcacgcgggtgtcgcgtacccagcgctccagcggataa

SEQ ID NO: 13063 - DNA, 543 bp, Pseudomonas aeruginosa
  unsure (22),(170): Identity of nucleotide at the above locations are unknown.
gccaccgcgcttgccagggtcnccccggcgccgggccattcgcccatgacgaaacctagcagaccgcatcgcatgttgaccatgaatacgctggcggcctccttgaagttgaacagcatgcgtccggtggctttcaccgcctcctggccgtggtgggtcttctccaccancatgaggatctcgctgaccgagaacaggcccagcaccaggaccacgaactggatgccgtcggcgaggtggatgctgtccccggtgaagcggtacacgccgctgttggcgtcgatcccgacgctcgacaggaacagcccgagcagcgccgccagcagggtcttcagcgggcggtcgccggccatcccgccgaggcagacgatggcgaacaccatcagcacgaaatattccgccggaccgaaggcgatcgcccacttggccagcagcggggcgaacaggaccatcccgcaggtggcgatgaaagcgccaatgaacgaactccaggccgacagcgacagggccacgccggccaggcccttgcgtgccatcgggtag

SEQ ID NO: 13064 - DNA, 1578 bp, Pseudomonas aeruginosa
ttcaaggtttccatcacgaagtcctcacagcggcaggaagtcgagaacgcccagcggcagcgggacgtccagggcgcggtcgaacagccagtagaggccgatcccgagcaggctcgcggtgaccaccgcagggattggccgggcgccgtagagaatggccatgcaggagccgaccagggcggcgctgaggatgaagccgagcgtttcgaacaggccggcgaacaccagcagcagggcgatgcaggcgagcaccttgagcagcacggcgccgcccagcggttgttcgtcctcggcgtggcggatcggcgtcggccgcgcgatcagccacgccaggccggcgcccatcagcgccaggcagagcagcgggtaggcgcgcgggccgaccggttcgtaggaaaacggcgcctggtaacgccagccggcgaccgccaggccgacgcaggcgagcagccagagcccggcgaacaggcgctggtacaggttggaacgggtcatgggacgatcctcgtggcgcggccggggtccggccgcgcgcgggctggcttactggatcaggccgaagtccttggccagttgcttgtactgctggacctgctgcttcacgtagccgtcgagttcctcgccggtcatggcgaaggggaacagctcgcgctggtcgcgcagcttggcgaagtcctcggaggccagcagttggtcgaaggcgttcttccaccaggcgtagtcttcgtcgctgaccttcggcccgaggtagaacccgcgaaccaccggccagacgatgtcgtagccctgttccttggcggtggggatgttggccatcgccgcctctggcaggcgttcttcggagaacaccgcgagcaggcgcatgtcgccgctgaggatgtgcggcatggagtcggaaatgtcggtgctgccgacctggatgtgcccgccgagcagcgcggtggcgatctcgccgccgccttccagggccacgtagcgcaggtcgcgcggattgatcccggcggccttggcgatcagcgcggtctgcatccagtcctggctgccgacggtgccgccggagccgatcaccaccttgctcgggtcggccttgagcgccttcaccaggtcgtcgaggttcttgtagggcgagtcggtgcgcaccgcgatggcgccgtagctggtgccgatggcggccagccatttcaccgcgttctcgtcgaagcggccgaacttgccctgggccaggttcagcagcgagccgctggagaaggcggtgatggtgccggcgtcgcccgggcgttgggcgaccaccgcgttataggcgaccgcgccgacgccgccgggcatgtaggtgacgcgcatcggcttgctcagcagcttggcctcgaccagggcgctctgggccagcttgcaggtgaggtcgaaaccgccgccgggggacgccggggcgatgcattcgggacgcttgggttcggccacggcggcgccggccagcagcaggccggcggcaaccaaggcgaggggacgaaaagacagtttcatcatcatcggtgctcctgtggagttcttgttctggcttaccagatcggcagggtatag

SEQ ID NO: 13065 - DNA, 1422 bp, Pseudomonas aeruginosa
tcaccttccgcggcctcggctacctgctggaggcgctgggtgactgatgccggcagcctgcgcggaaggctgctgctgtggctggccctgctcctgctgctggtgctcctggcgagcggcctgagcgcctactggaacggtcgcgaggtggccgacaccgcctacgaccggaccttgctggcctcggcgcgggcgatcgccgacgggctctacgagaaggacggcaccctgcgcgccgacgtcccctacgtggcactggataccttcgcctacgacagcgccgggcggatcttctaccaggtcaacgacatccacggacggatgatctccggctacgagaatcttccggcggcacccgccgatgccctgcgcaccgacgactacccggccctggccaagttctacgacggcgtctaccagggcgtcgacgtacgcgtggtgagcctgctgcaaccggtcagcgaaccgagcatgagcggcatggcggagatccgcgtggcggagaccgaaggcgcccgcgagcgcatggcgcgcagcctgatgaccgataccctgctgcgcctgggcgtcctcggcgtcggcgcgctggtgctggtgtggctggcggtgagcgccgcgctgcgtccgctggatcgcctgcgccgcgaggtggaagagcgccagccggacgacctgcggccgttgccgatgctcgaggtccagcatgaattgcggccgctggtggagtcgctgaaccacttcacccagcgcctgcgcagcctgttcgagcggcagtcgcacttcatcgccgatgccgcccacgagttgcgcacgccgctggcggcgctcaaggcgcgcctggaactgggcctgcgcgagcaggagccggaagcctggcgttcgaccctggagaccacggcgaagaacaccgaccgcctgatccacctggccaaccagctgctctccctggcgcgcatcgaaagcggcgcccaggccattgccgagggtggcgccgagcgtatcgacctgaccgccctggcccgggaactgggcctggcgctggcgccgctggcctatgcgcggggagcctcgctggcgctggaaagcgccgggccggtgtggatccagggtgaaccgacgctgctcaacgaattgctcagcaacctgctggacaacgcgctggcgcacaccccgcagggcggcaacgtgatcctcagggtgctggagggaggcgtgctggaagtggaagacgatggtccgggaattcccgccgccgaccgcgagcgggtcttccagcgcttctaccggcgcggcgacagccccggcagcggcctggggctggcgatcgtcggcgaggtctgccgggcgcaccgggcgcagatccagctcgaccagggcgaactgggcggcttgctggtgcgggtgcgcttcccggtggagtag

SEQ ID NO: 13066 - DNA, 525 bp, Pseudomonas aeruginosa
cagcccttcttgaagctgaccccgccgaccgcctgcaggttgatcatctgtgggatgaacagctcgcgggtagcgccgaacacctggccgatgcctgcgcgcacctggccgagcagccaatcgtcgagcggcgcctcgcggctgtgctcgcggagcgtggcaagcaccgcctcggcgcgttgcgccggaacccatagctcgacgcgggcgtcgcccagggcgacggcgagcaggtcgccgtggcgggcgatcctgccgctctccgccggggtgtctatccccagggcgcgcagtgcctcgctggcgtcgcgcaagcctatgcggagccaggctgcgctctcgtcggcaaggctggccttggagaatacggcgtatttcttcaggtccgccaactgggcctcgagcagctcgccggccatcgccagcagcaggccgtcgccctcgggcaggatgcggaagctcgatagcaggcggcccttgatgttgcagcggccgccgaggctggaggtctcgtcgttgaggtag

SEQ ID NO: 13067 - DNA, 1212 bp, Pseudomonas aeruginosa
tcgtactgcgcgtgcgcctgccgggccgctggcgcatccttggctgctgtatcccggccgatgcattgggcgccgacagccatcggcgcctgcgtgtccgcctgcgcttcagtcgccgtagatgggcggcaccaggatagtgtcgcgggcttcgggcagcaggtccggataatccagcgtgtagtgcaggccccggctttcgcggcgctgcatggccgagcggatgatcagttcggcgaccagtgccaggttgcgcaactcgatcaggtcgcggctgaccttgtagttgctgtagaactcgtcgatctcgctgagcagcaggcgtacccggtgctgggcgcgctgcaggcgcttgttggtgcgcacgataccgacgtagtcccacatgaaacgccgcagttcgtcccagttgtgcgcgatgatcacgtcctcgtcggagtcggtgacctggctggcgtcccagctcggcaggctttccggcacgggcgtgccgggcaggcgctggagcatgtcggcggcggcagagcgggcatagacgaagcattccagcagcgaattgctggccatgcggttggcgccgtgcaggccggtgaaggtggtttcgccgatggcgtagaggcccggcacgtcggtatgcccgtgctggtcgacgagcacgccgccgcaggtatagtgagcggccggcactaccgggatcggttgctgggtaatgtcgatgccgaagtccaggcagcgctcgtagacggtggggaagtgcgccttgatgaactcggccggcttgtggctgatgtccaggtagacacagtcgatccccagacgcttcatttcatggtcgatggcgcgggccacgatgtcccggggcgccagctcgccacgcgggtcgaagcgcggcatgaaacgctcgccattgggcaggcggagcagggcgccttcgccgcgcaatgcctcggtgatgaggaaactcttggcctgcgggtggtacaggcaggtcgggtggaactggttgaactccaggttgccgacccggcagccggcgcgccaggccatggcgatgccgtcgccggagttgccgtcgggattgctggtataaaggtagaccttgctcgcgccaccggaggccagcacggtgaagcgggcacggaaggtatcgacttcgccgctttcccgattcagcacgtaggcgcccaggcagcgcttgctcggcaggcctag

SEQ ID NO: 13068 - DNA, 549 bp, Pseudomonas aeruginosa
cttgcgctcggtgatcaggtcgaccgccacccgctgcgacagcaactggatgttcggtcgccgccgggcctgggccagcaaggtattgaagatcgcggcgccggtggcgtcggcggcatggatgatgcgccggtggctgtgcccgccttcgcgggtcaggtggtattcgaagctgccttcctcgtggttgtgctgctcgtcgcgggtgaagggcaccccctgttcgatcagccactggatcgcttcgcggctatgctccacggtgaagcgcaccgcatcctcgcggcacaggccgccaccggcgaccagggtgtcctcgacgtgggattccacggtgtcggtatcgtccagcacggcggccacgccgccctgggcccagtaggtcgagccctgcgacagtccgcccttgctgaggacggcgatgcgcaggtgttccggaagggtcaaggccagactcaggccggcggcgccgctgccgatgaccagtacatcgtgttgataatgttggctcatgcccgcatttccccgtggtggagccctagtatatag

SEQ ID NO: 13069 - DNA, 840 bp, Pseudomonas aeruginosa
acgcatcggttccaaagcaggatgcctgaagacctcgtccggttggcctacccagcggcacagaggccgggccctgagcccgatgcaatccattttcgcggggcccggacacgatgtccggggccgcacgtcacgagcgaggaaaaaactcgtgacgcatgcttggaggggagaacttttgcaagaagcccgagtctatcttggcaagacgattcgctgggacgctcgaagctcctccaggttcgaagaggagctttcatgctaacccaggaacaggatcagcaactggttgaacgggtacagcgcggagacaagcgggctttcgatctgctggtactgaaataccagcacaagatactgggattgatcgtgcggttcgtgcacgacgcccaggaagcccaggacgtagcgcaggaagccttcatcaaggcataccgtgcgctcggcaatttccgcggcgatagtgctttttatacctggctgtatcggatcgccatcaacaccgcgaagaaccacctggtcgctcgcgggcgtcggccaccggacagcgatgtgaccgcagaggatgcggagttcttcgagggcgaccacgccctgaaggacatcgagtcgccggaacgggcgatgttgcgggatgagatcgaggccaccgtgcaccagaccatccagcagttgcccgaggatttgcgcacggccctgaccctgcgcgagttcgaaggtttgagttacgaagatatcgccaccgtgatgcagtgtccggtggggacggtacggtcgcggatcttccgcgctcgtgaagcaatcgacaaagctctgcagcctttgttgcgagaagcctga

SEQ ID NO: 13070 - DNA, 1065 bp, Pseudomonas aeruginosa
gcagcgtctgccgatctacctgcgtcagcacgtgcaacaatccgccgtcagtggtacagagagcgcgctgccctacgctcgggcagccagcctggaaaaccgctgaggagagacatgcgcaccacctccctgttgcttttgcttggcagcctgatggcggttcccgccactcaggctgccgacgcttccgactggctgaatcgtctcgccgaggccgatcgccagaacagtttccaaggcaccttcgtctacgagcgcaatggcagcttctccacccatgagatctggcatcgcgtggagagcgatggtgcggttcgcgagcgcctgctccagctcgacggcgcgcgccaggaagtggtccgggtcgacgggcgcacccagtgcatcagcggcggccttgccgaccaactggccgatgcccagctgtggccggtgcgcaagttcgatccctcccagctggcttcctggtacgacctgcgcctggtcggcgaatcccgtgtcgccggccgcccggcagtggtccttgcggtgactccgcgcgaccagcatcgctacggcttcgagctgcacctggaccgcgacaccggcctgccgttgaagtcgctgctgctgaacgagaaggggcagttgctcgagcgcttccagttcacccagttgaataccggcgcggcacctgccgaagaccagttgcaggcgggcgccgaatgccaggtcgtcggcccggccaaggccgacggcgagaagaccgtggcctggcgctcggaatggctgccgccaggtttcaccctgacccgcagtttcatgcgtcgcagtccggtcacccccgatccggtcgcctgcctgacctatggcgatggcctggcacgattctcggtgttcatcgagccgctgcacggtgccatggttggcgacgcgcgcagccagctcggcccgaccgtggtggtttccaagcgcctgcagaccgatgacggcggccagatggtgaccgtcgtcggcgaagtgccgctgggcaccgccgagcgggtggcgctgtccatccggcccgaggccgccgcccaaaaatga

SEQ ID NO: 13071 - DNA, 1476 bp, Pseudomonas aeruginosa
gacctaccagctcaacttcatcgatacccccggccacgtcgacttcacctacgaagtcagccgctcgctggccgcctgcgagggcgcgctgctggtagtggacgccggccagggcgtcgaggcgcagtccgtcgccaactgctacaccgccatcgagcaggggctggaagtgatgcccgtgctgaacaagatggacctgccccaggccgagccggagcgggtgaaagaggaaatcgagagcatcatcggcatcgacgccaccgacgccgtggcctgcagcgccaagagcgggatgggcgtgctggaggtgctggagcgcctggtgaccgccatccccgccccggaaggcgagatcgaggcgccgctgcaggcgctgatcatcgactcctggttcgacaactaccttggcgtggtctcgctggtacgggtgaagaacggccgggtgaagaagggcgacaagatcctggtgaagtccaccggcaaggtccaccaggtggacagcgtcggggtattcactccgaagcacaccgagaccgtcgacctgaaggcgggcgaggtgggcttcatcatcgccggtatcaaggatatccacggcgcgccggtgggcgatacgctgaccctgaacaacacgccggacgtcgaggtcctgccgggcttcaagcgggtcaagccgcaggtctacgcgggcctgttcccggtcagctcggacgatttcgaggacttccgcgacgccctgcagaaactgaccctcaacgactcgtcgctgcaatacgagccggaaagctccgaagccctgggcttcggcttccgttgcggcttcctcggcatgctgcacatggagatcatccaggagcgcctggagcgcgaatacgacctggacctgatcaccaccgcgcccacggtggtcttcgagatcgtgcagaagaatggcgagatcatctacgtcgacaacccgtccaagctcccggacctggcgtcgatccaggaaatgcgcgaaccgatctgccgcgccaccatcctggtgcccaaggaccacctgggcaacgtgatcaccctgtgcatcgagaagcgcggcgtgcagcgcgacatgcacttcctcagcggccaggtgcaggtggtctacgacctgccgatgaacgaggtggtgctcgacttcttcgatcgcctcaagtccaccagccgcggctatgcttccctggactacagcttcgatcgtttcgagccgtccaacctggttcgtctcgacgtgctgatcaatggcgagaaggtcgacgccctcgccctgatcgtccaccgcgacaacgccccctacaagggccgccagctggtggagaaaatgaaggaactgatcccgcggcagatgttcgacgtggcgatccaggcagccatcggtgggcagatcatcgcccgctcgacggtcaaggcgctcaggaagaacgtgctggccaagtgttacggtggcgacgtgagccgtaa

SEQ ID NO: 13072 - DNA, 864 bp, Pseudomonas aeruginosa
ctagaacccatgacactcaatttcccgttgttgctggtcatcgccgtggctgtatgcggcgccctggccctggtcgacctggtgctgttcgcgccgcgtcggcgggccgcgatctcttcctacgaagggcaggtgaacgagcccgatccggcagtgctggagaagctcaacaaggaaccgctgctggtggagtacggcaagtcgttcttcccggtgctgttcatcgtgctggtgctgcgttccttcctggtcgagccgttccagattccctcggggtcgatgaaacctaccctcgaggtcggcgatttcatcctggtcaacaagttcgcctacggtatccgcctgccggtgctggacaccaaggtgatcccgatcggtgatccgcagcgcggcgatgtcatggtgttccgctatcccagcgaaccgaacatcaactacatcaagcgcgtggtcggcctgcccggcgacaccgtgcgctacaccaaggaaaagcgcctgtacgtcaacggcgagctggtggcggagaaactggtcggcgaggaaccgggcaccctgggcagcgtgaccctgtaccaggagaagctgggccaggccgagcacctgatccgcaaggaaatgagccgctatcgcattgagcccgaccgccagtggaccattcccgccggccactacttcatgatgggcgacaaccgcgacaactccaacgacagccgctactggaacgatccgaagatccccaaggatctgctgggcatggttccggaccgcaatatcgtcggcaaggccttcgctgtatggatgagctggcccgatccgaagatgagcaacctgccgaacttctcccgggtcggcgtgattcactga

SEQ ID NO: 13073 - DNA, 501 bp, Pseudomonas aeruginosa
tcgcgaagcggggctgctcccgagggcagccccgctttcacttccgcgaacgccgccgcagggccttgcccgatggcgttaccgctcgctggacggaataactacactgacatgaggtccgacatgaggttcgcgcgttcgcagaaggggatgtccctgctggggtggctggtggtgctgggcgtggtggcgttcttcgccagcgccgcgttcaagatcatcccgcactacatggattactattcgctggagaaggtgatcacttccgtggagaccgacaaggcggccgaggtgcgttccgtgccggagttctacagctacgtcggcaaggggatgcagatcaacggcatccgcaacctggacctggagaaggccctggaggtgcaactggaagacaaccaattccgggcgcacctgaaatatgaaaaacgcgagccactgatcagcaacatcgacctggtggtccacttcgacaaagaattccgtgtacgcatgccgtga

SEQ ID NO: 13074 - DNA, 1011 bp, Pseudomonas aeruginosa
  unsure (138): Identity of nucleotide at the above locations are unknown.
gcgacaagacccacgggcacggcggcagccgccgcatcgccgagcaggtggccgcggccgccgcgctggtggctctgggcgtggagaatggccatgactgacatgcacgacgacatccccgccggcagccgttgcggntacgtggcgattgtgggccgccccaacgtgggcaagtccaccctgctcaaccacatcctcgggcagaagctggcgatcacctcgcgcaagccgcagactacccgtcacaacatgctcgggatcaagaccgagggcgaggtgcaggccgtctacgtcgatacgcccggcctgcacaagagcggcgagaaggccctcaaccgctacatgaaccgtaccgccagcgcggcattgaaggatgtcgacgtggtgatcttcgtggtcgaccgcacccgctggaccgaagaggaccagatggtcctggagcgcgtgcagtacgtcagttgcccggtgctgatcgcggtgaacaagaccgaccgcatcgaggagaaggccgacctgctgccgcacctcgaatggctcacccagcagttgccgaaggccgaggtagtaccgatctcggcgcagcacgggaccaacctggacgtgctggagaagctggtcgccgagcgtctgccggaaagcgagcacttcttccccgaagaccagatcaccgaccgcagcagccgcttcctggccgccgagctggtccgcgagaagatcatgcgccagctcggcgccgagctgccctaccagatcaccgtggagatcgaggagttcaagcaggaaggtcgcatcctgcatatccatgcgctgatcctggtggagcgcgaggggcagaagaagatcatcatcggcgacaagggcgagcggatcaaaagcatcggccagaacgcgcgcaaggacatggaagtactgttcgactccaaggtcatgctcaacctctgggtcaaggtcaagggcggctggtccgacgacgagcgtgccctgcgctcgctgggctacggcgacctctga

SEQ ID NO: 13075 - DNA, 762 bp, Pseudomonas aeruginosa
ccgttcccggcagcccggcgccagccgggcgccattcctctcgcgcccggtcgacccgccatgtccttcgccgccgcccaagccacctacgtgctgcatagccggccgtacaaggaaaccagcgccctggtggacttcttcaccccgttgggtcgcctgcgcgcggtcctgcgcggcgcccgcggcaaggccggcgccctggcgcggccattcgtgccgctggaagcggagtggcgcgggcgcggcgaactgaagaccgtggcccgcctggaaagcgccggcattcccaacctgctcaatggccaggcgctgttcagcggtctctatctcaacgagctgttgatccgcctgttgccggcggaagacccgcagccggaaatcttcgcccactacgccgcgaccctgccgctgctggcggcggggcgacccatcgaaccgctgctgcgcgcgttcgaatggcgcctgctggagcaactgggctatggtttcgctctcgatgtcgacatcgatgggcgcccgatcgagccgcaggcgttgtaccagcttttgccagaggccggcctggagccggtggcgcaactgcaacccgggctgttccagggctccgaactgttatccatggccgacgccgactggagcgcccccggcgccctggcggcggccaagcgcctgatgcgccaggcgctcgctccccatctgggcggccggccgctggtcagccgcgagctgttcatgaaccgtaaggagtcaccccgtgactga

SEQ ID NO: 13076 - DNA, 804 bp, Pseudomonas aeruginosa
gctgcagcgggtacgcgagggcgtggccctcgggcgttccctcggcctgatcgtcaacgccgggcatggcctgcactaccacaatgtcgagccggtcgcggccatcgacggcatcaacgagctgaacatcggccacgccatcgtcgcccacgccctcttcgtcggcttcaggcaggcggtggccgagatgaaagcgctgatgctggccgcggcgaccaagcgctgaggcaatcgcgccccgcttgccgtcgacctgcggggcggatgaaagcaaaaaaaaaaaccatccgaggatgggcttttccctattcgctgtcagggcttgcgcgccaccagcgtggcgcgcatcggtgccggcaggccttcgacggttcgcgaacggtcctgcggatcgaggaattccggcagcgactggaaacgcatccattcggtggagcgttgttcctcgacgctggtcaggctgacgtcgacgcagcgcgcgtcggcgaacccggcgcggcgcagccagagctccagggctgccaccgagggcaggaaccagacgttgcgcatctgcgcgtagcggtcctcgggcaccagcacggtgctggcgtcgccttccaccaccagggtctccaggaccagttcgccgccgcgcttcaggcagtccttgagcgccagcaggtggtcgatgggcgagcgacggtgatagagcacgcccatggagaataccgtgtcgaagccttcgagcttctccggcaggtcttccagggccagcggcaggtgccaggccggcagctccggcaggtagcgcttggcggctag

SEQ ID NO: 13077 - DNA, 639 bp, Pseudomonas aeruginosa
gaactggcagaggaacagccagttcggatcgaccccgaccacgctttccgcgccggcgccgagcatgcgccactggtagtagccgttgccgcagccgacgtcgaggacgcgtttgccacgcagttcgacatgtggcgagacacgctcccatttccagtcggaacgccattcggtatcgacctgtacgccgaagaagtcgaacggccccttgcgccagggaatcagcccttgcagcgcttccttcacctgcgcttgcagcgccgcatcgtggtcgctgtgcagggcgaagcgctgggccagttcgaccttcggtgcgggcacctggggcaggcgctggaccgcgctccaccaacgggccaggtcgccgtggccttcctcgatgcgcgcggcgatctgcgcgggcaggctggtcgcccagccgtacagcggagagccggcgaggtgtcgctggagggcgtcgagggcgaggtgctggatcatggcagggcgatcatcgatgcgaagttgagacactggaaccattggctgacccggctgaagccggcggccagcagccgttcacggtgttcctcgaaggtgtcggggagcatgacgttttccagcgcgctgcgcttctgcgcgatctccagctcgctgtag

SEQ ID NO: 13078 - DNA, 1395 bp, Pseudomonas aeruginosa
accgtcgttctcggcgaagcgctcgttgcccttggcgtcggggtccacgcgggtgtgctccaggcgggcgccgaagctgaggtcgaggcggtcgctgagcttccattcctccagggcgaacagcgcggcgctgtcggtttccgtgtgcggcacgaaggcttcctcgccgagggcggagaagcggctgttggcgaactgcgcgccgaccaccccgttcagcgggccgagcgggcggtggcgggcctcgatgcggccttcgtagccttcgttcttgaaggtggtgccggtctcgccatcctcgatttccttgtgctcgtacttggtataggcggcgtccagcttcagcgaggtgaacgggccttcgaggtcgcggatctcggaggcgaaggcgtagcggtcctgctgcatcttcaggcgcacgtcgtcctcggccggcgagccatagttgctgtcgtagccgctgtaggagaggccggcgtaaccgtgctcccagtgataggagccaccgacggcgccgccgtcctggcggccgtcgctgttctgcacccgatgcttgccggtgtcgccgtcgatctgccgctggcggctggaatgggcgtagccgggaatcctgacgtcgttgaactcgcggctggcggcgtccacgtgcagggcgaagttgccgtcgccggcctccagtgcgccggagcggctacgggtggtgttggcgccgccgtagcgcagttcgccgctgccgtggatgccgtcgacgggttcgctggggatgcggttgtcgaagctgttcaccaccccgccgatggcattgccgccgtagagcagggcggccgggccgcgtaccacttccaggcgctcgacgctgttggggtcttccggcaccgcgtggtcgtaggacagcgacgaggcgtcgagcgcaccgatgccgttgcgcagcaggcggatgcgatcaccgtccatgccgcggatcaccggtcggctggcgcccggtccgaagtaggtggaggacaccccgggcaggccgttgagggtttcgccgaggctgcctttctgtcgcagggtcagctcgtcgccttcgagcacgctgctgggcgtggcgggagattcgttgcccagcgggttggcggtgatcacctgggagggcaattcgctggggcggccgtcggcgccgagcgtttcccccgaaacgatcaggcaggccagcgccagtggcgtgagaggccagagcggacgggaagggaaaaggccggaagaggacattgcgggctccatggtcatgggtcggacttttttcaggccaaagcgaacccaggcccttcccggaggaagggcgacggggtcggatcggcgtatttattgggatgttatattatttctttttgtgtcggtagacccgcgtag

SEQ ID NO: 13079 - DNA, 2028 bp, Pseudomonas aeruginosa
cgcggcgaccgccgacgcgctgatccgcgacaagctgtccgccgccgactggcagcgccatctcggccagagcgacaacgttctggtcaatttcgccgcctggggcctggtgatgaccggcaaggtggtgaacatcgacgaacgcaccgacggccgcgccccgagcgtcatcagccggctggtgcagcgctctggcgaaccggtgatccgcgccgcgatgaacccggcgatgaagctgatgggcaagcagttcgtgcttggccggaccatctccgaagcgctgaagaacggtcgtccatgccgcgagcagggctacacctattccttcgacatgctcggcgaggccgcgctgaccgccgccgacgccgagaaatgcttggccgactaccgccaggccatcgacaccgtcggcgccgagccgcaggtcggtccggggccgcggccgtcgatctcgatcaagctctcggcggagcatccgcgctacgaagtggcgcaacgcgagcgggtgctcagcgagctgttcgccaatgtcctggaactggcggtgcgcgcgcgcaagctgaacgtcggcatcaccatcgacgccgaggaagccgatcgcctggagctgtccctcgaactctacgagaagctgatgcgcgacccggccatcgccggctggggcgagttcggcctggtcatccaggcctactccaagcgctgcctgccggtgctggtatggctgaccctgctcggccgcgagcttggcgcacgcatcccgctgcgcctggtgaagggtgcctactgggacagcgagatcaagcagtgccaggtgcagggcgccgatggctaccccgtctacacccgcaaggaaggcaccgacacttcctacctggcctgcgcccgctacctgctcagcgagcacacccgcggggtgatctacccgcagttcgccagccacaacgcccacaccgtgaccgccatcctcgccctggccgacgaagccagggccgccggcggcgaggagcgcgacttcgagttccagcgcctgcacggcatgggcgacgcgctgtacgacacggtgatcgagaagtaccgccgcaacgtgcgcatctacgccccggtcggcgcgcacaaggacctgctgccgtacctggtccgccgcctgctggagaacggcgccaactcttccttcgtgcacaagctggtggacccgcgcgtgccggtggagacgctgatccagcacccggttacccaactgcgccagttcaagacgctggccaacgaccgtatccctctgccccaggcgatcttcggcgccgggcggaaaaactcccagggcatcaacatgaacatccagaaccagtggaacgagctggagctcgcctacaagccacacctgacccgccagtggcaagccgcgccgatcgtcaacggcgagaagctctccggcccggcccacgaagtgcgttgcccgtacgacctggagaggctggtcggcagcgtccagtacgcgtccgccgagcaggccggcaaggccctcgacgtgttgcaggcggcctggccgcgctggagcgccaccccggtggacgagcgtgccggcatcctcgagcgtctcgccgacctgctggaagcccagcgcggcgagctgatggcgctgtgcaccctggaagccggcaagtcgttgcaggacggtatcgacgagatccgcgaggcggtcgacttctgccgctactacgcccagcaggcccgccagcgcctggtccgcgaggaactgcgtggcccgaccggcgagcgcaacgagctgttctacgaaggccgcggcatcttcgcctgcgtcagcccgtggaacttcccgctggcgatcttcctcggccagatcagcgccgcgctggtggccggcaacactgtgctggccaagccggccgagcagaccagcctgatcgccgcgcgcaccgtcgaactgatgttcgaagccggcctgccgaaggacgttatcgccctgctgccgggcgacggcgccactctcggcggcgtgttctgccgtga

SEQ ID NO: 13080 - DNA, 600 bp, Pseudomonas aeruginosa
cgcgcgggtcgccggggtggccttcaccggctccaccgacaccgcccgcatcatcaaccgccaactggccgagaagcccggcgccatcgccaccctgatcgccgagaccggcgggcagaacgcgatgatcgtcgattccaccgctttgccggaacaggtgatcaaggatgcggtacaatccgcgttcaccagcgccggccagcgctgctccgcgctgcgcgtgatgtacgtgcagcaggacatcgccgagcgggtgatcgagttgctcaagggcgccatggccgagctgaaggtcggcccgaccgacgtgcgcgtcagcgacgtcggcccggtgatcgacgccgaggccaaggccggcctggagcagcacatcgccgcgctgaaggccgccggcaagctgatcgccgagaccaaggtgccgggcaacctgaacggtcacttcgtcgctcccgtcgcgttcgagatcagcggcatcgacgagctgaagaaagagaacttcggcccggtgctgcacgtggtgcgttatgccgcgcaggacctggaaaaggtcgtgcaggcgatcaacgccaccggtttcggcctgaccatgggggtccatag

SEQ ID NO: 13081 - DNA, 1659 bp, Pseudomonas aeruginosa
ggccacccacgtttccggcttgctccggcaagcgctcacggagtgacgccacaagcgccattctgccaaccaagggcccgctacccgttgcttgcacacgcaagggcccggataaaaacaagcaataggggagtccctatgagtgtcaatacgcccacgctgatcaccttcgtgatctacatcgcggccatggtcctgatcggcctggcggcatatcgctccaccaacaacttctccgactacatcctcggtggccgcagcctcggcagcttcgtcacggcgctgtccgccggcgcctccgacatgagcggctggctgctgatgggcctgcccggcgcggtgtacctgtccggcctgtccgaaagctggatcgccatcggcctgatcgtcggcgcctacctcaactggctgttcgtcgccggccgcctgcgggtgcagaccgagcacaacggcaacgcgctgaccctgcccgactacttcaccaaccgcttcgaggacaacagccgcctgctgcggatcttctcggccctggtgatcctggtgttcttcaccatctactgcgcttccggcatcgtcgccggtgcgcgcctgttcgagagcaccttcggcctctcctacgagaccgcgctgtgggccggcgccgcggcgaccatcgcctacaccttcatcggtggcttcctcgcggtgagctggaccgacaccgtgcaggcctcgctgatgatcttcgcgctgatcctcaccccggtgatcgtgatgctcgccaccggcggcgtcgagccgaccttcaccgccatcgagctgaaggacgcgaccagcttcgacatgctcaagggcgcctccttcatcggcgtgatctcgctgatggcctggggcctgggctacttcggccagccgcacatcctggcgcgcttcatggccgccgactcggtgaaatcgatcccggccgcgcgccgcatctccatgacctggatgatcctctgcctcggtggcgccgtggccgtgggcttcttcggcatcgcctacttccaggcgcatccggagcaggccggcgcggtcagcgagaaccccgagcgggtattcatcgagctggccaagatcctgttcaacccgtggatcgccggcgtgttgctgtccgccatcctcgccgcggtcatgagcaccctgagctgccagctgctggtctgctcctcggcgctcaccgaggacttctacaaggccttcctgcgcaagggcgccagccagctggaactggtctgggtcggtcgcgccatggtgctgctggtggcggtgatcgccatctggctggcctccaacccggaaaaccgcgtgctcggcctggtgtcctatgcctgggccggcttcggcgccgccttcggcccgctggtgctgttctccctgctgtggaagcggatgacccgcaacggcgcgctggccggcatgatcgtcggcgcggcgacggtgatcctgtggaagaacctgttgggctggaccggcctgtacgagatcatccccggcttcctcttcgccagcgtcgccatcgtcgtcttcagcctgctcggcaaggcgccttcgacgagcatgctcaagcgcttcgacgatgcggagcaggagtaccgcgaggcgcaccagggctccgccgctccggtaacccagcgctga

SEQ ID NO: 13082 - DNA, 825 bp, Pseudomonas aeruginosa
cgcgctgtagccggcgccgtcgacactgatatccgctctgtagggttgcagcaggccgctggcgacgctttccgaaaccaggatcgaactggccagcaccagtccctggccggcgatggccgcctgcagggcatagtgctcctcgtcgtactggcggatcaccggctggccctccatccagtcttcgccggcctgcgcgcaccaggcctcccagccgtgggcgtagagcctggagttgtgccagcgcacgctgatcagggtcggctgccgttctgcggccagggcgacctgggccggcgagccgtagaccgcgaagcattcgtcgaacaggcagagaccgtagaagttcggatggtcttcgagactgtagcggatcaccaggtcgatgctggcgtcctggtgcaggtcgaggacttcgcagttggtgtccaggcgcaggttgatctgcgggtgcgcggcgtagaagcggccgagacgcggcaccagccagagggcggcgaaggccggggtggtggagaccgtcaggttgcctacgctgcgctgcggacgcagcgtgtcgacgctctgcgaaatttccagcagggccccgtgcaggctgcggaacagccgttcgccgcagtcggtcaggcgcactttccgtggcaggcgctggaacagcggaacgccgagccaggcttccagcgaacggatctggtgggaaaccgcggttggcgttaccgcaagctcctcggcggcggccttgaagctcgactggcgggccgccgattcgaaggtgcgcaacgcggtcagcggcagggaagcgaacattggaatctccatgggtga

SEQ ID NO: 13083 - DNA, 675 bp, Pseudomonas aeruginosa
ggccattcgagtctagccgaatccaaggagatacagatgagtagaattcttgcagtgcatgccagtccgcgaggcgagcgctcgcagtcccggcgtctcgccgaggttttcctggcggcctatcgcgaagcccatccgcaggcccgcgtggcgcgccgcgaagtcggccgggtaccgcttccggcggtcaccgaggccttcgtcgccgccgccttccatccccagccggaacagcgttcgctggcgatgcaggccgacctggcgctgagcgaccaactggtcggcgaactgttcgacagcgacctgctggtgatctccacgccgatgtacaacttcagcgtgcccagcggcctgaaggcctggatcgaccagatcgtgcgcctcggggtgaccttcgatttcgtcctcgacaatggcgtcgcccagtaccggccgctgctgcgtggcaagcgtgcgctgatcgtcaccagtcgcggtggccatggcttcggcccgggcggcgagaaccaggcgatgaaccacgccgatccctggttgcgcaccgcgctgggtttcatcggcatcgacgaggtcacggtggtcgcggcggaaggcgaggaatccggcggcaggtccttcgaggactcctgcgccgaggcggaacagcgcctgctggcgctggcgcggtcggcctga

SEQ ID NO: 13084 - DNA, 315 bp, Pseudomonas aeruginosa
ggagccgccatggcctggttccatctgctggtggcggcggccttcgaggtcgccttcgccatgggcatgaagttctccaacggcttcggcagactctggccgtcgttgctgacggtggtcgcggcgatcggcgggatctatttcctgaccctggcgctgcgcgagttgccggtcagcgtcgcctatccgatctggaccgcgatcggctcgctgggcacggtgttcctcggcgtcctgctgcttggcgagagcctgacggcggtgaagctggtttctgtcgggttgatcgtcgccggggtggccgggctcaagtaa

SEQ ID NO: 13085 - DNA, 456 bp, Pseudomonas aeruginosa
caacccgggagggcgcttcgaagtgctgatcgagcagcccggcctgctgcggccgctgcgcaccgcggagctgtcggacggcaccctgcgatacctgctgtggatcgccgccctgttgtcgccgcggccgccggcgctgctggtgctcaacgaaccggaaaccagcctgcatcccgacctgctgccggccctcgggcgcctggtcggccaggccgcgcagcactcccaggtgctggtggtgtcgcacgccgcgcggcttgtcgcgacgctcgaagagcacccggaatgccattcgctggggctggagaaggacttcggcgagacccgcatccaggggctgcgcgagctggaccggccggcctggtactggccggtgcgctgaaccgctacaggcggccgatctgttgcggcgacaacggtacctggcagcgggtggcggtgcgtgggtcgaggtag

SEQ ID NO: 13086 - DNA, 246 bp, Pseudomonas aeruginosa
agtgtctgtctgagttccttgtgtttcgggtccggaatgtcgatgcgcacactttttccccttctcgtcggtgtcgtcctggcgggtttctccggcctcgcggcgcaggccgcgccggcgcccttctacaaatggcagagcaagctcgacggccaggtcgcctgcatgcagacctcgccgggagacggctgggtcaggctcgacggcccctaccgcgatctccgctgccgcgaacccctgcgctga

SEQ ID NO: 13087 - DNA, 642 bp, Pseudomonas aeruginosa
gcgacacatccgcctgatggcgctcggcgcctgtatcggcgtcggcctgttcctgggctcggcgaaggccatccagatggccggcccggccatcatgatctcctacatcctcggcggcctggcgatcctggtgatcatgcgcgccctcggcgagatggcggtacacaatccggtggccggttccttcagccagtacgccaaggactacctgggcccgctggcgggcttcatcaccggctggaactactggttcctctggctggtgacctgtgtcgccgaaatcaccgccgtcgccgtctacatgggtatctggttccccgacgtgccgcgctggatctgggccctggcggccctggcgagcatgggcacgatcaacctcatcgcggtgcgtgccttcggcgagttcgagttctggttcgccctgatcaagatcttcaccatcctggcgatggtggtggtcggcatcggcatgatcgccttcggcttcggcaacgacggcatcgccaccggcatctccaacctctgggcccacggcggcttcatgcccaatggcatccagggcgtgctgatgtcgctgcagatggtgatgttcgcctacctcggggtggaaatgatcggcctcaccgccggcgaagcgcgtaa

SEQ ID NO: 13088 - DNA, 2172 bp, Pseudomonas aeruginosa
cccgaccaagaccattcccagcgcgatcaactcggtgttctggcgcatcctgctgttctatgtcggctcgctgttcgtgatcatgtcgctctatccgtggaacgagatcggcacccagggcagccccttcgtgatgaccttcgagcgcatgggcatcaagaccgccgccgggatcatcaacttcgtggtgatcaccgccgcgctgtcgtcctgcaatggcggcatcttcagtaccgggcgcatgctctacagcctggcccagcatcgccaggccccggccttcttcggcaaggcctcgcgcagcggcgtaccgcgccgggcgctgatcctgtcgatcctggcgctgctgctgggcgtgttgctgaactacctggtgccggagaaggtattcgtctgggtgacttccatcgccaccttcggcgcgatctggacctgggcgatgatcctgctggcccagttgcgcttccgcaagacgctcagcccggccgagtgcgacaagctgcaataccgcatgtggctgtacccggtcagttcctacctggcgctggcgttcctggtgatggtggtggtgctgatggccttcttcgaggacacccgcatcgccctctacatcggcccgccgttcatcctgctgctgaccgtcctgtactacgccttcaacctggcgccgaaggagcctgccggcaccggctcggtaagccgcgcggcgtcctgagcggtgtagcgccggaaaagaaaaggggcctcggacgaggcccttttttcgttgcgccgatatccggtccggtgcatccggcgaataacgccgttggcgttattcgccctacccaggctggggcatcagcccgccagcatgctcagcatcaccgccgccagcaggccgacgtacacccgtgcatgcagcgcatcgggaagccgcccgatcagcggggtcgccaggcggatgccgagccagccgccgccggccagggtggcgaaggccagcaggtcgatgtagccgacgaagcctcggcccaggccttgctcctggtagccggccaggaccaggtaggtaagggtgccgccaagagccaccggcaggctcagcgggttggccatggaggtcgcctgggtcatgctcagcccgcagcggcgcagcagtggtacggtcatcacgctgcctccgacgccgaggaaggtggcgatcgcaccgatcagcgttccgcccaggcgcgtctcgccgacgcccagcggccgcgcctggcgctcctcggcgcggctgaggaagccgcgacgcaacaggcagtcgaggatggtgatggcgaggtaggcgacgaaggccaggcgaatgaagtcgccgctggccaggccgaccagcgccgcgccaagcaccgcgccgacaccgatgtacgcgcccagcggccagacataggcgcgcagcaggctaccggcgcgccggtggcgataggtggcgagggcggcgttgacgatcatcacgcaggtcgaggtggccaccgcgacctgcatggccgcctgggccagcgggtcgtcggcggcgcgaccgagttgcagcaggtgatagagcagcggcaccaccacgaagccgccgccaaagccgaacaacacggcgctgaccccggtgaggcagccgcagagaaagagcaggagatagaacatggcgggtttccggagcgagagcggaaggccagcttaggcgtcccggggctggcccgcttcgcgaggttggccaatactattcgcgtttcggccagatgcttcgaccatgcgcaacgcttccatcgagcagtacgacgccacgccccgggccgtggtggccatgggtaccgactatcccgacggctacctgctgccgcgccatcggcatcgtcgcgcgcaattgctgtacggtgccagcggggtgatgcaggtgcgtaccggcgacgccggctgggtggtgccgccacagcgcgcagtgtggattccgccgggcgtcgagcacgaggtgcgaatgctcggggtgagcacccgcagcctgtacatcgagcccggcagcgccatggcgatgccggcgcactgccaggtgctggcggtgtcgccgctgctgcggcaactgttgctggcggcggtggacatgcccctagaatacgacaccgaaggtcgcgacggcgcgttggcgacgctgttgctccatga

SEQ ID NO: 13089 - DNA, 2136 bp, Pseudomonas aeruginosa
gtggcggggatgcggatctggggtgggtgggccatgcgtcgtcgtcctcggcaatcgaattcaggggcagcggctgcgttcgacagccgctgccggtcgtcggcggatgacgctacgcgtcgtccgtcctaccagggtgtttcgccggcgccatcaggcgccggccgcctccaggaagtcctgggcgaagcgttgcagtacgccgccggcttcgtagatggagacttcctcgtcgctgtccaggcggcaggtcaccggcacttcgagccgctccccgtcgcgccggtggatgaccagggtcaggtcggcgcgcggccggcgagcgccgagcacgtcgaaggtctcgctgccgtcgatccccagggtcaggcgggtggtacccggcttgaactccagcggcagcacgcccatgccgatcaggttggtgcggtggatgcgctcgaagccctcggcgacgatcgcctccaccccggccaggcgcacgcccttggctgcccagtcgcgcgaagaaccctgcccgtagtcggcgccggcgacgatgatcagcggctgcttgcgctccatgtaggtctcgatggcttcccacatgcgcatcaccttgccttccggctcgacccgcgccagcgaaccctgcttcacgctgccgtcggcgttgcgcaccatctcgttgaacagcttcgggttggcgaaggtcgcgcgttgtgcggtgaggtggtcgccgcggtgggtggcgtaggagttgaagtcctcctcgggcaggcccattttcgccaggtactcgcccgccgcgctgtcggcgaggatcgcgttggacggcgacaggtggtcggtggtgatgttgtccggcagcaccgccagcgggcgcatgccgcgcagggtgcgttcgccggcgagggcgccttcccagtacggcgggcggcggatgtaagtgctcgtcgggcgccaggcgtagagcgggtcgaccctctcgcgctcgccgtgggtgatgtcgaacatcgggatgtagacctggcggaactgctcgggcttcaccgccgccctgaccaccgcgtcgatctcctcgtcgctcggccagaggtccttcaggcggatctccttgccgtccaccacgccgagcacgtcgcgctcgatgtcgaagcggatggtcccggcgatggcgtaggccaccaccagcggcggcgaggcgaggaaggcctgcttggcgtaggggtggatgcgcccgtcgaagttgcggttgccggagagcaccgcggtggcgtacaggtcgcgctcgacgatctcctgctggatcgccgggtcgagggcgccggacatgccgttgcaagacgtacaggcgtaggccaccacgccgaagccgagggcttccaggtgcggcagcaggccggcttcgcgcaggtattcggtgaccaccttggagccgggtgccagcgaggtcttcacccatggcttgcggaccaggccgaggcggtcggcgttgcgcgccagcaggccggcggcgatcacgttgcgcgggttgctggtgttggtgcaactggtgatcgcggcgatgatcaccgcgccgtccggcatcaggccctcggcttcctcggcgcgggcccgctcgaggttgccggcgatgcctttcgccgccagttcgctggtggcgaccctggcgtgcggattggacgggccggccatgttgcgcaccacgctggacaggtcgaacttcagtacccgctcgtactcggcgtcgaccaggctgtcggcccagagtccggcggtgcgcgcataggcctccaccagggcgacctgttcgtcgtcgcggccggtgaggcgcaggtagtcgatggtctgctggtcgatggcgaacatcgccgcggtggcgccgtattccggagccatgttggagatggtcgcgcggtcgccgagggtcaggctggaggcgccttcgccgtagaactccaggtaggcgccgaccaccttctgcttgcgcaggaactcggtcagggccagcaccacgtcggtggcggtgatgtccggctggcgacggccgctcagctcgacgccgacgatgtccggcaggcgcatccaggaggcgcggccgagcatcacgttttccgcttccaggccgccgacgccgatggcgatcacgcctag

SEQ ID NO: 13090 - DNA, 1476 bp, Pseudomonas aeruginosa
tcgccgggaaggcggcgagcaggcggtcggcgacgtcgcgctgctggtcgaagctcagctccggttccagggtgccgaggaccgaggcgccagtgcgcatcacgtccatcgggtgggcgtccttgggaatccgttcgagaacttccttcagcgcctgcggcaggtcgcgctggccctggagcttcttcaggtaggcgtcgagctgttgcttgttcggcagttcgccgtagagcagcaggtaggcgacttcctcgaagatcgccgccgccgccaggtcgcggacgtcgtagccacggtaggtcaggccggcgccttcctggccgacggtggacagggctgtctgaccggccacctggccacgcaggccggcgccactcagtacttttgcttcagccattgctctctcctttcttgaactttttctggatgctgcaactcggtttcacggggttcgcggaccggcgctcaggcgcacgccgggctcgatgttcaggcgttcttcttctgcgcgaagagcgcgtcgagcttctgctcgaagctgtggtaatcgatgcgatcgtacagctccatgcgggtctgcatggtatcgatcacattcttctgggtgccgtcgcgacggatcgcggtgtagacgttctccgccgccttgttcatggcgcggaaggccgacagcgggtagagcaccagggacacgtcggcggaggccagttcgtcggtggtgaacagcggggtggcgccgaactcggtgatgttggccagcaccggcaccttcaccgcggcggcgaattccttgtacatggccagttcggtcatggcttccgggaagatcatgtcggcaccggcctcgacacaggcgcaggcgcggtcgatggcggcctgcaggccttccacggccagcgcgtcggtgcgcgccatgatcacgaaggagtcgtcgctgcgggcatcgacggcggccttgatgcggtcgaccatctcctgctgcgagacgatctccttgttcggcctatggccgcagcgcttggcgccgacctggtcctcgatatgcatcgcggcggcgccgaacttgatcatcgacttcaccgtgcgggcgacgttgaacgccgaggagccgaagccggtgtcgacgtccaccagcagcggcaggtcgcagacgtcggtgatccggcgcacgtcggtgagcacgtcgtcgaggccgctgatacccaggtccggcaggcccagggaaccggcggcgacaccgccgccggacaggtagatggccttgaagccggcgcgcttggccagcagggcgtggttggcgttgatggtgccgaccacctgcagcgggtgttcggtggccacggcttcgcggaagcgctggccgggggtaagggacgtctggctcatcacggacctcttagacggtggaggaagcggaggcgagcttcgccggctggggttccagctggcgctcgatattgcggcgcgacgcactga

SEQ ID NO: 13091 - DNA, 777 bp, Pseudomonas aeruginosa
ccgttacgtgttgccgcgcctgatcgacttcgcctgcggcatgggcgacgtgatgaagcagcgttcgctgctggtgccgcgcgcccatgggcgggtgctggagatcggtctgggcaccgggctcaacctgggcttctacgacgcggcgaaggtgtcggcgatcgtcggcgtcgacccggccgcgcaaatgcaggcgctggcccgcgagcgcgcggcgcaaatcggcatcccggtggaaatggtcgccctcgagcttggcgagatccgcgccgaggcggaaagcttcgacaccatcgtctgcactttcaccctttgctccatcgccgcgccgctgccggcgctgggcgagatgcgtcgggtgctgaagcgtggcggcgaattgctgttctgcgagcatgggcgcgcgccggacgcctcggtgctggcctggcaacggcgcctgacgccctggtggaaaccgctggccggcggttgccacctggaccgcgacatgccggccttgctgcgcgaggccggctttcgcatcgacgagctggaacagggctacctgcccgggccgcggccgatgacctacgtctaccgcggcgtcgcgcgctgaatccgggcggccctcagagcgccttgggcaagggcgcgaacagcgcgtcgatatcggcctcgtcgagcttccagccgtcgccgttgccttcgctgaacaggccgtcggcgagggcggccttttcctgctgcaggtgctggatcttctcttccaccgtgccgcgggcgatcagccggtag

SEQ ID NO: 13092 - DNA, 720 bp, Pseudomonas aeruginosa
ccgctgtgcacgtggctgccgagggtcagccgcgcatacggccgggccgggtcgatggccaggctgagctgggtgtctggggcggagggtgaagtcatccggtatgtccttcggcgagaccagccgaaaccgcaaacagccgatattaccaagctcggcgcgcttgcgcagagcggagatggacgtatggcgcggcggacgaatgcgacgggatacgacccgcactcgtcggaccccggcaatccctggcgcgacgcgacctggcggtcgtccggagcaagtacaaatgcgaacgtaattgagatacagtcgcaaaccttccgaatcgacgaccgcctcgccacccgcgagcgcggcgtcgccgtgccagccagacgaggtagcgacgatgcaaggccctgtttccacccgggacgccaccccatgaccagccaggccctggccggcggactgtccgtcaccggccgcatcctcgtcgcggtcctgcttggctacgcgctggcctatgcggtcaccgcctgcctgagcatctacctgccgctgccgcgtcccgaccgggtctcgttcggcagcctcggctgcttcgccgtgtgggtcgcggccatcgtctacgccttcgccgcgcgcagcgcctggcgcgcctgctgggtgctggcgctggccagcctggcgctgggcggcctggcctggctcggcctcgactacggagcgcgtccatga

SEQ ID NO: 13093 - DNA, 1059 bp, Pseudomonas aeruginosa
tgcggcacgtcgacgaagccggcggcaatacccagagcctctacctggtggtcgccgatcccgacgccctgttccgcagcgcccaggccgccggcgccgagatcgtcatcgacatcaaggacgaggactacggcggtcgcggcttcacttgccgcgatccggagggccacgtctggagcttcggcagctatgatccctgggcatgaggccccgtccattcaccacaggagacgctgcatgaaaacgctcacgctgatcgatggccaggaggtcgccgccatcggtcagggtacctggcatatcggcgagcagcccggcgaacgcaagcgcgaggtcgcggcgctgcgcgaaggcatcgagctggggatgacgctgatcgataccgccgagatgtacgccgagggcggcgccgaggacgtggtcggcgcggctatcgcgggacgccgcgaagaggtcttcctggtcagcaaggtctacccgcacaacgccagccgcaagggtctgccggcggcctgcgagcgcagcctgcgccggctcggttgcgaaaccatcgacctctacctgctgcactggcagggccggtatccgctggaggaaaccatcgaagccttcgagcggttgcgcgaccagggcaagatcctgcgctggggcgtgtccaacttcgacctgggcgacatgtacgagctggacggcagcgcctgtgccaccaaccaggtgatgtacaacctggaggaacgcggcatcgaatacgacctgctgccctggtgccaggagcgcggcatgccggtgatggcctactgtccggtggggcagggcggcaggctgctacggcacccggcgctcggcgagatcgccgcgcgccacgacgccagcagcgcccaggtcgccctggcctggctactggagcagggggtgatcgcgatcccgaaggcggtgacgtccgctcacatccgccagaatgcagcggcggccgacctggaactgagcgccgatgacctgcgggcgctcgaccaggcgtttccgccgcctacccgcaagcgaaacctggcgatcgtctga

SEQ ID NO: 13094 - DNA, 204 bp, Pseudomonas aeruginosa
atagacatattcttatgttcctttactttcacgcttatggagcagcgtatattgcaaatgttcccgctccgtgacagtgccaagaaagctttgtgtcgggggaacgtactggttatgccggcttttttcgaaaagagcaagctggcagttcaggtactaatcagaggatcgattggcaggaaagtttccaggccaggatcctga

SEQ ID NO: 13095 - DNA, 498 bp, Pseudomonas aeruginosa
gcatttgtttcggcggacgcctgccaaccgggcaaaggttatgggcctggcgtcggcggcgcgtggcaggattgccgttccatcgccgcgcccaggttatccatgccgtcgcccgctcgcacgctgctcgtggccttcgtgtccgcctggttcctgctgggtgggctgggccatttcgtcttcaccgatttcttcgtcggcatcgtcccgccctacgtgccctggccgctggcggcggtgtgggtcagcggggtcttcgaactgctcggcgccgccgccctgctggtgccggcatggcgccggctggcggcgtgcgggctgttcatcctgaccctctgcgtgaccccggccaacctctacatgtggcagcaccccgacctgttcccatccttcccgccgacgctgctggccgctcgcctggcgctgcaggcgttcctcctcggctgcatcctggcgctgatgctggcgcgggacgaggcgccgctggcacgacgctag

SEQ ID NO: 13096 - DNA, 585 bp, Pseudomonas aeruginosa
tcgccgttttggcaggccagccacagcaggcggcaggtgctccggcgagtagcgttcgcggcaggcctgggccaggtccaggccgctggcgatgcccaggcgcgcggacagcgcctgcagcagcatcgccatcaggctggagagcaggattaccgagagcagcaggtagcccagttgcgcgccgccggcgacgtcggtggcccagttgcccgggtccatgtagcccaccgcgaccaggtagccggggccggcgaaggccagcaggcggcgccaccagtggccgccgccggggacttcgaccggctgggcgcgaccgggctcggcggcctggggggccggggtatccttcgcggacatgacgaagctcctgccggacgcgtgccggcgctgcgcgcgcctttcccggcgcgccgtggcgcgcgggttgggcgagcggttcagggggcaggaaggaggaagtcggtcaggccgaggccgccagttgccggtgcaggtccagcaggtcgctggcgatcaggtcccagtcctgctcggcggcgaggtcctgggactggccggggccgtattccagcggccgggcgatga

SEQ ID NO: 13097 - DNA, 438 bp, Pseudomonas aeruginosa
aggccagcgcgccgaggaacgctaccaggccgccggcgaggaatgcgctgcgccagccgtagatccccgccaggtacggcagcagcgcggcggacagcgcgccgcccagcggcagcccggcctggcggatgcccatggcgaagcccagctgggtcttggcgaaccagcgtgacaccgacttgctgccgcccggctgcgccgtgctgtagccggcgccgacgaccaccaggaacagcaggatggtcaggtagtcggtggcccacagcgaggcgcagagggccagcgcgacgatcagcgtgccgaggccgaccaccagccgctcggagtagcggtcgagcagctcgccggccaccagcaggccgacgatcggcaccagctgcgccgccgacaccagcaggccgatctgtagcgacgagagttgcaggtcgttctggatga

SEQ ID NO: 13098 - DNA, 2325 bp, Pseudomonas aeruginosa
cccagcggtagcgctgggttgggttcgcggcgagggcggcggtcactggacgaactcccgtgcgagggtgaagttggcttcgccgagcggatgcaggcgctgcagcgacaggtattcgccgagggtgcgttccatgcccatgcgctggaagatccgttcgccgtcgagctcggcctcggcgccgttggcgcgcagttcgtcgagagcctggcgcagcaactggcagttgtcgctgagcgtcacctggccgtcatcgtccaccgcgtagggcgtgtcctccatgccgacccgcagcacgtcgacctggctgtccgcctgcgcggcataggcggccagccggcgcaccgcgcagagcggggtgccggcgcgagggccgacgtcgagcggccggaagtgctgcgcggcatgctgcggcatcaccgccgcgccgaccgtgatgctgaccttgcgcttgcgcacgccgggttcgccgatgtcgtactccaggctcttggcgctctcgatcaccgcgcggaactgctggtaggtctccgggaacggcaggcgtggcgagaagccgaacagcaggatcacgttcaactggccggaaccgcccaggcgcaggcgcgggtgctccacggcgaaacgggtcatggcgtagctgcgcacatgctgcacccactccacctcgtggaacaggccgagcttctggcgcgcctggatggcgttgcggtagacctggaactgggtcatcggcgaggtcaccccgtagtcggcgcccttgctggtggagtgggtctgcaactcggccttttccagcgccgtcgacggctggtagtcgcgcaggtcggcgaggaaggccgggctggaggcatagtcgaggtcgagcttgcgcctttgcttctccagctcgcagatcacctgcaattcgatggccgcctggatcgtcacgaagtgcgcaccgcccaggtgcagcgggatggcgcagtggctgacccgctcccactcgccgaagcggcggatgttctcctgcacctcgctgccgttgcggctggcgccgaagctcaacatcaggtcggggaagcggttctgcagggcgcggctgaccgcctggtagatgtcgttgtcggtggtctgttcctgggtcagcgggttgcgcgcgtgatagtggtagtagcggcaacccatctcgtagagttggcgcgcttcgtccagcagttcgccaggggcggtgcggatggtggcgccggtgcagatgctgtcgagcaggcggtcgccggtggcggcgtggttgcgcggggtgaacttggcgccggtggaggcgcatccgagaatcagggttttccgggatccggtcatggtcgtctttcctccattcatcattccattgagggcggagcggtccgcggcggaccgaaaggctgcccagggcgtcgaaagtcgtcggtgtctcaggcaggtgaaagatgtcgctggcgggatcgttatgcgttgttctacgagagggatttaaaccgcatggcggcggccgtgcgcggcgcattcggcaacgctcgttgccgccggcacaaagaccttgcgcaaatcgcccggcgttgcgccaaccgccggcacggcggcgcaacgttgccattcgcgcaaggtcgctcaactggcggcgcgctgtcgcaggcaatcctccagggcctcgccgaggcgctcgatctcgccgtcgtcggtcaggtagtgcggagtcaggcgcagtacccccggcagcgcctgctcgcgcagcgcccagcgggcatactgcgggccgatgtaggaggcgttcacgccgcgcgcgtggaggcgcttcagccattgctcgccgctcagttcgggggccgcgtaggtcatcaacgcgctggcgtgcggcccttgttccagcggcgtccagccgagccggcggtagagctgctgggcgatgcgttcgcgcaactggcggttgcgtcgggcgatgcgccggacatcggtctgcaacaggtagtcgcaactggccttgagcgccaggcggcagcccgggttgaactccgggcattcggaagcgccgcgcgtcatcccgcgcctgcagggcgaaggcgtcgctccattgcgcgccgccgacgtccagcccgtcgggcagggccaggcgctccagggcacgttcgccgagatagagcacgccgagtccctttggcccgcgcagccacttgcgtggcgggaacaccagcacgtcgcagccggtcgcctccaccgccagcggcaactggccgaccgcatggctggcatcgaggaacaacagcccgtcatgggcgcggatgcgctcggccacgccctccagcgcggtag

SEQ ID NO: 13099 - DNA, 1110 bp, Pseudomonas aeruginosa
ggaacgcgcaacgatgatcgacctggtgatgctcaaggacttcctcgtcctctgtcggatcaagagcttcagccgtgcggcgcaggagtgccatgtctccgtgtccgggctcagccggcgtatccagaccctggaacagtggctcggcgcgccggtgttcgagcgccacaagcacgccctcgaactgaccgaggccggccgccagttgcaaggcgtggcgcaggacgcggtgcgcgccctggacaacctgcgccagtcgatccgcgagcgcgacgaagacgcccagcggcgcattcgtttctgcgccccgcacatcctctcctcggtgttcttcccgcactggattccgcgcctgcaggcggacttccgcagcgccaagttcagcgtcgactgcgattacctgccgcaatgcctgtcgcgcctgcgcgacggctcggtagactacgtggtggcgttgctcgacgaaggcgaggcggtgtcgcgccgcctgggcatcgacagcgaagccgagttccagcgcctggagcttggccacgaacaactggtggcggtctgcgcgccggacgccgccggccagccgttgttcaacctcgaccgcctgcagaccgaagcgctatcgttcctcggctactccgaggaatgccacctgggctgggccctggaaccgctgctgcgcgacagcggcctgttcctccagcgccatcacagctccagccagaccgaggggctgcgcttcttcgcccagtcgcgcctgggcgtcgcctggctgccgcataccctggtccgcgaggacctcgccagccgtcgcctggtgcgcgccggcggccagcgcttcgacgtgccgttgcgctacaccctgatccgtcgccgcctgccgctacccggcgaggccgaacgcctgtggaccttcctcggcgagctggcgcgcccggcgccgcgctacgcggtggtcggcgcggcctcctgagccgccgtctcggccagcagggcgcggcggaattcaccgaccaggtcgtcctgcgccgaaccgctgcggctgaccatcaccagctcgcgctggaattccagcgcgcccagttcgatcacccgtacccgcgccggctcgcgtag

SEQ ID NO: 13100 - DNA, 1374 bp, Pseudomonas aeruginosa
ccacagcccggcccggggcagcagcgccacgccgagaccgttctccaccatccgcgcgatcgcgtcgatctcatccagctccatcacctggcgtggcctgagctgttgcgcctcgaggaaatcgcccaccaggcgaccgccgaaggacacatggtcgtagcggatgaacggttgcgtgcgcagcaattccagcgcatccgtcgcagtgcattgcggcggcgcgatcagcacgaacggctggcgctcgacccgttgcgcggagagcccgcgcggcaggttgaacggcgggcggatgaggatcgccaggtccagttcggcggcgtccacctggtccagcaggtgcagcgagacgcccggcatcacctgcggctcgatgtgtggcgcctgttcggcgaggcgcttgagcacctccggcagcagcccggtctgcgccgtgttcaccgcaccgatgcgcaggcgtccgcgcgggctgtcgccctggccgatgccgtcgaacagcgcgaggatctgctcggccgtacgcaccgcctgcctcccgacctcgttcaggtgtgccgcgcgcggcgtgcgcttgaacaactcgacgccgacgctgcgttccagcgcgcggatctgcgcgctcaccgccgactgcgtcagccccacctgttcccccgccgcggcgaaggagccccggcgcgccacggcgaccagggtgcggagttcgcggatcatccaagcctcgaaaaaagtgttgctcaggcgaaatattatgcgctttccatcgaaatcggcacggcaaataatcccggcacacccacagaggaaccgcgccatgagcctgatgcccttccacctcgccatccccgtccacgacctgcccgccgcccggcgcttttacggcgaggtcttcggcctgagcgaaggccgctccgccgagcactgggtcgacttcgacttcttcggccaccagttggtcatccaccagcatccgcagaccgattcccagcgccacgccggcagcaacccggtggacggccacgacgtgccggtgccgcacttcggcgtggtcctcgcatgggacgactggcacgccctggccgaacgcctgcagcagcgcggcacccgcttcgtgatcgagccctacatccgcttcaagggccaggtcggcgagcaggccacgctgtttctcttcgacccctgcggcaacgcgctggagttcaagagcttccgcgacatgggccagttgttcgccaagtgagattgccggcgctccaccttactgtgcgcagtccgtgcagaactccagcgccgcgcagctggactgctcgtccggtaggctcgatgtcgcgcactctttcttgcgcaccacgctgcccagcggcgccagcttga

SEQ ID NO: 13101 - DNA, 315 bp, Pseudomonas aeruginosa
agcgcttcgcaccttgcccgagcggcaccttgtccgggcaaaaccgtcaccgcacagtccccttccaccttcatccccctgcgacgcacctcgcaatgcaaccagcatcccggctgcgccaccctctacctggactgcagcgcagccagcgaagatctgttcgacaccgcccgcacccgtctggagtcggcgatcggaacgctgagcgtcctcgacctgctcgacgaaaccgaagaacccggtgaaagcacctgccgcatcaccggctccttgctgtcgctgttcgaggcggaatacgcacgcagacaccgataa

SEQ ID NO: 13102 - DNA, 1536 bp, Pseudomonas aeruginosa
gctcgtgcttggacaacctttgtcgatgtggccgtcatggaagaaagcgcacaacagtgctcagaacgctatgtatccacccgcagccaacaccctgcttggcttttgcttgcatcacgccgggctccgcttgtgttgggttgcctgcggacgctgttcgagcgggcgcacgatgggattcccatggaggatgcgctgcaagcgctgtccgaaatgctggctgcttatgccagccaggatctttacgagatcgacccggatgcaacgcacatccaggcaggtcgtgaactccgtgaatggatcaagcggcgccttgttgtagagcgagagggccgcatctatgcaaccgacgcgctggagtccgccatacagttcgtcgactcgttggatagtcgtatcatgacctccacggcctctcgcctttcggtggtccagcgcgagattgaaaacctggaaacgggtctgaaccccagcccaagtggccgtattgccagcctgcgccgccgaatccaggacttggagcacgagctagcgcaggtagaagctggccacgtcgtcgtgctggacgaagctcaggcgatagagagtatacgcgaggtatataacctggccaccagcctgcgcgcagactttcgacgagttgaagactcttggcgcgaagctgatcgcgccttgcggcaatccatcatcagcgagcagtctcaccgtggagaaatcgtcgatcggttgctggacggtcaagatgcgttactcaacacaccggaaggacgtgtcttcgaaagtttccagcagcaactgaggcagtccgccgagctggaagtcatgcgtgagcgcttgcgtaccatccttcgtcatccagcggttccgaaggcactgaatcgtccccagcaacgtgagctgcgttggctggcgttacgcttggttcgggagtcgcaggctgtgcttcaggcgcgtgcccgaagcgagcgcgatgtacgtggcttcatgaagacgggcctggccgccgagcatcatcgcgtcggacagttactcaacgatttcttcaatctagcgctcagcgtcgactggcaacgccaggccgtgcgtcgtagcactgtccgtttgccgccggttggcgtagccattaccggagtcccagcgattgagcgtctacgtttcaagaccctggatgacgatgacacgggcgagctggatctgagtctgaagccagcggggctggaacagattgacgatgacttctgggatgctttcgacgggttggatcgcgaagcgctgattcatgacaccctggcggtgctggtggagcaggggcgacctgtgagtctcggggagcttgcgtctttgcttccacctgctcacgacctggaaacctttgcgctctggttggctatggcgcgcgaggcaggtactgaggtgctgacagaggagcgtcagctcgtggagctagttgacgaggatgagcaacgctggcgcttcaatctgccttatgtcggactcgaccacgaggcactcaaggacatcgattgggagttgtga

SEQ ID NO: 13103 - DNA, 1230 bp, Pseudomonas aeruginosa
gctgggaagctttggatgagcatcatcaacagcgcatcaaggccatgcatgaagtcgcccactgacatcggtcgcagcttggccaggcaatggcagcgttctagtgttcggttggaccgcttactcaattctgctagctggccgcaaagcttcaacatcggcaagccttcggcacgactattctctgacaacatccggacggtgcttcggcatgtggaaaattggcggagcgtgaaagtgggtaaggtcgactgggaacccgtcagctaccgagcagggttggctccaatttccttgccaatgcgctggcacttgcgcagtccctccgaatggattgccgcaaccgacgatccttcggtcagccaggaatacgctcaactcgagtatctggtcgagcaggtagatagttcctttcatgctctgctggtggcgcaacggagcctgtggttgacgaagccctctgaagaagtcatcgctacagcgcagctcgccactcaactatctccgggctgcgctcaaggccgcccattgcgcctgcttgcagagcacggagtggacaccaagtttttcgagcgaaacgctatcttgctgacgaaactcctcgatgagcgcttcgaaggcgcggcgtccgagcaaggtctgacgacttttctggatgcctttgaagaaaccagtcattgggttctagtcgttcctcttcagcctgagctgctgcccttcaagcggatcaggctcacgacttcggaactggccgaaacctcacttcccggttcgcgattgctcgtggtggaaaatgagcaatgtgttcacttgctacccgaaacgctgccggacaccctcgctgttctgggcgcagggctcgatttgcagtggttggcgtctgcgcatctggccgggaaacagatcgcttactggggcgacatggatacctggggcttactgatgctggcgcgagcgagacaccatcaacctgcagtcgaagcactgctaatggaccgggagctgtttgaccagcactccttgggaagcgcggtcgtcgagccagctaaagctcaggaattggctcccgaaggattgatgaccgacgaagctgatttctatcggtatctccttgcacaggagcgggggcgccttgagcaggagtatctgccacgcaggcaagtcgaacaggctattagtaaatggtttggagagtcggtagcgccggctcatcctgagcgaacggcttga

SEQ ID NO: 13104 - DNA, 255 bp, Pseudomonas aeruginosa
aggtatgttctgcttctggtagtcggggatcacgatccagcgaggcaagtgggacggaatctgttcgatgtgtttggcgagttcgtgggccgatacccacacctttgcgtcgatatcctgagtgctttggcctatacggacacgaagatctgttcgatcgacgttaggccaaagttctacttcgtaacctctctcggtcagggcgtgtgccagggacagttccagcaatcccggctgcagcgtgaatttccataa

SEQ ID NO: 13105 - DNA, 1053 bp, Pseudomonas aeruginosa
acggccttgaacatgatgacccccgaaaaatcactgctttggtccgaggtgcttaagaggccggttgatgtccaattggcgatgtttcgtcaggcttccgctcagccctgtgctgatgatgtgaagacaggtttccgcgcgttcgccgccgacctgtttgcacgtaaactggtcagcatggccgagtatgtttcgatttttggcggcactgcccttaactgccttacacctgccgggtcggggttattccgcgacatggccacgggcaccgatgccacagcattggccgggatctacagccgtgcaaaatacggcagtgtgggtgatatccagtatctcgcacgacaattgatcgactacctctgtggcgagctggataggtcagattcgcaatggtcatgcctgttccggaacgccaaggcctgtggtgacaacgtggtgatgatgaccactggttggcgtaacgtgccgtccacggcgaacgtgctctatgagatcgtggtcgaggaggtcaacgtcaaattggcgcatttggcgttgccgaccatcatcaacgtcaagctacccaggattgcgccaccctgcgaggactacgccagcctcagcaccgaggagcgggagcacgtcaatctggttcaggaccacgtcattccggctgaaaacttctatcgttggagcggtgtgcatgtgatcttcggcgacgatgtgttggttaccggatctactgccgacaaagtgctttatgaatccatgaataacggtgcaaagtcgttccgcgcaatctatccggtggcgatcgatccccgggtggcgctgggcgacgcctcggttgaggatcggctgaatagtgtggtggtcgagcaacggctggacgataccgttgcggagctgctgtctgcgcgggactaccaacctatcttgcgcactcttcgcctgttgttcggggagggaaaccgagagtctctcgccgctttcttaccgaaggtgcctgcaccgacctggttgcgcttgggtggattcaatcggccctcgcaacactgggttgctgaatag

SEQ ID NO: 13106 - DNA, 183 bp, Pseudomonas aeruginosa
ttgtcgtcgttggcaactataagtttgcagcagcgaatttacgagttctgctaccagctcggcatgcccctcaagttttgttaccggcgtcgaatcctaatcggccccaaaaccttgacaggtcgacgaccagtctacggcaaagggctgcgagagtccaatccgccgctcataaacctttga

SEQ ID NO: 13107 - DNA, 1056 bp, Pseudomonas aeruginosa
attcgccgctgcgtcgcggcagggcgttcttctgggtttcctcgatcttcttcagggcgtcgatcagcacctggtagtcgtggctgtcccagggcttctggatgtccgggatgcgctggccgaggtagtagaggtcggcggccgcgagcgggcggccgagaaccagtaaaaggatggccagcggccagagcaggcggcgtgatagggtcggcacggactttccttgcggggcgcgtggatcggcctaggttagcgatggccgaggccgccgtcaccccgcgcttcgattggggcggacgggatggcaacggcgcagtgggacggcttgcaggcggtattcgaggacctcggcggctacggcgcgctggcgcgccaggcggcgcagggcgaggggccgctggtggggcatctgcaacgaaccaacatccagctcgcggcgatcccggtgttcacccgcaaggggatcgccgagaccacggtcaacgacttgctggaggctgcgcgggtctcgcggcggactttctacaagtatttcgccggcaagctggaggtgctggaaagcatctaccacagcgccgtgcaattgctgctggcgcgcttcggcgggctgcgcagcgaggccggcagcgacgaggactggttgcgggcgatggtctcgctgttcttcgactaccacctggcggtcggtccgatcattcgcatgatgcaggaggaggccctgcatgccggctcgccgctggcggcgcaccggcagcgcgcgcacctgaagattatcgagctgtgggccgagcgcctgggcgcccagggcgcggcccacgatgcgctgacctaccgggtgctgatctgggcgatggaggcggcttcgctggagctgctcaatgccagcgacccgctggagctgccgcgggtcaagcgggtgctcggcgacctgctggtgggtacgctctgtccccgcacccaggctccgacgagattgcaagggtaacagccgggcagtcgccgctcgcgcctacagaacctaggttgggctcgcagcccgccgtggccatgctctga

SEQ ID NO: 13108 - DNA, 636 bp, Pseudomonas aeruginosa
gggcctgatggcgacgctgtattccatcgcctgcttcctggtcggcgagccgttgcaggacgtgcgggtcggcttcgcctatccgccgccggcccatgcccggcgctacgccgaggtgttcggggtggccgcggagttcgagcagccctggcactggctgagcatgcccagcgagtacctggaacgaccgatggcgctggccaacccggccacggtgcagatgtgcgagcagcagtgcgaggcgctgctggccaccctggacgtccaggaaggcctgctgacccgtgtgcgccgcctgctgctggcgcgtcccggcgacttccccgatctcgaacaggccgcccgcgaactgcacaccagcgggcgcagcctgcgccggcacctgtcgtcgttgggcaccacctaccagcaggtcctcgacgatgtgcgcaagcgcctggccctgcaatacctgaccaccacccagctaccgctgtacgagatcgccctgctgctcggcttcaacgattcgtcgaacttccgccgggcgtttcgcaagtggaccggcaagctgcccagcgactaccgcgaagcgccctgagccgacgccggcgatcctcggcagcggatggatgtgccatgcttggcgtttcatag

SEQ ID NO: 13109 - DNA, 654 bp, Pseudomonas aeruginosa
tcggagtcttgcatgtcgacatcccccgcgctgatccgcgaaacctttcccgtcgggcctttgcagtgcaactgcaccatcattggcgatccgctgaccaggaaggccatcgtcgtcgatccgggcggcgaccacgaactgatcctgcagcgcctcgaccgcctcggcctgcaggtggtcagcatcatccatacccacgcgcacctggatcacttcctcgcctccggcgagatgaagaagcgcaccggcgccagcctgcacctgcacaaggacgaccagttcctctgggacaacctggagatgcagtgccaactgttcggcgtgccctacacgccggtgccggccccggaccgctggctggccgacgacgaggaactggcctgcggttgcggagtggcactgcacacgccggggcatacgccgggctcgatgagtttctggttcccccgggcgaagctgctgatcgccggcgacaccctgttccgccgtggcatcggccgcaccgacctgtggggcggcgactcggcggcgatccagcgttcgatcaggcagcgtctgtacagcctcgacgaggacgccacggtggtcgccggccatggcccggacaccacgctgggcgaagagatgcgcgagaaccccttcgtcaggggctga

SEQ ID NO: 13110 - DNA, 819 bp, Pseudomonas aeruginosa
aaaggatttttccgagcatcgggaattttgccacctggctatgctctaagatatcggccgcccctcacgcaggggcgtttcagtacctcgaggagtagttttcccatgttcacctcccgttgcctgcctctggccgcagccgtcaccgcactggcgctgctcgccggttgtgccaacaacaacccctacgacacgcaaagccaaagccagggtggcatgagcaagacggccaagtacggcggactgggtgcgctggccggcgccgtcgccggcgctgcgatcgaccacaacaaccgtggcaagggcgcgctgatcggcgctgccgttgccggcgcggccgccgcgggttatggctactacgccgacaagcaggaagccgagctgcgtcggcagatggaaggcaccggcgtggaagtgcagcgccaaggtgacgacatcaagctgatcatgccgggcaacatcaccttcgccaccgattcggcgaacatcgccccgagcttctacgcgccgctgaacaacctggcgaactcgttcaagcagtacaaccagaacaccatcgagatcgtcggctacaccgacagcaccggcagccgccagcacaacatggacctgtcccagcgtcgtgcgcagagcgtggccggctacctgaccgcccagggcgtcgacggcacccgcctgagcacccgcggcatgggcccggaccagccgatcgcgagcaactccactgccgacggtcgcgcgcagaaccggcgcgtcgaggtcaacctgcgaccggttccgggcgcccagggcccggcgcagacccagccgcagtactga

SEQ ID NO: 13111 - DNA, 1629 bp, Pseudomonas aeruginosa
tcgcggcctggacgaaaaagcccgccattcggcgggcttttttatgggcgctggtcggcgctcttcgtcctacgccttggcgttaccgggaaactcgcggtgcaggctgtcgagcaactggtccttgcgctcccacagctggttgacccattgctggaattccgcgcggtagccggcgtcctggtcgtagctcttgccgacgaactggcgcggaatctccagttcctcgaagcgcaccacgacgtccttcaggcgtccggaaagcaggcaccagaaggtcgggctgccgtccgggtagtggatggtcacgttgaccagggtcttcaattgctcgcccatggcgtcgaggacgaaggcgataccgccggccttgggcttgagcaggtggcggaacggcgactgctgctcgtcgtgcttggcgcgggtgaaacgggtgccttcgaggaagttgaacaccgctaccgggatgcggctgaacttggcgcaggccttgcgcgtggtcgccaggtcctggcctttcttctccgggtgcctggccaggtaggccttgctgtagcgcttcatgaaggggaaatcgagggcccaccagcacaggccgatgatcgggacccagatcagttcctgcttgaggaagaagcgcagcagcgggatgcgtcggttcaactggtattgcaggacgaggatgtcgacccagctctggtggttgctggtgaccaggtaggagtgttggtactccaggccctccaggccctggacgttccagcgggtgcgctggaccaggttcatccagcccttgttgcaggcgatccagccttcggcgatcaggctcatgatcttgctgcacaggcgctgagcggcggcgaacggcaggagcagcttgaccagggtcatgccgaacagcaggcaggcccagcacagggtgctggacaccagcagcaggccggccagggagccgcgcaggaaatgggggagaaacgacagcatcaaggagtccttgtacgtaggcgcccggccagggccgggcgcgtggagcggggcgtggtcccgccgttcacatggcacatcctcgtgcctggccgaagccagtgccgcccactgggcggcgttccttcaggccggggcctgggcgtccgcctggatggcggtgagggcgatggtgtagacgatgtcttccaccagcgcgccgcgcgacaggtcgttcaccggtttgcgcaggccttgcagcatcggcccgacgctgacgcaatcggcgctgcgctgcaccgccttgtaggtggtgttgccggtgttcaggtcggggaagatgaacaccgtggcctgcccggccaccgggctgttcggcgccttctggcggccgacgctggcgatggcggcggcatcatactgcaagggtccatcgatcaacaggtcggggcgctgctcgcgcgccaggcgggtggcctcgcgaaccttgtcgacatccaccccggaaccggagtcgccggtggagtagctgatcatcgcgacccgtgccgggatgccgaaagcctgcgccgacgcggcactctgcacggcgatctcggccaggtcactggccgaaggatcgggattcaccgcgcaatcgccgtagaccagcacctggtccggtaa

SEQ ID NO: 13112 - DNA, 576 bp, Pseudomonas aeruginosa
cacgatgccctgggcctgggccaccgcctggacctcttccggcttggccagcagcacgcagcgggcgatgccgcgcgcctggcagatcgccgccgcctgtacggtgcgcggctcgctgccctcgggcaggacgatgcgcttgccggccttctgcgcgcgttgcaccacctggtagcggaacgccggcggcgacaggcgcagctcgcgcggcgtgccgcagcgctgcttgagccattcgaaatcgatgtgcccggcgacgaactcggtgacccgctcggcgcgctcgcggtcgtccaccgggatttccttgttcatccggttcaggttggtcgcggtgtcgtaggagccggtggccaccgacagcaccggcaggccgccctgcagggcgccgcggcagagttccatgatccgcgggtcgggcgggaagtcgctgcacagcagcaggccggccaagggtacgccgttcatcgcggccaggctggcggcgaggatgatgtcgtcgcggtcgccgggggtcaccaccagcacgccgggcttgagcagttgcacggtgttgggcacggcgcgggcgcatag

SEQ ID NO: 13113 - DNA, 1083 bp, Pseudomonas aeruginosa
cacgatcttctgcacccggcgctgctcatagtcgccggcgttgatcacccgagcgctgagcaggtcggcgatgtcgcgggtgcgcgcggcgttgagttcgtcctgccagggaatgcagccgatcaggcggaagtcgtcgcgcagcagcggcgagtgttcggtgaggcgccgggcgaagtccgccacgccgtcctcggcgttggccgcgtcggcctcgccgcggaccttgttgaggatcaccccgagcaccttcggatcgcgcgggccgccgaacagctgggcctggatctcgatacggtcggtcagttcggtgagcgtctcgttttccggcgcggagaccaggatcacctcggcgtcgagactctttgccaggtggaagttgacccgcgcggcgtagctggcgtgacgggtcggtaccatgccttcgacgatcaccacgtccttgtcggcggcggcgcgctggtagaggctgatgatctcttcgagcagttcgtccagttggccgtcgccgagcatgcgctcgacctgggccagcggcagcggcttcggcgtatccaggccgtgggtgcgcgccaccagttcgctggagcgctccgggccgaggtcgccgggatgcagttgggcgatgggtttgaagaagccaaccttcagcccggcgcgttccagggcgcgaagcaggccgaggctgatcgaggtgaggccgacgccgaaaccggtcggggcgatgaagaaggtatgcatctgggctccttaagccgtgcgtttggccacgccgcctggttgggcgggggcgtcgatccagttcagtcgagcagggccagcgtgtcgagggcgatctgccgctcttcgttggtcgggatcaccagtacccgcggatgccccgcggcctggatcggcccggcgacgccgcgcacgcagcgggcgttggcctcctggtcgaggcgcaggtcgaacagccgcaggtgggcggcggtcttggcgcgcaccagcggcgagttctcgccgatgccaccggtgaagatcaccccgtccagttgcggcagggcgcagctcatcgccgccagggacttggccaggcggtag

SEQ ID NO: 13114 - DNA, 501 bp, Pseudomonas aeruginosa
atgcgcaaggagtacgtcatgagtgcctttcacgatctcaccctgcaggggttggatggacaggacctgccgctttccccgttcaagggcaaggtgctgctggtggtcaatgtcgcctccaaatgcggcctgacaccccagtacgccggcctggagaatctctaccagacctaccgcgagcgcggtttcgcggtgctcggcgtgccctgcaaccagttcgccgggcaggagccgggcagcgaggcggatatccagtccttctgcagcctgaactatggcgtcagcttcccgatgagcgccaaggtcgaggtcaacggcagcgcgcggcatccgctctatcgcctgctggcgggcgagggcgcggagtttcccggcgacatcacctggaacttcgagaaattcctgctcggtcccgacggtcgcgtgctggcgcgtttcagcccgcgcacggcgccggacgacccggccctggtgcaagccatcgagaaggccctgggttga

SEQ ID NO: 13115 - DNA, 654 bp, Pseudomonas aeruginosa
cgcctgatcaccgccgttgataatgctgggcggacgagacgaccggtcatattctctcgttccatgactagcaaccgtctcgacaagcgcgaactgatcctggccaagggctccgaggtcatgacccgacgtggctaccacggcaccggggtgctggagatcgtccaggccgcgcgcatccccaagggctccttctatcactacttcgatagcaaggaagctttcgcccagcaggccctggagcacgtctacgcgccgcgcctggcgcgctacgcccaggccctcggcgatagccgcttcagcccgcgcgagcgggtgctgcgctactacggcgagctgctggagcacttcgcccgccaggaaaagcccgaataccactgcttcatcggcagcctgagcttcgagatggccgagctgtcgccgccgatcgcggccaaggtcgagtcgatcctgcaggcttccgcgcgaatcctccaggactgtctggagcaggcgcgcgaggccggcgaactggccgccgacgaggactgcgcgagcctggccggcttcatcggcttcgcctggcagggcgccctggcgcgcttcaaggtcggcaccggcctcgctccgctgaatgctttcatgtcgcgcctggagctgctgctccgcgcctga

SEQ ID NO: 13116 - DNA, 444 bp, Pseudomonas aeruginosa
tacctgcccgaacctcccattccctctcaggagtccgtccatgagtgcccccgtagaagccctgttccaaccgttccgcctcggcgccctggaactgcccacccgtgtggtgatggcaccgatgacccgcaacttttcccccggcggcgtacccaacgccaaggtcgtcgagtactaccgccggcgcgccgccgccggcgtcggcctgatcgtcagcgaaggcacaacggtcggccacaaggccgccaacggctatccgaacgtgccgcgcttctatggcgaggacgccctggccggctggaagcaggtggtcgacgcggtgcatgccgagggcgggcgcatcgttccgcagctctggcacgtcggcagcgttcggcgcctgggcgtggagccggacgccagcgtgcccggctacggcccgatggagaaggccaaggacggtaa

SEQ ID NO: 13117 - DNA, 495 bp, Pseudomonas aeruginosa
cgtcggcctggacggcagcgagttcctgcaattcttcggcaaaaccgacgaggtggcgcagccggcgagcatcgacggcctggtggagcgcctggacaagggcgagttcgacctggtcgcggtgggccgcgcgctgctggtggatccggagtgggcggtgaaggtccgcgaggggcgtatcggcgacatcaagccgttcagccgcgaggccctggccagcctggtctgaaggcgcgtccgcgacgcaccggcccggcgcagcgccggcaagcagatcccacccctcggggtgggatttttcatggccgtgattttttccgaaaacccgccgtgcggccggctgacttcaaagtccgaaacgggcattgtatgaccgccaacacaacaataggccgagaaacggccagaggagcgaatccatgcgtatcggcctggtggtcgacgcgacctgcgacctgccgcccgaattcctcgccgcccacggcatccgcgtga

SEQ ID NO: 13118 - DNA, 681 bp, Pseudomonas aeruginosa
ccgacttcgactacgtggtctgcctcaccgtcgacagcctgcgcagtccgatcttcgagcacgccacccaggcttccttcggcctgctccagcactaccacgagcgccgccacgcggccggcatcgccggtcccttcaccctgcgcgtactcgacagccactcggtgttcgccggcatcgcctgcctggcggccgagggcacgcgcctgctggcgcagggcagccaccccaacgcgctgcgtacgcgcctcgaacagctcagccagcagacctgcacctacctggtcgccgatgacctgggccacttgcgccggcgcggcttccagaagggtgatcgcagcggtttcgtcgaccgggtcaagggcgcggcgctggggttgggctcgctgctcgacgtcaagccggtgttcagcctggccgatggcgaggacaaaccggtggcgctctcgccgagcttcgagaagtcggcggagaagctgttcggctatgccctggcgcgggtacaggcgggtgagctgctggcaccgcaactgggtctcagctatgccggcgatccgaccgcgctgcgcgacctgccgggcttcgccgcgctggagaatgcctgccgcgagcgcgacatccacttgcacctgggcatgctcagccctaccggcggcatcaacctgggcgccggggccatga

SEQ ID NO: 13119 - DNA, 363 bp, Pseudomonas aeruginosa
gcgtcctccttgcgcgcgtcgctctgcgggacgttggtcaggtcgggggcgacctgggtatcgcctgcgccctggaagtcgaacagcgaagtcaggtcgccgcagacggcacgccgccagggcgagatgttttcctcgacgacgccgaagcggcgttcgaggaagcgcagcaccgaggtatggtcgaacacttcggcgctgaccttgccgcccttcgaccagggcgagatggcgatcagcgggacgcggtggccgagcccgatgggcagcccgctggatgcctcgatctcgccggcggtgctgaccgtggaaaggccgacgccatccttccacggcggcaccggggcgctggcgtggtcatag

SEQ ID NO: 13120 - DNA, 2067 bp, Pseudomonas aeruginosa
cgactttcatgcgtcataaagttggctggcgaatctcgcaaccttggctggagcccgctagggagtggtgccgagcacctcgaaggagcgggtcgagccgccgatttcgctgatcttctgggtccagaagttcttcgcgttgccgtagtgcctgatgtagtaatggccgggctcggtccctggtggaatggaccagttgatagtcgctttcgaggcagatatacccactctctcccagcggtattgagtatcccagtcattatcggtggcaacggtcacgggtgtctgtttgccatccttgccgatattcaccacttccaggaaagtcttctcggtgcgcaagtcattcttcggatgtccggtcacgaaagcgacggtcaccttgtcgccgatgcgataactttccctgggttgttgcaacacgtcgccgaaggacttgccgatatagggatcatcggccactactccggtctggaagttcatctggcagcaggacaggtccggcgctatcgccgaggtttccaccggcaggcgttcgcgcagcgccaccgccatgtcgacgaacaactgctggtaggcggcctgggtccaggggccatagagggtcgagccgccttcgtattcctgggcggcgtattcctcgcgggtggtgacgtagctggcataggcattcgcgtagccattgaagaccacatggcggataccggccgcttcgctggccgcctgcaccgcgcggcggatccgcaccccggccatcacggtgaactcggcgggggcgccgagcagttccaactggccgatgcggaacatctggatcggcagcaccgtcggcgtccaggggtagggtttcttgttgccggtgtcggcgaggatggtcttttccgcctggcattgcaccagttcctgcggcggcacgccggtgagcaacccgccaagggccgagaggaacggattgttgccttcctccagccccagcgggcctggaccgtcttcggtgctaccggcggccaggctggtgccgatggccgcggtgcacaactggcgcggctggccgtcggtgaactccgggcggatcggcaggcgggtgaagtcgacgaaacggaagcgcgaatccagttcgccgagcacttcctcctgggcctggccggcgatctcgtaggccttggcgaattggcgcagaccgatctcgcgggtgttgtcgaactcgttgtcgaagggaccggagccgggcttcaggttcaggttgggcgacaggttgccggcattggtctgggcgaaggcggcgacgaaaccgctcttgcggctgacgtcgtgctcccagtgataggaggcgtagcccttgttgtccggggagatcaggtgattggcgttggtcatcgaggtgctgtgcaccgggaaccaactgatcgcgccggccagctcgccgttggcgtcgacgaagctgagcacgctcatctgcgggtcgatgccatcctcgtagccggcgatgtccggattcttcaggtgcgacagcagcgaacggttgcggctggcgttgcgcagctcgccgctgccgtagaacaggcggccgggctgcaacctggcctgggcccgctcgatggagcggacgatgccgtcgacgatggcgttgaaggtcttttcctggaagccgagcaccgacaggttgtacatcgcgtagtgggagaagccgcccggaccggagtgggtgtgggtggcggcgagcatcacgttgttctcgtcgtagacaccggggtacttcgccttgagccgggccaggaccttcaggtgcacggcctggaagatcatccccaggtcggtgttgacgtagaccaggcgacgtccgctggccgcttcctcgatcacgaaggcacgcgcccactggcgcatgtggatgccggcggtcttctgttcgagggaggagtaacccatcatgccgacttcggcggcttcgccggtgatgtccgccttgcccaggccgaagcggtagggcaggtcgtcggccctggcaggcatggagagcgccagcaggacgcaggacagcaagagcgcggtgaatgcggaacgtga

SEQ ID NO: 13121 - DNA, 735 bp, Pseudomonas aeruginosa
gagcataggctgactctatcgtgcgaattgaaattcgacatttcaatgcatcgtcgtggctgggtaacctgcgctgcatattcttccgggagcctggcgtcgccgggcgcaacccaaccttctaggagcctcgcgatgagcgtactggtcaacaagcaagcccccgatttcactgccgccgcggtcctcggcgacggttccatcgtcgatgccttccagctttccagcctgcgcggcaagtacgtcgtactgttcttctggccgctcgacttcactttcgtctgcccctcggaaatcatcgcccacaacaaccgcatggataagttccgcgagctgggcgtcgaggtggtcggtgtctccatcgactcgcagttcacccatcacgcctggcgcagcacgccggtggagaagggcggcatcggtgcggtcgagttcaccatggtcgccgacgtcaagcacgagatcacccgcgcctacggcatcgagcacgaggacggcgtggccttgcgtgcttcgttcctgatcgaccgcgccggggtggtccagcaccaagtggtgaacaatctgccgctggggcgcgaggtggacgagatggtgcgcctggtcgaggccctgcagttcaccgaggaacacggcgaggtctgcccggccggctggcgcaagggccagaaaagcatgaaggcgatcgccgagggcgtggcctcgtacctggccgagaacgccgaggcactgtga

SEQ ID NO: 13122 - DNA, 1611 bp, Pseudomonas aeruginosa
cattcggcgagcaggtggcagaagctcttgcgcttgggcgagccgacgatcagcaggatgcgcttgccgtcgccttccagcggggtggcgccggtcttggcggtttcaaccatggtggccggcctccagcatctgctccggccgtacccattcgtcgaactgcgcttcgtccaggtagcccagctgcagcgccgcggcgcgcagggtggtgccttcggcgtaggccttcttggcgatttcggcggccttgtcgtagccgatgtgcgggttcagtgcggtgaccagcatcaggccgcgctccagcaggtcggccatgcgctgggcgtccggctccaggccggcgacgcaatgcttgttgaagttgcggcagccgtcggcgagcaggcggatggactccagcaggttgtagacgatcaccggcttgaacacgttgagttgcagatggccctggctggcggcgaaggaaatcgtgctgtcgttgcccatgacctggcaggccagcatcgacagcgcctcgcactgggtcgggttgaccttgccgggcatgatcgagctgcccggctcgttggccggcagcttcacctcggcgaagccggcgcgtgggccggaaccgagcaggcgcaggtcgttggcgatcttcatcagggccaccgccaggctcttcagggcgccggagaggatgaccagcggctcgtggccggccagggcggcgaacttgttcggcgcggcgacgaagggcaggcccgattcggcggcgatttccgcggcgatggcgtcggcgaagcccttcggcgcgttgagcccggtgcccaccgcggtgccgccctgggccaactggtagaccgccggcagcgccgcgcggatggcgcgctcggcgtagtcgagctgggcgacgaaggccgagagttcctggccgaaggtgatcggcgtggcgtccatcaggtgggtgcgcccggtcttgaccaggctggcgtgccgcgccgactgttcggcgagaccgccggaaagctcggcgatggccggcagcaattgttcgtgcacggccttggcggcggcgatgtgcatggcggtggggaagctgtcgttggaactctgcgcgcggttgacgtggtcgttgggatgcaccggcgacttgccgccacgcggattgccggccagttcgttggcgcggccagcgatcacctcgttgacgttcatgttggtctgggtgccgctgccggtctgccagaccaccagcgggaagtgttcgtcgtggcggcctgcgaggacttcgtcggcggcctgttcgatcagccgggcgacttccggcggcagttcgccgaggtggtcgttgacccgcgcggcggctttcttgatcagcgccagggcgtggatcacggcgagcggcatgcgctggccgccgatggcgaagttctccagcgaacgctgggtctgggcgccccagtaggcgtcgtcgggcacctcgatggtgcccaggctatcggtttcggtccggctcatgagtgttctccagggtgcgtatccggcagtttaggccttcgctcccgccttgggttccgctgccgtcgcttcctcgtgggcatttttcgccgcgctgcgggtcggaaatag

SEQ ID NO: 13123 - DNA, 447 bp, Pseudomonas aeruginosa
ggcagaaccggactctcgacaagccccgcctgctcggcctggtatggcccttcatcgtcgtggtgctgctgcaggccatgctggcgggcggcagtctctacgtcctctccgcggtgcgcagctatgtcggcggcgaaagcctctggtcgaagggccagaaggatgccatctactacctcaccctctatgccgactcacgcgccgacgaagacttccgccgctacgaggaggccatcgcgatccccctcggcgaccgcgagatgcgccttgccctggaccagcccgacccggacatcgaggcggcccgccagggcatcctcaagggcggcaaccatgccgacgacgttaccgcgatcatctggctgtaccgcaacttccacgacttcagttacttcgagcgcgccatcgagctgtggctggtgggtgacaagtacgtcatggaactga

SEQ ID NO: 13124 - DNA, 1845 bp, Pseudomonas aeruginosa
gcgcacatggccgtcggccggtgcggcgatgatcgccaggcgaccgaaggcggccagcgccgggaccgccgcctcgagccagaaaccggtcgtatcgaagatcacctcggccccgccggggaagatcccttccacctgtgccgccagttcggccggctcgcccagcagcagcgcggcgatgccctgcgtttccagcgcctggcgttgctcctcgcgccgcatcgcgccgatcgcttcggcccccagggccttggccagcgccagcgcggccttgccgaccgcgccgttggcgccgattaccaggagccgggtgccggccttgacctggctgcgttgcagggcgtcccaggcggtgctgtagggcaccccgcaactggcggcctgggcgaagctcaggctttccggcttgagcgcgacgccggcggccggcagggtcaggaactgcgcgtggctaccgtcgcggaagaatcccggctcccgcccggtgccccagaccgcctggccgagcagagccttcggtccctccaccaccaccccggcgaagtcgcggcccggtacccggggcagggtggtataggggaagcggccgaggacgttcttcacgtcgctcggattcagcccggcggcgcggatttccacccgcacctcatcggcggcgggaagcgggtcgggcatgtccaccagctcgagggcggcgaggtcgccggtacggtcgaattgcagtgctttcatcgggggctccgtgtcgtcgcggcgatcagtgcagccactgctgcagcaggtcgcggccaagggggaaaagctgttcgccgagctgcatgccaagcaggccgaccagggcgatggcggggggcgccggcgagcggaagtcgaggacggcgtagagcgcgccgaccagcaggccgatgccgagggagatcaggtagttcatggcggctgacagggacggtgaacgatggtgccagtctagttggccgaaaaaacatgtatcggccaatcgctatcgaataccggtcaaggctggaacggctggtgatgctcggccctgtactcggtgggagagacgcccagctcgcggcggaacatgtcgctgaaggcgctcggcgtatatcccagggcatgggcgatgcctgccaccggacggccatcgatcagtgcggcggcggcggtcgccagctgcacctgccgccgccagtcggcaaagcccatgcccaggctgcgctggaacaggcgcgagagggtccgcacgctggccccggcgtcttcagccaggcgctccaggccgatgtccagggagggattggccatcaccgcctggcacagcgcgagcaggcgcctgtcggaggcgtccggcagcggtacgcggaggctggaacggcgcgcgcggccgagttcgagcacggcgagatcggccagcgcccgatagtagtcggggtcgctctgccgttcctgctccaccaggctgacgatcagctcgcgcagcagcgggccgaccaccagcaccagggtgcggtcctccaggccgcgggagagttccgggctcaggtaaatgttgcgcatctgcaactcggaggcgacccgcaccgcatggcgcaggcccggaggcaaccagaccgcccgttgcggcgggaccggcagggcctcgtcgggcgtctccagccacatcatcccggacaccgcataaagcacctggccccaggcgtgctcgtgggcatcgacgcggtgcccggcaggatatctgcgggcgaccccgcgcaggggccggcgactgtcgctcaggtcgggtggggcgggtcgtgccatgggaatgccgtcgcggaggaaagacgcaggttaaccgcttga

SEQ ID NO: 13125 - DNA, 1149 bp, Pseudomonas aeruginosa
gatgaaggcatctcccatgtcgccggccgcctggaccggcggcggtccattcaacaagaacaacgaggaggccggatgaacgccgtggccaagatcgaacagcacaatcccatcggtaccgacggattcgaattcgtcgagttcaccgcccccgacgccaagggcatcgagcagctgcgccagctgttcaacatgatgggcttcaccgaaaccgccaagcatcgttccaaggaagtcttcctgttccagcagaacgatatcaacatcgtgctcaacggcagcccgaccgggcatgtccacgaattcgccctcaagcacggcccgagcgcctgcgccatggccttccgggtgaagaacgcttcccaggccgccgcctacgccgaatcccagggtgccaagctggtgggcagccacgccaacttcggcgagctgaacatcccctgcctggaaggcatcggcggttcgctgctgtatctcgtcgaccgctacggcgaccgcagcatctatgacgtcgacttcgagttcatcgaaggccgcagcgccaacgacaactcggtcggcctgacctacatcgaccacctgacccacaacgtcaagcgcggccagatggacgtctggtccggtttctacgagcgcatcgccaacttccgcgagattcgctacttcgacatcgaaggcaagctcaccggcctgttctcccgcgccatgaccgcaccttgcgggaagatccgcatcccgatcaacgaatcggccgacgatacctcgcagatcgaggaattcatccgcgaataccatggcgaaggcatccagcacatcgccctgaccaccgacgacatctatgccaccgtgcgcaagctgcgcgacaacggcgtgaagttcatgtcgaccccggacacctactacgagaaggtcgacacccgcgtcgccgggcatggcgagccgctcgagcaactgcgcgaactgaacctgctgatcgacggcgccccgggcgacgacggcatcctgctgcagatcttcaccgacacggtgatcggcccgatcttcttcgagatcatccagcgcaagggcaaccagggtttcggcgagggcaatttcaaggccctgttcgagtccatcgaggaagatcagattcgccgcggcgtgatctga

SEQ ID NO: 13126 - DNA, 1428 bp, Pseudomonas aeruginosa
gataattcaatggacggccaacatccgcattcgggcgagctcaagcgcggcctgaagaatcgtcacatccagttgatcgccctcggcggcgccatcggcaccggcctgttcctcggctcggccggggtgctcaagtcggcgggcccgtcgatgatcctcggctacgccatcgccggcttcatcgctttcatgatcatgcgccagctcggcgagatgatcgtcgaggagccggtcgccggctccttcagccacttcgcgcacaagtactggggcggcttcgccggcttcctctccggctggaactgctgggtgctgtacatcctggtcgggatgtcggaactgaccgcggtcggcaagtacatccactactggtggccggaggtgccgacctgggccacggcggcgttgttcttcgtcgtcgtcaacgcgatcaacctaaccaacgtcaaggccttcggcgaagccgagttctggttcgcgatcatcaaggtggtggcgatcatcggcatgatcctgctcggctgctacctgctgttcagcggcagcggcggtccgcaggcttcggtgagcaacctctgggcacacggcggtttcttccccaacggagtgagcggactggtgatggccatggcgatcatcatgttctccttcggtggcctggaaatgctcggcttcaccgcggccgaggcggacaagccgaggacggtgatcccgaaggcgatcaaccaggtgatctatcgcatcctgatcttctacatcggcgccctgatcgtgctgctctcgctgacgccctgggacagcctgctgcagaccctcaacgcttccggcgatgcctacagcggcagcccgttcgtgcagatcttctcgatgatcggcagcggcaccgccgcgcacctgctgaacttcgtggtgctcaccgccgcactgtcggtgtacaacagcggcacctattgcaacggccgcatgcttctcggcctggccgagcagggcgatgccccgcgcgcgctggccagggtcgacaagcgcggcgtaccggtatgcgccctggtggtatcggcgctggtgaccttcctcgcggtggtggtgaactatgtgatcccgcaccaggcgctggagctgctgatgtcgctggtggtggcggcgttggtgatcaactgggcgatgatcagcatggcgcacctgaagttccgcgcgcagatggaccgccagggcacccgcacgcacttccgcgcgttctggtatccgtacggcaactacctgtgcatggccttcgtggtgttcatcctcggcgtcatgttgctgatccccggcatccaggtctcggtctatgccatcccggtctggctgctggtgatgtgggcctgctaccgactcaagggagccccgcggccgatgccgggcctgcgggtgaagccggtcaccgagtga

SEQ ID NO: 13127 - DNA, 507 bp, Pseudomonas aeruginosa
aggaacccggctgcggccgggtttcttttggcctgcttttccgctcggcaaaggggttatgctggcagccccgttggtccaccgtgccgccccatgctgatcatctccaatgccgtccacctgcccgaccatgagatcgagctgaatgccattcgcgcccagggcgccggcgggcagaacgtcaacaaggtctccagcgcggtgcacctgcgcttcgacatccaggcctcgtcgttgccgccgttctacaaggagcgtctgctggcactgaacgaccagcgcatcagcggcgacggcgtggtggtgatcaaggcccagcagtaccggacccaggagcagaaccgcgaggatgccctggagcgcctggcggagttaatccgcagcgtggccaaggtgcagaaggcgcggcgcccgaccaagcctacgcgcggctcgcagaagcgccggctggacggcaaggccaagcgcggcgcggtgaaggccgggcgcggcaaggtggatttctga

SEQ ID NO: 13128 - DNA, 2967 bp, Pseudomonas aeruginosa
gtgcggtcatggtgggagtccttggttgtcgcatgtgggagcggcgcacgggccgtgcccgtccaccatagtacaaggccgccgcggggtcagccgcggcggcggcgtttctcgtcaggccgcctgcttgggcgggaacagcggcgcgtgcaggcccaggcgcatggcctcgtggaccagcgccatgatgtcttcctgggccagttggaacaggcgcttgaggtcgggcaggacgaaatagagcggttgcaggatgtcgatgcggtagggcgtgcgcatcgcctccagcggattgaaggcctggtgcagcggctcgtcggagaggctgtagacggtctccttcggcgaggagaggatgccgccgccgtagatgcgcttgccctggtcggtctcgaccaggccgaactcgatggtcatccagtacaggcgggcgaggaacacgcgttcctccttgctcgccttgaggccgagcttgccgtaggtatgggtgaactcggcgaaccaggggttggtcagcagtgggcagtggccgaagatctcgtggaagatgtccggctcctgcaggtagtccagttcttccggggtgcggatgaaggtggcgacggggaattgctggctggccagcagttcgaagaaggtctggaacggaatcagcgccggaacccgcgccacgcgccagccggtggtggcctggagaaccctgttgatctcgtcgagctgggggatccggtcgtggggcaggccgagctgttcgatgccgtcgaggtattcctgacaggcgcggccttcgatcaccttcagttgccgggtgatcagggtattccagacctggtgctcggtttccggatagtggatgaaaccgttgtcgtcgggctggcgggccacgtactgcgttgttttcatacggactccatgagcggcttgtggccgcggggtctttgttgttgtcgttgccttatcgataccgcgtcgggacggtccgtgcagccccggatagggaccgggcaacggggaggaatcggcgttttcgtaaagttttccttacgaattggcctgggtcgcctgttcattgggtcaggcattgttgctggtgagtctaactgtcacatattcttgacggaaatttccggccgggagttaaaaaaccggccgcgagcccatcagaacgacaacaccgggccacgccatgcgtatcaaagtgcactgccagaaccgtgtaggcatcctccgcgacatcctcaacctgctggtcgactacggcatcaacgtcaatcgcggcgaagtcggcggcgaccagggcaacgccatctacctgctctgtccgaacatgatcaacctccagttgcagtcgctgcggcccaagctggaggcggtgccgggggtcttcggcgtcaagcgcgtcggcctgatgcccagcgagcgccggcacctggaactcaacgcgctgctcgccgccctggacttcccggtgctctcggtggacatgggcgggcagatcgtcgccgccaaccgtgccgccgcgcagttgctcggcgtgcgcgtcgacgaggtgccggggattccgctgtcgcgctatgtggaggacctcgacctgcccgaactggtgcgcgccaacaaggcgcggatcaacgggctgcgggtgaaggtgaagggcgacgtgttcctcgccgacatcgcgccgctgcaatccgagcacgacgagagcgaggcgctggctggagcggtgctgaccctgcatcgcgcggatcgcgtcggcgagcgcatctaccatgtgcgcaagcaggagctgcgtggcttcgacagtatcttccagagttcgcgggtaatggccgcggtggtccgcgaggcgcggcgcatggcgccgctggacgcgccgctgctgatcgagggcgagaccggcaccggcaaggagctgctggcgcgcgcctgccacctggccagcccgcgcgggcagtcgccgttcatggcgttgaactgcgccggcctgccggaatccatggccgagaccgagctgttcggctatggtccgggagccttcgagggcgcccgcccggagggcaagctcggcctgctggagcttaccgccggcggcacgctgttcctcgacggcgtcggcgagatgagcccgcgcctgcaggccaagctgttgcgcttcctgcaggacggctgtttccgccgggtcggcagcgacgaggaggtgtacctggacgtgcgggtgatctgcgccacccaggtagacctgtccgaactctgcgccaagggcgaattccgccaggacctctatcaccgtctcaatgtgctctcgctgcacatcccgccgctgcgcgagtgcctggatggcctggcgccgctcgccgagcatttcctcgaccaggccagccggcagatcggctgcggcctgccgaagctttccgcgcaggcactggaacgtctcgaacgctaccactggccgggcaacgtgcggcaattggaaaacgtgctgttccaggcggtttcgctgtgcgaagggggaacggtcaaggccgagcacatccgcctgccggactacggcgcgccgcagccgctgggggatttttccctggaaggagacctcgacgccatcgtcgggcgcttcgagaaggcggtgctggagcgcctgttccgcgaacatccgagcagccgccagttgggcaagcgcctcggcgtttcgcataccacggcggcgaacaagctgcgccagcatggcgtggggcaaagcgagggctgagcggcatgcttgccggtttgttgcaggctgggaaagaaacggtggaggcgtcggcccttgtgaaagggcggcagcacgatgaggcgtggggaggacagccaggatgttcgccgaggggcgggattgtcgccgccgagtacacaatgatcgcgccggatgggcgagctgcccctcgtggcgcgatccttcggaggtcgacccggaggtcgagcagagtttag

SEQ ID NO: 13129 - DNA, 852 bp, Pseudomonas aeruginosa
gcggtggaggccgtggaagcgactggtcatgaccatgaattcgttgttcaggcgaatcagccggccgctgcgcaggcgcatgtgcggatcttcgaaagtagtggcgctgcgcaggttttccaggcccacggactgggcgacgaagcgcgcgctgagctcgccgaagcgctcgccgtcgaggctgccctgcaggccttcggcggcgaacccggcgaagtcgcggaagcgcccgtagagtgtgttgcgcagggcggcgccgctggtctgcggcaggaagatggcgctgacggtaccggtgcagaggatgcccagggatatttccaggacccgccacagcgccgccatgaaagcgccttccgggtgcgcggtggctggaatcccgatcatggtcgcggtgtagccggcgagtacgcaggcgtagccgcggaaatcgcggtagcgcgcggcgccggcggtgcacaggccgacccagagcgccaggcaggcgaggaacagcacgcgctcctgggcgaacagggcgatcagagtgaccatcacgctgaggccgatcagggttccgacgatgcggtagaagctcttggccaggacctgcccgctctgcgtctgcatgacgatgaagaccgtcaccagcaccgtgctcggctgcggcagctccaggcgataggccagccacagggcgaggctggcggtgagcagggccttgaacacgaagacccaggcgacgccgtcgctacgcgcccattcgagcagggcgcggcgcaattcgtcggggctgggaaagaacgcgaggggagccggtggaaccagggggagacctttccgggtggcgcggggcactgctgcgaatcctga

SEQ ID NO: 13130 - DNA, 954 bp, Pseudomonas aeruginosa
agggccgtgatggatatcctgttcaatatgcgcgcgttcgtcagcgtcgcggagaccggcagtttcactgccgccgcccagcgcctggacctgacgaccgcctatgtctcccgtgcggtggccaagctggaggcccacctgcagacccgcctgctgcatcgcaccacccggcgcatcgcgctgaccgaagccgggcagcgctacctgatgcgcgcccagcagatactcgcctacatcgaggaggccgaggctgaggcgggcgacgcccatgcgcggccgtcgggcacgctgaaggtccacgcgatgaccggcatcggccagcactacctgatcaaggccatctcgcaatattgcgagacctacccggaggttggcttcgacctgaccctggccaaccggatcaccgacattctcgacgaaggctacgacatttccgtggtgatcgcccccgagctgccggactccggtttcgtctccaagtgcatcggccagacctacagcatcctctgcgcctcgccgggctacattgccgcgcatggcttccccaagctgccggcggagctgtccgcgcaccgttgcctgcgcctggtgaactcggtgatgtcgctggaccgctggctgttcgacggtcccgacggccaggaactggcctgcatcaaccagacgcatttccaagtcaacaccgccgacgccatgaccgaggcggtggtctccggcatgggtatcggcgcgctgccggtgtacgcggcggtcaacggcctgaaggacggcagcctggtgcgggtgttgccgcgctatagcctgttccatctcaacgtctacgccctctacccctcgcggcagtacctggatgcgaagatccgcacctgggtcgagttcctccgcgagcacatgccggcgatgctcgccgcggacgagcacagcctggcggagagcggtgggttggcgaactga

SEQ ID NO: 13131 - DNA, 477 bp, Pseudomonas aeruginosa
ccgcctggcggttgtccgccgattctccggagccccgcggacaacgccaggggcgttatccgccctacaggctgtctcccaccctctgcaactcctcgatcaacgcccgcaggcaactcggcagtgcttccaggtcgcgtaccagcaggctgcgctcgcggatcgcccagggctcgtcgagttcgatggtcgccagcttcatcgtccggctgtggcggcgcgcggcggactgcgggatcacgccgatgccgacgccgccctcgatcatccggcagatcgcctcgaagctggagacctggatgcgcagcgatagctgctcgcccatctgctccacccgttcgtacaggaaggcgtgcagggtggtgccctcgggcaggccgatatgctggaactgcagggtgtcgcgtaggcgtaccctggcctgtccggccagcggatggccctggggcaccgccatcaccaggcggtcggtgctga

SEQ ID NO: 13132 - DNA, 975 bp, Pseudomonas aeruginosa
acaggcgcaggtcggcgagatcgaaatgcatgggcactccatggcgttcggcaaatccgaacgcgccattgcgtaattgcaaattctcaaaacgctagcatcctatcattctcctcccatcaccccctaggtcatgggaagccacgcatgagtgagtccgctttcgccccctggatcggtcgccaggaagaaacccacgatcaattgagccgcaacctggtcaagcgcatcgccgccaccttcggcgagccgaccccggcccacggcgaagcgctgccgccgctctggcactgggcgttcttccaggacccggtggaggccgccggcctcggcgtcgacggccacccggcgcgcggcggtttcctgccgccggcggacgatcgcaaccgcatgtgggccggcgggcgcctggagttccaccagccgctgcgggtcggcggcgaggccagccgcacctcgaccatcctccgggtcgaggagaagcacggtcgcagcggcgcgctgctgttcgtcaccctgcgccacgactaccgccaggacggccaactggcgctgagcgaagagcacgacatcgtttaccgcgaaccgaccccgcccaagctcggcggtaccgaggccttgcccgagggcgactggcgcgaggcgctggagcccgatccggtgttgctgttccgctactcggcggtgactttcaacggccaccgcattcactacgactggccctatgtcaccgatgccgaaggctatccgggcctggtggtgcacggtccgctgatcgccaccctggccctgcgcgcgttctgccgggccaatccgcaggcgcgcctgcgtcgcttcgcctatcgcggcctgcgcccgctgatctgtcccgagccgttcgaggtcggcggccgcctgctcgctgccggcaaggccgaggtatgggtcggcaatggcgccggcctggcccagcgcggcgacgtggaattcgactga

SEQ ID NO: 13133 - DNA, 1206 bp, Pseudomonas aeruginosa
aagggccccagcgcccatccaacgacaagaatcgaggagtcaccgatgaatccgaacagcgaagagctgaacgcgatccgcgagggtgtacgtgccctctgcgccgaattcgacgccgcctactggcgccgcatcgatgagcagcgcggttttcccgaggccttcgtcaaggccctgaccgacgccggctggctctcggcgatgatcccggaggagtacggcggttccggtctgggcctggccgaggcctcggtgatcctggaggaagtcaaccgctgcggcggcaactccggcaccgtgcacgggcagatgtacaacatgttcacgttgctgcgtaacggcagcgaggcgcagaagcgcttctacctgccgaagctggccagcggcgagctgcgcctgcagtcgatgggggtgaccgagccgaccaccggcaccgataccaccaagatcaagaccaccgccgtgcgcaagggcgaccgctatgtgatcaacgggcagaaggtgtggatctcgcggatccagcactccgacctgatgatcctgctggcgcgcaccacgccgctggccgaggtgaagcgcaagtccgaaggcatgtcgatcttcctcgtcgacctgcgcgaggccatcggcaagggcctgaccgtgcagccgatcgccaacatggtcaaccacgagaccaacgagctgttcttcgacaacctggagatccccgccgatagcctgatcggcgaggaaggcaagggcttccgctacatcctcgacggcctcaatgccgagcgcaccctgatcgccgccgaatgcatcggcgacggccgctggttcatcgacaaggccagccactatgcccgcgaccgcgtggtcttcggccggccgatagggcagaaccagggcgtgcagttccccatcgccgaggcgcacatcgaagtggaggccgccgacctgatgcgctggcgcgcctgccaggagtacgacgccgggctcaacgccggggccagcgcgaacatggccaagtacctggcggcgaaagcttcctgggaggcggccaacgcctgcctgcagacccacggcggcttcggcttcgcctgcgagtacgacgtcgagcgcaagttccgcgagacccgcctgtaccaggtggcgccgatctccaccaacctgatcctgtcctacgtggccgagcacctgctcgaactgccgcgctcgttctga

SEQ ID NO: 13134 - DNA, 1050 bp, Pseudomonas aeruginosa
cgcgcagatcctgcccagccggcggcgcagctcgccgtatttcgccgccctggtgaacggcgcggcttcccacgtggtggagcaggacgacctgcacaacagctcggtgctgcaccccgcggcggtggtcttccctgctgccctggccgcggcccaggacctcggccgcagcggcgccgagctgatcctcgcggcggtggccggctacgaggccggcatccgcatcggcgaattcctcggccgttcccactaccgggtgttccataccactgccacggtcggcaccctcgccgcggcagtggcggtgggcaagctgatggacttcgaccgcgagcgcttcgtcgacctgctcggcagcgccggaacccaggccgccgggctctgggagttcctccgcgacgccgccgattccaagcagttgcataccgccaaggccgccgccgacgggctgctcgccgcctatctcaccgccgacggcctgagcggcgcgcgacacatcctcgaaggcgagcaggggatggccgccgggatgtccagcgacgccgaccccgagcgcctggtggatcgcctcggcagccgctgggcgttgctggaaacctcgttcaagttccacgcctcgtgccgccatacccatcccgcggccgacgcgctgctggcgctgatgcagcgcgaagggctcgatcactcgcagatcgccgcggtcaccgcgcgggtccaccagggcgccatcgacgtgctcggccgggtggtcgagccgcagaccgtgcaccaggcgaagttctccatgggcaccgtgctgggcctgatcgccgtgtacggcaaggccggcctcggcgagttccatcggcatgcgctgagcgacccgcgggtcgcagcgttccgcgagcgggtcgagatgcgcctggacccggaggtcgatgccgcctatccgcagcgctggctcgggcgggtcgaagtgctcgatcgccaggggcggcgccataccgccgccatcgacgaacccaagggcgatcccggcaataccctcagccgcgacgaactggccgataa

SEQ ID NO: 13135 - DNA, 1152 bp, Pseudomonas aeruginosa
tcgtcgaagccttcgccgccttgccggccgccgaggtggtggcgcgcctggaacaggcgcagatcgccagcgcccacgtcaacgacatggccggggtctgggcgcacccgcagttacaggcgcggcaacgctggacctccatcgacagcccggccgggcgcctgccggcgttgttgccgccggccagcagcagcgccttcgttccgcgcatggatgcggtgccggcgctgggcggcgacagcgacgcgctgcttgccgaactgggctgtaccgcggccgatatccagcgcctgcgcgcgaccggaacggtatgaggaggcggacatgaaccgacagatcgtgcgcagcgcgctgttcgtcccggcgacccgcccggagcggatccccaaggcccttgccagcggcgccgaccgggtcatcgtcgacctcgaggatgcggtggaggaggggctgaaggtcgaggcgcgggccaatctccggcgtttcctcgtcgatacgccggaagcccgggtgctggtgcggatcaacgcggcggagcatcccgggcatgccgacgacctggcgctgtgccgcgaccacgccggagtgatcggcctgctcctgccgaaagtggagagcgccgcccaggtgcgccacgccgccgtggccagcggcaagccggtctggcccatcgtcgagagtgcccgcggccttgccgcgctgggcgagatcgccgccgccgcgggggtcgagcggctgtccttcggcagcctcgacctggccctggacctcgatctcaacagcggcagcaacgcagccgaacagattctcggtcacgcccgttacgcactgctcctgcaaacgcgcctggcaggcctggcgccgccgctggacggcgtctatccggcgatccagaaccgtgccggactggtcgaggcagtgcgcttcgctcgcgacatgggcttcggcgggttgctgtgcatccatccgagccaggtcgagccgatccaccagacattgatgccgagtcccgcggaactggagtgggcgcgtcgggtggcagaggccggcgcctccggtgccggcgtcttcgtggtcgacggcgagatggtcgacgcgccggtgctggggcgcgcgcgacgcctgctggagcgggccggggagggtggctga

SEQ ID NO: 13136 - DNA, 1575 bp, Pseudomonas aeruginosa
agaccctgttcgtcgccggcatcggcgccgaggacctcgaccacttcggcatcctccaggcctacatcgcggtggtggtgccggtcggcttcggcctggtgctgctgcgctacctggaaatcctcgtcaacctgttgcgcggtcgccagctcgggctgggcctcgccgacgaggccgccgaggcctccaaactggccggcgaagaggccggggagaaccgtccatgaccgtgctgatcctgttcctgctgctgttcctgttcatgttcatcggcgtgcccatcgccatctccctggggctgtccggcgccctgacgatcctgctgttcagcccggattcggtgcgctcgctggcgatcaagctgttcgagacctccgaggcctacaccctgctggcgatcccgttcttcctgctctccggcgcgttcatgaccaccggtggcgtggcgcggcgcctgatcgacttcgccaatgcctgcgtcgggcatatccgcggcggcctggcgatcgctgcggtgcttgcctgcatgctgttcgccgcgctgtccggttcgtcgccggcgacagtggcggcggtcggctcgatcgctgtggccggcatggtccgctccggctatccgcgcgccttcggcgcggggatcatctgcaatgccgggaccctgggcatcctcatcccgccatcgatcgtgatggtggtgtacgccgccgccaccgagacctcggtgggcaagctgttcgtcgccggggtggttccggggctgctgctcggggtgatcctgatggtggtgatctacatcgtcgcgcgggtcaagaagctgccggcgcagccgcgcgccagcttccgcgagtggctggccgccgcacgccgtgcaggctggggcctgttgttgctggtgatcatcctcggcggcatgtattccgggctgttcacccccaccgaggcggcggcggtggcggcggtgtattcggccttcgtcgcgctgttcgtgtacaaggacatgcgcctgcgcgactgtcccaaggtgctgctggagtcggggcggctgagcatcatgctgatgttcatcatcgccaatgccatgctcttcgcccacgtgttgaccaccgagcagatcccccagcagatcaccgaatgggtggtgcaggaaggcctgaccccgatcggcttcctgctgatggtcaacgtggtgctgctggtcgccggcagcttcatggagccctcggcgatcgtgctgatcctggcgccgatcttcttccccatcgccatgaagctgggcatcgacccgatccacctgggcatcgtcatggtggtgaacatggagatcggcctggtacacccgccggtcggcctcaacctgttcgtcacttcggcggtcaccggcatgccgcttggggcgaccatccgcgcggcgctgccgtggctgatgatcctgctgctgttcctgatcctggtgacctacgtgccgttgatctcgctgtggctgccgggcctgctgggcatgagctgaggtcgcggcggcggggcgcgggacgcgctccgccgctggcgcaaggctacgatcggcgcggcttatag

SEQ ID NO: 13137 - DNA, 516 bp, Pseudomonas aeruginosa
ctactatcggcgctgtcgcgcagtggtaagaccatggtcgtatggttcgtggggtgtgcgctcgctacaactgggcacaacagaaacaacactcacgtaccgaggttaaagccatgtctgcggcatccctgtaccccgtgcacccggaagcggtggcacggaccttcaccgacgaagccacctacaagacgatgtaccagcagtccgtcgtcaaccccgacggcttctggcgcgagcaggcccagcggatcgactggatcaagccgttcgagaaggtcaagcagacctccttcgacgaccatcacgtggacatcaagtggttcgccgacggcaccctcaacgtgtcgcacaactgcctcgaccgtcacctcgccgaccgcggcgaccaggtggcgatcatctgggaaggcgacgatcccgccgaccaccaggaaatcacctaccgccagctccacgagcaggtctgcaggttcgccaacgccctgcgcgggcaggacgtgcaccgcggcgacgtag

SEQ ID NO: 13138 - DNA, 711 bp, Pseudomonas aeruginosa
ctgcatagaggtaccgttttgatgatcactggctacggtgcgaccatcgtcgatggcgcctggctgactctccagctggccctgctttccatgctcctggccatcgtcctcggcctgctgggcgcggccttccgcctgtcgccggtgcgctggctggcctggtgcggcgacctgtacgccacggtagtgcgcggcatccccgacctggtgctgatcctgctgatcttctacggcggccagggcctgctgaactgggtcgccccgcaactcggctacgacgactacatcgacctgaatcccttcgtgtccggcgtcggcaccctcggcttcatcttcggcgcctatctctcggagaccttccgcggcgccttcatggcgattcccaagggccagggcgaggccggctacgcctacggcatgagccaccgccaggtgttcttccgcatccaggtgccgcagatgatccgcctggcgatccccggcttcaccaacaactggctggtgctggtcaaggccaccgcgctgatttccgtggtcggcctgcaggacatgatgttcaaggccaagcaggcctccgatgcgacccgcgagccgttcacctactacctcgccgtggccggcctgtacctgctggtgaccagcgtgtcgctgctgttgctgcgcctgctcgaacgccgctattcggtcggcgtgaaaaccgcggaactgtga

SEQ ID NO: 13139 - DNA, 570 bp, Pseudomonas aeruginosa
tcgacagcgtcggcgagcgtctcggcagcgatccggcggccaatgtcgcgctggtccgccaggccctgcgcgcggcgctggacgccctgccgccggcgacctcggaactggagggcatgcagcgcgtgctctatcgccacgcctgcgacgccgacctggtgctcgacctgcattgcgacttcgaggccgccatccatctctataccctgccgcaacaatggcccaccttcgcctccctggccgcacgcctgggcgccgctgtcgggctgctcgccgaggagtccggcggcggttccttcgacgaggcctgctcggtgccgtggctgcgcctgtcgcgcctgtatccgcgcgccgagctgccgctggcctgcctggcgaccaccgtcgaactcggcggccaggccgacaccaccgtgcagcaggccgaggccaacgccgcggcgatcctggccttcctcgccgagcagggcttcgtcgagggcgaatggccggcggcgcccgaagcctgctgcgaaggcttgcccttcgagggcaccgaatacgtccacgccccgcataccggcgtggtga

SEQ ID NO: 13140 - DNA, 972 bp, Pseudomonas aeruginosa
ccgccttcaggcaggagaaacaccgatgtccgctccccatgcgcaggtagaacgtgccgatttcgaccggtatatggtccccaactacgcccccgccgccttcattccggtgcgaggcgagggatcgcgcgtctgggaccaaagcggccgcgaactgatcgatttcgccggcggcatcgccgtgacctccctgggccacgcgcatccggcgctggtcaaggcgctcaccgagcaggcccagcgcatctggcacgtttccaacgtcttcaccaacgagccggccctgcgcctggcgcgcaagctggtggacgccaccttcgccgagcgggtgttcctcgccaactccggcgccgaagccaacgaggcggccttcaagctggctcgccgctacgccaacgatgtctacggcccgcagaagtacgagatcatcgccgccagcaacagcttccacgggcgcaccctgttcaccgtcaacgtcggcggccagccgaagtattccgatggcttcgggcccaagttcgagggtatcacccacgttccctacaacgacctggaagcgctgaaggcggcgatctccgacaagacctgcgccgtggtgctggaaccgatccagggcgagggcggcgtgctgccggcgcagcaggcctacctggaaggggcgcgcaagctgtgcgacgagcacaacgcgctgctggtcttcgacgaggtccagagcggcatgggccgggtcggcgagctgttcgcctacatgcactacggcgtggtcccggacatcctctccagcgccaagagcctgggcggcggcttccctatcggtgcgatgctgaccaccggcgagatcgccaagcacctgtcggtcggcacccacggcaccacctacggcggcaacccgctggcgtcggcggtggccgaggcggcgctggacgtgatcaataccccggaagtgctggatggcgtgaaggccaagcatga

SEQ ID NO: 13141 - DNA, 468 bp, Pseudomonas aeruginosa
gcgcttcaagtcccgcctgcagaagatcggccaggagtacggcatcttcgacgagatccgcggcatgggcctgctgatcggtgcggcgctgaccgacgagtggaagggcaaggccagggatgtgctcaacgccgccgagaaagaggcggtcatggtgctccaggccagcccggacgtggtgcgcttcgcgccgagcctggtgatcgacgacgccgagatcgacgaaggcctggagcgcttcgagcgcgccgtggccaagctggtccgcggctgagcgaacccacggggccccggcgcaggccggggcacccgatgcgacatcccggagcggcccgcgccggagccgggaaccgtgccgccgtgcgtggcgcgggatcttccctgctggacgttcgaaaccgtggcacaggaaggtgccgcggtcccgcgcatggatgcggcaatcatcgttgtctgagaaaggagtga

SEQ ID NO: 13142 - DNA, 1092 bp, Pseudomonas aeruginosa
agccgccgaggccctgggcgtcggcgaaggcgccagcgtgcgcctggtagcggtctgaaggagccagtcatgatcgtacgtcctgttaccagcgccgacctgccggccctgatcgagctggcgcgcagcaccggcaccggcctgaccaccctgccggccaacgagcagcgcctgcagcatcgcgtcagctgggccgagaaggccttccgcggcgaggccgaacgcggcgacgccgactacctgttcgtcctcgaggacgacgccggcaaggtcgtcggcatctccgccatcgccggagcggtggggcttcgcgaaccctggtacaactaccgggtcggcctcaccgtgagcgcctcgcaggaactcaacatccatcgcgagatccccacgctgttcctggccaacgacctgaccggcaattccgagctgtgctcgctgttcctccacgccgaccaccgcagcggcctcaacggcaagctgctgtcgcgcgcgcgcttcctgttcatcgccgaattccgtcacctgttcggcgacaagctgatcgccgagatgcgcggcatgtccgacgaggaggggcgttcgccattctgggaaagcctcggccggcacttcttcaagatggaattctcccaggccgactacctcaccggggtcggcaacaaggccttcatcgccgagctgatgccgaagttcccgctctatacctgcttcctctccgaggaggcgcgcggggtgatcggccgcgtccatccgaacaccgagccggcgctggccatgctcaaggccgagggcttcagctaccagggctacgtcgacatcttcgacgccggcccggcgatcgaggccgagaccgacaagatccgcgccatcgccgagagccagaacctggtgctggcggtgggcactcccggcgacgacgccgagccctacctgatccacaaccgcaagcgcgaagactgtcgcatcaccgccgcgccggcgcgggccgccgccggcaccctggtggtcgatccgctgactgccaagcgcctgcgcctgtcggccggcgcctcggtacgcgcggtgccgctgtcggcgcagaagcgcggttga

SEQ ID NO: 13143 - DNA, 1509 bp, Pseudomonas aeruginosa
aagcctgatggaggcgtcccggcgagggcgcccgaggagtcgatgatgagtacccattacattgccggccagtggctggcgggccagggcgagaccctggagtccctcgacccggttggccagggcgtggtctggtccgggcgcggcgctgacgtcacccaggtcgacgctgccgtgcgcgccgcccgcgaggccttcccggcctgggcgcggcgcccgctggagcagcgcatcgagttgctcgagcgcttcgctgcgaccctcaagtcccgcgccgacgagctggcccgagtgatcggcgaggaaaccggcaagccgctgtgggagtcggccaccgaagtgaccagcatggtcaacaaggtggcgatctcggtgcaggcgttccgcgagcgcactggcgagaaatccggtccgctggccgacgctaccgccgtgctacggcacaagccgcatggcgtggtggcagtattcggtccctacaatttccccggccacctgcccaacgggcatatcgtcccggcgctgctggccggtaactgcgtggtgttcaagcccagcgagctgaccccgaaggtcgccgagctgacgctcaaggcctggatccaggccggcctgccggccggcgtgctcaacctggtccagggcggtcgcgaaaccggcgtcgcgctggccgcccaccgtgggctcgacggtctgttcttcaccgggtccagtcgcaccggcaacctgctgcacagccagtttggcggccagccgcagaaaatcctggcgctggagatgggcggcaacaacccgctggtggtggaggaggtcgccgacctcgacgccgccgtctacaccatcatccagtccgccttcatctccgcaggccagcgttgcacctgcgcccgccgcctgctggtgccgcagggcgcctggggcgacgcactgctggcgcgcctggtggcggtcagcgctaccctgcgggtcggtcgcttcgacgaacagccggcgccgttcatgggcgcggtgatttcgctgagcgccgccgagcacctgctcaaggcccaggagcatttgatcggcaagggcgcacagccgctgctggcgatgacccagccgatcgacggcgccgccctgctgaccccgggcatcctcgacgtcagcgcggtggccgagcgaccggacgaagagttcttcgggccgctgttgcaagtgatccgctactccgatttcgctgcggcgatccgtgaagccaacgccacccagtacggcctggccgccgggttgctgtcggattcccgcgagcgtttcgagcagttcctcgtggaaagccgcgccggcatcgtcaactggaacaagcagctcaccggcgccgccagcagcgcgccgttcggcggtatcggcgcgtccggcaaccaccggccgagcgcctactacgccgccgattactgcgcctatccggtcgcctcgctggaaagccccagcgtgtcccttcctgccaccctgactcccgggatcagcctatga

SEQ ID NO: 13144 - DNA, 351 bp, Pseudomonas aeruginosa
cgcagatccttaaactgggctcggtttattccttccaactcgattgagagcctcgccaccatgtccgatagcctgcaactgatcctcgaagataccgacggcacccagctggaaacttcctgcacccgtttcgccgtggtctggcagggcaaggaagtgtgggtccagcaagccggcaacggccagttgctgatcggcgtcgacgtcgaagacggcgataccgaatacaccaacctgctgctgcggccgatggcgaccaacctggtcagcctgcaactggagatggagccgatcgaagagggcgacgaccacgagcacggccccgactgcggctgcgaccacacccactga

SEQ ID NO: 13145 - DNA, 885 bp, Pseudomonas aeruginosa
cggcgtcgacctgttgctctcggccggtatccacggcaacgagaccgcgcccatcgaactgctcgaacggctgatccgcaaggtcgccgctggcaccctcaagcctgccgccagggtcctcttcctgttcggcaaccccgaagccatccgccgcggcgagcgctacgtcgaacaggacatgaaccgcctgttcaacggtcgccacgaggagggcagcggcaacgaggccttccgtgccgccgagctggagcgcctggcccaggtgttcttcagcaagaccgagcgagtccacctgcactacgacctgcataccgcgatccgcggctcgaagatcgagcagttcgccctctacccctgggccgagggccgccagcattcccgcagcgaactggcccgcctgcgcgacgccggcatcgaggcggtgctgttgcagaacaagccgggcatcaccttcagcgcctacacctacggccagctcggcgcggaggcctttaccctggaactgggcaaggcacgtccgttcggagagaaccaggaggtcaacctggagcgcctggagcggagcctggagctgctgatcgacggcagcgaggaacagccggacggctcccggctcgacggcctcaagctgttcagcgtgtcgcgcgaggtgatcaagcacagcgaccacttccgcctgcacctcgacgacgacgtggccaacttcaccgaactctcgccgggctacctgctggccgaggatatcggcggcacgcgctgggtggtggacgaggtcggcgcgcgcatcatcttccccaatccacgggtgaagaacggcctgcgtgccggaatcctggtggtgccggccaagctctgaggcgtatcggccttccctctcgatcatga

SEQ ID NO: 13146 - DNA, 1065 bp, Pseudomonas aeruginosa
gatcgggcttttccgccgaaccgaggagccctccgtgcctgtcatcgacctgcgcagcgacaccgtcacccagcccaccgccggcatgcgcgaagccatggccgcggccgaactgggcgacgacgtctatggcgaggaccccacggtcaaccgcctggaggccgaactggcggcgcgcctgggcttcgccgcggcgctcttcgtaccgaccgggaccatgagcaacctgctcggattgatggcccactgcgagcgcggcgacgaatacatcgtcggccagcaggcgcatacctacaaatacgagggcggcggtgccgcggtgctgggctcgatccagccgcagccgatcgacggcgaggccgacggatcgctccacctggacaaggtcgcggcggcgatcaaggccgacgatttccacttcgccaggacccgcctgctggccctggaaaacaccatgcagggcaaggtgctgccgctcgactacctggccgcggcgcgcgccttcactcgcgcgcgtggcctggccctgcacctggatggcgcgcgcctgtacaacgcggcggtgaagctgggcgtagacgccagcgagatcacccgacacttcgactcggtgtcggtgtgcctgtccaagggcctcggtgcgccggtgggctcggtgctttgcggcagcgtagaactgatcggcaaggcccgtcgctggcgcaagatggtcggcggcgggatgcgccaggccggcctgttggcggctgccggcctgtacgccctcgaccaccaggtggcacgcctggccgacgaccacgccaacgccgcgcgcctgggcgacgggctgcgcgaactgggctatgcggtggagccggtgcagaccaacatggtctatgtcgatgtcggcgagcgggcggtcgcgctgcgcgacttcctcgccgagcgcgaggtgcggatcagcgcggcggcgcgtttgcgcctggtcacccacctggacgtttccgccgagtccataggacaagtactggatgccttcgcggcctttcgtcgctcataagcgaaaaggtcggcaataggcaataa

SEQ ID NO: 13147 - DNA, 429 bp, Pseudomonas aeruginosa
acctgcccaaggaaaagctctgggtcaccgtctacgccaccgacgacgaggcctacgacatctggaccaaggaagtcggcgtgcccgccgagcgtatggtgcggatcggcgacaacaagggcgcgccctatgcgtccgacaacttctgggcgatgggcgataccggaccttgcggtccctgcaccgagatcttcttcgaccatgggccggagatctggggcggcccgcccggttcgccggaagaggacggcgaccgctacatcgagatctggaacaacgtgttcatgcagttcaaccgcaccgcggacggcgtcatgcacccgctgccggcgccgagcgtggacaccggcatgggcctggagcgcgtcagcgcggtactccagcacgtgcactcgaactatgagatcgacctgttccagaacctgttga

SEQ ID NO: 13148 - DNA, 1551 bp, Pseudomonas aeruginosa
agaccgaggaagaacagttcgccaagaccctggagcaaggccctgaagatcctcgaacaggacctcgccgaactgcagggcagcgtgattcccggcaacgtggtgttcaagctgtacgacacctatggcttcccggtcgacctgaccaatgacatcgcccgcgagcgcgagctgaccatcgacgaggacggcttcgagcgcgagatggaggcccagcgcgagcgcgcccgcgcttccagcgccttcggcatggactacaacagcctggtcaaggtcgacggcgagacccgcttcctcggctatcagggcgtctccggcgccgggcagatcgtcgcgctgttcagggacggccaggccgtcgagcgcctggaggagggcgaggagggcgtcgtggtcctcgaccagacgccgttctacgccgagtccggcggccaggtcggcgacagtggctacctcgaggcggctggcgtgcgcttcgacgtgcgcgataccaccaaggctggcggcgcgcacttgcaccatggcgtggtcgcccggggcaacctgagcgtcggcggcgcggtcaaggccgaggtcgacgcttcggtacgccaggccaccgcgctcaaccactccgcgacccacctgctgcatgccgcgctgcgccaggtactgggcgaccacgtacaacagaagggctcgctggtggacagccagcgcctgcgtttcgacttcagccacttcgaggcgatcaaggcggaacaactgaaggccctggaggatatcgtcaacgccgaaatccgtcgcaacaccgaggtcgagaccgaggaaaccgatatcgacaccgccaaggctaagggcgccatggcgctgttcggcgagaagtacggcgaccaggtgcgcgtactgagcatgggcggcgatttctccgtcgagctgtgcggtggcacccacgtatcccgcaccggcgacatcggcctgttcaagatcaccagcgagggtggcgtggctgccggcgtacgccgtatcgaggcggtcaccggcgcggcggcgctggcctacctgaacggtgccgaggagcagctcaaggaagccgccagcctggtcaagggcagccgcgacaacctgctggacaagctcggcgccctgctggagcgcaaccgctcgctggagaaggagctggaacagctcaaggccaaggctgccagcgcggccggcgacgacctttcggcggcggcggtggaaatcaagggcgcgaaggtactcgccgcgcgcctcgatggtctggacggcaaggcgctgctggcgctggtcgaccagttgaagaacaagctcggccgcgcagtgatcctgctcggcggcgagctggacgggaaggtcgtactggtcgcaggcgtgacccaggacctgaccggccaactgaaggccggcgagcttatgaagcaagccgcggcggcagttggtggcaaaggtggcggacgcccggatatggcccagggcggcggcaccgatgcagcgaaattggacgaggccctggccctggcccagcgcttcgtcgagcaagggctctga

SEQ ID NO: 13149 - DNA, 1386 bp, Pseudomonas aeruginosa
tgccatgccggccccgcgccagagcgatgcggggccgggcggccagcgccccttgatgcccggccggcggtgcgccccgccagtccgggtagcgaaagaatgtggcaggttcaaaagggcgcccttcacggaatcaggcggtttgaaatggctttgatcgtacagaagtttggagggacctccgtcggcaccgtcgagcgtatcgagcaggtggccgagaaggtgaagaaattccgcgaagcgggcgatgacgtcgtcgtggtggtatccgccatgagcggcgagaccaaccgtctgatcggcctggccaaccagatcatggagcagccggttccgcgcgaactggacgtcatggtctcgaccggagagcaggtgaccatcgccctgctcagcatggccctgatcaagcgcggcgtgccggcggtctcctataccggcaaccaggtgcgtatcctcaccgacagtgcgcacaccaaggcgcgcatcctgcacatcgacgacacccacatccgcgccgacctcaaggccggcagggtagtggtggtcgccggtttccagggcgtcgacggcaacggcaacatcaccacgctgggccgcggcggttccgataccaccggggtggccctggcggcggcgttgaaggccgacgaatgccaaatctacaccgacgtcgacggcgtctacaccaccgatccgcgcgtagtgccgcaggcccgtcggctggacaagatcaccttcgaggaaatgctggaaatggccagcctcggttccaaggtgctgcagatccgggcggtcgagttcgccggcaagtacaacgttccgctgcgcgtgctgcacagcttccaggagggtccgggcaccctcattactatcgatgatgaagaggaatccatggaacagccgatcatctccggcatcgccttcaaccgcgacgaagccaagctgaccatccgtggcgtacccgatacccccggcgtggccttcaagatcctcgggccgatcagtgccgccaatgtggaagtcgacatgatcgtgcagaacgtggcgcacgataacaccaccgacttcaccttcacggtgcatcgcaacgattacctgaacgccctggaaatcctcaagcagaccgccgccaacatcggcgcgcgcgaagccatcggcgacaccaacatcgccaaggtttccatcgtcggcgtcggcatgcgttcgcacgccggcgtggccagccgcatgttcgaggcgctggccaaggaaagcatcaacatccagatgatctccacctcggaaatcaaggtttccgtggtgatcgaagagaagtacctggaactggcggtacgtgccctgcacacggcgttcgagctcgacgcgccggcgcgacagggtgagtga

SEQ ID NO: 13150 - DNA, 486 bp, Pseudomonas aeruginosa
aggtataaattctccacgattgaaattcctctggccgaagcccgccgatgcgggcttcggccgttccgggcccgccttttcggcgggcctttgcatttccgggagtcatccatgtccgagccaagctctgcggcctccgccgccagcgcaatggctggcgtcggcctggccatgtacctgccgggtatcgatggcaacgccttgctgggaggcttcggcggcgccatcttctttgtcgtgttcgcccgtgactacaacgccctgacccgcctcggctacctgctggtgtcctgggtcggcggctattacgccggaatcgaagcgctcggccgcggattgacccagaccagcggcatggccgccttcgtcgccgcgaccctctgcgtgaccggcggcatcggcatgctcgagtggatgcgtggcggcgaactgcccagctggatgcgcgggctgttgcgccgccggggaggcaagtccgatggttga

SEQ ID NO: 13151 - DNA, 483 bp, Pseudomonas aeruginosa
cgatgccatccatacatagaggagagatccatggtcatgttgatcagtcgtcgcgtcggcatcgttcgcctggatgcggtgatttccgaaaacctcgcgcaggctgccgtcagcgcgcgcggcgaccagctcatcaccatcgtcggcagcattgtcgaccatgcgcccgctggcgagccgttgccctccttgctgccgatggagggaggcagccgcgcgttgaacgagtgccgtgtgcgcaagggcatcgctgccttgacttcactgcaaggcgcttccgaaacggtggacgtgcaaacgggattccacctgtatcgcggtctgttcatcacgcgcgttgttgcccggcgaaccgcagaaagaggattgagcctgaccatgaccgccagccagaggcgtgcgcggcgggcaggcggtaggttgcttaagactgtcgtccgtcttttccatgcaggcagggcgacaccctgcccggcacgctaa

SEQ ID NO: 13152 - DNA, 432 bp, Pseudomonas aeruginosa
actgatggaaagcctcgacgcgcagcagcgcgagcgagtgcgttcggcgctgtcctacgaggaggaccaggtcggcgcgctgatggacttcgagatggtcaccatccgcgaggacgtcagcctggaagtggtgctgcgctacctgcgccgcctgaaggaactgcccgggcataccgacaaactgttcgtggtcgactacgacggcgtgctcaagggcgtgctgccgatcaagcgcctgctggtcaacgatccggacaagcaagtgctggaagtcatggccaccgacccggtgaccttccacccggacgaggacggctacgacgccgcccaggcattcgagcgttacgacctgatttccgcgccggtggtggacaagggcggcaagctgatcggtcgtctgaccatcgacgagatggtcgacctgatccgtga

SEQ ID NO: 13153 - DNA, 1215 bp, Pseudomonas aeruginosa
agaagaagatatcttcgcctcggtctggaagtcggtgcgcaaccgctgggcctggctggccaccaacctgatcaccgccttcgtcgcctcgcgggtgatcggcctgttcgaaggctccatcgagaaactggtggcgctggccgcgctgatgccgatcgttgccggcatcggtggcaattccggcaaccagaccatcaccatgatcgtccgcgccatcgcgctcgaccaggtacagccgaccagcaacagtcgcaaccgcctgctgcgcaaggagcttggcgtcgcgctggtcaacggcctggcgtggggcggagtgatcggcgtggtggccttctatctttacggcaactgggaactgggcgtggtgatgaccgccgcgatgaccctgaacctgctgctggcggcgatgatgggagtgctgatcccgatgaccctgcatcgtttcggacgcgatccggcgatgggctccagcgtgatgatcactgcgatgaccgacagcggcggtttcttcatcttcctcggcctggcgacgatcttcctgatgtagccggagcgccacgcgagaagccgcccacgggcggcttttttcatggcggtcagatcagcggggaaaccttcggtggcgaccaggacagcacgctcaggcagcgatcgccgccattgacgaaatactcgtcgacggccttggtctcgcgggcgacgaagccctcgcgacggcattcctggtccagccagccgccttgctcgacccggtacagccaaccctcggatgccgcacaggctggccagaattccagcaggtcggcagcgtcgagctggcgcaggccttcgacttcgacgaactcgacgcgccaggtgcgctggttggcgaggtcgcggacgaggatggtcaggccggcgcgatcctggcggcactccaggaaccaggggtcggcgcagggcggcgcctggagcagaaccgccagcagtggctccgcgcgttcagccacggacgcgcagggtcaggcccttgaggaagttgcgcagcaactggtcgccgcaggtccggtagttgctgtggccgggcttgcgaaacagggcgctcagctcgggtttggagaccgggaagtcgacgctgtcgaggatggcatggaggtcttcctccttgagttcgaaggcgacccgcagcttcttcaggatcatgttgttgctcaacggcagctccagcggcggtag

SEQ ID NO: 13154 - DNA, 1998 bp, Pseudomonas aeruginosa
tgcagcgacgcgtgccgaggagacttcggaggggcattccagctctgccatcggcctgatggtcggggcggttggagtctgctatggggatattggcaccagtcccttgtataccctgaaagaggtcttcatcggcggctacggggtgcaggccaaccacgatggcgtccttggcgtgctgtcgctgatcttctggtcgctggtctgggtcgtttccatcaagtacgtgatcttcgtcctgcgtgccgacaaccagggcgagggcggggtgatggcgctgtcggccctggcgcgccgggcggcggcgccgttcggcaggctgcagaccttcgtggtggttgccggcctgatcggcgcggcgctgttctacggcgacagcatgatcaccccggcgatctcggtactgtcggcggtagaagggctggagatcgccttcgacggcctggagcactggacggtaccgctggcgcttatcgtgctgatcggcctgttcctgatccagaagcacggcaccgcgcggatcggcatcctgttcggcccggtcatggtgctctggttcggcgccctggcggcgctgggcgtctacggggtgatccagcagccggaagtgctgcaggcgatgaaccctgtatgggccgtgcgtttcttcagctcgcatcccggcatcggtgtcgccatcctcggcgccaccgtactggcgctgaccggcgccgaggcgctgtacgccgacatgggccacttcggtcgcaagccgatcgcccgtgcctggttcctgctggtgctgccggcgctggtgctgaactacttcggccagggcgcgaccatcctttccaacgccgaggcggcgcgcaaccccttctacctgctggcgccgggctgggcgctgctgccgatggtggcgctgtccaccctggccacggtgatcgcctcccaggcggtgatctccggcgccttctccctgacccgccaggcgatccagctcggctacgtgccgcggatgaccatccagcacacttccagccacgagcaggggcagatctacatcggcggggtgaattgggcgctgatggtcggcgtggtcctgctggtgctcggcttcgagtcctcggcgtcgctggcggctgcctacggcgtggcggtgaccggaaccatgctgatcaccaccctgctgatgggcgtggtgatctggcgcctgtggaaatggccgctgtggctgggcgtcccgttcttctgcgtgatgctcgcggtggacagcctgttcttcgccgccaacctgcccaaggtgatccagggcggcgccttcccggtcatcgcgggtatcgtcatcttcatcctgatgtccacctggaagcgtggccgccaactgctggtggagcgtctcgacgagggctcgctgccgctctcggtgttcatttccagcatgcgcgtgcagccgccgcaccgggtccaggggaccgcggtgttccttaccgcgcgtaccgacgcggtgcctcacgcgctgctgcacaacctgttgcacaaccaggtgctgcacgagcaggtggtgctgctcaccgtggtcaacgaagacagcccacgggtttcgccggatcgccgtttcgaggtcgaggcctatggcgacgggttcttccgggtgatcctgcacttcggcttcatggaagagccagacatcccggctgccttgcgcctgtgccatctcaacgaactggacttcagcccgatgcgcaccacctacttcctcagccgggagacggtgattccatccaagcgcatcggcatggcgcgctggcgcgaggggttgttcgccttcctgctgaagaacgccaacggcaacctgcgctatttcaacctgccgctcaaccgggtgatcgagttgggaacccaggtcgagatctgatccgctccgctgcaaaaaagcgcgcccgattgggcgcgtttttttgcgcgtttctcagcgccgttgcggcagcatccgtaccagggtgttgtcgcggctga

SEQ ID NO: 13155 - DNA, 1950 bp, Pseudomonas aeruginosa
cgtttcacgacagacatatcagcgtttcaccaatccagtcaggccgccggcgatcagcgcggcggtatcggccagggccaccagcgggtcgagcccggctggcacggccaggtagcggggttcccagtcgggctggaacttgtccttgaagcgtcgcagcccctggaaattgtagaactgttcgccccgccggaagaccagcgcgcccaggcgctgggtcaacggcgcgccgcgccttggctggagcccggccagcggcaccatgccgaggctgaagcgcgcgtggccctgggccttgtagtggaggatgaggccgagcatgaggaactccatggtcagcttcggcgcgtccgggtgcacgcgcatcaggtcgaggctcgccagttcgcggctgtcggtttccagcaggttggcgaaggccaccggcttgccctggtggcggacgatggcgatgcggaagaagttcaggtacgccggggtgaagcggcccagggagaagcctttctcgcgcacctgcttgccgcccagccaggcgtccgatatcgccttcagctcgtccagcggagcctggcccggttcatggaactccagggccaggccgtcgcgctggccgcggttccaggtgtagcgcaggtctttcatttccttgcccttgttctccaggtcgaagcgcagcaggtcgactcgcgcttcttcgccgagcttgagggcggtcaggccaatgtccatgtagaacggcaggttctcggcacgcacctggtagaacaccgggcgggcatggtgcagttcgcagaggtcgcggaattgccagatcagttcggcgcgctgcatggccgggccgatcgggtcgtacagggctatcatgctgcgaccgcggcgggcgtacatgaggaaagcgtcgtcgctctcatggaagagcagggccttgtcgccggtcagggccaggccgccatccggctggtccgagtggcggatgatccgcgccgcgcgctgcagctcttccgcgttcggctcgcggatcgccggcggtgccgcgcgcagcagccagccaagggccagggccaggagcagcaggcaactgccgagggcggcgcgcagggcgcgcggggcgtcggcgtccagggcgaactgccaccagagctggttgctgtaatgcacgtcctggttggcgaacagcagcagccagaccgaggcgccgaccacgcagatgctggcgcctacgtaaagcggcgagaagggtacttccatcagccggctgggacggtagaaggagcggcggaacatggcgagcagcgcggcggtcaggctcagcaggctggcttcctcccagtcgaagcctttcagcagcgaaagcagggcgcccaccagcaacagcaccagggtcagggcccaggcggccgacagccgtcggcgcaaaccctgcgcgagcaggaggcagagcacgccgatcaggctggcgaccaggtgcgaggcatcgatcaggcgatgtggaatgaggaaaccgaggtgttccaggcgggtgtcgatcgccggtgtggcgccggaaaacagcagcacgacaccggagaggaagaccaggatcgccaggatcggtgcggcgaaacccgaggcgacgcggatcgcctggcgcgtcacccacaaccggcgcgcttcgaggaacagcaacaaaaggcaggccagcagcagtggcagtaccacataaatcaagcggtacaagagcagggccgcggccagcggcgcggcgcccagttggccggcgaacgcggccagcagcaccgcctcgaacaccccgactccgcccggtacgtggctgagcacgccggcggccagggcgagcaggtagaccagcaggaacgccgcgaagggtggggtttccggcagcaacagataaaggacggtagcggcggcggcgacgtcgagggcggtgatcagcagttgcagcagcgatag

SEQ ID NO: 13156 - DNA, 1098 bp, Pseudomonas aeruginosa
aattcagcgctccggggcaggcccggcggggcttgtagcgagattccggtgcggaaaatcatccatatagactgcgactgtttctatgccgccctcgagatgcgcgacgaccccagcctgcgcggcaaggcgctggcggttggcggttcgccggacaagcgcggagtggtcgccacttgcagctacgaggcgcgagcctatggcgtgcgctcggcgatggccatgcgcacggcgctcaagctgtgtcccgatctgctggtggtgcgcccgcgtttcgatgtctaccgggcggtgtcgaagcagatccatgcgatcttccgcgattataccgatctgatcgagccgctttcgctggacgaggcctacctggacgtcagcgcttcgccgcatttcgccggtagcgccacgcggattgcccaggacatccgccgccgggtggccgaggagctgcacatcaccgtttcggcgggcgtcgcgccgaacaagttcctggccaagatcgccagcgactggcgcaagccggacgggctgttcgtgattaccccggagcaggtcgacgggttcgtcgccgagttgccggtggccaagttgcatggcgtcggcaaggtcacggcggagcgcctggcgcggatgggcatccgcacctgcgccgacctgcgccagggcagcaagctgagtctggtgcgcgagttcggcagcttcggcgaacgcctgtgggggttggcccatggtatcgacgagcgaccggtggaagtcgacagccggcgccagtcggtgagcgtcgaatgtaccttcgatcgcgacctgccggacctggcggcttgcctggaggaactgccgaccctgctcgaggagctggacggacgcctgcaacgcctggatggcagttatcggccggacaagccgttcgtgaaactgaagtttcacaatttcacccagaccacggtggaacagtccggcgccgggcgcgacctggagagctaccggcaattgctcggccaggcctttgcccgtggcaatcgtccggtgcgcctgatcggcgtcggcgtgcgcctgctcgacctgcagggcgcccacgaacaactcaggctgttctga

SEQ ID NO: 13157 - DNA, 1203 bp, Pseudomonas aeruginosa
tcggcgatcgacgaagcgcagcaggtcgtcggtgttccgggcgtcgcgctgccaggcaggctccgggctatccagcacgtgcaggtcctgggggcgcaggttgacgaacacgctgcggtcgaagggcggatagctgaaacgttgcgcggcattgatccggaactggtagttctgctgcctgagtacctccatgagcaccggcggctggccggccttcagcacggcgtcccagtagccgccgtgcagcccgtagaacatgccgaagacgcccatctgggtcaggttgccgctgctgtagtggttgtccaggcggatcgcccggttggagaagtcccacagcctgggcatgtagcgcggatcgagcatgtccccgcggagcgactcggcgacgatccagacgatgttcaatgggtgcgccggggcgctgatctccagcggccggagcggatagtgcaggtcgctctgctgctggagcagctcgcgctgggtgggcgtcggctggatgcccaggcttcgcgccaggctgcggacggtcaatggcaggtaaagcggatagcgttcgctggccagcaggatcggccggtagtcgcgcagggagctgaacgcataggccaggcgttcgcccagggccaggcagaggaaggccgccaacaggtagcgccaggcgcgccgagggagcgcgggaaggcgctcgcggctgacctggcaggcgctgtacagcagcacctgcaggcagagcagggccagggccgccaggcttgcgctgagcagggtgccgtcgccgctgccgaggctggagaggccgccgggcgagaccagcaggccgatgctgaaaccgttgaggtggaatccgtacaggtcgtagagggtgcggtcggcgtagagcagtatctgtaccgccgcgctgccgacgatggccagcacgcctgccagccacggactgaggcgcacgggaaggcgatcatggaaatgcaggagcagtcggcaggcgaggtacaccgggactatataaaggaaggcgtagctcaggctggcagcgacgctccagagcggcagccaggcgtcgtcgaagacgatcccgtcctgcaggcgcagcacctgccagagcaccaccagccacgacaacagaaagaagcggttgagtgtctcggtgctgggtggggcgaacatcaagcgtctccgggcgaggatgcggaagcctag

SEQ ID NO: 13158 - DNA, 1404 bp, Pseudomonas aeruginosa
agaacaggatgcgcatggtcagagttcgctggagtcgaggctggtggaggacaggtgggtggtggccgaggcagtgtcggccagggcctcgatggccttgtccagctcgtccagggccgcggccgccgccggatcgttctgcttgagcagggtttcgctggtctggcaggccgcgcgcaactgcggcacgccacagtagcgggtggcgccatgcagccggtggaccctctcgagcaaagcggtgcggtcgtcgttgtcgcgggcctggcgaatcgcctggcggtccgccgccagcgaggccagcagcatcgccagcatgtcggcggcgaggtcggccttgccggcggccaggcgcagcccttcctcggggtcgagcacgctcaactggccgagctgcggcgcacggctcatgctggccagcgactggcccaggctcagtccggtccacttcagcactacctgggccaattgctgctcgtcgatcggcttggtcaggtagtcgtccatgccggcctgcagcaatgcgcgcttctcgttggaaagcgcatgtgcggtgagcgcgatcaccggcaccgggctgacttcccgctcggcctcccagcggcggatcgcctcggtggcctggcggccgtccatgccgggcatctgcacgtccatgaagaccaggtcgaagcgctcgcgctgcaccacctcgagggccgcgtagccgctgtccaccgcggtgacctgggcgccgaggtcgctgagcagggtctgcaccagcagcaggttggccgggttgtcgtcgacgcagagcagccgtggcggccgtccggaaaccatggcgtggggcttgtcgctgcgcgtcgggcggacttgaagcaactcctgcagcttgcgttgcagcttgcgggtgcaggcgggcttggcctcgacctgttcgtcgggcagggtcgcgtggtattgcgcctgctcggtggtcgggcaaagcaccagggtcttgcagccgagccgttcgaattcccagaacgactggctcagctcttccggcggatggatcgcggccgagacgccgagcaccgccaggctgatcggcaactggccgggcggcgggttgcgcaggctttcctggaggctgtcgaggtcggcgaattcgctcacttccaggccgaagtcggtgagctggtggtgcagcgagcggcgcgtcagttcctgcggttcgagcagcgccacgcgttggcccgcggcccaggaggcgcccggctcctcgttgtcgtcgcgacttttcggcagactcaggctgatccagaactcggcgccttcccctggcgtactgtcgacgccgatctcgccgcccatctgctcgatcaggcgcttggagatcaccaggcccaggccggtgccaccggcttgtcgcgacagtga

SEQ ID NO: 13159 - DNA, 1014 bp, Pseudomonas aeruginosa
gttgtcggcctggctgaaggccttgaacaaggcttgctggtcctcctcggagaggccgataccggtgtcctgtacgctgatccgcagctgcgcgcggtcgtcgctttcgtcctcgagcatggcgcgcacggcgacggtgccgccctgggtgaacttgatggcgttgccgaccaggttggtgaggatctgcttcagccgctgcgggtcgccctgcaattggatcggggtatcccggtagaccaggctgaccagttccagttgcttctcgtgggcggccggagccagcatggtcagggcgtcctggatcaggtcgcggagattgaaagggaggttttccagaaccagcttgccggcctcgatcttcgagaaatcgaggatctcgttgatgatccccagcaggctttccgccgatttctggatggtcgtgaggtattcctgctggcgcgggctgagctcgcttttctgcagcaggtttgtgaaaccgaggatgccgttgagcggggtgcggatctcgtggctcatgttggcgaggaactcggacttgatcctgctcgcctccagggcctccttgcgcgccaggtccagctcgatgttctggatctcgatggtttccaggttctgccgtacgtcctcggtggcctggtcgatgttgtgctgcatttcctcctgggcgctctgcagcgtttccgccatgcggttgatgccggaggccagttcgtccagctcgttgctgcccatcggtggcaggcgggtttccatgcggccttccttgagctgggcgacgccctggctgatcagttccagcggcgcgttgatcgcgcgactcatgcgcagggcgaggagggcggtgacgccgaggccggcggcgatcagcaagaggctggtgaacaggctgcgatatccgcgcagcagagtcccgtggtgcgacagttccagttcgacccagccgagtacgcgctcgtcgtcaggctcggtggcgccggacaggctgtggtggcggccaagaaccggtag

SEQ ID NO: 13160 - DNA, 1392 bp, Pseudomonas aeruginosa
caccggcgccatgatgcccaaccgccattcgctgttctggcgcctggccctggtgctggtggcgttcttcctgctatcggtatggctgtcctggacctggggacgcagtgccgaactgaagggttactacctgtccgccgaagcccgctccgccttggcggattatgcgcggcgagccgaacgtgcctggctcgacgatggccgcgagggcatcgaccgttggctggccgagccgcgccagcgggcgctggactgggtggtcgtgctcgacggacggttgcaatcgctgggcagtcgtccgctcaccacggaggaagccgagcgcctgactttcctgcggggcgtcgactggccgatgagctcccgctcgttgtcgcggccgttcatcagcctgcgcttccccgaacatccggagcaaggccgggtggtcctgcgtcttcccgccgagttcgtccctcccggcttgtcgccggccaagcgcctggtcacccatggcctggtgccggccgggctggccctgctgctgggagtgttgctgtatcggcgctggatagtgccgctgggacgcctgcgagcgcaggccaatgccctgcgcggcaacgacctgacggcgcgtacgcaggcagagatcagccggcgcagcgacgagctgggcgatctggggcgggcgttcgaccatatggccgagcgactcgacgagcacatggtgttgcagcgccaactgctccgcgatctctcccacgagctgcgcacgccgctggcgcgcctgcaggtggcggcagagggcacgctgtccgcgcagctcctgcgcgagcgcctggagcaggaggtacagggcatgcagcaactggtggacaacaccctggagctggcctggatggacaccgaacgcccggtattggcgctggaggacatttccatcccggcgttatgggacctgctggtggagaacgcacgcttcgaaagcggctgggccgccgagcggttccgcagcgatctgcccgaggattgtgtcgtgcgtggcaacctcaatgcacttgcccaggccctggagaacctgctgcgcaacgccatccggcattcgccggaaggcggcgtgatccgcctgcatggtcggcgcgaaggaagttgctggtggctttgcctggaagaccagggcgagggtgtggccgagcaccagttggagaccatcttccgcccgttcacccggctgtcttcggcacgtaccggcaagggcttcggcctgggactgagcattgcccgtcgcgccgtggtgctccagggcggccgcctatgggcggaagccgccgatccggggctgcgcctgtgcctggtgctgccttctgcctagcgaggcgcaggtgcctttacatttggcctatatgtaaatga

SEQ ID NO: 13161 - DNA, 363 bp, Pseudomonas aeruginosa
cccccgaccaggtcgtcgatttcgaagcgggcttcagccgacagggcaacatctatgccggcgatacccagaacaacaacggcaccgccaatacccagggactcgccgacgagggtgcggagaccaaccgcatgtatcgcgagaactacgccatcacccacaacgggacctggtcgttcggcacttccaggttcgtcgcccagtacgactccacccgcaacaaccgtctggaggaggggctggccggttccgtcgaggggcagatcggcgccgaccgttcgttcagcaccagcaagctggagaactatcgcctcagcggcgaactcaaccttccgttgcatgcgttgttcgagcaggtgctga

SEQ ID NO: 13162 - DNA, 600 bp, Pseudomonas aeruginosa
ccgcctatggcgccgagctcattctggtcagcaaggaagagggcatggagggcgcgcgcgatctggccgacaagctgcagcgcgaaggccgcggcaaggtcctcgaccagttcgccaatggcgacaacccggaagcccattaccacagcaccggcccggaaatctggcagcagaccggcggcagcatcacccatttcgtcagctccatgggcaccaccgggaccatcatgggcgtctcgcgctacctcaaggagcagaacccggcggtgcagatcgtcggcctgcaacccatggagggctcggccatcccgggaatccgacgctggccgcaggaatacctgccgaagatctatgacgccagtcgcgtcgaccgggtcgtcgacatgcaccaggacgaagccgaggacatcatgcgccggctggcccgcgaggaaggcatcttctgcggcgtgtcctccggtggggcggtggcggcgatgctgcgcctgtcccgcgaactggagaatgccgtgctggtggcgatcatctgcgaccgcggcgaccgctacctgtcttccggcgtctatgacccgcgctgagcatgtccatggccagaaataa

SEQ ID NO: 13163 - DNA, 1875 bp, Pseudomonas aeruginosa
ctggctggcgccgaccgccgacgagcgggtcctcgacctgttctgcgggctgggcaatttctccctgccgctggcgcgccgggtggcgcgggtagtcggggtggagggcgtggcggcgatggtcgagcgggcaggcgccaacgcgctggccaatggccttggcaacgcgcactttttccaggccgacctgtccaaagcgcttgccgaagcgccctgggcggagcaaggttttaccgctgtgctgctcgatccgccgcgcgacggcgcgttcgaggcggtacgcgaaatgagttctctgggtgcccggagggtagtctatgtatcctgcaatccggcgaccctggcgcgcgatgctggcgaaatggccaggcagggctatcgtctgaagcgcgccggaatcctcgatatgtttccgcagaccgcacatgtcgaggccatggctttgttcgaggcaggttaggatgcctgcgtaatccgaccagcccgttcgaaggctggcgcagtcatcggtgggctacgcgcaccgtggtaaagggtaggcaagatggtacaggtgagagcgcaccagccggtcaacaccgacggcagtatcaacctcgaggcctggctggaccacgtccagaacctcgtccccgggctcgatcgtcagggcttgctggaggcttgcgagttcgctcgcgaatccgagcagcgagcgatcgccgcacagaactcctgggcggaaggcacgtccagcttccagaccggactggaaatcgccgagatcctcgcggacctcaagctggatcaggagtccctggtcgccgcggtcatctatcgaggcgtgcgggaaggcaagatcaccctggaagcggtcaacaagcatttcgggccggtggtggccaagctgatcgagggcgtgctgcgcatggccgcgatcagcgccagcctcaatccgcgccattccatggtgctgggtacccaggcgcaggtggagaacctgcgcaagatgctggtggcgatggtcgacgacgttcgcgtcgccctgatcaagctggccgagcgcacctgcgccattcgcgcggtgaagaacgccgacgaggaaaagcgccaccgcgtcgcccgggaagtcttcgatatctacgcgccgctggcccaccgcctgggcatcgggcatatcaagtgggagctggaggacctgtccttccgttacctcgagcccgaccagtacaagcagatcgccaagctgctacacgagcgccggctggatcgcgagcagtacatcgccaacgtgatgagccagttgaaggaagctctcgcggccaccggcgtacaggccgatctcagcggacgggcgaaacacatctattcgatctggcgcaagatgcagcgcaagggcctggacttcagccagatctacgacgttcgcgccgtgcgcgtgctcgttccggagatgcgcgactgctacaccgcgctgggcatcgtgcataccctctggcggcacattcccaaggagttcgacgactacatcgccaaccccaaggaaaacggctatcgctcgctgcataccgcagtgatcggccccgaggggaaggtgctggaagtacagatccgtacccactccatgcacgaagaggcggagctcggagtctgcgcgcactggcgctacaaggggaccgacgtcaaggccagctccaaccattacgaggaaaagatctcctggctgcgccaggtgctcgaatggcacgaggaactgggcgacatcggtggcctggcggagcaactgcgggtcgatatcgagccggacagggtctacgtcttcactcccgacggccatgccatcgacctgcccaagggcgcgaccccgctggatttcgcctatcgggtccacactga

SEQ ID NO: 13164 - DNA, 846 bp, Pseudomonas aeruginosa
agacccgagatacccatgtaccgactcgacgacctgctccacctcatggcgcgcctgcgcgatcccgaattcggctgcccctgggatctccagcagagctacgcgaccatcgtcccgcacaccctggaagaagcctacgaagtagcggacgccatagagcagggggatttcccgcaattgcgcgaggaactgggcgacctgctgttccaggtggtctattacagccagttggctcgtgaagaggatcgcttcgctttcgacgaggtggtggacggcatcacccgcaagctgatccgtcgacacccccacgtattcctcgatggcgatctctatggcaagcccgatgcggcgaagctggccgaagcggcggtcaagcagcgctgggaagaactgaaggccgaggagcgtgccgccaaggccaaggagccgcagcagttgtcgctgctggatgacgttcctgtcgccctgccggcgttgtcacgggcggcgaagctgcagaagcgcgcggcgcaggtcggcttcgactggccggaagcgctgccggtggtggacaaggttcgcgaggagctggacgaagtcctcgaggcgatggcagagggtgacgagggtgccgtgggcgaggaggttggcgacctgctgttcgtcgtggtcaacctggcccggcatctcaaggtcgatccggaggctgctctgcgccaggccaacggcaagttcgagcggcgattccggttcatcgagcggaacctgcgcgaagccggccggaaagccgaagagtgttcgctggaggaactggacagcctctggggcgaggctaagaaagcggagaggagcgcgcccggctgttaa

SEQ ID NO: 13165 - DNA, 480 bp, Pseudomonas aeruginosa
tgggaaaattaccgtggcagccgggctgccacggcatctgaatcagccgaagatccaacgatagaggatgaccagcaggatcaccgccagcaccgggcggaggattcggtaggccttcgggtaggcgcgtttgaagcgcttcacctgggcgccgatggcattgccgccgcgaatggcgaccgagtaggcctggttgatgctgccgacgcgttcgccttcgacgttctgcggtgcggtcgcacgcccgagaatgccgctgatccagcgattgaggcgggtcagcaggcgggagcggagcggccgctcgatatcgcagaagagaatcacccgggtctgctcggtctcgttcttcacccagtggacgaaggtttcgtcgaacatcacgtcttcgccatcacgccacgcgtagggctggccgtcgacgtagatgcggcagttgtccgaattcggcgtggacaggccgaggtggtagcgcagtga

SEQ ID NO: 13166 - DNA, 567 bp, Pseudomonas aeruginosa
gccgccgaaggggtcgcggtgcggattcaggtggctgccgccgggaagcagggtgaacatcgcgcccttgacgttggggatgcggctcaccagctctacggtcttcgggcagagctgctgggcggagggcagcgggccgtcgtaccaggtcaggtagaagcgcttccagcctttcttgaagaacgagccgaagccggcttcgttgttgttcagggcagcccggatataaccctcgtcgaacaggttgagggcttcttcgcggatggtttgccaattgttcttcagttcgtccagctccggaaaacggctgcgatccagatagggcttcgagggaacgctggagaacaggtacatcagcgagttgtagggggcgaaccaggcggagtggttgaccagttggcgcaggaagggcaagcgcgcgcgcccacggaaatggacgaacaggacgctggcgacgaacaggcccaccagagtgacttttaccaggagagaaacgctcatgccttgctttccatgccttcgatatcaggggccgggaggagtgcctgcgggtgctcgggacggtag

SEQ ID NO: 13167 - DNA, 1353 bp, Pseudomonas aeruginosa
ccgcctatcgaaaaggacgttggtatgccttcctcacagcttccgggggcttcgccctcggagatcgatctcgttcagctgttccagcaattgtgggcgtcgaaatggctgatagcgctgatcgcggccttggcgaccgccgctgcgctcgcctacgcgctgttggccgttccaacctaccaggtggatgtcctgttgcggccgatccagaccaaggccctggaggctgtcaatgtcaacgggctgtatgccctgactccgcgggaagcgctggatcgcgtcggcaacgagctggcagcctactccggcaggctggagtatttcgaagcccatccagagctattccagcaattgaacgccgagggtctgtcccccgagcaggctttctggaagttcaaccaggatgccttcagcatgcagcaggcggacttgaagaaggacccccaggcggcgcctttcttccgcttgtccatgcagtatccccagggcatggatggtgccgccattctcaacggcatgctcgcgtcgaccatcgagaacgagcgccagcgaatcctggacgacctccaggcacgtatcgacggtcgcctgcaattcctcgagcaggatatcgaaggcaagcgtgccagttaccaggctaccaaggagggcaagatcgcccggttgctggaagcggacagcatccggcgggccggcctggaggatgagctcaaggcgttgcgcgggcggctgaagatggtgcgcgattcgcgtatccagcagctcaacgaggctatccagatcgccacccggctggggatcgtcaagccgacgaccccgggcgcactgggagaggtcgggcaggatggctcgcgcagcgttttccgcaccgaggtgaataaccagcagatacccctgtatttcatgggtgtcgatgccttgaccgccgagcgcgataccttgctcaaacgcaagggcgatgacttcaccgagccccgcgtggcgaagatccagcaggagctgaagcagctggagaacaaccgtgaagtgcaatacctgcaggctcgaaagggcgaggagcgtttcttcgaaaacatcgacaagctgcgtggagagcaggcgcgcctcaagactctgaaggcgagcgagctgaagatcgaactggtgcggatcgaccagaaggcttcgacccctctgaaaccgatcaagccgcgcaaggccttggtggtggccttgggtctcctgggcgggttggtgttcggcgtgctggtggctctggttcgggcaatgttgcgtgcccctcggcaacgggtacaggaagatagcctgccgccgggagtcgtcagtctcgaccggagcctttcggggacctga

SEQ ID NO: 13168 - DNA, 660 bp, Pseudomonas aeruginosa
gaatttagtatcgatacgatacgttttcagcctaaacaaggcgcgacctctttgtcaaacatgtttttagtcgatactataatggcaaggaggtatcccatgtccgccatcgccctttacgattatctggaaaggctgaccagcctgatgcgtgcctggtcccgcgagcagccgctggtggctgagctgcagccggtgcagttgagcgccttgcattacctggcgcgttgtaatcgctattcggatactccgctgggcgtgaccgaatacctcggcttgaccaagggcacagtgtcgcaatcgctcaaggtgctggaagggcgggggctgatcagcaagctgccggatgcgcgggatcggcgcagcgttcatctgcggctgaccgatgcggggcgcgcgctgatcgaggcggtgattccgccgcagttcctcgagcaggccgtcacggcactgggcgagaagggcgaacacttgcaaggcttgttgcgtgatcttctggtcgtcatccagcgtcaggaggatgtgcctggtttcggcctttgtcggtcctgccggttccatcaacggcgtgcgggttcgcccttctgcggtctaaccggggagccgttgagcgatgccgatgccgaactgatctgccgcgagcaccaggcctgcggctga

SEQ ID NO: 13169 - DNA, 1026 bp, Pseudomonas aeruginosa
gccggcagggtcagcagcgtcagcaggaacagcatggctttacgcattgcgaatctccttggtgcgaatctgatggccggtggcaggcagggcctggccatccagcagggcgccctgttcgcccaggcgcaagcggccctcggcgaaccagcgcatggccagcgggtagatccggtgttcttcctcgtgaacccgtctggccaggcgttccggcgtatcttgcgactctaccgggattactgcctgtacgaccagtggccccccatcgagttcctccgtcacgaagtgcacgctgcaaccgtgctcgcggtcgccggcttcgagggcgcgttgatgggtatgcagccctttgtggcgcggcagcaacgagggatggatattcagcagacgcccctggtaatggcgaacgaaatcggcgctgaggatgcgcatgaacccggcaaggatcaccaggtgcggttcatgggcatcgatccgttgtgccagggcctggtcgaagctttcgcgatcggcataggccttgtgatcgagcacctcggtctggatgccggcctggcgtgcgcgttccaggccataggcgtccgcgcggttggagatcaccgcgcggatccgggccggcgtggcgccgtcccggaggctgtcgatcagcgcctgcaggttgctgccggagccggaaatcagcaccacgacattgcagagtttcggcatcagtggtttttcagattgttcaggaccacgcgctcggcgtccgcgccgcaggtttcgatgcgaccgatctgccagggttgctcgccggcggcacgcaggacttccagggctttctcggcgtcgctctgggccacgcagatgaccatgccgacgccgcagttgagtacgcgatgcatctcggtctcgtcgacgttgccctgttcctgcagccagtcgaataccgccggacggttccagctggcgacatcgatcacggcctgggcgttgtccggcaggacgcgcgggatgttgtccagcaggccgccgccggtaatgtga

SEQ ID NO: 13170 - DNA, 426 bp, Pseudomonas aeruginosa
tccggcgcctcgcttcaagctccctcgcagcgaagcgttgcccgtcacctatatcgtcgatgctcggggggaaatgcgtcagcgtctgctgggcgagcagacggccgatggcatattgaaacagctcgaggctttgcgggagggacgctgatggcgaggatctgcttgcatgcctatgtcggcggccgggtacagggcgtcggtttccgtcaggcgacccgggaagaggctgatcgcctcgaactcgacggttgggtgcgaaacctggatgacgggcgtgtcgaagtcgtctgggagggcgaggaggaccgggcgaaagccctggagcgatggctggggcggggcccgcggcacgcggaggtctctgcggtcgaggtcgagcaaatgccgctgcaggggatcgctggcttcgtcgtccgtcgctga

SEQ ID NO: 13171 - DNA, 1104 bp, Pseudomonas aeruginosa
tccggacccggcgctgcggcagttcgagcacatcgggctggccgacatcgacttgcagggtgtgttcgagcagcttccgctcgacgcgctcctcatgctcgctacgctgcggcaactggttggcgcagccgctcagcagaaggccgccgcacagggcggcggcgaataggcgcaggggtcttccggtgggcatcgttacgctcagcggctgagtttttcggtgatgaacgacatcagttcgccgatcggcaggttctgcgactcgctgtcacggcggcccttgtattccaggacgccttcgctgaggccgcggtcgctgaccacgatgcggtggggaatgccgatcagctccatgtcggcgaacttcaccccggggctggtcttcttgtcgcgatcgtccagcagcacttcgaaaccggctgcggtcagctcggcatagagcttgtcggtcgcctgcttgacgctctcggtttcgtacttcagcggtaccagggcgatctggaacggcgccagtgcgcttggccagagaatgccgcgctcgtcatggttctgctcgatggcggcggcgaccacgcgggatacgccgatgccgtagcagcccatgatcaggttgaccggcttgccctgttcgctcaggacgctcagcttcatcgcttcgctgtacttggtgccaagctggaagatatgaccgacctcgatgccgcgcttgatcaccagggtgcccttgccgtccgggctggggtcgccttcgacgacattgcgcaggtcggcgacctcgggcagcggcaggtcgcgctcccagttcacgccgaagtagtgcttgtcctcgatgttggcgccagcggcgaaatcgctcatcagggcgacggagcggtcgacgatgcaggcgatcggcaggttgaccgggcccagcgagccggggccggcgccgatggcggcacggatctcggcctccgaagcgaataccagcgggctggcgaccagcggctggttggcagccttgatttcgttgagctcgtgatcaccgcggacgatcagggcgaccagggtgccttcttcggcgccatgcaccaccagggtcttgatggttttctcgatcggtag

SEQ ID NO: 13172 - DNA, 903 bp, Pseudomonas aeruginosa
ctggaagccgtccaccagggccgcgatggtcttggtgttgggcgtgtcgaccaggcgcatgtcctcggtggcgctgccgcgggcgctctcgcgcggcacggcttcggccttctcgatgttcgcggcgtagtcggagctgtcgctgaagacgatatcgtcctcgccggagttggccagcacgtggaactcatgggagccgctgccgccgatggagccgttgtcggcttgcacgggacggaaatccaggccgaggcgggagaagatcttgctgtacgcctggtacatcccgtcgtaggtctgctgcagcgagtcctggctcaggtggaaggaataggcgtccttcatgatgaattcgcgtccgcgcatcaggccgaagcgcgggcggatctcatcgcggaacttggtctggatctgatagaagttgatcggcagttgcttgtagctgttcagctcgttgcgcgcgaggtcggtgatcacttcttcgtgggtcgggcctacgcagaattcgcgctcgtggcggtccttcaggcgcagcagctcagggccgtattgctcccagcgccccgactcctgccacagctcggccggctgcaccgccggcatcagcacttccagggcgccggcagcgttcatttcctcgcggacgatggtctcgaccttgcgcagtacccgcaggcccattggcagccaggtgtagagacccgaggccaggcgacggatcatgccggcgcgaagcagcagttgatggctgattaccaccgcgtcggcgggggtttctttgagcgtggaaagcagatactgactggtacgcatctttggccgttatgtcggttgtatcgggaggaatggctgggcattgtacggtgccggtctggctgcgtacagggcgccggccatcgatga

SEQ ID NO: 13173 - DNA, 714 bp, Pseudomonas aeruginosa
aacctgattgtaatccgtctgcttcaagggttggttgccatcgagttgtctgtggcgaatgcgtttgtatccacggcatgtcttatgttcggcgtcgcgctgtattcatttggccggcatcttatggggcgttcggctggagaggcgcgccaagctggggcgggcggatgtgtgggcttgctttggccgggcggcgaagtatcctgcgcggcagttacggcggggcccttcccggagggaggggctaagctgtccatgaacgacggtcgaacaggagaggtcagtatgttcgctttggatccccggctggagcaggacaccctgttgctcggcgactttcccctcagccgcctgctgctgatgaacgatgcccgctatccgtggttcatcctggtgccgaggcgggaggatgtcaccgagctgttccagctcgatgtcgatgaccagcaggcgctgtggcgcgaggccacgctgctggcagaggtgctcaaggacaccttccgtgcggacaagatgaatgtcgctaacctgggcaatgtggtcagccagcttcacatgcacctgatcgtccggcgacgtggtgacgacgcctggcccggccctgtctgggggcgccatccggctcggccttattcttccgagcaggtcgaggcgatccgcggcaagttgcggatggtgctgaccgacggcttccgttttgccggggaggcctag

SEQ ID NO: 13174 - DNA, 210 bp, Pseudomonas aeruginosa
atggagctggacgcgcgcatggatgacctggaatgccgccaggctttccaggatgacactttgcaggctctcaacgatgtggtggtcgagcagcagcgcagcatcgagcgactgcagcttcaggtcgcggcattgatcaagcgtctggaagacgtccaggggctggtgggcgaggcgggggaagacgaagcgcctcctccccattattga

SEQ ID NO: 13175 - DNA, 252 bp, Pseudomonas aeruginosa
cgatcaagtagccggacagcgcttcggtgcatgaaacgaaaggtgcggaaggaaggccggcctatgcgcgtgacgcacggcggctatttaacaggaaagcaggaggctactcaaatcaagcggttggcgccggagggggagggcgggaccctgaggcgggccccgctttctatcgagcgatcgacgatcagctggcaagaaggctgcgcaacatccaggcggtcttttcatgcacctgcatacgttgggtga

SEQ ID NO: 13176 - DNA, 1083 bp, Pseudomonas aeruginosa
agggcatggtctaggtggcgcccgatgatcgagcctgatcgcctcatatccgccgtttccggtcgcgaacgcgatgagcagctggaccgcgccattcgcccgctgaagctggccgactacatcggccagcccagcgtgcgcgagcagatggagctgttcatccatgccgcgcgcggccgccaggaggcgctcgaccatacgctgatcttcggtccgccggggctgggcaagacgaccctggcgaatatcatcgcccaggaaatgggcgtttccatcaagagtacttccgggccggtgctcgagcgtcccggcgatctcgccgcattgctgaccaacctggaggccggcgacgtcctgttcgtcgacgagatccaccgtctttcgcccatcgtcgaagaagtgctgtatccggccatggaagatttccagctggacatcatgatcggcgaagggcccgcggcccgctccatcaagctggacctgccgccgttcaccctggtcggcgcgaccacccgtgccggcatgctgaccaatccactgcgcgatcgcttcggtatcgtccagcgcctggagttctacaacgtcgaggacctggcgaccatcgtcagtcggtcggccggcattctcggcctggagatcgagccgcagggcgcggcggaaatcgccaagcgcgcccgcggtacgccgcgaatcgccaatcgcctgctgcgccgggtacgcgacttcgccgaggtccgggggcagggcgacattacccgggtgatcgccgacaaggcattgaacctgctcgatgtcgacgagcgtggcttcgaccacctcgaccgtcgtctgttgctgaccatgatcgacaagttcgatggcgggcctgtaggaatcgacaacttggctgcggcgttgagcgaggagcggcacacgatcgaagatgtactggagccctatctgatccagcagggctacatcatgcggacaccgcgggggcgcgtggtaacacgccatgcgtacctgcactttggcctgaatattccgaaaaggttggggccgggggtgacgacggatctgttcacgtctgaagatggtaattaa

SEQ ID NO: 13177 - DNA, 447 bp, Pseudomonas aeruginosa
gccgatatggcaagggttcgtcacaagcgcaagccggtcgcggaaatgaacgtggtgccttacatcgacgtgatgctggtactgctggtgattttcatggtgaccgcaccgatgctcaaccagggggtcaaggtcgacctgccgaaggtgtccagcgaggcgttgcctcaggacaacaacaagcaggtcctgaccctttcggtgaaggccgacggttcctattactggaacgtcggcagcgaagtggatactgaaaaacagaccgatagtgccgtgtcgttggaacagatgaccgatgcagtcaccaagatcatgagtgcccgtccggacacccaggtattcatccgcggcgacaaggcggtgaactatggtgcggtggttggcgccatgggtgccttgcagcaggccggtgtgcccaacgtcgggttgattaccgaggccccctga

SEQ ID NO: 13178 - DNA, 774 bp, Pseudomonas aeruginosa
cggcctgggcggaagttcctgtgtatgacgggcgttgccgccaacaatggcggtaacgttcctccttccgggtatggcacggcaggtgccggcggcgcctttgccggaggtggggtgacaacccccacctccgtgcagggcgaactgttcatgcagctccagcagatgcaggacgagttggctcgcctgcgtggcacgctcgaggagcagcagaaccagatccagcagctcaagcaggaaagcctggaacgctaccaggacctcgaccgtcggatttccggtggtggcgctcccgctgcacagaattccgcacccgctggcgccatcaacgccaatggggcgcctgcggctcccgcaggcaacaacgcaccggcgccgagcagcgagccgggcgacccggcgaaggagaagctctactacgatgcggccttcgacctgataaagagcaaggatttcgacaaggcgagccaggcgttcaatgccttcttgcgcaagtacccgaacagccagtactccggcaacgcccagtactggctcggcgaggtgaacctggccaagggcgacctgcaaggtgccggccaggccttcgcgcgggtcagccagagctaccccagcagccagaaggtgcccgactctctgtacaagctggcggacgtcgagcgtcgcctgggtaacaacgacaaggccaagggtatcctccagcaggtcatttcccagtacccaggcacttcggccgctcaactggcgcagcgcgatctcaagaaccttcgctga

SEQ ID NO: 13179 - DNA, 801 bp, Pseudomonas aeruginosa
agctgcatggtttcagctcggctgatcttcgtgcctctccacgcgagaccttccgggatttcgagcgccacgacaggatacgtcccgtggcgttccttcatttaccgcaacggaggcggacgacctgttcagtcgtcacgcccgtggctgaatatgcaacagaccctgcgcatcaccgagattttctactcgttgcagggggaaacacgtaccgccggcttgccgacggtcttcgtgcgcctgaccggctgccccttgcgctgtcactattgcgataccgcctatgccttcagcggcggcgacgtcgttagcctggacgccattttcgagcgggttgccgcctacaagccccgctacatctgcgtgaccggcggggagccgctggcccagccgaattgcatctctctgctggaacggctctgcgacgccggctacgaagtttccctggaaaccagcggggctctcgacgtgtcacgggtcgacccgcgcgtaagcaaggttctcgacctcaagacgccgggatctggcgaggtcggacgcaaccgatacgaaaatatcccgttgctgaccgacaacgatcaggtgaagttcgtcgtctgttcgcgagaggactacgactgggcggtatccaagctgatcgagtaccgcctcgaccagcgtgccggtgaagtcctgttctcgccgagccaccatcaggtcagcgcgcgagaactggccgattggatcgtggccgacaacctgccggtccgcctgcaattgcaactgcacaagattctctggaacgacgaaccgggccattga

SEQ ID NO: 13180 - DNA, 690 bp, Pseudomonas aeruginosa
gacgaggaattcatcatgaaccagaagaaagcggtcatcctgctctccggcggcctcgactccgccaccgttgtcgccatggccaaggccgacggctacgcctgctacaccatgagtttcgactacggccagcgccatcgcgccgagctgcaggccgccgagcgcgtggcccggcagttgggcgtgatcgagcacaaggtgatagggctcgacctcaatggcatgggcggctcggcattgaccgacgagagcatcgcggtgcccgagtcgcctagcgaaggtataccggtgacttacgtgccggcgcgcaatacggtgttcctctcgctcgccctgggctgggccgaggtcctggatgcccgtgacatcttcatcggtgtgaatgcggtggattactctggttatccggattgtcgccctgagttcgtcgaggctttcgaacgcatggcgaatctggcaaccaaggcgggcgtggaaggcaatggcttccgcatccaggcgccgctgcagtatctgtccaaggcgcagatcatccaggcgggcgtggcgcgtggggtggattacggcctgacggtgtcctgttatcaagccgatgagcagggacgtgcgtgcggcaaatgcgatagctgccggctgcgtgcggatggcttcgcggcggctggtatttccgacccgacgccatatttctga

SEQ ID NO: 13181 - DNA, 327 bp, Pseudomonas aeruginosa
ttgagctttaaatactattgggctaagtttttctggggagctttcttctttgttttagtggcttggaaaggctccgtatttcccagcctggcatcagttaaccccttggtagtggctgggctcagtactatcctgtttcctttctcggtaaagcttgttgaagacttcgctttaaaatatacggaaagagagttctgggtcacgggttttttctccgaaacccctgccaaaacaggtttgtatgcagtcttttatttgtcttgttatttgttttcaattcccttggggatggtttttttattctataagtatggaaaggcctcgtag

SEQ ID NO: 13182 - DNA, 291 bp, Pseudomonas aeruginosa
agtccgttttccgagcagaagacggcagtgaaaaagcgttttaccgaagagcagattctcgacttcctcaagcaggcggaggccggtgtaccggtgaaggaactgtgtcgccgacacggcttcagtgatgcctcgttctacacctggcgggccaagtttggcggtatgaccgtggcggacgccaaacggttgaaggatcttgaactggaaaatagccgattgaagaagttgctcgccgaggcccacctcgacatcgagtcgctgaaagtggtcgctcggggaaaagggtaa

SEQ ID NO: 13183 - DNA, 195 bp, Pseudomonas aeruginosa
tcgggctgtcccgctcggtgttgcgctaccagccgcgagccagtgtgcaaaacaccgagctgcaagcccaactggtggaactggcccaagagcgccggcgctttggctatcgccgcctgcacatcctgctgcggcgtgctggcgtgcaggtcaaccacaagcggatctatcgcctgtaccgcgctgccggcttga

SEQ ID NO: 13184 - DNA, 408 bp, Pseudomonas aeruginosa
ccttcctttaagcatatcgatggagtctgtatgaaagagcttggttcggaatcgccgatggaaagtcttttcgacattcgttcgctggaggccattaccggcggcgagccggctgcattgcagcggttgctggaaactttattggccagcagtcgggatgatcgtactcggttggcggaattgcttgaactcgcagacctgcaaggagtggccgaacttgcgcacaggataaaaggggctgcgagggtggtgggcagcagcctattggtcgagtcttgttcctgccttgaaaaggcttgccagaacccatcggagtcttccgagcggatagccaatctggcctcttcattggaaggcaaactaagtgcgttcgaaatcagtatctcaaccgaattggcaaagctctag

SEQ ID NO: 13185 - DNA, 2577 bp, Pseudomonas aeruginosa
cttcccctatggatgggtgtttccgttttgtcggaaattagtccaaggaatattcgcgtggccatatttaggaaaaagttcgacttcgagttgtccgtctattccaggtcttcctgtctcatggccttgggattggctttgcctgccgtaactttcgcggtggaattcaacgccgagttcctgaacaacgagggcggggcgcctgttgaactgaagtatttcgagaacggcaactcggtgtcgcccggcacttacagcgtcgacattcatttgaaccagatcatgatccggcgcgaagatgtcgtgttcagtgccgatcccgaaaccggaagcgttcgtccggtcgtccggatagggctgctcaaggagatcggggtcgatatcgcccggctgacgcgagacaaactcattccggataatctggaaaacaatacgcccctgaatgtcgccgaactcatccccggtgcatccatcgagttcgacgtcaacagcctttccctgctggtcagcattccacagctgtatgtacagcggcactcgcgtggctatgtggatccctctctttgggatgacggtgtcaccgcgttgttttccaactaccaggccaacttcacgcgcaacaccaactttggccagaacagcgattatcgctacctgggcctgcgcaacggcttcaacctgtttggctggcgtctgcgcaacgactcctccctgagcggaggtaccggcatgcgcaacaagttcagtagcaaccgtacctatgtggaacgtgacattcgtgccctgaaggggaccttgtccctcggcgagttgtatacctccgctcagggggatgctttcgagagcgtgcgtatgcgcggcgtgcaactgcaatccgatataggcatgctgcccgacaacgagatcagctataccccggtggtgcgcggtatcgctgaaaccaatgcgacggtcgaggtgagccagaatggcttcgtgatctattccaccaacgtaccgcccggtgcgttcgagatcaccgacatctatcccagcggctccaatggcgacctggaggtcaagatcatcgaggcggacggacgccagcggtccttcaagcagtcctattcctacctgccggtcatgacccgcaaggggaacctgcgctatggcctggctgccggtgaataccataatgatggccagccgtcggtcaacctgctccaggggtcggctgtgtatggcttgtccgacagggttaccggctttggcggcctgctcgctgcggagaagtacaatgccaccaacctgggcctcggcttcaacacgcccctgggcggtttttctgcggacgtgacccatagccagtcccgcacgcggcggggtgggcgcaaccagggacagagtctgcggcttctctattccaagaccatcaacgccaccgaaaccagctttaccgtggtgggctatcgctattccacggaaggctaccgtactctcagccagcatatcgacgacatgtccgaagagagctacctctatggctcaagttccagtcggcagaagagccgcatagacctgacggtgaaccagacgctgttccgacgcagttcgctctatctcacggcgggcgaaaccacatattggaatcgccccggcagcagccgtcgcgtgcagttcggcttcagcagcggcatcaagcgcgcgagctatagcctggcggtttcccgtacccaggagacgggttcgttcgggcgctccgatacccagttcacggcctccgtcagcatccccttgggcggtagcgcacgctccagtcaggtatatgccaatgccgtgagttcacagcatggtgattcgagtctgaacaccggtatctccggatacctggatgaagccaatgcgttcaactacagcgcacaggccaactacagcaaggacggcggcaactccggcagcgtcggcctgggttgggacacgtccaaggccaagttgtccgccaattacagccaggggcgcgacaacaagcagatcaacctgggagcaagcggttcggtagtggtgcattcggggggagtgaccttcggccagccggtgggggaaacgttcggcctggtggaggttccggaggtcggcggcgtcggcctcgacggctactcttcggttcgcaccgacggccgtggctatgccgtgctcccctacatgcaaccctatcgttacaactgggtgaacctggataccaatacccttggaagcgataccgagatcagcgacagcacgcaaatggccgtgccgacccggggcgccgtgatcgccaagcgtttctccgcggagtccggtcggcgggtgcagttcgacctgagcatggactctggaggaaagagtcccttcggtgcacaggcatacgacaaggaagagcgggtcgtgggaatggtcgacaacctgtcccgtttgctggtgttcggtatcgaggaccaggggcgcctgtccattcgctggagcgatggctcctgttccgtcgactatcagttgccgcccaggaacaaggacctgacttacgaacgagttgcgctcagttgccgtcggtcctcgatctga

SEQ ID NO: 13186 - DNA, 1590 bp, Pseudomonas aeruginosa
tccggatgcatatcgctgaagagggaacgttctgtcatgtccacattggccaacctgaccgaggttctgttccgcctcgatttcgatcccgataccgccgtttatcactatcggggccagactctcagccggctgcaatgccggacctacattctctcccaggccagccaactggcccgcctgctcaagcccggcgatcgcgtggtgctggcgttgaacgactcgccttcgctggcctgcctgttcctggcctgcatcgcggtcggcgccattcccgccgtgatcaatcccaagtcccgcgagcaggccctggccgatatcgctgccgactgccaggccagcctggtggtgcgtgaagccgatgcaccgtcgctgagcggtcctttggcgccgttgaccctgcgtgcggccgccggacgccctttgctcgacgatttctcgctggacgcgctggtcggtcctgcggacctcgattggagtgccttccatcgccaggacccggcggcagcctgtttcctgcaatacacctcgggttccaccggggcgcccaagggggtgatgcacagcctgcgcaacacgctcggtttctgccgggcgttcgctacggagttgctggcattgcaggcgggagaccggctgtattcgattcccaagatgttcttcggctatggcatgggcaacagcctgttctttccctggttcagcggagcctcggcgctgctcgacgatacctggccgagcccggagcgggttctggagaacctggtcgccttccgcccccgggtcctgtttggggtgccggccatctatgcctcgctgcgtccgcaggccagggagctgttgagcagcgtgcgcctggcgttttccgccggctcgccgctgccgcgcggcgagttcgaattctgggccgcgcacgggctggagatctgcgacggcatcggggctaccgaggtcggccatgtgttcctcgccaaccgcccggggcaggcgcgtgccgacagcaccgggctgccgttgcctggctatgagtgccggctggtggaccgcgaagggcacactatcgaggaaactggccagcaaggcgtgctgttggtgcgtggccctgggctgagtccgggttactggcgggccagcgaagagcagcaggcgcgcttcgcaggtggctggtaccgcaccggcgacctgttcgagcgcgacgagtcgggtgcctaccgtcactgtgggcgggaagacgatctgttcaaggtgaatggccgctgggtggtgccgacccaggtcgagcaggcgatctgccgtcatctgccggaagtgagcgaggcggttctggttcctacctgccggctgcacgacggcttgcgtccgaccctgttcgtcaccctggccactccgctggacgacaaccagatcctgctggcgcagcgcatcgaccagcatctcgccgaacagattccctcgcacatgctgcccagccaattgcatgtgctgccggccttgccgcgcaacgacaacggcaagttggcgcgcgccgagctgcgccacctggccgacaccctttatcacgacaaccttccggaggaacgggcatgttga

SEQ ID NO: 13187 - DNA, 1071 bp, Pseudomonas aeruginosa
ccctggaactggcgggagaagctcatgcataaggtcaaactggcagcgatcacctgtgaacttccggctcgcagctacgaaaacgacgatccggtgttcgccgcggtaccggacctcagcgagtcctggtggcaattctggggcgtcaatcggcggggctatttcgacccgcggaacggcgagaacgagttcagcctggtggtccgggccgccgagcgcctgctgcgcagcagcgataccgcgccggatagcgtggacatgctgatctgttcggcttcctcgccgatcatgaccgacgccggcgatgtcctgccggacctgcgcggacgtctctacccgcgcatggccaacgtgctgtccaagcagctcggcctgagtcgggcgctgccattggattcgcagatggagtgcgccagcttcctgctcaacctgcgcctggcagcgagcatgatccgccagggtaaggccgagaaagtgctggtggtgtgcagcgagtacatctccaacctgctcgacttcacctcgcgtacctcgaccctgttcgccgatggctgcgcggtggccctgctgacccgcggcgacgatgacagctgcgacctgctggcttcggccgaacacagcgacgctacgttctatgaagtggccaccggtcgctggcgcctgccggaaaacccgaccggcgaggctaagccgcggctgtatttctcgttgttcagcgacggccagaacaagatggccagcttcgtcccgaccaacgtgccgatcgcgatgcgccgggcgttggaaaaggccggcctgggcagcgatgacatcgattatttcgtcttccaccagccagcgccgttcctggtcaaggcctgggccgagggcatcggtgcccgtcctgagcagtaccaactgacgatgggcgataccggcgtgatgatctccgtttccatcccgtacaccctgatgaccggcctgcgcgagggcaagatccgccccggcgatcgtatcgtcatggccggcgcagccactggctgggggttcgccgcccaggtctggcaattgggcgaggtgctggtgtgctga

SEQ ID NO: 13188 - DNA, 1056 bp, Pseudomonas aeruginosa
ggcatcgccatgttgaaccacggtgtccgaggagggctgcacatgggtaatccgatcctggccgggctgggtttcagcctgccgaaacgccaggtcagcaatcatgacctggtagggcgcatcaatacgtcggacgagttcatcgtcgaacgtaccggcgtgcgcacccgctatcacgtcgagccggaacaggcggtcagcgcgctgatggtgccggcggcacgccaggccatcgaggctgccgggctgctgccggaggacatcgacctgttgctggtgaacaccctgtcgccggaccaccacgacccgtcccaggcctgcctgatccagccgctgctgggcctgcggcacatcccggtgctggatatccgggcacagtgcagcgggttgctgtacggcttgcagatggctcgcgggcagatcctcgccgggctggcacggcatgtcctggtggtctgcggcgaggtgctgtccaagcgcatggactgttcggaccgcggccgcaacctgtcgatcctgctcggcgacggtgccggcgcagtggtggtcagcgccggcgagagcctcgacgacggcctgctggacctgcgcctgggcgccgacggcaactacttcgacctgctgatgactgcggcgccgggcagtgcctcgccgaccttcctcgacgagaatgtcctgcgcgagggcgggggcgagttcctcatgcgcggccggccgatgttcgagcatgccagccagaccctggtacggatcgccggcgaaatgctcgcggcccatgagctgaccctggacgacatcgaccatgtgatctgccatcaaccgaacctgcgcatcctcgatgcggtgcaggagcaactgggcattccccagcacaagttcgcggtgaccgtggatcgtctgggcaacatggcttcggcctcgaccccggtcacgctggcgatgttctggccggacatccagccgggacagcgggtgctggtcctgacctacggctccggcgcgacctggggcgcggcgctgtaccgcaaacctgaggaggtgaaccggccatgttga

SEQ ID NO: 13189 - DNA, 642 bp, Pseudomonas aeruginosa
ccgccgtggccgctgccgaacgcgaaaggggagagcgcgatgcgcatcacgctgttggataacttcgattccttcacctacaacctggtcgagcagttctgcctgctcggcgcggaggtccgggtgatgcgcaacgatacgccgttgccgacgatccaggcggtattgctggccgacggttgcgaactgctggtgctgtcgccggggcccggtcggccggaagacgccggctgcatgctggaattgctcgcctgggcccgcgggcgcttgccggtgctcggcgtctgcctcggccaccaggcgctggcgctggccgccggtggcgcggtgggcgaggcgaggaagccgctgcacggcaagagcacgtccctgcgtttcgatcagcgtcacccgctgttcgacggcatcgctgacctgcgcgtcgcgcgctaccactcgctggtggtcagtcgcctgccggaaggtttcgactgcctggccgatgccgatggcgagatcatggcgatggccgatccgcgcaatcgacagctgggcttgcagttccatcccgagtcgattctcaccacccacggccagcgtctgctggagaacgctctactctggtgcggcgcgctggcggtacgcgagcgccttcgggcctga

SEQ ID NO: 13190 - DNA, 993 bp, Pseudomonas aeruginosa
gcggcgctgcgccgtttcgacgatgctcggttgccaggccggcgcatcgtcgaaacgctggcggccgagttcgcgcaggcgctggcgggcgctttcgagaaagcgcaggaagctgcgctcggattccagcgcggtgttgtagtagcaatacaccttggtgtcgatgccgcccggttcgtagagttcgctgaggactgccagggtaccgttgcgcaggcgttcctcgacgaaataatgcggcgcgatgccccatccgacgccggcttccaccagacgcagcatgtcgtcgaagttttccacgaagagcaccttgtcgctgaccggccgcagcaggttcgaatgctgcccggagcggctgccgaggctgatctgccggtaattggccaggctcgcgatgctgtgcagggaggcattgcacaaggggtgctgcggatgggcgacgacgaacgccttggtgtagccgagcacgcactggttgaagcgggatatcttcagttcctcgtcgatggtgatggcgatatcgatttccgcgttgtcctgcttgatcgtcgccaggctatcggcgggcgaggtgcgtatcaggctgaccatgttgaaatcgtcgagcagtacgctgctcaccgtatcgcagaacgacggcgggatggcggtgtccagcaacacccggagattgcgcggacccttgttgagattgaaggcgatgtcgccgatcagctgctggtagttcagcaggctgcgcatgttagggatcaggcgaagcgcctgctcggtgggttcgaccttgtagccgtcccgacggaccagctccacgcacaggtcgatttccaggttgctgaccgccgagctgaccgcggtgtgcgacttgcgcaggatccgcgcagcggaggaaatcgaaccggaggcgatgacctggaggaacatgttcacgtgattcaggttatgaataggcatcccttattccttttattgggtggcgcgtgccgcttcccttga

SEQ ID NO: 13191 - DNA, 735 bp, Pseudomonas aeruginosa
cgaccgaaacctatgtcttttgttagcggagccaccggccaggccggtacggatgccgggatggccctggcgcgacctatgcggttagaatccgcggccttgcaggcggatccccggggtttgctcaagggggacacgggtgccgtgcccgaaacctgcaatcgtcagttccctgcggtccagcctgccgccgggtataaaatcgagagacgcgctgttgcgccttcaggtgtagcgactatgacgcacatttccgaacgactcctggtacaggcccacctggccgccaagcaaccccgtgtgttgagcgagcaggagagcgccgagcatcgcgcggcgatcgcggccgaactgaaggcgcaaaatgctgtactggtggcgcattactactgcgacccggtgatccaggcgttggccgaggagaccggcggttgcgtatccgattcgctggagatggcccgtttcggcaaccagcatccggcgcagacggtggtcgtggccggggtgcgcttcatgggcgagacggcgaagatcctcaaccctgagaagcgtgtgctgatgccgaccctcgaagcgacctgctcgctcgacctgggctgcccggtggatgaattctcggcattctgcgaccagcacccggaacggaccgtggtggtctatgcgaacacctccgcggcggtgaaggcacgcgccgactgggtcgtgacctccacttgcgcggtggacatcgtctaa

SEQ ID NO: 13192 - DNA, 414 bp, Pseudomonas aeruginosa
aggcgctctacccggacgccgccattcctggtccaccccgaatcgccggaaagcgtggtcgcgctggccgatgccgtgggctcgaccagccagttgatcaaggccgcgcagaccctgccgaacaagaccttcatcgtcgccaccgatcgcggcatcttctacaagatgcagcagttgtgcccggtcaaggatttcatcgaggcccccaccgccggcaacggcgccgcctgccgcagctgtgcgcactgcccgtggatggcgatgaacacgctcgagcggaccctggcctgcctgcgcgagggcagcggggaaatcttcgtcgacccggcgttgatcccgagggcggtccgtccgctcaagcgcatgctcgacttcacccaggccgcgcgcctgcgccaggccgggaacgcctga

SEQ ID NO: 13193 - DNA, 1179 bp, Pseudomonas aeruginosa
actgctgcgcgaagaggccgccgaaggcgtctatcgatactggctgcgcaagcgttagcggagccttcgccgttccgattcaggatttccgatgatcaaggtgttacgcgactggatgcagcgctacttctccgacgaggaggcagtggtgctggcgatcatgctggtgctcggcttcagcgtcatcctcgccttcggcgggatgctcgcgccggtactggcggcgatggtgatcgccttcctgatccagggcgtggtcggcatgctggaacgcttccgggtgccgcacctgttcgccgtgtggctggtctacagcctgttcctcggcttgctggcgctgttcctggtggtcctgctgccgctgctctggcagcaattgttcaccctgttcaacgaactgccgcggatgctcggcgaatggcagagcgtgctgctgatgctgcccgagcgctatcccagcctgatcagcgaggagcaggtgctcaaggccatcgagaccgcgcgcggcgaattcggccagatcggccagtgggcgctgacctcgtcgctggccagcctgccggtggtggtgaacgtcatgatctacctggtgctggtgccgatcctggtgttcttcttcctcaaggacaagaagcgcttccagacctggttccaccgctacctgccgcgcgagcgcgggctgatgaaacaggtctgggccgagatgaaccagcagatcgccaattacattcgcggcaaggtcatcgagatcgtcattaccggcgcggtgacttacatcgccttcgcctacctggggctcaactacgcagcgctgctggccctgctggtcggcctgtcggtggtggtgccgtacatcggcgcggtggtggtgagcgtaccggtggcgatgatcgccttcttccagtggggctggagcgaccagttcatctacctgatggtggcccacgcgatcatccaggcgctggatggcaacgtgctggtgccgctgctgttctccgaggcggtgaacctgcacccggtggcgatcatctgcgcggtgttgctgttcggcgggctctggggcttctggggcgtgttcttcgcgatccccctggcgaccctggtgaaagcggtgctggatgcctggcccaaggaccttcccgagactccggcagccacgcgatagcatcggccgcatga

SEQ ID NO: 13194 - DNA, 693 bp, Pseudomonas aeruginosa
aaaatgcaaaaggccgcggatgcggcctttttttcggggcggggctcaggtgccgttgagcgcttgggcggcggcgagaaccgcgtcgacatgcccgggcaccttcacgccgcgccactcctggcgcagtacgccgtccctgtcgatcaggaaggtgctgcggtcgacgcccatgtattccttgccgtagagcttcttcagcttgatcacgtcgaacagttggcagaccgcttcatccttgtcgctgatcagctcgaaggggaattcctgtttgcacttgaagttctcgtgggacttcaggccgtcgcgggagatgccgaagacctcggtattggccttctggaacgccgcgtactggtcgcggaagccctggccctcggtggtgcaaccgggggtgctgtccttcgggtagaagtacaggacgacctgcttgcccttcagcgcggacagggtcacctccttgccgctggttgcgggggcggtgaagtcgggtacgggtttgtcgattgcgaccggcatggctcggctcctcaggggtgttgggggcgccagggttcgatcagggcatccaggttcagggcgtcggcgaagtctaggaactggtcgcgcagccagctgatctgggtgccggcgggcagcgtcacggtaatcgtggcgttgagcatggtggtgttggtgtgcggcgcctggtag

SEQ ID NO: 13195 - DNA, 723 bp, Pseudomonas aeruginosa
gcggagcccatcatggaaaaacgcgaagaactctaccgcggcaaagccaagtcggtttaccagaccgacgatgccgatcgtctcatcctgctgttccgcaacgacacctccgccttcgacggcaagcgcatcgaacagctcgatcgcaagggcgcggtgaacaacaagttcaacgccttcatcatgcagaagctggaagctgccggcattccgacccagttcgacaagctgctgtcggataccgagtgcctggtgaagaagctcgacatgatcccggtcgagtgcgtggtgcgcaatttcgccgccggcagcctggtgcgtcgcctcggcgtggaagagggcatcgccctgactcctcccaccttcgagttgttcctgaagaacgacgccctgggcgatccgttcatcaacgaatcccacgtccaggccttcggctgggccactcccgagcagctggcgcagatgaagacctattccttcaaggtcaatgaagtgctgaacaagctgttcgacgacgccggtctgctgctggtggacttcaagctggagttcggcctgttccatggccagatcgtcctcggcgatgagtttagcccggacggctgccgtctgtgggacaaggaaacccgcaagaagatggacaaggaccgcttccgccagggcctcggcgatgtgatcgaagcctacgaagaggtagccaagcgcctgggcgtgccgctttaa

SEQ ID NO: 13196 - DNA, 213 bp, Pseudomonas aeruginosa
agcagtcgcaagaacagctatgagtccgatagcgccaactgtgtagatcgcggctcgatcagttttagactcctctatcctcgcttcaagggcagcaagctctgcccgcttttctgcaatttgtttttctatttcttcatttccgctcattgcttcacctcgattccggcttcgcgcagcgcctttacaatctctgcgcgctctcgctgttga

SEQ ID NO: 13197 - DNA, 414 bp, Pseudomonas aeruginosa
ggccttcccatctcactccgccaaggccgttgcctaacccgatccaatctaccggccgggaggccagccatgaccgaattcatgcaaatcctgatctttggttcctcgttggcgatggcctacttcctgggcgccacgtcgtcgaggaagagctccagtgaaatccggctgatcgacaagtggccaacggcctacatccagttcgactcaggcatgagccaagaggatgcgctgcgcttccttgagctggcccgcgaaatggttctggccgggccagagaaagtgactgccgagaatgcgctgaaggatgacgaggagagccgagacgctttctgggcgcagtctctcaagactggtttggcctcgttcgaatcgcgttccaagtcttcacatagccctcgagacccccaatga

SEQ ID NO: 13198 - DNA, 468 bp, Pseudomonas aeruginosa
agcatgaaaacgcccgtactagagacccgcagaaaggtagtgaccacggtagccaatgcctatccgggcggtcgcgattgcgctgctgcgcgactggggattccgctgaagcgcctggagaaccagatgtacgaaacggcgggcgtgaagcccctgagcgacggcgacctgtacgtcctggagcaggagatggggacttcctatctgccggactacatctgcgcgatgtacgggggagtgtttgtgcggacgccggaagcgggcgatctggacaacgtagacctgcaccaccgttcgctgcgtacagcggttaagcgtggacgggttgatcagatgatcgctctggccctggaggagggggagatcagcgccgatgaggcgaaggaaatcttggccctgcatgccaagcacatggctgcccggcatgaagaggttcgagccgtgctcgaactgcacagggcgaagtga

SEQ ID NO: 13199 - DNA, 1443 bp, Pseudomonas aeruginosa
caaccgccagcaagatccagcgcttcatggagggcaagtacgatgccgcatgagcgtcctctggtagcgatggaagctgagcagggtgtgcttggcgcgctgatgaagaaaccggaactgtgcgaggttgttggggctttcctttccccgaccgacttcagccatgccgacaactcggtgatctacagcctgatccttgcctgtcattcgaaggccatcgtgcctgacccgctttctctggcggaggctaggtcggagcttccaagtggcgcctttacgcttgcatacgccaacgatctatggcgcgaggttgcaagcacagctagcgccgaaaacttcgccaggattgtcgtcgagcgtgcaaaggctcgggagctgtacgaagcgggcgaacggatcatgaacatcgcccttcagagagggaaaatcccggaccaggtggctgaagcgcagagcatcgttctcgatctcaacgcccaggacgagactcctgatgtggtgacactgcgcgaggcaatgctcccagtcttcgacgaaatggaagttcgctggaagggaactcagtcggtcggactgaagttcaacctgccagacctcgatgccgttatccagggattgcgtcccggcaacctggcaatcatcgctggtcggcctggcacgggtaagacggttctcggggtggggattgctgacgaaattgccgttcgcaaccggggcgccgcgttgatcttctcgctggagatgtctcaagccgaacttgcaaagcgctcgctcgcatcgctttctggtgtttcgcaagcggcgatcgactcaggcaaagcgctggagtgccaggactctattgcgcgcatgactgccgcagtggaccaagtctccaggggtgatgtgcgaatttgcgacaagggaggactgactttcagtcggatctgctccatcgcccgattccagcatcgagcaaagccgctgagcctgatcgtcatcgactatctcgggcttatcacctcagatccgagtcaccgtcatcagaaccgaaaccaagaacttggcgccataagccgagggctcaaggctctcgccaaagagcttggcattccaattgtcgcgcttgctcagctcaatcggagcatcgaaacccgggccgacgccaagccaaaaatgagcgacctgcgcgattccggcgagatcgaacaagacgccgacgtgatcatcatggctcaccgggatatgagcactgagcgtggacagaacggtatcaccgagcttgatgtcgtgaagtgtcgacacgcaaagccgggcttctgcctgttgcagttccagggtgagttcgcgcgcttcgtcagttgcgcccaggaccgggaagagcagcaggagcagacggttcgtccgcagcgtccttccgcgcgatcaatggtagctgacttcaagccgcgaggtgcccaatga

SEQ ID NO: 13200 - DNA, 285 bp, Pseudomonas aeruginosa
ggttcccggcgccaagccggaggaggtcgagtgatgccgaactatcgcaagccggacatgtactcggacgccgattgggaaatggttcagggctacatggccggcaaggacggcctgcgcgcccagcgctcgacggctgcctacatgcatggctatcgcaacggggtttctgatcggaccggagtcccgcatgagcgggcagaagttcttcgccgtcgcgcagagatgatccctggcatcacgcccgataaagtttggttccaggggagggtaggccgtggctga

SEQ ID NO: 13201 - DNA, 771 bp, Pseudomonas aeruginosa
gcccctgaagctgaccatcgaggacatcaaggcactgaaggccaagttccgggcctgggtgcgcgaactgaagagggcaacggcatgaatctaaacagcgcgcgcattgcctggcacgatgcgttctataccccttggaacagcggcatggctgaggcggcggagcgagctgctcttggaattgtcgaggctggcggttatgtccggcgccgtatcaccgaaatcgacgatgatggggaagccgtctcctacagccagcacaccttcgtgccaggaatccatcagactaggactgagcgcgacatcagcacgcctcgggctgttcatcaggcgctcgccggcatgattcaaaaggcgatcgataccctcccggcgcacctgaaggttttcggcaatcacatgtacagcccaatggctggcgaagacgaaaaggaggctgctgaagagatcgttttcaaagtcgcgtacgaaactgggccaaggatgtacacgaagaagttcgagaaggcgcgctatgtcgctgcgggagtcttgttccggtaccgccgcatgcaccagggcggccagagcgaaggcgttgatccttgcccgagcccggagtcattccgcgcatggttgctccagattcacggacttgaactgtcgtccgaacagtggaccagggagtgggatggattcattcagtcctgctttgatgcctgcaacgatctcgacaagggagcgcttgtgcctgtctcttcagcgataaaaatgatgaaaaatgctgcttga

SEQ ID NO: 13202 - DNA, 438 bp, Pseudomonas aeruginosa
tctgtgcaaactgccaccgaatcaggacgcatgcgcgccgccacaaaccagcacctagcgcataagtcagcccttgctaccaaatccttctgggttgcgactacgcggccgaggatggtcaaaggtgggacccggccctaccgcgacctaatactccgggatcgccttggacacgcaggcgttaaagtgaagtgggagccggtggaagcccggcacggagtgaatgcgcaggctgatgcgctaagaggatacgcggcggcaacgttcagtgggcgctatagccagttcaccgccatgccggattcagcaccggtcactccaaatcacgcatgcggcagaagaaggcaagggtcaccactggtgatcaaggcgaaagccccggctccttgctctgcgggcgtgacgccggctagtccggcacctattccgcggctctag

SEQ ID NO: 13203 - DNA, 528 bp, Pseudomonas aeruginosa
catatcatggccattctcgttgatttgctagaggatggcgtgatgactgattttctcgaaatacgtgaggcatacacgaagtacaaggccgctcaggacgcctactggtctgaccttcagaagaaggcttgggccatctatattggcttcgagcgccatctccgtcttgaccagcacaaggtgacggttcccggcgaggatgcgcagccttatgtccaagtcggcagcatggatggagaccgcttcgtaagggctctggcccctcagttcagcggagcggatggaaaggtggaattcacgatcagcctgttggttgacgaacaccccacctcctaccccaaaaagagaatccttattcaggcctctatcggaaaagagtcgggccggtacatggtggagattaaaggtaggtcgggacctatcactgtttccattgggcctgatttcccaagcgatcagcttggcgatttgtacgaaatgatcgctagagacgtgatcgcgtcgatggacccatcggcattcgcctag

SEQ ID NO: 13204 - DNA, 306 bp, Pseudomonas aeruginosa
cggaccgctttggaggtcgtaatggttgacccttggactctggtggccgcgatgatttgcggcgccatctgcatgcggctggcgacataccgccggcaaggcgcgaggtatcgccggggagtgtcctggctcgcatacctgctgtgcgttggtagtgggtgtttcgccctgagcgtgatgctcgatgcactccacggctacagactgaatcctgtctccccttggctgaccctggtgctggcgatcctgctcggccttgtctgccgcgctcgggggaacctggcccacattctgagggtgtactga

SEQ ID NO: 13205 - DNA, 273 bp, Pseudomonas aeruginosa
aggaacgccctcatgaagagtcacccgatccctgtaggagtcgaggtcaaccccaatcggccctggacgcctgatgacattgctgggtacagcggcgaggtagtgagcgccatgaaggttctcgagcctctgctgcgctccggactgctggcgctccatcctgatgaatggcaaggcggaaagctctcgttcctcagaccggcacaagctaggcggcaaggctggaccccgccggttcaggcagccggcaatcaggtatccagaagtgcctga

SEQ ID NO: 13206 - DNA, 432 bp, Pseudomonas aeruginosa
gacaccgcgcccccaaagcactttccatttccacagaatttaggtttcaagatggcacgacacaaacagccagatgtcgtcgccaagttcaaaggcgccgacaagaaaaacccccagcgctaccggcaggagccggcaaagggagagggggaggtcggcgaagcgcccatccatctgcaaggccccgctcgtctcgcatggaaagagttgtgcgctcagtcgatcaagggcgttctgacgggatcggaccggatcatcctggaggtcaccgcgaacctgctcgctgaataccgtgccaacccgacagagttcgcggttggcaagtacacccatctgatcggaaacctggcccggcttggactaacgccgtccgaccgccagaagttcggcctggaaaagccgaaggagaaggacgagttcgaggatttctga

SEQ ID NO: 13207 - DNA, 894 bp, Pseudomonas aeruginosa
cccatgactctgcgaaatcttccggcagcgccggaggctcgcccgcgctcgggcgtccagtgcgacctggcgcccaaagcgctagatgcatggcgtcctgagcttcgagcagcttctggcgataacccggactccacgatcaccatctacgaaccgattggctacgactggtggaccggtgaaggtgtcacggcaaaacgcattgctggagctctgcgcgccataggcagcgatgtcgatgtgaccgtgaatatcaacagccccggcggcgatgtattcgaaggcctggctatttataacctgctgcgcgagcacaagggcaaggtcacggtgaacatcatcggcctggccgcctctgccgcctctttcatcgccatggcgggggatgaaatccacatcggccgcgccgccttcctgatgatccacaacgcctggctgatcgccatgggcaatcggaatgatctccgcgagatcgccgattggctggagccattcgacatgacgctggctgacatttacgcacagcgcacgggaatcgacatcgacgacatcgtgaagcagatggacgccgagacctggatcggtgggcgcgaagccgtcgacaaagggtgggcagatgccttcctggagtccgatgagatctccagcgctcccagcaaccgcagcgaagccatcttggccaagcgccgaatggatgccgccctggctcgcagcggaatgccgagaagccagcgcaatgaactcatcaacgacttcaagaccagcatgcttggcgctgctggcgggggtggtgacaccccgaccgatatgcctggcgctgtcgctcctgacctctccgctgcactacgggcagcacaagacatcaccaaattcctccaaggagaatcgcaatga

SEQ ID NO: 13208 - DNA, 648 bp, Pseudomonas aeruginosa
tgcatacctcgcatccgagcacctggcgcgccagttggtggcccgaggcttgtgccagattgtggaatcagagatcccaaagcctgtggctggcgagtcgccgcctgcatcgccagcggcccaagcctcactgccgaagactgcgagcgagtcaggcgatggcgagcagccgcgccgcagagggcggccatctgcacgaacacaacgttccgactgaccccctgggctgatgcactgtgggcaatggataaggcctggtgggagagatacgccgccgaggctaaagcaaacttctgtggtgagcttctgacactcagcgccaatcccttcggaatcaagacggcgcgcatcgagcactacaggaactcaggcggcggcgcagtttccttggccatcgccaggggtgctaaacgcatcatcctgctgggctatgacatgcagaaaactaatggccaatcgcactggcacggcgaccacccgaaggggcttgggagcgccggaaagatcgcggagtggccttccgagttcgagcgcctgaagcgcaacaacccgacaatcgagatcatcaattgcactcgcgaaacagcgctgacctgcttcgctcggctcccactggaggaaatgctgaatgagcctgatcccgcttga

SEQ ID NO: 13209 - DNA, 858 bp, Pseudomonas aeruginosa
tggattgacggacggacgctaggaggtcgcttgtttatccgcggaatgcttggccttggtgacaatatctacgcgcgcgcgttcgtgaagaagcaccagggcgcctatctcgaaacgccatggccgcaactctattcagacatcgatgtgaaatgcgtgcgcccatacacccagctccgcacgcaggcgaagaacgtccagcgcccggcgcagtggcacaagcctttcggtggcggacaattacgaatcgcatacggccagatgccgatcatccagggcttgcgacaagctttccggtgcgagcccggcgcgttcgatttgcccgacttcggcccgtcgccggtcgaggggcgctacgttctcgttcgtcccgcgacggtgcgcgctgagtggcgtgcagacacgcgcaacccactgcctgagtacatcgccagcgctgcctcagagatgcgccgaaggggctggagagtggtttccgtggcggacctggagccgggaaaggagtgggcgctcgctccacttccgccggctgacatccagttccacaagggcgagctgccggttgaacaactgctggcgctgctccagcacgcagatgccgtgattggcggcatcggctggatcgttccggccagcatcgccgccaaggttccggcctggatcatctgcggcggccagggcggatacaactcgccagaacacatcaccgacaagtgcatggacctgtcccgcatcaccttcgcggtccccgacaggttctgccgctgcaccctgaaacagcacacttgtgacaaaaggatcgccgatcatgacgcacgctttgccgcctgggctgaccgactgcctgctctggtctga

SEQ ID NO: 13210 - DNA, 309 bp, Pseudomonas aeruginosa
cgaaaaaaactgacgcccgccgatgaggtttggcatgagctcgtgctgaacggcatcggcggttgcaccattcgagaggcgaaggaacgcatcgactacgacgagtacagggcgtgggttgcctacctgaaaaagcgtggctccctcaacgggagctatcgcctggagtgggtgctggcccaattggcggcgatccaggccaaggttggcggggtgaagtgcgaacccgacgacttccgtccccatgttcgggggccggtagagccggtgggtatctcgctcgagcaagccatggccgcatgggtttga

SEQ ID NO: 13211 - DNA, 243 bp, Pseudomonas aeruginosa
atgagcacttttgcttgtgagtccaacatgagggagctctcaatgagcacaggtcggcccattgaggagctaaagcaggtagtcgtgactgagttaatggtcaaagccgcgatggattatgtgctcgggttatgggatcgggatgtcgacattttcctgctagaggatgtgttcaggataatggcagttcttcagcctcggcctctggatattccaaaattgacgagcgcaccttctcaatga

SEQ ID NO: 13212 - DNA, 924 bp, Pseudomonas aeruginosa
ccacgatctgcccgatttctgcccgcatggcagagtttgggcccgcgtcgtatctatagtttgtggttcttgggtcttccattccgcttgcctcctcggcccctggtctcatccaagcacgggaagctaccgccagagcaaacatgctgccactggcatttcatccacgctgtacaaccttccagcccgcctcgcgcgggctttttcatatctggagaacgcatggccttcaatgctgatgtgcagaagcttgagccggggaacctgatccggctgtttgaggtggatgcgacgcgccttggcggaaatctctggcgattccatggccacgcccaggaaggggagatcatctggcagggaaatgtgtacgagccgattcaaatcaccgcaaaaggctttgatatccgcggcgatggtcgacccgcgtcgccgaccctccaactggcaaacgagctcgccggcattcgaggagcgatatcggccatctgccttcagttgcgagacctctgtggcgccagggttcgggtgatcgagacgtggcggcactatctggattccgcgaacttccctgatggcaaccccgatgcagccgacgaggctcgggtgggaatctggttcattgagcagaagaccgaggaaacccgggagcaggtcaccttcgcgctcagcagccctatcgacatggaggggcagatgctaccggcccagcagatcaccaagctttgccggtgggcgtgccgaggtcagtaccgaggagaggcttgcgcctataccggcgccgccctcttcacgaagaaggatgagcctacagataacccggctctcgatcggtgcggcggccgctggagcagttgcaagctgcgcggcaacaccaaccgcttcggcggttctttgggggcaagtttgatcgtttcgtcgaggtaa

SEQ ID NO: 13213 - DNA, 408 bp, Pseudomonas aeruginosa
tcaccaaggagtacgtcgagtccgcgctgggcgagcagttcttcgccgacatcgatcagatgcaggtcgatatcagtggcctgcagggccagatcgataatctgtccgatgtgctggcctacgacccgacgaagacctacgcgaagaacgatatcgtgcgggtcggcaaccggctgtatcaggcaaagcaggcggtgccgctcaacgcctcgccgccgaacgcgtcctactgggccgacatcggacagtcgatcgagacggccaacggcctggcccagcaggtggccaccaacaccgcggatatcaccgagctcgacggtaaggtcgaagcggcggcttcgagcctggatgttctgcaggctgccgcccgccgggagccggcgaccggagagaaggccgatgcgctga

SEQ ID NO: 13214 - DNA, 822 bp, Pseudomonas aeruginosa
caggagaactctatggcgtggtactcaaccggaaccgtggcggtgaccgcaaatagcccgaccgttaccggtaccggcacacagttctcgtccaatgcccgagtcggcgacgcatttcgcggacccgatggacgttggtacgaggtcacaaacgtcgccagttcgacggtcatctcgatcaagcccaactaccagggcagcacggccagcggccaggcctatgcggtggcgccgatgctgggctacgacaaggacctgtcggatcgattcaacctgatcgccaaccagtggggggcaaccctggcggggattaagccctgggcgctctctgcaaatgcggcggcagcgcggggggatctcggcctcggcagtgcggctgtccgcgaagcgctcggtagttcgggcgcgctgtattcgcgagacagcatcctcggcgccgtttcgcagtcgagcggcgtaccgaccggtgcggtgattgatcgcgggagtaacgcgaacggggagtatgtgcggttcgcggatgggacgcagatttgttggacgaacactctcaccttcaccgctggggtcacgtcggtcggtgcgaactggtcgtacccggcgagctttagttcctcgtaccccatcgctggggctgtctccgcttctggtgctggtggagactatgactctggcgtgtcggcgagaaaccagggagcgacctacttcaatccatccgcgggtacggctggggtggggttcttctgcatatcgtcggcatcattcacatcaggcgctcagactaggaataacagggtcgtcgccatcgggaggtggttctga

SEQ ID NO: 13215 - DNA, 465 bp, Pseudomonas aeruginosa
cccgcttggtggagaacctcaactacagtgcccgtggcctggctgcgacctggccgagccggtacctcggcgccgacggccagcccaacgccctggcgcagcgcctggcgcgcaacccccgagccatcgccaacaacgcctacgcctcgcgcaacggcaatggcgacgaggcatcgggcgacggctggcggtaccgcgggcgcgggctgctacagatcaccggccggtcgaactaccgcgccgccggcaccggggctgggccagccgctggagcaggaacccgaactgctcgagcagccggagtgggcggcgatctcggcggcctggtggtgggccagtcacggcttgaacgacctggccgaccgcggcgagttcgccgccatcactcggcgcatcaacggcgggctcaacggccaggcggagcgcctggcgctgtgggagcgggcgaagagggtgctgtcgtga

SEQ ID NO: 13216 - DNA, 498 bp, Pseudomonas aeruginosa
atatattctggccttccggaacgtacaaccgggggcggaagcagtatccggttcggcgtccagcgcgatgcactttgcagcaaaggtcgacaagaacaaaggagaaacctcgtggcagatcttcccgatggcagtactccgggacctgaggcgcagtacctagcgtttctcgcccagggccgtttcatgttgcagcgcagccgttccagcggtcgccatgtgttctacccgcgccagttggtgccgggtagcggcgagactgatctcgagtgggttcccgccagcggcctgggtacgctctacgcgatcactgtcaatcgctcccgcggcggcaatcacaatgtcgcgctggtcgacctggacgagggcgtgcgcatgatgtcgcggatcgacgggcaccagagcctgccgatcggcacccgtgtgcaggcgcgcatcgtcgagcaggatggtgccaatgtcgtggtgttcgttccccaccaggagggacgaccatga

SEQ ID NO: 13217 - DNA, 1242 bp, Pseudomonas aeruginosa
tggacatcgcctacctcgccacccgggcgtatctatccggtgggcgacagcctccgcatgatcaccgtcagcggcggcgccgggatcatcgtcagcgatgtcgccgaggaagtcggcctgccgatgccgccgatgccggacatggcccaggagcggctgaaggcacggctgtccttcgcttcgccgatcaacccggtggactgcaccgcgcaggccctgaacgacctgacgctggtgcgcgactttaccgagtcgatggtggtcgacggtggctaccgttcgctgctcgccttcttcacccaggccggcaccgccgcctccatcggcgcgcgtctggccgagcagttccggcggatcaaggaggctcatcccgagcgtctgttcgtggtctcggtgatgggcgagggggaggagctggcaccctacgaggaggccggcttcgcactgttcgaagaccccacccgggcggtagtggcgatccaggccatggggcggctcggcgaagccttcgcccggccgttgcgcctgcgccggcctgccggcgggctacagttgcccgcctccacgcccggcgaagccgaggccaagcgcctgctggcgcgcgccggtatcgagtccgccgccgaggcggtgctgggcagtgccgaagaggcggttgccttcgccgagggcatcggatacccggtggtgctgaagctcgcctcggcggacatccagcacaagtcggaaatcggcggcgtgctgcttggcgtaagcgatgcggacgcggtacgcgccggtttccaactgctcctgcgccgggccgccgagaaggcgccgcaggcgcgtctcgatggcgtcctggtggcgcgccaactgcagggcggggtggagtgcttcatggggatccagcgcgatccgctgttcggcccggtggcgttgttcggcctgggcgggatcttcgtcgaagtgctgcaggacgtggtgttccgccgctgcccgttcgaggtcgacgaagccgaggcgatgatccgtagcatcagaggcgcgccgctcctgttcggcgcgcgtggccggccgcgggccgacgtcgcggcgctggcacggctgctgtcgaatctctcgcggttcgcctgggaggcgggagagcgcttgcgctcggtggacctcaacccggtcatcgccttgcgggagggccagggcgcctgggcggtggatgcggtgttggaagtcgacgaggtggccgatggcgctcgatcctga

SEQ ID NO: 13218 - DNA, 480 bp, Pseudomonas aeruginosa
ggtactcctgaactacccgatccccgaagtacgccagcgctacagccggcgcgacagcgccttctacgcattgaccctcggtctgggcggcgacccgctggacgagcgccagctggcctacgtcgatccgtgccgcgatctccaggcattgccgtgcatggccctggtgctcggtcatccgggcttctggctgggcaatccggcgactggcgtggacgcgctgcgcctggttcacggcgagcagcgcctggagtggcggcggccgttgccggcggaaggcgaggtgatcggccggacccgggtcaccggtctggtagacaagggcgccgacaagggcgcgctgctctacagcgagaaggtgctcagcgacgcgctcagcggcgaggtgctggctgtcgcccgcagcaccaccttccttcgcggcgacggcggcttcggtggttcccggcaggtgccggaaacgccgcatcgcttgcctga

SEQ ID NO: 13219 - DNA, 2238 bp, Pseudomonas aeruginosa
acggacacccgacctgcgactcgacctgccgacccgtccggagcaggccctgtactaccgcctcaacggcgacgacaacccgctccacgcggagcccgcggcagcgctgcgggccggcttcccgcggccgatcctgcatggcctgtgcaccctcggcgtggcattccacgcggtgttgcgcgggctcgccgactaccgcgcggggcaactgggacatctgcaggtgcgtttctcggctccggtgtttcccggcgagaccttgcgtaccgagatgtggagcgacggctcgttccgcactcgcgtcgtcgagcgcgatgtggtggtgctggacaacggccgggtaggtccgccgccagagcggccggactgaagcgaagggcggcggcgcgagggaacgaccgtcgggctgccgtgaagatcaaccgaaatcctgcttgcgagaacaagaataatgaatgcaaccgcgctttcaccgaacccggcgccggccatttcccggcgcaccatgctgatcgccttcgtcttctgcttcctcggcctgctcgccgacggcgtcgacctgatgttcctggcctacagcctcaacagcctgaaggccgaattcggcctgagcaacttcgaagccggctccctcggcagcctgactctcgccggcatggccgtcggcggtatctatggcggctggtgctgcgaccgcttcggccgggtgcgagtggtgacctggaccatcgtgctgttctccatcggtaccgcgttgctggggctgacccagaactactggcagttcgcgctgatccgcttcgtcgcctcgctcggcctcggctcgctgttcgtcgcctgcaacatcctgatgtccgagtgcgtcggaaccaggtaccgcaccaccatcctcgccgccatgcaggccggctggaccgtgggctacctggtggcgaccctgctggcggggcagatcatccccgagttcggctggcgcgccttgttcttcaccgccgtggcgccggcgctggtctgcctggccctgcggccctgggtgccggagtcgccgtcctggctcgcggcccaggccgggcgccagcgtcccggcgcggctccgcagagccacgccgaggctggcggcgccggcccgctgggacggatgctgggcgatccggaaacgcgcggcatgttcctgctctggagcctcacctcctgcttcctgctgttcggctactacggcaccaacaactggatgccgtcctacctggagagcgagttggggatgaacttcaagtcgatgaccggctacatggtcggcacctacagcgcgatgatcctcggcaaggtcgccgccggcgtctgcgccgatctcttcggtcggcgcctgaccttcgccgccggggccatcggcagtgccgctttcatgccgttgatcgtgttctaccactcgccctccaacatcctctggatcctcatcaccttcggcttcatctacggcgttccggtcggggtgctggccacctacatgaccgagagcttctccacccgcgtccgcggctcggcagtgggcaccgcctacaacctggggcgtatcggcgcggcggtggcgcccgccggcatcggcctgctggccacccacgtgtcgatcggcgcgggtttcctggtgatgggcatcacctacgtgctcaccggactgatcccggcgctgttcattgcggaccggctctacgacccgaaccgcgagtcccgcgatgccgagagcgcttcccgacggcaagcgccgggcagtgccgtggataccgccgagcggcgcgcggccaaggcctgatcctgcggaaggagtgcacatccatgagttcttttccacgacagccagcggcggagcagcggcccgccagcttccaggagttcatcggcctcgagcgctggaccgatgccgacggggtggcgcgggtgcgcctggggcatcgcccggaactgatgaactacctgcaacagttccacggcggggtgttgatgtcggtgctggacgccgccatggcccaggcgatccgtgcctgcctgccggactgctcgatggtgaccatcgacatggctacccacttcatgggtagcgcccgcggcgagcttcgtgcggttggcagggtggtgcgacggacccgcacgatctgcttctgcacggcggaaatctgcaacgaggacggcgaggtcatcgccatggcctcgggcagcttcaggtaccgcgcggctaagccgtaa

SEQ ID NO: 13220 - DNA, 1206 bp, Pseudomonas aeruginosa
cggatttccggcggcgcggcagcgggagccatccgtcgcgcgtccggaccacggcctgcgcggtcgctccgcgcggacaagccggcgcctcccgtgcagatgacggacgggcggacggcgtatcgacaggagggcgaacagatgagtgagcaagacgagtgggccggcgagcgcgagcagcgtctgcggatgatccgcgacagcgcggcttcgctggtgccacgcgacggcgacctgacccgcgtgcgccgcggtcgtttcaccggtagcggggtggaccgccaggcctggcgcgaggtctgcgccatgggctggccggcgctgcgcctggatgaagcgttgggcggcagcggcctgggcatgagcgaatacgcggcgttgctggaggcgctggggcgcggcctgctgcccgagccgctgatcgaggccgggctggtggcgccgctgctgccggaagacgagcgcgttgcgttgctggccgctgagcggctggtcctgccggcgggcatcgcctaccgcgatgggcggcgacgccctcgtatgcagcaagggcggttgcacggcgaagtcgctcacgtacatctggctggtgccgccgatgcctggctggtggcctgcgagcagggcctggcgctggtcgagcgcgatgccgatggcgtggaactgctctgcgaggcgacccaggatggcgctcacctggcgcgcctgcgtttccgcgatgcgccggcacggtggttgtccggcgaggtaacggaacaggttctggacgaggcagcgctggcctgcgcggcctatctggttggactgatggatggcgccttcgagcgaaccctggagtacctcaaggtacgtcgccagttcggccgcgagatcggtagtttccaggcgctgcagcaccgcatggtcgacctgaggatccagatcgaactgtcgcgcgccatggtcgagcaggccgccgccgcgatcgatgccggggcgtcggaaagcgagcgccagcggcaggtttccagcgcacgggtacgggcctcggaagcggctctgctggtgacccgccaggccatccagttgcacggcggcatcggctacaccgacgaggcggacatcggcctgttcctgcgccgcgccatggtactgctcaatgcccacggctcgctggcgttccacaaggcgcgctacgccgcgctgctacagcgggaggtggcctga

SEQ ID NO: 13221 - DNA, 1290 bp, Pseudomonas aeruginosa
ccaaggcgttgctcgccgagggccttgacctattgctggagcgggagggcgagttgcagagccagttgtttctcagcgccgaccacgccgagggcaaggcggcctttctcgccaagcgtccccccgtattcagaggaaactgagatgagcgactacgacagtctcgatgacaacgcctttcgcctgatggtccgtgagtggatcgccgccaactatccgcagcgcatccgcaatccgccccgtcgcctggggcgcgaggaaacccgcgagtggtacctgctgttgtcgcgccagggctggctgtgtcccggctggcccagggagtacggcggcatggggctgagcgccggcaagcaactgatcatgatggaggaaatggaggagtacggctgcgcgcgcctgcccgacagcggcgtgaccatgctcggcccattgttgatccgctatggcgacgaggcgcaacgggcgcgcttcctgccgcgcattctcagcggcgaagacatctggtgccagggctacagcgagcccaacgccggctccgacctggccagcctgcgcaccgaggcgcgcctggaaaacggcgagtgggtgatcaacggacagaagacctggaccaccatgggctcggaggccaactggatcttcctgctggtccgcaccgagcgcagcgccaaggcgcagcacggcatcagcttcctgctggtgccgatggacagcccgggcatcgaggtgcggccgatcctcaacctggagctgcacggcgagttctgcgaagtgtttttcaacgacgtgcgggtgccctatgacagcctggtcggcggaatcaaccagggttggagcatggccaaggcgctgctcggtttcgagcggatcttcctcggttcgcccaagcagtccaccttcgctctccagcgcctggagcgcctggcccggcacctgggactgtggcacgaccctctgttcgtgcgccgcttcgccgcgctgagcatggacctggacagccacaaggcgctttacgagcgtttcgccgaacgcctgcggcgtggggagagcctcggcccggaggtatccatgctgaagatcttccagtccgaactgttccagcgcatcagcgagctgggcctggaggtcgccggggaggattcggccctgctgcagcccttcgccgaagaccccgagttgcatccggcggggatcttcatccagtcgcggccgaccaccatctacggcggcagcaacgaaatccagcgcaacatcctggccaagagcgtcctcggcctgtcgggctga

SEQ ID NO: 13222 - DNA, 1116 bp, Pseudomonas aeruginosa
cgagcacggctggaccccggagagcatcgccgagcacggcatgccggcgttgcgcggcagcttcatggacctggcgcgcagcccggacgtgttctcctgggacccgatctgaccgaggaggcaatccatgggcgtgttcaggacccgtttcaccgagaccttcggcgtcgaacacccgatcatgcagggcggcatgcagtgggtcggccgtgccgagatggctgcggcggtggccaacgccggtggcctggcgacgctgtcggcgttgacccagccgagcccggaggcactggctgcggagattgcccgctgccgcgagctgaccgatcggccgttcggggtcaacctgaccttgctgccgacgcagaagccggtgccctatgccgaatatcgcgcagccctcctcgagacgggaatcccccgtcctccaaaaccgccggcaacgaccccggcgagcacatcgccgaattccgtcgacacggcgtcaaggtgatccacaagtgcaccgccgtgcgccatgcgctcaaggccgagcgactgggcgtggacgccgtctccatcgacggcttcgagtgtgccggccacccgggcgaggacgacatccccggcctggtgttgctgccggccgcggccaaccggctacgcgtgccgatcatcgcctccggcggtttcgccgatggacgtggcctggtcgcggcgctggcgctgggcgccgacgcgatcaacatgggcacgcgcttcctggccactcgcgaatgtccgatacaccctgcggtgaaggcggcgatccgtgcggccgacgagcgttccaccgacctgatcatgcgttccctgcgcaataccgcgcgggtggcgcgcaacgcgatcagccaggaagtactggcgatcgaggcacgcggcggcgccggctacgccgatatcgccgcgctggtcagcggccagcgcggtcgccaggtgtaccagcagggcgatgccgacctggggatctggtcggccggcatggtccagggcctgatcgacgacgaaccggcctgcgccgagttgctcagggacatcgtcgagcaggcgcgccaactggtgcgtcaacgcctggagggcatgctcgccggggtctga

SEQ ID NO: 13223 - DNA, 1329 bp, Pseudomonas aeruginosa
tccgctccgccacggcggtcgcggcagggagtgctcgcggcgccgtgtctatccactgacgacgaagagacaacaacaatgaaaattcttcccgttccgatgctggccgcggggctggcgttgctgccgtcgttcgcccaggcggagtttttcgccgacggcaaggccggcctcgaactgcgcaatttctatttcaatcgcgactatcgccagcccggcgccagccagtcctattcggaggagtgggcgcagggtttcctgttgcgctacgagtccggctacaccgaggggctcttcggcctgggcgtcgatgcgctgggcctgctgggcgtcaggctggactcctcgccagagcgatccggtagtggtctgttgccgtattcgacgagcgaccggcgcgccgcccacgactattccagcctgggcctgaccgccaagctacgggtctcgcacagtacgctgaagatcggcagcctgatgcccaggctgccggtggtgcagttcaacgacacgcgcctgcacccgcaaaccttccagggtggactgctggaagtgaacgagatcgacgggctggcgctgcagtttggccagttgcgccaggtcaagcagcgcgactcgaccaacgccgaagacctcggcatcacccgcggcaacaagcgcaacgtactggcgggccggcaccccggcagcgaccgcttcgacttcgccggcggtacctaccgctggagcgagcgcctgagcagcagctaccactacgccaacctggaggatttctaccgccagcattatctcggcgtgcagcacctcttgccgctcaccgatgaccagtcgctgaagtccgacatccgctgggcgcgttccaccgacgagggcggcagccgcgtcgacaatcgcgcgctgaatgcgctgttcacctatcgcctgggtggccacgccttcggcctcggctaccagcgcatgtccggcgacagcggcttcgcctacctggccgggaccgatccgtatctggtcaacttcgtgcagatcggcgatttcgccaacaaggacgagcgctcctggcagttgcgctacgactacgacttcgccgccatcggcctgcccggcctgacattcatgagccgctacctgcgtggcgaacacatcgaccttctggacggcggtgggcgcggcaaggaatgggagcgggacaccgatatcgcctacctggtgcaatcggggccgctgaagaacctggggatcaagttgcgcaacggcaccttccgcagcgatttcggcaacgacatcgacgagacccggctgatcgtcagctacgcgttgccgctgtggtga

SEQ ID NO: 13224 - DNA, 534 bp, Pseudomonas aeruginosa
ggggcccgtaaaaacaggttgaacggagaaaagttgaacccgactggccctgggggatggggcgtcattgcttcccggcggttgccgcgccaaggggcaaggcccaccccccggggccccttgggaggaacgcccacgatccaacctgataccgccttattggaacagcagggcgtgttgaagaaggcaacagcccgatgcgctgttcaggcaggccgaggccgaggcgcagcaggcccagcaggcgcgccagaccgtggcgcccgcggcggccgttgccgctgtccccggggaggtccgcgtaccctatatcccgcaggtggtgcgcgaccagatccgcgacgaagtgaaggccgaggtaatgacccaggccaaggcggagaattgggcgcagcccaacgccttcccggactgggcctcgcgcatcagcttcgacggcgacgtgcgcctgcgctacgagtcgcgctccttcggcaacggcaacagcaaccagatcaccgacttcgccgaactcaacgacgacggtccctatga

SEQ ID NO: 13225 - DNA, 1233 bp, Pseudomonas aeruginosa
cgtcaacccgaataccagctcgggcctgccgccgctgctcaatacccgcgaggaccgcgacagcctggtgcgcctgcgcgcgcgtttcggcctcaaggcggcgctgtcggaaagctggagcgccggcatccgcatcggcaccggttcggacaacaacccggtgtcgaccacccagaccctcggcggcggcttcggcaagaaggacctctggctcgaccagggctacctgacctggaagcccagcgagcgcctgagcctgaccggcgggcggatcgccaatccgttcctgtccaccgacctgctgtattccaacgacctcaacttcgacggcgtggcggcgatcttcaaccagccgctgagccgcgatgtctcgctgttcggcacggtcggcgcgttccccgtggagtacagctcggacaccgcctcgtcgaacggtttcgacaaggaagacagcgacaacaagtggatgtacggcgcgcaattgggcgccacctggaagatcaacccgcagcacagccttaccggcgcgctggcctactaccgcttcgacgatatcgaagggcggcgttccagcccctgccggccctgggccggagatccggagtgcgacaccgacggcagccgtccgaccttcatgcagaagggcaacacggtgttcctcctgcgcgacatcgtgcccaacccggccgacccggcgaacacgccgaacccgcagtacgtcggcctggcctcggagttcaatctgctcgacctgaacctcggctgggatgccgagctacccaacgacttcaagctgcgggtggccggcaactacgtgcacaacctgggctacgacgagggcgacatgcgcaagcgcgccggcggtgtggcgcaaatcgccaacaacctcggctccgacggcgacatcaagagcggggcgaacgcctggatgctccagttcaccctgggcaacgccctggacatgcgcgacgccggcgactggcaggtcttcgccgcctacaagtacatccagccggatgccctgccggacggtttcaacgattccaccttccaccttggcgggaccaacgccaagggctacatcctcggcgccagctatggcttcgacaagcgcgtctacggtaccgcgcgctggctcagctccgacgaggtctacggcgcaccgttctccatcgacgtcctgcaactcgaggtcaacacgcgcttctgagcgctcctcgaggcagaccatga

SEQ ID NO: 13226 - DNA, 591 bp, Pseudomonas aeruginosa
aattcgaagagatggcgcagaagctcggcgacgacctctacaagacccaggtcgagaaccgccaggcggcgctcgcccagtgaaatccgacagcaaaccaggaacccggacatgaacgacatcaccctgatcgaacacctttccgtcgacagcctgaccgaggccttgcaggacgccggctaccgggtcaaccgcagcgagcagaacggcgtcgtgcaactgctcagtgccagccagggaatcggctacgcggtgcgcttcggcaatccggcggcgacgccggcgagctacctcgacttcaccttcagctgcgccctgcgcgtgcagggcgaattgcccgccgggctgaccgagcgctggaatctcagccggcgcttcggccgcctgtcgcagcagggcgagttcctggtgatggaaatggacgtgatcgtcgccggcggcgtcagcccggccaacctgcgtagccatatcgaactgtgggatcgcctgctgcaggagttcatcgcctacctgcgcgactacagccgcctggccgcggagcaacagggcatggcgcaggatgccggtcaacccgtcgatggcgaggcctga

SEQ ID NO: 13227 - DNA, 1374 bp, Pseudomonas aeruginosa
gccgatgcggccggcatttcgttgcggtgtcctggcgttcgcgcttgcccttctcgccggctgtggccagcgcgaggacggcggcgcgggccaggcccaggccgcgcttgccaagccatctgccagcgccgccgcggagcccgcggtggcccgcctcggcgccttgcaggtggcgccggacgaactgaaggcgctgctggccgaggtgccggcggaaacccgcgcgcagttgagcgagaaccgcgacgcactggaacgctggatgcgtgcgcgactggccgagaaggcgctctacgaacaggccagcgcccaggactggcaacagcgtccgcaggtgaagacgttgatcgatgcggcggcgcggcagatcgtcctgcgtacctacctggagtcggtgagcacggtgcccgaggactaccccagcgatgccgaactgcaggccgcctaccaggcgaacaaggcgcaactggctgtaccggcgctgtaccgggtcagccagatcttcatcgccgcctctgcggccggcgggcttgccgaagcgcgcaagcgcgcccaggaactctaccggcaggccgcggacggcgacttcgccgaactggcgcgcaagcattccgacgacccgcagaccgcccgcaacggcggcgacatcggtgggttactggcgcaggcgcaactgctgccggcgatccgtccggcgctggaacggctgaaggtcggcgcggtgtccgagccgatccagggcgccaacggtttccacctggtcaagctgaccgagcgtcgcgacgcccgcctcgccaccctcgacgaggtccgtggtcgcctgcgcgaaagcctgcgcgcgcaacgccaggagcagatagccaaggcctacctggatggcctggtgaacaacgctaccctgagcatcgacggcgcgttgctcggcaagaccctggcggaactgcactgatggacggcatcccggaggccaggcgtgggccgcgcgcgagccgctggcggcacctgcgcagctggctgttcggcgagcccgagcggttccgcgacgaacgccagcggctctggggcgcctatgccgcatggctcgacgagcaggtccagcagcgcctgggcgaagacgccgaaaccgcgccgcggctgctggccttcctggagtcgcggcgcgcggcggggcagttgccgaataccgacatcgacctgcgggtctggctcgatgaacgcggctggatcgtccgtctcgcctgcctgcgcagcgacgccgagccgatcgagaatgaactgcggcgcgcactgatggaccgttcgttgcgcctgccgccgccggaacacatgccgcagccgatcgaactgcggattcgcctcatgcctggacgctag

SEQ ID NO: 13228 - DNA, 996 bp, Pseudomonas aeruginosa
cgaggaagcatggccctatcggagtccgccgggcagcgcccggcactgctcaggcccgcgcagggacgcgacgaccgtgcctattggcacgagctgttcggttctctggaggtggtgcatttcttcctggtcaccgcccgttgcggctgtttcatgcaggctgcgcgcagcctggacgtcaagccgacgctgctgcgcaagaccctggcccggctcgaggagcgcctcggcctgcatctgttcgtgcatgagggcaacgccctctcgctgacccgcgagggccgcatcgtccaggccgccgggcagcgcctggtcgaggacagccagagccacgccgatcttcaccggcaacagccgctggtgcgcctggcggtggccgaaagcgtcctgcacgatgtgctcagtcgcgagctgtggggctacctgcgcaagaacgccaacctgcgcgtagccctcgccgagttgcgcgagggctggccggaaagcgcagggccggcggagatcgccatctggatcgccgatccggggcagccgcatccgccgatggaaggccacttcgccgcaccggcgcgcatcgctgagctggagtaccagccgcacatcggcaagcgctattcgcgcgagcgcacgcggccggccagcgaggacgagctggacgactacctgctggcgcagctccacggccaggccgccagcgccgccctggcaccctggaaccggcgggtggcggctcgccagtcgggagtgatcgaggtacagagccacgacctgctgctacaggcgatcctctggggcgcctgcatcggcctgctgccgcattacgccggacgcctggagcgcaacctggcggcgttgccgcaggtcttcgacgagccgatgcggcgggaagtctggatgagcgtgcagccggaagcggagaaccgcgtggaggtgcgtgccttgctcgatctgatcgagcacgccttcgacgatcggcgcgactggttcggacgctga

SEQ ID NO: 13229 - DNA, 831 bp, Pseudomonas aeruginosa
agggtaggccatcgggcccgagaaaaatcctcgacctccttcgtccaaccgtcaggccgtggcctggcgctgtttccagtgccggtacaaggcggggatatccccggcacacagcagtggcatggctgcctcgatatcggccagtggccagtcccaccaggccatttccagcaggttctggatatcgccatcggaaaagcgcttacgaatggtccgggccgggttaccgccgacgatggcatagggctcgacatcgccggtcaccagcgcgcggctgccgatgatggctccgtggccgacccgtacgccgggcatgaacatcgcctcggtaccgatccagacgtcatggccgatcagcgtgtcgcccgctggctgatagccgttcacggcgccggcgaaggcaggctcttcgtgcatgaagtggaaggggaaggtcgacgcccattcggcgcggtgtccctggttgccggccatgatgaaggcggcgccactgccgatcgagcagaaactgccgatgaccagcttgtccacgtcgtcgcggtccggcatcaggtagcgggcgcagtcgtcgaaggaatgcccgtgatagtagccggagtagtagctgtagcgccccacccgtatgttcgggttgctgacctgttccgagagcagcttgcccctgaaggggctctcgaaatagttgcccatgaccgtcgtccctgtccgtcgaaactgccaagggtagcgcctggcgggatagcgggccagcctggcgtgacggctggcagccgcgtcggcgttcagcaggccggactgctgaacggccaggcctggaaaggctccgaatag

SEQ ID NO: 13230 - DNA, 345 bp, Pseudomonas aeruginosa
catggacctcgcgatcgcttccaaccccatttcacgaggaaagattccatgacctaccacgtactggttcagttcgacgttccctccgacaagcgcgaagcgttcgccgcggcaggcctgttcgatgccaatggctcgttgcagaacgaaccgggcaccctgcgcttcgaggtgatccgcgacgagaacaaccgcaaccgcttctacctcgacgaggtgtacgaagacgaggcggcgttcctccagcattgccgcaacgaaaccatcgcgcgcttctacgaactgatcgacagctacgccttcggtccgcttttcctgttcaagggctaccgcatcgagggttga

SEQ ID NO: 13231 - DNA, 186 bp, Pseudomonas aeruginosa
aggagaatgctgatggtcatgcgattgttcgggctgctactggcggccttcctgatgagcggttgcagcgttcgggtgccgggcgcctacgtcgaactggatccgttcgacgatggctactacggctacgatcgcggcggcccgccccattgtcctccgggccacgccaagaaaggctggtgctga

SEQ ID NO: 13232 - DNA, 789 bp, Pseudomonas aeruginosa
gagtcccgcttcttctgcttctcgccagcctgggtggctgcgcggtgtatgactacgactacgatgacggcgattggcgccactatcgcggccagccctacggctacgcctacgaagtgccgcgctatcgcgtgtatgacgatggctggcgcagcgaacggcgctactactcgacgcgctactacgaccaacgctactacccggcgccacgccgctacgatggccaccgcgactaccggcgcgagcaatatcgctaccagcagcgctaccacgaatcgcgcccggcccatcgtggcgagcggcatccgggcaactggcagcgcggcggccagccgcaatggcgcgggcattctccgcaacgctggcaacaacacggtcggcaggatcgtccgggacaccagggccagcagggcgggacacctcgctggcgcaactgaggtgcgcaaggaaaggcggcgcctgcgggcgccgtcgtgctttccagtcgaaagtgcggaccctcttggcgcatttgctcggcacactctgccgataccgaaacgaggaggttcccatgagtcattttctgtcgttcgccaagggcgccctggcgatgttctggctcgtcgcgctggtcaacctggcctacccgctgggcgagttgcatcgaccgatcctgctgttgtccggcgtgctggtgctggtccatgccgccgagatcctgctgctcaacgggcgtctcaaggcgcgcccggcaccttggctggagcgccttcaggtgctgctgttcggcgtcctgcacctgcgtag

SEQ ID NO: 13233 - DNA, 321 bp, Pseudomonas aeruginosa
cctcggctgatttacccaggctttactctcgccgcgggcaccgcccgcgcgccgcgcagtccgatgtgcaggttccggaacaggcaatcctcccgcatccgcaggagaggccggaaccgcacaggaggcgccatgcgtcgtttgctttccctgctgatcctcgtcctgccgctgtcggcctgcgtggtctacgaccgcaacgaccaccggcatcgtcccgactaccgttacgagcgctatcacgaccgcgaccgtgacaaccgcgggcgcgactggaaccgttcctggcaggagcgccgcgacgacgctcgctggcgctga

SEQ ID NO: 13234 - DNA, 2088 bp, Pseudomonas aeruginosa
atcgctcatgcggactctgcatcgaatgtggacctggaatgcattggaattattgccgtgccgctcggcatagtgccagccgaagcccacaacaataaaacggagtatccgatgagccgtctgcttgcactcctggcgctcgccccgctgctcgccggcgccgccgaaaccaccgcgcccaaaccgcccagtgccttcaccgtcgaggcccagcggcgggtcgaagcggaattgcccttcgccgaccgcgccgacttcgagcgcgccgaccgcggcctgatccggcgcccggagcggttactcatccgcaaccccgacggcagcgtcgcctggcagctcggtggctacgacttcctcctcgacggcaagcctcgcgacagcatcaatcccagcctgcaacgccaggccctgctcaatctcaagtacggcttgttcgaggttgccgagggtatctaccaggtgcgcggcttcgacctggccaacatcaccttcatccgcggcgacagcggctggatcgtggtcgacaccctgaccaccccggccaccgccagggcggcctacgaactggtcagccgcgagctgggcgagaggccgatccgtacggtgatctacagccacgcccacgccgatcactttggaggcgtgcgcggtctggtagagccacagcaggtcgccagcggcgcggtgcagatcatcgctccggccggcttcatggaggcggcgatcaaggagaacgtcctggccggcaacgccatgatgcgccgcgccacctaccagtacggcacgcaactgcccaaggggccgcaggggcaggtcgacatggccatcggcaagggattggcgcgcggaccgctgagcctgctggcgccgacccgcctgatcgaaggcgagggcgaggacctggtgctggacggcgtgccgttcaccttccagaacacgccgggcaccgagtcgccggcggagatgaacatctggctgccgcggcagaaggccctgctgatggccgagaacgtggtcggtaccctgcacaacctgtacaccctgcgcggcgccgaggtacgtgatgcgctgggctggagcaagtacatcaaccaggcgctgcatcgtttcggcaggcaggccgaggtgatgttcgcggtgcacaactggccgcgctggggcaacgcggagatcgtcgaggtgctggagaagcagcgcgacctgtacggctacctgcacgaccagaccctgcacctggccaaccagggcgtgaccatcggccaggtgcacaaccgcctgcgcctgccgcccagcctcgaccaggaatggtacgaccgcggctaccacggctcggtcagccataacgcacgggccgtgctgaaccgctacctgggctactacgacggcaacccggcgaccctcgacccgctcagcccggaggactcggcgggccgctacgtggaatacatgggcggcgccgagcgcctgttggagcaagcgcgggcgtcgtacgccaggggcgaataccgttgggtggtcgaggtggtcaacaggctggtcttcgccgagccggataatcgggccgcgcgcgagctgcaggccgacgccctggagcaactcggctaccaggcggagaacgccggctggcgcaacagctacctcagcgccgcctacgaactgcgccacggcgtaccgcgcgaccagccgacgatgaaggccggcagcgccgatgccctggcggcgatggacaccggcctgctgttcgactatctcggcgtgcgcctggacgccggcgctgcggagggcaaggcgctgagcatcaacctgcgcctgccggacatcggtgagaactacctgctggaactgaagaactcgcacctgaacaacctgcgcggcgtgcagagcgaggacgccgggcagaccgtgagcatcgaccgcgccgatctcaaccggctgctgctcaaagaggtatcggcggtacgcctggtcttcgagggcaagctgaagagttccggcaatccgctgttgctggggcaactgttcggcatgctcggcgacttcgacttctggttcgatatcgtcacgccggcggcgaagtccgaaggctga

SEQ ID NO: 13235 - DNA, 2145 bp, Pseudomonas aeruginosa
aggtcaaggtgccggctgccgcgccggcagtaccgccggacaccggcgcgtctagcatcgccaggccgcgctcgcgggcggcggggtggacccttcgcgccgaggtccgggcgaaggtccagcattccagccaccagggtgccgggggcgatgtgcgcgagcaggccatcctcctcgaggtacaggccttcgacgtgctggctggccggcagcatgctgatgaacacgtcggcgccctgcaccgcgtcgcgggcgctgcgggcggcgctggcgccggcggcgaccaggccgtcgacggcgcttctgcaccaggtcgaagacgttcagcaggtagccggccttgagcaggttggtggccatcggcgcgcccatgtggccgaggccgatgaaggcgatctgtttcatggagctcctcctgtggcggccgcgaggcctcttggggatgctgtgaaacagcttagacgctatggacgtggcgggcccgcgccttccttcggcagagggcggcgcggcggatcagagccccgccagcggatgctcgccctcccaggtcggctcgaagtgcgcctcgatcaccgcctgcgggatcgattccacctgcggccaatgccagttcggtgcgttgtcgcgatcgatcagccttgcgcgtaccccctcggcgaagtccggatggcgcgtgcagttcaggctcatggcgtattccaggcggaacacctcggccagcgacaggtagcgcgcacgctcgatctgctgccagaccagatgcgcggtcatcgggcagccctcggccagggtcttcgcgccacgcgcaagcagcgggtcggcgtcgtcgcgcagcgccaccagcgcctgccaggcgctcgccaggtccggctggtcgagcagtgcgtccaggcgcggccggcgcgggagcaactgggcctccggcagttcgccgcgggcctcgtgttcgagggcgcgaagcaggctgtgaagttgcacctggggcgactcgttccagttcatctgcaccaggccggcgagcagggcgtcctgctggtcgtcgagaaggaagcggtcggccaggtcgaggtcgagagcgtcgcgggcgttcatctgcgccgcgctcaggccgaggaacaggccgagcctgccgggcaggcgggcgaggaaccagctggcgccgacgtctgggtacaggccgatgccgatctccggcatcgccaggcggctggacggggtgacgatgcgaatcccggcaccctgcatcagccccatgccgccacccatcacatagccgtgggcccagcagatgaagggtttcgggtaggtatggatgcggtagtcgaggcggtattcatcggcgaaggaagcgtcgcgccagggccggtacctcgccgggttgctcgcggcaggcgtccactagcttgcgcacgtcgccgccggcgcaaaaggccttggcgccgttgccgcgcaacagcacgcaggcgatgccggcgtcctcggcccaggcgtcgagtttcgccgccagggtctcgatcatcggcagggacagggcgttcagactcttttccgcatccagggtggcaatgccgatgcggaagccatgcaggctcgggcgttcttcgaaaagcacgttcatgtcggggctctcggctcgggcgggctgtggcgcagcccgccgggttcgatgggaaggctcagcagttgcgccacttgggatcgcgcttctcgaggaaggcgttgaccccttcgcgggtgtcctgggcgtcgaacagatcgacgaagcgctcgcgctcctccggcagccaggtgttcggcgcgcgttcgcgggcaccctggatcagcggcttgatggtgcggatcgccaccgggctctggcgtgccaccttggccgccagcagcagggcggcgccgcgcgcctcgccgctgtccaccacctgttcgaccaggccgatgcgcagggcggtttccgcatccacccgctcgttgcagaggatcatccgcttggcccagccttcgcccaccagccagggcagcgcctgggtcccgccggcgcagggcagcaggcccaccgcggcctccggcagggccatctgcgcctggcgctcggcgatgcggatgtcgcaggcgagggcgcactccagcccgccgcccatggcgtag

SEQ ID NO: 13236 - DNA, 978 bp, Pseudomonas aeruginosa
ccggccgcaagccgcctgtggattgacgatcttgcgcaagggatggacgatcttgggattcagactaccgagtcgcgccgccgtgaagcgttccgtacagacctccgcctggcccctgcccaaccagggggtgcgtttcatcacgccgccccgcctgcgtcgcgccctggcccgccatccgctcggccaggcctgctacccgctggccctcggttactatccggaggcgcatggccaccacatgcagcggcgcgcgccggacgacaacctgttgatctactgccgggccggacgcggctggctggagtgtgccggcgagcgcgtcgaggtcggcggcggcgacctgctggtcctgcccaagggccgggaacatgcctacggcgccgactcgcagcggccctggagcatctactgggtacatttcgaaggcggactggcggaggatttcctgcgtccgctgggcagcgccccgcgcctgcgcctgggcatgcagccacgcctgctggcggagttcgatgcgctgctggcgctgcgtcgccagggcctcagcctgccgcacttcatccatgccgcgcacctgttgcagggcctgctcacctcgctggcggtgcgtccggcgcgggccagcctgaaatccggacgggtgctggacatcgacgcggtgcaggcgctgatgcgcgcgcacctgcacgacagcctcaacctcgacgagctggcggcgcagttcaagctgtcgcgcttccatttcgccaagacctatcgcgccctgaccggccaggcgccgatccaggatttcatccagatgaagatggcccatgcctgccgcctgctcgacgagggcgcgctggaggtgcggcagatcgccgagcagctcggctacgccgatccctattacttctcgcggctgttccgcaaggtggtgggcatggcgcccagtcactaccgggcgctgcaccagggctagtgctccgggcataa

SEQ ID NO: 13237 - DNA, 864 bp, Pseudomonas aeruginosa
tgctgcatcctgcccgtgggccgagaccgacaaggatcgtcgatgcgcaaacccctatcgctctaccacccctggctctactggctgcgggtctggcaacgacgtctctggcggcactgccgctggcgtcttggcggccgtcgctacgtgcggttgccatcgatcgacgagcgcctgccgtaccgctacatcaagcacacctcgaagttgatccgccgcctcggcgacagcgacctcgccctgcaacgcaacaaggtggtcaacctgcgcctggcggtggactgcatgaacggcgtgagcatcggccccggcgagtacttctcgttctgccggctggtcggtcggcccagcgcccggcgtggcttcgtcgaaggtatggagttgtccttcggcgaggcgcgcagcggaatcggcggcggcatctgccaactgagcaacctgatccactggatggccctgcattccccgctgcgcgtggtggagcgggccaaccacagcttcgacccgtttcccgacgagggacggatcctgccgttcggctcgggcgcggcgatcttctacaacttcatcgacctggtgctgcacaatccgacggcggataccttccagctgcgcttccatatcgccgcccaccaactggaaggcgaactgctgtgcagcgcgccgcgccctgtgcgctaccacgtctatgagagggcccagcgctttgtccgcgacggcgatgcggtgctgaggctcaacgagatctggcgcgacatccgggaaaagggccaggccggcaccctgctggccagcgagtgcctgtaccgcaaccgggtgcgcgtgaagtatccggtggaagaggcccgcctgtcccgagattga

SEQ ID NO: 13238 - DNA, 738 bp, Pseudomonas aeruginosa
aaaaggccggacgactttttcagtaccgagacagggggttccatgaccgataacgacgaccgcatcaagctcgaggcgagttggaaggaagcgctgcgcgaggaattcgacaagccctacatgaagcaactgggcgagttcctgcgccaggagaaggccgccggcaaggtgatctttccgcccgggccattgatcttcaacgcgctgaacaccacgccgctggagaacgtcaaggtggtgatcatcggccaggatccctaccacggaccaggccaggcccacggcctgtgcttctcggtgcagcccggcgtgccgacgccgccgtccttgcagaacatctacaaggaactcaaccgcgacctgaacatcccgattcccaacaacggctacctgcagcgctgggcggagcagggcgtgctgttgctcaatacctccctgaccgtcgagcaggccaaggccggctcccacgccaatgccggctggcagccgttcaccgaccgcgtcatcgaggtggtcaacgagcgttgcgagcgcctggtgttcctgctctggggcagccacgcgcagagcaagcagaagctgatcgacccgcagcgccacctgattctcaagtcggcgcacccgtcgccgttgtcggcctaccgcggtttcctcggcaacggccacttcagccgcaccaacaagttcctcgagcagaacggcaagacgcctatcgactggtcgctgccggacctctga

SEQ ID NO: 13239 - DNA, 786 bp, Pseudomonas aeruginosa
gacgccaagctttcgccaggctttcagcaatccccggtggcagagaagccatttaccggagggttttccccggtacacttcgcctcttgtgccctcatccggtggtggagaaccgtccatgcgcatccttctggtggaagatcatccgcagctcgccgaaagcgtggtccaggcgctcaagggcgccggctggacggtagacctgctgcaggacggggtggccgccgacctggctctggccagcgaggagtacgccctggcgatcctcgacgtcggcctgccgcggatggacggcttcgaggtgctggcgcgcctgcgcgggcgcggcaagaccctgccggtgctgatgctgactgcgcgcggcgaggtgaaggaccgggtgcacggcctcaatctcggcgccgacgactacctggcaaagcctttcgaactgtccgagctggaggcgcgggtcaaggccctgctgcgccgcagcgtgctcggtggcgaacagttgcagcgctgcggcgccctggtctacgacctcggcacccggcgcttcagcctcgacgagcagccgctgaccctgacctcgcgggaacaggcggtgctggaagcgatgatcgcccgtccggggcgggtgatgagcaaggagcaactggccgcccaggtcttcggcctggacgaggaggccagcgccgacgccatcgagatctacgtccaccgcctgcgcaagaagctggaaggcggcgccgtgcgcatagtcaccttccgcggcctcggctacctgctggaggcgctgggtga

SEQ ID NO: 13240 - DNA, 1224 bp, Pseudomonas aeruginosa
tcctcagggtgctggagggaggcgtgctggaagtggaagacgatggtccgggaattcccgccgccgaccgcgagcgggtcttccagcgcttctaccggcgcggcgacagccccggcagcggcctggggctggcgatcgtcggcgaggtctgccgggcgcaccgggcgcagatccagctcgaccagggcgaactgggcggcttgctggtgcgggtgcgcttcccggtggagtagggcgggcctattgcagcatgctggtggcggcttccagggcgctggagaggtcctcgtcttccttcatgtcgacggtcggctcgaggccgagcttggcgaacgccgggatctggctccagtccaggcgggtatagggatgctcgctgccaaggtagctctgcagggtggcgacctggaccaggtcggtatagtccgcgcgcggcgagttgcgggcgaagtccaggtgctggcgcgggacctcggcgatcggcgcggggaaatcccaggccttgagaatgcgctcgccgatcagcggatggatgcgctcgatcacatggctcaggctgatggagtccgacagcagctcgttgtgatcctcggcgtaggtgaggatcggcagcacgccgatctggtgcaccagtccggccagggtcgcctggtccggcgccaggcgggtgtagtgacgggccagcacgtggcagatgccggcgatctcggtgctcttgttccagacttcgcgcatcttgcgatcgaccacgtcggtggtggcctggaacatctgctccatggccaggccggtggccaggttgcaggtgtagttgatgcccagccggctgatcgccatctgcaggtcggtgatttccttcgggctgcgcagcagcggactgttcaccacgcggatgatgcgcgcggtcagcgccgcgtcgttgccgatcaccttgctcagggcctggatgctgacatccgggtcttccgccgcctcacggacctgcagggccacctcgggcagggtcggcagcaccagttcatcctgatcgatggcgcggatcaggtcctgttggactttgtcggcaagcttgctcatggcatttcctttgaaaacgcaatggccggagcacgctctacgtgcaccggccatgggaatactggcgggccgtccgcggacggcgaggcacagtttacggtcagcgctggatttcgcggtcgctgtccagcgtgtaaggcagattga

SEQ ID NO: 13241 - DNA, 408 bp, Pseudomonas aeruginosa
cgccgaacacctggccgatgcctgcgcgcacctggccgagcagccaatcgtcgagcggcgcctcgcggctgtgctcgcggagcgtggcaagcaccgcctcggcgcgttgcgccggaacccatagctcgacgcgggcgtcgcccagggcgacggcgagcaggtcgccgtggcgggcgatcctgccgctctccgccggggtgtctatccccagggcgcgcagtgcctcgctggcgtcgcgcaagcctatgcggagccaggctgcgctctcgtcggcaaggctggccttggagaatacggcgtatttcttcaggtccgccaactgggcctcgagcagctcgccggccatcgccagcagcaggccgtcgccctcgggcaggatgcggaagctcgatagcaggcggcccttga

SEQ ID NO: 13242 - DNA, 282 bp, Pseudomonas aeruginosa
tgccgggcgttttcgaggagcccgaacatggcagatgaaaccgaactgaaacgactctactggcacagccgtcgcggcatgctggaactggatgtgctgctggtgcctttcgtgcaggaggtttacccgggcctggacgccgaggaccaggcgcgcttccgcaagctgctggagtgcgaggaccaggacatgttcggttggttcatgcagcgcggcgagccggaagacgccgacctgcggcggatggtgcggatgatcctggaccgtgtccagccggattga

SEQ ID NO: 13243 - DNA, 708 bp, Pseudomonas aeruginosa
tgcagtgtccggtggggacggtacggtcgcggatcttccgcgctcgtgaagcaatcgacaaagctctgcagcctttgttgcgagaagcctgacacagcggcaaatgccaagagaggtatcgctatgagtcgtgaagccctgcacgaaactctgtccgctgtgatggataacgaagcggatgaactcgagttgcggcgggtgctcgcagcttgcggcgaggatgccgagctgcgttccacctggtcgcgttaccagctggcgcggtccgtcatgcaccgtgagcctaccctgccgaagctggatatcgctgcggcggtctctgctgccctggccgacgaggccgctccgccgaaagcggagaagggaccgtggcggatggtcggtcgcctggcggtcgctgcctcggtgaccctggcggtgctggccggcgtgcgtctgtacaaccagaacgacgccctgccgcagatggcgcaacaggggaccaccccgcagatcgccctgcctcaggtgaaaggcccggccgtgctggccggctacagcgaagagcagggggcgccgcaggtgatcaccaactcctcgtccagcgatacccgctggcatgagcagcgtctgccgatctacctgcgtcagcacgtgcaacaatccgccgtcagtggtacagagagcgcgctgccctacgctcgggcagccagcctggaaaaccgctga

SEQ ID NO: 13244 - DNA, 489 bp, Pseudomonas aeruginosa
tccagcctcgcagccggtggttctgcgagcgctgatttccgggccgtccgattcggcctgagtctttctcttccctcgaacatcacgggagctgtagtcgatgcataccctaaaacgctgtatggctgcgatggtggccttgctggccttgagcctggcgatgacggcccgggcagaactgccggacttcacgcctttggtcgaacaggcgtcgccggcggtggtgaatatcagtacgcggcagaagctgccggatcgcgccatggcgcgcgggcagctgtctatccccgacctcgaagggctgccgccgatgttccgcgacttcctcgaacgcagcatcccgcaggttccgcgcaatccgcgcggccagcagcgcgaggcgcaatcgctgggttccggcttcatcatctccaacgacggctacatcctcaccaacaatcacgtcgtggccgatgccgacgagatcctggtgcgcctgtccgaccgtag

SEQ ID NO: 13245 - DNA, 846 bp, Pseudomonas aeruginosa
ctccggcggtccgctgctgaacctgcagggcgaagtggtcggcatcaactcgcagatcttcacccgttccggcggcttcatgggcctgtccttcgccattccgatcgatgtcgcgctgaacgtcgccgaccagttgaagaaagccggcaaggtcagtcgcggctggctgggcgtggtgatccaggaagtgaacaaggatctcgccgagtccttcggcctcgacaagccgtccggcgcgctggtggcgcaactggtggaagacggcccggcggccaagggtggcctgcaggtgggcgatgtgatcctcagcctgaacggccagtcgatcaacgagtccgccgacctgccgcacctggtgggcaacatgaagccgggcgacaagatcaacctggacgtgattcgcaacggccagcgcaagtccctgagcatggcggtaggcagccttccggacgacgacgaggaaatcgcctcgatgggcgctccgggcgccgagcgcagcagcaaccgcctgggcgtgaccgtcgccgacctgaccgccgagcagcgcaagagcctggatatccagggcggcgtggtgatcaaggaagtccaggacggtccggccgcggtcatcggcctgcgtccgggcgatgtcatcacccacctggacaacaaggcggtgacctcgaccaaggtcttcgccgacgtggccaaggccctgccgaagaaccgttcggtttcgatgcgggtgctgcgccagggacgcgccagcttcattaccttcaagctggccgaataagccggctggcgaaaaaagggcggtttccaccgccctttttcatgcccgtcaatccgttacctgcgtga

SEQ ID NO: 13246 - DNA, 1803 bp, Pseudomonas aeruginosa
gccgtgagcgacctgagccatatccgcaatttctccatcattgcccatatcgaccatggcaagtcgacgctggccgatcgcttcatccagatgtgcggcggcctctccgatcgcgaaatggaggcccaggtcctggactccatggacctggagcgcgagcgcgggatcaccatcaaggcccacagcgtgaccctgcactacaaggcgcaggacggtaagacctaccagctcaacttcatcgatacccccggccacgtcgacttcacctacgaagtcagccgctcgctggccgcctgcgagggcgcgctgctggtagtggacgccggccagggcgtcgaggcgcagtccgtcgccaactgctacaccgccatcgagcaggggctggaagtgatgcccgtgctgaacaagatggacctgccccaggccgagccggagcgggtgaaagaggaaatcgagagcatcatcggcatcgacgccaccgacgccgtggcctgcagcgccaagagcgggatgggcgtgctggaggtgctggagcgcctggtgaccgccatccccgccccggaaggcgagatcgaggcgccgctgcaggcgctgatcatcgactcctggttcgacaactaccttggcgtggtctcgctggtacgggtgaagaacggccgggtgaagaagggcgacaagatcctggtgaagtccaccggcaaggtccaccaggtggacagcgtcggggtattcactccgaagcacaccgagaccgtcgacctgaaggcgggcgaggtgggcttcatcatcgccggtatcaaggatatccacggcgcgccggtgggcgatacgctgaccctgaacaacacgccggacgtcgaggtcctgccgggcttcaagcgggtcaagccgcaggtctacgcgggcctgttcccggtcagctcggacgatttcgaggacttccgcgacgccctgcagaaactgaccctcaacgactcgtcgctgcaatacgagccggaaagctccgaagccctgggcttcggcttccgttgcggcttcctcggcatgctgcacatggagatcatccaggagcgcctggagcgcgaatacgacctggacctgatcaccaccgcgcccacggtggtcttcgagatcgtgcagaagaatggcgagatcatctacgtcgacaacccgtccaagctcccggacctggcgtcgatccaggaaatgcgcgaaccgatctgccgcgccaccatcctggtgcccaaggaccacctgggcaacgtgatcaccctgtgcatcgagaagcgcggcgtgcagcgcgacatgcacttcctcagcggccaggtgcaggtggtctacgacctgccgatgaacgaggtggtgctcgacttcttcgatcgcctcaagtccaccagccgcggctatgcttccctggactacagcttcgatcgtttcgagccgtccaacctggttcgtctcgacgtgctgatcaatggcgagaaggtcgacgccctcgccctgatcgtccaccgcgacaacgccccctacaagggccgccagctggtggagaaaatgaaggaactgatcccgcggcagatgttcgacgtggcgatccaggcagccatcggtgggcagatcatcgcccgctcgacggtcaaggcgctcaggaagaacgtgctggccaagtgttacggtggcgacgtgagccgtaaacgcaagctgctggagaagcagaaggctggtaagaaaaggatgaagcaggtcggtagcgtggaaattccccaggaagccttcctcgccgtgctcaaagtggatagctag

SEQ ID NO: 13247 - DNA, 453 bp, Pseudomonas aeruginosa
tcctggtggagcgcgaggggcagaagaagatcatcatcggcgacaagggcgagcggatcaaaagcatcggccagaacgcgcgcaaggacatggaagtactgttcgactccaaggtcatgctcaacctctgggtcaaggtcaagggcggctggtccgacgacgagcgtgccctgcgctcgctgggctacggcgacctctgaccgttcccggcagcccggcgccagccgggcgccattcctctcgcgcccggtcgacccgccatgtccttcgccgccgcccaagccacctacgtgctgcatagccggccgtacaaggaaaccagcgccctggtggacttcttcaccccgttgggtcgcctgcgcgcggtcctgcgcggcgcccgcggcaaggccggcgccctggcgcggccattcgtgccgctggaagcggagtggcgcgggcgcggcgaactga

SEQ ID NO: 13248 - DNA, 765 bp, Pseudomonas aeruginosa
accgtaaggagtcaccccgtgactgaagccactcgaattctgctcggcgtgaacatcgatcacgtcgccaccctgcgccaggcccggggcacccgctatccggatccggtgaaggccgccctggacgccgaggaagccggcgccgacggtatcaccgtgcacctgcgcgaggaccgccggcatatccaggaacgcgacgtgcgggtgctcaaggaagtgctgcagacgcggatgaacttcgagatgggggtcaccgaggaaatgctcgccttcgccgaggagatccggccggcgcatagctgcctggtccccgagcgccgcgaggaactgaccaccgagggcggcctcgacgtcgccggccaggaacagcgcatccgcgacgcggtgcgacgcctggctgcggtgggcagcgaagtgtcgctgttcatcgatcccgatccgcggcagatcgaggcctccgcccgggtcggcgcgccggctatcgaactgcataccggtcgctacgccgacgccgaagaccccgaggagcaggcccgtgagctgcagcgggtacgcgagggcgtggccctcgggcgttccctcggcctgatcgtcaacgccgggcatggcctgcactaccacaatgtcgagccggtcgcggccatcgacggcatcaacgagctgaacatcggccacgccatcgtcgcccacgccctcttcgtcggcttcaggcaggcggtggccgagatgaaagcgctgatgctggccgcggcgaccaagcgctga

SEQ ID NO: 13249 - DNA, 2607 bp, Pseudomonas aeruginosa
  unsure (2532): Identity of nucleotide at the above locations are unknown.
ccaccggcttctgttgcccggcgcagccggccaggaccacgatggacaatggcagcagcagacgggagggggaaaaggacatgcagcgctcctcggctcgaatggaaagggcgccagcataaaccctgctggcgcccgagtgccaaggttggcgcggcggacggccgaaccggtcggccatccgccgccggctcaggccgggaacagcaccttggccacgtcgccgtagcgcttggcgaaatgcacggtcagcccttccctgagatagtcgggcaactcttcgaagtggccgcggttggcttccggcaggatcagctcgaagatcttctgccggcgcgcggcgatcaccttctcgcggaccccgccgatgggcaggacctggccggtcagggtcagttcgccggtcatcgccacgcctttcttcggcacctggttgcgcgccagggagagcagggcgctggccatggtgacgccggcgctgggaccgtccttgggcgtggcaccttccggcacgtgcaggtggacgaacgcctggtcgaagaaggtcgggtcgccgccatacttcttcaggtgcgagccgatgtagctataggcgatctcggcggattccttcatcacgtcgccgagctggccggtgagcttgaagccacggttcagcgtgtggatgcgggtcgcctcgatcggcagggtggcgccgcccatgctggtccaggccagcccggtgatcacgccgatcccggaaagcacctgctcgctgcggaacaccggcatgccgaggtagtcctcgaggtccctgggaccgatcttcaccttcgactcgggatcctccagcagtttgaccaccgacttgcgcaccagcttgccgagctgtttctccaactggcgcaccccggcttcccgcgcatagccctcgatcaccgcgcgcagcgcggcatcgctgatgctcaggcggcccttgggtacgccggccttttccaactgcttgggccacaggtggcgcttggcgatggccagtttttcctcggagatgtagccggacaggcggatcacttccatccggtcgaggagcggtccggggatcgagtcgagggtgttggcggtgcagacgaacagcaccttggacaggtccaggcgcaggtccaggtagtggtcgaggaattcgacgttctgctccgggtcgagggtttccagcagcgccgaggccgggtcgccctggtagctggcgccgagcttgtcgatctcgtcgagcatgatcaccgggttcatcacctcgacttccttcaatgcctgcaccagcttgccgggcagggcgccgatgtaggtgcggcggtggcccttgatctccgcctcgtcgcgcatgccgccgacgctgaaacggtagaacggccggccgaggctctcggcgatggatttgccgatgctggtcttgcccactcccggcgggccgaccaggagcacgatggagccggcgatctcgcccttgaaactacccacggcgaggaactcgaggatgcgatccttgatgtcgtcgaggcccgcgtgatgcttgtcgaggaccttgcgcgcatgcttgaggtcgagcttgtccttgccgtacacgccccagggcagggctgtggcccagtccaggtagttgcgggtgacggcgtactcgggcgagccgctctcgaggatcgacagcttgttcagctcttcgtcgatacgcttgcgcgcctgctcgggcagcaccttgccttccaggcgggcgcggaattcgtcggcgtcggcgctcttgtcgtccttggtgatgcccagctcctgctggatgatcttcaactgttccttgaggaagaattcgcgctggtgttcgccgatcttgcggttgacctcggcggacagttccttctgcaggcgcgcgacttccacttccttgcgcagcagcggcaagaccttctccatccgcttgaggatcggcacggtgtccagcacttcctgcagttcgccgccgggcgcggtggtcagggccgcggcgaagtcggtgagtggcgacgggtcgttgggactgaagcggttcaggtagttcttcagttcctcgctgtacagcggattgagcggcagcagctccttgatcgcgttgatcagggccatgccgtaggccttcacttcgtcactgggatcgatcggggtcttcggatagtccacctccaccatgaacggcggacgatggcgcttgatccagccccggatacgcacccgcgacaggccctgggcgacgaactgcagcttgccgccctcgcgcgaggcatggtgcacccggaccagcgtgccgtgctcgggcaggctgttgacgtcgaagtggcgcgggtcttccggaggattgtccatgaagaacagggccagcgaatggtggtcggtcttggccaccagttcgagggtttccgcccagggttcttggttgacgatcaccggcagcacctgcgccgggaagaacgggcggttgtggatcgggatcacgtagagggtggtcggcagggtctggccgggcagcaccangccggtgccggcgggctgcgcgtcgctgatgtgttcgggattaacgtcctggtcgctcatgaggcacctgactga

SEQ ID NO: 13250 - DNA, 840 bp, Pseudomonas aeruginosa
gcagttgccgttcatgttcgacacccgcctcatccgtctgcccgaccagtcgcacacccacgcccacgagcatcaccaactggtgatgtcgctggccgggcgcgccgaattcgaggtcaacggctgtggtggggaagtctgccggatgcgcgcctgcctggtgccgggcgaggcgggccacgtgttcgccggggtgggcgacaaccgcatgctgatcatcgacctgggcgaggacaacccgaccccggaagaccccgacctgctcgcgcgcctgttcgaggcgccgcgctacccgaccctggacgccgacttccagaacctgctcagctacgccggcgccgaactggcccgctacggcagcgacccgctgctgacccgtgccctcggcggagtgctgatccgcgccctgcacctgcgcctgttcggcgagcagcagcccctggcggccagcgggccgctcgacctggagcgcctggacgcgcatatcgtgcggaacctggcgcggcgcatcacggtcgccgaactggcccaggtcgcctgtctcagcccgagccatttccacgcgcagttcaaggacagcgtcggcctgaccccgcaccagtacctgctcaaggtccgcctcgactgcgccgcgcggttgctgcgggaaagccgcctgcctctggtgcggatcgccgaggaatgcggattctccagccagagcgcgctgaccacggcgatgcgccgctacctggggctgacgccgaagtcgctgcgcaagggctgagcgccatccgccaccttcggcggataaccgcaggcggttattcgccctaccggcaggagtccatatacggataa

SEQ ID NO: 13251 - DNA, 3906 bp, Pseudomonas aeruginosa
gtggaggacaccccgggcaggccgttgagggtttcgccgaggctgcctttctgtcgcagggtcagctcgtcgccttcgagcacgctgctgggcgtggcgggagattcgttgcccagcgggttggcggtgatcacctgggagggcaattcgctggggcggccgtcggcgccgagcgtttcccccgaaacgatcaggcaggccagcgccagtggcgtgagaggccagagcggacgggaagggaaaaggccggaagaggacattgcgggctccatggtcatgggtcggacttttttcaggccaaagcgaacccaggcccttcccggaggaagggcgacggggtcggatcggcgtatttattgggatgttatattatttctttttgtgtcggtagacccgcgtagccactctgcatggcgtcgtgccgacgtgcagcggcaatgtccgcatgcctgccggcgaagaggaacgggaaagttccgcagccaggagttttccgcaaaaactccagagtctttcgcaagaatcgcccctctcgcagccactacattccgctatccgctggtgcctcgcgccggcggaatgggcctgacccatactgatccgtattcccgcgccacaggatgtgccgcgccgccggcacaacccgccggcggcggtgccccgggcaatggacgcctggccggacttctttcaataacaatggctccacaagaggagggcgtgatgttcaaagccagtcacgtcttgcagggcgaggaccagacccggtccgcagccgaattcttccctgtcatcagcgccaactacgcggtcgacgaggaagcctacctgggcgaactgctgcagctcgccgaccccggtcccgacggcatcgaggctatccgccgcaacgcccgcgcactgatcgaaaccgtgcgcagccgggacaacgccgtcgataccctcgacgcactcctgcgccaatacagcctggacacccaggaaggcctgatgctgatgtgtctggccgaggcgctgttgcgtgtgcctgacgcggcgaccgccgacgcgctgatccgcgacaagctgtccgccgccgactggcagcgccatctcggccagagcgacaacgttctggtcaatttcgccgcctggggcctggtgatgaccggcaaggtggtgaacatcgacgaacgcaccgacggccgcgccccgagcgtcatcagccggctggtgcagcgctctggcgaaccggtgatccgcgccgcgatgaacccggcgatgaagctgatgggcaagcagttcgtgcttggccggaccatctccgaagcgctgaagaacggtcgtccatgccgcgagcagggctacacctattccttcgacatgctcggcgaggccgcgctgaccgccgccgacgccgagaaatgcttggccgactaccgccaggccatcgacaccgtcggcgccgagccgcaggtcggtccggggccgcggccgtcgatctcgatcaagctctcggcggagcatccgcgctacgaagtggcgcaacgcgagcgggtgctcagcgagctgttcgccaatgtcctggaactggcggtgcgcgcgcgcaagctgaacgtcggcatcaccatcgacgccgaggaagccgatcgcctggagctgtccctcgaactctacgagaagctgatgcgcgacccggccatcgccggctggggcgagttcggcctggtcatccaggcctactccaagcgctgcctgccggtgctggtatggctgaccctgctcggccgcgagcttggcgcacgcatcccgctgcgcctggtgaagggtgcctactgggacagcgagatcaagcagtgccaggtgcagggcgccgatggctaccccgtctacacccgcaaggaaggcaccgacacttcctacctggcctgcgcccgctacctgctcagcgagcacacccgcggggtgatctacccgcagttcgccagccacaacgcccacaccgtgaccgccatcctcgccctggccgacgaagccagggccgccggcggcgaggagcgcgacttcgagttccagcgcctgcacggcatgggcgacgcgctgtacgacacggtgatcgagaagtaccgccgcaacgtgcgcatctacgccccggtcggcgcgcacaaggacctgctgccgtacctggtccgccgcctgctggagaacggcgccaactcttccttcgtgcacaagctggtggacccgcgcgtgccggtggagacgctgatccagcacccggttacccaactgcgccagttcaagacgctggccaacgaccgtatccctctgccccaggcgatcttcggcgccgggcggaaaaactcccagggcatcaacatgaacatccagaaccagtggaacgagctggagctcgcctacaagccacacctgacccgccagtggcaagccgcgccgatcgtcaacggcgagaagctctccggcccggcccacgaagtgcgttgcccgtacgacctggagaggctggtcggcagcgtccagtacgcgtccgccgagcaggccggcaaggccctcgacgtgttgcaggcggcctggccgcgctggagcgccaccccggtggacgagcgtgccggcatcctcgagcgtctcgccgacctgctggaagcccagcgcggcgagctgatggcgctgtgcaccctggaagccggcaagtcgttgcaggacggtatcgacgagatccgcgaggcggtcgacttctgccgctactacgcccagcaggcccgccagcgcctggtccgcgaggaactgcgtggcccgaccggcgagcgcaacgagctgttctacgaaggccgcggcatcttcgcctgcgtcagcccgtggaacttcccgctggcgatcttcctcggccagatcagcgccgcgctggtggccggcaacactgtgctggccaagccggccgagcagaccagcctgatcgccgcgcgcaccgtcgaactgatgttcgaagccggcctgccgaaggacgttatcgccctgctgccgggcgacggcgccactctcggcggcgtgttctgccgtgacgcgcgggtcgccggggtggccttcaccggctccaccgacaccgcccgcatcatcaaccgccaactggccgagaagcccggcgccatcgccaccctgatcgccgagaccggcgggcagaacgcgatgatcgtcgattccaccgctttgccggaacaggtgatcaaggatgcggtacaatccgcgttcaccagcgccggccagcgctgctccgcgctgcgcgtgatgtacgtgcagcaggacatcgccgagcgggtgatcgagttgctcaagggcgccatggccgagctgaaggtcggcccgaccgacgtgcgcgtcagcgacgtcggcccggtgatcgacgccgaggccaaggccggcctggagcagcacatcgccgcgctgaaggccgccggcaagctgatcgccgagaccaaggtgccgggcaacctgaacggtcacttcgtcgctcccgtcgcgttcgagatcagcggcatcgacgagctgaagaaagagaacttcggcccggtgctgcacgtggtgcgttatgccgcgcaggacctggaaaaggtcgtgcaggcgatcaacgccaccggtttcggcctgaccatgggggtccatagccgcaacgaggaaaccgcccgtcgcatcgaagagctggcgcgggtcggcaacctctacatcaaccgcaaccagatcggcgcggtggtgggcgtgcaaccgttcggcggccacggcctgtccggcaccggtcccaaggccggcgggccgaactacctgctgcgtttcgtcagcgagcgcaccacgtcggtgaacaccaccgcggtgggcggcaacgcgtcgctgctgtcgctggccgacgccgagtga

SEQ ID NO: 13252 - DNA, 378 bp, Pseudomonas aeruginosa
aagcggccgagacgcggcaccagccagagggcggcgaaggccggggtggtggagaccgtcaggttgcctacgctgcgctgcggacgcagcgtgtcgacgctctgcgaaatttccagcagggccccgtgcaggctgcggaacagccgttcgccgcagtcggtcaggcgcactttccgtggcaggcgctggaacagcggaacgccgagccaggcttccagcgaacggatctggtgggaaaccgcggttggcgttaccgcaagctcctcggcggcggccttgaagctcgactggcgggccgccgattcgaaggtgcgcaacgcggtcagcggcagggaagcgaacattggaatctccatgggtgaactgaattcaccctga

SEQ ID NO: 13253 - DNA, 1248 bp, Pseudomonas aeruginosa
tcgtcgccggggtggccgggctcaagtaagcgatgcggcatttggcctacaatcggccgcgtttccgttccttcgagagcagccatgctgaccaccctggcggtgtccaactaccgcaccctgcgcgacctggtgatgccgctgcggcgcctgaacctgatcaccggcgccaacggcgccggcaagtccaacgtctaccgggccttgcgcctgctggcggacagcgcgcgcggcgaagtgatcccgtcgctggcgcgcgagggcggcctgccatcgaccctgtgggcgggaccggaggacatcagccgggccatgcgcagtggcgcccagccgatcgaaggcagcgtgcgccggcagtcggtgaacctgcgcctgggcttcgccggggaggatttcggttattgcatcgacctcggcctgccggagccaagccagagcaagttcggtctcgacccggtgatcaagcgcgaatgcatctgggccggcccgttcctgcgcccggccaatgtcctcgtcgaccgtcgcgggccgttgttgcgcgcacgcggcggcggcggtcgctgggaagtggcggcgcagcacctcgccaccttcgacagcatgctgggcgcggcggtggacccgcgacaggtgccggaactgctcggcctgcgcgagcggatccgctcctggcgcttctacgaccatttccgcagcgacgccgaggcgccggcgcggtgtccgcagatcggcacccatacaccggtgctgggcgccgacggcgccgacctggccgcggccctgcagaccatccgcgagatcggcgatgcggcggcgctggacgaggcggtggacgatgcctttcccggcagccgcctgcacattgacaacccgggagggcgcttcgaagtgctgatcgagcagcccggcctgctgcggccgctgcgcaccgcggagctgtcggacggcaccctgcgatacctgctgtggatcgccgccctgttgtcgccgcggccgccggcgctgctggtgctcaacgaaccggaaaccagcctgcatcccgacctgctgccggccctcgggcgcctggtcggccaggccgcgcagcactcccaggtgctggtggtgtcgcacgccgcgcggcttgtcgcgacgctcgaagagcacccggaatgccattcgctggggctggagaaggacttcggcgagacccgcatccaggggctgcgcgagctggaccggccggcctggtactggccggtgcgctga

SEQ ID NO: 13254 - DNA, 1434 bp, Pseudomonas aeruginosa
caaaatgaggttgttcccatgtcgtctgtcggcgaacagaaggttcaagacggctccctgaagcgcgagctcggtgagcgacacatccgcctgatggcgctcggcgcctgtatcggcgtcggcctgttcctgggctcggcgaaggccatccagatggccggcccggccatcatgatctcctacatcctcggcggcctggcgatcctggtgatcatgcgcgccctcggcgagatggcggtacacaatccggtggccggttccttcagccagtacgccaaggactacctgggcccgctggcgggcttcatcaccggctggaactactggttcctctggctggtgacctgtgtcgccgaaatcaccgccgtcgccgtctacatgggtatctggttccccgacgtgccgcgctggatctgggccctggcggccctggcgagcatgggcacgatcaacctcatcgcggtgcgtgccttcggcgagttcgagttctggttcgccctgatcaagatcttcaccatcctggcgatggtggtggtcggcatcggcatgatcgccttcggcttcggcaacgacggcatcgccaccggcatctccaacctctgggcccacggcggcttcatgcccaatggcatccagggcgtgctgatgtcgctgcagatggtgatgttcgcctacctcggggtggaaatgatcggcctcaccgccggcgaagcgcgtaacccgaccaagaccattcccagcgcgatcaactcggtgttctggcgcatcctgctgttctatgtcggctcgctgttcgtgatcatgtcgctctatccgtggaacgagatcggcacccagggcagccccttcgtgatgaccttcgagcgcatgggcatcaagaccgccgccgggatcatcaacttcgtggtgatcaccgccgcgctgtcgtcctgcaatggcggcatcttcagtaccgggcgcatgctctacagcctggcccagcatcgccaggccccggccttcttcggcaaggcctcgcgcagcggcgtaccgcgccgggcgctgatcctgtcgatcctggcgctgctgctgggcgtgttgctgaactacctggtgccggagaaggtattcgtctgggtgacttccatcgccaccttcggcgcgatctggacctgggcgatgatcctgctggcccagttgcgcttccgcaagacgctcagcccggccgagtgcgacaagctgcaataccgcatgtggctgtacccggtcagttcctacctggcgctggcgttcctggtgatggtggtggtgctgatggccttcttcgaggacacccgcatcgccctctacatcggcccgccgttcatcctgctgctgaccgtcctgtactacgccttcaacctggcgccgaaggagcctgccggcaccggctcggtaagccgcgcggcgtcctga

SEQ ID NO: 13255 - DNA, 858 bp, Pseudomonas aeruginosa
gcgtcccggggctggcccgcttcgcgaggttggccaatactattcgcgtttcggccagatgcttcgaccatgcgcaacgcttccatcgagcagtacgacgccacgccccgggccgtggtggccatgggtaccgactatcccgacggctacctgctgccgcgccatcggcatcgtcgcgcgcaattgctgtacggtgccagcggggtgatgcaggtgcgtaccggcgacgccggctgggtggtgccgccacagcgcgcagtgtggattccgccgggcgtcgagcacgaggtgcgaatgctcggggtgagcacccgcagcctgtacatcgagcccggcagcgccatggcgatgccggcgcactgccaggtgctggcggtgtcgccgctgctgcggcaactgttgctggcggcggtggacatgcccctagaatacgacaccgaaggtcgcgacggcgcgttggcgacgctgttgctccatgagctggcggcggccgagacgctgccgctgcacgtgcccttgccgcccgagccgcgctggctggcgctctgcgaggcgttcctcgtcgagcccgacatccgcgccagcgccgaacgctgggccgggttgctgcataccagcctgcgcagtttcaaccgcaccttccgtcgctacaccggcctcagcttcggtgcctggaagcaacgcgcctgcgtggtgcaggcactggcgcggctggccggcggcgaaacggtcaccgccatcgccctggactgcggctaccagagcccggcagccttctcgaccatgttccgccgggtcctcggccagccgcccagcgcctttcaggcgggcgcgctcagatcgccaggaggtccatga

SEQ ID NO: 13256 - DNA, 432 bp, Pseudomonas aeruginosa
gccaccacgccgaagccgagggcttccaggtgcggcagcaggccggcttcgcgcaggtattcggtgaccaccttggagccgggtgccagcgaggtcttcacccatggcttgcggaccaggccgaggcggtcggcgttgcgcgccagcaggccggcggcgatcacgttgcgcgggttgctggtgttggtgcaactggtgatcgcggcgatgatcaccgcgccgtccggcatcaggccctcggcttcctcggcgcgggcccgctcgaggttgccggcgatgcctttcgccgccagttcgctggtggcgaccctggcgtgcggattggacgggccggccatgttgcgcaccacgctggacaggtcgaacttcagtacccgctcgtactcggcgtcgaccaggctgtcggcccagagtccggcggtgcgcgcatag

SEQ ID NO: 13257 - DNA, 1320 bp, Pseudomonas aeruginosa
tccaggcgggtgccggggagcggtttgcggtgtgcgctgttcatggctcggactcaatcacggggtgttcggaagcgtgtcgctcgcgccgtggcgcagcccacgccggcctttcgaattctgggtgcggcaaccgtccggcgcgctcgcgttcggcgcgccggacggcgtggatcagcgttgctccagcggcacgaacgcgcgctgctcgacgccggtgtactcggcgctcgggcggatgatgcggttgttggcgcgctgttcgaagacgtgggcggtccagccgctggtccgcgagcagacgaagatcggcgtgaacagcttggtcgggatgcccatgaagtgatacgccgaggcgtggtagaagtcggcgttggggaacagcttcttctgctcccacatggtcttgtcgatggcctcggaaaccgcgaacaggaccttgtcgccgacctcgtcggcgagctgcttcgaccaacccttgatcacttcgttgcgtgggtcggaatccttgtagatggcatgcccgaagcccatgatcttgtccttgcgctcgagcatcttcagcaactcggcggtggcttcctgcggcgaagagaagcgttcgatcagttccatcgccgcctcgttggcgccgccgtgcagcgggccgcgcagcgagccgatggcgccggtgacgcaggagtagaggtcggacagggtcgaggcgcaaacccgcgcggtgaaggtggatgcgttgaactcatgctcggcgtagaggatcagcgagacgttcatcaccttcacgtgcagctcgctgggcttcttgccgtggagcagggcgaggaagtgcccgccgatggtcggctcgtcgctgttgcagtcgatgcgctggccttcgtgggtgaagcggtaccagtaggtcatgatcgccgggaaggcggcgagcaggcggtcggcgacgtcgcgctgctggtcgaagctcagctccggttccagggtgccgaggaccgaggcgccagtgcgcatcacgtccatcgggtgggcgtccttgggaatccgttcgagaacttccttcagcgcctgcggcaggtcgcgctggccctggagcttcttcaggtaggcgtcgagctgttgcttgttcggcagttcgccgtagagcagcaggtaggcgacttcctcgaagatcgccgccgccgccaggtcgcggacgtcgtagccacggtaggtcaggccggcgccttcctggccgacggtggacagggctgtctgaccggccacctggccacgcaggccggcgccactcagtacttttgcttcagccattgctctctcctttcttga

SEQ ID NO: 13258 - DNA, 576 bp, Pseudomonas aeruginosa
agcaccagggacacgtcggcggaggccagttcgtcggtggtgaacagcggggtggcgccgaactcggtgatgttggccagcaccggcaccttcaccgcggcggcgaattccttgtacatggccagttcggtcatggcttccgggaagatcatgtcggcaccggcctcgacacaggcgcaggcgcggtcgatggcggcctgcaggccttccacggccagcgcgtcggtgcgcgccatgatcacgaaggagtcgtcgctgcgggcatcgacggcggccttgatgcggtcgaccatctcctgctgcgagacgatctccttgttcggcctatggccgcagcgcttggcgccgacctggtcctcgatatgcatcgcggcggcgccgaacttgatcatcgacttcaccgtgcgggcgacgttgaacgccgaggagccgaagccggtgtcgacgtccaccagcagcggcaggtcgcagacgtcggtgatccggcgcacgtcggtgagcacgtcgtcgaggccgctgatacccaggtccggcaggcccagggaaccggcggcgacaccgccgccggacaggtag

SEQ ID NO: 13259 - DNA, 1632 bp, Pseudomonas aeruginosa
atggccttgaagccggcgcgcttggccagcagggcgtggttggcgttgatggtgccgaccacctgcagcgggtgttcggtggccacggcttcgcggaagcgctggccgggggtaagggacgtctggctcatcacggacctcttagacggtggaggaagcggaggcgagcttcgccggctggggttccagctggcgctcgatattgcggcgcgacgcactgatgtggcggcgcatcagcagctcggccagttcgccgtcacggtcggcgatggcgtcgagaatgcggtggtgttcggcgaaggcctggcgcggccggttcggcgtggtcgagtactggatgcggtacatccgcaccagttggtagagctcgccgcagagcatgcgggtgagggtggcgttgccgctgccctggatgatccggtagtggaagtcgtagtcgccttcctgctggtaatagccgcgcccggcctggaacgcctcgtcgcgctcgtgggtatcgagcacccgacgcaactcgtcgatctcggcctggctcatgcgctcggcggccagtcggcaggccatgccttccagggactcgcggatctcgtagagctcgatcagctcggcgtggctcagcgacaccacccgcgccccgacatgcggcacccgcaccagcaggcgcaggccttccaggcggtggatcgcctcgcgcagcgggccgcggctgatgccgtaggtgcgcgccagctccggctcggagatcttgctgcccggcgcgatctcgccgctgacgatggcgctctggatcttgcggaagacgtgttccgacaaggtctcgccgtcgtcatgggcaatctcgagagggggcgggttctgggtcatggtactggctgtccgggtcgatgtgtcgacaatgtttgcgaaagctatcgcctggattgcgtggggtcaatcattcgtcgcttgattgtcgacaatcgtctaatgcatcgctggtctatgctttcccctccagccgctgtgccaggagagagtttcgtgggcatctatgaccgttacgtgttgccgcgcctgatcgacttcgcctgcggcatgggcgacgtgatgaagcagcgttcgctgctggtgccgcgcgcccatgggcgggtgctggagatcggtctgggcaccgggctcaacctgggcttctacgacgcggcgaaggtgtcggcgatcgtcggcgtcgacccggccgcgcaaatgcaggcgctggcccgcgagcgcgcggcgcaaatcggcatcccggtggaaatggtcgccctcgagcttggcgagatccgcgccgaggcggaaagcttcgacaccatcgtctgcactttcaccctttgctccatcgccgcgccgctgccggcgctgggcgagatgcgtcgggtgctgaagcgtggcggcgaattgctgttctgcgagcatgggcgcgcgccggacgcctcggtgctggcctggcaacggcgcctgacgccctggtggaaaccgctggccggcggttgccacctggaccgcgacatgccggccttgctgcgcgaggccggctttcgcatcgacgagctggaacagggctacctgcccgggccgcggccgatgacctacgtctaccgcggcgtcgcgcgctga

SEQ ID NO: 13260 - DNA, 639 bp, Pseudomonas aeruginosa
tgttctgcgcctcgtcgaggatcagcaggtggaaccgccgcttgcccagctcggcggcgtcgcgtggcagcagggcataggtggtcagcaccaggtcgtgctcgtcgatgcgggcgaagtcgcggcgccggccggcgccgtgcagggccagcacgcgcagatcgggggcgaagcgctcggcctcgtccagccagttggggatcaggctggtgggcatcaccaccagcgccggcgtgtcgagccgcccggcctgcttttccaggagcacgtgggccagcgactgcaaggtcttgcccagccccatgtcgtcggccagcacgccgccgctgtcgagttcgcgcagggtctgcatccagctcaggccttcgagctggtagggccgcagttcggcgcgcaggccttgcggcggggtcgccggacgagcctggaaactgcgtaggcggcgggcgaagtcgcgcaggttgtcgccgccttcccaggccagcggcaactcgtcgagatcggccaggcgcgccgcgtccggtgcgcccaggcgcagcttgcgctgcggttcggggtcgcccaggtagaagtcggaaagcgccgccagcaccggcttcaggcggccgaagggcagcgccacgcgcagcggcgggttga

SEQ ID NO: 13261 - DNA, 492 bp, Pseudomonas aeruginosa
cccggaaggcaacctgttggccagcctgcagcgcggcgactgggtgctggccggcgtcgacctcagcctgctgggcctcggcctgctctgcgcctggctaggttggcgacgtcggcaagcgtcgagcaagcccgtccggcgacgcctgaacgtccaggaggtggcctgatgctgctggtcttcggcctcaacctgctggctttcaccgctctctgcctggccatgaaccgccaccacaagaacctcctcggccacgagccgtcggctccccgggtgcttctgctacgcggcgtggcgctgctcgacctgggcctggcactggccttctcgatccaccggcagggcgtggagatcggcatcgtcttctggtcctgcctgctgatgctggcggccggcacgctggtcctgctgctcgcctggcggccacgctgggcattgccttgcgccgccggagtgccgttgctcggcggggtgctggcgctgctgcgctga

SEQ ID NO: 13262 - DNA, 513 bp, Pseudomonas aeruginosa
agggcgcgccgcccatccgtgcctcgggggcggtccggtccagcgtctatgctggtggtcgtgctttcccccggaggtatgcgccatgcacacgcccgccagcaacaccgtcgccagcgtcattccctgcctgcgttaccgcgatgcgccggccgccatcgactggctgtgccggacctttggcttccagcgcaagctggtggtgcccggcgaggacggacaggtgctccacgccgagttgacctacgccagcccgaacggcgccaacggtatgctgatgctcggctcgagcgtccgcgacaacgcctacggtcggctgatgcggcacgtcgacgaagccggcggcaatacccagagcctctacctggtggtcgccgatcccgacgccctgttccgcagcgcccaggccgccggcgccgagatcgtcatcgacatcaaggacgaggactacggcggtcgcggcttcacttgccgcgatccggagggccacgtctggagcttcggcagctatga

SEQ ID NO: 13263 - DNA, 534 bp, Pseudomonas aeruginosa
ccgcgagcggccgcccgatgcggcggccgctcccttgcccacccccatggaggacttgccatgactgccgtcgcacaggtcgtcgccaaggcggaaatgctgatccgccgccccatcgccgaggtcttcgaagccttcgtcgatccggccatcaccgccaggttctggttcagccgcggcgatgcccgcctcgaagccgggaaacggctgcgctggcactgggacatgtacggggtttcccaggaaatcgaagtgaaggacctgcagacgaaccgccgcatcctcatcgaatggccgaatggcgacagcaacccttcccaggtggagtggctgttcgaggaactgcccggcgccgggaccttcgtcagcatccgcaacagcggtttcgtcggcaccccggaagaggtcatcccgcgggtggtcgacgccaccgaaggtttcaccctggtgctggccgggctcaaggcctgcctggagcatggcatcgccttgaacctggtggccgaccgttttccccgcggtctcgatggctga

SEQ ID NO: 13264 - DNA, 879 bp, Pseudomonas aeruginosa
cagcgggatcactgccagcggcaactgcatcgacaggatcacctggctgaagatcagcagccgcgcggtgccatcctcgccgtagagcagggtcaccagcagcaccggcagcactgcgacgccacgggtcagcaggcgccgcgcccagggcgccaggcgcaggcggaggaagccctccatgacgatctgcccggccagggtggtggtgaccgtcgagttgaggccggacgcgagcagcgccacggcgaacagcagcgaggcgagttccaggccgagcaatggcgagagcagcgcgtgggcctgctcgatatcgaccacctcggtgtgcccgttgcggtggaacacgctggcggcgacgatcaggatcgccgcgttgaccagcagcgccagggtcagcgccaggctgctgtcggccaccgcccagcgcagcgcctggcgcttgccggcaaggctgcgcgggtaggcgcggctctgcaccagcgaggaatgcaggtagaggttgtgcggcatgacggtcgcgccgacgatgccgatcgccaggtacagggcagccgggtcgctgagcacccgcgggctcggcaagaacccttggagcacctcgccgagttcgggacgcgagagcagcaactgtaccgcgaagcaggcgaagatcagtgtcagcaacgccaccacgaaggcctccagcggccgctggccacgtccgatcaggaccagcaccagcagcgcgtcgcccacgcagagcaaggcgccccaggccagcggcaggccgaacagcagattcagggcgatggcggtgccgatcacctcggccaggtcgcaggcgatgatcgccgttttggcaggccagccacagcaggcggcaggtgctccggcgagtag

SEQ ID NO: 13265 - DNA, 1260 bp, Pseudomonas aeruginosa
ccggggccggcgaaggccagcaggcggcgccaccagtggccgccgccggggacttcgaccggctgggcgcgaccgggctcggcggcctggggggccggggtatccttcgcggacatgacgaagctcctgccggacgcgtgccggcgctgcgcgcgcctttcccggcgcgccgtggcgcgcgggttgggcgagcggttcagggggcaggaaggaggaagtcggtcaggccgaggccgccagttgccggtgcaggtccagcaggtcgctggcgatcaggtcccagtcctgctcggcggcgaggtcctgggactggccggggccgtattccagcggccgggcgatgaacgcggtcttcaggccgagggcgcgcgcggccttgaggtcgtagttgtgcgccgcgcagagcatcacctcctgcggcggcaggtcgagcaggcggcaggcgccgaggtagacctgcgggtcgggcttgtagtggccgaacaggtcggcgcacagcagcatgtcccagggcagcccggcgtgccgcgcgacgtcgagcatcagcgcggtgttgccgttgctcagcgcggcgagccagtagtcggccttcagcgcgtgcatcccggcgagcgtgtccggccacggccgcaggcggtgccagaagccagtgatgcgttgcagcagggcctcgtccagcgccaggccgaactctccggccagggcctcgagactctgccggtgcaactggtcaaggtgctgccagggcgcctggccgttgcgtacccggtccatcgccggcttgtattgctggcgccagcggtcggtcagttccacgcagggcagggtcccgccgagttcgcgctccaacgcctggaactgctcgatcaggctggaacgccagtccaccagggtgacgaacacatcgaacaggatcgcgcgcatcgtgcctcctcggccgtggccgtcatcgcttcagtgcttctgtggcagcgcggtgggcagtccgcggccgctccaggcggtgaccacaagggctaccgccgccatcaggcagagcgccagccagccggggacgaagctgtggctgaagtccttgagcagccccagcgccggcggcgcgagaacgatcgccaactggttgatggccatcgccaggccgagggcgaagccggttttgccgaccggcgcggtatccgccacataggccacccagggactgtaccagccgaagccgaagaagcccagccaggccaataccaggcccatccccaacggtga

SEQ ID NO: 13266 - DNA, 984 bp, Pseudomonas aeruginosa
aaacgcccgaccgttgaggaacgcgcaacgatgatcgacctggtgatgctcaaggacttcctcgtcctctgtcggatcaagagcttcagccgtgcggcgcaggagtgccatgtctccgtgtccgggctcagccggcgtatccagaccctggaacagtggctcggcgcgccggtgttcgagcgccacaagcacgccctcgaactgaccgaggccggccgccagttgcaaggcgtggcgcaggacgcggtgcgcgccctggacaacctgcgccagtcgatccgcgagcgcgacgaagacgcccagcggcgcattcgtttctgcgccccgcacatcctctcctcggtgttcttcccgcactggattccgcgcctgcaggcggacttccgcagcgccaagttcagcgtcgactgcgattacctgccgcaatgcctgtcgcgcctgcgcgacggctcggtagactacgtggtggcgttgctcgacgaaggcgaggcggtgtcgcgccgcctgggcatcgacagcgaagccgagttccagcgcctggagcttggccacgaacaactggtggcggtctgcgcgccggacgccgccggccagccgttgttcaacctcgaccgcctgcagaccgaagcgctatcgttcctcggctactccgaggaatgccacctgggctgggccctggaaccgctgctgcgcgacagcggcctgttcctccagcgccatcacagctccagccagaccgaggggctgcgcttcttcgcccagtcgcgcctgggcgtcgcctggctgccgcataccctggtccgcgaggacctcgccagccgtcgcctggtgcgcgccggcggccagcgcttcgacgtgccgttgcgctacaccctgatccgtcgccgcctgccgctacccggcgaggccgaacgcctgtggaccttcctcggcgagctggcgcgcccggcgccgcgctacgcggtggtcggcgcggcctcctga

SEQ ID NO: 13267 - DNA, 1080 bp, Pseudomonas aeruginosa
cggatgaacggttgcgtgcgcagcaattccagcgcatccgtcgcagtgcattgcggcggcgcgatcagcacgaacggctggcgctcgacccgttgcgcggagagcccgcgcggcaggttgaacggcgggcggatgaggatcgccaggtccagttcggcggcgtccacctggtccagcaggtgcagcgagacgcccggcatcacctgcggctcgatgtgtggcgcctgttcggcgaggcgcttgagcacctccggcagcagcccggtctgcgccgtgttcaccgcaccgatgcgcaggcgtccgcgcgggctgtcgccctggccgatgccgtcgaacagcgcgaggatctgctcggccgtacgcaccgcctgcctcccgacctcgttcaggtgtgccgcgcgcggcgtgcgcttgaacaactcgacgccgacgctgcgttccagcgcgcggatctgcgcgctcaccgccgactgcgtcagccccacctgttcccccgccgcggcgaaggagccccggcgcgccacggcgaccagggtgcggagttcgcggatcatccaagcctcgaaaaaagtgttgctcaggcgaaatattatgcgctttccatcgaaatcggcacggcaaataatcccggcacacccacagaggaaccgcgccatgagcctgatgcccttccacctcgccatccccgtccacgacctgcccgccgcccggcgcttttacggcgaggtcttcggcctgagcgaaggccgctccgccgagcactgggtcgacttcgacttcttcggccaccagttggtcatccaccagcatccgcagaccgattcccagcgccacgccggcagcaacccggtggacggccacgacgtgccggtgccgcacttcggcgtggtcctcgcatgggacgactggcacgccctggccgaacgcctgcagcagcgcggcacccgcttcgtgatcgagccctacatccgcttcaagggccaggtcggcgagcaggccacgctgtttctcttcgacccctgcggcaacgcgctggagttcaagagcttccgcgacatgggccagttgttcgccaagtga

SEQ ID NO: 13268 - DNA, 393 bp, Pseudomonas aeruginosa
tggaatattccctgggggttatattttgtggcgtgggatatcgagtacaccgacgagttcggtgattggtggggttctctgtccgaggatgagcaggagtcgctagctgtgacggttcgcttgcttgaggagcgggggccatccttggggcacccccacagcagcggcatcaatggctcccgccatggccatatgagagagctacggactcaacacggcgggcgacctttccgaacgctttacgcgtttgaccccagacgctccgcgatactgctgatcggtggcgacaagactggcgatgatcgttggtacgaattgaacgtgcccattgccgaccgcctctatgacgaacacttgcaccagctccgtgaggagggactgatcgatggttaa

SEQ ID NO: 13269 - DNA, 966 bp, Pseudomonas aeruginosa
ctgcctcaagttcggtgccctgatgcttcgtccaggtcgtgcccaccaatctcgtgttgcactcgccgcgatagcaggtgcgttggtgagcgccagcacgccgaacgatccgaacatcgacgactaaaacgtcgagcaatcaataggaatcgcagtatggcaatcattcacgacgccgacttagcggacgtgctattgagcgcaagctcagacgatatcaggctgctgatcgacgtcatcacggacaacggcaacggacggatctccttgtcctcctcggtgtgccgccaactgagcgcggcgaaggagggtgtggtcggcgagttcgagcgcggcatggtcgccgaagaactcatgcgttttggaggcaactcgttgatgaacctgttccggggcggcagcggcgtgccttacaaggaactgctgagcgatgttgcctctcacgtgggtgtctcgaaggaaagtacgggcgactgcgcacgcatggaaatggccatcatcaccaaggtgttcgaacagtcgattggccgcatgagcgaggaagacaaggcgacctttttcgaatcactggggacaagctacagatctggcatggggccggttgcgctggcagcactgatagccagcctgagcgcttccggtatgacctcctatggattggccgcaatggtggccagcgcaacgatgagcagcctggtcggccggggtgtcgcgcttgctgggggagcaaccttgggcaggggactgtcggtgctcacagggcccgttggctgggcgatcgccggcatctggacggccttcgacttggccagccctgcttaccgggtgacgctgccgtgcgttatccagatcggtcacatgcgccagaaaatgctgctcaagcccgaatgccccggctgccgcgcatcggtcagcccaggcagcaacttctgtggcaattgcggtacgcggctggtcgatcgctga

SEQ ID NO: 13270 - DNA, 822 bp, Pseudomonas aeruginosa
agtgaggctgatcagtcgggacgcttaccagcaggacaaggagtcgctgtagtgactagcaacgatatcagcaatacccgtcagcttctggagcgtgtcagcaacgatgatctggagcctctggtggaatacatcctcaaggcccgaaccgagtccttgtcgaagcaagtggacttcaagcgctggcacccggaacaccgccgttatgccagtgcaatccttgatgagctgcgtttgttcggtggcaacagtttcgccaacctgtggcgcaagagcgggccttcctacaccgaggtggtgcgagatgttgccggtaagctcaaggtcaagggtgttggctcgatggagctcatcgagctggaggaggcgatggtgcagtcgatcctacgtcaggcgttggagaagtcgtcgggcgaggatcgtcgcgagctggaagagattctgcgcgaggcgggactcgacaagaccaagatgacggctctgctgaatggttcggcactgagtgggctggtggtgccggccgtagcacggatgatcctctatcgcacttcgacggtaatcgtgaattcgatggcccagcagttgcttgggcacggtctgcgcagtgcggtggtcgctgggggaacctttgccggcggtcgtgccgtcgccgcgctggctgggccggtcggctgggtcatagccggtgtctggaccgccgtggatctggctgggcctgcctaccgggtcaccattccttgcgtattgcatatcgccatgctgcgtctcaaggctcgtgccgaggcagcgaccgatttcatgaatggagctttcgatggctga

SEQ ID NO: 13271 - DNA, 1071 bp, Pseudomonas aeruginosa
tcgggtcgactggcaacggttggtcgcccacgtgcgggagacaccgttgacccgagcactctatacgcaccccttgaccgagttgctggcgcgcctggagagcaccgacctgctgcgttcgatcattgccaaggcgaacaacccctactggctggtgaaggagctggcaggtcatgccgggttgctcgaacaatgggaggttgcatgatcgactcacacagccacacctcttattcgaagcatgcaaccggcaccgtcgatgaattggttcgcgcctcgatcgctgccggcgtgaccatcctaaccatcaccgaccacgcgccattccccgtggatacggacaatcgtctgctcgcgtccgaacttgatcgctatttcgccgacatcgagcgggcgcggaagatctaccaggggcagatcaccatcctgtgcggcctggaactcgactacatgcctggcaccgatgccttcaatcgcgagctgcttactcgttacccgatggacttcgtaatcggctcgattcattacgtggaaattccagacgaaaccatggtgaaggtatgggagctgccgcgcctggccgggcagacgttcctggaccgctacttcgccaacctcgaagggctgttggacagtgggctgttcgatgccgtagggcacgccgacactctgctgcgtggcgtaccggaagacattttcctgcgccgtttcgaacctttgctggcaccgctcacccgaagcggtattgccttcgagctcaatgcctcaggccttcgaaagtcgagcctggatcctgcaacggggagggaggttcagggcttgtggtcttatccgtctcgggaattggtggcgcagctcatcgcacacgaagtgcccttcacggttgggtccgatacccatgacccgagtgacgccggctgtggcattgccgaactgctcacggccctgcggcctttggggctgaaacgcattagttactacgagaggcgccgacgaatcgatgtcgccctcgacagcctgccgttgctgggcacgccagcaactttgacagaaggacttgaacggccttga

SEQ ID NO: 13272 - DNA, 732 bp, Pseudomonas aeruginosa
cgatggccgaggccgccgtcaccccgcgcttcgattggggcggacgggatggcaacggcgcagtgggacggcttgcaggcggtattcgaggacctcggcggctacggcgcgctggcgcgccaggcggcgcagggcgaggggccgctggtggggcatctgcaacgaaccaacatccagctcgcggcgatcccggtgttcacccgcaaggggatcgccgagaccacggtcaacgacttgctggaggctgcgcgggtctcgcggcggactttctacaagtatttcgccggcaagctggaggtgctggaaagcatctaccacagcgccgtgcaattgctgctggcgcgcttcggcgggctgcgcagcgaggccggcagcgacgaggactggttgcgggcgatggtctcgctgttcttcgactaccacctggcggtcggtccgatcattcgcatgatgcaggaggaggccctgcatgccggctcgccgctggcggcgcaccggcagcgcgcgcacctgaagattatcgagctgtgggccgagcgcctgggcgcccagggcgcggcccacgatgcgctgacctaccgggtgctgatctgggcgatggaggcggcttcgctggagctgctcaatgccagcgacccgctggagctgccgcgggtcaagcgggtgctcggcgacctgctggtgggtacgctctgtccccgcacccaggctccgacgagattgcaagggtaa

SEQ ID NO: 13273 - DNA, 966 bp, Pseudomonas aeruginosa
caacaagacgggagacgtgcgtccatgtccgcgacaccctatctgctgcaaccgccgctggcggtcggattcgcccgcctgggcttcggctccctctcgctggagtcgttgcgcgagcgctacgccgcaccgtccagcggctcgcgcttcatcgagctggacggtttcccgctgcactaccgcgacgaaggcagccgcgacaagccggtgctggtgatgatccacggcgtggtcgcctcgctgcacacctgggacggctgggtgaaggcgatgtcgccctacttccgcatcgtgcgcttcgacgtgccgggcttcggcctgaccgggccggggcgtgacagccgttactccggcgagcgcatggtggcgatcctcggccagttgctcgatttcctgaagatcgacaaggcctcgatcgccggcaactccctgggcggttatatcgcctggaacttcgccctggcgcagccgcagcgagtggagcggctggtgctgatcgacccggccggttaccagatgcgcaaggtgccgtggatgatcgcctcggcggcgctgcccggctcgaccctggcgatgccgctgtggatgccgcgagcgctgatcgcccagggcatcaaggaagtctatggcgagccggggcggatcaagccgggggtggtcgaccgctactacgacctgagccgccgcccgggcaaccgcaagggcatgatggagatcttccgcgtgttgctgaaggtcaaccgcgaggaactcggcacctccggcgaacgcatcgcccggatcgtcgcgccgaccctgctgatgtggggagaacgcgaccgctggatctcgccgaagcacgtaccgctgtggcaacgcgacctgccggggatccaggtgaagacctatccgggcgtcgggcatatccccatggaggagattcccgagcagaccgcggcggatgcactgcgcttcctgatggcctga

SEQ ID NO: 13274 - DNA, 1026 bp, Pseudomonas aeruginosa
acagccatgaaacaaccgctcaatttcaccgccgaactggtgccggtggcctatgccgaggcactcctcgatcttgtcgcggagtacggcgtatcccgccaggcgctgttcgacgctgcgcgggtgcgtcccgaggtgctggacagcccgaacggccgcctgtccttcctcgacttcaaccagctcacctacagcgcccaggccctgtgcggcgagccggcgctggggctggtgctcggccagcgcctgaacgtctccgcccacggcatcctcggctacgcggtgctgtccagcgccaacttgggcaaggccatccagttcgccctcaagtactaccgggtgctcggcctggcctacgaactggaactggtgctcgatgacggccgcgccgagttgcgcgcggtggagtcgatgccgctgggcgccgcttcggtgttcgccgctgagggcctgatggcgacgctgtattccatcgcctgcttcctggtcggcgagccgttgcaggacgtgcgggtcggcttcgcctatccgccgccggcccatgcccggcgctacgccgaggtgttcggggtggccgcggagttcgagcagccctggcactggctgagcatgcccagcgagtacctggaacgaccgatggcgctggccaacccggccacggtgcagatgtgcgagcagcagtgcgaggcgctgctggccaccctggacgtccaggaaggcctgctgacccgtgtgcgccgcctgctgctggcgcgtcccggcgacttccccgatctcgaacaggccgcccgcgaactgcacaccagcgggcgcagcctgcgccggcacctgtcgtcgttgggcaccacctaccagcaggtcctcgacgatgtgcgcaagcgcctggccctgcaatacctgaccaccacccagctaccgctgtacgagatcgccctgctgctcggcttcaacgattcgtcgaacttccgccgggcgtttcgcaagtggaccggcaagctgcccagcgactaccgcgaagcgccctga

SEQ ID NO: 13275 - DNA, 528 bp, Pseudomonas aeruginosa
cgaactgagcgtcgccatcgagccggaagacgcctatggcgaatacagcgccgaactggtcgcgaccctgacccgcgagatgttcgaaggcgtcgacgaactggaagtcggcatgcagttccacgcctcggctccggacggcggcatgcagatcgtcaccatccgcgacatcgacggcgacgacgtgaccgtcgacggcaaccatccgctggccggccagcgcctgaacttcaaggtcaaggtagtcgacgtgcgcgaggccaacgccgaggaaatcgcccacggccacatccatggcgaaggcggtcaccaccactgatcggcgttcattcgccgattgatggcctgggccgtccgccggcggaactgctaagctggtatagcgaaaggcgcctgtgggcgcctttcgcgtcatgcgccatgcctgggctctttaccccgtccctggggatgcgccgcagccagggttcttgcccggtgcggggcttggcacgttgtgtcgctgaatgcgcaaggagtacgtcatga

SEQ ID NO: 13276 - DNA, 1194 bp, Pseudomonas aeruginosa
atgctttcatgtcgcgcctggagctgctgctccgcgcctgatacctgcccgaacctcccattccctctcaggagtccgtccatgagtgcccccgtagaagccctgttccaaccgttccgcctcggcgccctggaactgcccacccgtgtggtgatggcaccgatgacccgcaacttttcccccggcggcgtacccaacgccaaggtcgtcgagtactaccgccggcgcgccgccgccggcgtcggcctgatcgtcagcgaaggcacaacggtcggccacaaggccgccaacggctatccgaacgtgccgcgcttctatggcgaggacgccctggccggctggaagcaggtggtcgacgcggtgcatgccgagggcgggcgcatcgttccgcagctctggcacgtcggcagcgttcggcgcctgggcgtggagccggacgccagcgtgcccggctacggcccgatggagaaggccaaggacggtaaggtgctggtccacggcatgagtaaggccgacatccaggacgtcatcgccgccttcgcccaggccgcccgcgacgcccaggcgatcggcatggacggggtggagatccacggcgcccacggctacctgatcgaccagttcttctgggaaggcagcaaccagcgggacgacgagtacggcggcagcctggccaatcgctcgcgcttcgccgtcgagctggtgcgggcggtgcgcgcggcggtcggcgcggatttcccgatcatcttccgcttctcccaatggaagcagcaggactattccgcgcgcctggtggaaaccccggagggcctgcgcgagttcctcgcgccgctggtggaggccggcgtcgatatcttccactgctcgacccgccgcttctggattcccgagttcgaaggctcggaactcaacctggccggctggacccgcgagctgaccggcaagccgaccattaccgtgggtaacgtcggcctggacggcagcgagttcctgcaattcttcggcaaaaccgacgaggtggcgcagccggcgagcatcgacggcctggtggagcgcctggacaagggcgagttcgacctggtcgcggtgggccgcgcgctgctggtggatccggagtgggcggtgaaggtccgcgaggggcgtatcggcgacatcaagccgttcagccgcgaggccctggccagcctggtctga

SEQ ID NO: 13277 - DNA, 534 bp, Pseudomonas aeruginosa
gacggacccggcgcaggcgttcctggtcgtccagcagccaactggcgacttcgacgaagccgctcttgtcgcccggcgcggcgagcacgccgttgtgcccatggcggatgtgctggccggcggcggcctggtcgaaggcgaccaccgcgaggccggcggcctgggcttcgaggaccacgttgccgaaggtctccgacaggcttgggaagaggaacaggtcgcccgaggcgtagtgggcggccagggtttcgccgcgctggacgccgcagaacagcgcttcgggcaggtcccgttcgaggtgcctgcgctccggcccgtcgcccaccagtaccaggcgcagcttcagctgcggatgggcggcgcagagcgcgcggaaggtgccgccgagcaggccgaggttcttctctgccgccagccggccgacgtgcagcacggcgatgtcctgttcgcccaggccccagcgccggcgtagttcgggatcgcgccgggagggatggaagagttggctgtcgaccccgcgggagagcaggttga

SEQ ID NO: 13278 - DNA, 972 bp, Pseudomonas aeruginosa
tgtcggcaggagtccgacgagatgcccgataccctccgccacgcccgagtgatcatcctcggttccggtcccgccggttacagcgcggctgtctacgccgcgcgcgccaacctcaagccgctgctgatcaccggcatgcaggccggcggccagttgaccaccaccaccgaggtcgacaactggccgggcgatccccacggcctgaccggcccggcactgatgcagcggatgcaggagcacgccgagcgcttcgagaccgagatcgtcttcgaccacattcatgccgtggacctggccggcaagccgttcaccctgcgcggcgacaatggcacctacacctgcgacgcactgatcgtcgccaccggtgccagcgcgcgctacctggggttgccgtcggagcaggcgttcatgggcaagggcgtgtcggcctgcgccacctgcgacggtttcttctaccgcaaccgcgaagtggcggtgatcggcggcggcaataccgctgtcgaagaggccctgtacctggccaacatcgccagccgggtgaccctggtgcatcgtcgcgaaaccttccgcgccgagaagattctccaggacaagctgcaggcgcgggtcgccgaaggcaagatagtgctcaagctcaacgccgaggtcgatgaggtgcttggcgacacgatgggcgtcaccggcgtgcgcctgaagacccgcgatggtggcagcgaggagatcgccgtggatggcatgttcgtcgccatcggccatactcccaatacctcgctgttcgaagggcaactggccctgaaggacggctacctggtggtcaacggcgggcgcgaaggcaacgccaccgcgaccaacgtaccgggtgtgttcgccgccggcgacgtggccgaccacgtctaccgccaggcgatcacctcggccggcgccggctgcatggccgcgctggatgtggagcgctatctcgattcgctctga

SEQ ID NO: 13279 - DNA, 750 bp, Pseudomonas aeruginosa
cgcgatctgcctgctcggcctgatcgcctggaccctgttgctggtcttcctgctggtcagccagcgcggcctgctggtactcggcgggcggatggcggtgaacgccttcgccgccgatggcagcaacacgcctggcggtttcggccagcggctggtgcgagtccatgccaactgcgtggagaacctgccgctgctggccggcgcgctgctctacgcgatcgccagcgggcagagcagcctgaccgacccgttggcgccactggtgctcggcgcccggctgttccagtcgctgatgcacctggtcagcacctccgcgctgttcgtctggctgcgttttgccggcttcttcgtgcagttgctggtgctcgcctggtggctgctgctcctcgcggggctggcctagcggcgccggctcagtcgccggcggccagttgctcggcgaatacctcgcggtcgacgttcgctccgctgaggatcaggcctaccttcagccccttcaggcgctcgcgctcctgccaggcggcggccagcgccgccaccccggcgccctcggcgacgttgtgggtgctggtgaagcacaggcgcatggccgcgccgatctccctgtcgctgacccgcaccagacgatcggcgccggccaggatcatttccagcgcgctcgggtccggcgtactgcacgccatgccgtcggccaggcgggtgtcgaccgggtggctgatcgccgtgccggcctcgaacgacagggcgtag

SEQ ID NO: 13280 - DNA, 528 bp, Pseudomonas aeruginosa
ggaagcgcagccgcgacagcggctggtcgtggcagaccagcaggtcggcgctgcgcccgcccagcagttgctcccagtccttgtcctgggtgccgcggtagcggaaggcgaagcccggctgcagggcgcggtcgaagaagccctgcagcaacgccggcaggccgccccaccagaccgggtagacgaacaccaggtgctcggcccagtggatctgccgctgcgcttccagcaggtcgggttcgagcacctggctctgttcgtagccttcgtggaggatcgggtcgaaggccagctcgcccagcttcagttcgcgcaccacgtgatccttgctgcgcgcgccctgggcgtagcattcggcgagcaggtggcagaagctcttgcgcttgggcgagccgacgatcagcaggatgcgcttgccgtcgccttccagcggggtggcgccggtcttggcggtttcaaccatggtggccggcctccagcatctgctccggccgtacccattcgtcgaactgcgcttcgtccaggtag

SEQ ID NO: 13281 - DNA, 432 bp, Pseudomonas aeruginosa
acgatcaccggcttgaacacgttgagttgcagatggccctggctggcggcgaaggaaatcgtgctgtcgttgcccatgacctggcaggccagcatcgacagcgcctcgcactgggtcgggttgaccttgccgggcatgatcgagctgcccggctcgttggccggcagcttcacctcggcgaagccggcgcgtgggccggaaccgagcaggcgcaggtcgttggcgatcttcatcagggccaccgccaggctcttcagggcgccggagaggatgaccagcggctcgtggccggccagggcggcgaacttgttcggcgcggcgacgaagggcaggcccgattcggcggcgatttccgcggcgatggcgtcggcgaagcccttcggcgcgttgagcccggtgcccaccgcggtgccgccctgggccaactggtag

SEQ ID NO: 13282 - DNA, 567 bp, Pseudomonas aeruginosa
tcgagctgggcgacgaaggccgagagttcctggccgaaggtgatcggcgtggcgtccatcaggtgggtgcgcccggtcttgaccaggctggcgtgccgcgccgactgttcggcgagaccgccggaaagctcggcgatggccggcagcaattgttcgtgcacggccttggcggcggcgatgtgcatggcggtggggaagctgtcgttggaactctgcgcgcggttgacgtggtcgttgggatgcaccggcgacttgccgccacgcggattgccggccagttcgttggcgcggccagcgatcacctcgttgacgttcatgttggtctgggtgccgctgccggtctgccagaccaccagcgggaagtgttcgtcgtggcggcctgcgaggacttcgtcggcggcctgttcgatcagccgggcgacttccggcggcagttcgccgaggtggtcgttgacccgcgcggcggctttcttgatcagcgccagggcgtggatcacggcgagcggcatgcgctggccgccgatggcgaagttctccagcgaacgctgggtctgggcgccccagtag

SEQ ID NO: 13283 - DNA, 573 bp, Pseudomonas aeruginosa
gcggatttcgaacttaggcgcagaatgtcgggtcccacggacacatctacccaacctcaaggattttccatgacccgtcttcgcctcatcggcagcgccgtgctgctcagcctcagctccatggccatggccgattccgccagccaggccgagcaattcctcaagctggtccatgccgacaagctgacggtcccggtctatgcccaagtgcagcagatgctggcccagcgcttcgcccaggccaaggcgccggagagcaagaaggcggttctcgagcgttaccaggccaaggccaatgccgaactggaccgcgccatcggctgggacaagatcaagcccgagctgatcaagctttacaccaccaacttcaccgagtccgagctgaaggacctgaatgccttctaccagtcgccgctgggcaagaaggtgctggagaagatgccgcgcctgaccgccgaatccgcccaactgacccaggccaagctgcaaggcgccgtcgagccggtgaacaagctgatggccgacatggacaaggaactcggcgtcgccgcgccggcccagaagaaaaagtga

SEQ ID NO: 13284 - DNA, 1173 bp, Pseudomonas aeruginosa
ggagtggagccaggctgcggtgccggcctcgccgacctgccgcggcgggagcaagcacgacataccctgagacggcgtccgtcgcggcggggtgcagagcctgcccctgctgcgctagactacgcacccagcgccggccttccgccggcgttgtcgtttccatggcgccagcggctggcgcttttcgttccggtccgccctttacgcgggcgaccacctggaggctatatccccatgacatccatcgtcgtggcggcgctgtacaagttcgtgactctcgacgattacgtggcgctgcgtgaacccctgctgcaaaccctgctcgacaacggtgtgaaaggcaccttgctgctggccgaggaaggcatcaacggcaccgtctccggtagccgcgaaggcatcgatgcgctgttcgcctggctgcgcagcgatccccggctggccgatatcgagcacaaggaatcctactgcgacgaacagcccttctaccgcaccaaggtcaagctgaagaaggaaatcgtcaccctcggcgtgcctggcgtggatccgaacaagcaggtcggccagtatgtcgaggcgaaggactggaatgccctgatcagcgatccggaagtcctgctgatcgatacccgcaacgactacgaggtggcgatcggcaccttcgagggcgcggtcgatccgaagaccaggtcgttccgcgagttccccgagtacatcaaggcccactacgacccggcgcggcacaagaaggtggcgatgttctgcaccggcggcatccgctgcgagaaggcttccagctacatgctcggcgccggtttcgaggaggtcttccacctcaagggcggcatcctcaagtacctcgaagaggtgccgcaggaacagagcctgtggcgcggcgactgcttcgtattcgacaaccgcgtgaccgtgcgccacgatcttagcgagggcgagtacgatcagtgccacgcctgccgcaacccggtttcgctggaggaccgccagtccgagcactacgtgcccggcatcagctgtccgcactgctgggactcgctgagcgagaagacccgcgccggcgctcgcgagcggcagaaacagatcgaactggcgcggcagcgcaaccagccgcacccgctcggtcgcgatccgcgccagtccacgctggagaactga

SEQ ID NO: 13285 - DNA, 642 bp, Pseudomonas aeruginosa
accttggccaaggcccgcctgctgtacgtgatggaccccatgtgctcctggtgctggggcttcgccccggtcgccgaggcgctgtcccggcaggcggtcgccgacggcgtcgctttccacctggtagccggtggcctgcgcgccggccacggcgcggcgctcgacccgaatacccgcggctacatcctcggccactggcagaccgtgcagcagaccaccggccagccgttccgcttcgacgacgcgttgcccgaaggcttcgtctatgacaccgagccggcctgccgggccctggtggcggcgcgcagcctcgacgaggaaagcgcctggccgctggtaagggcgatccagcgggcgttctacgccgagggtcgcgatgtcacccaggcggcggtgctcgccggcctggcggaagcggtggggcttccgcgcatcgagttcgccgcggccttcgacagcggcgaggcgcgtgacgccaccgccgccgatttcgcctgggtccaggatctcggcatcgccgggttcccgaccctgctggccgaacgcaacggccaactggcgttgctcaccaacggctaccagccgcttgccgaactttcacccttgctcggccgctggctggaacggggccggcatgagtga

SEQ ID NO: 13286 - DNA, 1209 bp, Pseudomonas aeruginosa
cggcgcgctgcgtttcatggaccgcctgttgcccgccgactggcaggtggcgttcggctacatcggcctgatgctggcggcgacccttctgttgcggggggcggcgctggtgttcaacgtgctccaggcgaagctgttcgcgcggctgtccaaggacatcgtctaccgcatccgcctgcgtctgatcgagcgcctccggcatatcgccctgggcgaatacgaaaccctcggcggcgggtcgatcagcgcccacctggtcaccgacctggataccctggacaagttcgtcggggaaaccctcagccgcttcctggtcgccttgctgacgctgctcggcaccgccgcgatcctggtctggatgcactggcagctggccttgctgatcctgctgttcaacccgctggtgatctggtccacggtgcagctgggcaagcgcgtcaagcatctcaagaagctcgagaacgacagcaccgcgcgcttcacccaggcgctcaccgagaccctcgaggcgatccaggaagtccgcgccggcaatcgccagggctatttcctcggccgcctcggccaccgcgcccaggaggtccgcgactacgccgtggcctcgcaatggaagagcgacgccgccgggcgcgccagcggcctgctgttccagttcggcatcgacgtgttccgcgccgcggcgatgctcaccgtgctgctctcggacctgtcgatcggccagatgctcgcggtgttcagctacctctggttcatgatcggtccggtcgaacagctgctcggcctgcaatacgcctactacgccgctggcggcgcgttgcagcggatcaacgagttgctggcgcgggccgacgagccgcgctacccgccgctgcgcgatccgttcgccggccgcacgaccgttggcatcgaggtgcgcgggctggatttcgcctacggcgaggacaaggtcctggagcagttggacctgaacatcggcgccggcgagaaggttgccctggtcggcgccagcggcggcggcaagagcacgctggtgcaactgctgctcggcctctacagtgcgcagcgcggcagcatccgctacggcggggtgcccctggaggaaatcggcctggactgcgtgcgcgaacatgtcgcggtggtcctccagcatccggcgctgttcaacgacagcgtgcgggccaacctgaccatgggccgcgaacgcagtga

SEQ ID NO: 13287 - DNA, 648 bp, Pseudomonas aeruginosa
aaaacgctgtctgttccgccaggtgcagggcaggttcggcaaacagccactagactcctactgtttgccaggtgtccgcctcctccagcgtcgtggctgccggcaggcaaggcctcgggagttctgcgacgggatcttgagcggccgacaggtgatgcagtcaggggcgacggagacggcgcccgatcgcttagcgccagtttgaatggtagatggaatgaggcagaaccggactctcgacaagccccgcctgctcggcctggtatggcccttcatcgtcgtggtgctgctgcaggccatgctggcgggcggcagtctctacgtcctctccgcggtgcgcagctatgtcggcggcgaaagcctctggtcgaagggccagaaggatgccatctactacctcaccctctatgccgactcacgcgccgacgaagacttccgccgctacgaggaggccatcgcgatccccctcggcgaccgcgagatgcgccttgccctggaccagcccgacccggacatcgaggcggcccgccagggcatcctcaagggcggcaaccatgccgacgacgttaccgcgatcatctggctgtaccgcaacttccacgacttcagttacttcgagcgcgccatcgagctgtggctggtgggtga

SEQ ID NO: 13288 - DNA, 2052 bp, Pseudomonas aeruginosa
caagtacgtcatggaactgatcgacgtcgccggcaagatgcgcgcgggcatcggcgccgggcaggccagcgccgagcaggtgcaacagtggaagaccgagatccacgcgatcaacgagaaggtcacgccggcggccaaggccttcagcgacgcccttggcgagggctcgcgggccttgctcaggctgctgctggtggccaacctgaccaccgccagcgtgctcatcctcctggcgttcctgcggacccggcagcaactgatgcagcgccaggaagtggagaacgccctcgatgccgagcgcgaacgggcccagatcaccctggcctcgatcggcgacggagtgatcaccgccgacacccaggggggcatttcctacctcaacccggccgccgagcagatgaccaactggacgctggacaaggcccgcggcctgcccctggcgtcgctgttccggatcgtcgacgaaagctcgcgggaggagggcatgctgctgatcgagcagatcctcagcggcgagatcgacggcggtcgcgagcattccaagctggttctgcgtcacgacggcagcagcgtgccggtgaccctggtgggcgcgccgatccaccgtggcggcgagatcaccggggtggtcctggtgcttcacgacatgacccgcgagcgccagtacatggcgcgcctgtcctggcaggcgacccacgatgcgttgaccgggctgaccaaccgccgcgagttcgagtatcgcctgcagatagcgctggaacgcctggagcgcaacagcgggcggcacgccctgatgttcctcgacctggaccagttcaagctggtcaacgacacctgcggccacgccgccggcgacgaactgctgcgccaggtctgtaccctgctgcaacaaggcttgcgcgagggcgacacgctggcgcggctgggcggcgacgagttcggcatcctgctggagaactgtccggcggaaaaagccgtggagatcgccgaccatctgcgcaagaccatccaggacctgcacttcacctggagcgggcagccgttcaactgcaccgtcagcgttggcctggtgcacctgctgccgggtatctcgaccctcgaggaggcgctgcgctccgccgatatggcctgctacatggccaaggaaaagggccgcaaccgggtccaggtgttccatcaggacgacgtcgaactatcgatgcgcttcggcgagatgacctgggtccagcgcatccacctggcgctggaggaagaccgcttcagtctctatgcccagcccatcgtgccgctgggcgaaggtgcggaggagggcttgcacgtcgaactgctgctgcgcctgcgcgacgagggcgggcgcctggtgccgccgctgagcttcatacccgccgccgagcgctacggcctgatgacgctgatcgatcgctgggtggtggagaatgccttccgcacccttgtcgagcgcgcccaggaccctcgcgccgagccgatcggcacctgcgccatcaacctctccggcgcgaccatcggcgacgagtcgttcctgcagttcctcaccgagctgttcgcccgttaccgcattccgccgcagacgatctgcttcgaggtcaccgaaaccgtggcggttgccaacctggccagcgccatccgcttcatcaacgagctcaaggacaccggttgtcgtttctccctggacgatttctgcgctggcatgtcgtccttcatctacctcaagcacccgccggtggattacctgaagatcgatggcagcttcgtcaaggacatgctcgaggatcccatcgatcgcgccatggtccaggtgatcaaccatatcggccacgtgatgggcaaacgtaccatcgccgagttcgtcgagaccgtcgaagtcatggaagcgctgcgcgagatcggcatcgactatgcccagggcctggccatcggcgcgcccctgccgttcagtcgccagcctccgggcgcagggctggatgcccagggcctgtggccgagcctcggacagaacctccggtaggtgaccgcggagcgaagaaagagtag

SEQ ID NO: 13289 - DNA, 1053 bp, Pseudomonas aeruginosa
tttcgctgctatgaggccgttgccgagaagaagagaagggagacgggtgtgagcgagttctttgaccgtacgggccccttgcaggaggcgggaagctatccgcagtgggcgcagcaactgatcgtcgactgccaggcgagcaaggaccgggtttccggccacgagctgtaccggcgcatgcgcgacgccgagctgagcccggcgctgatgcgcctgtacctgatcggcggctggccggtggtcgagcagttccccttgtacatgtcgcagaacctgctgaagacccgtttcgcccgccatcccggcgaagacatggcgcgccgctggctgatgcgcaatattcgggtcgaactcaaccacgccgactactggctgcactgggccgaggcccacggcgtgagcctggccgagatccaggcgcaagacgtgccggccgaactgcacgcgctcagccactggtgctggcacacctgcgccagcgactcactgccggtggccatggccgccaccaactacgccatcgaaggcgtcaccggcgagtggtcggcgctggtctgttcgaacggcgtctacgaaaacgccttccccaaggaaggccgcaagcgcgccatgaagtggctcaagctccacgcccagtacgacgatgcccacccctgggaggcgctggagatcatctgcaccctggccggcaccaatcccagcgccgagctgcgccggcaactgcgcgacgcgatctgcaagagctacgactacatgtacctgttcctcgagcggctgcatgcagctggaggaggcgcgcagcgccccgcaagctcgcggtcggcgcggagtagtcttgcgcgcagcgggaatcccggcgtgttccgccgggattccgctggtcctcaaggcaccaggatgatcttctcgcaggtgccttcgttcactgcccggtactgctcaacgccctgctccagcgggacttcccgcagcccgtccggcagcggcaggcggccctggtcgaacagcttgccgaaggcgtcgaggaagcctgcgcaggcttccacgccatag

SEQ ID NO: 13290 - DNA, 420 bp, Pseudomonas aeruginosa
agcagcgagttgatccccaccaccgagccaccgcggcggtacaggttcaatgcgggtaggcgcacatggccgtcggccggtgcggcgatgatcgccaggcgaccgaaggcggccagcgccgggaccgccgcctcgagccagaaaccggtcgtatcgaagatcacctcggccccgccggggaagatcccttccacctgtgccgccagttcggccggctcgcccagcagcagcgcggcgatgccctgcgtttccagcgcctggcgttgctcctcgcgccgcatcgcgccgatcgcttcggcccccagggccttggccagcgccagcgcggccttgccgaccgcgccgttggcgccgattaccaggagccgggtgccggccttgacctggctgcgttgcagggcgtcccaggcggtgctgtag

SEQ ID NO: 13291 - DNA, 186 bp, Pseudomonas aeruginosa
tccgtgagtccttccttcgcccagccgaccgcccgccgccacgcgccccgcatggcgcccgccgtgcgcctgccgcctgagccgcacggccccgtttcgcctccgacaacaataaatttccacttgcgtgagataattcaatggacggccaacatccgcattcgggcgagctcaagcgcggcctga

SEQ ID NO: 13292 - DNA, 789 bp, Pseudomonas aeruginosa
aggccgggcgcggcaaggtggatttctgagccggccggtcttcgcgacggatcagcgtacggcctgggccaccggctggccgaggccgcgctcgcggtcgcgttgcaggcgataggccttggccgcggccgggatcgcagtgacctggccggtttccagccagcgtcgcaggcgcgtggcgtcggcgaagtgggtgtatttgccgaaggcgtccagcaccaccagattgaccggactgcggttgatcgtggtgcgcatcaccaggcagtggcctgcctcgttggtgaagccggtcttggtcaactggatgttccaggtcttgttgttgatcaggtggttggtgttgcggaagcccagggtgtagttggggttgcggaaggccacggtcttctccggagtggtgctccactgactgagcagcggatattgccggctggccaccagcaggcgggtgaggtcgcgagcggtggagacgttgtgcagcgacagcccggtcggctcgacgtagcgggtgttcttcattcccagggcgtgggccttggcgttcatcgccttgacgaaggcgttcttgccgcccggatagttctgcgcgaggctggcggcggcgcggttctccgaggacatcagggcgagcaggagcatgtcccggcggctgatctggctgccgacccgcacccgggaaaacaccccgcgcatttcgctggtctcgctgatggcgatcggcagtacctcgtccagcggcagtttcgagtcgagcacgaccatggcggtcatcagcttggtgattga

SEQ ID NO: 13293 - DNA, 564 bp, Pseudomonas aeruginosa
agtcgccggccaggcgcaaggcgccggtgccgccgggcgtctgggtggcgtcggcgcgttgctccagcaacagcggcgaggcggcgccgagcgccagttccgccaggcgcgcggcgaacagcgcatcgccgtggccgccgacgtagctcttggtggtttcctgctcgaccaggcgctgctcggcgagtttcaccgagcgcaggatcggggtcaggccctgggcatccttgtagacaccgacgccgaggtccagcttgtccgcgcgcggatcgttgcggtaggcgtcgagcaggcccaggatcgggtcgcccggtacgcgggcgaccttggcgaaatgactcatttgcgcccctcggcggttttcgctacctcgtcggtgcgcgccgccatgatgaaatcgttgcggtgcaggcccttgatcgagtggctccaccaggtcacggtgactttgccccactcggtcagcaggcccggatggtggccttcggcctcggatatctcgccgacggcattggtgaaggccagggcatgcttgaagttcttgaacaggtagaccttctctag

SEQ ID NO: 13294 - DNA, 1605 bp, Pseudomonas aeruginosa
aaaaccggccgcgagcccatcagaacgacaacaccgggccacgccatgcgtatcaaagtgcactgccagaaccgtgtaggcatcctccgcgacatcctcaacctgctggtcgactacggcatcaacgtcaatcgcggcgaagtcggcggcgaccagggcaacgccatctacctgctctgtccgaacatgatcaacctccagttgcagtcgctgcggcccaagctggaggcggtgccgggggtcttcggcgtcaagcgcgtcggcctgatgcccagcgagcgccggcacctggaactcaacgcgctgctcgccgccctggacttcccggtgctctcggtggacatgggcgggcagatcgtcgccgccaaccgtgccgccgcgcagttgctcggcgtgcgcgtcgacgaggtgccggggattccgctgtcgcgctatgtggaggacctcgacctgcccgaactggtgcgcgccaacaaggcgcggatcaacgggctgcgggtgaaggtgaagggcgacgtgttcctcgccgacatcgcgccgctgcaatccgagcacgacgagagcgaggcgctggctggagcggtgctgaccctgcatcgcgcggatcgcgtcggcgagcgcatctaccatgtgcgcaagcaggagctgcgtggcttcgacagtatcttccagagttcgcgggtaatggccgcggtggtccgcgaggcgcggcgcatggcgccgctggacgcgccgctgctgatcgagggcgagaccggcaccggcaaggagctgctggcgcgcgcctgccacctggccagcccgcgcgggcagtcgccgttcatggcgttgaactgcgccggcctgccggaatccatggccgagaccgagctgttcggctatggtccgggagccttcgagggcgcccgcccggagggcaagctcggcctgctggagcttaccgccggcggcacgctgttcctcgacggcgtcggcgagatgagcccgcgcctgcaggccaagctgttgcgcttcctgcaggacggctgtttccgccgggtcggcagcgacgaggaggtgtacctggacgtgcgggtgatctgcgccacccaggtagacctgtccgaactctgcgccaagggcgaattccgccaggacctctatcaccgtctcaatgtgctctcgctgcacatcccgccgctgcgcgagtgcctggatggcctggcgccgctcgccgagcatttcctcgaccaggccagccggcagatcggctgcggcctgccgaagctttccgcgcaggcactggaacgtctcgaacgctaccactggccgggcaacgtgcggcaattggaaaacgtgctgttccaggcggtttcgctgtgcgaagggggaacggtcaaggccgagcacatccgcctgccggactacggcgcgccgcagccgctgggggatttttccctggaaggagacctcgacgccatcgtcgggcgcttcgagaaggcggtgctggagcgcctgttccgcgaacatccgagcagccgccagttgggcaagcgcctcggcgtttcgcataccacggcggcgaacaagctgcgccagcatggcgtggggcaaagcgagggctga

SEQ ID NO: 13295 - DNA, 1836 bp, Pseudomonas aeruginosa
tcctgtcctacgtggccgagcacctgctcgaactgccgcgctcgttctgaagcgggagccgcccatgcagatcgaccgtctcgaccacctggtgctcaccgtccgcgacatcgacgccagcatcgatttctacacccgcgtgctgggcatgcgcgccgttaccttcggcgcgggtcgcaaggccctcgccttcggtgcgcagaagatcaacctgcaccaggccgggggcgaattcgaacccaaggccgagcgacctacgccagggtccgccgacctctgtttcatcgtcgccacgccactcgaggcggtggccgagcaactgcgccagcaggccgtggaaatcctcgagggcccggtgcagcgcaccggcgccggcgggccgatcctctcgctgtacctgcgcgaccccgacctgaacctgatcgaactgagcaacccgctgtaggccgtgtgcctcgggacaactacaagagagcgttggtcatgaccgactacacccagcaactcgccggctttctcgccggcctgcgctaccaggacctgccgccggcggtgttggcgcggatggaagaattgttcctcgactggctcggctcggcgctggccggcaagggccagcatccgatcccattgttcgagcgctacgccgaacgcatgggcccggccgacggtagcgcgcagatcctgcccagccggcggcgcagctcgccgtatttcgccgccctggtgaacggcgcggcttcccacgtggtggagcaggacgacctgcacaacagctcggtgctgcaccccgcggcggtggtcttccctgctgccctggccgcggcccaggacctcggccgcagcggcgccgagctgatcctcgcggcggtggccggctacgaggccggcatccgcatcggcgaattcctcggccgttcccactaccgggtgttccataccactgccacggtcggcaccctcgccgcggcagtggcggtgggcaagctgatggacttcgaccgcgagcgcttcgtcgacctgctcggcagcgccggaacccaggccgccgggctctgggagttcctccgcgacgccgccgattccaagcagttgcataccgccaaggccgccgccgacgggctgctcgccgcctatctcaccgccgacggcctgagcggcgcgcgacacatcctcgaaggcgagcaggggatggccgccgggatgtccagcgacgccgaccccgagcgcctggtggatcgcctcggcagccgctgggcgttgctggaaacctcgttcaagttccacgcctcgtgccgccatacccatcccgcggccgacgcgctgctggcgctgatgcagcgcgaagggctcgatcactcgcagatcgccgcggtcaccgcgcgggtccaccagggcgccatcgacgtgctcggccgggtggtcgagccgcagaccgtgcaccaggcgaagttctccatgggcaccgtgctgggcctgatcgccgtgtacggcaaggccggcctcggcgagttccatcggcatgcgctgagcgacccgcgggtcgcagcgttccgcgagcgggtcgagatgcgcctggacccggaggtcgatgccgcctatccgcagcgctggctcgggcgggtcgaagtgctcgatcgccaggggcggcgccataccgccgccatcgacgaacccaagggcgatcccggcaataccctcagccgcgacgaactggccgataagttccgccgcctgctggcgttctccggcgcggccaccgacgccgaggcggaaatcctcatccagcgcgcctggggcctgcgccaggcgccttccgtagcgccgctgatctga

SEQ ID NO: 13296 - DNA, 1272 bp, Pseudomonas aeruginosa
tcaaccgaaccagccgcacctcgtcttcgacggacgagggcagggagtccgacccatgacacaatcccaccgaccgcgcccgctcgacggcatcaccgtggtcagcctggagcacgccatcgccgcgccgttctgcacccgccaactggccgatctcggcgcgcgggtgatcaagatcgaacgccccggcgtcggcgatttcgcccgcggttacgacgagcgggtcaacggcctgtcgtcgcacttcgtctggaccaatcgttccaagcagagcctcagcctcgatctcaagcaggccgaggcgctgccgttgctggagaagctgctggccggcgccgacgtgctggtgcagaacctcgcgccgggcgccgccgcgcgcctgggcctgtcctacgaggcgttgcgcgagcgcttcccgcgactgatcgtctgcgatatctccggctacggcgaaggcggtccctacgagaagaagaaggcctacgacctgctgatccagagcgagggcggcttcctttcggtgaccggcggcgccgggccgaacgagatggccaaggccggctgttcgatcgccgatatcgccgccggcatgtacgcctacagcagcatcctttcggccctgctgctgcgcgagcgcaccggcgagggcagccgcatcgacgtgtcgatgctggagagcctggtggagtggatgggctacccgatgtactacgcctaccaggacgcgccgccgccgccgcgcgccggcgcttcgcactcgaccatctacccctatgggccattccccgccggcgacggcggcacggtgatgctcggcctgcagaacgagcgcgagtggcgggccttctgcgacaaggtcctgcgccgcccggaactggccgacgacgaacgcttctcggcgaacttcaagcgctcggccaaccgcgaggagctgcgtgcgctgatcgtcgaagccttcgccgccttgccggccgccgaggtggtggcgcgcctggaacaggcgcagatcgccagcgcccacgtcaacgacatggccggggtctgggcgcacccgcagttacaggcgcggcaacgctggacctccatcgacagcccggccgggcgcctgccggcgttgttgccgccggccagcagcagcgccttcgttccgcgcatggatgcggtgccggcgctgggcggcgacagcgacgcgctgcttgccgaactgggctgtaccgcggccgatatccagcgcctgcgcgcgaccggaacggtatgaggaggcggacatga

SEQ ID NO: 13297 - DNA, 3045 bp, Pseudomonas aeruginosa
gcaatggcgaattctccgaacgcgccggctgcgtcaggctcgtcgatacctcgaaagcacaacaacaatctgaggtcacgaaatgttcaagacgatggtacgggcgctgttgtgcgccctggcgatcggtggctcctgcctggcgaatgccgcgcagccgatcgtcatcaagttctcccacgtggtcgcggaaaacacgcccaaaggccagggcgcgctgctgttcaagaaactcgtcgaacagcgcctgggcggccgggtcgaggtagacgtctatcccaactcgtcgctgttcggcgacggcaaggaaatggaggcgctgctgctgggcgacgtgcagatgctggcgccgtccctggccaagttcgagcagtacacgcgcaaggtgcagatcttcgacctgccgttcctcttcgacgacatccaggcggtcgaccgcttccagcgcagcccgcaggggcgcgccttgctgaccagcatgcagggcaagggcatcctcggcctggcctactggcacaacgggatgaagcagctctccgccaatcgcccgttgctggagccggaagacgcgcgcgggctgaaattccgcgtgcaggcgtccgacgtgctcaacgagcagttccgccagctccgcgcgatctcccggaagatgtccttcgccgaggtctaccagggcttgcagaccggcgtggtgaatggcaccgagaacacctggtcgaactacgagagccagaaggtcaacgaggtacagaagtatttcaccgagtccaaccacggcttggtggactacatggtgatcaccaacgcgaagttctggaatggccttccggcggacatccgcgaagaactgcagcggatcatggacgaggtcaccgtgcaggtgaacctcgaggccgagcgcctcaaccgcgacgcccgccagcgcatcctcgccagtggcgccagcgagatccataccctgagcccgcagcagcgcgccgactggcgccaggcgatgcagccggtatggcagaaattccgcggcaatgtcggtgccgatctgctccaggccgccgaagcttccaaccgtcccgattgacccgtccggccccgcccggccgggcggggcatcgtggagaacgctgcgatgaatcgactcgtgcgcgtctggaaccgcttcgaggagggcgctatcgccttcctgctggcggcgatgacgctggtgaccttcctctatgtggtgatgaccaacgtcttcaccctgttctacgacctcggcgaccgcctgccgacactgcgggctccgctgtactcgatgggcgacgcgatcctcggggtagcccaggatatgtcctggagcaacgcgctgaccaaggcgctgttcggctggctgatcttcctcggcatcgcctacggcgtacgcaccgccggccacctcggggtggatgccctggtgcgcctggcgccgcgtcccttgcagcgcctgatcgggatactcgcctgcctctgctgcctgggctacgccgggctgttcatggtcgccagctacgactgggtgaagaccctgttcgtcgccggcatcggcgccgaggacctcgaccacttcggcatcctccaggcctacatcgcggtggtggtgccggtcggcttcggcctggtgctgctgcgctacctggaaatcctcgtcaacctgttgcgcggtcgccagctcgggctgggcctcgccgacgaggccgccgaggcctccaaactggccggcgaagaggccggggagaaccgtccatgaccgtgctgatcctgttcctgctgctgttcctgttcatgttcatcggcgtgcccatcgccatctccctggggctgtccggcgccctgacgatcctgctgttcagcccggattcggtgcgctcgctggcgatcaagctgttcgagacctccgaggcctacaccctgctggcgatcccgttcttcctgctctccggcgcgttcatgaccaccggtggcgtggcgcggcgcctgatcgacttcgccaatgcctgcgtcgggcatatccgcggcggcctggcgatcgctgcggtgcttgcctgcatgctgttcgccgcgctgtccggttcgtcgccggcgacagtggcggcggtcggctcgatcgctgtggccggcatggtccgctccggctatccgcgcgccttcggcgcggggatcatctgcaatgccgggaccctgggcatcctcatcccgccatcgatcgtgatggtggtgtacgccgccgccaccgagacctcggtgggcaagctgttcgtcgccggggtggttccggggctgctgctcggggtgatcctgatggtggtgatctacatcgtcgcgcgggtcaagaagctgccggcgcagccgcgcgccagcttccgcgagtggctggccgccgcacgccgtgcaggctggggcctgttgttgctggtgatcatcctcggcggcatgtattccgggctgttcacccccaccgaggcggcggcggtggcggcggtgtattcggccttcgtcgcgctgttcgtgtacaaggacatgcgcctgcgcgactgtcccaaggtgctgctggagtcggggcggctgagcatcatgctgatgttcatcatcgccaatgccatgctcttcgcccacgtgttgaccaccgagcagatcccccagcagatcaccgaatgggtggtgcaggaaggcctgaccccgatcggcttcctgctgatggtcaacgtggtgctgctggtcgccggcagcttcatggagccctcggcgatcgtgctgatcctggcgccgatcttcttccccatcgccatgaagctgggcatcgacccgatccacctgggcatcgtcatggtggtgaacatggagatcggcctggtacacccgccggtcggcctcaacctgttcgtcacttcggcggtcaccggcatgccgcttggggcgaccatccgcgcggcgctgccgtggctgatgatcctgctgctgttcctgatcctggtgacctacgtgccgttgatctcgctgtggctgccgggcctgctgggcatgagctga

SEQ ID NO: 13298 - DNA, 1449 bp, Pseudomonas aeruginosa
agccatgtctgcggcatccctgtaccccgtgcacccggaagcggtggcacggaccttcaccgacgaagccacctacaagacgatgtaccagcagtccgtcgtcaaccccgacggcttctggcgcgagcaggcccagcggatcgactggatcaagccgttcgagaaggtcaagcagacctccttcgacgaccatcacgtggacatcaagtggttcgccgacggcaccctcaacgtgtcgcacaactgcctcgaccgtcacctcgccgaccgcggcgaccaggtggcgatcatctgggaaggcgacgatcccgccgaccaccaggaaatcacctaccgccagctccacgagcaggtctgcaggttcgccaacgccctgcgcgggcaggacgtgcaccgcggcgacgtagtgaccatctacatgccgatgatccccgaggccgtggtcgccatgctcgcctgcacccgcatcggcgcgatccactcggtggtcttcggcggcttctcccccgaggccctggcaggacgcatcatcgattgcaagtcgaaggtggtgatcaccgccgacgaaggcgtgcgcggcggcaagcgcactccgctgaaggccaatgtcgacgacgccctgaccaacccggaaacctccagcgtgcagaagatcatcgtctgcaagcgtaccggtgcggagatcaagtggaaccagcaccgcgacgtctggtacgacgacctgatgaaggttgccggcagcacttgcgcacccaaggaaatgggcgccgaggacccgctgttcatcctctacacctccggctccaccggcaagccgaagggcgtgctgcataccaccggcggctacctggtgtacgcctcgctgacccacgagcgggtcttcgactaccgtccgggcgaagtctactggtgcaccgccgacatcggctgggtcaccggccacacctacatcgtctatggcccgctggccaacggcgccaccaccattctgttcgagggcgtgccgaactaccccgacgtgacccgcgtggcgaaaatcatcgacaagcacaaggtcaacatcctctacaccgcgccgaccgcgatccgcgcgatgatggccgaaggcaaggcggcggtggccggtgccgacggttccagcctgcgtctgctcggttcggtgggcgagccgatcaacccggaagcctggcagtggtactacgagaccgtcggccagtcgcgctgcccgatcgtcgacacctggtggcagaccgagaccggcgcctgcctgatgaccccgctgccgggcgcccacgcgatgaagccgggctccgcggccaagccgttcttcggcgtggtaccggcactggtggacaacctcggcaacctgatcgagggcgccgccgagggcaacctggtgatcctcgactcctggccgggccaggcgcggaccctgttcggcgaccatga

SEQ ID NO: 13299 - DNA, 732 bp, Pseudomonas aeruginosa
aaaccgcggaactgtgagtcaaggggccctatcgtgatcttcgatttctccgtcatctgggacagccttccgctctatttcgacggcctgctggtcaccctcaagctgctctcgatctccctgctgatcggcctgctgctggcggtgccgctagcgctgatgcgggtctccaagcagccgctggtgaacttcccggcctggctctatacctacgtgatccgcggcacgccgatgctggtccagctgttcctgatctactacggcctggcgcagttcgacgcggtgcgcgagagcgcgctgtggccctggctgtcgaacgcgtccttctgcgcctgcctggcgttcgccatcaacaccagcgcctacaccgccgagatcctcgccggcagcctgaaggccacgccccatggcgagatcgaggcggccaaggcgatgggcatgtcgcgcctgaagatgtaccgccgtatcctcctgccgtcggccctgcggcgcgccctgccgcagtacagcaacgaagtgatcatgatgctgcagaccaccagcctggcgtccatcgtcaccctggtggacatcaccggcgccgcgcggaccgtctactcgcagtactacctgccgttcgaggcgttcatcaccgccggcctgttctacctgtgcctgaccttcatcctggtgcgcctgttcaagcttgccgagcgccgctggctggcctacctggcgccgcgcaaatcctga

SEQ ID NO: 13300 - DNA, 1023 bp, Pseudomonas aeruginosa
agcagccggttgcgcctgctggaggcggaaggccgcctgcgcggcaccgtccagctggtgccggtgggcaatccggtcggtctcgggcagatgatccaggcgctgcaccaggggcgcttcgaaatgagcagcggggcgcaacttcaatcgcgatttccccgacctgctggacgcggtgatcgacagcgtcggcgagcgtctcggcagcgatccggcggccaatgtcgcgctggtccgccaggccctgcgcgcggcgctggacgccctgccgccggcgacctcggaactggagggcatgcagcgcgtgctctatcgccacgcctgcgacgccgacctggtgctcgacctgcattgcgacttcgaggccgccatccatctctataccctgccgcaacaatggcccaccttcgcctccctggccgcacgcctgggcgccgctgtcgggctgctcgccgaggagtccggcggcggttccttcgacgaggcctgctcggtgccgtggctgcgcctgtcgcgcctgtatccgcgcgccgagctgccgctggcctgcctggcgaccaccgtcgaactcggcggccaggccgacaccaccgtgcagcaggccgaggccaacgccgcggcgatcctggccttcctcgccgagcagggcttcgtcgagggcgaatggccggcggcgcccgaagcctgctgcgaaggcttgcccttcgagggcaccgaatacgtccacgccccgcataccggcgtggtgagtttcctgcgccggccgggcgaatgggtggaggcgggcgaaccgctgttccaggtcatcgatcccctggccgaccgtgccagcaccgtgtgcgccggggtttccggcgtgcttttcgccatcgaacggatgcgctacgcgcagccgggactctggctggccaaggtggccggtcgtcaaccgatccgtcagggacgcttgctcagcgactgattagccgagaacacacacatgtacaaactggaagtccaagacctgcacaagcgctacggtag

SEQ ID NO: 13301 - DNA, 744 bp, Pseudomonas aeruginosa
ccacgaggtgctcaagggcgtctcgctggcggcgaaagcgggcgacgtgatcagcatcatcggctcgagcggttccggcaagagcacctttctgcgctgcataaacctgctggaacagccgcacgccggcaagatcctgctcaacggcgaggagctgaagctggtgcctggccgcgacggcgcgctgaaggccgccgactcccgccagttgcagcgcatgcgctcgcgcctgtcgatggtgttccagcatttcaacctgtggtcgcacatgagtgccctggagaacgtcatcgaggcgcccgtgcatgtgctcggcgtgtcgaagaaggaagccatcgagaaggccgagcactacctggccaaggtcggcgtggcgcaccgcaaggacgcctacccggcgcacatgagcggcggcgagcagcagcgcgtggcgatcgcccgggcgctggcggtggagccggaagtgatgctgttcgacgagccgacctcggcgctcgaccccgaactggtgggcgaagtgctgaaggtcatgcaggacctggcgcaggaaggccgcaccatggtggtggtgacccacgagatgggtttcgcccgcgaggtgtcgaaccagttggtgttcctgcacaagggcctggtcgaggaacacggctgcccgaaggaagtcctcgccaacccgcagtcggaccgcctcaagcagttcctctccggcagcctcaagtaacattcatcgcagaggccggctaa

SEQ ID NO: 13302 - DNA, 999 bp, Pseudomonas aeruginosa
gctgctcccatgactgcccaaccccaacgcatcggtttcctcctctggcccgccacccgcgcgctgacgctatcgcttgccgaggaagccctgcgggcggcccggcggttgcaccccgaggtgctctacgagccgctgttcctgctcgccgaagcgccggccgaagaggagggctggcgcctgccgggaacggcctggaacggtaggctggagcaatgctcgcggctgttcctggtcgccgacgaggcgccggcggcggtgtcgccagcgctgggcctggcgctcaagcaactggcgcgttcgggagcggcgatcggcgcgctgtccgccggcatctacccgctggcccagctcggcctgctcgacggctatcgcgccgcggtgcactggcgttggcacgatgacttcaccgagcgcttccccaaggtcatcgccaccaatcacctgttcgagtgggatcgcgaccgcatgaccgcctgcggcggcatggcggtactcgacctgctgctggcgctgctgtcccgcgaccatggcgctgaactggccggcgcggtctcggaggagctggtggtggagcgcattcgcgaaggcaacgagcgccagcgcatcccgctgaagaatcgcctcggctccagccatccgaagctgacccaggcggtactgctgatggaagccaatatcgaggagccactgaccaccgatgagatcgcccagcatgtgtgtgtttcgcggcgccagttggaacggatcttcaagcaatacctgaaccgcgtacccagccagtactacctggagctgcgcctgaaccgcgcgcggcagatgctgatgcagaccagcaagtcgatcatccagatcggcctgtcctgcggtttctcttccgggccgcatttctccagcgcctaccgcaacttcttcggcgtcactccgcgcgaggaccgcaaccagcggcgcggcggcagcgccttcgagacgaccttcactcccgtcgaacgcggctga

SEQ ID NO: 13303 - DNA, 1308 bp, Pseudomonas aeruginosa
caagttgtcgcatggcggcaatgccggcccggtcccaatccctacaatcctttcatcgatagccgccttcaggcaggagaaacaccgatgtccgctccccatgcgcaggtagaacgtgccgatttcgaccggtatatggtccccaactacgcccccgccgccttcattccggtgcgaggcgagggatcgcgcgtctgggaccaaagcggccgcgaactgatcgatttcgccggcggcatcgccgtgacctccctgggccacgcgcatccggcgctggtcaaggcgctcaccgagcaggcccagcgcatctggcacgtttccaacgtcttcaccaacgagccggccctgcgcctggcgcgcaagctggtggacgccaccttcgccgagcgggtgttcctcgccaactccggcgccgaagccaacgaggcggccttcaagctggctcgccgctacgccaacgatgtctacggcccgcagaagtacgagatcatcgccgccagcaacagcttccacgggcgcaccctgttcaccgtcaacgtcggcggccagccgaagtattccgatggcttcgggcccaagttcgagggtatcacccacgttccctacaacgacctggaagcgctgaaggcggcgatctccgacaagacctgcgccgtggtgctggaaccgatccagggcgagggcggcgtgctgccggcgcagcaggcctacctggaaggggcgcgcaagctgtgcgacgagcacaacgcgctgctggtcttcgacgaggtccagagcggcatgggccgggtcggcgagctgttcgcctacatgcactacggcgtggtcccggacatcctctccagcgccaagagcctgggcggcggcttccctatcggtgcgatgctgaccaccggcgagatcgccaagcacctgtcggtcggcacccacggcaccacctacggcggcaacccgctggcgtcggcggtggccgaggcggcgctggacgtgatcaataccccggaagtgctggatggcgtgaaggccaagcatgagcgcttcaagtcccgcctgcagaagatcggccaggagtacggcatcttcgacgagatccgcggcatgggcctgctgatcggtgcggcgctgaccgacgagtggaagggcaaggccagggatgtgctcaacgccgccgagaaagaggcggtcatggtgctccaggccagcccggacgtggtgcgcttcgcgccgagcctggtgatcgacgacgccgagatcgacgaaggcctggagcgcttcgagcgcgccgtggccaagctggtccgcggctga

SEQ ID NO: 13304 - DNA, 1032 bp, Pseudomonas aeruginosa
gaaaggagtgacgccatgttggtgatgcgccccgcccaagcggccgacctgccacaggtgcagcgtctggcggcggacagcccggtaggcgtcacgtccttgccggatgacgccgaacgcctgcgcgacaagatcctcgcttccgaggcctcgttcgccgcggaggtgagctacaacggcgaggaaagctatttcttcgtcctcgaggacagcgccagcggcgagctggtcggctgctcggcgatcgtcgcctcggccgggttctcggaaccgttctacagcttccgcaacgaaaccttcgtgcacgcctcgcgctcgctgtcgatccacaacaagatccatgtcctctcgctgtgccacgaccttaccggcaacagcctgctgaccagtttctacgtacagcgcgacctggtgcagagcgtctacgccgaactcaactcgcgcggtcgcctgctgttcatggccagccatccggagcgcttcgccgacgcggtggtggtggagatcgtcggctacagcgacgagcagggcgaatcgccgttctggaacgcggtcgggcgcaacttcttcgacctgaactacatcgaggcggaaaagctctccgggctgaagagccgcaccttcctcgccgaactgatgccgcactatccgatctatgtgccactgttgccggatgccgcccaggagtccatgggccaggtccacccgcgagcgcagatcaccttcgatatcctgatgcgcgaaggcttcgagaccgacaactacatcgacatcttcgatggcggcccgaccctgcacgcgcgtacctcggggattcgctcgatcgcccagagccgggtggttccggtgaagatcggcgaggcgccgaagagcgggcgtccatacctggtcaccaacggccagttgcaggacttccgcgcggtcgtgctggacctggactgggcgcccggcaagccggtggccctgagtgttgaagccgccgaggccctgggcgtcggcgaaggcgccagcgtgcgcctggtagcggtctga

SEQ ID NO: 13305 - DNA, 426 bp, Pseudomonas aeruginosa
cgctcaaggcctggatccaggccggcctgccggccggcgtgctcaacctggtccagggcggtcgcgaaaccggcgtcgcgctggccgcccaccgtgggctcgacggtctgttcttcaccgggtccagtcgcaccggcaacctgctgcacagccagtttggcggccagccgcagaaaatcctggcgctggagatgggcggcaacaacccgctggtggtggaggaggtcgccgacctcgacgccgccgtctacaccatcatccagtccgccttcatctccgcaggccagcgttgcacctgcgcccgccgcctgctggtgccgcagggcgcctggggcgacgcactgctggcgcgcctggtggcggtcagcgctaccctgcgggtcggtcgcttcgacgaacagccggcgccgttcatgggcgcggtga

SEQ ID NO: 13306 - DNA, 291 bp, Pseudomonas aeruginosa
tccgctactccgatttcgctgcggcgatccgtgaagccaacgccacccagtacggcctggccgccgggttgctgtcggattcccgcgagcgtttcgagcagttcctcgtggaaagccgcgccggcatcgtcaactggaacaagcagctcaccggcgccgccagcagcgcgccgttcggcggtatcggcgcgtccggcaaccaccggccgagcgcctactacgccgccgattactgcgcctatccggtcgcctcgctggaaagccccagcgtgtcccttcctgccaccctga

SEQ ID NO: 13307 - DNA, 1008 bp, Pseudomonas aeruginosa
ggacatcccatgctcgccctcggcaaactgctcgacttgaccctggccggccgcgagccgaccgagaagatccagctcaccgccgacggcacccgcctgcactggctggccgagggcgcgctggaagtcacgccgatcggcgcccgcgataacggcgtcgacctgttgctctcggccggtatccacggcaacgagaccgcgcccatcgaactgctcgaacggctgatccgcaaggtcgccgctggcaccctcaagcctgccgccagggtcctcttcctgttcggcaaccccgaagccatccgccgcggcgagcgctacgtcgaacaggacatgaaccgcctgttcaacggtcgccacgaggagggcagcggcaacgaggccttccgtgccgccgagctggagcgcctggcccaggtgttcttcagcaagaccgagcgagtccacctgcactacgacctgcataccgcgatccgcggctcgaagatcgagcagttcgccctctacccctgggccgagggccgccagcattcccgcagcgaactggcccgcctgcgcgacgccggcatcgaggcggtgctgttgcagaacaagccgggcatcaccttcagcgcctacacctacggccagctcggcgcggaggcctttaccctggaactgggcaaggcacgtccgttcggagagaaccaggaggtcaacctggagcgcctggagcggagcctggagctgctgatcgacggcagcgaggaacagccggacggctcccggctcgacggcctcaagctgttcagcgtgtcgcgcgaggtgatcaagcacagcgaccacttccgcctgcacctcgacgacgacgtggccaacttcaccgaactctcgccgggctacctgctggccgaggatatcggcggcacgcgctgggtggtggacgaggtcggcgcgcgcatcatcttccccaatccacgggtgaagaacggcctgcgtgccggaatcctggtggtgccggccaagctctga

SEQ ID NO: 13308 - DNA, 1149 bp, Pseudomonas aeruginosa
ggcgtatcggccttccctctcgatcatgacggagcgcttcggcgctccgtttccgttgcggccgggaagatttcccgacttcccttgtggctgtcggtagagcgccgtaggatcgggcttttccgccgaaccgaggagccctccgtgcctgtcatcgacctgcgcagcgacaccgtcacccagcccaccgccggcatgcgcgaagccatggccgcggccgaactgggcgacgacgtctatggcgaggaccccacggtcaaccgcctggaggccgaactggcggcgcgcctgggcttcgccgcggcgctcttcgtaccgaccgggaccatgagcaacctgctcggattgatggcccactgcgagcgcggcgacgaatacatcgtcggccagcaggcgcatacctacaaatacgagggcggcggtgccgcggtgctgggctcgatccagccgcagccgatcgacggcgaggccgacggatcgctccacctggacaaggtcgcggcggcgatcaaggccgacgatttccacttcgccaggacccgcctgctggccctggaaaacaccatgcagggcaaggtgctgccgctcgactacctggccgcggcgcgcgccttcactcgcgcgcgtggcctggccctgcacctggatggcgcgcgcctgtacaacgcggcggtgaagctgggcgtagacgccagcgagatcacccgacacttcgactcggtgtcggtgtgcctgtccaagggcctcggtgcgccggtgggctcggtgctttgcggcagcgtagaactgatcggcaaggcccgtcgctggcgcaagatggtcggcggcgggatgcgccaggccggcctgttggcggctgccggcctgtacgccctcgaccaccaggtggcacgcctggccgacgaccacgccaacgccgcgcgcctgggcgacgggctgcgcgaactgggctatgcggtggagccggtgcagaccaacatggtctatgtcgatgtcggcgagcgggcggtcgcgctgcgcgacttcctcgccgagcgcgaggtgcggatcagcgcggcggcgcgtttgcgcctggtcacccacctggacgtttccgccgagtccataggacaagtactggatgccttcgcggcctttcgtcgctcataa

SEQ ID NO: 13309 - DNA, 321 bp, Pseudomonas aeruginosa
ccgttcggcaggaactttcattccggcgggactggtcaatactgggtgaaggatcgcgctcttgatttctgcggatccgccgccatttcttttttgcagactgttgtcctgaaatattcgcgtgaggagaaaggaatgctgattctgactcgtcgggtcggagagaccctgatggtaggtgacgacgtcaccgtgacggtactgggtgtcaaagggaaccaggtgcgcatcggcgtcaacgcgccgaaggaagtcgccgtgcaccgggaggaaatttaccagcgcatccagaaagagaaagatcaagagccaaaccattaa

SEQ ID NO: 13310 - DNA, 573 bp, Pseudomonas aeruginosa
tgcgagcggccagccaggtgggccggccaaggagggaataccatgtttcaaagtaccgagcaggcgctggccgtggcctactggatgttcgagcaccagccgggaccgaagtcgtcgacggcgatggtgatcgatggcctgcgcgagcgcttcgatcgcagcttcatcgaacacctgcccagcggtttgagtccgcacgaatggcaggcccaggcggtgatgaccgtgcgtttcgcccagcgccagctggctgcgcacccactggagctggcggtggtgcgggccgagttcgcccgcgggcgggatttcgtccttggcctggcggctttgcgcgactggctgaagcccggggccgacccgatcgagcagcgggcaaccctggccttgctgatgcgcatgttccgtcgtccgccgtcgagcatccgcgagatcgagcgactcagcggcctgtcgaagagcaccctgcatcgctgggacaaggaatggcgcgagcgggtcgtcgctttgctgcgccaggccttgcagcggctggaggagccgatggcggaggtggggatcgtgggcgagcgctaa

SEQ ID NO: 13311 - DNA, 366 bp, Pseudomonas aeruginosa
ccggcggcatcggcatgctcgagtggatgcgtggcggcgaactgcccagctggatgcgcgggctgttgcgccgccggggaggcaagtccgatggttgatccgctgtccaccctgaccgtgctggtctgctcggcgatctgcatgcgcctgatcacctatcgccgcgccggcgcgcgtttccgccccggcgtttccctgtgcgcctacctgctggcgttgtgcaccggctgccaggcgctgggaatagtggccgggttgtatcgtgccgagcacctctcgccgtggatgctcggggtactgctggtgctgctggtcctgctgttgcaggcgcgcggcaacctggcgcgggtcctgcgcctgcattga

SEQ ID NO: 13312 - DNA, 1488 bp, Pseudomonas aeruginosa
cccctttggcgtgctccgctactgggggtggagcgcgctatgaccgaagtagaagccaagaagccgcaggaaagcctgcaggaccgcctagcgcaggtggtcgagctgctgcatcgccacaaggtggtggaagacctgacccatcgtcaggaaggccagcaccatgaccgggtggaaaacctcgtccaccggcagaatctcgtagaactccagcgcaagctggaggaactgcaccccgccgacatcgcccacatcctcgaatcgctgccgctggacgaccgcctgacggtctggcaactggtcaagtccgaggacgacggcgacatcctcctcgaagtctccgacgcggtccgggaaaccctgatcgcggacatggacgaccacgagatcatcgccgcgaccaaggacctggacgccgacgaactcgccgacctggcaccggaactgccgcgcgacgtggtccatgaactgatggaaagcctcgacgcgcagcagcgcgagcgagtgcgttcggcgctgtcctacgaggaggaccaggtcggcgcgctgatggacttcgagatggtcaccatccgcgaggacgtcagcctggaagtggtgctgcgctacctgcgccgcctgaaggaactgcccgggcataccgacaaactgttcgtggtcgactacgacggcgtgctcaagggcgtgctgccgatcaagcgcctgctggtcaacgatccggacaagcaagtgctggaagtcatggccaccgacccggtgaccttccacccggacgaggacggctacgacgccgcccaggcattcgagcgttacgacctgatttccgcgccggtggtggacaagggcggcaagctgatcggtcgtctgaccatcgacgagatggtcgacctgatccgtgaggaaagcgaaagcgaagtcctcaacatggccggtctgcgtgaagaagaagatatcttcgcctcggtctggaagtcggtgcgcaaccgctgggcctggctggccaccaacctgatcaccgccttcgtcgcctcgcgggtgatcggcctgttcgaaggctccatcgagaaactggtggcgctggccgcgctgatgccgatcgttgccggcatcggtggcaattccggcaaccagaccatcaccatgatcgtccgcgccatcgcgctcgaccaggtacagccgaccagcaacagtcgcaaccgcctgctgcgcaaggagcttggcgtcgcgctggtcaacggcctggcgtggggcggagtgatcggcgtggtggccttctatctttacggcaactgggaactgggcgtggtgatgaccgccgcgatgaccctgaacctgctgctggcggcgatgatgggagtgctgatcccgatgaccctgcatcgtttcggacgcgatccggcgatgggctccagcgtgatgatcactgcgatgaccgacagcggcggtttcttcatcttcctcggcctggcgacgatcttcctgatgtag

SEQ ID NO: 13313 - DNA, 1422 bp, Pseudomonas aeruginosa
cgcaggctgcgtagtacgtcgttgttgagcatcgtgctctccggaacggttggcgatgaaaaagccccgcggggcggggctcttcaggggggctcagaccagctcggcccagaggtcgtactcgtcggcatcggtgatgcgcacgcggaccttgtcgcccggcttcagctcgtcgctgtcgacgaacacgttgccgtcgatttccggagcgtcggcccaggagcggccgaccgcgccctgttcgtcgacttcgtcgatcagcacttcgatttccttgcccaccttgagctgcaggcgagcggcggaaatcgcctgctggtgggccatgaagcgttcccagcggtcctgcttgacctcgtccggcaccggctccaggcccagctcgttggccggagcgccttcgacgggggagtactggaagcagccgacgcggtcgagctgggcttccgtcagccagtcgagcaggtactggaagtcttcttcggtttcgcccgggaagccgacgatgaaggtcgagcggatggtcagttccgggcagatctcgcgccactgcttgatccgggccagggtcttgtcctcgaaggccgggcgcttcatggccttgagcaccttcgggctggcgtgctggaaggggatgtcgaggtacggcaggagcttgccggcggccatcagcgggatcacgtcgtcgacgttggggtacgggtagacgtagtgcaggcgaacccacacgcccatgctgctcagcgcctcgcagagttccttcatgcgggtcttgaccggctggccgttccagaagtcggtcttgtacttcaggtccacgccgtaggcgctggtgtcctgggaaatcaccaggagttccttgaccccggccttgaccaggcgctcggcctcgctcagcacgtcgccgaccggccggctgaccagcttgccgcgcatggacgggatgatgcagaagctgcaactgtggttgcagccttcggaaatcttcaggtaggcgtagtggcgcggggtcagcttgacgccttgcggcgggaccaggtcgaccagcgggttgtgttcggtcttcggcggcaccacttcgtgcaccgcggtaaccacctgctcgtactgttgcgggccggtgaccgccagcacgcttggatgcacgtcgcggatcgcgtgctcttccacgcccatgcagccggtgacgatgaccttgccgttctcggcgatggcttcgccgatcacttccagggactcggccttggcgctgtcgatgaaaccgcaggtgttgaccaccacgacgtcggcgtcttcgtaggtcggaacgacctcatagccttccatgcgcagctgggtgaggatgcgctcggagtcgaccagcgccttggggcatccaagactgacgaagccgactttgggagtgggggtggacatggctaa

SEQ ID NO: 13314 - DNA, 1983 bp, Pseudomonas aeruginosa
cagtccgtggcctcggcgcttgcatcgcggacggcatgggcgcagcatttgccgaatttttccgggggaaagcgtttcatgagtgatgcagcgacgcgtgccgaggagacttcggaggggcattccagctctgccatcggcctgatggtcggggcggttggagtctgctatggggatattggcaccagtcccttgtataccctgaaagaggtcttcatcggcggctacggggtgcaggccaaccacgatggcgtccttggcgtgctgtcgctgatcttctggtcgctggtctgggtcgtttccatcaagtacgtgatcttcgtcctgcgtgccgacaaccagggcgagggcggggtgatggcgctgtcggccctggcgcgccgggcggcggcgccgttcggcaggctgcagaccttcgtggtggttgccggcctgatcggcgcggcgctgttctacggcgacagcatgatcaccccggcgatctcggtactgtcggcggtagaagggctggagatcgccttcgacggcctggagcactggacggtaccgctggcgcttatcgtgctgatcggcctgttcctgatccagaagcacggcaccgcgcggatcggcatcctgttcggcccggtcatggtgctctggttcggcgccctggcggcgctgggcgtctacggggtgatccagcagccggaagtgctgcaggcgatgaaccctgtatgggccgtgcgtttcttcagctcgcatcccggcatcggtgtcgccatcctcggcgccaccgtactggcgctgaccggcgccgaggcgctgtacgccgacatgggccacttcggtcgcaagccgatcgcccgtgcctggttcctgctggtgctgccggcgctggtgctgaactacttcggccagggcgcgaccatcctttccaacgccgaggcggcgcgcaaccccttctacctgctggcgccgggctgggcgctgctgccgatggtggcgctgtccaccctggccacggtgatcgcctcccaggcggtgatctccggcgccttctccctgacccgccaggcgatccagctcggctacgtgccgcggatgaccatccagcacacttccagccacgagcaggggcagatctacatcggcggggtgaattgggcgctgatggtcggcgtggtcctgctggtgctcggcttcgagtcctcggcgtcgctggcggctgcctacggcgtggcggtgaccggaaccatgctgatcaccaccctgctgatgggcgtggtgatctggcgcctgtggaaatggccgctgtggctgggcgtcccgttcttctgcgtgatgctcgcggtggacagcctgttcttcgccgccaacctgcccaaggtgatccagggcggcgccttcccggtcatcgcgggtatcgtcatcttcatcctgatgtccacctggaagcgtggccgccaactgctggtggagcgtctcgacgagggctcgctgccgctctcggtgttcatttccagcatgcgcgtgcagccgccgcaccgggtccaggggaccgcggtgttccttaccgcgcgtaccgacgcggtgcctcacgcgctgctgcacaacctgttgcacaaccaggtgctgcacgagcaggtggtgctgctcaccgtggtcaacgaagacagcccacgggtttcgccggatcgccgtttcgaggtcgaggcctatggcgacgggttcttccgggtgatcctgcacttcggcttcatggaagagccagacatcccggctgccttgcgcctgtgccatctcaacgaactggacttcagcccgatgcgcaccacctacttcctcagccgggagacggtgattccatccaagcgcatcggcatggcgcgctggcgcgaggggttgttcgccttcctgctgaagaacgccaacggcaacctgcgctatttcaacctgccgctcaaccgggtgatcgagttgggaacccaggtcgagatctga

SEQ ID NO: 13315 - DNA, 1239 bp, Pseudomonas aeruginosa
gcagggtgtaacggaaatcgtgttcagccatggagcctccaatcagccgcgcatgctaccacgccatcaggcccggacccgattgcgtggcgtcccgtcctgccaggcgtcgatgttgtccagggtggtgtcggcgatcgccgccagcgcctcgcgggtaaggaaggcctggtgggcggtcaccaccacgttggggaagctcagcaggcgtgccagcacgtcatcctgcaggggctggtcggagcgatcctcgaagaagatatccgcttcctcttcatagacatcgaggccgaggtagcccagttgtccgctcttcagcgcctcgatcagcgccgcggcgttcaccagggcgccacggccggtattgatcagcatcgcgccgggtttcatcgtcgccaggcgctgcgcgtcgatgaggtggcgggtgtcggcggtcagcgggcaatgcaggctgacgatgtcggactcggcgagcagggcgtcgagcgacaggtagcggccgccgagtgcttggatgcgcggattgggatagggatcgtaggccagcagctcgcagccgaagccggccatgatgcgggcgaaggtctcgccgatctgtccggtgccgatcactccgacgcgtttgccgtggaggtcgaagccggtcagcccatgcagcgagaaatcgccctcgcgggtccggttgtaggcgcggtgcaggcgccggttgagcgtcaggatcaggccgaccgcgtgctcggcgacagcgtgcggcgaataggccgggacgtgcaccaccggcaggccgagcgcttcggcggcggccaggtcgacgtggttgtagccggccgagcgcagggcgaccaggcgcgtgccgccggccgccaggcgttccagcaccggccgcgagaggtcgtcgttgacgaaggcgcagactacttcgaagccctgggcgaggaccgccgtgtccgcctgcaggtgggcctgctggaagtgcagttcgaagccgtgccggtggttgctggcctggaagctctcgctgtcgtaggcctgggtgctgaagaacaggatgcgcatggtcagagttcgctggagtcgaggctggtggaggacaggtgggtggtggccgaggcagtgtcggccagggcctcgatggccttgtccagctcgtccagggccgcggccgccgccggatcgttctgcttgagcagggtttcgctggtctggcaggccgcgcgcaactgcggcacgccacagtag

SEQ ID NO: 13316 - DNA, 783 bp, Pseudomonas aeruginosa
agcaactcctgcagcttgcgttgcagcttgcgggtgcaggcgggcttggcctcgacctgttcgtcgggcagggtcgcgtggtattgcgcctgctcggtggtcgggcaaagcaccagggtcttgcagccgagccgttcgaattcccagaacgactggctcagctcttccggcggatggatcgcggccgagacgccgagcaccgccaggctgatcggcaactggccgggcggcgggttgcgcaggctttcctggaggctgtcgaggtcggcgaattcgctcacttccaggccgaagtcggtgagctggtggtgcagcgagcggcgcgtcagttcctgcggttcgagcagcgccacgcgttggcccgcggcccaggaggcgcccggctcctcgttgtcgtcgcgacttttcggcagactcaggctgatccagaactcggcgccttcccctggcgtactgtcgacgccgatctcgccgcccatctgctcgatcaggcgcttggagatcaccaggcccaggccggtgccaccggcttgtcgcgacagtgagttgtcggcctggctgaaggccttgaacaaggcttgctggtcctcctcggagaggccgataccggtgtcctgtacgctgatccgcagctgcgcgcggtcgtcgctttcgtcctcgagcatggcgcgcacggcgacggtgccgccctgggtgaacttgatggcgttgccgaccaggttggtgaggatctgcttcagccgctgcgggtcgccctgcaattggatcggggtatcccggtag

SEQ ID NO: 13317 - DNA, 1071 bp, Pseudomonas aeruginosa
accaggctgaccagttccagttgcttctcgtgggcggccggagccagcatggtcagggcgtcctggatcaggtcgcggagattgaaagggaggttttccagaaccagcttgccggcctcgatcttcgagaaatcgaggatctcgttgatgatccccagcaggctttccgccgatttctggatggtcgtgaggtattcctgctggcgcgggctgagctcgcttttctgcagcaggtttgtgaaaccgaggatgccgttgagcggggtgcggatctcgtggctcatgttggcgaggaactcggacttgatcctgctcgcctccagggcctccttgcgcgccaggtccagctcgatgttctggatctcgatggtttccaggttctgccgtacgtcctcggtggcctggtcgatgttgtgctgcatttcctcctgggcgctctgcagcgtttccgccatgcggttgatgccggaggccagttcgtccagctcgttgctgcccatcggtggcaggcgggtttccatgcggccttccttgagctgggcgacgccctggctgatcagttccagcggcgcgttgatcgcgcgactcatgcgcagggcgaggagggcggtgacgccgaggccggcggcgatcagcaagaggctggtgaacaggctgcgatatccgcgcagcagagtcccgtggtgcgacagttccagttcgacccagccgagtacgcgctcgtcgtcaggctcggtggcgccggacaggctgtggtggcggccaagaaccggtagcaggaagtgcgtggtgtccagttcggtggacatgctcagatggctggcgtcgccggccggggcgacggtgagcatgcttggcccggcatgggcgaggcgttcctggcgggcgtcgaggaaggtcaccgcgcgcacgtccggttggtccagcgcctcgttggcgatgcggttgagcacggcggtatcctttcgcgccagcgcggtggcggccagcggcgccagttgttcggcgatcagttgcccgcgctcgatcaactgggcgcgcatgtcggacagctggacccaggtgaagtaa

SEQ ID NO: 13318 - DNA, 1455 bp, Pseudomonas aeruginosa
tcgcagcctggacatgcacgtcagtcacctgcggcgcaagctgcaacgcctcggttacgccggtcaccagttgcataccgtctggggcaagggttacgtcctgacaccggcgccatgatgcccaaccgccattcgctgttctggcgcctggccctggtgctggtggcgttcttcctgctatcggtatggctgtcctggacctggggacgcagtgccgaactgaagggttactacctgtccgccgaagcccgctccgccttggcggattatgcgcggcgagccgaacgtgcctggctcgacgatggccgcgagggcatcgaccgttggctggccgagccgcgccagcgggcgctggactgggtggtcgtgctcgacggacggttgcaatcgctgggcagtcgtccgctcaccacggaggaagccgagcgcctgactttcctgcggggcgtcgactggccgatgagctcccgctcgttgtcgcggccgttcatcagcctgcgcttccccgaacatccggagcaaggccgggtggtcctgcgtcttcccgccgagttcgtccctcccggcttgtcgccggccaagcgcctggtcacccatggcctggtgccggccgggctggccctgctgctgggagtgttgctgtatcggcgctggatagtgccgctgggacgcctgcgagcgcaggccaatgccctgcgcggcaacgacctgacggcgcgtacgcaggcagagatcagccggcgcagcgacgagctgggcgatctggggcgggcgttcgaccatatggccgagcgactcgacgagcacatggtgttgcagcgccaactgctccgcgatctctcccacgagctgcgcacgccgctggcgcgcctgcaggtggcggcagagggcacgctgtccgcgcagctcctgcgcgagcgcctggagcaggaggtacagggcatgcagcaactggtggacaacaccctggagctggcctggatggacaccgaacgcccggtattggcgctggaggacatttccatcccggcgttatgggacctgctggtggagaacgcacgcttcgaaagcggctgggccgccgagcggttccgcagcgatctgcccgaggattgtgtcgtgcgtggcaacctcaatgcacttgcccaggccctggagaacctgctgcgcaacgccatccggcattcgccggaaggcggcgtgatccgcctgcatggtcggcgcgaaggaagttgctggtggctttgcctggaagaccagggcgagggtgtggccgagcaccagttggagaccatcttccgcccgttcacccggctgtcttcggcacgtaccggcaagggcttcggcctgggactgagcattgcccgtcgcgccgtggtgctccagggcggccgcctatgggcggaagccgccgatccggggctgcgcctgtgcctggtgctgccttctgcctag

SEQ ID NO: 13319 - DNA, 1116 bp, Pseudomonas aeruginosa
cgaggtggtgctgggcaccgccgaacaggagctcaagcaggcaccgggggtatccatcatcaccgccgaggacatcaggaagcgcccgccggtgaacgatctctccgagatcatccgcaccatgcccggggtcaacctcaccggcaacagttccagcggccagcgcggcaacaaccggcagatcgacatccgcggcatggggccggagaacaccctgatcctggtcgacggcaagccggtcagctcgcgcaactcggtgcgctacggctggcgcggcgaacgcgacacccgcggcgacagcaactgggtgccgccggaggaggtcgagcgcatcgaggtcctccgtgggcccgcggcggcacgctacggttccggcgcggcgggcggggtagtcaacatcatcaccaagcgcccgaccgatcgtttgcgtggttccatgacggtgttcaccaacattccggaaagctccaaggatggcgccacgcgccgcgccaacttcagcctcagcgggccgctgaccgaagccttgagcttccgcgcgtacggcagcgcgaacaagaccgattcggacgataccgacatcaacctcggacataccgtcaacccgagccgtaccgtggccggacgcgaaggggtacgcaatcgcgatctcagcgggatgctgtcgtggcaggtgacccccgaccaggtcgtcgatttcgaagcgggcttcagccgacagggcaacatctatgccggcgatacccagaacaacaacggcaccgccaatacccagggactcgccgacgagggtgcggagaccaaccgcatgtatcgcgagaactacgccatcacccacaacgggacctggtcgttcggcacttccaggttcgtcgcccagtacgactccacccgcaacaaccgtctggaggaggggctggccggttccgtcgaggggcagatcggcgccgaccgttcgttcagcaccagcaagctggagaactatcgcctcagcggcgaactcaaccttccgttgcatgcgttgttcgagcaggtgctgacggtgggcgcggagtggaacaaggaaaccctcaacgacccgtcctcgctcaagcagggcttcgtgggaagcgatag

SEQ ID NO: 13320 - DNA, 741 bp, Pseudomonas aeruginosa
ggtccggccccagtttcccggtatcatgctcagcctttaccgtcagtgccgaacgagtgcctccatgaccgtgcagtacccgactatcgccgactgcgttggcaatacccctctggtgcgtctgcagcgccttcccggggaaacctccaataccctgctggtgaagctcgaaggcaacaacccggcgggatcggtgaaggaccgcccggccctgtcgatgatcacccgtgccgaactgcgcggcgacatccgccccggcgatacgctgatcgaggctacttccggcaacaccggcatcgccctggccatggcggcggcgatcaagggttacaagatgatcctgatcatgccggacaactccacggccgaacgcaaggcggcgatgaccgcctatggcgccgagctcattctggtcagcaaggaagagggcatggagggcgcgcgcgatctggccgacaagctgcagcgcgaaggccgcggcaaggtcctcgaccagttcgccaatggcgacaacccggaagcccattaccacagcaccggcccggaaatctggcagcagaccggcggcagcatcacccatttcgtcagctccatgggcaccaccgggaccatcatgggcgtctcgcgctacctcaaggagcagaacccggcggtgcagatcgtcggcctgcaacccatggagggctcggccatcccgggaatccgacgctggccgcaggaatacctgccgaagatctatga

SEQ ID NO: 13321 - DNA, 1371 bp, Pseudomonas aeruginosa
cccgcgctgagcatgtccatggccagaaataagggcgggctgcgcttccagcccagcggtggtgcgcgcggtcccgcgataccggtaggcaagaagcagcgcctgaccatcgagcgcctggcccatgacggccgaggtatcgcccacgaggcggggatgacctggttcgtcagcggcgggctgcctggcgaggaacttgaggcccgggtgctgggcgcacgaagcaaggtggtcgacgcgcgcagcgagcgcctgttcagcagtagcgacctgcgtcgccgcgagccctgcactgtagcgggtcgctgcggcggctgcaccctgcagcacctggaacacggcgagcagttggccctgaagcagcgtaccttgcaggagcagttgcagcgtttcgccgggatcgagccggaagaatgggccgcccctctggtcgggcccgaattcggctatcggcgccgcgctcggatcgccgtgcgctgggatgccatggcgcggcgtctggatgtcggcttccgtgcctcggccagccaggagatcgtcgccttcgatgagtgcctggtcctggtgccgcctttgcaaacgattgcccgtgccctgcctgctcttctgcaggacttccgcaagccggaaagcatcggccacgtggagctcttccatggcacggccagtgcattgctgttgcggcatacgactgccctggtcgacgaggatcgccagcgcctggccgctttctgctccgcacaccaggcccagctctggctgcaaggtgcggaacagcccttgccggtggagccggccgccgaactgggctactccttgggtgactggcaactgactctggcataccgacccggagacttcgtccaggtcaatgcgccggtgaacgagtcgatgatccgccaggcccttgactggctggcgccgaccgccgacgagcgggtcctcgacctgttctgcgggctgggcaatttctccctgccgctggcgcgccgggtggcgcgggtagtcggggtggagggcgtggcggcgatggtcgagcgggcaggcgccaacgcgctggccaatggccttggcaacgcgcactttttccaggccgacctgtccaaagcgcttgccgaagcgccctgggcggagcaaggttttaccgctgtgctgctcgatccgccgcgcgacggcgcgttcgaggcggtacgcgaaatgagttctctgggtgcccggagggtagtctatgtatcctgcaatccggcgaccctggcgcgcgatgctggcgaaatggccaggcagggctatcgtctgaagcgcgccggaatcctcgatatgtttccgcagaccgcacatgtcgaggccatggctttgttcgaggcaggttag

SEQ ID NO: 13322 - DNA, 2256 bp, Pseudomonas aeruginosa
agggtaggcaagatggtacaggtgagagcgcaccagccggtcaacaccgacggcagtatcaacctcgaggcctggctggaccacgtccagaacctcgtccccgggctcgatcgtcagggcttgctggaggcttgcgagttcgctcgcgaatccgagcagcgagcgatcgccgcacagaactcctgggcggaaggcacgtccagcttccagaccggactggaaatcgccgagatcctcgcggacctcaagctggatcaggagtccctggtcgccgcggtcatctatcgaggcgtgcgggaaggcaagatcaccctggaagcggtcaacaagcatttcgggccggtggtggccaagctgatcgagggcgtgctgcgcatggccgcgatcagcgccagcctcaatccgcgccattccatggtgctgggtacccaggcgcaggtggagaacctgcgcaagatgctggtggcgatggtcgacgacgttcgcgtcgccctgatcaagctggccgagcgcacctgcgccattcgcgcggtgaagaacgccgacgaggaaaagcgccaccgcgtcgcccgggaagtcttcgatatctacgcgccgctggcccaccgcctgggcatcgggcatatcaagtgggagctggaggacctgtccttccgttacctcgagcccgaccagtacaagcagatcgccaagctgctacacgagcgccggctggatcgcgagcagtacatcgccaacgtgatgagccagttgaaggaagctctcgcggccaccggcgtacaggccgatctcagcggacgggcgaaacacatctattcgatctggcgcaagatgcagcgcaagggcctggacttcagccagatctacgacgttcgcgccgtgcgcgtgctcgttccggagatgcgcgactgctacaccgcgctgggcatcgtgcataccctctggcggcacattcccaaggagttcgacgactacatcgccaaccccaaggaaaacggctatcgctcgctgcataccgcagtgatcggccccgaggggaaggtgctggaagtacagatccgtacccactccatgcacgaagaggcggagctcggagtctgcgcgcactggcgctacaaggggaccgacgtcaaggccagctccaaccattacgaggaaaagatctcctggctgcgccaggtgctcgaatggcacgaggaactgggcgacatcggtggcctggcggagcaactgcgggtcgatatcgagccggacagggtctacgtcttcactcccgacggccatgccatcgacctgcccaagggcgcgaccccgctggatttcgcctatcgggtccacactgaagtcgggcacaactgccgcggggcgaagatcaacggacgcatcgtgccgctgaactacagcctgcagaccggcgagcaggtcgagatcatcaccggcaagcacagcggtccgagccgcgactggctgaacagcaacctgggctacgtcaccacctcccgggcgcgggcgaagatcgtccactggttcaagctgcaggcgcgggaccagaacgtcgctgccggcaaggccctgatcgaacgcgagctgtcgcgcctggcgctgccgccggtggatttcgaccggctggcggagaaggccaacgtgcgtaccgccgaggatatgttcgccgctctcggcgccggcgacctgcgcttggcgcacctggtcaactatgcccagcaactggtcgagccggaccgcgacagcgagcaactcgaactgatcccgcgcaagccgagcaagatcggccacggcaagcgcggcgacgtgcagatccagggtgtcggcaatctcctgacgcagatggccggctgctgccagccgctgccgggagatcccatcgtcggctacatcacgctgggccgtggggtcaccatccaccgccaggattgcgccaccgcgctgcaactggcgggacgcgaaccggagcggatgatccaggtcagctgggggccggagccggttcgcacctatccggtggatatcgcgatccgtgcctatgatcgttccggcctgttgcgcgacgtgtcccaggtgctgctcaatgagcggatcaacgttctggcggtgaatacccgttcgaacaaggaagacaacaccgcgaccatgcaactgaccatcgagattcccggtctggacgctcttggacgcctgctggcgcgcgtctcgcaactgcccaacatcatcgaggcgcggcgcaaccgtacgccttga

SEQ ID NO: 13323 - DNA, 1467 bp, Pseudomonas aeruginosa
cgccatggcgactgtagtacagcaccaggatgtagggactgctcaagcgaggatctccaggactctttccggaggccggccaaccaccgccttgtcacctgcgaccagcaccggacgctcgatcagcttcggatgcctggccattgcctcgatgatggcctcttcgccaagactgggctcatccaggccgagggccttgtattcgtcctccccggtccgcagcaactggcgggcgggaatgccgagcttggccaggatcgctttcagctcggcgacgctcggcggggtttccagatagcgcaccacctgcggttgcaggccgcgggcttcgagcagttcgagcgctgcgcgggatttcgagcagcgcggattgtgcaacaggatcagttcgctcatgtcaggggtcgcatggccggtgaagtgacggctattctaaccgcctcgtcgaccaggactgaacccgtcggcgcgaagtaccgccccgagaggcgaagaaccggcgcgacttcaaggagagggcatgcgcgaacatttcaacgatggggtcgagttcgctcgcttcctcgctcatcgcttcgtcaccgacaaggctcccaacagcgcggcggcgctgacctacaccacgttgttcgcggtagtgccgatgatgacggtgatgttttccatgctttcgctgattccggcattccatggcatgggcgagtcgatccagactttcatctttcgcaatttcgtgccttccgctggagaagcggtggaaacctacctgaagagtttcaccacccaggcccggcacctgacctgggtcggggtggtctttctggcagtcaccgccttcactatgctggtgaccatcgagaaagccttcaacgagatctggcgggttcgccagccacgccgcggtgtcgggcggttcctcctctactgggcgatcctcagcctgggcccattgttgctgggggccggcttcgccgtgaccacctacatcacttcgctgtcgctgctccatggcccggacgcgttgccgggcgcggagacgctgctggggctgatgccgctggcgttcagcgtggcggccttcaccctgctctattcggcggtcccgaacgcccgggtcccggtgcgccatgccctgatgggcggcgtgttcaccgcggtactgttcgaagccgcgaaaaccctgttcgggctgtacgtaagcctgtttcccggctaccagttgatctacggtgccttcgccaccgtgcctatcttcctgctgtggatctatctttcctggatgatcgttctgttcggcgcggtgctggtctgcaatctctcttcttcccgtctctggcggcggcgctcgctgcccaagctgatcgtcctgctcggcgtgctgagggtgttccaccagcgccagcagcttggacagtcgctgcgcctgacccacttgcatcgtgcgggttggctgttgcccgaggatga

SEQ ID NO: 13324 - DNA, 606 bp, Pseudomonas aeruginosa
gaagtatcggggcttcttcttcccatattcgtctccactcggttttgcagaggtggatggcttccagtaaggtctcgccatagtgccgcgccgggttgccctggtccggccgatgttttcctgactcgagaggttcctgacatggggagttggctacgcccgctgggcgctgctgcggtgttgtttctcgcgggctgttcggcggattacggagtcgaccaggacgggcgtcctgtcgctgcggagcagttggacgggcattggctggtggtcaattactgggctgactggtgcgcgccctgccggaccgagattccggagatgaatcgccttgcgcaggtgctggaagggcagggcgggcgcgtcattggcgtgaatttcgatggcctgcgcgatgccgagttgaagaagtcggccgatggcatggggattcgcttcaccgtgctggccgatgatccggcgcctcgcttcaagctccctcgcagcgaagcgttgcccgtcacctatatcgtcgatgctcggggggaaatgcgtcagcgtctgctgggcgagcagacggccgatggcatattgaaacagctcgaggctttgcgggagggacgctga

SEQ ID NO: 13325 - DNA, 1224 bp, Pseudomonas aeruginosa
tggcgaggatctgcttgcatgcctatgtcggcggccgggtacagggcgtcggtttccgtcaggcgacccgggaagaggctgatcgcctcgaactcgacggttgggtgcgaaacctggatgacgggcgtgtcgaagtcgtctgggagggcgaggaggaccgggcgaaagccctggagcgatggctggggcggggcccgcggcacgcggaggtctctgcggtcgaggtcgagcaaatgccgctgcaggggatcgctggcttcgtcgtccgtcgctgacgaggcgagttcgccgtcagggcgtctcgccagggtccgcggccaggcgaccggcatcccggagcagggcatgcatgaactgctgctgcagttcggggtcgttgcgcgtgagctcgatcaggctctgttccagttcgctggcttcttcttccaggcccagctccgcgaggcgtttcacccgatggacccagtggtggacgtcatcgccttccaggtcgtcatagatcagggcgtgagcttccaggagcttgccgcgcaggctgcggctgacgcggaggctggcatcggcgcgggtaccatcctgtgggtcgctcaccgaaaggtgtatctgcgagatgcggctgatgtcctgttcggcgaaggggctgtcgagcaggttgaggcgcagcacgccatgacggtcggtaagcagttcgttgagttccttgccggaactgaccaggaccggacgctccgcccagggcaggctggagtattccaggcgcttgtcgcgctgtttctcgtcgatgctcgcgagattctgttcggcgcgaccgttggattccacgttcatgaacggattcaccccggccagtccgtagttgatccagccgtgggtgatgttgtccggtacgctgccgaaggtcaccacgttgacgatgttcgctccgacgccggccaccagcgccaccgcgcccaacgggatctcgtagatctcccgccaggcctggtacggcgtatagcggtcgtaacggcgcgtcacctcgaactcggtgacctcgaaggacttctggtcgttgatccggacccggcgctgcggcagttcgagcacatcgggctggccgacatcgacttgcagggtgtgttcgagcagcttccgctcgacgcgctcctcatgctcgctacgctgcggcaactggttggcgcagccgctcagcagaaggccgccgcacagggcggcggcgaatag

SEQ ID NO: 13326 - DNA, 630 bp, Pseudomonas aeruginosa
tcaagcgtctggaagacgtccaggggctggtgggcgaggcgggggaagacgaagcgcctcctccccattattgaatgcacaaaaaacccgccgttcggcgggttttctgtttttcgcggcggtcagcggcgggaggcgatcacgtcttccgcctgcaggcccttgtcccgttgtaccaccgagaactccacgcgctggccttcgatgaggatgcggtggccttcgccgcgaatcgctcggaagtggacgaagatgtcctcgcccgaatcgcgggaaatgaagccgaaaccttttgaggtgttgaaccacttcacggtaccggtctcccggttgccgctgtcctggctgccgccgagggctgccggggcgctggcgctgcgcgagaccggcttgccgggtttcaggctgcccgccagttgcagagccgtggccagcaccaggcttagcaggggcaggacgatcgccggctggtcggcgatggtcggcagcggcgccagcaggatcagtgcctgcaggacgacgcccaggaccagcagggcggctgcgccggcctgcagcgggcgggttggatgtgacgattgcagtacgggagcgaagagcaggttgatcaggcccagaatggccaggtag

SEQ ID NO: 13327 - DNA, 432 bp, Pseudomonas aeruginosa
tggccccttgcacgagcgtctacacgtggtgtttcgcagcgtccgcgaggtgatccgcacccatggcccgacggccctgagcatcgagcaggtgttcatggcgcgcaacgccgattcggccctgaagctggggcaggcgcggggggcggccatcgtcgcggcaatggaggaggggttgagcgtggcggagtacaccgcctcgcaggtcaagcaggcagtcgtggggaccggcggtgcagacaagcagcaggtgcagatgatggtcatgcatctgttgaagctgacccagaaaccgcagatagatgcttccgacgccctggccatcgccctgtgtcatgcccatacccaacagagtctggtcccccatggcctggtgggcgcacgccgacgtggcgggcgcctgcgtctttgaataaggaaagctcttcgtga

SEQ ID NO: 13328 - DNA, 450 bp, Pseudomonas aeruginosa
agtatgcgcgcgcaacacgggggaaagccgttccagcagcgtttccgggtctattacgaggacacggatgccggcggcatcgtctattacgtcaactatctcaagttcatggaacgggctcggaccgagcggctgcgagctttggggttcgcccaatcgcaactggtcggcgacaatctgctgttcgtcgtgcactccgccgaggcgcgttaccacgccccggccaagctcgatgatgaactgcttgtcagcgccgaggtcgaggagttgaaccgggcgagcctgaagtttcgtcaacaggttcgtcgagcgtcggactccgtcctgctctgcgaggggcggttcctggtggcgtgcgtgcgagcggacaccctgaagccacgtgctatccccgaaacgttgcgtgcggcttttgccggaagcccggattctttttcagcaggagattaa

SEQ ID NO: 13329 - DNA, 1317 bp, Pseudomonas aeruginosa
accggaggatttgagtctgtgagtaccctgattcgcattgcgctgttcgccctggccctggtggcaggtgctgcgcaggctgccgacccgctggtgatctccagcggtaacgaccgtgccattcccatcgccgtggtgccgttcggcttccaggggggcaacgtgttgccggaagacatgtccaatatcatcggcaacgacctgcgcaactccggctacttcgagccgctgccccggcagaacatgatcagccagccggcgcaggccagcgaagtgatcttccgtgactggaaggcagttggcgtcaactacgtgatggtcggcaacatcgtgcctgccggcggacgcctgcaggtgcagtacgcattgttcgatgtcggcaccgagcagcaggtcctgaccggcagcgtgaccggcagcaccgatcagctccgcgacatgtcgcactacatcgccgaccagtcgttcgagaagctcaccggtatcaagggcgcgttctccaccaagatgctctatgtcaccgccgagcgtttctcggtcgacaacacccgctacaccttgcagcgctccgactacgacggcgcccgcccggtgaccctgctgcagtcgcgcgagcccatcgtgtcgccgcgcttctcgcccgatggccgccgtatcgcctatgtctccttcgaacagaagcgcccgcgtatcttcatccagtacgtcgatactggccgtcgtgagcagatcaccaatttcgagggcctgaatggcgctccggcattctcccctgacggcaaccgcctggccttcgtgctgtcgcgcgacggcaacccggaaatctacgtcatggaccttggcagccgcgccctgcgccgcctgaccaacaacctggcgatcgataccgaacccttctggggcaaggacggctctaccctgtacttcacctcggaccgtggcggcaagccgcagatctacaagatgaacgtgaacagcggtgccgtggaccgggtaaccttcatcggcaactacaacgccaacccgaaactttcggccgacgagaagaccctggtaatggtccaccgccagcagggctacaccaacttccagatcgccgcccaggacctccagcgcggcaatctgcgggtgctgtcgaacaccactctggacgattcgcccactgttgcgcccaatggcaccatgctaatctacgccacccgccagcaggaccggggcgtgctgatgctcgtatccatcaacggacgcgtacggatacctctccctaccgctcagggcgatgtgcgcgagccttcctggtccccttacctgaactga

SEQ ID NO: 13330 - DNA, 438 bp, Pseudomonas aeruginosa
ggttcctttcctggcgaccggatgagtgacccgatgccgaccccggttttcataaagagaacggtactgtttggcgactgtgatcccgaagggatcgtctatacgccacgtttttcatactttgtgctggaagcggtgcaggaggcgctcggggtctggctgggcggcccggggctcagaaccctcctggggttcaggattcttcccccggcgagagcgttctccctggaattcctgcatccggtcacctgggacgacgagctcacgatgcaggtgggcgtgtcgaacgtggggacgcattctttctcgttttcagtcgaaggacgtctttcgccggacgtggtggcgttcactgcgagcctgacgcaggtctgtgtctccccggatacccgcgaagtcatggaggtccccgcgcagctccgcgcgctcctcgcatag

SEQ ID NO: 13331 - DNA, 774 bp, Pseudomonas aeruginosa
gcgaggcggttctggttcctacctgccggctgcacgacggcttgcgtccgaccctgttcgtcaccctggccactccgctggacgacaaccagatcctgctggcgcagcgcatcgaccagcatctcgccgaacagattccctcgcacatgctgcccagccaattgcatgtgctgccggccttgccgcgcaacgacaacggcaagttggcgcgcgccgagctgcgccacctggccgacaccctttatcacgacaaccttccggaggaacgggcatgttgattcaggctgtgggggtgaacctgcccccatcctatgtgtgtctggaggggccgctgggaggcgaacgccctcgcgcccagggcgacgagatgctgatgcagcgcttgctgccggcggttcgcgaagccctggacgaggcggcggtcaagcccgaggagatcgacctgatcgtcggcctcgccctgtctcccgaccatctgatcgagaaccgcgacatcatggcgccgaagatcggccatccgttgcagaaggtcctcggcgcgaatcgcgcgcatgtcttcgacctcaccgactcgagcctggcccgcgccctctacgtggtcgataccctcgccagcgaccagggctatcgcaacgtcctggtcgtgcgcggcgaatccagccagggattggaagtggacagcgagtccggcttcgcccttgccgacggcgccctggcgctgctctgccggccgaccggcaaggccgcgttccgtcgcggtgcgctgggcggtga

SEQ ID NO: 13332 - DNA, 1356 bp, Pseudomonas aeruginosa
cggcgacaccctgcactggcgcttcccccaggaagagtcgcatgcggacgagtggcgacgcctgcatggcctgtccagcctggaggcgctgcgccgcgtgctcggaacgctgggcgacgcggaggggcccgcgctgctgggcggcttgttcagcttcgacctggccgagcagttcgaacccttgccggcgccggccgaacctgcgcggcattgcccggactacctgttcctggtgccggagttgctgctggacatcgatcacctggcgcgccggacttcgctgcaggcgttcgtccacgatccggccgggcacgaccggttggccgccagcctgcgccagtgtgccgacgaattccatggcgccgtggaggaggcttccgagtcgccggtggcaggcgtacgggccggcaactaccaggtcgacctggacgatgcgagctttgcccgccaggtagagcgcctgcaggcccacgtgagggccggcgacgtgttccagatcgtaccgtcgcgcagcttcagcatgccgtgtgcggacccctggcgggcctatcgccagttgtgcctgcgcaaccccagcccgtaccgcttcttcctcgatgcgggggacttctgcctgttcggcgcttcgccggagtcggcattgaagtacgacgcggagagtcgcgaggtggaactctatcccatcgccggcacccgcccgcgcggacgcgatgcccggggcgccatcgatgcggaactggacaatcgcctggaagcggagttgcgcctggacgccaaggagatcgccgagcacatgatgctggtcgacctggcgcgcaacgatctggcgcgggtctgccgcagcggtacgcggcaggtgcgcgacatgctcaaggtcgatcgctacagccacgtgatgcacctggtctcgcgcgtggctggcgaactgcatggcgaactggatgcgctgcatgcctaccgtgcctgcctgaacatgggcaccctggtcggtgcgccgaaggtccgtgccatgcagttgctgcggcagtacgaggatggctatcgcggcagctacggtggcgcgatcggcattctcgacagcgccggcaacctcgataccagcatcgtcatccgctccgccgaggtccgcgaaggtatcgcccgggtccgggcaggcgccggcgtggtgctggattcggatccacggctggaggccgaggaaacccgcaacaaggcgctggcggtgctgaccgccgtggccgctgccgaacgcgaaaggggagagcgcgatgcgcatcacgctgttggataacttcgattccttcacctacaacctggtcgagcagttctgcctgctcggcgcggaggtccgggtga

SEQ ID NO: 13333 - DNA, 657 bp, Pseudomonas aeruginosa
tgcgcaacgatacgccgttgccgacgatccaggcggtattgctggccgacggttgcgaactgctggtgctgtcgccggggcccggtcggccggaagacgccggctgcatgctggaattgctcgcctgggcccgcgggcgcttgccggtgctcggcgtctgcctcggccaccaggcgctggcgctggccgccggtggcgcggtgggcgaggcgaggaagccgctgcacggcaagagcacgtccctgcgtttcgatcagcgtcacccgctgttcgacggcatcgctgacctgcgcgtcgcgcgctaccactcgctggtggtcagtcgcctgccggaaggtttcgactgcctggccgatgccgatggcgagatcatggcgatggccgatccgcgcaatcgacagctgggcttgcagttccatcccgagtcgattctcaccacccacggccagcgtctgctggagaacgctctactctggtgcggcgcgctggcggtacgcgagcgccttcgggcctgagcggcgctgcgccgtttcgacgatgctcggttgccaggccggcgcatcgtcgaaacgctggcggccgagttcgcgcaggcgctggcgggcgctttcgagaaagcgcaggaagctgcgctcggattccagcgcggtgttgtag

SEQ ID NO: 13334 - DNA, 243 bp, Pseudomonas aeruginosa
tggacaacggcgagcccatcctctgggcgcccggaccaccacctgggacgctacatccagcgcgagaacggggccgacatgctgctctgggatggcgcctgcatcttccacgaggagttcaacgccaagccagctggaagacatgaaggcgctctacccggacgccgccattcctggtccaccccgaatcgccggaaagcgtggtcgcgctggccgatgccgtgggctcgaccagccagttga

SEQ ID NO: 13335 - DNA, 627 bp, Pseudomonas aeruginosa
acgctgctttcgacgaagtccttgagctgcgggtcggagatcgcatcgacctggttgcgcagcatgctcagccaggcgcggcccagctggaactcctgctccggcgaaacgatcgaggaagatgcgtcgcccagggagggcagatcgtccgacatgaccggcgaagcgagcatgcaggcgagcgtcaacagggcagggcgcagtacattcatgcaggaggctcaggttggcaaaggccttactttagccgttggttatcggcactgcctaggtatctgcccgagcccccgaagctgttggacttcgagcgccgtttcaactggccagcggcggataggcttgggtatgcttgtcggcccttcgggagaggctgtcatgacggataacgattcatcccccctggtatgtgacgcggagctggatgccagtggtctcaattgtccgctgcccctgctaaaggccaagctggagctgaaccgcctgcccagcggcggggtgctcaaggtgatcgccaccgatgccgggtcgcagcgagacttccgggccttcgcccagctcgccggccatgaactgctgcgcgaagaggccgccgaaggcgtctatcgatactggctgcgcaagcgttag

SEQ ID NO: 13336 - DNA, 1107 bp, Pseudomonas aeruginosa
cggagccttcgccgttccgattcaggatttccgatgatcaaggtgttacgcgactggatgcagcgctacttctccgacgaggaggcagtggtgctggcgatcatgctggtgctcggcttcagcgtcatcctcgccttcggcgggatgctcgcgccggtactggcggcgatggtgatcgccttcctgatccagggcgtggtcggcatgctggaacgcttccgggtgccgcacctgttcgccgtgtggctggtctacagcctgttcctcggcttgctggcgctgttcctggtggtcctgctgccgctgctctggcagcaattgttcaccctgttcaacgaactgccgcggatgctcggcgaatggcagagcgtgctgctgatgctgcccgagcgctatcccagcctgatcagcgaggagcaggtgctcaaggccatcgagaccgcgcgcggcgaattcggccagatcggccagtgggcgctgacctcgtcgctggccagcctgccggtggtggtgaacgtcatgatctacctggtgctggtgccgatcctggtgttcttcttcctcaaggacaagaagcgcttccagacctggttccaccgctacctgccgcgcgagcgcgggctgatgaaacaggtctgggccgagatgaaccagcagatcgccaattacattcgcggcaaggtcatcgagatcgtcattaccggcgcggtgacttacatcgccttcgcctacctggggctcaactacgcagcgctgctggccctgctggtcggcctgtcggtggtggtgccgtacatcggcgcggtggtggtgagcgtaccggtggcgatgatcgccttcttccagtggggctggagcgaccagttcatctacctgatggtggcccacgcgatcatccaggcgctggatggcaacgtgctggtgccgctgctgttctccgaggcggtgaacctgcacccggtggcgatcatctgcgcggtgttgctgttcggcgggctctggggcttctggggcgtgttcttcgcgatccccctggcgaccctggtgaaagcggtgctggatgcctggcccaaggaccttcccgagactccggcagccacgcgatag

SEQ ID NO: 13337 - DNA, 633 bp, Pseudomonas aeruginosa
atcggccacgctggacgtggaagagcacatccaggtgatccgtcgcgtggtcgaccaggtcaagggccgcatcccggtgatcgccggcaccggcgccaactccacccgcgaggcggtggcgctgaccgaggccgcgaaaagcggcggcgccgacgcctgcctgctggtgacgccgtactacaacaagccgacccaggaaggcatgtaccagcacttccgccatatcgccgaagccgttgcgatcccgcagatcctctacaacgtaccgggccgcacctcctgcgacatgcttccggagaccgtcgagcgcctgtccaaggtgccgaacatcatcggcatcaaggaggccaccggcgacctgcaacgcgccaaggaagtcatcgagcgcgtcggcaaggacttcctcgtctattccggcgacgacgccacggccgtcgagctgatgctgctgggtggcaagggcaacatctccgtgaccgccaacgtcgcgccgcgcgccatgagcgacctgtgcgccgccgccatgcgcggcgacgccgcagccgcgcgcgccatcaacgatcgcctgatgccgctgcacaaggcgctgttcatcgaatccaaccccattccggtgaagtgggccctgcatga

SEQ ID NO: 13338 - DNA, 1314 bp, Pseudomonas aeruginosa
gatgggtctgatccccgagggcatccgcctgcccctgacctggctcagcccgcgttgccacgagccgctgcgtcaggccatgcgccagaccggcgtattggcttgatcaaggagctccacgcaatgaagcgactggctggactgaccgccctcgccctggttatcggcaacacttccggctgcggctggctgtgggggccggagggctatttccgcgaccgcggtgacgactacctcggcgcccgcgaaacgcctcccatgcaattgcccgaaggggtgcacagcaagccgctcgatccgctgctgccgattccgctgaacgtcgccaccacccacgaaaaagagggtgagtacgaggttccgcgtccgcagccgctggccaacgccggcgacatcagcgactacagcctgcagcgcagcggtgatagccgctgggtcgtggcccagcgtccgccggcggaagtctggccggtggcccggcagttcttcgaggagaacggtttccgcatcgccgacgagcgcccgcagaccggcgagttcagttccgactggcaatcgctgtcgcagctttccgcgccgctggcacgccgccttagcagccgcgtgagcggtgtcgagccggacggccaggcacgggttcgggtgcgtatcgagcccggcgtgcaaagcaataccagcgaggtctacgtgctcagccagacccgcgccgccggtgacaccagcagcccgagctggccgagcaagtcggtggcgccgagcctcgacgcggcgctgctcgacgagatggtcgcgagcatggcgcgcagcgccgagcagggcggctcggtctccctgctggcagccaactcgatctacgacacgcccggcaccttcgagttgagcaaggacggcagcggcaacccggtgctgaccttgcaatccgacttcgaccgctcctgggtcagtgtcgggcgtgccctggataacgccgatatccgcgtcgacgacctcaaccgcagccttggcgtgtactacgtgaacatcgccgaaggggcgaagaagcccgacgaagacaagcccgggttcttcagtcgcctgttcggcggcggcgagaagaccaaggaagaggaagacgccaaggcgcagcgctaccaggtccgcctgaccaccgtcagcgacgccgtgcaggtcaccgtcgacaaggacatcaacacctctgcgccggccgatgtcgcgcaaaacgtactggaaaaactccaggagagcatgcgcaatgcggttcgcggttctgggcagcggaagccggggcaattcggccttggtgagcagttctga

SEQ ID NO: 13339 - DNA, 1242 bp, Pseudomonas aeruginosa
aagaacgcgaaaaaatcttcaagaaagcttcgcgttcttcgtacaagctggtatcatgcgcgccgcacggagagatgccggagtggtcgaacgggacggattcgaaatccgttgagtcagcaatggctcctagggttcaaatccctatctctccgccatatacaagggctccagaggttttcgcttctggggcccttttcttttgggggaatcctgggggagttgcttcgcgtgacattcccccattcccccactaaagttcgccgcatggcttacttcgagaaacgcgggagcgcctggcgcgcacagatccgcagaaaaggacacccaactctttccgctaccttcgataccaaggctgaggcccagcgctgggcagccgagatcgaaggcgatatgtctcgctcgagatttgtcgataccagagcggctatgcgaaccaccctgggcaaggccttggagcaatacgaaagggagatttctgagcacaagaagggggccagccaggaaagggggcgaatcaggagatggctggcgcatcccctggcagcgaaagggcttggagaaattactccgtctgatcttgccgagtatcgcgactctcgactgaaggatggggcttcatcgtctaccgttcggctagatctggcgatcatcagccacctctataccattgcgacaaaggagtggaggcttgaaggcctgacgaatccctgcaagaacttgcgtatgccaaaggggagcagggcgcgtgagcggcgaccaacaaccctagagctgcggaagatttatgctgaagcggccaagcttcaccctgaactcccggtgattatcgaactggcagccgacacagctatgcgccggtctgagcttctgctgttacgccgagagcagatccgcgacaaggttgcggtactggaggacacgaagaacggtgagcgtcgtatggtgccgctctcgagcagggctcgcgagttgctgaagtccctgcctgcgcgaatcgacggcaaggtgttcagccttgcgccaaacacagtcagcaactacttccccaaggcttgcgaggccgccggtgtcagcggccttaccttccacgacctgcgccatgaggccacatctcggctgttcgagcgcggcttttccatgatggaggtcgccgcgatcaccgggcacaagacattggtcatgctcaaacgctacacgcatctatctccccacgccttggccgacaaactcggctag

SEQ ID NO: 13340 - DNA, 1263 bp, Pseudomonas aeruginosa
tctttgtgccttcgattaatgggttgtcgactcgaaaggccactgtcttctcccagaagccgcactggaaaaaaacaccaaaacggtcgtaagacatcacaacccctccttgccgggcgcggcggcgagcagtttgaattcctccgcgtactcgtcgcagcgacactcgacaacgttcgtctcgcccaccggctcgcagttgcagaacttgctgcacagcgcttcgaacaggaagtcgggcatctcattgatcacctgctcccggcttaccgttaccgtgtggcactcgccattggggtggcgatactcgaagctgaactcctccggcacgctgtgctggcccctggccggtgcggcggcgagcatgtcgcgcagttcccggagcagagctttcccggtagcgccgcgctgtgcgaggaattcactcaggcgcccgatgaacccctccggcacgctgtgctgagccacgaccttttcgtcggcgaccttcgccaggatgatcagggaacgagcgagttcgtcgggcgtgaagctctcgaagtcgcgcaggatgcgctggaggttcttgttgaagtagtgggcgtctaccccgtagcgattgcggttggccgtcagctccgcgaccctggccagggcggacttcagttgatcctccaagcgcttggcatagcagcgaatgccctgcacggtccagccgccatcgatggcatcttgcggcagcccttcgcagatgcgttcgaactggcgcaggcgctcgacttcggccagggcggcgtcgcgctcttgctccagttgcgcgataccagcagacagatagccgtcgagcgccttctgcgtgtctcggttgcgccatgcctcggcgaagtggcgggtcatcatgcccatcatgcggtgttcgagggtgtcggcacggtcctcagcggcttgcagcttcgcccgcagctccccgacgatgcgctcgtgctgggcgctcagttcatccaagccattgcggacgatgagcgcggattcggcaatgtcctccatgtagccgagtgcgctgcgaccggcttcgtacgcgctggccgcctcatctgctcgctgccgaatcttctcggcgtggtagcggcacggattgaagtcagccacctccggccgctccgcctctgcctctgcctgcgccggggagggttgcgccagggcggcgcgggcctgctccggggttacgaaccagccggtgccgtcgcattcgcggcagacttctccgacataaccgtcgcctga

SEQ ID NO: 13341 - DNA, 219 bp, Pseudomonas aeruginosa
accatggagacctgggttatgcaccgcattcctctcaaagaattttctgcccagaagggccagaccaaggccgctgcgctgcttggactgacccagggcgcactgaacaaggcgctgcgggtcgggcgtgacatctatgtcaccgaaaacgcagacggaacctactcggctgaggaggttaaggccttcccatctcactccgccaaggccgttgcctaa

SEQ ID NO: 13342 - DNA, 855 bp, Pseudomonas aeruginosa
gtggaggcgcagatacaacaaagccctgagcgactactacagggctttgtcggtgcgcaagccagttgcagctggcttgcgcgtatagcaatacgtggagacctgagtatgagttacagagagagcattcgcaagtccgtgcgctttgaggtgttcaagcgcgacaacttcacttgccagtactgcggcgccaaggcgcctgacgtggtcctgcatgtcgatcacatcaacccggtgagcaagggcggcgacaacgagatcatcaacctggtgaccgcctgcctgccctgcaatctcggcaagtcggatcgcctgctgtcggacacctcaatgctggatcgtcagcgggcccagttggaagacctgaacgagcgccgcgagcagctggaaatgatgctggcctggcgcgatgagctccagtctttcggtgaagagaccgtacagctgattgccgatcgcatcaccgcgcgcatggtcggccactcggtcaacgagcacggcaagacggtaatccgcaaatggatcaagaagttctccgtcgaggagatcctggacgccctggacatcgccgccgacaagctcagcactgcgcccgatcaggaggaagtgctggagtgcttcgatgccattcctcgcatttgcgtcacccggcgccttcccgaagcaaagcagaaaatgctctacgccagaggaatcctgcgccgccggatttatgtcaacgaagctcacgtcatgccgctgatggccaaggccatcgaggcgggtctcgaggtggaagagctgatcgaatttgcgaaacaagtgaagaactggaccgaattccgggcagagatggaggaaatcgcaaatggctag

SEQ ID NO: 13343 - DNA, 525 bp, Pseudomonas aeruginosa
agggaggatcgagcagtgactcccgcaaaacaggaatccctcatgcagggccagaccggaatcgcgaagaaggtctacgagtgcgtaccgatctctgagccctggcgttcgttccaggtgctcaccgcacttcgcaacatgaccggaagcacgccggacgttcggattgtccagggctgcctgcgcgatctagtcgattccggactgatccgccgcactggtactgaccactaccaacgaatccaagtcgagaaaaagaccaagcatcaggagccgaagatggcggagcccgcgaagaagatcgaaacccagtccgagccgaagcgctccgcctccccgctggagatgctaggcgaactggcaaacgagctcgccggcatggccgagcacatgaagcgcctgtctgatcgcatcgaggacgtcgcgctggcagtcgagcaggagcgcgaatcgagcgccaagtcgatggaaagctatcgccaactcaaggcactgctgaagagcctgcaaggggagggcgagtga

SEQ ID NO: 13344 - DNA, 213 bp, Pseudomonas aeruginosa
gcggagggctgtgtaatgagcgagaaaactcactattgctcgttctgcggagagtccgagcacgacctcaaggctctcatcaaaggcccatcggcgcttatctgcgatgcgtgcgtcgcgctgtgcgtggacctgctcgaggacaaggggcactggccgccagctgcttgcagttctgaggttcccggcgccaagccggaggaggtcgagtga

SEQ ID NO: 13345 - DNA, 591 bp, Pseudomonas aeruginosa
gccgtggctgaactcgcccttatccgtaccgcccagggattggttccggccaccgaggctgaccgtgaaactgtccagaagtggaaggccggccaggtcgtccatggaaaattcactcggatgcgcaacgccaaattccacgggaagttcttcgcgatgctggatttggcgtgggagtactgggagccgaaaggcgggctggtgccgcgccaggagatgcgcggtatccgcgggcttgccaagtacttcgaggatctgaatggccgccctggccagttgcagaacgccgtcgctgcgtatatcgccaagcttgaggctgatcgcgccgaccgcttccccgcagtcgagaagagccgagaggctttccgggagtggatcaccatcgaggccgggcacttccacctgatccacacgcctgacggcgttcgcaaggaagccaagtcgatcagctgggccagcatggacgatacggcctttgagcctctctatcgggatgtgttcgcggcctgctggcggctggtcctttcctctcacttcgaaaccgaggctgacgccatggcggcggctgatcagatggggactttcgcatga

SEQ ID NO: 13346 - DNA, 810 bp, Pseudomonas aeruginosa
ttcggccagcttggtgggtgctccatgaaggagaccggctctacatacctgaacggtatctcatgcccctgcgcggcgacttccagcccgagcagcagaaggcgaaggaggtggaggcatgagcaagttcaccatcttcattctcggtatgacctttttgtcgctcatcactggtcagattgcatcggctctttggttcgcctcggctgcgctgatttgggagttcgtatgagcctctccacccgccagctcaagcccaagatctgccagaacaccgagtgcggcaccaagttcatcccgcagcgcctggggcagcgcgtgtgctccccagcctgcgccctggccaccaaggacaagcaccaggctccggccaggaaggccatcgccgaccgcaaccgccgggagatcaaggcgcggaaggagaagttgaagagtcggtcggatcacctgcgcgaggctcagcaggcgttcaacgagttcattcgcctgcgcgacgcggatcagccgtgcatcagttgcggtcgccatcacgatgggcagtatcacgccgggcactaccgcacggttgctgccagccccgagctgcgtttcgagccgttgaacgtccacaaacaatgcgccccatgcaacaaccacaaatccggcgacatcgtgaattaccgaatcaacctggtgcgcaagatcggcgccgagaaggtcgagtggctggaaggcccccatgagcccctgaagctgaccatcgaggacatcaaggcactgaaggccaagttccgggcctgggtgcgcgaactgaagagggcaacggcatga

SEQ ID NO: 13347 - DNA, 282 bp, Pseudomonas aeruginosa
ccttttggcaacaccgccaggggagcgatgatgtcgacgtttatgggctccgccagggaaacccagatagctgctgttcgagtccgccgcgggtggttcggcaagctggttgtccagcttcgctacaagatcgagcgccccgaaagcccgctccctggccgggagttgatctaccacgtatgcgggctctcccgttggcgagatgccaacgcaaatgatttcgctgagtccctgatggtcgcgaagctcatcgggatgtctgatgaaggaacgccctcatga

SEQ ID NO: 13348 - DNA, 465 bp, Pseudomonas aeruginosa
aggttctcgagcctctgctgcgctccggactgctggcgctccatcctgatgaatggcaaggcggaaagctctcgttcctcagaccggcacaagctaggcggcaaggctggaccccgccggttcaggcagccggcaatcaggtatccagaagtgcctgacctccctcagcgtcacaccaagcccaaggccaatggagtgactaagcacgaggtagaggacaaggcatgggggaatgggcgcggcggcagaccgtggcgtcgcaagcgagagcgcatcctcaggcgggatggctacatgtgccagtgcccagagtgcaagggagtgaagaggatcgccacagaggtggatcacatcatcccgctgagccagggaggcacagacgatgactccaacctgatggctattgctggatacccatgtcatgcgaggaagacggcaagggagtcggcggtatctaggaaatag

SEQ ID NO: 13349 - DNA, 1761 bp, Pseudomonas aeruginosa
cgccgtccgaccgccagaagttcggcctggaaaagccgaaggagaaggacgagttcgaggatttctgagatgactcccagcgacattgcacgacagtacgctagcgatgtcgtgagtgggggtatcgttgcgtgccggtatgtgaagcttgcatgccagcgcctcctgaatgacttggaccgccagggcgatgacgattggccatacgttttcgatgaggctaaggcagatcgtgctgtcaagttcatgcagctcatgcctcacaccagaggcaaatggagcgcttcgaagtcgaagctagtgttcgagccttggcaggtattcatcgaggccaacatcttcggctgggtgaagagggacaccggcaagcgcaggttccgcgaggcctacgaagagattcccaggaagaacgggaagtcggcccgtcttgccgcacgaggcatttacctattcgccgcagatggagagtcgggggccgaggtctactccggcgccaccaccgagaagcaggccttcgaggttttccgtccggcgtggatgatggcgcacaagctggagaacctgcgtaaccgattcggtatcgagctttctggcaaccagaagaaccctggtcccatgttcgtcatggaggacatgtcgaagttcgagacggttatcggcaacccgggggacggtgcgagtccccatgcggccctggtggacgagtaccacgaacacgacacggatgccctggttgacaccatgcagaccggcatgggggcacgagaacagccattgctgtcgatcatcacaacggcgggatcgaatctcggcggaccctgctacgagaagcgacgggatgtgatccgcattctcgagggtcagacgatcgatgagacgattttcgggatcatctacacgatcgacgaggatgacccgtgggatgacccggccagcctgatcaaggccaatccgaattacggagtgtcggtattccctgacttcctcctggcccagctccagcaggccaagcgttcggcgtcgaagcagaacgccttccgcaccaagcatctgaaccagtgggtgggagctaggacggtctggatgaacatgctggcctggcagcggcagaagcgcgacttcacgattgcggacatggccggctgccgctgctggatggctttggacctggcgagcaagaaagacgtggctgccctggtgatgttgttcgagaaggcgggacagttctactgcattccgcgcttctacgctccagaggctgccgccgaggaaaacgagaagtatcagaacttcgcgcttgagggtcacctgatcctgactccagggagcatgaccgattacgcattcatcgaggcggacatcctagatctggcaaagcaggtcgacttgcaggatgttgccttcgacgactggcaggccaactacctgattacacggctctcgaacacctcaatcccggtcgtggacttcaaccagacggtgaagaacatgagcgacccgatgaaggaggtggaggcgagggtgatagcgcggacgctctggcatgacggaaacccagtcatgacctggatgatgggaaatgtggcggcaaagatcgatgccaaggaaaacatctacccgcgcaaggaaaacgacaacgaccccaactgcaagatcgacggtccagtgaccttgatcatggctatggggcgcgccctggttgccggcgttgatgacggcgacgacttcatgaacgccatacggaacccgatcatcgcatga

SEQ ID NO: 13350 - DNA, 1266 bp, Pseudomonas aeruginosa
ccagtgagtaagagtctcggaaaagtcctgagcagtgctacgtctgcgcccaggtcttcattgttcggttggggggataagaccatccgcctgacagatggcgcgttctggtcgcagttcctggggcgggagtcgtctagcgggaaaaaggtcactgtcgacaaggcaatgaagctgtctgcggtatgggcttgcgttcgcttgatctctacttctgtcgccggtcttccgcttggagtgtacgagcggaaagcggacggaagcagagtcgatgctcggtcgttcccgctctacgatgttgttcacaacagccccaacgacgacatgacggccttccagttctggcaggccatggtcgcatcgatgctgctttggggtaacgcatacgcggagattcgccgcgctgcgggcagaccggctgcgttggacttcctgcttccatcgagggtcgacctggagtgtgatgacaacggtcggctgaagtacttctatacgccaaagaagggtgctcgtagagagatcgagcgtactaacatgctgcacatcccggcgttcacgctggatggtcgaattggtctctctgcaatcaggtacggcgttgatgtcttcggctcggtcatgtcggcggaggacgcagccaacggcacattcaagaacggacttctacccacggtcgccttcaaggttgatcgcattctccagcctgcgcagcgggaggagttcagggagtatgtgaagtccgtatcgggcgcgatgaactccggaagatccccggttctggagcaggggattacccctgaaaccatcggcatcaatccggtcgatgctcagttgctggagacgcgagagcatggcgtgatcgagatttgcagatggttcggggtgccgccctggatgatcggccagaccgacaaggggagcaactgggggacagggcttgaacagcagatgctcgcgttcctgacattctcgatcagctcgatcaccaatcagattcagcagtgcgtcaacaagcggctgctaactgcgcccgagcggattcgctattacgccgagttctcacttgagggattcctgaaggctgatagcgctggtcgcgctgcctggtacagcaccatggcgcaaaacggtttcatgacccgcaacgaaggtcgccggaaagagaacctgccagaactccccggcggagacattctcaccgtccagtccaacctggttcccctagatcaactggggggggcagcgaaaaaaagctctccgccgtag

SEQ ID NO: 13351 - DNA, 321 bp, Pseudomonas aeruginosa
atgagcctgatcccgcttgatacagcaaagtccttccttgatgtgatccatgaatgggatgacgcgaagctccaattgctgctggacggggccgaagacgaggcctgccaattcatgtggcgccagtctcttgatggcctctgcaactgcgaagagagcagcgaggtggtcagcagcgagccaggcattccgcctagcgtggtcatcggagtgcttcttttgcttcaggccagctatcaggctgctcccgatgaaatcgcaacgctgcgcaaggcggccgaggtgaagctgatgccgtaccgatgcggcctgggggtttga

SEQ ID NO: 13352 - DNA, 651 bp, Pseudomonas aeruginosa
aacagcacacttgtgacaaaaggatcgccgatcatgacgcacgctttgccgcctgggctgaccgactgcctgctctggtctgaagagcttggcatgggcttccacccgcgccctccgatggactacacgggaccgtatttcgagaagtaccagctgcttgacgctaccccgatgggcgctgcgctgacccgggcccgtcttgatctggtgcgccgtcactttgccggccaggtggtagacatcggtatcggaggaggccgtttcgtcaccgagtccggcgcgatgggctttgacgtgaatccggaagcggtggactggctgaaggcgcaggagcgctactacgacccgtaccagcaccacgcagaggctgtgacctgctgggacagcctggaacacatcccggagccggagaaactgctggaccatgttggcgagtggctgttcgtgtcgatgccgatttataaggatcaggctgactgcctgtcctccaagcactacaagccgggtgagcatatctggtaccacacgatgcacggtttgatcggatggtgcgagcgtcaaggtttcgaatgtgtcgagctaaacgaccaggagtcgaaacttggccgagaaggcatcaccagctttgcgttccggagagtccatggctga

SEQ ID NO: 13353 - DNA, 399 bp, Pseudomonas aeruginosa
tggcgaaatagacaaggctctaagggggaggtgatgcatccgccaatctttaaggtctgctcaagtagtcccgctgttaccgcgattctcggtgcgtccccgctgaggatgtatcagtttggcctggccccccagctcgtcgtcaagccgtacgcaacatggcagaccatatctggatcgccggagaactacctatgggggcgccctgacgccgatgggttcaccctccaggtggacattttctcagccaccgctgcggaagccagagatgcagcaaaggccatcagggatgcaattgagctttcagcctatgtagtccgctggggaggggaatctgttgatcctgataccaagacctaccgagtcagctttgacatcgactggatagtccagcgatag

SEQ ID NO: 13354 - DNA, 567 bp, Pseudomonas aeruginosa
acacctaaaccaatcagcccgccaccgcgcgggtttttattgcctgctacaggagaagacgttatgtcgatgcttacccaaggaactcaggtctatgcccttgttccgccccgctctggatctggtccttttacggtgatggagatcgagtgcgcaacctccttcaaccccggaggaaacccggcggatcagatcgaggacccgtgcttgagcgagacctcgcgcaaatacaagaagggcatgcgtacccctggtcaagccactctcggactgaatgcagatccgcggaatgcgagccatgttcggctctttcagctctcagaggatgacagtgaccaggatattgtctttgctgtcggctggtcagatggtgtcggtgtaagcccgtccgcagaccaagacagcaatggagactgggactttgatcttccgccgacgcgtacatggttcgttttccgtggttacgtcagcgacttcccgttcgattttgcagccaacaccctggtcgccacccaggccacgatccagcgctctggcgcagggcagtggattccgaaaaccgcgtaa

SEQ ID NO: 13355 - DNA, 360 bp, Pseudomonas aeruginosa
ggagcagacatgaaactagccgatctagtggccgctggcgcggtcctgggcgatggactggtgaagaaaagcatcacctggacgcacaccccgccgggcaagaaaaaagcggtcacggacaccttcgacgtgttcatcaagcgcagcagtttcggtgccatggaacgcctgttcgcccaagacgacgacaagaagagccagaatgcgcgctacctggccgagagcgtcagactgggcgagggtggggaagaggagattccctacgaaactgcgttcaacctcgaccctgcgctgggcttcctgctcttgcaggctgtcgcggaggtcaatggcactgggccaggtgacgaaaaaaactga

SEQ ID NO: 13356 - DNA, 3390 bp, Pseudomonas aeruginosa
atggcctctcgctcccttggtgtgctgacgctcgacctcattgcgcgcattgggggatttcagcagagcatgaatcgcgcctcccaagacactgcgcgcagcatggcgcggattgagcaaagcacgcagcgggcgagttcgacagcagttagcgctatcaagtctattggtgttgcggcggctgcttatctgagcgcccgagagcttgttggatattcgcaagcctgggtctctattgagaaccgcatcaagcaggtcagcgaaagtcaggctcagttcagtcagtcgatggatgcagtgtattccgtcgctcagaatgcgcagtcatccttggagggcactgcggagctgtaccagaggattgccgcttcaactggcgacctcggggtaaatcaacagcaagttgtccaggtgacccagaacatcagcaaggccatgtcggccagtggtgtttccgctgccgctgcggaaggtgcgctggtgcaactcggacaggcctttgcctctggcgtgctccgaggccaggagttgaactcggtactcgagcaggctccgggcttggcccaggccgtcgcaaacggtctcggggttgcggttggagaccttcgaaagcttggcgaacagggcaagctgacctccaagcaggtcttcgaggcgattctgtctcaaacccgagctattgatgaccagtttgcgcgcgcccagactaccatcgctggcgcgtttcaagttctggagaacagcgcgaccagggcgatcggcagcctggatagcactctcggggtgtccaaggcttttacggaagccatggtttccctgtcgaagtcgcttgactctacgaacgtgcagtccttcgtccaggtcctgaatactgggctgtacctggcgatcggacgtactgctggcgctctggtaggtgcgacggctgccaagatcgcagacgtcaaggtgacccaggagcagacctatgccgcgtcggttgctgcggctggagaggtgcgacgcgcccaggcggtgaaggctgaggccgttgccgagttagacagagcacgccaggccgtggcttctgctcgtgcgcaggtggctgctgaccgggagcgacaagcctccgaaatctctcgtttgcgggcggtgcaggcatcgcttgtggctgagcgcgaactcgaaggccagcggctgaaggcccaaatcacagagattggccgacagcagtctgtcgctcgaatggccgagttacggctagccgaaacggccatcatcaagcagcttcaggctgcggaggcgcaattgacggccaccaccgtggcgggctcgcaggcggttactgcagcccttgctcagcgagtgtctgcaaccgaagcgctttctgcggcgaacttgcaacttaccgcagctcaaactgcctcgacggccgcaatgggccgatggttcgcggccagcacagctttgggggcagggttaaatgccctgagaacagcaggcgcggggattctcaggattgcttctggatgggtggggctgatcatctctctggggatggtagccttgtccttcgtcgacttcggggacaaggccgagagcaatgctggtcgtgcggccaatgctttcgaagacgcctccacccgcatccgccaggcagctcggacgatgattccggaggatctttccgggctcagctatgaccagttgaagcagcagttggcgggccttcaggatcaattgaaggatgctgaggcgcttcaagagcggttccagaagggcgttgacgacaataccgacgttccgtttggtccttctctggacgaggcaaaggagaaagcagagtccttgcgccttgccatccagaagacacagcgagaactggacggtgcaaggttcgcttcggataaggctggcgcgagctatctggataatttgcagaaacagagcgttgtcgccggcaagctgaccgaggtagagaagctccgcgcccagatcaacgctggaatcctgaagctaagtcctgacgatgaaaagcgcgccctggcctatgccgcagccgtggacaaggcgaatgcctcgaccaagtcccagaaggacctgttgaaggactctgcgaaggggctgaagcaggctgaggagcggtatcgggacctcaagaaggagatcgaccctaccgcgactgcggcggacgagtacaggaaaaacatcgaggccctcaacaccctgaaggacagggggaagatcacgagccaggagtatgcgaagggaatcgagtgggcggccaagtcgttcaactccgcagtggacgcggccaatccgttcgtgaagcggctcagagagatcaagtccgcgatggacgagagcctgggcaatctcaagctcgaagggcagcgcgaaatcctcgggatggggatgagcgatagccagagggggctgttcgacaagctgaacgaggagaatgaccgttacgccaaggcccgcagggatcttgccgaccgctacgcagacagatcggtcgggatgagcgacgacgagtaccagcaagaactccaggctcaacagaagcaccatgagcaaatgctggagcagttgcaggcaaactacgatgctcgacttgaggcccagggggactgggtgtccggagcccgctccgcatgggaaacctacgtggaggatgcacagaattactcgaagcaggcctctgacttcgtatctggtgcacttggcgatgctaccaacggcttgggcgatgcaatcaccgatatcgtcacgcggaccaagagcctcggagatgcgttcggtgacatggctgcggacctggctaagtcggtcatcaaggccctggctgacatggccgcccagtggcttgtctaccaggcggtgcagttgttcgtagggaagacggctcaatcgactgcggcaatcgggctggtcgacaatgctcaggcaatggcgttccaggcacagctagcagcgtttgcctcgacggctgccatcccgattgttggccctggcctggctgctggtgctgctgcggctgccgccgcagctaccgcgccaatggttgctggagtttcttcggcggccttcgggggcatcgcgcacggcggcatcgacaacatcccgaaggagagtacctggctgcttgatgctggtgagcgggtgctcagtccgaatcaaaacagggacctgactgctttcctcagcagggaaggcggcgcgagtgctggggctggacaggcgccgtcgatcactatcaacgctccggtcacggttaatgcccagcccggcatgagccaagaggaagctcgaatgcagggagaggctgccgggctggccttgcgggaggaggtccggggcgtcattcgggaagagttggggcagaacggtctgctttggaggcgataa

SEQ ID NO: 13357 - DNA, 348 bp, Pseudomonas aeruginosa
gtggctgagaccttttcttactgtacccgccttggagctagcggcgagattgcccagcgcacctggcagaacgacttcggggatggatacgttcagtccggcggaacggggatcaacaccagatccgagatctgggatggaatgacgatcatcgggcgcctggaggctggtgatgatctcctgggcgcccgcgccttcctggaccggcacgaggggtataggtcgttcctatggacgccccctggcggcgcacagggtcgataccggtgcaatggatacaagctgaggccgttgggtggagggctgtacgaactgagtttcacgttcgtccaagtcttctacccgtag

SEQ ID NO: 13358 - DNA, 642 bp, Pseudomonas aeruginosa
aatctacggctggtccatggccaacagggtccggctgatccttcgccacaaggacttcccccaatgaagaccgtgcgactgcatggcgcgttgcgccgtgaatttggccgtgagtatgtgctcgatgtatcaggtccgcgagaggccaccattgccctggccagcatggtagatggtttcgagaaattcatgcgaaccgcagaagagcgcgggatgcggttcgcggttttcgtagggcggcgaaatcttcgcgaagaggagcttgacctggccggagccggcgagtcggtcatccgcatcgtgccagtcatccaaggcagcaagagttccggaatttttcagacggtcctgggagcggcgttggtcgttgcgggctatttcacgttcggcaccacctcggcaataggcgttgcaatgatggctggcggcgctggcctggcgcttggtggcgttgcccagatgctggccccgtcaactcaggcttccgccgcgaagaacgaggatgggaataacccgagctatggattcggtggcgccatgaccactattgctcagggcaacccatacccagtgctttacggcgagcgagagatcggcggcgccgtcgagtcgggcggggtttacacggaagaccagctctag

SEQ ID NO: 13359 - DNA, 291 bp, Pseudomonas aeruginosa
tgtatgagttacggaatgagaacgcgttcggccggcggctcaatactctttgacagcaacaattactcattgaggatggtctatcgtcgggacttggggaacattcctcagggactttcagttacggtccctgggttcgacggttctaaaggtgtcatgtttgtcgtctgcaatacgccggattctagatcttggattcccaggcataccattagcggctcgactattacgtttggttggtccggtgatgtaacagcgaattacactctatatgcggtgatgttctcatga

SEQ ID NO: 13360 - DNA, 282 bp, Pseudomonas aeruginosa
accgctgctgatcgatgccgatggacctgtggagttaccgcgatgatcgactggagcaaggtaaagaccgccgaacagcaggcgcaagagcgcaggcaggctgagtacgatgccgcagccgtggcgcgagcaaatgcctaccgcctggagagtgacccgctcaagaccgaggctgaattcgctgcgatcaaggccggtaccgagccggactacagcgcctgggccgccaaggtcgaggagatcaaggccaggtatccgctgccggagacgggcggcgtgtag

SEQ ID NO: 13361 - DNA, 528 bp, Pseudomonas aeruginosa
agtgaggttgtctatgcccatcaccgagcagcaactgctgcatatcctcccgaacgccggccctcgagccggcgtttttgttggtgcgctgaaccgcgggatgacgcgcttcggtatcacgtcgcctgtgcgcgcggcggcgttcctcgcccaagtcggccacgaaagcggccagttgacccgcttggtggagaacctcaactacagtgcccgtggcctggctgcgacctggccgagccggtacctcggcgccgacggccagcccaacgccctggcgcagcgcctggcgcgcaacccccgagccatcgccaacaacgcctacgcctcgcgcaacggcaatggcgacgaggcatcgggcgacggctggcggtaccgcgggcgcgggctgctacagatcaccggccggtcgaactaccgcgccgccggcaccggggctgggccagccgctggagcaggaacccgaactgctcgagcagccggagtgggcggcgatctcggcggcctggtggtgggccagtcacggcttga

SEQ ID NO: 13362 - DNA, 279 bp, Pseudomonas aeruginosa
tcaggagttgggtctatgaggatggtgctgatgctggtggtgttcgcgctggcgggatgcgccggccggcaggaagccgagccgcgcacggtgcgcgtagaagtgccggtggcggtgccgtgccgagcgcccgcggtcgaggtgccggcatgggcagcggctgggctgaagaagagcgacgacctacagaccaaggtccgcgcgctgctcgccgaacgcttgcagcggatcggttacgaggcgcagctcctggctgcgaaccgggcctgtcaggattag

SEQ ID NO: 13363 - DNA, 1083 bp, Pseudomonas aeruginosa
tccgtagcatcagaggcgcgccgctcctgttcggcgcgcgtggccggccgcgggccgacgtcgcggcgctggcacggctgctgtcgaatctctcgcggttcgcctgggaggcgggagagcgcttgcgctcggtggacctcaacccggtcatcgccttgcgggagggccagggcgcctgggcggtggatgcggtgttggaagtcgacgaggtggccgatggcgctcgatcctgaggtactcctgaactacccgatccccgaagtacgccagcgctacagccggcgcgacagcgccttctacgcattgaccctcggtctgggcggcgacccgctggacgagcgccagctggcctacgtcgatccgtgccgcgatctccaggcattgccgtgcatggccctggtgctcggtcatccgggcttctggctgggcaatccggcgactggcgtggacgcgctgcgcctggttcacggcgagcagcgcctggagtggcggcggccgttgccggcggaaggcgaggtgatcggccggacccgggtcaccggtctggtagacaagggcgccgacaagggcgcgctgctctacagcgagaaggtgctcagcgacgcgctcagcggcgaggtgctggctgtcgcccgcagcaccaccttccttcgcggcgacggcggcttcggtggttcccggcaggtgccggaaacgccgcatcgcttgcctgaacggacacccgacctgcgactcgacctgccgacccgtccggagcaggccctgtactaccgcctcaacggcgacgacaacccgctccacgcggagcccgcggcagcgctgcgggccggcttcccgcggccgatcctgcatggcctgtgcaccctcggcgtggcattccacgcggtgttgcgcgggctcgccgactaccgcgcggggcaactgggacatctgcaggtgcgtttctcggctccggtgtttcccggcgagaccttgcgtaccgagatgtggagcgacggctcgttccgcactcgcgtcgtcgagcgcgatgtggtggtgctggacaacggccgggtaggtccgccgccagagcggccggactga

SEQ ID NO: 13364 - DNA, 1392 bp, Pseudomonas aeruginosa
agatcaaccgaaatcctgcttgcgagaacaagaataatgaatgcaaccgcgctttcaccgaacccggcgccggccatttcccggcgcaccatgctgatcgccttcgtcttctgcttcctcggcctgctcgccgacggcgtcgacctgatgttcctggcctacagcctcaacagcctgaaggccgaattcggcctgagcaacttcgaagccggctccctcggcagcctgactctcgccggcatggccgtcggcggtatctatggcggctggtgctgcgaccgcttcggccgggtgcgagtggtgacctggaccatcgtgctgttctccatcggtaccgcgttgctggggctgacccagaactactggcagttcgcgctgatccgcttcgtcgcctcgctcggcctcggctcgctgttcgtcgcctgcaacatcctgatgtccgagtgcgtcggaaccaggtaccgcaccaccatcctcgccgccatgcaggccggctggaccgtgggctacctggtggcgaccctgctggcggggcagatcatccccgagttcggctggcgcgccttgttcttcaccgccgtggcgccggcgctggtctgcctggccctgcggccctgggtgccggagtcgccgtcctggctcgcggcccaggccgggcgccagcgtcccggcgcggctccgcagagccacgccgaggctggcggcgccggcccgctgggacggatgctgggcgatccggaaacgcgcggcatgttcctgctctggagcctcacctcctgcttcctgctgttcggctactacggcaccaacaactggatgccgtcctacctggagagcgagttggggatgaacttcaagtcgatgaccggctacatggtcggcacctacagcgcgatgatcctcggcaaggtcgccgccggcgtctgcgccgatctcttcggtcggcgcctgaccttcgccgccggggccatcggcagtgccgctttcatgccgttgatcgtgttctaccactcgccctccaacatcctctggatcctcatcaccttcggcttcatctacggcgttccggtcggggtgctggccacctacatgaccgagagcttctccacccgcgtccgcggctcggcagtgggcaccgcctacaacctggggcgtatcggcgcggcggtggcgcccgccggcatcggcctgctggccacccacgtgtcgatcggcgcgggtttcctggtgatgggcatcacctacgtgctcaccggactgatcccggcgctgttcattgcggaccggctctacgacccgaaccgcgagtcccgcgatgccgagagcgcttcccgacggcaagcgccgggcagtgccgtggataccgccgagcggcgcgcggccaaggcctga

SEQ ID NO: 13365 - DNA, 804 bp, Pseudomonas aeruginosa
cccgccaggccatccagttgcacggcggcatcggctacaccgacgaggcggacatcggcctgttcctgcgccgcgccatggtactgctcaatgcccacggctcgctggcgttccacaaggcgcgctacgccgcgctgctacagcgggaggtggcctgatgagcggtttgttgcaggaaacgcgcggcacggtgcgcctgctgcgcttcgacaacccggcccggcgcaacgcactgtcgccggcgctgcgcatggaattgctgcgggccctggaggcggccgaatgcgacccatcgatccgcagcgtgctgctgaccggtggcgaagaggtgttctgcgccggcggcgacctgggcgacatgcgggtgaccgagttggccgccggcagggcgcgaatgcaggacaacgcgcggctggtgcggcagatggtgcgcatgggcaagccgctgatcgccgcggtcgagggctgggcggtgggggccgggctgtccgtggcgctggcctgcgacagcatcgtttgcggcgccggcgcccgcttcgccgccggcttcggcaaggtcgggctgctcgccgacctcggccagttgcataccttgccggcgcgcatcggttgggggcgggcacggcagatcctgatgttcggccaggtggtacaggccgaggaggcactgcgcatcggcctggccgaccgcctctgcgccgctggcggcgccttggcgatggcgctggagctggccgggcgggtggagcagcaggcgccgttgcccctggcgatgaccaaggcgttgctcgccgagggccttga

SEQ ID NO: 13366 - DNA, 393 bp, Pseudomonas aeruginosa
tcaacggacagaagacctggaccaccatgggctcggaggccaactggatcttcctgctggtccgcaccgagcgcagcgccaaggcgcagcacggcatcagcttcctgctggtgccgatggacagcccgggcatcgaggtgcggccgatcctcaacctggagctgcacggcgagttctgcgaagtgtttttcaacgacgtgcgggtgccctatgacagcctggtcggcggaatcaaccagggttggagcatggccaaggcgctgctcggtttcgagcggatcttcctcggttcgcccaagcagtccaccttcgctctccagcgcctggagcgcctggcccggcacctgggactgtggcacgaccctctgttcgtgcgccgcttcgccgcgctga

SEQ ID NO: 13367 - DNA, 1170 bp, Pseudomonas aeruginosa
agatcttccagtccgaactgttccagcgcatcagcgagctgggcctggaggtcgccggggaggattcggccctgctgcagcccttcgccgaagaccccgagttgcatccggcggggatcttcatccagtcgcggccgaccaccatctacggcggcagcaacgaaatccagcgcaacatcctggccaagagcgtcctcggcctgtcgggctgagcgcaaccgaacgacatccacgggacgaagaggattacccatgagcagcagactcaatgaaggcaaggtcgcgatcgttaccggcgcgggcggcggcatcggccgcgagatcgccctggccctggccgattccggggcacgggtggtgatcaacgatatcggcgtatcgctacagggcgagggcgggtcggcctcgccggccgaagagacccttggcctgatccgccagcgaggcggcgaaggtctgatcaacaccgacagcgtcgccgactgggacagcgcgcggcgtatcgtcgaatgcgccatggacggtttcgggcgtctggatatcgtggtgaacaacgctggcatcctgcgcgatgcgatcttccacaagatgagcgccgacgactggctgtcggtgatcaatgtccatctcaacggcagcttcttcgtcagccgggccgccgccgaacgcttccgtacccagcaggccggcgccttcgtacacatgaccagcacttccgggctgatcggcaacttcggccaggccaattattccgcggccaagctgggcatcgtcgccttgagcaaatccatcgccctcgacatgcagcgctacaacgtgcgttcgaattgcatcgcgccgttcgcctggagccggatgaccgactcgatcccggccgcaaccccggagcagaaggcccgcgtcgacaagctgcagcgcatgacccccgagaagaacgcgccgctggccgtctacctggcgtccgacgccgcccgcgaggtcaccggccaggtgttcgccgcgcgtcaccacgaactcttcctgatgagccagagccggccgctgcgcagtgtgcatagcgagcacggctggaccccggagagcatcgccgagcacggcatgccggcgttgcgcggcagcttcatggacctggcgcgcagcccggacgtgttctcctgggacccgatctga

SEQ ID NO: 13368 - DNA, 381 bp, Pseudomonas aeruginosa
ccgaggaggcaatccatgggcgtgttcaggacccgtttcaccgagaccttcggcgtcgaacacccgatcatgcagggcggcatgcagtgggtcggccgtgccgagatggctgcggcggtggccaacgccggtggcctggcgacgctgtcggcgttgacccagccgagcccggaggcactggctgcggagattgcccgctgccgcgagctgaccgatcggccgttcggggtcaacctgaccttgctgccgacgcagaagccggtgccctatgccgaatatcgcgcagccctcctcgagacgggaatcccccgtcctccaaaaccgccggcaacgaccccggcgagcacatcgccgaattccgtcgacacggcgtcaaggtga

SEQ ID NO: 13369 - DNA, 1659 bp, Pseudomonas aeruginosa
gcgggggctggccggcgaaggcgtgcatggtacgggaaacacggcggatcgcgacagcttggagccagtatgaaaactcggaatgacgtggcgaataaaggtcgtttgttgctaccgggcaaaccgactaaaacgagcggaaacgaacagccaggagaacctcacatgatcgacggattgctgcgcagtctcggcctcgaccccaatgcctttcgcgatggcgagcttgccgtgcatacccccatcgacggcagtcgcctggctgcggtgcgactggaggggcgcgccgccgttgccgccaaggtcgagcgcgccgaacaggcgttccgcgcctggcgccaggtgccggcgccgcgccgtggtgaactggtgcggctgttcggcgaggaattgcgtcggcacaaggccgaactcggcgaactggtgtcctgggaggcgggcaagatcacccaggaaggcctcggcgaagtccaggaaatgatcgatatctgcgacttcgcggtgggcctctcgcgccagttgtacggtcttaccatcgcatccgagcgtcccggccaccacatgcgcgagacctggcacccgctgggcgtggtaggcgtgatcagcgcgttcaacttcccagtcgcggtgtggtcgtggaataccgcgctggcgctggtctgcggtaattccgtggtctggaagccttcggagaagacccccctcaccgcactggcctgccaggcactgttcgagcgtgccgcgcgggccttcggcagcgatgcgccggcgcacctgagccaattgctgatcggcgaccgcgaggccggcgaagcgctggtggacgaccgtcgcgtcgccctggtcagcgccaccggcagcactcgcatggggcgcgaagtggcgccgcgggtggcggcgcgtttcgctcgctgtatcctcgaactgggcggcaacaacgcgatgatcctggcgccaagcgccgacctcgacctggcggtgcgcggcatcctgttcggcgcggtgggcaccgccgggcagcgctgcaccaccttgcgccggttgattgcccatgagtcggtgaaggacgagatagtcgagcgcctcaaggcagcctattccagggtccgtatcggtcatccgctggagggcaacctggtcgggccgctgatcgacgaacgcagctacctggccatgcaggacgccctggcgcgagcccgcgagcagggggggcgggtgttcggcggcgagcggcaattgcaggagcgctatccggatgcctactacgtgtcgccggccatcgtcgagatgccgggacagaccgaagtggtgcgcacggagaccttcgcaccgatcctgtacgtggtcggctaccgcgatttcgacgaggccctgcgcctgaacaacgaggttccccagggactgtcgtcgtgcatcttcaccaccgacctgcgcgaggcggaactgttccagggcgcggcgggcagtgactgcgggatcgccaacgtcaacatcggcaccagcggggcggaaatcggcggggcgttcggcggcgagaaagagaccggcggcggccgcgagtccggctcggacgcctggaaggcctacatgcgacggcagaccaacaccgtcaactattcccgcgagctgccgctggcacagggcatcaccttcgattga

SEQ ID NO: 13370 - DNA, 1314 bp, Pseudomonas aeruginosa
ggaggtcgtcatgagcgctctcatcaaggaacgtcccagcgccgatgccgtcctggccaaggccgtcctggccgcgcgcgagcaattggggctgacgcagctcgaactggccggcatcgtcggcgtcgatcgcagcgccatcagccgctggaagacccagggcctgcgggtggacagcaagaccggcgagctggctctgctgctggtgcgagtctatcgcgcactgtatgccctgttcggcgggcagcaggaggacatgcgccacttcctgcgcactcccaaccatcacctggcgggcgagccgctggcactgatgggacaggtgcagggcctggttcatgtgctggaatacctcgatgcgatccgcggcaaggtctgatacccggcgcgcctgtacgggggcctacgcctgtcacggaaaaggctggcagccagaggcgacaagcctggctgaatggagactgcggtgccgctacgctggcatccgacaccacaggaagcgaggggcggaaggtgagcgagatctggcgacagtgcaagggtgagcggcatatccgaccgctcccaggggcgcctggtgcggttggtggagagccaggagcaggtggcgaccctgcaattggtcgacaccctggaagaacaggcgttgctcgaggaactgctcgagtcgagcaagccgccggtgccggcggatgccgagccattgcattacctgttgaagaccccgttccgttatccgcccttgcgctgggggtcgcggtttggccgtcgccacgagccaagcctgttttacgccgcgctgaagctggaaacggccatggccgaaagcgcgtattaccgttgcgtcctgtggagtggcatggtggtgccgccaccgagcgggaggattctgtccgagcacgcttcgttcgaggcgggctggaaggtggagcggggaatccgtctgcaggcgccgcctttctccgatcacgaggctgcgctgaccgacatcgccgaataccgcgctccccaggaactgggaagtgccatgcgcagcgccggggtgcaggcattcgaataccgttcggcgcgttgcccggagcgcggctgcaatgtcgccctgttcacgcccgcggccttcaccgaaaagcgtcctcgcaacctgacgccctggctgtgcgaaaccacggccggttacgtggccttcaagccggcgcatgtgccggggtcgccgaaaatcttctcctgggagctgttcctggtggacggaaagttgccgcatccggcgtgagtggaggggggctcggttgccagcgatccgggggcaccgtctga

SEQ ID NO: 13371 - DNA, 534 bp, Pseudomonas aeruginosa
  unsure (348): Identity of nucleotide at the above locations are unknown.
aatcccgagtgcggccgcgcctccgccaggcctccaggggaatgccgggcagcgccgcggtcactggcggtagcccgggttctgctggtcgagcttgcgcagcagcgccggccaggcgagctggccgcccatgccggtcttgctgcgcatcaccccggcgatcatgtcgcgcgcgccggcgaggatctgccccgggatgtggatcagctcggcgccgccgctctgcgccatcacctgtacctcgcaggcgcgttgcagggtgaacatcatgaggaaggtatcggcgatggaaccgccgcaggtgagcaggccgtggttgggcaggatcaggaagttgctggtccccangtcggcctgcaggcgggccttttcctcatggttcagggcgacgccctcgtaggcgtggtaggacaggctggaaagcacgaacaacgattgctgcgacagcggcaacaggccctgcttctggcaggacaccgcgatccccgcggcggtatgggtgtgcagcacgcactcgacgtcgtggcggaactc

SEQ ID NO: 13372 - DNA, 981 bp, Pseudomonas aeruginosa
  unsure (26): Identity of nucleotide at the above locations are unknown.
ggaaaaggcccgcctgcaggccgacntggggaccagcaacttcctgatcctgcccaaccacggcctgctcacctgcggcggttccatcgccgataccttcctcatgatgttcaccctgcaacgcgcctgcgaggtacaggtgatggcgcagagcggcggcgccgagctgatccacatcccggggcagatcctcgccggcgcgcgcgacatgatcgccggggtgatgcgcagcaagaccggcatgggcggccagctcgcctggccggcgctgctgcgcaagctcgaccagcagaacccgggctaccgccagtgaccgcggcgctgcccggcattcccctggaggcctggcggaggcgcggccgcactcgggatttcaagggcttcccgatccgcaattgggaagccgggcagggtcgcccgttgctgctgatccacggttttcccagcgccgcctgggactggcaatacctctgggagccgctggcgcagcgctaccgcgtgctggtctgcgacctgctcggcttcggcgattcggccaagccgcgcgcccatcgatacagcctgctggagcaggccgacctgcaacaggcgctgctcggccgcctgggaatcgacgagccgctgcacgtgctggcccacgactacggcgacagcgtcgcccaggaactgctcgcccgccatcacgaaggccggctgcggctcgcctcctgcgtgttcctcaatggtgggctgttcccggaaacgcaccgcccggtgctcagccaggacggcgacgaaaacctggtcagccacctgaacggcggcgccggcggcagctggatcagaccgtgtaaaaacgcagcaagcgatggcgatcaactgctgagtgattttcttagtcccaggaggccgtgggaggctcaatcaggcgcaatcggtgattctgattgtatgggcacttccggcttcggcgcgcctgttgagagggggcaagagtcgtaa

SEQ ID NO: 13373 - DNA, 474 bp, Pseudomonas aeruginosa
  unsure (187): Identity of nucleotide at the above locations are unknown.
gagttccgccacgacgtcgagtgcgtgctgcacacccataccgccgcggggatcgcggtgtcctgccagaagcagggcctgttgccgctgtcgcagcaatcgttgttcgtgctttccagcctgtcctaccacgcctacgagggcgtcgccctgaaccatgaggaaaaggcccgcctgcaggccgacntggggaccagcaacttcctgatcctgcccaaccacggcctgctcacctgcggcggttccatcgccgataccttcctcatgatgttcaccctgcaacgcgcctgcgaggtacaggtgatggcgcagagcggcggcgccgagctgatccacatcccggggcagatcctcgccggcgcgcgcgacatgatcgccggggtgatgcgcagcaagaccggcatgggcggccagctcgcctggccggcgctgctgcgcaagctcgaccagcagaacccgggctaccgccagtga

SEQ ID NO: 13374 - DNA, 366 bp, Pseudomonas aeruginosa
tccacggttttcccagcgccgcctgggactggcaatacctctgggagccgctggcgcagcgctaccgcgtgctggtctgcgacctgctcggcttcggcgattcggccaagccgcgcgcccatcgatacagcctgctggagcaggccgacctgcaacaggcgctgctcggccgcctgggaatcgacgagccgctgcacgtgctggcccacgactacggcgacagcgtcgcccaggaactgctcgcccgccatcacgaaggccggctgcggctcgcctcctgcgtgttcctcaatggtgggctgttcccggaaacgcaccgcccggtgctcagccaggacggcgacgaaaacctggtcagccacctga

SEQ ID NO: 13375 - DNA, 609 bp, Pseudomonas aeruginosa
tgcgcagcaagaccggcatgggcggccagctcgcctggccggcgctgctgcgcaagctcgaccagcagaacccgggctaccgccagtgaccgcggcgctgcccggcattcccctggaggcctggcggaggcgcggccgcactcgggatttcaagggcttcccgatccgcaattgggaagccgggcagggtcgcccgttgctgctgatccacggttttcccagcgccgcctgggactggcaatacctctgggagccgctggcgcagcgctaccgcgtgctggtctgcgacctgctcggcttcggcgattcggccaagccgcgcgcccatcgatacagcctgctggagcaggccgacctgcaacaggcgctgctcggccgcctgggaatcgacgagccgctgcacgtgctggcccacgactacggcgacagcgtcgcccaggaactgctcgcccgccatcacgaaggccggctgcggctcgcctcctgcgtgttcctcaatggtgggctgttcccggaaacgcaccgcccggtgctcagccaggacggcgacgaaaacctggtcagccacctgaacggcggcgccggcggcagctggatcagaccgtgtaa

SEQ ID NO: 13376 - DNA, 1389 bp, Pseudomonas aeruginosa
gcccggcgtccgaaccgaaacgcacttccttgttgcgatgatcggcccagacctccagcaggttctgctccttgcgcagcatcaggcctggcacctggatgctcaggcgcagcaggctctggtccgcgctgtgccgttcgaccctgccgagctggacgaagcgcagggggcgggcgccggtcgcgcggtcggtgggcagtggcgccaggcggagcaggcggaaatgctccggggccagttcggcccaggggtgcggcggtttcttctcggcttcttctgcggccggttgggtatcgctatcgatcatcggacatcctctggccggccgccttcacgggccggctttcagaacttgtcggcgcgggaagcgatttctgtagcggctcagcggcctttttccgcctctgcgccgcgcaggatgaagcggctgaccgcctcgaccagttgccgggccagcggcaggttcgggtcgttgtaggcggaaagctgctggagaccggtgctcggggcgatccgcaggatgtggttcatgccgtcgatgagcaccagttgcgagtcgggcttggctcgctggagcgcctcggcgtcggcgacgccgacctggatgtcattgcggccctggacgatcagggtcgggatgcgcaggcggccgaacgcgcgggccgggtcttcgcggaacagcgagatcaggtacggctgcacgctggggcggagcaggttggcgagcgccggcgggatatcgccgcgggtctccccggccttcagcgaagccagcaccgagtcggcctggcgcagttgcgccggcggcaggcgaccgcgcagttgctcgcgcaacacccggtcgatgggttggccgctgccggcgatggcgatcaattcctcggccggcgtgcgaggcgccgccaggctggcgatcagcgcgccttcgctatggccgaccaggatcagccgggagaagcgcgggtcgcgggccagccgctcgctccaggcgaccacgtcgtcgacataggcgccgacgctgaggtcttcctcgcgtggcgccgccgccaggctgcgggcgactccccgcttgtcgtagcgcacgctggcgattccgcgttcggccagggcctcggcgagacgcagcaggtagcggttgttgccgccgaaggggttgttgccgtcgcggtcggtgggaccggagccggcgaccagcaggaccaccggcggcggcacggcgctgcgcggcagcagcaaggagccgcgcagcacgccgtgcccggtgtccaggtcgtaggggcggtgcaggatgctgttgggagcggcgtgggccaggctggcgagcaggcagaacagggcgaggagggcgcgcggcatggaggtcttcatgggccgatgatagcgctttga

SEQ ID NO: 13377 - DNA, 1284 bp, Pseudomonas aeruginosa
tggccatcgtcctgctcgaccaattgctgcgccagcgtgggcagaacgccgacgtgcgcgtcgacacgccggtcctgccgcagctgtgagggctgtggcaggcagcgatgcgggacgggtgaacggcggatcgtgaccagcgcggttccctactggcgcctgtccagcttctatttcttctatttcagcctgctcggcgccacggcgccgttcctcgccctgtatttccatcacctgggcttccccagtccgcgcatcggcgagctggtggcgattcccatgctgatgggttgcgtcgcgcccaacctgtggggctggctgggcgaccgcagcggccagcgcctgaccatcgtgcgcttcggcgcggtatgcacggcgctgggcttctcgctgatcttcgtcagccacagctacgcctggctggccttggtgatggcgttgcacgcgttcttctggcacgccgtgctgccgcagttcgaggtcatcaccctggcccacctgcgcgagcgcagcgccagctacagccggattcgcctgtggggctcgatcggtttcatctgcaccgtggtcggtctcggcgcgctgttcgagcgcctgagcctggatgtctacccggcgacgctgctgggtatcatgctcggcatcgtgctgtgcagctggtgggtgcccaatgcccagccggcccatcgcgaaccgcgcgaaggcgagggcggcttcctcgcccagttgcgccagccgggcgtgctggcgttctacctgtgcgtgtgcctgatgcagctgtcccatgggccgtactacaccttcctgaccctgcacctggaatcgctgggctacagccgggcgctgatcggtctgctctgggcgctgggggtggtcgccgaggtcatgttgttcctcgccatgccacgcctgctgcaacgcttcagcctgtgccaggtgctggccgcgagcttcctgctggcgtcgttgcgctggctgcttctcggcaacctggccgacagcctggcgctgctggtctttgcccagacgctgcatgccgccaccttcggcagttttcatgcggctgccatccatttcgtgcagcgtagcttcggcccgcgccagcagggccagggccaggccctgtatgctgcgctggccggtaccggcggagccctgggcgcgctgtattccggctatagctggaacagcctgggccctgcctggaccttcgccatcgccagcctggcagccttgctggcagccgctatcatcagtacccgtttgcaagaggtgcgggcatga

SEQ ID NO: 13378 - DNA, 1299 bp, Pseudomonas aeruginosa
gccgatgagcagccttaccgtctatcacgagaaccagccggagcagccgctgaagctgctgacccatgccgaggacatcgcttcgaccctggccgaggtcggcgtccgtttcgaacgctgggaagccgccgcgccgatcgccgccggcgccagccaggacgaggtgatcgccgcctacgcccacgagatcgagcggctcaagcgcgagcgcggctacatcaccgtggacgtggtcagcttgaacagcgaccacccgcagaaggccgaattgcgcgccaagttcctcgacgagcaccgccatggcgaagacgaggtgcgcttcttcgtcgccgggcgcggcctgttcgtcctgcatatcgaggagcatgtctacgccgtgctctgcgagcgcaacgaccttatctcggtgccggccggcacccgccactggttcgacatgggcgagcacccgcatttcgtcgccgtgcgcctgttcaacaacccggagggctgggtcgcccagttcaccggcgacgacatcgccagccgcttccccctgctggaagactgagcgaggcaccgtcccatccgtcaccatccgcgcccccggtcctgccgggggcggtttcatccggagtccgcatgaccatcaaagccatcctcaccgacatcgaaggcaccaccagcgcggtcagcttcgttttcgacgtgctgtttccctatgccgcccggcacctgccggacttcgtccgcgaacacgccggagagaccgaggtagccgcacagttggcggcggtgcgtgccgagagcggtgaggcggacgccgatgtcgagcgggcgatcgcgatcctcctgcaatggatcgccgaggaccgcaaggcgacgccgctgaaggccctgcaaggcatggtctgggcccagggctaccgcgacggtcaattgaagggccacgtctacccggacgcggtgcaggcgctgcgcgagtggaaggcccgtgggctggacctgtacgtctattcctccggctcgatccaggcgcagaagctgatcttcggctgttccgaggccggcgacctgggcccgctgttttccggctacttcgacactaccagcgggccgaagcgggaaagcgcctcctatgcgcggatcgccggggccatcggcctgccggccgcggaaatccttttcctttccgacgtggtgcaggagctggacgccgcgcgcgacgcgggcatgcgcacgctcggcctggcccgcgaaggcggcagcctggacggccatccgacggtggccagcttcgccgacatcctcgtggagtga

SEQ ID NO: 13379 - DNA, 222 bp, Pseudomonas aeruginosa
gggaacactcttgctcgggagcatcgcgccatgggttccaccctcagcgggctgatcagcctggtcatcctggccctggatatctgggccatcgtcaacatcctgaaaagcgctgcggaaaccgggatgaagatcatctgggtcctggtgatcatcgtcctgccggtgctcggcctgatcatctgggccatcgccggcccgcgcggcaacgtcaggctgtag

SEQ ID NO: 13380 - DNA, 864 bp, Pseudomonas aeruginosa
cctcccgccgcggcgttagccgcctgcggcgtagtggtgccacaggtggatcgcggcgtaggcgcgccaaggccgccaggcctcggcgcgggccttcaggctgcgcgcatcgatgccttgcggcccccagaccgtggatttcagcaggccgaggtcggcggcggggaaggcgtcggcttcgcccatggcacgcagggctatgtattcggcggtccaggggccgatgccgggcaacgcgcagaggcgctccaccagggcctcggggccgtccgccaggtccaggctcagctctcccgaggcgatcgccgcggcgaagcgttgcagcgtctgtacccgcttgccgggcatgccgatgccgtcgaggttggcttgcgccagcgcggcgggcgtcgggaacaggtggctgatgccgtcgtaaccgagatcttccagcggctcgccgaggcgctggatcaggcgcccggtgatggtcaccgcggccttcaccgtgacctgctggccgacgatggcgcgcaccgcctgttcgaagggatcgaaggccaccggcaggcgcagtcccggattggcggccaccagcgggccgagcaggggatccccggcgaaatgccgggcgatggcggccgggtcgctgtccaggtcgaacatccggcggacccgtgcctcgagttcggcggccagggcatgggcggacgggctgaggctcagcgccaggacctggcgttccgccagcggtcgcacctcgaaccaggccgggcgaccgttggcccggaagctgcgggcatagtggtcgtcacccaggctttcgacaccggcgagcaggcgcagggcgaaatgctggtggaactggcgccattcccagggtga

SEQ ID NO: 13381 - DNA, 861 bp, Pseudomonas aeruginosa
ggtgcgcaccgagcaccagcacctggtgattttcgaaaacgcccggatgggccgggtgatggcgctcgatggagtgatccagaccaccgaggccgacgagttcatctaccacgagatgctcacccacgtgccgatcctcgcccacggcgcggcccggcgcgtgctgatcatcggcggcggcgacggtggcatgctgcgcgaggtggccaagcacaagagcgtcgagcggatcaccatggtcgagatcgacggcaccgtggtcgacatgtgcaaggcgttcctgcccaaccactcccagggcgccttcgacgacccgcggctgaacctggtgatcgacgacggcatgcgcttcgtggctaccacggaagaacgcttcgacgtgatcatctccgactccaccgacccgatcggccctggcgaggtgctgttctccgagaacttctaccaggcctgccggcgctgcctgaacgagggtggcatcctggtcacccagaacggcacgccgttcatgcaactggaggaagtgcgcaccaccgccgcacgtaccgacgggctgttcgccgactggcatttctaccaggcggcggtgccgacctatatcggcggcgccatgaccttcgcctggggttcgacccgcgaaggcctgcgtcgccttccgctggaaacgctgcgccagcgcttccgcgacagcggcatcgccacccgctactacaacgccgatatccacctgggcgcgtttgctctgccgcagtacgtgctgcaggccatcggcaagcaggacaacgactgacgcttcaccaagaagggccgcaaggccctttttcatgcgtcgctccgacatcccctgttactgccagctaa

SEQ ID NO: 13382 - DNA, 402 bp, Pseudomonas aeruginosa
ccctggtcaaggcggccaaggagcgcttctccgaagaaccgcgcgaacatctggaatgcccccctgtacgacaatgtcgccctggagaccacccggcagatgttgctgacccccaacgacaagctggtggacgccgatgaggccgcggtgcgccgcgagttcaccccgccggcggcgaataccctgccgatccgcaacgtggtggtggtcctgctggaaagcttcccccggccctatttttgggcccctgggggcccccgggcaacatcaccccgtatttccaaaaacgggtcaaggaatgcctgctgtttcaccagttcttctccaacggcacccatacccaccagggcatgttcgccaccatggcctgcttccccaacctgccgggcttctaatacctga

SEQ ID NO: 13383 - DNA, 954 bp, Pseudomonas aeruginosa
tacaaaccccggagggcggccacaagttctccggcctgccgcaattgctcaacgccccgccaataccaggacgtctacgtctacaacggcgatttcgcctgggacaaccagtccggcttcttcagcaaccagggcatgaccaccttcatcggccgcaacgactatgtcgacccggtgttctccgatccgacctggggcgtctccgaccaggacatgttcgcccgtggcaacgaggaactggacaagctggcgagcaccggcaagccgttctatgcgctgttgcagagcctctccaaccacgtgccctatgcgttgccgaaggacctgccggtggagcgcgtgaccggctacggttcgctcgacgagcacctgaccgccatgcgctattccgactgggcgctgggccagttcttcgagaaggcgaagaagtcgccgtactacaaggacacccttttcgtggtggtcggcgaccatggcttcggcagccccgagcagctcaccgagatggacctgcaccgcttcaacgtgccgctgctgctgatcgcccccggcatccaggagaagttcggtacccacctgccgaccgtcggtacccaggtcgacatcgtgccgaccatcatgggcctgctcggcggcgagaccgtccaccagtgctggggccgcgacctgctgaacctgccggaaggcgacaagggcttcggcgtgatcaagccgtcgggcagcgagcagaacgtcgccatcgtctccggcaaccgcatcctggtgcggccgaaggacggtgacgtgcgcgtctacgattaccaactgggcggcgatgctaaggcggtgatcaccaaggaagtgccggaccaggccgagctgcagaagaatctggagtcgttcatccagaccgcgaccaagagcctgctggagaataccgcgggcgtggtacacgggatcccggacaaggactga

SEQ ID NO: 13384 - DNA, 1116 bp, Pseudomonas aeruginosa
cgatcagggcgtatccgtctgctggctttccagccagcgcaggacttcggcggtggcctggatcaggtccgccggtatgtactggtcgacattgccgtcgcgcagcagcgcccgtgccagcggaattcgttgcagcaccgggattccttcttcctcggcgatgcgccggacccgcagggccagggcgtcggtgtgcttcagggtgaccagcggcaggggcgtttcgccgcgtcgatagcgtatgccgatggcgacgtgggtcgggttggcgacgatcaccgaggagcgccggacatccgcgcgcaggttgctcgattgcagttcctgatggaattgccggcgcttgctcttgatctccggactgccctccatctccttgtactcgcgcttcacctcgtccttgctcatgcgcaactgcttgtagtgctggtggcgttcgaaggcgtagtcggcgacggcaatcgccaggaagccgaccgcgcagaccagcatcagctgcctgagcatcagcccgctcaccggtgccacgcagtccagcccgcaggcgggaatccgcaggaggctggccaggttgccctgcaaggtcagccagaccagcagggagagcagggcgaccttcagggtcgacttgaggaactccaccaggctccggatcgagaagatcttcttcgcgccctccaccgggttgatcttcttcaggtccggcttgacgctgtcgaggctgagcaggaaaccgtactggccgacatggctgagcaccaccaccagcgccgcgaccagcaggaccggcgccagcaggtagaggagctcctggagaaggttctccaggatggtctccagcgcctggcgaaacggcaggtcgatgtactcggcgggcagcaggagcagcttgccgagatgctccaggtagtagtcggaaaagcccatcagcagcgccaccagcgacaggatcaacgcgctggagacaatttccttgctcttcaccacctggccttgccggcgggcgtcgcgcagcttcttcgccgtgggctgctcggtcttctcggcgctcatggcgtctccagcacgggacgcagcaggcgcagcgggtcgacggcgagcagcagggcatcgtag

SEQ ID NO: 13385 - DNA, 1041 bp, Pseudomonas aeruginosa
agtggaggatgtcggcgctgctcatggtcagcctccgtagctgatgaccaggccgtgggtcagccgcgcccagccgtcgaggaggacgaacaggagcagcttgaacggcagggaaatggtcatcggcgacaccatcatcatgcccatcgccaggaggatgttggagatgatcaggtcgatggcgatgaagggcaggtagatcaggaagccgatctcgaaggcacgggtcagttcgctgactgtgaaggccggcagcaggatcagcaggctgtccgggtcgagccgctcggcgtattcgctgggccagacctggcgggtgctttccatgaagaaggtgtgttcgcgctcctggatctgccgcttgaggaagttccggtagggcgccatgccctcgtcgagaaagcgttccaccgatgccgagtcgctcaggctgacgtcgtggttgcgcaggtagtcgcgggtggcgaagccgaccggtgccatcacgtacaggctgaggatgatcgccagcccgtacatcgccatgttcggcggaatctgctggacgcccagggcgttgcgcagcagcgagaagaccacggtcatcttgatgaaggaggtcgccatcaccgcgatgaacgggaccagcgcgagcagggccaggccgaggatcaggccgagctcgtcgggcaattggatcatgcttcgtcgtgtccgaacaggcgggttacgcgcaccccgagccgatcctggagcctgaccagttcgccgataccgaggcagcgctggttggcgaggatgcgcacttcgccgtccagggcactgtcgagatcgagcagcgagcctggctgcagggtggagagggtatgcaggtccagggtgcggcggccgacctcgaagctgaccgggatcggcagttggtcgagttcgtgcaggtcctcgccgtcggcgagggagggggtgtcgtgcatgtcgagcagttccagttgcgtggagtggagttggcagcgcgcccaggggcgtccttcgagaacccccagcagcgctgcgtcggggcgatga

SEQ ID NO: 13386 - DNA, 483 bp, Pseudomonas aeruginosa
ccggcaggcagcagcaacaggtcgccgggctccagggtgcgcagctcgctggcgtccagcggcaggccgggccattgcagcgacaggcgcagcggtatggccaggcgttgcgccgaggggcgcggcggcaggcgtgccagcagcgtcgcgggatcgccgtcgagccagagcgccaggcgctggtcgtcgcgttccaggctcaaacgcaggcccatcgcagcgcgtggttgcgccgggctcaggccgtaccagaccaggccgggaaagacgttgccttcgcgctccagcaaggccagttgcagggccgccggcaggctggcgaaggctgcctcctgcaggttcggcgcgagccagtgggcgagcgccggagcctggcagagaaagcgcaggggcaggccgtcccacgccaggctcagttcgagatcgacgtcgggggcggcctgggcgatgtccaggcgcgcttgcaaagcgttgccggcatag

SEQ ID NO: 13387 - DNA, 927 bp, Pseudomonas aeruginosa
tctcgacctgcaactggccatggccatgcaggacctgcacctccacggcgccgagctggggcagtcgcacctgcaggcgcgccgcatggctttcggctgcgctggcgacctggatgcgcccctgcacggcatcgagcaggcgcgcgagatcggccagcggcagtggccggctcccgctcgatgccagcaggcgtgccaccaggcggtcgccgggggtttgcatggcaggcagtggcacaggcgcttggtcgtcggggggcagtgcggatggatcggtttctccgggttgccgacgctcctctccgcggccttcgccgcccgctgtcggcgcgggcggcgaatcctggacactggcctgcgccgtggacgcgacctcggctgcggttttcgccgggaagccggggccgggctgtggccgctcatgcgtccgacctgcgatttgcgggtgggaggacaccggcaccagcggcggttcgtcgaccggaggcgccgaaacgctggccggctcccgggcttgcgtggacgccgcgacgcgcgcggagaccgccggcgcttgccgtgctaccgatccggacggcgacactgttggcgttggcgttggcgttggcgttggcgttggcgttggcgttggcgttggcgttgcgtccgcggcaactggcacgggggcttgccgagtggtcggcggccggtcggcggcaggcgccgcgggctggtcggcgagaggcgtcgaggtcggcgcgtcggctgtcgcggcgggctcttcggcctctgtcgtttcgtcgcccttgtcgaacggtggcctgggcgccggcggtcggtgcgcgggcagggcctgttcgaaggcgatctgctgcgcgcgcagcggcggaaggggggcaggggtgtcggacgacacgagcggagccgtatccacggcgttcagcttga

SEQ ID NO: 13388 - DNA, 462 bp, Pseudomonas aeruginosa
ccgcggcgggtgggcggttcaccggccgccaggccgatttcgcgctgggccctggcgaagcgggtcagcgagtccatcagcagcaggacgcggcgtccctggtcgcggaaatactcggcgatgctggtggcgacgaaaccggccttggcgcgctccatcgccggtcggtcggaagtggcgaccaccagcaccgagcggcgcagcccctgttcgccgaggtcgctttcgatgaactcgcggacttcgcgaccgcgttcgccgaccagggcgagtaccgtcacatccacctcggcattgcgcaccaggctggccagcagggtgctcttgccgccgccggcggcagcgaagatgcccatgcgctggccttcgccgcaggtcagcaggccgtcgatggcgcgcacacccagcgatagcggccgctctatcaggcgccggctcatcggttgcggggcatcccggtag

SEQ ID NO: 13389 - DNA, 951 bp, Pseudomonas aeruginosa
  unsure (793): Identity of nucleotide at the above locations are unknown.
aaaaaaccggccgatattggcatcggcggcaccgggccggttcctatactgcgccgcctttgcagaccaggagccacagccacgatggacatcctccagagttcctccgccgcgcccctcgcgccgcgggaagcggccaacgcccccgcgcagcaggccggcggcagcttccagggcgagcgcgtccactacgtctccgtttcgcagtcgctggccgatgccgcggaagagctgaccttcgccttttccgagcgcgccgagaaatccctggccaagcgccgcctgagcgacgcccatgcgcgcctgagcgaagtccaggccatgctgcaggagtactggaagcgcattccggacctggaaagccagcagaagctcgaggcgctgatcgcccacctgggcagcggtcaactgagcagcctggcgcagctcagcgcttacctggagggcttctccagcgagatcagccagcgcttcctggcgctgtcgcgggcgcgcgacgtcctggccgggcggccggaggcgcgggcgatgctggcgctggtcgaccaggcgttgctgcggatggccgacgagcagggcctggagatcgaactcggcctgcgcatcgagccgctggccgccgaggcttccgccgccggtgtcggcgatatccaggcgctgcgcgatacctaccgtgacgcggtactcgactaccggggcctgtcggcggcctggcaggacatccaggcgcgcttcgccgcgacgccgctggagcgggtcgtggccttcctgcagaaagccatgagcgccgacntggacagtcagtcgagccggctcgatccggtgaagctggagcgggtcatgagcgacatgcacaagctgcgcgtgctcggcggcctggcggagcaggtgggggcgctctggcaggtgctggtgacgggggagcggggccatggcatacgggccttctga

SEQ ID NO: 13390 - DNA, 321 bp, Pseudomonas aeruginosa
gcgtaccggcgccgctggcgcgcgtggtgcaactggatttcgaggacagcggcaccttgcagctggaacgccatggcgaacagttgtcgctctggctggcctgtgacctggcctggcaccaggcctatcgcggcaccctgcgggcgttgcgccctgtgccatgcgcgcgcggccgggagcctgccgctgcgttgcgcctggagcggcgaatcgcgcctgctgctgtgcatcaccctggaagcccggcaggtcggcatcccgacgttgcaccaggccttgcaggcgctgcgctcggcgcgcagcgaagtgctcgccgcatga

SEQ ID NO: 13391 - DNA, 696 bp, Pseudomonas aeruginosa
gccgggtcggtgcctggcacatcggcatcgaacgactcgacctggcgcatgccgagccgttcgcgccgcccctgccggagcgccatctgctggcgcccgacggccggccggtggagacccacgtcgccagcctgtatcccgcgcagcaggcgcaacagcgcctgttcgactacgcccggccccagctggagttccacggcctgctgcgccccggcgacttccgccaggcgctgcgcgatctccgcctggccctcacgctgccccgccagccggccctgcaggccgcggcctgcctgctcggcgagcgcgatgaagaccagcgactgctgcaaatggccccgaacctgttgcacaaggtatgaatcgatgacgttgaaacagacgcaacagcgcctgttgctgatgctgggctggttgcacctgcaatgcggccagccgcgacgcgcccaggtgttgctggaggccttgctgagcgttgcgccggagcgccgcgacgggcgccgcgccttgctcctggcgttgctccagcaaggcctcggcgagcccgccgtgcgcctgtgccggcagttgcaggaggatggcgaggaggagcccggtctgtggctttgcctgagccgtgccgaacagctcgccgggcgtctcgacgcggcgcgtgccgcgcacgcccgggcgctggagctggaggcgcgggaatga

SEQ ID NO: 13392 - DNA, 720 bp, Pseudomonas aeruginosa
gtaccccttcgagaaggacaacaacccggtcggcaatttcgccaccacggtgagcgaccgctcgcgtccgctgaacgacaaggtcaacgagaagaccaccctgctcaacgacaccagctcccgctacaactcggcggtcgaggcgctcaaccgcttcatccagaaatacgacagcgtcctgcgcgacattctcagcgcgatctagaggtatccatgaaccagcaagcgaccccttccgacaccgaccagcaacaggcgctggaggccttcctgcgcgacggcggcaccctggcgatgcttcgcggactcagcgaggacaccctggagcagctctatgcgctgggcttcaaccagtaccaggcgggcaagtgggacgacgcgcagaagatcttccaggcactgtgcatgctcgaccactacgacgcccgctactttctcggcctgggcgcctgccgccagtccctcggtctctatgaacaggccctgcagagctacagctacggcgcgctgatggacatcaacgagccgcgctttcccttccatgccgccgagtgccatctgcaactgggtgatctcgacggagccgagagtggcttctactcggcccgggccctggccgcggcacagccggcgcacgaggccctggccgcgcgtgccggcgccatgttggaagccgtaaccgcgagaaaggatcgaatatatgaatccgataacgcttga

SEQ ID NO: 13393 - DNA, 801 bp, Pseudomonas aeruginosa
gcgcgccggactgccctacggggtggccgacgccggggatgtcccggcgctcggcaggccggtcgcgaggtatgtcgagagtctgcgggtggagcgcctggcggcgccggccgcggcttccgcgagcggcacgggggtggcgctgacgccgccgtccgcagccagccagcagcgcctggaggtcgccaatcgtgcggagatcgccagcctggtgcaagcagtgggcgaggatgccggactggcgcggcaggttgtgctggccggcgcttcgacgctgttgtccgccggcctgatgtcgccgcaggcgttcgagatcgagctggcgaaaatcaccggcgaagtcgagaaccagcagaagaaactcaagctgaccgaaatcgagcaggcgcgaaagcagaacctgcagaagatggaggacaaccagcagaagatcagggaatcggaagaagccgcgaaagaagcccagaagtccggtctggcagccaaaatctttggttggatcagtgcaatagcttcgatcatcgtcggcgcaatcatggtggcaaccggcgtcggcgcggccgcgggtgcactgatgatcgcgggcggtgtcatgggagtggtctcccagtcggtacagcaggcagccgcggacggattgatcagcaaggaagtgatggaaaagctcggcccggcactgatgggtatcgagatcgccgtcgcgctgctggcggcggtggtcagcttcggcggctcagcggtcggcgggctggccaagctgggcgcgaagatcggcggcaaggcggccgagatgaccgctag

SEQ ID NO: 13394 - DNA, 939 bp, Pseudomonas aeruginosa
aaccctgcacaacctgtccagccgaccggcagcgatctgaggagacgtcacatgatcgatacgcaatattccctggcggctacccaggccgcgatcccctccgagccgatcgctcccggcgccgccgggcgttccgtcggcacgccgcaagcggctgcggagctggcgcaggcgccggccacgcggggcgaccgggtcgagctgaacgctccgcgccaggcgctcgacccggtgcgcatggaagcggccggcagcgagctggacagcagcgtcgagcttctgctgattctcttccgcatcgcgcagaaggcgcgcgagctgggcgtgctccagcgcgacaacgagaaccaggcgatcatccacgcgcagaaggcgcaggtggacgagatgcgcagcggtgccacgctgatgatcgccatggcggtgatcgccggcgtcggcgcattggcctcggcggtggtcggcagcctcggcgcgttgaagaacggcaaggccatcagtcaagagaagaccctgcagaagaacatcgatgggcgcaacgaactgatcgacgcgaagatgcaggcgctgggcaagacctccgacgaggatcgcaagatcgtcggcaaggtctgggcggcggaccaggcgcaggacagtgtggccttgcgtgcggcgggccgtgccttcgagagccgcaacggcgccctgcaggtggccaacacggtgatccagtccttcgtccagatggccaacgcctcggtccaggtgcgccagggcgaatcgcaggcgagcgcccgggaaggagaggtcaacgccaccatcgggcagagccagaagcagaaggtcgaggaccagatgagcttcgatgccggcttcatgaaggacgtcctgcagctcatccagcagtacacccagagccataaccaggcctggcgtgcggcggccggagtggtctga

SEQ ID NO: 13395 - DNA, 867 bp, Pseudomonas aeruginosa
cgagcgcgcaatgtagtgaggaagccaaggcagagaatggagcaggaagacgataagcagtactcccgagaagcggtgttcgccggcaggcgggtatccgtggtgggctcggacgcccgctcgcggggtcgggtgccgggttacgcatcgagcagtttgtatcgtgagtccggaatcatcagtgcgcggcaactggcgttgctgcagcggatgctgccgcgcctgcggctggagcaactgttccgctgcgagtggttgcagcagcgcctggcgcgcggcctggcgctggggcgcgaagaggtgcggcagattctcctctgcgcggcgcaggacgacgacggctggtgcgccgaactgggcgaccgggtcaacctcgccgtgccgcagtcgatgatcgactgggtcctgctgccggtctatggctggtgggaaagcctgctcgaccaggcgatccccggctggcgcctgtcgctggtggagctggagacccagtcccggcaactgcgagtcaagtccgaattctggtcccgcgtggccgagctggagccggagcaggcccgcgaggaactggccagggtcgccaagtgccaggcgcgcacccaggaacaggtggccgaactggccggcaagctggagacggcttcggcactggcgaagagcgcctggccgaactggcagcggggcatggcgacgctgctcgccagcggcgggctggccggcttcgagccgatccccgaggtcctcgaatgcctctggcaacctctctgccggctggacgacgacgtcggcgcggcggacgccgtccaggcctggctgcacgaacgcaacctgtgccaggcacaggatcacttctactggcagagctga

SEQ ID NO: 13396 - DNA, 2259 bp, Pseudomonas aeruginosa
gcggccggcgaaagccggccctaccgaggaatcatggatcatctgttgagcggattggccactcgcctgggccaagggccctttgttgccgatcggacgggttcgtaccacctgcgcatcgacggacagagcgtcctgttgctgcgccagggcgacgacctgctgctggaaagcccgctggagcacgcccccctggacccgcagcgcgaccagcaggggttgctgcgggtgctgttgtcgcgggtcgccagttggagtcggcgctatccccaggccattgtcctggacgcggacgggcgcctgctgttgcaggcgcggctgggcctcgacggcctcgatcccgagcgactcgaacgggccctggccgccccaggtggggctgctcgaggcgctggcgccggagctggaaccgctgccccgcgggttgccgccgcaggctccggtgtggcgtccctgatgcgccgcctgctgatcggcggactgctggcgctgctgcctggcgcggtcttgcgcgcgcagccgctggactggcccagcctgccttacgactatgtggcgcagggcgaaagcctgcgcgacgtgttggccaacttcggcgccaactacgatgcctcggtgatcgtcagcgacaaggtcaacgaccaggtcagcggtcgcttcgacctggaaagcccgcaggccttcctgcagttgatggcctccctctacaacctcggctggtactacgacggcaccgtgctgtacgtattcaagaccaccgagatgcaatcgcggctggtgaggctggagcaggtcggcgaggccgagctgaagcgcgcgctgaccgccgccggcatctgggagccgcgcttcggctggcgtgccgacccttccgggcggctggtgcacgtgtccggtccggggcgctatctcgaactggtcgagcagaccgcccaggtgctggagcagcaatacaccctgcgcagcgaaaagaccggcgacctcagcgtggagatcttcccgctgcgctatgcggtcgccgaggaccgcaagatcgagtaccgcgacgacgagatcgaggcgccgggcatcgccagcatcctctcgcgggtgctcagcgatgccaacgtggttgcggtgggcgacgagccgggcaagctgcgcccgggaccgcaatcgagccatgcggtggtccaggcggaaccgtcgctgaatgcggtggtggtgcgcgaccacaaggaccggttgcccatgtatcgccgcctgatcgaagccctcgaccggccctcggcgcggatcgaggtcggcttgtcgatcatcgacatcaatgccgagaacctcgcccagctgggcgtcgactggagcgccgggattcgcctgggcaacaacaagtcgatccagatccgcaccaccggccaggatagcgaggagggcggcggcgccggtaacggggcggtcggcagcctggtggacagtcgcgggctggatttcctgctggccaaggtcaccctgttgcagagccaggggcaggcgcagatcggatcccggccgaccctgctgacccaggagaatacccaggcggtgctcgaccagagcgaaacctactatgtgcgggtcacgggtgagcgggtggccgagctgaaggcgatcacctacggcaccatgctgaaaatgacgccgcgagtggtgactctcggcgatacgccggagatcagcctcagcctgcacatcgaggacggcagccagaaacccaatagcgccggcctggacaagatccccacgatcaaccgcacggtgatcgataccatcgcccgcgtgggccatggccagagcctgctgatcggcggcatctaccgcgacgaactgagccagagccagcgcaaggtaccctggctcggcgacattccctatctcggcgcgctgttccgcactaccgcggacaccgtgcgccgctcggtgcggctgttcctcatcgagccgcggctgatcgacgatggcgtcggccattacctggcgctgaacaaccgtcgcgacctgcgcggcggcctgcttgaaatcgacgagttgtcgaaccagagcctgtcgttgcgcaagctgctcggtagcgcccgctgccaggcgctggcgccggccagggccgaacaggagcgcttgcgccaggccggccagggttcgttcctcacgccctgccggatgggtgcgcaggagggctggcgggtgaccgacggcgcctgtcccaaggacggcgcctggtgcgtcggcgcggagcgcgggaattag

SEQ ID NO: 13397 - DNA, 1266 bp, Pseudomonas aeruginosa
catggcctggaagatccgcttctacagcgggctgaaccagggcgccgaagtctcgctcggagagggccgggtggcgcttggcagcgatccgttgcaggccgacctggtgttgctcgacgagggcatcgcggcagtccacctggtgctcgaggtcgatgcccagggcgtgcgcctgctggaatgggcggagggctgcgagcctcgccaggacggccaggcgcaagtcgccggagcgatcctgcaggcgcttgccgggcagacctgcggcccgctgcgctgggcattctgcgacccgcagcggagttttcccgagcgtttccccgaagccgaggtgcagaccgcgccagtgcgccgcaagtcgtccgcccgtgccggcggggcctggctgctcggcgtcagcctggcgctggcgctgtgtctgctgggcatgctcgtcgaaccctggtcggcccgccagcacggcatggccggcgaggagccccaggcgaaggtgcgcgcctacctgcgcgagcagggcatgagcgaggtggatgtgcagcgccagggcgacagtctcctgctcggcggctacctggaggacaacgcccggcgcctggcgctacagcgctacctcgatggcagcggcgtggactaccgactggaagcacggagcatggaagacattcgccagggcgtggatttcatcctgcagaaattcggctatcggcagatcctcagcagcaacgcggacaagcctggctgggtccggctcaacggcgaactggcggaacaggacgaacgctgggcgcggatcgacgcattgctggagtccgaggtgccgggcctgctcggggtggaaaaccaggtccgggtggccggctcgcacctgcgccgcctcgagcgcctgctggcggacgccggcctcgaccggcaactgagtttccgcgagcgcggcgagcgcatcgagttgagcggcacgctcgacgaggtccagctcagcgccttctaccgcctgcagcgcgagttccagcaggaattcggcaaccgcccgagcctggagctgctcagtcgcggcaagcgcgccagcggcgacgaactggagttcacgattcgctcggtgtcgctggggcgggtgccctatgtagtgctcggcgacggccagaaatacccggtgggcgcctcgacatcccgcggtgtgcgaatcctcgccatcgagccggagtcgatcctggtggcccgcggcaagcagcgtttcatcatcaatctcaaaggggaggtgctccatga

SEQ ID NO: 13398 - DNA, 807 bp, Pseudomonas aeruginosa
cagccttggaaacgcgactgtcggtcgctgacggcacgcatgccgcagcgctccggcagcgtctgcaggcggcgctggcggagtgtcgccgggaactggccagaggcgccggcccggagcgcttccagttcctgcaacagcaggcccgggccctcgaaggcggtctcggcattctttcgcagctcacagaggactaagcatggcgcagatattcaaccccaacccggggaataccctcgataccgtggccaatgccctgaaggagcaggccaacgcagcgaacaaggacgtcaacgaagcgatcaaggccttgcaggggaccgacaatgccgacaacccggcgctgctggccgagctgcaacacaagatcaacaagtggtcggtcatctacaacatcaactcgacggtgacccgtgcgctgcgcgacctgatgcaaggcatcctgcagaagatctgaacatggacacttcactgatacgcgaattggcggaactggcgctggccggcagcgggcagcactgccacgaagaggcgctgtgcatcgccgagtggctggagcgcctcggacaggacgaagcggcgcggctgatccggatttccagcctggccaaccaggggcgctatcaggaagccctggccttcgcccatggcaatccctggccggcgctggagccctggttcgccttgtgcgagtggcacctggggctgggcgccgcgctggaccgcaggctggccgggctgggcggcagcagcgatcctgccctggccgacttcgccgccggcatgcgcgcccaggtgcggacatga

SEQ ID NO: 13399 - DNA, 1146 bp, Pseudomonas aeruginosa
tcccgctcaacggcatgctcgacaacctcgtgcgcaacagccacaaactcgacctggagtcatgatggatatctctcggatgggcgcccaggcgcagatcaccagtctcgaagaactctccggcggcccggccggcgcggcccacgtcgccgagttcgaacgggcgatgggcggtgccggcagcctgggcggcgacctgctcagcgaactggggcagatcagggagcgtttcagccaggccaagcaggagttgcaggtggagctgtcgacgcccggcgacgatcccaacagcctgatgcagatgcagtggtcgctgatgcgcatcaccatgcaggaagagctgatcgccaagaccgtcgggcgcatgagccagaacgtcgaaaccctgatgaagacccaatgaggcgaacggtgaaaggtctgtcgcgcatggcgctcctggcgctggtcctggcgttgggcgggtgcaaggtcgaactctataccgggatcagccagaaggaaggtaacgagatgctggcgctgttgcgttcggagggcgtttccgcggacaagcaggcggacaaggatggcaccgtgcgcctgctggtggaggaatcggatatcgccgaggcggtggaggtgctcaagcgcaagggctatccgcgggagaacttctccacgctgaaggatgtgtttcccaaggacgggctgatttcctcgcccatcgaagagcgcgcgcggctcaactacgccaaggcccaggagatttcccataccctttccgagatcgatggcgtgctggtggcgcgggtccatgtggtgctgccagaggagcgcgacggactgggcaggaagtcctcgccggcatcggcctcggtgttcatcaagcacgccgccgacgtgcaactggatgcctacgtgccgcagatcaagcaactggtgaacaacggcatcgaaggactcagctacgaccgcatcagcgtggtgctggtgccgtcggccggggtccgccaggtcccgctggcgccacgcttcgagagtgtcttctcgatccaggtggcggagcactcgcgcggacgcctgctcggcctgttcggcctgctgctggcgttgctgctggcgagcaacctggcgcagttcttctggcaccggcaacggggctga

SEQ ID NO: 13400 - DNA, 564 bp, Pseudomonas aeruginosa
cggcctaccagttgcgcttctgcccggcccgctacatccacgagtcgcacctgcccgcggtattgctgcggttgctgccggcgctgccggactggcggcgacagagcgttctcaacgcctggctgctggagcaactggaattggactgcgcgttccgcatgcccgcgcaactgggcgggctggccctttacccgcaggcggcgctggaacggaccctgggctggctcggcgcgctgctgcacggccaggccttgcggcaggtgctggacggtgcgcgggtacggcgcatccgcgcgcagatcggcgaacagggccagcgtttctgcctggagcagctcgacctgctcatcggtcgctggccgcccggctggcagcgggccttgccggaaaacccggaagaaggctatttccggcgctgcggcctggctttctggctggccgcctgtagcgatgccgactgcggtttctcgcggcgcctgcgcctgcgcctggaggccatgccggccccggcggactggaccttcgacgaacaacggcgatccctggcgcggaccctgtgcctga

SEQ ID NO: 13401 - DNA, 744 bp, Pseudomonas aeruginosa
actagacgccagtcgcgtacggctggcccccgggcaggccctgttgcgcgcccgcgactaccaggactacctcagcgccaaccgcctggtggaagcggcccgcgagcgtgccgccgaaatcgagcgcgaggcccacgaggtttaccaggagcagaagcgcctgggctgggaggccggactggaggaggcgcgtctgcgccaggccgggctgatccaggaaacgctactgcgctgcaatcgctactaccggcaggtcgatcgccagcttggcgaggtggtgctgcaggcggtgcgcaaggtgttgcgccactacgacgctgtcgagctgaccctggcggccacgcgcgaggcactggcattggtgagcaaccagaagcaggtgatcctgcacgtccagccggaacaactggccgcggtgcgcgagcaggtcgcccgggtgctcaaggatttccccgaggtgggctacctggaagtggtcggcgatgcccggctggaccagggcggttgcatcctggaaaccgagatcgggatcatcgacgcttcgctcgacagccagttggcggcgttgcaggccgcattgacggagagcgtggcgcggagcggcgaggaggaaggggacgccggttgagggaaccaggcgccgcccccggcccgggcgttggctccgggccgagggctgagacgctgccgttcgcccgcggcggcgacgctggcggtgcggtcggcgccttcagagcagggtga

SEQ ID NO: 13402 - DNA, 222 bp, Pseudomonas aeruginosa
ggccgtagccgaacgggtagagcgggccgttggcttcgtcgaaatagcgcgaggtgtatttgccggggttgtcgtggtccatcggccggccggtgttcaggtggttgtagtagaccggtacctggcccaccgagcgcgggaaggacatggtcagcttgccgctggggttgtgctcgccgaacagcacgtcggcgatggcattgccgccttcggtgccactga

SEQ ID NO: 13403 - DNA, 2277 bp, Pseudomonas aeruginosa
gaagccccagtacacacagcctgttcatgcatgttttctcgttattggatagacgctcgtcgtggcggcgtgacatgtcgcggcatgccgcccggcgggcgcgacataaggtgttcgcagcgcgggcggaagtcaacgagacggcgatgggcgaatctgccggttctgacaggtcccgtggcgcgccgctggcggcgctcaggcgacgctggcgagcaactgctcggccggcatcggcctgccgagcaggaagccttgcagcgaattgcagccgaggcgggtcaggaactcctgctgggcctcggtttccacgccctcggcgacgatcttcaggttcagcgtgcggccgagggcgacgatcgccgagacgattgcggcgtcgtcgctgtcgtgggccagctcgttgatgaagccacggtcgatcttcagttcgctcgccggcaggcgcttgagatagagcaggctggagtagccggtgccgaagtcgtcgatggagatgccgacgcccatcgccgacaactgctcgaggatcaccaggctggcatcggcatcgcgcatggcggtcgattcggtcacctcgaggatcaggtggctgggctccaggctgtggcgcaggagtgcgttgcgcaccgagtcgaccaggccggcatgggcgaactgcagggccgaaaggttcaccgcgatgttccactccgcatgcccgccgtccagccagaggcgcatctgccggcaggcttcgtcgagcacccactcgccgatctgcacgatcaggccggttttttccgccagcggcaggaactggtcgggggggatcagtccgtgttgcggatgctcccagcgcagcagcgcttccacgccgaccatcggtccgttcggcgccagtaccttgggttggtagtgcaagaccaactgccggcgctccagggcctggcgcaggtcatggagcagttgcaactgttcctgggcgttggcgttcatcgaactctcgaagaagcagtagccgttccgtccctggtccttggcgtgatacatcgccgcgtcggcattgatcatcagttcgtggcgggtctgcccgtcgccggggtagagcgcgatgccgatgctcgccgagatccgcacctcgtggcgggatatctggtacggctggctgatccgcttcaccagcttctcggccagggtcgcggcgtcggcgggctctcgggcctcgatcagcaggacgaactcgtcgccgccgaggcgggcgatggtgtcctgggcgcggacgttggcgcggatacgctcggcgacttcgatcagcaacaggtcgccgaggtgatggccgtaggcatcgttgaccgccttgaagccgtccaggtccatgaacagcacggcgaaccggcgatcgtcgcggatcgcctgctggatcgcatgctccaggcggtcgtcgaggagcatgcggttgggcagcttggtcaggttgtcgtgcagggccaactggatcagctcgcggttggctcgtgcgagggaggtggcgagcaccgaggtacgtgcctcgaggcgcgagtccagcaccgagacgatcagggcgatggcgatcaccgccagggtgatcacgatgaccagcaccgccagccagccgttgtcgatgcctcggccggcggcgccgcagaagctgcccagggggaactgcgcggcggccatcccggtgtagtgcatgccgacgatggcgcagcccatcaccagggcggcgccggcgcggaccaggacgatgcgccggctgccatggcgcaggcggaaggcgatccacagcgcggcgccggaggcgatcaccgcgatcaggatggagaggccgagccacagcgggtcgtagacgatccccggcatcatcagcagggcggccatcccggtgtagtgcatggcggcgatgccgctgcccatcagcagggcgcccagcgccaggcgttgccaggggagttccgcctggcacaccagccagagggcgaaggccgaactgccgacggccagcagcagcgacagcagggtcaggcccaggtcgtagccgagcgggatcggcaggctgaaggcgagcatgccgacgaaatgcatcgaccagatgccgaagcccatggcgaaagcgccgccgatcagccaggagagcgcctcgcggcctttcgccagggtcacccggccggccatgtcgagagcggtgtaggacgccaggatggccacaatcagggaaaaggcgacaagaacctggttgtagctgctgataagcatgaaagcgtccgaacgggatag

SEQ ID NO: 13404 - DNA, 1473 bp, Pseudomonas aeruginosa
tccgcgcgctggcacgggctttgcgagttccccatcgttcgtgacgacaaggagtccggcatggcacgcatgttttacgacgagatgcacgatgctggcggcgaatgccgctcgcattatcgggaattcgctcgctggctggccgacacccctgaagagcaactgctgcaacgccggcgtgaagccgacctgctgttccaccgcgccggcatcaccttcaccctgtacggcgacgagcagggcaccgagcgcctgatccccttcgacaccatcccgcgcagcattcccgcggcggagtgggcgcacatcgaggccggctgcatccagcgcgtccaggcgctgaacctgttcctcgccgatctctaccacgaacagcgcatcctcaaggccggcgtgattcctgccgagcaggtcctggccaacgaccagtaccaactggcgatgcagggactggacctgccgggcaacgtctacgcgcacattgccggggtcgacctggtccgcgacggcagcggcaactactacgtgctggaggacaacctgcgcacgcccagcggtgtttcctacatgctggaaaaccgcaagatgatgatgcgcctgttccccgagctgttcgtccgccagcgcgtggcgccgatcgaccactacccggacctgttgctcgacaccctcaagcgggccagtgacgtcgaatcgccgagcgtggtggtattgacgccgggacgtttcaacagcgcctacttcgaacacgccttcctcgcccgcgagatgggcgtggaactggtcgaaggcgccgatctgttcgtccgcgacgagcgggtctacatgcgcacgacggccggaccgcaaccggtggacgtgatctaccgaaggatcgacgacgccttcctcgacccgctggcgttcaacccggattcgctgctcggcgtgcccggcctgctggccgcctaccgggccggcaacctggtgctggccaacgcgatcggtaccggggtggccgacgacaagtcgatctatccctacgtgccggacatgatccgcttctacctcggcgaagacccgctactgcacaacgtgccgacctggcaatgtcgcaagccgaaggaactggcgcacgtcctggcgcacctgccggagctggtggtgaaggagacccagggttccggcggctacggcatgctggtcggaccggcggccagccgggaggaaatcgagctgttccgcgagcgcctgaaggctcgcccggaggcctatatcgcgcaaccgacgctgtccctgtcgacctgtccgaccttcgtcgagagcggcgtcgcgccgcgccatatcgacctgcggccgttcgtcctgtcggcgccggatcgggttcgcctggtgcctggcgggctgacccgggtggcgttgcgcgaaggctcgctggtggtcaattcgtcccagggcggcggcaccaaggacacctgggtggtggaggaataa

SEQ ID NO: 13405 - DNA, 339 bp, Pseudomonas aeruginosa
aggaccgctcgcacctgttccgcggcgcgaccttcgccaccagcatgcgcaacgatgcgttccgcttcatccgtctcggaaccttcatcgaacgcgccgacaataccttgcgcctgctcgatgcgcgctaccagacccagggcgaagcggcgctcgccggggcggacgagggcaccgcgcgcggctactaccagtggagcgcgctgctgcgggcgctatccgccttcgagggctacaccgagctgtaccgcgcctcgcccaacgcgcgcaacatcgccgaattgctgctgttgcgcgaggacgtgccgcgttcgctgctgtcctgcatcgaggaactga

SEQ ID NO: 13406 - DNA, 909 bp, Pseudomonas aeruginosa
ctggctaaccaaggggttcccgtgctcgccgagttgttcgccgtgatggcgcccgtgctgttcggcgccggtgtcggttacgtctgggtccgtctcggacacgcctatccgaccgagttcgtttcgcgcatcgtgttcaacatcggttcgccatgcctgatcctcgccaccctggcgcatacccgggtggacctgcacagtttcggccggatggccctggccagcgcgctgatctgcgtctgcatggctgcgctgggctgggcggcggcgcgcctcgggcgccaggagtggcaggtgctggtgccggcctacagcttcccgaatgtcggcaacatgggcctgccggtgtgcctgtatgcgttcggcgaggcggggatgaccctggcggtggcgttctacctgatcatgtcgatcggcaacttcagcctcggcgtgttctggatgagcggcgagcgctcctggcgctcgctgctgggcaatccgatcctgctcagcgtgctgctggccttgttgttgatggggctcgacctgcaactgccacgctggatggcgaataccgtcgacctgatggccgggctgaccattccgctgatgctgatcaccctcggcgtgtccctggccagcatccgcccgcggcaactgggcaatggcttcttctatggcggcctgcgtcttctgctgggggcgctggtgggctggtcggtggcgctggcgttgcaattgccgccgctggcgcagggggtgctggtggtgcagtcgtcgatgccggtggcggtgttcaactatctctacgccttgcgcggcaatcgttcgccggatcaggtcgccagcctggtgctgtgttcgaccttgctgtcgttcgccttcattccgctgctgctgacctggtggctgcctgcgctgcgctga

SEQ ID NO: 13407 - DNA, 1257 bp, Pseudomonas aeruginosa
ggtaggcggaggcccgctcggccggacgagaacaggataagagagaccgccatgaccgacgcattcatttacgacgccgtgcgtactccccgcggcaagggcaagaaggatggcgcgctgcacagcgtcaagccggtgaacctgatggccgggctgttgcgcgcggtccagcggcgcaacgacctggataccgcccaggtcgacgatatcgtgctcggctgcgtgacgccggtgggcgaccagggcgccgatatcgccaagaccgcggcgctggtggccgactgggacgaacaggttgccggcgtgcagatcaaccgtttctgcgcctccggcctggaggcggtgaacctgggggcgatgaaggtacgctccggcttcgaggacctggtcctggtcggtggcgtcgagtccatgtcacgcgtgccgatgggctccgacggcggcgcctgggcactggatccggaaaccaacctgcacaccagcttcgtcccgcaagggatcggcgccgacctgatcgccaccctggaaggcttcagtcgcgccgatgtcgatgccttcgccctgcgctcccagcagaaggccgccaaggcccgcgccgaagggctgttcggcaagtcgctggtgccggtcgccgaccagaatggcatcgtcctgctcgaccacgatgagttcattcgcgccgactccaccctggaagggctcgccgcgctcaaaccgagtttcgagatgatggggcagatgggcttcgacgccaccgcgctgcgcaagtacagccaggtcgagcgcatcgagcacgtgcatacgccgggcaacagctcggggatcgtcgacggcgccagcgccatgctcattggctccgaggccaagggccgcgaactgggcctgaaggcgcgggcgcggatcgtcgctaccgcggtgacctccaccgaccccaccatcatgcttaccggccccgcgccggcgacccgcaaggccctggccaaggccggcctgaaggtggaagacatcgacctgttcgaagtcaacgaggcgttcgcttcggtggtgatgaagttcatgaaggacatgggcgtggcggaaagcaaggtcaacgtcaacggcggcgccatcgccatgggccacccgctcggcgccaccggctgcatcatcctcggcacgctgctcgacgaactggagcggcgcaacctgcgctacggcctggccaccctctgcgtaggcggcggcatgggcatcgccaccatcatcgagcgcgtgtga

SEQ ID NO: 13408 - DNA, 1743 bp, Pseudomonas aeruginosa
cgctatccgttacgaaaaaggccaggacaacgtcgtcgtcctgaccatggacatgcccgggcagagcgccaacaccatgaacggtgtctaccgcgaggcgatggcgaagaccatcgcacggctggaggcggagaaagaggggatcgccggcgtggtgctgacctcggcgaagaagaccttcttcgccggcggcgatctcaacgagctgatcaaggtcaccaaggccgacgccccggccttctaccagggcatcctcgaactcaagggccaactgcggcgcctggagaccctcggcaagccggtggtcgccgcgatcaacggcgctgcgctgggcggcggctgggagatctgcctggcctgccaccaccgcatcgccctggacaatcccggcgtgcagctcggcctgccggaggtgactctcggcctgttgccgggcggcggcgggatcgtgcgcatggtgcgcctgcttggcctggagaaagccctgccgtacctcgccgaaggcaagaaggtgcgtccggcggaagcgctcaaggccgggctgatccacgaactggccgacagccccgaggaaatgctggagaaggcccgcgcctggatcctcgccaacccggcggcgaagcagccctgggacagcgccggctacaagattcccggcggtacgcctgccagtcccaacgtggcgcagatgctggccatcgcaccgtcggtgctgcgcgacaagaccaagggttgcttcccggcgcccgagaagatcatgtgcgcggcagtggagggcgcccaggtcgatttcgacaccgcgcaactgatcgaggcgcgctatttcaccgagctgaccaccggccaggtggcgaagaacatgatcggcaccttctggttccagctcaacgagatcaacgccggcaagtcgcggccgcaggggtatccggtgcgggcgacgaaaaaggtcggcgtgctcggcgccgggatgatgggcgcgggcatcgcctacgtatcggcggcggccggcatcgaggtggtgctcaaggacgtctcgctggaagcggcggagaagggcaaggcttattcggccaggctgctggacaagaaagttgcgcgcgggcacctgtccgccgagaagcgcgacgccttcctcgcgcggatcgtgccgagcgtcagcgaagccgacttcgaaggctgcgacctgatcatcgaggcggtcttcgaggaccgcgcgctgaaaggcaaggtcaccgccgaggccgagaagcatgccctggccgatgcggtagtggcgtccaatacctcgaccctgccgatcaccggtctggcccaggcggtggcgcggccggagaagttcatcggcctgcacttcttcagcccggtggacaagatgccgctggtggagatcatccgcggcgaaaagaccagcgacgaaaccctggcgcgcggtttcgactacgtactgcagatcaagaaaacgccgatcgtggtcaacgacagccgcggcttcttcacctcgcgggtattcggcaccttcaccaacgaaggcatcgccatgctcggcgaaggcgtgagcgccgcgatgatcgacaaccaggcgcgccaggccggtatgccggtggggccgctggcgatttccgacgaagtctccctgagcctgatgacccacatccgcaaccagaccgcccgcgacctcgaggccgagggcaaggctctgccgacgcaccctgcgttcgccgtgatcgacctgatggtcaatga

SEQ ID NO: 13409 - DNA, 495 bp, Pseudomonas aeruginosa
ccgcgatgcggttatccgccctacgccgcgcggcggtacaggcccttgcctccagcctccattggtagggcgaatagcgccacaggcgctatccgccgatataccgagattcggcggataaccgcgatgcggttatccgccctacgccgtgcgtcgatacaggccagcctccaggccgccacgggcgcttccgccgatgtgcctacgcgggacctgggtgttcctcgccggggtagcgcagcaggtcgatcacggtgctcaacgccgccgggtggttgcggcggttcggataatagagatggaaaccgggaaagggggcgcaccaatccgccaggacccgttccaggcggccggcggcgaggtgctcggcgacttcctcctcgatggcgaaggcaatcccgacatcggccagcgccgcctgtagcatcaggcgcgggtcgtcgaggaccagcggtccgctcacggccaccgaaagcgctttcgtgcccttgctga

SEQ ID NO: 13410 - DNA, 486 bp, Pseudomonas aeruginosa
ggccgccgcggacgatattgtgcaggtgctgcggaggggcgcgccttgcgcgtatccgctggccgaggagggcgccagcgctatcgcaggagccgaagcctacggatgatggtcgggccccatttcttcctttctatcgaggtcagcagcgtgccgtccctggaactcaccgatctggacgccgaccggcagttgcttgccctggaaggggtttcgctgttggtattcaccagcgaaggctgcgcgtcgtgccgctgggcccggcgccatctccccgcgatggacctgcccatcgagcgcctgtgctgggtggacgccggccgcaatggcggcctggtggaacgctacggcgtctttcacctgccggccctgttcatggtccgcgacggccgcttccatggcgcactgaacgttccgctgcaccaggaagccttgcggggtgcggtgctggcggggtcgaccgctttacctgaggagttgccctga

SEQ ID NO: 13411 - DNA, 1491 bp, Pseudomonas aeruginosa
tcgccggtcgcgacaaccttttcgaggaatctccatgaagcttcagcaattgcgctatatctgggaggttgcgcaccacgacctcaacgtctccgccacggcgcagagcctctatacttcgcagccgggcatcagcaagcagatccgcctgctggaggacgaactgggcgtcgaggtgttcgctcgcagcggcaagcacctgacccgggtgacgccggcgggggagcggatcatccataccgccggcgagatcctgcgcaaggtcgagagcatcaagcagatcgcccaggaattctccaacgagaagaagggcacgctgtccatcgccactacccacacccaggcgcgctatgcgctgcccaacgtgatcagcggcttcatcaagcagtacccggacgtctccctgcacatgcaccagggcacgccgatgcagatcgccgaaatggccgccgacggcaccgtcgacttcgccatcgccaccgaggcgctggagttgttcggcgacctgatcatgatgccctgctaccgctggaatcgctgcgtcatcgtgccccacgggcatccgctgaccaagctgccgaaactgaccctggaagccctggccgagcagccgatcgtcacctacgtgttcggcttcaccggccgctccaagctcgacgaagccttcagccagcgcggcctggtgcccaaggtggtattcaccgcggccgatgccgacgtgatcaagacctacgtgcggttgggcctgggggtcggcatcgtggcgcacatggcggtcgatccgaagctcgacaacgacctggtgatcctcgacgccagccacctgttcgagtccagcgtgaccaagatcggcttccgccgcggcaccttcctgcgcggcttcatgtgcgacttcatcgagaaattcgctccgcacctgacccgcgagctgctggccaaggccgtgcaatgccacaacaaggccgagctggacgagttgttcgacggcatcgaactgccggtctactgatcgcctcggcccatgaaaaagcccggcctggtgccgggctttttcatggctggccctcagagcatgtcgagattgtcgcgaccggccagcctggccagcgcttcgcgatcagcgtccgcggactgctcggctcgcggttcgaggacttcatggaggaagctcatgaacacggtgtagacctgttcgcgcccgtcgtcgtggcgaaccacgaagaacggcgcggtctctacgccatattgggcggcgaccatccagcctgcgctgttcgggtcgcgttcgtcggccaccagggtgcgatggatgcgcggcaggtagccgccttgttccaggcgttgccggacttccttgcacttgcggcagtcctcgccgttggcgaggactttcttgaccatggtgatgcgcatgctgggtctccgctcggggttcgacctgcactttaccccgattgcatacgctctatcgacggtttcaggccttactga

SEQ ID NO: 13412 - DNA, 738 bp, Pseudomonas aeruginosa
ccatttacccctgtcgaccttgattccaggaataagccggcgttgccttgccctcggcgaggggctagagtgccgcgtccgtcgtcaccccatcgttcagagaatttcgaggagagtcctgtggaaattgcctgtcttgacctggaaggcgtgctggttccggaaatctggatcgcgttcgcggaaaaaaccggtatcgacgccttgaaggcgaccacccgggacattccggactacgacgtgctgatgaagcagcgcctgcgcatcctcgacgaacatggtctgaagctgggcgacatccaggaggtgatcgccaccctgaagccgctggagggggcggtggaattcgtcgactggctgcgcgagcgcttccaggtggtgatcctctccgacaccttctacgagttctcccagccgctgatgcgccagctgggcttcccgaccctgttgtgccacaagctggagatcgacggcagcgaccgggtggtcggctatcaattgcgccagaaggatcccaagcggcagtcggtgatcgccttcaagagcctctactaccgggtgatcgccgcaggcgactcctacaacgacaccaccatgctttccgaggcccacgccggcatcctgttccatgccccggaaaacgtgatccgcgagtttccccagttccccgcggtgcatacctacgaagacctcaagcgcgagttcctcaaggcttccagccgttcgctgagtctgtag

SEQ ID NO: 13413 - DNA, 1101 bp, Pseudomonas aeruginosa
aagagcccgcggaacgcgggctcttttctattccggggacgctgtcccggccatcccttccagggtttccagcagcacccggaccttgtccagggtttcctggtactcgtcctcccagtgcgagtcggcgacgatgccgccgccgccccagcaactgacctggccgttcctgaccagcagggtgcggatggcgatcgagctgtccatctcgccgcgcacgtcgaggtagaacaggctgccgcagtagatgccgcgtcggctcggttccagttcgtcgatgatctgcatggcgcgaatcttcggcgcgccggtgatcgagccgccggggaagctgccttccagcaggtcgagggcgtccttgcccggcgccagttcgccggtgacgctgctcaccaggtgatgcacgttgggatagctttccagggcgaacagctccggtacccgtacgctgccaggttggcaactgcgtccgatgtcgttgcgcagcaggtcgacgatcatcaggttttccgcgcggtccttggggctggccagcagcgacgccgccagcgccatgtcctcctcgggggtcttgccgcgcgggcgggtgcccttgatcggccgggtttccaccttgcccttgtcgagcttgaggaagcgctccggcgacaggctgaggatcgcgccgtcggccagtcgcaggtagccggagaacggcgtcgggcaggcctcgcgcagggcgcgataggccggccacggcgagccgctgcaagcggcctggaagcgctggctatagttcacctggtagcagtcgcctgcctggatgtagtcctggatgcggcggatcgcctgccgatagtcggatgcgctgatgctccgtcggaattttcccagaagcttgaagttgccggccgcgccttgcgtttcctcgctgaacagggcgatcaggcgctggcgttcgcgctcgtccaatcgcgggtggaataccagttggctggtgccggcctggtggtcgctgatcagcgcccaggcatacaggccgacggaggccagcggcaggcccaggtcatcgcgggcgtgttcgccgatgcgctcgatgcgccgacccaggtcgtaggataa

SEQ ID NO: 13414 - DNA, 1215 bp, Pseudomonas aeruginosa
gcctgctctgaccatgggccatcgcgacggggttcccgccagcaccatcccgctgttgcagaccaagctgttcccgccaggcgccggagggttgccgctgcttccccgccaggcgctgatcgaccgcctgtacgaggcccgcgggcgacgcgcgatggtgctcagcgcgccggccggcttcggcaagagcaccatcctctgccagttgcgcctgcgcctgctggagcagggcgcggcggtggcatggttgtcctgcgacgagaccgacagcgaaccgcagcgtctgatccagtacctgctggcgagcatccagcgagtggtcccggcattcggcggcaataccgccaatctgctcggcaccgacgtcgcggtgccgctggagggcatcctggatgccttcctcgccgacctgcgtcgcctggaaggccccttgtacctgttcctcgacgatttccaccgcatccgccacgccgccttgccgcatggggttcgctacctgatcgagaacctgcccgatcacgtgcgggtggtggcctcgacccgcttccgcccgcgcttcctggtcgacgaaccgaccctcaagccctggaccttctgcctgagcgcggaagacctgcgactttcgcgcgaggagagcgatgcgtttctcctcgacctcaaggggctggagctgggcgagcgcgagctgaagctgctgttcaagcgcaccgaaggctggatcacggcgttgcacctggcggccctggccctcagtcgcaataccgaccgggaaggtttcctccgcgggctctccgggaccgaacggaacatcgccgactacctggcggaagacgtgctggccagcctgcccgccgacctgcagctgttcctcgaccagacctcggtgctcgacgagttcaatgcggaactgtgcaatgcgctgaccgggcgtcgcgacggcctggacatgctcatgcgcctgcagaacgagcagttgttcgtcatcgccctggacgaccagcgcgaatggttccgctaccaccatctgttcgccgagttcctccaggggcggctgtcccggcatgccgatccgaccccgttgctgcatgcggcggcgcgctggtgcgaggggcgcgacctggccgaccgggcgatcaagtacgcccttcgcgcccgcgactacctgttcgccgccgagttactggagcgccagggcgcgcgcctgatcgccggtaa

SEQ ID NO: 13415 - DNA, 966 bp, Pseudomonas aeruginosa
aagcctgggactgctgagcgaggcgtgagcggcagccgccaccgctccatcccttggatgggctggcggcggaaggggtggcccagtagcttggaatccaggacgagagagcatgaggctctaccgaatccatgtccgggacacctagggaagcagtaccggacctggagaccggcgagatgccggtcgatctgccggggacaggatgcaaacggcagtgccctggggcaaaccacacctgaacactggagaaataacaatgaaaaagcacctgttccttgcaactgctgttctggctgctcccttgctggcgcatgccgacctgaaagccatggacgatggcgcgctgtccgacgtgaccggccaggcaggcatcagcatttccggtactttccagggctccgtcggggccgtgacctacaccgataccgacaccaacggcggctccctgcggctggagaacatcagcctgccggcgctgaccatcgacgataccaagccgctgaccatcgacgtcgtcaccaccgatatcggcggcaagtcgacccagcaactggccatcggcctgccggccatcaccggcgacgtgaccgttggcgccatcaaggtgggcgacaccagcgccgccagcatcggctcgctgaccgtctccgggctgaacatggccggttccaccatcaaggtctggggtcactgatccaggaaccgagtcgagacgcgaagacctcgccgaggcatcggcggggtctttctccgaaagaggtacgacggggcgatgttcgagattttgctgggaagtctgatcggactgttcgggttcacccagacggtcgataccaagccgcaaccgcagggcacggtcaacctcagccagcctctgacccccaatggaccctaccgcgaatcggtgcaactggagccgatgagccagttgcagttccgcaacgtcatccgccaggcctatga

SEQ ID NO: 13416 - DNA, 1629 bp, Pseudomonas aeruginosa
aggcccagtaacccgcgagcgaggcctgttatgaagatgcgcattgcgccgctctggctggcgctggcaggggtgtgcctggcctggattccgccggccggcgcgcagatggccaacgacctgaccatcggcaacccgaaagccatggccctcggcaacgccgtgaccgccgacgagaccggcatcgattcggtgcactacaacccggcggcgctgaccaggatgaagggccgccaggcgaccgtgaagctgctcaccggggtgatggacatccgcgccggcttcaaggcgccgccgaactacggcgaaggcaccttcggcctgcgcgacgacccggtcgccaacagccacagccggaccctgaccccgaccatgtacctgcccggtctcggcggcatgaccgacgtgccgttgctggtggcgccgctggccggaatctcgatcaacccgccgggctccaagttcaccttcgccaccaacgtctacaccccgcaagcgctgggctacagccgcgattccgatagcgatccggcgcgctaccagggacgcgaggtgtcgttgcagcggctcacctacttctcgccgaccctggcctaccaggtcaacgacgagctgtcggtcggcctgtctgtgggtttctcccaccaggcagtagcgttgaacgaggatttccgggcgccgaaccagttgctcgggctgttgcagcagaccaaggagatcggttgcctgccgggaatgcaggagatcctcgaggtgttcttcaacgtctgcggcggcaatatcggtccgttccagaacctggccaatatcgacctggacatgcaacagtcgctttcgcccagcttcaacctcggcgtgctctgggagcccaccgactggttcgcctggggcgcgacctaccagagcgagtcgcggatgaagctcaagggcaagtaccgggtcgactacggccagggctggcagggtttctggaccggggtgcacaagtcgctcggcggtgcgatcctcggccagatgttcccctacgggaacgtcgacgaagagcatggcaacgccacgatgaacatggtctatccggatgccttctccaccggcgtgaagctgcgcccgttcaagaagtggcaattcaacttcgacctgaaatggaacggctacagcgactggaacgagttcaagatcgagttcgaccgcgagctcgacctgctgcgcatcgccaagtacctcgactcgaaggacgccaccagccacagcatcaccctcgaccgcggctaccgcgatacctggagctgggccatgggcgtgcagtacgacgtcaacgaccgtttgcagctgcgcgccggctacgaataccggccttcggcgatccccaagggccaggcggatatcctggtgccgatcggcgatgccaatctctacggcctggggctgggctaccagtgggacaaggacacggtgatcgatgtcggtttcaactacttcgtcaccaagcagagcgtcaaggccgataccagctgcaacctgaactgcaccgggctcgacaacctggtgtacaacccttacgcgggactggacgtggacaccacggtgaaagcctatattttcgccatgacctaccgtacgaccttctga

SEQ ID NO: 13417 - DNA, 2544 bp, Pseudomonas aeruginosa
gatcagcgggcctttctcctggtcgagaaccatgtccacgccgatgtagccgaggcccgacaactcgtagcaaccggccgccagcttcatgaagccgtcccagttcggcagttgcacaccgtccaccgcgttggtggtgtccgggtgcttggcgatcttgttgttcagccaggtgccgcgcagggtgacgccggtggccaggtcgacgcccacgccgatggcgccctggtgcaggttggccttgccgcccgactgccgggtcggcaggcgcagcatggccatcaccgggtagcccatcagcacgatgatgcggatgtccggcacaccttcgtagctgatgctcttgaagatctggtcgggggtcacccggtactcgatcagtacgcggtcgcgatgaccgccgagggagtagaggccggagaggatgctcgagatgtggtgctcgatctcctcgtggctgacgatcttccccgacacggtcttgtagcggccctcgaagcggtcggcgatcaccatgatgccgtcgccgccggcgccctgcgccggcttgatgacgaaatcgttgtgctcgccgatgatctcgttgagcttgtcgatgcctttctcggtctcgatgatgccgtacatctccggcacgtggatgccggcctcgagcgcgcgttccttggtgatgatcttgtcgtccaccaccggatacaggtgccgcttgttgtacttcaggacgtaatcggcattgcgtcggttgatgcccatcacgcctttcgcggtcaggtctttccaggtcttccagatcgacatggttcagtccttgagcagggccttgaagcggaacagctcggtcaggcggtagccgcggtagcggcccatggcgagcatgaaggcgaccaggatcagcagcacggccgggaaggtgaagatgaagtacaccagttccgggatgcgcatgaggatgtgcgccagcgatgccgcgaacagggtgccgatggccaccttcatcgcatggccgccgccgcgctcttcccaggtgatcgacaggcgttcgatggtcatggtcaggatcaccatcgggaacagggcgatcgacaggccgctctcgaagccgagcttgtggctgaacaggctgatcaccgcgatcatcaccaccacgaaggtcagcaccaccgagaggcgcggcagcatctgcagcttcaggtgctcgagataggagcgcagcgacaggcccagggcggtgatcacggtgaacagggcgataccccattgcaggccggtctcgcggaaggccagggcgatcagcaccggggtgaaggtgccgagggtctgcaggccgatcaggttgcgcaggatcaggatcaccagcacgccgatcgggatcatgatcatgatctggaaggtctgctgggtggacagcggcaggccgtacagggagtactcgaggaaggccgcctcggtgttctcgtcggacagcttggccaggcggatggcgttcatctcgctgctgttcaggctgaagctgacctgggccttcttgccgccgtcgatggtcatcagcggctcatcgccaagccaccagatcaggcgatcggagggcaggccctgttcgccggtgaccacgttgaaatacagccagttctcgccgttgaagctgcgcagccacagttccgggctctgttgcaggtcggcgaccaggcggatggtatggacccgctccatcggcacgtgagcgatggacagcagggtttcgacgatatgcgctttcttttccaggctggtgtcgccggccatcagcagcttgacgttgtcgtcgttgccgttgttggcgcgcttgatggcttcgctgacgaaggtctcgacgtcggccgagtgctggcgaatgggggccagcagggcttctgcggcgatcttctccgggccttccaggggcaggctgtcgcggaagatcgggcctttctccttggtcttctcgccggtgtagcgcttggtcagcaccaggcggtagtacagggtctgcttgccgttggcgcggcgggcggaccaggtcaccttgcgattgccgtcggcgcgattgatgctgacgccgtaattgttggagacgaagctttcgttgaggctgacgtagtcctggctcaacggcggaacgaacatctgcaccttgaccggggttttcggcgtggcgacgaagtcgaccttggcatcgatgttccagaggtcatcggtttcggcttcggtaacgggaataccctggacgaaaatctgataggcggtgatcgccacacccagggtcagcaggatggcgatcaggactttcagatgcaggttgagagagcgcatgtcgtttactcagcaggttttgcatcaggtttgcagccgggtttcccggccgagtatttcaagctcggatcgaccagtgcgtcgaatttcttcaaggcctccgagccgatcaaaagcgggtattggaatgcacttcggtcggtcaggttcacttcgatggtgcgaatcgccttgcccatgcagacctgcagctcgatcaccggacgggcggtatag

SEQ ID NO: 13418 - DNA, 612 bp, Pseudomonas aeruginosa
cttcctcgagcagagtggcctcaacgaccgtatccacgcggccctggacgccctggacgtcgacgacgtcaacgccctggccaagaccggcgcgcagatccgccagtgggtgatggaagccgagttcccggcccgtctcgacagcgagatccgccaggccttcgccgccctggccaacggcaacgacaacctcgccgtggcagtgcgttcctccgctaccgccgaagaccttccggacgcctcgttcgccggccagcaggaaaccttcctcaatatccgcggcgtggacaatgtgatccgcgcagcaaaagaggtcttcgcctccctgttcaacgaccgcgccatcgcctaccgcgtgcaccagggcttcgatcacaagctggtcgccttgtccgccggcgtgcagcgcatggtccgctcggaaaccggcaccgccggggtgatgttcaccctggacaccgaatccggcttccgcgacgtggtcttcatcaccggtgcctacggcctgggcgagaccgtggtccagggcgcggtgaaccccgacgagttctacgtccacaagccgaccctggaagccgggcgtccggccatcctgcgccgcaacctgggtag

SEQ ID NO: 13419 - DNA, 588 bp, Pseudomonas aeruginosa
cgtcctggtctccgacatgaccgacccggactgggagccggtgatgaagcgcgccagcgccatcgtcaccaaccgcggcgggcgtacctgccacgcggcgatcatcgctcgcgaactgggcatcccggcggtggtcggttgcggcaacgccacccagatcctgcaggatggccagggggtgaccgtttcctgtgccgaaggcgataccggcttcatcttcgaaggcgaactcggtttcgatgtgcgcaagaactcggtcgacgccatgcccgaccttccgttcaagatcatgatgaacgtcggcaatcccgatcgcgctttcgatttcgcccagttgccgaacgaaggcgtgggcctggcccgcctcgaattcatcatcaaccgcatgatcggcgtgcaccccaaggcattgctgaacttcgccggcctgccggcggacatcaaggaaagcgtggagaagcgcatcgcgggctatcccgatccggtcggcttctacgtcgagaaactggtggagggcatcagcaccctggccgcggcgttctggccgaagaaggtcatcgtgcgcctgtccgacttcaagtccaatga

SEQ ID NO: 13420 - DNA, 915 bp, Pseudomonas aeruginosa
ccaggtcagcaccgcgcactggctgttcaggttgcccatggcaggcatcctcgcgcgcctgctgctgcgccgcgtcgatgcgctgtccggaagccgttggcggcaggggccggaagacgagccggtcggcctggcgctggaggtcctgcgttggcatgggctgttcggccgcttcggcgagccgggcaacgactggtggaaggggctcgccgcagtcgacgtaccgctattggcggtcgccggggctggggaccggcaggacccgtcctgggcctgtcgcaagttgttcgagcagttcgcctcgtccgagcgcgaatacctgttgctcggacgcgaggctggctacgccgaggactacgggcatatcgagatgctgatcggcaaggcggcccagctagaggtctggcccttggtggagcgctggctgcgccagcgatcgccggcgggcgacgaatccgcgtggagcgaggcgctagacgtatcggaagccggaatcagcggctaacatgtgacgcaaatggcggctccggtcacgccggcgccgccggggcgggcggccgatgttcctccggagctgcccgagccgatcccttcacccacaggagcttcccatgcattacgtcactcccgatctgtgcgatgcctatcctgagctggtccaggtcgtcgaacccatgttcagcaacttcggcggccgcgactccttcggcggcgagatcgtcaccatcaagtgcttcgaagacaactcgttggtcaaggagcaggtcgacaaggacggcaagggcaaggtcctggtcgtcgatggcggtggttcgctgcgccgcgccctgctgggcgacatgctggccgagaaagcggcgaagaacggctgggaagggatcgtcgtgtatggctgcatccgtgacgtcgacgtga

SEQ ID NO: 13421 - DNA, 1056 bp, Pseudomonas aeruginosa
ctggtaccggacttgtgtttttactgtcgaaatggtcgttttaccaagggaagcgcaatgcaagcgtacgagtcgggtgacgagcgcggcctgatctatggctacgtcctcaacgggcgcggcggcggacgccgtgtcggacgcaaccagatagcggtgctcgacctgctgccggaggaaagcctttggctgcactgggaccgcggcgtgccggaagcgcaggcctggctgcgggattccgcggggctcagcgagttcgcctgcgatctgctgctggaggaggcgactcgcccccgtttgctcgatctcggggccgaaagcctgctggtgttcctccgtggagtgaacctgaatccgggcgcggagccggaagacatggtttcgctgcgggtattcgccgacgcgcgccgggtgatctcgctgcgcctgcggccgctgaaggcggtggccgatctgctcgaggacctggaggcggggaaagggccgaagacagcatccgaggtcgtgtactacctcgcgcactacctgaccgatcgcgtcgacacgctgatcagcggcatagccgaccagctcgatgctgtcgaggagctggtcgaggcggacgagcgcgccagtcccgaccagcaccagttgcgtaccctgcgccgccggtcggcggggttgcggcgctacctggcgccgcagcgggacatctactcgcaactggcgcgctacaagctgtcctggttcgtcgaggacgacgccgattactggaacgagctgaacaaccggctgacgcggaatctcgaagaactcgagttgatacgggagcgcatcagcgtcctgcaggaagccgagtcgcggcgaatcaccgaacggatgaaccgcaccatgtatctccttggtataatcaccggctttttcctgccgatgagcttcgtcaccggcctgctgggaatcaatgtcggcggcattccaggggcggatgcaccgcatgggttctggctggcctgcctgctgatcggcggggtcgccaccttccagtggtgggtatttcgtcggctgcgctggctctga

SEQ ID NO: 13422 - DNA, 288 bp, Pseudomonas aeruginosa
ggagagggcgtcactccctcgtacagacatgaggtgcgcatgcacgatccgttcgaagagtccctgcgggacctgctcaaggcttcggctccccagccggacgacgacgcgcgtctgggacgggtgctgaagaccgccaatcgccaggtcggcgccggtgacctgttcagcctcatggggcactggctgcaggcgctgatgatcggcatcaacaacggttcgccgcatctggcgccggtttcccgtatttccgcgaaaaacgcatcttctgctgacaaggctgagtga

SEQ ID NO: 13423 - DNA, 693 bp, Pseudomonas aeruginosa
ctcgccgaggttgctgcggcattcgcgctggttgcccaaggtggcgttctcgatcatcgccagcggcgtatcctcggccatgcctccagccagcagcccggcctggatctccgcgagtcgggcgacgcccatgtagaccaccagcgtggtaccgctgcgtgccagggcttcccaggccagcgggctgtcgtcctgggtatgcgcggtcaccagggtcacgccgcggctgatgccgcggtaggtcagcggtatgccgcaggcagtggcgccagccagcccggcggtgatgccgttcactatctcgctgtctatcccgtgccgggccagccattcggcttcttcgccggcgcggccgaagatgcatggatcgccgcctttcaggcgcaccacgctgcgtccctggcgggcatgccgcagcatcaggcgctggatgaagtcctgcggtgtggagcggcagccgccgcgtttgccgacccggaccagccgggcggacggacagtgctccagtatgctcgggttgaccagatcgtcgaccatcaccacatccgcgtcctgcagggcgcgaactgccttcagggtcaacagttccggatcgccgggaacccgcacccaccagccagaccttaccgctcatcgtcgttctcctcaggcattcgccgccatgggcccggggggccgccagcagtctcttga

SEQ ID NO: 13424 - DNA, 768 bp, Pseudomonas aeruginosa
ggttggcgcaaacaaaaaaggcgtcccgctgttgccagcaggacgcctttgtccaggtcccgttcggtcgggaaacgccgcctcgtcgttgaggcaggcgctttgttgtcgattgtcgggagaacccaagcaggcgccgtgccaacttgcgctattgcctatctccatggccttgcagggataacgcggggcctcaccgcggtctttctgccccgtgccggggcgtatcgcaccgggctggtgcctctcagcccttcagccagaccaggagtagcgccaggttggcggccagggacagcagggcgatggcgcgccaggtctgcagcggttcgcgctccagcaatgggcggggtgccgcgaccggcaacgcttctccctgttgcagcgagagcagccattcctcggcggtctcgaagcgctgtgcggggtcgcaggcgacggcgcgcagcagcaggtcgtcgatccaggccggcaggtcggggcgatagcggctgggcgggacggggcgaccgaagcgcgggtgctggaaggcttcgatctcgccatagggatagcgcccggtcagcgcctggtagaggcagacgccggtggcgtagagatcctggcgcaccgagggcgaggtgccggagaagcattccggcgccaggtagctgggcgtacccggtagcagatgggggtcttcgcgcgacaatcccggacaccaggccaggccgaaatccagcaggcgcagctcgccgtcacggccgaggtggagattttccggcttga

SEQ ID NO: 13425 - DNA, 615 bp, Pseudomonas aeruginosa
ggtcgcggtgcagcaggttgcgtcgatgcaactggccaagcccgcgcagcagctggttggccagccccagccactccggcagcgacagcgggccatggttgcgcaagcgctcggcgagagtctctccggggtgctcgcgcatcaggtaatacagatgctggcgttgcgccaatccgtacagctcggggaaatgccggccctggacgcggcgcaggaaccattcctcgagcagcagggcctgggttgccagcggatcgtcggcacgtgcggcgggaagggtcttcagcagccagggttggccctggccatcttcgacccggtagagcagggactggcgggattcgcctagcaactgccggacccgccagccttcgaagagctggtcgggcttcagcggtggcggcagtggccagtggcccagttgcgcgagggcgtcgccgaggctgcctgcgggcacggcttccacgcgtaccagcagggcgctggcgttgtcctggctgcctgccaggtgggcggcgcgaaccagggcctcggcgctgcgctgcggctcctcggcgttgcgcaggatgctgcggatgccgctgtcgcccagcgtcgcccagacgccgtcgctga

SEQ ID NO: 13426 - DNA, 273 bp, Pseudomonas aeruginosa
gcatggcgaccacgaacaggccgagggcggccatcgcgctggacaagtggaaaccgaccgcggcgatgcagatggcggccagggtgtacaccatcagcaggctgcggatgccgccgatgcgatcggcgagggcgccaccgagcgggcgcatcaggctgccggcgaagacgcaggcggcggtgtagtagccggcggtcaccgggttcaggccgtactggtcgtggaaatagccgggcagggtgctggccaggccgaggaagccgccgaaggtga

SEQ ID NO: 13427 - DNA, 414 bp, Pseudomonas aeruginosa
gcgaccgggaagcccttggccttgaccgcttcgatctgcttcagcggaccgaccgaacccggctggaccggctcgatgccgtcgcgggccatcttcagcatggccagggcgtgcagcgggatgtccgggcgcgaccaggcgtcgggggccggggagaggtcgtcggtgttggtttcgccggggaccttgaatacggtgagcgtcagcttttccgggacttccggcttggccttgaaccactcgccatcggcccaggattgcagcacggacttggccgcggcattgcccttcttggcgcgctcggcgacgtcgtggaaggcgtcgaacatcagcagggtgtgcttcagctgttcggcggcggtgttggccagttcggcgtcgtccagcagctcgaccagggtggcgatgttgtag

SEQ ID NO: 13428 - DNA, 1125 bp, Pseudomonas aeruginosa
tcaaccagatcgaagcctacggcgtggcactgctgccggaattccgcgactggagcctgccggacctgcgcgatgccatcgaccgggaattcttcctgctgtcggaagcgcattaccagcgctacatcgcgccctcgttcctgcaggcgatcgacagataggcggtgtctccagcgaaaaagccgcccttgggcggcgttttcgtccgaccagcggtcactccttgctggccagctcctccaggtgggcgatgatgtcgtccggcttcaacaccagcacgtcgctttccagggtatccagcaccacttccgcggtattgccgatcagcgcgccggacaacccggtgcgcgccacggtgccgatcacggtgaccaccgcgtcgagcttctgcgcggtgcgcgggatcagcacgtcggccggaccttcctcgatgtgcaattgttcgtcgctgaaaccgtactcggcctggaaggtgcggcaggcctcgcgatagcgggcctcgatggtttcgctgagctggaaggtcgggtcggcggaggagagcatcggcgaggggtgggcgctgatcacgtgcagcgtggccttggccaggccggcgatgtcgtaggcatggctgatgatcccggcgtgcagggagcggtgctcgccgtcgttgttgccgacgtcgaccgcggcgaggatctttccgcccgtccagggccgggcggtcttggtcatcagtaccggacagggcgcgaagcgcagcagcttccagtcgtccggggtgaggatggcctttttcagcgggttgtcgggaaagtgctgcttgatgatcagcccgcagccttcggcctgttgctcggcgatgatggtctggtgcagggagtccttccaggcctggttggtcgagacgctgtagccttcctcgcgcagctcctgggccaggtcgttgagagcggcgctgtggtcgcggcgcttctcgcagaccagcaggtgcaggtgcgactgggtcacgccggcgatcagttgtgcccgtttcagggcgagaccttccagctggtccggttcaatcaccacgaggatgctgcgaatggcttgcatgatcgtctccctgagtgcttgtggttatcgctgaaacaactctag

SEQ ID NO: 13429 - DNA, 798 bp, Pseudomonas aeruginosa
tgcttcgctgaaaggcccgcatggcgggcctggggtgggtcagagcgggaagggcgcctggcgatggccgttggcgtcgatctccagggcccagccctggcggtcccagtcgccgagcacgatgcgccgggcgggctggccgtcgatgtccagcgggtgttcggccggccgatgagtgtggccgtggatcagggtacgcacgccatgcccgcgcatgacccggggcacttcttcgggcgtgacatcgatgatgtcgacggctttcatgcgggtctgcgcgcggctttccttgcgcagcttgcgtgccagcttgtgccgggtggccagcggcaggtggcgcagtacccagagcgtgagcgggttgcgcagccagcggcgcaggcgcatgtaggcctcgtctcgggtgcacaggctgtccccgtgcatcagcaataccggctcgccgtacaggtcgatcacgctcgggtcgggcagcagcgtgcatccggcctcgcggcagaacgccttgccaatgaggaagtcgcgattgccgtgcatcaggtagatgcgcgtaccgccgtcggccacctggcgcagggactgggcgatggagcgctggaaggcgtccatgccgtcgtcgccgatccaggcttcgaagaagtcgccgaggatgtacagggcctcggcccggcgggcgcgctcatcgaggaaagacagaaacgcccgggtgatgtccgggcgttccgcttcgagatgcaggtccgagatgaacaggacgctcatcgcttcattcttcgacgatttcggccttctcgatga

SEQ ID NO: 13430 - DNA, 1770 bp, Pseudomonas aeruginosa
aaatcgaaggcctgtcagggggttgacagcttcggctatgataagcgctttgatttgcccggcctaccctggtcgggcgagagcatgaccaaggatcccatgagcaagccagagaccaccgccgccccgaacttcctgcgccagatcgttcaagccgacctggatgccggcaagcacgcgaagatcgtcacccgtttccccccggagcccaacggttacctgcacatcggccacgccaagtcgatctgcctgaacttcggcctggcccaggaattcgctggcgattgccatctgcgcttcgatgacaccaacccggccaaggaagaccaggagtacatcgatgccatcgaggccgacatcaagtggctgggcttccagtggtccggcgaggtctgctatgcctccaactatttcgaccagttgcatgcctgggccatcgagctgatcaaggccggcaaggcgttcgtctgcgacctcggtcccgaggaaatgcgcgaataccgcggcaccctcaccgagccgggccgcaacagcccttaccgtgaccgttcggtggaggagaacctcgacctgttcgcccgcatgaaggccggtgagttccccgacggcgcccgttcgctgcgggcgaagatcgacatgggttcgccgaacatgaacctgcgcgatccgatcctgtaccgcatccgccatgcgcatcaccaccagaccggcgacaagtggtgcatctacccgagctacgacttcacccacggtcagtcggacgccatcgagggcatcacccattcgatctgcaccctggaattcgaagaccatcgtccgctctacgagtggttcctggccaacctgccggtacctgcgcaaccgcgccagtacgaattctcccggctcaacctgaactacaccgtgaccagcaagcgcaagctcaagcaattggtcgacgaaggccatgtcagcggctgggacgatccgcgcatgtcgaccctgtccggctatcgccgccgcggctacaccccggagtcgatccgcaacttctgcgagatgatcggggtgaaccgtgccagcggcgtggtcgacatcggcatgctcgagttcagcatccgcgaccacctggacgccaccgcgccgcgtgccatgtgcgtgctgaaaccgctcaaggtggtgatcaccaactaccccgaagggcaggtggagaacctcgagttgccgcgtcatccgaaggaagacatgggagtgcgcgtactgccgttcggtcgcgagctgttcatcgatgccggtgacttcgaggaagtcccgccggccggctacaagcgcctgatccccggtggcgaggtgcgtctgcgcggcagctacgtgatccgtgccgacgaagcgatcaaggatgccgacggcaatatcgtcgaactgcgctgcagctacgatccggacaccctgggcaagaacccggaaggccgcaaggtcaagggcgtgatccactgggtgccggccgagggcagcgtcgagtgcgaagtgcgcctgtacgatcggctgttccgctcggccaatccggagaaggcggaagagggcggcagcttcctcgacaacatcaacgccgactccctgcaggtactggccggctgtcgcgccgagccgtcgctgggccaggcgaacccggaggatcgcttccagttcgagcgcgaaggctatttcgtcgccgacctgaaggactccaggccgggcaagccggtgttcaaccgtaccgtcaccctgcgtgactcctggggacagggctga

SEQ ID NO: 13431 - DNA, 1392 bp, Pseudomonas aeruginosa
ggaaagaccgtgctgcagatctacaacacgctgagcaagaccaaagaagtcttcacgccgctggtcggcaaccaggtacgcatgtacgtgtgcggcatgaccgtgtacgactactgccatctgggccacggccgcagcatggtggcgttcgacgtgatcacccgctggttgcgccaccgtggctacgacctgacgtacgtgcgcaacatcaccgatatcgatgacaagatcatcaatcgcgccaacgagaacggcgagccgttcgatgtgctgaccgagcgcatgatcgcggcgatgcacgaggacgaggcccggctgaacatcctcaagccggaccaggagccacgcgccaccgatcacatcgccggcatgcacgcgatgatccagaccctgatcgacaagggctatgcctacgcgccgggcaacggggacgtgtactaccgggtcggcaagttcgctggctacggcaagttgtcgcggcggcgggtcgaggacctgcgcatcggtgcgcggatcgagccgggcgaagcgaaggaggatccgctcgatttcgtgctctggaagggcgccaagcctggcgaaccgagctggtcgtcgccctggggcgaggggcgcccgggctggcacatcgaatgctcggtgatgtccacctgctgcctgggcgattccttcgacatccatggcggtggcaacgacctggagttccctcatcacgagaacgagatcgcccagagcgaggccgcgaccggcaagccctacgccaagtcctggctgcactgcgggatgatcaccatcaacggcgagaagatgtccaagtcgctgggcaatttcttcaccatccgcgaagtgctggagaaatatcaccccgaagtggtgcgttacctgctgatcgccagccattaccgcagtccgatcaactactcggaggagaacctgcgcgaggccaaggcggccctggaccgtttctacaacgcgctcaaggggctgcccgaggcggcgccggcggaagcggcggagtatgtcgagcgcttcgccgcggcgatggacgacgacttcaataccgcgggtgcctgctcggtgctgttcgagctggcgcgggaggtcaatcgtctgcgcgaaagcgacctgtcggcggcggccgcgctggccgcgcgcctgaagcagttggctggcctgctgggggtgctgcaactggagccggaagccttcctgcaggcgggcgccgagggcaaggtcgatgcggccgaggtcgaggcgctgatccaggcgcgcctggaggcgcgggcggcgaagaactgggcggagtccgaccggattcgcgatcggctcaccgccatgggcgtcgtgctggaggatggcaagggcggcactacctggcgcctggccgactga

SEQ ID NO: 13432 - DNA, 600 bp, Pseudomonas aeruginosa
aaagccccgcgaacgcggggcttttcattaccggcgacctcagtcgtgcaggtgttcggcggcgtgcagggtattttccagcaggcaggcgcgggtcatcggcccgacgccgcccggcaccggggtgatccagctggcgcgttgcgctgccacttcgtattccacgtcgccgaccaggcggccgtcggcctggcggttgatgccgacgtcgatgacgatggcgccttccttgatccactcgcccttgaccagtcccggcttgccggcagcgaccaccaccaggtcggcgcgcgacacatggtcggccaggtcgcgggtgaagcggtgggtcacggtgacggtgcagccacccagcagcaactccagagccatgggccggccgacgatgttcgaggcgccgaccacgaccgcatccatgccgtacaggtcggcgccggtgctggcgagcagggtcatgatgcctttcggggtgcaggggcgcaggaggggcatgcgctgggccaggcggccgatgttgtagggatggaaaccgtccacgtccttgtccgggtggatgcgctccagcagcagggaggcgtccaggtgggcgggcaggggtag

SEQ ID NO: 13433 - DNA, 408 bp, Pseudomonas aeruginosa
ctggaccaggatgccgtcgatggcggggtcgtcgttcaggcggtcgatcagggccagcaggtcgtcctggctggtttcggcgggaagatcgtaggcctgggagagaaagccgacttcctcgcagtccttgcgcttgtgcgccacatagacctgagaggccggatcggtgccgaccaggatcaccgccaggccgggaacgcgcaggccttgctggcggcgctcggtcacgcgttgggctatctgctggcgaaggttggcggcgatcgctttgccgtcgatcagttgtgcggtcatgtcggaagggtaaccatcgaatcgggtggaaaaaggacgcgcattttcgcatggacgccgcccggggcaaaggaggcgacccgtggatttgccgtaactcctttatatagctga

SEQ ID NO: 13434 - DNA, 1446 bp, Pseudomonas aeruginosa
cgaagctgtcaagtatggcctgatcgacaaggtcatgacccagcgcgacctggccgtctaaggctccgcaatactggcggtcgagacattcggccgcctcgtgggcttgaaaatgcccacaattgccttcatcttgtgtttgaagctacccattggatcgatcgaatgactgatacccgcaacggcgaggacaacggcaagctgctgtattgctccttctgcggcaagagccagcacgaagtgcgcaagttgattgccggcccctcggtctttatctgcgacgagtgtgtcgacctgtgcaatgacatcatccgcgaggaggtgcaggaagcgcaggcggaaagtagtgggcacaaacttccggcgccgaaagagatccgcaccatcctcgatcagtacgtgatcgggcaggagcgggccaagaaggttctggcggtagcggtatacaaccactacaagcgcctcaaccagcgtgacaagaaggacgatatcgagctcggcaagagcaacattctgatgatcggcccaaccggctcgggcaagaccctgctggccgagaccctcgcacgtctgctgaacgtgccgttcaccatcgccgatgcgaccacgctgacggaagcgggctacgtgggcgaggatgtcgagaacatcatccagaagctcttgcagaagtgcgattacgatgtggagaaggcccagatgggcatcgtctacatcgacgagatcgacaagatctcccggaaatcggacaacccctccatcactcgcgacgtttccggcgagggtgtgcagcaggccctgctgaagctcatcgagggcaccgttgcctcggtaccgccgcagggcggtcgcaagcatccgcagcaggagttcctgcaggtcgatacgcgcaacatcctgttcatctgcggcggcgctttcgccggtctggagcgggtcatccagaaccgttccgcgcgcggcggcatcggtttcaatgccgaagtgcgcagtcaggagatgggcaagaaggtcggcgaggcgttcaaggaagtcgaaccggaagatctcgtcaagttcggtcttattcccgagtttgtagggcgtttgccggtgatcgcgactcttgatgagctcgacgaggctgcgctcatgcagatcctgaccgagccgaagaacgctctcaccaagcagtacgccaagctgttcgaaatggaaggcgtcgatctcgaattccgtccggacgcactcaaggcggttgcccgcaaggcgctcgaacgcaagaccggtgcacgtggcttgcgttcaattctcgaaggtatccttctcgataccatgtacgagattccctcccagcaggatgtcagcaaggtggtcatcgatgagagtgtcatcgatggctcgtcgcaacccctgatgatctacgagaacagcgaaaagccagccaaggctgcgcctgaggcatga

SEQ ID NO: 13435 - DNA, 231 bp, Pseudomonas aeruginosa
ttcagtcggttagaataccggcctgtcacgccgggggtcgcgggttcgagtcccgtccgctccgccagttacgagaaggcgcatcctcggatgcgcctttcttatatccgcatctcttacccacgccgcgccgcccaagacggctggtcgtggcagtttttgggggctgcatgctgcagaacatcagggataattcccagggctggatcgccaagaccatcattggcgtga

SEQ ID NO: 13436 - DNA, 1509 bp, Pseudomonas aeruginosa
tcagtcgtcgtccagcgggcccatggcggtagtgttgaagccgccatcgacgtagaggatctcgccgctgataccgctggccaggtccgaacagaggaaggcgccggcattgccgacttcctcgatggtgacgttgcgccgcagcggcgtctgccgctcgttggcggccagcatcttgcggaagctcttgatcccggaggcggcgagcgttcggatcggcccggcggaaaccgcattgacccgggtgccttccgcgcccaggctgccggccaggtagcggaccccggcctccaggctggccttggccaggcccattacgttgtagttcggcatggtccgttcggcgcccaggtaggagagggtcagcaggctgccgttgcggcccttcatcatttcccgtccggccttggccagggcgatgaagctgtaggcgctgatgtcgtgggcgatgcggaagccctcgcgggtggtcaccgcggtgaagtcgccgtcgagctgatcgcctggagcgaatccgacggagtggacgatgatgtccaggccgtcccagtgcttgcccagggcggcgaacaccgcttcgatctggctgtcgtcggccacgtcacaggggaagcacagctccggccgcgagccccagccactggcgaactcctccacccggcccctgagcttgtcgttctggtaggtgaaggccagttcggcgccttcccggtgcatggcggcggcgatgccggaagcgatggagagcttgctggcgactccgacgatcagggcgcgttttcctgtgagaaatcccatggtccgttccttgtctgcaactcagttttccgcgcttgccggggccatgaaggcagcctccagcaattgctgcgtatagggatgttgcggcgaggcgaaaaccgcttcggcgctgccctgttccaccaccttgccatgtcgaaccaccatcaactggtggctgagcgccttgaccaccgccaggtcgtggctgatgaacaggtaggtgaggttgtacttgccctgcagttgccgcagcaattccacgacctggcgctgcacggtgcggtcgagcgccgaggtcggttcgtcgagcaggatcagtgccggtttcagcaccagtgcccgggcgatggcgatgcgctggcgctggccgccggagaattcgtgggggtaacggtagcgggtctgcggatcgagcccgacctccaccagcgcgtcgatgatcgcctgctcctgttcggcctcgctgccgatcctatggatgcgcaggccttcgccgacgatctcgccgacacacatgcgtgggctgaggctgccatatgggtcctggaacaccacctgcatctcgcggcgcagcgggcgcacgtcatgttgcgcgagaccgtccagccgggtgccttcgaagcggatgccgccctggctttccagcagccgcaggattgccaggccaagggtcgacttgcccgagccgctttcgccaacgatgcccagcgtctgcccgcggggtag

SEQ ID NO: 13437 - DNA, 966 bp, Pseudomonas aeruginosa
ttcgaaattgaccccgtcgaccgccttgacgtggtccacggtgcggcggaacacgcctttgcggatcgggaaccagacccgcaggtcgtccaccgccaacagggtttcaccgggcgggttgctcgccggcgcaccgctgggctcggcgttgagcagctcgcgggtataggggtgtcgcggggctgcgaagagttcctggcaggaagcctgctcgacgatccgcccttgttgcatgacgcagacgcggtgggcgatgcgccggaccaggttgaggtcgtgggtgatcagcagcagggacatgcccaggcgtgcctgcaggtccttgagcagatcgaggatcttcaactggacggtgacgtcgagcgcggtggtcggttcgtcggcgatcagcagttgcggctcgcaggccagggccatggcgatcatcacccgctgccgctggccgccggagagttcgtgtggataggctttcaggcgcttggccggctcggggatgccgaccagctcgagcagttcgagaattctcgcgctggccttggcgccacccaggcccttgtgcagggcgaggacctcggcgagctgcttctcgatggtatgcagcggattgagcgaggtcatgggttcctggaagaccatggcgatgcggttgccgcggatcccgcgcaggcgccgttccgggagcttgagcagatcctcgccctggtagtggatgctgcctgctgggtggctggcgacggagtagggcagcaggcgcaggatcgagtgggcggtcaccgacttgcccgagccgctttcgccgaccagggccagggtctcgccctggcggatgtcgaagctgacgccttcgaccacccgctggcgttgctcgccggagaggaattcgacggcgaggtcgcggatttccagaatgttctcgctcatctcatttcctcgggtcgaaagcgtcgcgggcggcttcgccgatga

SEQ ID NO: 13438 - DNA, 588 bp, Pseudomonas aeruginosa
tgcggtcccgttcgcgcagccgggtcgcttcctcgaagcgttcccgcagcgctgcgttgtcgggctccaccgccagcgcgaagcgcaggttgctcagcgtgtactcgtgggtgcagtagacccgggtgttggccggcagcgcggccagtcgcgccagggaatgatgcatctgcgccggggtgccttcgaagagacggccgcagccggcggcgaacagggtgtcgccgcagaacagcagcggcgtctccgccgggtggtagtaggcgatatggccgagggtatggccgggcacgtggaagatctcgaagaccaggccgagcacctcgacccgttcgccgtcttccagcgccaggtcgcgggccgggatcttctcgttggccgggccgagaacccgcgcgccggtcagttccttcagggccgcgacgccgccgacgtggtcgtgatggtggtgggtcaccaggatatcgctcaaccgccagtcgggatgggcggccagccaggcttccaccggcttggcgtcgccggggtcgaccaccgcgcagcgacggcttgtcgcatcttgcaacagccagatgtagttgtcgttga

SEQ ID NO: 13439 - DNA, 891 bp, Pseudomonas aeruginosa
aggcggacagggcgtcgatctgtatcatgggtcgatgtcgctaagcagaagtcattggcgcatagtattgcttattttcccgtcgtgccggcgtccgtcgccgcgaaggggaagacgctggaggtacgcatgaacgaaccgcaagccttcgcccagaccgatgccgagtggctggcatcgatcaaccgggcgcgcgactggttccagggcccgctgggcagcctgatgctggccgaggagcgacgcctgttgtgcgacgagctgacccgttacttcggtggctacctggtgcactacggaccgcatgccgaactgccgccgagcaccgggcagattcagcgcggtgtgcgcctggggccgccgctgccgggcgtggacatcgcctgcgaagagggcgcctggccgctcagcgaacatgccgcggacgtggtcctgctgcaacacggcctggatttctgcctgtcgcctcaccgtctcctgcgcgaagccgcgcgtaccgttcgtccgggcggccacctgctgctgatcggcatcaacccatggagcctgtggggcatccgtcattatttcgccggggatgccttgcgccaggcccgctgcattcctccgtcgcgggcctgcgactggctcaacctgctgggcttcgcgctggagaaacggcgcttcgggtgctatcgtccgccgcttgcgtcggcagcctggcaatcgcgcctggctcgcctggagcgctggggcgacgcctggcagtcttcgggcgccggcttctatctattggtggcacgcaagctggtcgtggggttgcgcccgttgcgccagagcaagcgcgaaccgcgcggtcagctggtgcccatgccggtggcgaaagtcagccggcgagattccgaaatttag

SEQ ID NO: 13440 - DNA, 741 bp, Pseudomonas aeruginosa
atgcgtagcgtcgtactggataccgaaaccaccggcatgccggtgaccgatggtcaccggatcatcgagatcggctgtgtcgagctggaggggcgccgcctgaccggtcgccacttccacgtctacctgcaacccgatcgcgaggtcgacgaaggggcgatcgccgtccacggcatcaccaacgaatacctgaaggacaagccgcgcttccgcgaggtcgccaacgatttcttcgaattcatccgcggcgcccagctgatcatccacaacgcggcgttcgatatcggcttcatcaacaacgagttcgccctgctgggccagcaggaccgctcggacgtgaccgagtactgctcggtgctggataccctgctgatggcccgcgagcgccatccgggccagcgcaacaacctcgatgcgttgtgcaagcgctacggcgtggacaactccggtcgcgacctgcacggcgcgttgctcgacgccgagatcctcgccgacgtctacctggcgatgaccggcggccagaccagcctgtcgctggccggcagcggcgcggaaggcgacggcagcggccggccgatggtcagcccgatccgtcggctcgatccggcgcgggtagccaccccggtgctgcgcgccaacgccgaagagctggctgcgcatgcggcgcggctggcggtgatcgagaagtcggcaggtggtccgtcactctgggcgcaactggaggcgccggtcggcgaatag

SEQ ID NO: 13441 - DNA, 1494 bp, Pseudomonas aeruginosa
agacctcaaatttcccgtcctcatcgtccatcgcgacatcaaggccgacaccgttgccggcgaacgcgtgcggggcatcgcccacgaactggagcaggacggcttcagcattctctccaccgccagctccgccgaggggcgcatcgtcgcttccacccaccacggcctggcctgcattctggtcgccgccgaaggtgccggggaaaaccagcgcctgctgcaggatgtggtcgaactgatccgcgtggcccgcgtgcgggcgccgcaattgccgatcttcgccctcggcgagcaggtgaccatcgagaacgcgccggccgagtccatggccgacctgcaccagttgcgcggcatcctctacctgttcgaagacaccgtgccgttcctcgcccgccaggtcgcccgggcggcgcgcaactacctggccgggctgctgccgccattcttccgtgcgctggtcgagcacaccgcgcagtccaactattcctggcatacgccgggccacggcggcggtgtcgcctatcgcaagagtccggtgggacaggcgttccaccagttcttcggggagaacacgctgcgttccgacctgtcggtctcggtccccgagctgggatcgctgctcgaccataccggccccctggccgaggccgaggaccgtgccgcgcgcaatttcggcgccgaccataccttcttcgtgatcaatggcacttccaccgcgaacaagatcgtctggcactccatggtcggtcgcgaagacctggtgctggtggaccgcaactgccacaagtcgatcctccactcgatcatcatgaccggggcgataccgctctacctgactccggaacgcaacgaactggggatcatcgggccgatccctctgagcgaattcagcaaggagtcgatcgccgcgaagatcgccgccagcccgctggcgcgcggccgcgagccgaaggtgaagctggcggtggtgaccaactccacctacgacggcctgtgctacaacgccgagctgatcaagcagaccctcggcgacagcgtcgaggtgttgcacttcgacgaggcttggtacgcctatgccgcgttccacgagttctacgacggacgctatggcatgggcacctcgcgcagcgaggagggacccctggtgttcgccacccactccacgcacaagatgctcgccgccttcagccaggcctcgatgatccacgtgcaggatggcgggacccggaagctggacgtggcgcgcttcaacgaagccttcatgatgcacatctcgacctcgccgcagtacggcatcatcgcttcgctggacgtggcttcggcgatgatggaagggcccgccgggcgttcgctgatccaggagaccttcgacgaggccctcagcttccgccgggccctggccaacgtacggcagaacctggaccggaacgactggtggttcggcgtctggcagccggagcaggtggagggcaccgatcaggtcggcacccatga

SEQ ID NO: 13442 - DNA, 1365 bp, Pseudomonas aeruginosa
ggggtgtcgatggcggggggagagaaggccggcaagcgcggcatggggttctggacctgcagcgcgctggtgatcggcaacatggtcggttcgggagtcttcctgcttccctccagcctggcggcgttcggcgggctcagcctgttcggctggctggtgtcgagcaccggcgcggtgctgctggcgctgaccttcgcccgcctggcgcgggtcaaccccggcgccggcggcccctacgcctatacccgcgacggtttcggcagcttcgccggctacctgtgcgcctggacctactggaaagccgcctggatcggcaacgcggcgatcgccgtgaccctggtcggctacctgcgggtgttcatcccggcgctggcggatccgctgctgatggtctgcgtggccatcgccgcgatctggctgtgcaccctgatcaacctgcgaggcatcggcaccttcagcgtggtgcagaacctgctgaccatcctcaagctgctgccgttgttgctggtcggtatcctcggctggttccacttcaatcccgagcacctggcgatcccggcgcgcagcgagctgccgaacatgggctatgcccaggcgatcgccaccaccgcggcgctgaccctttggtcgttcatcggcctggagtcggccaccgtgccggccgacgacgtcgaggacccgcgccgcaccattccccgcgcgaccctgttcggcacgctggccgcggcggccctctacatcctctctatcactgcggtgcagggcctgatgccgccggaggtgctggcccgctccacctcgccgttcgccgacgcggcacggatcctgatgggcgactggggctactacctggtggctgccggggcggtgatcgcctgcctgggcgcgctcaatggctgggtcctgttgcagggccagatcccggtggctccggcgcgcgacgggctgttccctgagtcgctcggccagctcaacaagaacggcgcgccggcccacggcctgctggcctcggggctgctggtgacggcgctggtgatggtcgacgggcatggcgacctggtcgatgtgttcaacgtgatcatcctgctcggcaccatgaccggggtggtcccctacgcgttctgcaccgccgcgctgttgcaactgctggcggtgcgaccggacgagttctcgccgcgttcacgccggcaattgctggtgatcggctcgctgggcttcgcctactcgctatgggcgctgtatggcaccggccagcaggcgatcttctggggcttcctggtgctgatggccggtatcccgatgtacacctggcggcaatggcgcaaccaggtcaacggagtgccgacgctcaaagccaatgactga

SEQ ID NO: 13443 - DNA, 864 bp, Pseudomonas aeruginosa
gaaagacagtattggatatatcgcggcggatccgtcgaaaatccatccgtacgctcgctctggccagacgaggcgttccatccattacagaggaagcccgtcatgcacactcattctccaatcccccgtaccgccctggtcaccggcggctcgtcgggcatcggcctggccatcgcccggcgccttcggcaacagggttatcggatcgccctggtggcccgtgattcccagcgcctgcaacgcgctgccgccgagttgggcggtgtgccctggatggccgccgatctttcccgccgcgaagctgtcgaggcggtggccgcctgggttggcgacaccttccaggggctcgacgtgctggtgaacaacgccgggttcacccgaaagatcgccgccaccactccgctggctgaggccgagcgggaatgggatgcgctgctggacggcaacctgaaaagcgcgttcctcatgtcgctggcggtgttgccgcatttcgcggaagagggcgggcggatcatccatatcggatcgatcgctgcgcagaccggtagcggcagtcctggtgcgctgggctatgcggcagccaaggccggcctgcatggcttcggcgtggccctggcgcgggaactcggttcgcgcgggatcacggtgaacagcgtggcgccgggttacatcgccgacacccggttctttcccggcggcctcgatccgcaacgggtcgccgccatcgtcggcgagaccccgctgggcaggaccggccgggtcgaggacatcgccgcggcggtggcctggctggcctcgcccgaggcggggttcgtcaccggaacggtggtgtcggtgaacggtggctggcgggtcggcaactga

SEQ ID NO: 13444 - DNA, 1092 bp, Pseudomonas aeruginosa
cctggtgggggcggctcaaccagcagaagttctggcaataggccggcgccgacagggacgaacacgctgtcttcagggttttcacgagaggaggtcgaaatggctgtattcaaggcgttgtgggtgacggaagcgccccacggcgtttacgaaacgcaggtggtcgagcgcgataccggcgacctgccggcgggcgacgtactgatccgcgtgcagtattcctcgctgaactacaaggatgcgctgtccgccagcggcaaccgtggggtgacccgcaagtacccgcatacccccggcatcgatgccgccggtgtggtcgccgagtcctcggtggccgagttcgcggccggcgacgaggtgatcgtcaccggctacgacctgggcatgaacaccgccggcggtttcggccagtacatccgcgtgcccgcggcctgggtgatcaagcgcccgcaaggcctgagcctgcgcgaggcgatgatcctcggcaccgccggcctgaccgcggcgctctgcgtcgaaaagctggagcgcagcggcctgcgccccgaccatggctcggtgctggtcaccggcgccagcggcggggtcggcagtatcgccgtggaactgctggccaagctcggctacaccgtggcggccgccaccggcaagctggagcaggccgagttcctcaaccgcctgggggccaagcagattctcgatcgcgccaccgtggccgatggcgtcgacaagccgttgctcaaggaacagtgggccggcgcggtggacaccgtcggcggcgacatcctcttcaacgtggtcaagtcgttgcagtacggcggcagcgtcgcctgctgcggcctgaccgccggcgccggcttcaaggcctcggtgctgccgttcatcctgcgcggggtcaacctgctcggggtggactcggtggagctgccgctggtggtcaaggcatccatgtgggacaagctgtcgctgcaatggaagctcgacaacctcgaagaggtggcgcgcgagatcgccctcgaagagctgccgggggcgatcaaccagatcctcgccggcaagctggtcggccgggtgctggtcaacctcggctga

SEQ ID NO: 13445 - DNA, 471 bp, Pseudomonas aeruginosa
cctctaccaccatttcggcaacaaggaacgcatccatggcgaactgtacctggccgggatcggccagtacgcggcgttgctcgaagccggcttcgccagggcgcgcagcgccgaggaaacggtcaggttgctggtcaccagctacatcgactgggtcgtggcgaatcccgactgggcacgcttcatcctgcacagccgcgggcgggtggaggcgggggagctgggcgagcgcctgcgggccgacaaccaggcgcacttcgcacggatccatgcggcgctggcgggatatcgggccgagggcctgttccgcgagatgccggacgactgctttgcttcggtggtgatcggcccggcccacgatcttgcccgccagtggctggccgggcgaacccgggtggcgttggccgactgtcgcgaactgctggcgcaggtggcctgggacagcgtgcgggcggcctgaggcgtccgtga

SEQ ID NO: 13446 - DNA, 1545 bp, Pseudomonas aeruginosa
atagtcgagattgtcgaagcggcgctggatggcttcggcgatcgggatcgacttggcgttggccagggagcagaagtcgccgccggggcagcagatgatgtcggtcagcaggccgacgttgggggtggcgaagcccagttcgcggagttcgccccagagggcgaagagttcgccctgctcgacgtcggcgagaatgatgttctgattatggctgttgcgcacctcgccgaagctgtagcggtcggcgagatcggcgatggcctccagctgtttgtcggtgacgtctcccggcgcggtgccggtgggcttcagcgagagcgtcacagcgacgtagccgggcttcttgtgggcgaaggtgttgcgtgcgcgccagcgggcgaagccggggtgctccgcgtcgagccgggcgagggactcgtcgaggtcgtcgagggccttgtaggccggatcgacgaaatgcgcggcgacgcgctggacttccgcctcggtgagggtgctcggtccgtccttgaggttggcccattcggcctcgacgcgctcggcgaagacttccggggtcagcgccttgaccaggattttgatccgcgccttgtacttgttgtcgcgccggccatagcggttgtagacgcgcaggatggcatccaggtagccgagcaggtgctgccagggcaggaattcattgatgaagctgccgacgatgggggttcggcccaggccgccgccgaccgagacgcggaagccgagctcgccggcctcgttcttcaccgcctccaggccgatgtcgtgcacttcgatggcggcacggtcgctcaccgcgccgttcaccgcgatcttgaacttgcgcggcaggtgggcgaactcggggtggaaggtcgaccattggcggatgatctcgcaccaggggcgcgggtccaccagctcgtcgcgggcgacgccggcgaactggtcggtggtggtgttgcggatgcagttgccgctggtctgaatcgcgtgcatctgcacggtggccagctcggcgaggatttccggcacgtcttccagctccggccagttgaactgcacgttctgccgggtgctgatgtgggcgtagcccttgtcgtagtcgcgggcgatctgcgccagcttgcgcagttggcgcgaggagagcaggccatagggaacggcgatgcgcagcatcggggcatagcgctggatatagagaccgttctgcaggcgcagcgggcggaactcctcaccggtcaattcacccgccaggtaacggcgggtctggtcgcggaactgcttgacgcggtcctcgacgatccgttggtcgtactcgtcgtatacgtacatgaatattcctgctgtcaggctatgcggcttactgcgttaaccagcgcgcacggctacgcgctccacgcggagtgggcgcacgataccagttcatatttatgcgtaaaagtgatgtttgagtatatggtaagaaccaaaaagactaagtcgccaggcaagcataaccgcttcgcaacggcgcctttcttgagcgatgggcggcgctggtcttaa

SEQ ID NO: 13447 - DNA, 1293 bp, Pseudomonas aeruginosa
acccttggcgggaggagggtggcttcaggcctggcgggcggggatgcgtcgttccgccgtgccctgcgtggccctggcgcgcagttgcccgcagccgccgtcgatgtcctggccggccgagttgcgcaccttggtcagcacgccgcggctgtgcaggtagcgcaccagctcgacgatccgctccccgctcgggcgccggtaggcgtcgccgtccatgctgttgtaggggatcaggttcatcaccgcgaagcggcccttgagcaggcgcaggatgccgtccatttcctccaggctgtcgttgatcccttcgagcagggtccattggtactggatcggatagtcgacccggcgggcgtaggcctcgccggcttccaccagttcttccgggctcagcggcggcgccttgggcaacagttgccggcgcagttcggcgcgggtgctgtgcagggacagggcgagggcgggcttcacccgttgccggggcaggcgctcgaacacgcgggggtcgccgacggtggagaacaccaggttcttgtggccgatgccgccatcggtgccgagcaggtcgatggcttcgaggacgttgtcgaggttgtgcgccggctcgcccatgcccatgaacaccactttcttcaccgctcgccggcgccgcgccaggaccacctgggcgaccatctccaggctgccgacctggcgcagcaggccgctgcggccggtcatgcagaacacgcagccgaccgcgcagccgacctgggtcgagacgcacagcccaccgcgcggcagcagcacgctttccaccatctgccggtcggccagttccaccagcaggcgcgacgagccgtcgctcgccggatgctcgctgtgcaggcgggcgatgccttccagttccgctgctacctggggcagaccatggcgtacgcccagcggcaggaagtcctcggcccgctggcgggcggtgcaggcatcgagggcgcggccctgcagccaggcgcggacgatcctcccgcaatgcaggggcttggcgccgagatcggcgaggcgctggtggaggtcttggctacgcatggggcgcgcatcctaccattgcccgtcatgaggcggtatggccggcgccgacgtgctatcgttgcgctccgctccaccgcagcaacggaaccgttccatgaaattcgtccaccagcgcgaacacctcaacgaagacgacatcgtggtcatcgagtgctcgcagcaatgcaatatccgcctgatgaacgacgccaatttccgcagtttcaagaatggcgggcggcatag

SEQ ID NO: 13448 - DNA, 3762 bp, Pseudomonas aeruginosa
ggaatttcatcgtcgccttcctggtcagtcatcgtagccaaggttcggcgccagccagcgctcgctgacgctggcttcctggcccttgcgctggctgtagcgttccacctggtccttgtcgatcttgccgaccgcgaagtactgcgcctgcgggtgggcgaaataccaaccgctgaccgccgcggcggggaacatcgcgtagtgctcggtcaggctgacgccggacaggccctgcggatcgagcagttcgaacagggtgcctttctcggtatggtcggggcaggccgggtagcccggtgccgggcggatgccgacgtattgctccttgatcaaggcctcgttgtcgaggtgctcgtcgcgggcgtagccccagtactccttgcgcacccgctcgtgcagccactcggcgcaggcttcggcgaggcggtcggcgagcgccttgaccatgatgctgttgtagtcgtcgcccttggcttcgtacgccttggccacttcctcggcgccgatcccggcggtggtgatgaagccgccgatgtagtcgcgcacgccgctttccttcggcgcgacgaaatcggccagcgacaggttcggcttgccgtccggcttgatcgtctgctgccgcaggtggtgcagggtggcgagggtctcgccatcggcgccgtagacctccaggtcgtcgtgctcgacctggttggccggccagaagccgaacaccgcgcgggccttgatcagcttctcgtcgatcagcttcttcagcatcgcctgggcgtcgttgaacaacgaggtggcggcctcgccgaccacttcgtcggtgaggatgcgcgggtacttgccggccaggtcccaggaaatgaagaacggcgtccagtcgatgtactcggcgagcaccgcgaggtcgatctcgtcgagcaccctgacgccggtgaaggaaggcgtcggcgcctggtagccggcccagtcgaacgccggcttgttggcgatcgcctgttcgtagctcagccgctcggtgcgggcgctgcggttggccgtgcgttcgcggaccaccgcgtagtcggcgcgggtgcgggccacgtagtcggccttcagctccttggacagcaggctggtggccacgcctaccgcgcgcgaggcgtcggtgacgtagaccaccgcgtcgttgctgtactgcggatcgatcttcaccgcggtatgcgccttcgaggtagtggcgccgccgatcatcagcggcaactggaaattctgccgctgcatttccttggcgacgtggaccatctcgtccagcgacggcgtgatcaggccagacaggccgatgatgtcgcatttctcggcgatggcggtctgcaggatcttctccgccggcaccatcacgccgaggtcgaccacgtcatagccgttgcagccgagcaccacgccgacgatgttcttgccgatgtcgtgcacgtcgcccttcaccgtggccatcaggatcttgcccttggcttccggcttatcgcctttctccgcctcgatgaagggaatcaggtgggccaccgcctgtttcatcactcgcgcggacttgaccacctgcgggaggaacatcttgccggcgccgaacaggtcgccgaccacgttcatcccggacatcagcggaccttcgatgacctcgatgggacgcgcacactgctggcggcattcctcggtgtcctcgacgatccaggtggtgatgcccttgaccagcgcatgctcgaggcgcttctcgacactgtagctgcgccattcctcgtcctcggcctccttgaccgcgccgccgcccttgtagtcgtcggcgatcgccagcagggcctcggtggcctcgggcgtgcggttgagcaccacgtcctcgacccggtcgcgcagcgctttcggaatctcgtcgtagatttccagctggccggcgttgacgatgcccatggtcaggccgttgcggatcgcgtagtagaggaacaccgagtggatcgcctcgcgcaccgggttgttgccgcggaacgagaaggacacgttggacaccccgcccgagctcagggcgtagggcaggtggtcgcggatgtaggcgcaggcgttgatgaaatcgaccgcgtagttgttgtgttcctcgatgccggtggcgatggcgaagatgttcgcatcgaagatgatgtcttccggtgggaagccgacttcgtcgaccaggatgtcgtaggagcgcttgcagatttcttccttgcgcgcctgggtgtcggcctggccgtcctcgtcgaaggccatcaccaccaccgcggcgccgtagcgcttgcacaggcgggcatggtgcttgaaggcctcgacgccttccttcatcgagatcgagttgacgatgcccttgccctggatgcacttcaggccggcctcgatcacttcccacttggaggagtcgatcatgatcggcacgcgcgagatgtcgggctcggaggcgatcaggttgaggaaggtgaccatggccgccttcgagtccagcatgccttcgtccatgttgatgtcgatcacctgggcgccggcttccacctgctgctgggcgacctcgagagcttccgcgtagttttcctcgcggatcagccgggcgaacttggccgaaccggtgatgttggtgcgctcgccgacgttgacgaacagcgagctgcggtcgatggtgaacggctccaggccggacaggcgacaggcccggggaatctccgggatggcccgcggcgggtacttggccactgccttggcgatcgcctcgatgtgcgccggggtggtgccgcagcagccgccgacgatattgaggaagccggcggcggcgaattcctcgaccaccacggccatttccgccggcgattcgtcgtattcgccgaaggcgttcggcaggccggcgttggggtgggccgagacatgagtgtcggccttggtcgacagttcctcgatgtacggccgcaattccttggcgccgagggcgcagttcaggcctaccgagatcggccgggcatgccgcaccgagttccagaaggcctcggtggtctggcccgacagggtgcggccggaggcgtcggtgatggttccggagatcatgatcggcagctccacgccgagttcctcgaacacgccctggacggcgaagatcgccgccttggcgttgagggtgtcgaagatggtctcgatcaggatcaggtcggcgccgccttcgatcaggccgcgggtcgcctcgacgtagttctccaccagttcgtcgaaggtgacgttgcggtagccggggttgttcacgtccggggaaatcgagcaggtgcggctggtcgggccgagcacgccggcgacgaagcgcggcttgtccggggtctcggcggtcttcgcgtccgccacctggcgggccaggcgcgccccttcgaggttgagttcgtaggccagcgactgcatgccgtagtcggcctgggacacctgggtggcgttgaaggtgttggtctcgaggatgtcggcgccggcgtcgaggtaggccttctcgatggcctggatcacgtccgggcggctcagcagcaagaggtcgttgttgcctttcacgtcgctcggccagtcggcgaagcgctcgccgcggtagtcggcctcttccagcttgtagctctggatcatggtgcccatgccgccatcgaggatcaggatacgttccctgagggcgtgctggagggcttgcaggcgggcgctgcgatcggtgagcgggctggacatggatggacctggcgtcagtgggcggaaaggtga

SEQ ID NO: 13449 - DNA, 270 bp, Pseudomonas aeruginosa
cgacagcaggcggaaagcggcgaagaggggacgtggggcgcacgcgaacgggcgcggatggggcgcggcgagtcgaaacatatccctgtttcctcgaagtcatcgtccttgatcgccagggcgggcctgggagcccggctagcatacgtggcggccgaagccggtggaatgctggcgaaatggcggctcgtgcccggggcgagttcgcccgccgttgtgaaagtgcggcgcagagaggcgggtttgctagaatcgcccgtcgccgagtga

SEQ ID NO: 13450 - DNA, 633 bp, Pseudomonas aeruginosa
cgccgaatacttcacccgtaccttcatccgcgggccggtgtgccgtggacagatcgccaccgacgtgatccgcgacaacttctgggtggtattccaggaccccgagcaggacctgttcgtcaccgacgccaacttccgcgcgcagagcgagccgctgctggccttgccggggcagatcgacgagctgaagaacctgctcggcctgtggagcgcctaccgggacaagcgcaacgagtacgaagacctgcgccaggacgtctacgccgacgcgccgccgccgacctggaacacgctctggcacggcaacgacaacgccctgctgagcatcttccgccagttcgacagcgcctcggtgcgcaagggcctgcttggcgaggtaccgcagaccctgtggctgatggactacccgctgttcgagcgaacctactacgggctggtggtgaacttcgatgtcttcggcaacgtctcgcaccaggcgcagacgcggctgtacttcgacctgatccgcaacggcgccgagcagaacttcctccgcctgatgccggtcgacgcgcgccagccgttgctcgacgactggtaccagaacagcggcaagctgaagatgtggatggactaccaggccttcgacgatga

SEQ ID NO: 13451 - DNA, 651 bp, Pseudomonas aeruginosa
tttactagggctttatccgcaagtaccgattggcgtaaactgtcggcatatttgcgaggagttgccatgagcgccatcaccattaccgaagctgcccaagcgtatctggccgagttgctggagaagcagagcaccccgggtatcggcattcgtatcttcatcacccagccgggtacccagtacgcggaaacctgcatcgcctactgcaagccgggcgaggaaaaggtcgaggacaccgccatcgccctgaaggacttcactgcctggatcgatgcggtcagcgagcccttcctcgaagacgcggtggtggactacgccaccgaccgcatgggcggccaactgaccatcaaggcgccgaacgccaaggtgccgatggtcaacgaggacagcccgatcaccgaacgcatcaactactacctgcagaccgagatcaatcccgggctggccagccacggcggacaggtgagcctggtcgacgtggtcgaggacaacatcgccgtgttgcgtttcggcggcggttgccagggctgcgggatggtcgacatgaccctcaaggatggcgtcgagaagaccctgatcgagcgtattcccgaactgaagggcgtgcgcgacgtgaccgaccacagcaacaaggagaacgcctactactga

SEQ ID NO: 13452 - DNA, 486 bp, Pseudomonas aeruginosa
tcaggatcatcaacccgtgtccggccgcggtgcaggcgatggccgcgcggaccaccggccgccgcaacaggccgcctatgtcgcgccaggcgagtcgtgccgggcgtggcgcctggccttcgcggagcagagccatcagcagcaggccggcgagggccagcacggcgatcagcagataggcgccgacgaagggctgggccagcgcgttgcgcgaccacagcgccaggctcggcgccagcagcgcggcgagtactccgccggcgagcacgtaggcgctggcgcggcctttccgcccggcatccaccgcctccagcgcggcgaaccggtagtacatggccgaggcctggtagaccccgatgcccagcgcgccgagacagaaccagaggaaatcgccagtccagacaccggcggcgcagaccaggccgccgagcacgccgccgccggcgccgagcatcagcccgggacgtcggccgtggcgctgcatga

SEQ ID NO: 13453 - DNA, 930 bp, Pseudomonas aeruginosa
cgggctagcgcatcccgcggacgccttggccgggccagcagttcgccgccgcagttcgggcactggccgcccaggcggaccgtcgcgcagtcgcggcagaaggtgcactcgaaggtgcagatcagcgcgtcgccgctgtcgccgggcaggtcgcggtcgcagcactcgcagttggggcgcagttccagcatgggaaggtcctcggtgggagcgtcaggtcagcatgccgaagcgttcggcgtattcctgggggctgaccgaaagatgcttgtggaacgtccgccggaggttttccggatggccgaagccgcacagccgggacaccgtggcgatcgacgcctgggcgtcctgcagcagggcgcgcgcggcctccaggcgaacccgctcgacgtagcgaccgggcgccacgcccagttcctggagaaatacccgggacagcgtacgcgggctcatgcaggcctggtcggcgagggcttccagggacaggtcgccggcgaggttggcgggaatccactccagcagcgcggccagacgcggggtgcggctcggttccggggtcagccaggcgctgaactgggcctggccgccaggacgcttgaggaacatcaccaggcgtcgcgcgacgctgagcgccaggctgcggccgaggtcggcctcgaccagcgccagggccaggtcgattcccgccgtgacgccggccgaggtgaagatgtgggcgtcgccgtcgcggcaccgcgggtcgtaggtatgcaggcggtcgccttgcacatggacgccgggaaacccctggcgcagcgtcgccacgtcggcccagtgggtggtcgccgggcgcccgtcgagaaccccggcggcggccaggatcagcgctcccgaacacaccgagccgagccgccgtatgcacggttcggcggctttcagccaggcgagtag

SEQ ID NO: 13454 - DNA, 1281 bp, Pseudomonas aeruginosa
ctcatcgctgcagaggcgccagggtattgtcgtccaggcctgtttcagcgttcggtccgaggtaggggagtcagcatgcttgcacgcgacagcctggtacaggctggtctgccggataatccgtatgcgcgccagttgcgcaccggctttcgttggttgcggttcgaaaaggagctggaaaacgagtttcgcgagtttctcagctggaactcgctgatgcagcggcgcgctgccatcggggtggcgttcctgatctgggcgctgttcatcgtggccgactggatgatggtggacatccgcctgcaccccagcctgttcgagcaactgctgggcgtgcgcctgggaatgatcggcctgctgctggtggtctggccggcggccttcctgcccagcctgcgcaaggtcggcgatgccatcgcgccctactgcctgctgctgatcaacctggcggtgctggcctgcgacgtgctgttcgagtggcatggggtgccgcgcttcacccaactgggcgcgaccctgggcatcctcgcggtgttcttcccgctcggcctggcgttctgggcctgcgtgcgcctggcgttgctgtgcctggccctgaacctggcggtattcctgcttttcggcggcgaagagaacctgcgtaccaacctgctgaatacgctctacaacggcctggtggtgctgatctgttcgttcgccctgtacctgcaggactacgcccagcgcgagcagttcctcggccggcggctgctgggcatgatggccgaacaggacagcctcaccggcctggtcaaccgacgctactacgagctgctcgcccagcgggccctggagcagggcgcccgcgaagaaaagggagtggcgctgatcctggtggatgtcgacgacttcaaggcctacaacgaccactacgggcatccggccggcgatgccgccctgcgccagcttggcgtcgtgctccggcagggcgcgcggcggccgctggatatcgccgcgcgcctgggcggggaggagttcgccgtgttgctctacgacagcgaggagggcaacaccctggccatcgccgagcgcctgcggcaggcggtggaggcgctgggcatcgagcacctgggctccagcgccggcccctgcctgaccatcagcctgggggtggcctattcgacctccggcatgggcctggacgcgctctatcgcgaggccgaccgcgcgctctacgaggccaaggatgcagggcgcaacgcggtgcgcgtggcgttccggcagcacgaccgcctcgaatag

SEQ ID NO: 13455 - DNA, 993 bp, Pseudomonas aeruginosa
cgtgccgaagcggctaggcgcggtgttttgtcgcagaactccaggagggcggccaggccgccttgcgctcgctgcccgcgcctgcacagcctagaatggcggcccacctgtggcagcggaccgcttcgcatggatatcgacctcgcccgtaccttcctggagatcgcccgcagcggtagcttcgtcgctgccgcggaacgcctgcacctgacccagaccgccgtcaccgcgcgcatccagaacctcgaagggcaactcggctgccggctgttcgtgcgcaaccgcgcgggcgcgcgcctgaccgccgacggcgagcacttcctcggctacgccagccaactggtgcagacctgggatgcggcgcgacgcgacctgccgctgccggacggcttccgcaacctgctcaacctcggcggcgaggtcagcctgtgcaatccgctgctgcttaactggatgcggcgcctgcgcgaggcgattcccggccacgccgtgcgggtcgagatcggccagggtgccgacctgctcaagcaactggagcagggcgcgctggacgccgcgctggtctaccagccggaatactggccggggctgcaggtcgagcagttgctggaggaaaagctggtgatggtgcgttccgtgctatccgcggagccttatctgtatgtcgactggggcccggatttccgcagccagcacgatgccgcgctgccggaccgggccaaggccgcgctagcctgcaacctcggtccgctggccctgcagtacatcatgcagaacggcggcagcggttatttccgtacccgggtggtgagcagctacctggatggcggcaccctgcaacgggtcgagcaggcgccggagttcgcctacccgacctacatggtgtactcccgcgagcgcctgtcgccgaccctgcgccatgcgttccagttgctgcgcgaagtggtccgcgaggacagcgactggtcgcagcgctgggactacgtgatctga

SEQ ID NO: 13456 - DNA, 684 bp, Pseudomonas aeruginosa
gcgctgaggccgccgaccagggcggcgaccaggttgccgccgagcatcgaccagggttgcgccagggggctggaggcgagggcgaacagtagtacggcggatgcgccgagcggcgctgccaggcgcagcgccagttcgctgccgaacaacgcctggcaggcgaataccgcggcgagcgcgccgatgcaggcaccgagtccggcgcgcaggcagtcgcgcggtcgagcgttcagggtcagggggcggaagcctttcagccaggtgcgtacggcggtgctgggggagtcgttcatggaactcttcgaagcgaaagaaaggggccgttgccggccccgtaaggcactttcgtgctggaggcatccatccctggatgatggagtcggttcaggcgaggaacggcgggccggcggcctcgcgggattcctcgagggggcggaccacctgccggcagatcttgccggtatcccgggcgacccggcgggcggcctcgggatcgtcggcgaatggcagcagggcggcctgttcgcgttcctcgcgggtactgccggcgagcctgagggcgaggccgagcgccagggtggagaggcacagcagggacaacagcatgttcaggccccctggccggccgccaggaccggctgccgctggtcctgcgcgctgcgcagggtccgccaggtgttgtag

SEQ ID NO: 13457 - DNA, 258 bp, Pseudomonas aeruginosa
acgccgatggtcatcaccagggcgatgccgaccagcaccagtacctgggtggtgaagctggactcggcgacggtacccagggtgatggcgatgatttccgcggagaggatgaagtcggtacggatcgcgccgccgatcttctgcttttccagggcggccacgtcgacattggccgccagcgctgcctcgtcggcgtgctcgtcgtcatggggcaggtatttgtgggcgatcttctcgaagccttcgaagcacaggtag

SEQ ID NO: 13458 - DNA, 636 bp, Pseudomonas aeruginosa
gcgccaccgagcatcagcagcgggatcaccgcccagggcgcgaaggcgctgatcaacagcgcggcggggacgaggatcgccttgttccgcagcgagcccttggctaccgcccagaccaccggcagttcgcggtcggcgttgaccccggtgacctgctgggcgttgagggccaggtcgtcgccgaggacaccggcggtcttcttcgcggcgaccttggtcatcagcgagacgtcgtcgagcaccgcggcaatatcgtcgaggagggtgaggaggctggctccggccatcttgggtttccttactgggtggtgggcaccgccatcttggcggggtgtgtatttgacaccggatcgcggcggcggaacagtgcctcgcgttggagcgcgggagccgccgcacagttcattggcgcaggcgttcgagcgaggtttgccagggccaggcgggcgatggccagctcggcttcggtctcctcgcggctgccgtcctcgtcgaaccaggccgccgagagtccggtccaggccaggatccattgcagcaggcggcggcgctgcaggccgctggcggcgattacgatctccagctggcgctcgaaacggccgggcgcctgggcggtcttcgcgtcgggattggtga

SEQ ID NO: 13459 - DNA, 1071 bp, Pseudomonas aeruginosa
gcagtacgtggccgaaacgctcttcttcggcactggatatcttcagcatcgccgctgcgccgcgatggcgcaccggcagcaggcggctgctgtgggtggcgaagggctcgccgtcgggttgcaacgcccagcgctcgaggtagggcgagaaatcgagggattcgttcacggtcggtctcaggcgcccaggcgctgctggatgaagtcgaggaagcactggatgcgcagcgccagttgcgagttgcgatagtagacggcgtggatcggttgccggtattcgctcatctgttcggcgaacagcggcaccaggcgcccgtcctggatatcgcggtcggtcatgaagctggccaggcaggcgatgccctggtggctcaggaccagttggcggagcgtctcgccgctggaggcagagatatccggctggatctccaggcgatcgccgtcggcgtgcaccaccggccagcggttgaggtgctcgggctgggtgaagccgagcagggtgtgccctcgcagcccctcgatgctcgccggcgtgccgtggcgggccaggtactccgggctggcgaggatgtgcaggcggctggcgcccagcgggcgcgcgtgcagggtggagtcgctgagcgcaccgatgcggatcgccacgtcggtgcgttgctccaacaggtcgatgatcaggtcgttggtgttgagttcgagctggatgtccgggtacagccggcggaactcgccgatgtgcggcaccaccgcgtgcagcatgaagggcgaggcggcgttgatccgcaggcgcccggcggggctctgccggcgcagggccaggcgttcctcgagcgcctccatctgctgcaggatctgccgtgcctggtcgaggaagtagcggccttcctcggtcagctccatgcgccgggtggtgcggttgagcagggtggtgccgagcttgtgctcgaggcgcgagagggtccggctgacggccgaggcggtcagtcccatctgttccgcggcggcgctgatggaaccgctgtcgactacactgacgaagctttgcagttcatcggagttggctttcattcgtga

SEQ ID NO: 13460 - DNA, 258 bp, Pseudomonas aeruginosa
tcgaatatctgcaccgagaccacgcgggttttctccgggatgttgccgccgatcatcagcaccacgccgaactcgccgacggtatgggcgaagccgaggatcgcggcggtgacgaaacccggccgggccagcggcaggaccacgctgaagaaacggtcgacggggctcgcgcgcagggtcgcggcagcctccagcggtttctcgccgatcgcctcgaaggcgttctgcaacggttgcacgacgaagggcagcgagtag

SEQ ID NO: 13461 - DNA, 1746 bp, Pseudomonas aeruginosa
tcgtcgtcaggccggcgacgcttgatcggatgcgcattgccaagccgtgggggcgctggtatctgtatgcatgaacagtaccaggctccgcttcccgtgaattccccagcgcttcccgaacccttctactacctgcacaacttccgcgcggtgctcgcctggatcggcgaacgctatgccgatctgctcgacgatcaggaacgtgccttcatcgccgcgttcgccgagctgcccgaggccagccaggccctgctggtgcgcatggtgatgcgcaagggcacgctgttccgcgaaggcaagctggcctatgccgagatcggcgacacgcgcgccgccgtgcaaccgctgttggcattgggctgggtggacgcgcagccgaccctggaactggcgcaactgttcggcttgctgaagaaggacgaattgtcgcagctgttcagggaccatctcgggcgcgcgaacctgcgcaaggatgcgctgctggaacggctccagccgttgttccccgaggcgcggcggctcgccgagtggcaggccgacttcgccgaaccggtctacgagttgcgctgcatggcgctctgcgaccgcttgcggttgatgtatttcggcaacctgtggcaggactggtcggagtttgtccttgccgacctgggtatctatcgttacgaaagcgtcgagttttccgccgactcccgcggctttcgcctgcgcgccgacgtcgacgcctatctccacctgttcgattgccgccagcgcttcgacctcggcgagccgctggaggaactgctcgccggcctgccgggcgaaccctacgccaatccctggctggaagggcggcgggtcaagctgctgttccagttcgcccagcactgcgaaaagcagcgggatttcgacctggcccagcggctctatcgccaatccagccaccccggcgcgcgcctgcgggcgattcgcagcctggaacgcggcgagcgcttcgccgaagcccatgcattggcgcgggaggccagctgtgcgccggaaagcgacgccgaacgccagggcctggcccgattgctgccgcgcctgcaaggcaagctcggcctgccgcgacaggcgcgggcggcggctccggaaatcgaccgcctggacctgtgcctggcgttcccgagcgaaccctgtagcgtcgagtgggcggtccgcgagcacctggaagagcccgattgcgcggtgcactacgtcgagaacggcctgatcaattcgctgttcggactgctctgctgggaggcgatcttcgccgccgttcctggggcgttcttccatcccttccacagcgcgccggcggacctgcacagcgccgacttccgccagcgccgcgccgccctgttcgaggcctgcctgggacggctggaggacggcagctaccgcgacgcgatccgctgtcgctaccgcgacaagttcggcctgcagtcgcccttcgtctactgggaactgcttggcgaggaactgctcgaacaggcgctcgattgcctaccggcggcccacctgcgcgcctggttcgaacgcctgctggaggatatcccgggcaaccgcgccggcctgccggacctgatccagttctggccggcgcagcggcgctaccggatggtcgaggtcaagggaccgggcgaccgcctgcaggacaaccagttgcgctggctgcaattctgccgcgagcgggagatgccggtggcggtctgctacgtgcgctggcatgtcgatgactga

SEQ ID NO: 13462 - DNA, 771 bp, Pseudomonas aeruginosa
gcagggcggcgaggcgctgtaccaggtggcggtgcgcgcgctttgcgagttcagcgccaagcgcggcgacctcgacctgcgcttcaccccgtcgcccagcgccctggaaggcatcgccggacataccctggtgacctcccggcgccccgctcactaccagcgcgaagtggcgctggacggacgctaccgtcacttgcaggtgcgcggccgggcggatggctacgatccgcaggcgaactgcctggaggaaatcaagacccaccgcggcgacctcgccctgcaaccggccaaccaccggcacctgcactgggcccaggccagggtctacggctggctgctctgcgccgaacggaagctggaggaagtcgaactggcgctggtctacctggaggtcggcagccagaaggagacccgcttcgtcgagcgggtgcgggccgacgagctgcggctgttcttcgagagccagtgccaggcgtttctcgcctgggccgagcaggaactggcgcaccgccagcggcgcgaccgcgaactggccgcgttacgctttccccacgccgaattccgccacggccagcggcaactggcggaggcggtgtacaaggccgcctccgccggttgttgcctgatggcccaggcgccgaccgggatcggcaagaccatcggcacgctgttcccgcaactcaaggcgatgcccgggcagcgcctggaccggctgttcttcctggccgccaagaccccgggccgggccctcgcgctgcatgccctgcgtag

SEQ ID NO: 13463 - DNA, 1245 bp, Pseudomonas aeruginosa
cctggaaggggagaccggcggactgccggtgcgggtgctggaactggtggcgcgggacaaggcctgcgagcacccggacaaggcctgccacggcgagtcctgtcccctggcccagggcttctacgaacgcctgccggcggcccgcgccgccgccgtggaggcgcgctggctggaccaggcgcggttgcgcgaggtggcgctggcgcaccgggtctgtccctactacctgggccaggaactggcgcgctggtgcgacctggcggtgggcgactacaactactacttcgatctcggcgccatgctccatggcctggcccaggtcaaccagtggcgggtggcggtactggtggacgaggcgcacaacctggtggagcgcggccggcggatgtattccgccgaactcgaccagggcgatttcctcggtgtgcgcaaaaccgccccggaggccctgaggaaaccgctggagcgcatccagcgtgcctggaacgaactggccaagacccaggcggacgactaccaggcctacgacgagcctccgcagaagctgctcctggccttgcagaacgcggtggcggcgatcaacgacctgctcgccgagcaaccgcaggcgctggagccggcgttgcaggagttctacttcgcgatcctgcagttcggccgtctcgccgagctgttcggcgagcattcgctgttcgacatcgagaagcgcccaggccgcaacggccgcagcctggcccggctgtgcctgcgcaacgtggtgccggcggcgtttctcgccgagcgcttcgccgccagccgctccaccgtgctgttctccgctacccttgggccgcgcgactattacgccgacctgctcggcctgccggcgggcacgccctggctggaagtggactcgccattcagcgccgagcaactggaggtgcacatacagcgtcgggtttccacgcgctatgcgcagcgccaggcatccctggcgcccatcgcagcgattctcggcgagcagtttcgccagcggccgggcaactacctggccttcttcagcagcttcgattacttgcagcaggcgctggacgtcttccgccaggcatacccgtgggtgccgtgctggagccagacgccacggatggacgaggcggagcgccgggtcttcctcgagcgcttcgtcgcgggcgggcgagggcatcggcttcgccgtgctcggcggtgccttcggcgaaggcatcgacctgcctggcgagcgcctga

SEQ ID NO: 13464 - DNA, 1392 bp, Pseudomonas aeruginosa
cggcgttgcacggtcctgcggcgtgcaacccggcctgggcgaaataccggcggagcggaccaggctatcccgtcggaggcgatgtcgccgggctgctggctttcaaggtttcccttcgatgaccaggagctacccatgcagcacaaaagatcccgcgcgatggcgagtccgcgctcgccgttcctcttcgtcttgctggcgctcgccgtgggcggtacggccaatgcccatgacgatggcctgccggccttccgctattcggcggagttactcggccagttgcaactgcccagcgtggccctgccgctgaatgacgacctgttcctctacggtcgcgacgccgaggcgttcgacctcgaggcctacctggcggtgaatgcgccggcgctgcgcgacaagagcgaatacctggagcactggagcggctactacagcatcaacccgaaagtgttgctgaccctgatggtcatgcaatccgggccgttgggggcgccggacgagcgcgccttggcggcgccgctgggacggctgtcggcgaaacgcggcttcgatgcccaggtccgcgacgtgttgcagcagttgtcgcggcgctactacggtttcgaggaataccagttgcgccaggcggctgcgcgcaaggccgtcggcgaggacggcctgaacgcggcatcggccgcgctgctcggtctgttgcgagagggggcgaaggcctccgccgtgcaaggcggcaatccgctcggcgcctacgcgcagaccttccagcgcctgttcggcaccccggccgcggaactcctgcagccgcgcaaccgcgtggcccggcaactccaggcgaaggccgcgctggcgccgccatccaacctgatgcaattgccctggcgccagggctattcctggcagcccaacggagcgcattcgaacaccggctcgggctatccgtactcgtccttcgatgcgtcctacgactggccgcgctggggcagtgcgacctacagcgtggtcgccgcccacgccggtacggtacgggtgctgtcgcgctgccaggtacgggtgacccaccccagcggctgggcgaccaactactaccatatggaccagatccaggtgagcaacggccagcaggtcagcgccgacaccaagctcggcgtctatgccggcaacatcaacaccgcgctctgcgagggtggcagctccaccggaccgcacctgcatttctcgctgctctacaacggcgccttcgtttccctgcagggcgccagcttcggtccgtaccggatcaacgtcggcaccagcaactacgacaacgactgtcgccgctactatttctacaaccagagcgccggcaccacccattgcgctttccgtcctttgtacaaccccggcctggcgctctga

SEQ ID NO: 13465 - DNA, 1332 bp, Pseudomonas aeruginosa
tcgaggacaacacggtacaggtcgtggtctgatgcgcgggcgcaggcagtacgcgcgcaagggacggcggcatgggaagggagccatctggctcctttccctgggtctgccgatgttcgcgtcggccatgcccctcgaccaggcggtcagggcagggctggcgatccacccggaagtacgatccgcgatggccgaagcggaccgtgcaggcaccgaggtggagatggccaaaggggggtactacccctccgtgacgatgtccggggggccgcaggagttcgacttcggcgagatcgtctacgatctcaccgcgtcgcagatgctgtacgactggggtcgggtgacgagcaaggtcgacagcgccagcgcgacccagcgcaagctgtccgaggcggtgctggtggcgcgcgacgatgcggcgctggatatcgtcgagacctacctcgacgtgcttgcctcggagcgccgggtggaggcggtgcgctaacacatccagcgcctcgacggcatccgcgagatgacccaggcgcgcggcggcgacggctacgccgaccgcagcgagctggatcgcgccaatctggaactgtcgcgggcccaggagcagttgtcgctggagaagggcaacctgcaggacgcgcgcaaccagtacgcgatcctggtcggccaggagcccgccgacctggtggagcccgagccgatgtcgctgcaacgctacctggcggccagcgatatggcgcgggtgatccgcgaatcgcctttgcagcgcaaggccctggaggacgccaatgtcgccgaggccgaggtccgcgaggccaaggcgtcgctgctgccgcaactgaacctggaggccagcgcgctgcgccgggagatcggcgggcatccggaaagcgactcggtggtatccctgcgcttccgcatggacaccttccaggggctttccaacttccgccggccgaccgccgcgcagcagcgcctggagtcggcgaaatggagcgccgacgcgatgcagcgcgacatccgccggcaactgcagaacctcttcgacaacggcgacacgctgcgctggcgggaacagtcgctgacccagcaggtgaccgagtcggagcaggtcggcgagttgtatcgcgaacagttcgaggttggccggcgcgacgtgatcgacctgctcaacgtgcagcgcgagcggttcgaggcagagcggcaactgatcaacctgcggatcgaacgcaagcgcatcgagtatcgggcggccgcgcaagtcggcctgttgggtccgctattggagaaccggctgaatcatggaagctgagaaaaccccggataacgtcgtga

SEQ ID NO: 13466 - DNA, 720 bp, Pseudomonas aeruginosa
tcctcaaccacgaccccatcgtcgacccgttgcgccagggcttgttgctgctctgccggcagcttggccgaccgctcggcgacgccgaactggtggacggcatgccgctggagcacggtcgcctgccgttgcacctggtggcccgcgcgttgcgccgcgccgacatcaccgcccaggtcacccgccagccgttgcgccggatcgatcgctacctgctgccggccctgctgctgctcgacgacggccgcgccctggtgctggtgggcaacgacggcgagcacgccgaggtgctggtaccgcagagcgacggcggaagccagaggatgccgctggccgagctggaagcgctgtacagcggcacggcggtcttcgccaagtgccgctaccggccggacgggcgggtcggcgactacgccagcgccttgcccgaacactggttcttcggcccgctcaagcggctctggcgttcctacgccgaggtcaccgccgcggcgttggtggccaacgtcctggcggtcgcctcggcactgttcgccatgcaggtctacgaccgcgtggtgcccaacgcggcgttcgacaccctgtggatcctcgccagcggcgtggccctggcgatcgtcctcgacggtgtcctgcggatcatgcgcggccacctgctcaacgtgctcggcaagcgcctcgacctgcaactctcgaccctgctgttctcccgcgtgctga

SEQ ID NO: 13467 - DNA, 1263 bp, Pseudomonas aeruginosa
tcatggacggcccgctggagcaggtggtgcagggcaaccaggtacaggcaccgcaggccgccgaaggaggcaaccatggactctgaccgcgacgccgccgccctgcgccggcaactggccgacccgttgctggcggctacccacccggtctaccggccgctgctctggaccctgctcggttgcgtgctgctgttcatcggctgggcggcctgggcgcaactggacgaggtgacccgcggcgacggtcgggtcgtgccgttcagccgcatccagaagatccaaagcctggagggcggcatcctcgaccgcctgctggtgaaggagggcgacctggtggaagtcggccagccgctggtgcgcctcgacgagacgcgcttcctcaccaacttccaggagtcggcgaaccaggccagcgtgctgcgcgcggccattgcccggctcgacgccgaggtgctaggcaagaagagcatcgagttcccgccggacgtcgatcccgaggggccgctggcgcgttccgaacgcgagctgttcaagtcgcgccgcgacaaactggtggagggcacccaggcgatccagcggcagatccacctggcgcagagccagctcgacctggttcgcccgctggtggccaagcgtgcggtgagccagatggaggcgctcaagctgagccaggacatcgccaccctcagcggcaagctgaccgagctgaaaagcacctatttccaggatgcctataccgagcgcgcacagcgcaaggccgatctcagcgccctggaaccgatcgtccagcagcgccaggaccagttgcgccgcaccgagatcctgtcgccagtgcgcgggcgggtgaacaccgtgctgatcaacacccgcggcggggtgatccagcccggcgagccgatcatggaagtgatcccggtagaggagcgtctgctggtggaggcgaagatcaagccgcgcgacgtggccttcctggttcccggcatgccggccaaggtgaagatcaccgcctacgactacaccatctacggcgacctcaagggcaccctggagcagatcagtgccgacaccatcgaggaggacaccccgcatggcaaggagtcctactaccaggtgctgatcaagaccgatggcagccagttgaagcgcggcgaggaggtattgccgatcattccggggatggtcgccgaggtggacatcctcagcggcaagcgcagcgtgctcaactacctgctgcggccgctgatcaaggcgcgcctttactga

SEQ ID NO: 13468 - DNA, 2862 bp, Pseudomonas aeruginosa
ggccacagcgaacggtcgagcagttcgccgagaggcacgccgaattgcgcggcgcgtgccggcgaacaggccaacaggcgatgggtgaggtcgcagatcaggtgcacgggttgcgggttggcctcgaccaggcgggccagtgcctggtcggcggcggcttccaggcgggcgccgagcagacgctccaggcgtgcccgttcctccaccagcagcgcctgggtaccggactcccagcgcgagatggtcgattgcgccacgccgagcaattcggcggcatgcgtttgcttgacccggtgcagcaggcgccagcgacgcagggcggggcccagggacgaagaagggagaggctcggtcatgcttggctacgcgggcgaatggacgctgaagtctgcgcccgacgccgggcggaggcaaatcggcgcgacaccggggagacccgtatggtcggcggcgatcctcggagggccgcccgcgccgcgccggcagccgtggagctgccggcgggcgtctcgctcaggccttggcgaaggaggtggggaagggcaggttgtacaggcgttgcccggtggcggcgaagatcgcattggccagcgccgggccgatgggcgccacaccgggttcgccgaccccggtgggcgcttcgccggagggcacgatgtgcacttcgaccttgggcatctcggcgatccgcagcacctggtagccgtcgaagttgttctgctcgaccttgccgtccttcagggtgatcgcgctgtgcaggatcgcgccgaggccgaagccgatgccgccctccatctgcgcggcgatcacgtccgggttgatcgggatgccacagtccaccgcacagaccacccgctcgaccttcagcttgccgtccttgtccaccgagacctcgaccacctgggcgacgaaggtcttgaatgcctcggtcaccgcgatcccgcgcccgcgcccggcgggcagcggcctggacgggtcccagccggccttttccgcagccagttcgagcacgccgcgcaggcgcggctgctctgccagcaggtcgtggcggaacaggtaggggtccttgccggcggcctgcgccgcctcgtcgatgaacgcctccaccgcgtagaccgtgtgcgagctgccgaccacccgccaccacaggaccggcacgccgacctgggtggtgctcagctcgaccgagacattgggcaccgcatagggcaggttggcggcgccttccaccgaggtggcgtcgatgccgtccttgaccatcaccgcggcgaacggcgtgccttccaggatcgactggccgacgatgcgatgttgccagccgaccagcttgccgtcggcgtcgagcccggcttcgagccggtggtagtacatcggccggtagaaaccgccgtggatgtcgtcctcgcgggtccattgcagcttcaccggcacgccgttggcgcccagcgccttggcgatcgataccgcctcgacgatatagtccgaccaggcgttggcgcgccggccgaagctgccgccggcgtagagcgtattgatcttcacctgctccggcttcagcccggcggtgcgcgccgcgttgccctggtcgacggtctggaactggtcgccggcccagatctcgcagctgtcggcggtcagcctgaccaccgcgtccagcggctccatcggcgcatgggcgaggaacgggaactcgtagctggcggcgatcctgcgggtcgccccggccaccgccttggcggcgtcgccgtccctgcgcgcgggcttgccgggttgctcggcgagcttgcggtactccgccatcagcgcctcggaaccacgcttctcggccttgctctcgtcccactcgaccttgagcgcgtcgcggccttgcttcgccgcccagaagcccttggcgaccaccgccacgccgtgcggcacctggaccacctcgaccacccccggaatcgccctggtcgccgtggcgtcgaacgatttcaccgtggcgccgaacagcggcgggcgctggagcagggcgaccagcatgccgggcaggctgacgtcgagggtgaattgcgcactgccgtcggtcttgccgggaacgtcgacgcgcggcgcctggtgaccgatcaggcggaagtccttgggatccttcaattgcactttttccggcaccggcagttccgccgccgcagcggccagcgaaccgtagctggccttgcgctggctggccggatgttcgacgaagccgtcgcgggtgcgcagttcggtggccggcactcgccactggcgggcggcggcctcgaccagcatcgcgcgcgccttggccccggcctcgcgcaattgcatccaggagttggccatcgccgaactgccgccggtgccctgcatggtgccgaaggccaggttggcgtagcgcttggcgtcggcgggcgcgctttccacgcggaccttgctccagtccgcgtcgagttcctcggcgacgatggtggcgataccggtataggcgccctggcccatctccacgtgcttggcgatcaccgtgacactgtcgtccggggcgatccgcaggaaggcgttgggcgcgaagccggcgtccggcagggccgcggcgagggcacgccgggctccgctccactggaagccgatggtcaggccgaccaccgcggcgcctttgaggaagccgcggcgcgagccgggcagggcgttgctcagatcgatcttgctgttcatggcgtcaggccttcagggtgtcggcggcttcgtggatggcggcgcggatccgcacataggcggcgcagcggcagatgttgccgttcatcgcggcatcgatgtcggcgtcgctggggctggcgttctgctccagcagcgcggtggcggacatga

SEQ ID NO: 13469 - DNA, 537 bp, Pseudomonas aeruginosa
atcaatcctgccgagcgtcccggcggggcacggcgcggaaacgcggcgaaacaactccgtcggcgcaggcgttcacccggcatcggcaacgcgctaggatcgctgccgtcggtgactgacgcccgcccgggcggcacgcactttcagccggaagcgggacgacccgttttccctctttcattgcgcggggacgaccctgcagagaggctgaaaatggcgtggatctatctcttgctcgccggtgtcttcgaaatcgtctgggccacggccatgaaggagtcggccggcttcacccgcctgtggccaagcctggtcaccctgctgttcatgatcctcagcttcggcctgctggccgtttccatgaaaaccctgcccctcggcacggcctacaccatctgggtcggcatcggtgcggtcggcgccttcgccctgggcatcctgctcttcggcgaaagcccgagcccgttgcggctgctggcggtggggctgatcgtggccggcatcgtcattctcaagctggcgacccggcagggctga

SEQ ID NO: 13470 - DNA, 411 bp, Pseudomonas aeruginosa
ggggcgaccatcatgtacgcatccttcgctcccgcgacctgggccttgctcgcctacctcttcggcgcgctcgccctttgcctgctcatgctggggttgggccgggtgctgggcggccgatcgcatggccgggcgaagaacctgccgttcgagtcgggggtggattccaccggctcgtcgcgcttgcgcttctcggtcaagtacgcgttggtcgccatgctgttcgtgatcttcggcatcgagatgccgttcctctacctctgggcggtgtcgctacgggagaatggctgggcgggtttcgtcgaggcgacgctgttcgtctccctgctgctggtcggactgttctacctgcaccgggtcggcgccctcgactggtcgccggagcgccggcggaaaaagccgcacgactag

SEQ ID NO: 13471 - DNA, 891 bp, Pseudomonas aeruginosa
ccgctggccgggtcttcccacacttcctgctgcgcgcgccggcagagcggttcggccggcgcctgcgcgtcgccgagcagctcggagagggcgacccccaggccgccggcgagacggccgaggacgctggcggtggggctgctttggttgcgctcgatgcgcgagatcatcgccttgctcaccgcgcagcgttcggccagttgggcgagggtcagctcgcgctccttgcgcagggcggctaggcgtcgggcaatcagttcgtcgatatccatgagtggccctggcggatttttctcgtccatgatagtcactgtccaatatattggaaattcgcccttgcattggagcttgcccgcgatgaccgaaccgacgattcgccgcctggctggcgaggagatcctggcgcgcctggacgaactggccgaggtactgctggactgcgtggaaggcggggcttcggtcagcttcatgtggccgttgccgcgggagcgggcgctggccttctggcgcggcgtcggcgagagcgtggcgggcgacgaacgcctgctgctggtggcggaagcggaggggcggatcgtcggtaccgtgcaactgctcctcgaccaaccgccgaaccagtcgcaccgcgccgacgtggcgaagatgctggtgcaccggcgtgcgcgtcggcgcggcatcggcgaggcgctgatgggcgagctggaccggctcgcccgggcctgcggcaagtccctgctggtgctggatacggtcagcggcagcgccgccgaacggctgtacctgaagaccggctggacacgggtcggggaaatcccggactacgccctgatgccggacggcacgccctgtcccaccacctatttctacaagcgcctggctgctgccggctga

SEQ ID NO: 13472 - DNA, 456 bp, Pseudomonas aeruginosa
aagaagaattcggcctcgacagcgccctcgagctgcaattcgagacccattaccggcgttttctcatgcccaccgtgcgcggcgccgaggagggcagcaagaaacgctacgccggcctggtgcgccgcgccgacggtggcgaggagatggtcttcaagggcctggagaccgtgcgcaccgactggtcgccgctggcccagcgcttccagcaggaactctacctgcgcatcttcaatcgccagccctaccaggactacgtgcgcgattacgtacgacggaccctggccggcgagctggacgacctgctggtctaccgcaagcgcctgcgccggcgcctcgacgattaccagcgcaacgtgccgccgcatgtgcgcgcggcgcgcatcgccgacgactacaacctcgagcgcgggcgcccgcggcagtaccagagcggcggctggatcagctacgtga

SEQ ID NO: 13473 - DNA, 1278 bp, Pseudomonas aeruginosa
gtggccttgtcttcggcggcgctggcggcgggcgccatccgcggggcgagcagaacgacggcgaagccgatcaggagcaggctagagagggttttcatagaggacgtcctgttcgctgcgggtgccgggttccgagagttgccgttgcagccgccggtgcatggccgtggctttgaggtagtggaagtcgaagcacttgccgaacgagaagttcttccgcaccgggtcgtggcactcccggtagtaggaggcgccagccgtacgttcgtagatggccttgctgacggcggtggccatgaaggcgatcacctggtcgttgaagatatcgttgtggtcggcgatgaaggactgcgaggtgtagatgaagttgaccggctcgttgctgtagcagggcatgcgcggcagcgccggatcggcgttgccgccgtccgcgctgcagaagctcctgaagcgccatttgccgatatcggtgtcgtcgatcacccgtggttcgggcggtcttggcgcgcagttgtcgctgccatccggcagcgggcactcgcggtcgatcagcagggcggtccgatacaggctgtagttgccgagggcggtggtatccaggtcttcttcccggaggcgatagcgggttccgttgtaggtcctgtccaggtccacctggctccaggtgaggttgacgccgacccattggccgagcgggaaggcgaagtgggtggcgctgtcgccgtgggaactgatgacgtacagcagcggcggcggccgggctcccagggcgccgaccttgaggctgttctccttgagcaacaggccctgattggcctctatcgccggattcagcatgattaccgcgtcgccgaaggcgcgtatccgctgaccgtcctggagagccagcaggcgttcgagcaacgggtcgtgaagtgcgccgagggtgattgcgccgccgaagctgtggccgacgatcaccagatagttcctgtccttgcgatcgatccgttccaactgggcgagcaactcggcgacgccaccccggccgacttcctcggcgacggccttcctgtcccagtaggtcaggttctcgctatacaggccatgcatcgacttgccccgccagccaacatagaggccgaccagcctgcgtttgcccagcaccccggaggaggcgagattggcgagtgccttgttgaagctggcgacgttgccgtcgtcccgtcccgcgttgtgcttccaaccgtgaataaacaccaccatggcgatgtccccccgggcggagtagcgctttag

SEQ ID NO: 13474 - DNA, 1758 bp, Pseudomonas aeruginosa
tcaggcggtagcctgggatgcgggttggttggtgtggggctggttggcggcatcggtctccggagcgagccgggcatggttctcgcggtaccagtcgacgattccgaacgggtccgactggccgcggcagaggtggtcgcgcaggatcaggaagttctcccacatgccccaggtctcggtcatcgggccgaacttcgaggggcgcgcctcgttggccgcgcgctccggcgcgatgcgccagaagttcactcccggcttgcgatggtggaagtcgtggctgggcaggtcctgcatgaaggagaacacccgcagcgggatgtcgatcagcagcacgcccaggctccagcgaacgaacgccagggcgaaggccaggccctgcttgtcggccgggtaggggcggccgaggaagcgtccccagctcagcgagccgtagtgcaggaagcgcggcaggccgtgctcgttgcgggcgaaccagaggtgctcggagacgtgctggatccacgacgagtactgggtgaggatgaagatcgggaacaggtagaacagcgcgaacgcctccaggtagccgctggcgtacaccaggccgagcagcgcagcccagtagagcgcccggctgacgcgctcgtggcgcggggcggagacgaagctgacgtcgaaacggaacttcaggtgctcgaggatccgcgccggatggaagggcgcgagcaccaggcgggtccagaaggcgctctcggacatgcccttgtagaagccgtgctgtttcatgaagaccaggtcgacgtcgtgctcggtattgaaggtgcgcacgctgtggtgttcgttcacgtgcagcttcacgtactcgtcgcgcggggtgtgcaggatcgggatcgacaggatccacttgcaggtgaagcgggccagcgccttgttctccaggctggcgccatgggtggtgtagtggaaggtatggaggaagccacgctggcggttgaccaccaggcacatgatcagcgcgcccaacaggcacttcagccacagtggctgctgcgaggcgagcagttgctggccgtagatcaccgcgaggaagaacaccgcgtagccccaactgatgtgcaggtagagctgccagggcttgagcagggtgtctttcggccgtcgcggcgggcggtcgttcagcgacttgccggtgacccaggtccagaacggctggcagggcaggtccttgtaggtacggcgcacgtcgatgccgtatccgtacttggagtatcgggtcttgaacagttcatcttgcatggcgcaggcgctccctcgttacaggtagtcggttcggatgtagagcgtcgggacggtcgcgaagaacgagtagaacggctccatccggtagtgatcgacggccagcacgacgaagttgtcgaagcgctcgccgaagagttttcccatcaatgcgtactcggcggcctgggagacgaagctggcccagatctgctcgcgcgactggctggcgaaccatttctcgtagagcggcaggcgcgacaggaagatcgattccagggccgggtagtccagcccggtctggccgtagtcgccctgttccaggcgctggacgatctcgccgtgggcccggtgccagccgtcctcgccgccgcacatctcgaagaaagagcaggtcgcggccgggcagggcagggccccggcgatccgctcgagctggcgctcgaccttgccgaggaaaccctcgcgggtctcgccggtggcggggttgcggttgaacgatag

SEQ ID NO: 13475 - DNA, 1098 bp, Pseudomonas aeruginosa
actatggacgatctattgcaacgcgtacggcgctgcgaagcgctgcagcaacccgaatggggcgatccgtcgcgcctgcgcgacgtgcaggcgtacatgcgcggcagtccggcgctgatccgcgccggcgacatcctggccctgcgcgcgaccctggcgcgggtcgcccgcggcgaggcgctggtggtgcagtgcggcgactgcgccgaggacatggacgaccaccatgccgagaacgtggcgcgcaaggctgccgtgttggaactgatggccggcgccgtgcgcctggccggccggcggccggtgatccgcgtcgggcgcatcgccgggcagtacgccaagccgcgttccaagccgcacgagcaggtcggcgagcagaccctgccggtctatcgcggcgacatggtcaacggccgcgaggcccatgccgaacagcgccgggccgatccgcagcggatcctcaagggctatgcggcggcgcgcaacatcatgcgccacctgggctgggacgccgcgtccgggcaggaggcgaatgcctcgccggtctggaccagccacgagatgctgctgctcgactacgacctgtcgatgctgcgcgaggacgagcagcgccgggtctatctcggttcgacccactggccgtggatcggcgagcgcacccgccaggtcgacggcgcccatgtggcgctgctggccgaggtgctcaacccggtggcctgcaaggtcggcccggaaatcggccgcgaccagttgctggcgctctgcgagcgcctcgacccgcgccgcgagccggggcgcctgacgctgatcgcgcggatgggcgcgcataaggtctgcgagcgcctgccgccgctggtggaatcggtgcgcgcggccggccacccggtgatttggctgaacgacccgatgcacggcaacaccatcgtcgcgccctgcggcaacaaaacccgcctggtggcgctcatcgcccaggaagtggccgcgttcccccctggccgtgtccggctccggcggcgtgggcccccgggctgcacctggaagaacacccccggacaacgtttcccaatgcgttccccaatcccgcgggcctgccccaac

SEQ ID NO: 13476 - DNA, 954 bp, Pseudomonas aeruginosa
aatgtcgcccttttgtgcgttgcgaggagcaattccgtcatgtccgagtcccgtctgctcaccctgcgcgactacatccgctgggctgtcagccgtttccacgccgccggcctgttcttcggtcacggcaccgacaatgcctgggacgaggcgcgccacctggttctgggctccctgcaccttccctgggaaatttctgacagctacctggattgccgcctggaagacgatgaacgcgccgagttggcggagatcctccggcggcgcatcgaggaacggattccggcggcctacctgctgggcgaagcctggttctgcgggattccattcagcgtcgacgaacgcgtgctggtgccgcgctcgcctatcgccgaacttatcgaacagcgcttcgcgccctggctgccggccgagccggcgcgaatcctcgacctctgcaccggttccggctgcatcggcatcgcctgcgcctatgcgttcgagcaggcggaggtggtgctcgccgacctgtccttcgatgcgctggaggtggccaacgtcaatatcgagcgccacgacctcggcgagcgggtctacaccgtccagggcgacggtttcgccgggcttcccggccagcgcttcgacctgatcgtgtccaatccgccctacgtggatgccgaggatttcgccgacatgccggcggagttccatcatgagcctgaactcggcctggcctgcggcgacgacggcctggacctggtgcgacggatgctcgccgaggcggccgaccacctcagcgagaaaggcctgctgatcgtcgaggtgggcaacagcgaggtccatgtgcaggcgctgtatccggaagtggacttcacctggctggagttcgagcacggcggccacggggtgttcatgctgtccgccgcgcagtgccgcgagcaccgggaactgttccgttcgcgcttggaaaagtga

SEQ ID NO: 13477 - DNA, 1233 bp, Pseudomonas aeruginosa
cgctttgatcgcgtcctccggggaaggttcgcaggcccgtccttgacgggtatactccgatgtctttccctgtcgtcctcacgcggagcctcgcatgtccggcaacacctacggcaagctcttcaccgtcaccaccgcaggcgaaagccacggcccggcgctggtcgccatcgtcgatgggtgccccccggggctggaactgtccgcccgggacctgcaacgcgacctcgaccggcgcaagcccggcaccagccggcacaccacccagcgccaggaagccgacgaggtggagattctttccggggtgttcgagggcaagaccaccggcacgccgatcggcctgctgatccgcaacaccgaccagaagtccaaggactactcggcgatcaaggacctgttccgcccggcccatgccgactacacctaccaccacaagtacggcgtgcgcgactaccgcggcggcggccgttcctcggcgcgcgagaccgccatgcgcgtggccgccggggctatcgccaagaaatacctggcgggcctgggcatccaggtgcgcggctacatgagccagctcgggccgatcgagattccgttcaggagctgggacagcgtcgagcagaatgccttcttcagccccgacccggacaaggtgccggagctggaggcctacatggaccaattgcgccgcgaccaggattcggtcggggcgaagatcaccgtggttgccgaaggcgtgccgccgggcctgggcgagccgatcttcgaccgcctggacgccgaactggcgcatgcgctgatgagcatcaacgcggtgaagggcgtggagatcggcgccggcttcgccagcatcgcccagcgcggcaccgagcaccgcgacgaactgaccccgcaaggcttcctgtcgaacaatgccggcggcatcctcggcgggatctcctccggccagccgatcgtcgcccacctggcgctgaagccgacctccagcatcaccactcccgggcgctcgatcgataccgccggcgagccggtggacatgatcaccaagggccgtcacgacccgtgcgtcggcatccgcgccacgccgatcgccgaggcgatgatggccatcgtcctgctcgaccaattgctgcgccagcgtgggcagaacgccgacgtgcgcgtcgacacgccggtcctgccgcagctgtgagggctgtggcaggcagcgatgcgggacgggtgaacggcggatcgtga

SEQ ID NO: 13478 - DNA, 570 bp, Pseudomonas aeruginosa
actgaaagtactgagtctgagccgatgagcagccttaccgtctatcacgagaaccagccggagcagccgctgaagctgctgacccatgccgaggacatcgcttcgaccctggccgaggtcggcgtccgtttcgaacgctgggaagccgccgcgccgatcgccgccggcgccagccaggacgaggtgatcgccgcctacgcccacgagatcgagcggctcaagcgcgagcgcggctacatcaccgtggacgtggtcagcttgaacagcgaccacccgcagaaggccgaattgcgcgccaagttcctcgacgagcaccgccatggcgaagacgaggtgcgcttcttcgtcgccgggcgcggcctgttcgtcctgcatatcgaggagcatgtctacgccgtgctctgcgagcgcaacgaccttatctcggtgccggccggcacccgccactggttcgacatgggcgagcacccgcatttcgtcgccgtgcgcctgttcaacaacccggagggctgggtcgcccagttcaccggcgacgacatcgccagccgcttccccctgctggaagactga

SEQ ID NO: 13479 - DNA, 1047 bp, Pseudomonas aeruginosa
ggcaggtgcaggacgaggggagaggtaggctggctcatgggcagacgatacctgtccggcgcagccggcgccatccgccggcggggttcgacctgtcattgccgccagcgtagaatgcgcgcctttcttcgcggcgcgggcaagtcccgctgccagattgcagccttaccagggagatcccggcccatgagcgattatcaggaaactctgtaccagggctacggccagcgcttcagcatcgacaacatgctgcatgaggtgcgcaccgagcaccagcacctggtgattttcgaaaacgcccggatgggccgggtgatggcgctcgatggagtgatccagaccaccgaggccgacgagttcatctaccacgagatgctcacccacgtgccgatcctcgcccacggcgcggcccggcgcgtgctgatcatcggcggcggcgacggtggcatgctgcgcgaggtggccaagcacaagagcgtcgagcggatcaccatggtcgagatcgacggcaccgtggtcgacatgtgcaaggcgttcctgcccaaccactcccagggcgccttcgacgacccgcggctgaacctggtgatcgacgacggcatgcgcttcgtggctaccacggaagaacgcttcgacgtgatcatctccgactccaccgacccgatcggccctggcgaggtgctgttctccgagaacttctaccaggcctgccggcgctgcctgaacgagggtggcatcctggtcacccagaacggcacgccgttcatgcaactggaggaagtgcgcaccaccgccgcacgtaccgacgggctgttcgccgactggcatttctaccaggcggcggtgccgacctatatcggcggcgccatgaccttcgcctggggttcgacccgcgaaggcctgcgtcgccttccgctggaaacgctgcgccagcgcttccgcgacagcggcatcgccacccgctactacaacgccgatatccacctgggcgcgtttgctctgccgcagtacgtgctgcaggccatcggcaagcaggacaacgactga

SEQ ID NO: 13480 - DNA, 1026 bp, Pseudomonas aeruginosa
cgcgcgagccttgctgctgccgcccgacgggccgctgcaggtgatcgcacggcgcctgcgttccgcacagtccatactgcccatcgggcccggccgctacctgctggccgagcaggggcgggaccgcattctggaaatcgaacgacagaagagcgaattgtaaacatggaccaaacggaagtccgaaccacccaatcgcccccacggctgttccagcccaccatccgcagccacctggcgttcaccgcgctcagcgcgctggtgctgctggtcatgttcagcctgctgcgcctggccttgctgatctacaaccgcgaactgatcggcgcgaccccggcgagcaccttcctcgaggcgttcggcaacggcgtgcgtttcgacctgcgggtcgtcgtctatgccgtggcgccgctggtgctgtcgttgttcgcggtacgcgcgatggccgctcgcggcctgttccgtacatggttgacgctgttcgccagcatcaccctgttcctcggcgtactcgaactggacttctaccgcgagttccaccagcgcctgaacagcctggtcttccagtacatgtcggaagacccgaagaccgtcatgagcatgctctggtacggcttcccggtggtccgctacctgctggcctgggccttcgccacctgggtgctgtaccgggtgttcaaggccatcgacctggcgacccgcccgagccagcgcaagctgcgcgaagacagcgtgatcgcccggccgagcgctgccgcgccctggtacgtgcgcggcgtggtgctgttcctctgcgtgctggtctgcgtcctctccgcccgcggcaccctgcgccagggcccgccgctgcgctgggggcgatgccttcaccaccgagtccatgttcgccaaccagttgggcctgaacggcaccctgaccctggtcaaggcggccaaggagcgcttctccgaagaaccgcgcgaacatctggaatgcccccctgtacgacaatgtcgccctggagaccacccggcagatgttgctga

SEQ ID NO: 13481 - DNA, 2160 bp, Pseudomonas aeruginosa
ccgggatcggcagttggtcgagttcgtgcaggtcctcgccgtcggcgagggagggggtgtcgtgcatgtcgagcagttccagttgcgtggagtggagttggcagcgcgcccaggggcgtccttcgagaacccccagcagcgctgcgtcggggcgatgaccggcaggcagcagcaacaggtcgccgggctccagggtgcgcagctcgctggcgtccagcggcaggccgggccattgcagcgacaggcgcagcggtatggccaggcgttgcgccgaggggcgcggcggcaggcgtgccagcagcgtcgcgggatcgccgtcgagccagagcgccaggcgctggtcgtcgcgttccaggctcaaacgcaggcccatcgcagcgcgtggttgcgccgggctcaggccgtaccagaccaggccgggaaagacgttgccttcgcgctccagcaaggccagttgcagggccgccggcaggctggcgaaggctgcctcctgcaggttcggcgcgagccagtgggcgagcgccggagcctggcagagaaagcgcaggggcaggccgtcccacgccaggctcagttcgagatcgacgtcgggggcggcctgggcgatgtccaggcgcgcttgcaaagcgttgccggcatagtggcgacggcaacgcgcgagacgtcgctggagatccagttcggcgcggctggcgagcggcaggtcgaggtccgtaccgttcattcggcttgccactcttcatgcaggtagcgacgttgccgcgagcgctggccgctgtcctgctgctggttgaaggtgagttgcaccggttgttccggatgcagccgttgcaggcgttcgagcaactcgccacgggcttgctggagaaacgccaggctgccggggctggcactgatctcgacctgcaactggccatggccatgcaggacctgcacctccacggcgccgagctggggcagtcgcacctgcaggcgcgccgcatggctttcggctgcgctggcgacctggatgcgcccctgcacggcatcgagcaggcgcgcgagatcggccagcggcagtggccggctcccgctcgatgccagcaggcgtgccaccaggcggtcgccgggggtttgcatggcaggcagtggcacaggcgcttggtcgtcggggggcagtgcggatggatcggtttctccgggttgccgacgctcctctccgcggccttcgccgcccgctgtcggcgcgggcggcgaatcctggacactggcctgcgccgtggacgcgacctcggctgcggttttcgccgggaagccggggccgggctgtggccgctcatgcgtccgacctgcgatttgcgggtgggaggacaccggcaccagcggcggttcgtcgaccggaggcgccgaaacgctggccggctcccgggcttgcgtggacgccgcgacgcgcgcggagaccgccggcgcttgccgtgctaccgatccggacggcgacactgttggcgttggcgttggcgttggcgttggcgttggcgttggcgttggcgttggcgttgcgtccgcggcaactggcacgggggcttgccgagtggtcggcggccggtcggcggcaggcgccgcgggctggtcggcgagaggcgtcgaggtcggcgcgtcggctgtcgcggcgggctcttcggcctctgtcgtttcgtcgcccttgtcgaacggtggcctgggcgccggcggtcggtgcgcgggcagggcctgttcgaaggcgatctgctgcgcgcgcagcggcggaaggggggcaggggtgtcggacgacacgagcggagccgtatccacggcgttcagcttgagcatggccaggtctcgtggcgggtgaattcttccagttcgccttcctcgctgcgttcgcgcagcccctggcgctcggcgtcgacgtggcgctccagttcggcgaacttctccagttgccgctggcgttccagcagttctcgccggcactgccgcaggcgctcgcgctccccttcgaggcgctgcgcggtctcggcgcagtcctgttccaggccggcttccttttcccgcagcagtcctacctgctgctgccaggcttccaggcgccggcggtcgagcatggccgcctggcaggcgagaaacagccgttgctcttcggccagtcgccagtcgcggtag

SEQ ID NO: 13482 - DNA, 369 bp, Pseudomonas aeruginosa
tcccgttgcgccgcctggcgctcggtgtgttcctgcgccgcggcgcgaacccgtagcaattggcggccctgggcgcgctcggcccggtccaggcgcaggcgtcggacgcgcaacagcagcgccaggctcatgcgcagaggctccgcaactgcgcgcaggcctgtgcgtaatcgctggtttcgtgggtaccctggcgcagccactggcggatcgccgcgatcttctcgatggcctggtcggcttcgctgtcctggcctttctggtattcgccgatcttcagcagcaactcgacttcctcgtacttcgccagccattcgcgcaagcgtccggccgcatggcgctgatcgtcgtcgacgatctggttcatga

SEQ ID NO: 13483 - DNA, 294 bp, Pseudomonas aeruginosa
cgggggagcggggccatggcatacgggccttctgaattgaccggcgcagtcatcgccttgctcgagaagcgctgggtcggcgtcgccgaggtgcaggcgttgctcgagccgttgccgctggccgacgtcgcccggcagatccattttttccgcgaactgaagcgtctctaccgcctgttgccggtcgaagtgttcggcgacgacgagcagcgccagaatcttttgaatgcctgccagatggcactcgacctggcgatcgagcgcgaagaggagcagcagcatggactgggttga

SEQ ID NO: 13484 - DNA, 528 bp, Pseudomonas aeruginosa
cctggcctggcaccaggcctatcgcggcaccctgcgggcgttgcgccctgtgccatgcgcgcgcggccgggagcctgccgctgcgttgcgcctggagcggcgaatcgcgcctgctgctgtgcatcaccctggaagcccggcaggtcggcatcccgacgttgcaccaggccttgcaggcgctgcgctcggcgcgcagcgaagtgctcgccgcatgagccgggtcggtgcctggcacatcggcatcgaacgactcgacctggcgcatgccgagccgttcgcgccgcccctgccggagcgccatctgctggcgcccgacggccggccggtggagacccacgtcgccagcctgtatcccgcgcagcaggcgcaacagcgcctgttcgactacgcccggccccagctggagttccacggcctgctgcgccccggcgacttccgccaggcgctgcgcgatctccgcctggccctcacgctgccccgccagccggccctgcaggccgcggcctgcctgctcggcgagcgcgatga

SEQ ID NO: 13485 - DNA, 2628 bp, Pseudomonas aeruginosa
gccgtgccgaacagctcgccgggcgtctcgacgcggcgcgtgccgcgcacgcccgggcgctggagctggaggcgcgggaatgaacgacctgagcgggcttctcggccgggtcggcgagcgcaaggacatcctgctggtggtgttgctgctggcggtggtgttcatgatggtgctgccgctgccaccgctgctgctggacatcctcatcgccgtcaacatcaccatctccgtggtcctgctgatgatgtcggtgtacatcggctcgccgttgcagttctcggtgttcccggcggtgctgctgatcaccacgctgttccgcctggcgctgtcggtgagcaccacgcggatgatcctgctgcaggccgacgcggggcagatcgtcaacaccttcggcagcttcgtggtcggcggcaacctggtggtgggcatcatcatcttcctgatcatcaccatcgtgcagttcctggtgatcaccaagggtgccgagcgggtcgccgaggtcagcgcgcgcttttccctggatgccatgccaggcaagcagatgagcatcgacggcgacatgcgtgccggcgtgatcgatgtcaacgaggcgcgggcgcggcgcgcggtgatcgaaaaggaaagccagatgttcggctccatggacggcgcgatgaagttcgtcaagggcgacgccatcgccgggctgatcatcatcgtcgtcaacatcctcggcggcatcgccatcggcgtcacgcagaagggcctgagcaccgccgacgcgctgcaactgtacgcggtgctgaccgtcggcgatggctggtctcgcaggtgccggcgttgctgatcgccatcaccgccgggatctcgtccccgggtgtcttccgacgaatcggcggacctcggcagcgacatcggcgaacaggtggtggcgcagcccaaggcgctgctgatcggcggcctgttgctggtgctgttcggcctgattcccggtgtcccgaccctgaccttcctggctctcgcgctgctggttggcggcggcggctacttcatgctctggcgccagcgggcccatgccagcgccggttcccgcgacctgccggcgctgctcgcgcagggcgccggagcgccatcggccaaggcgcgtggcaaggctggcggcggcaagccgaaggccgggcgtctcgccgagcaggaagaattcgccctcaccgtgccgttgctgatcgacgtcgatgccagcctccaggaacgtctcgaggcgatgtcgctgaacgaggagctggtgcgggtacgacgcgcgttgtacctggatttcggcgtgccgttcccgggtatccacttgcgcttcaacgaagcgatgggcgatggcgaatacctggtgcagctacaggaggtcccggtcgcgcgcggatgcctgcggccgggctggttgctggtgcgcgaacgcgccgcgcagctggaactgctcgcggtcccccacgagccggcagagctgcaggtgccgggagaagaggcgagctgggtggagcaggcgcatcaggatcgcctggagcgttccggctgtgcctgcctgggcctggagcaggtgctcacctggcacctgtcccatgtgctgcgggagtacgccgaggatttcatcggcatccaggagacgcgctacctgctggagcagatggagcagggttacggcgagctggtgaaggaggcgcagcggatcgttcccctgcagcggatgaccgagattctccagcgcctggtcggcgaggacatctcgatccgcaacatgcgggcgatcctcgaggcgatggtggagtgggggcagaaggagaaggacgtggtgcagctcaccgagtacatccgcagcagcctcaagcgctacatctgctacaagtactccagcggcaacaatatccttcccgcctatctgctggaccaggcggtggaggagcagatccgcggtggcatccgccagaccagcgccggcagctacctggccctcgacccggcgataacccaggccttcctcgagcgcgtgcggcagaccgtcggcgatctcgcgcagatgcagaaccggccggtgctgatcgtttccatggatatccgccgctacgtgcgcaagctggtggagagcgactatgccgggctgccggtgctgtcctaccaggagctgacccagcagatcaacatccagccgcttggcaggatcgtgttgtgagcgccgatccgctgattccctggtttctcgcccgcggcctggcggtgcgtccgcattgcctgcgcgacacctcgatcgcgctcggctggcaggtcctggcccatggctgcgaactggcctggcgctgcgacggcgagcgggtctggatcgtgatgttgcgtcggcggcaggcgcgcagcggattggccaatccattcgccgcgctgtacctgctggcggaggccacgctcgatacgctggggccgcgccagcgtctctacggcaaggtcctggcgctggccggcagcccactgcctggcgagcgcatggcgcgcttctatcgccgctggaccggcgccgccgagcccgccgacggctggttcgagctggaggccgggcgggtggtgacgcagcgaagcctgcgaaaacgacaaaaacccgaccgtgcctga

SEQ ID NO: 13486 - DNA, 324 bp, Pseudomonas aeruginosa
caggctccggcaacgtcgatccctaccatggacgacatgaacgaatacaccgaagacaccctgcgggcgaccgtccaggccgccgaactggcgattcgcgacagcgaggaacgcggccgcctgctggcggaaatgtggcaaggcctggggcttgccgcggacgccggcgagctgctgttccaggcgccggagcgagagctggcgcgagccgccgaagaggagctgctggccgaactgcggcgcatgcgcagttcccagccgacgcagggcgagcagggtacccggccgcggcgtccgacgccgatgcgtggcttgttgatctga

SEQ ID NO: 13487 - DNA, 894 bp, Pseudomonas aeruginosa
ggaatcacgatggaagtcagaaaccttaatgccgctcgcgagctgttcctggacgagctcctggccgcgtcggcggcgcctgccagtgccgagcaggaggaactgctggccctgttgcgcagcgagcggatcgtgctggcccacgccggccagccgctgagcgaggcgcaagtgctcaaggcgcttgcctggttgctcgcggccaatccctccgcgcctccggggcagggcctcgaggtactccgcgaagtcctgcaggcacgtcggcagcccggtgcgcagtgggatctgcgcgagttcctggtgtcggcctatttcagcctgcacggccgtctcgacgaggatgtcatcggtgtctacaaggatgtcctgcagacccaggacggcaagcgcaaggcgctgctcgacgagctcaaggcgctgaccgcggagttgaaggtctacagcgtgatccagtcgcagatcaacgccgcgctgtcggccaagcagggcatcaggatcgacgctggcggtatcgatctggtcgaccccacgctctatggctatgccgtcggcgatcccaggtggaaggacagccccgagtatgcgctgctgagcaatctggataccttcagcggcaagctgtcgatcaaggattttctcagcggctcgccgaagcagagcggggaactcaagggcctcagggatgagtaccccttcgagaaggacaacaacccggtcggcaatttcgccaccacggtgagcgaccgctcgcgtccgctgaacgacaaggtcaacgagaagaccaccctgctcaacgacaccagctcccgctacaactcggcggtcgaggcgctcaaccgcttcatccagaaatacgacagcgtcctgcgcgacattctcagcgcgatctag

SEQ ID NO: 13488 - DNA, 1194 bp, Pseudomonas aeruginosa
ccgcgagaaaggatcgaatatatgaatccgataacgcttgagcgcgccggactgccctacggggtggccgacgccggggatgtcccggcgctcggcaggccggtcgcgaggtatgtcgagagtctgcgggtggagcgcctggcggcgccggccgcggcttccgcgagcggcacgggggtggcgctgacgccgccgtccgcagccagccagcagcgcctggaggtcgccaatcgtgcggagatcgccagcctggtgcaagcagtgggcgaggatgccggactggcgcggcaggttgtgctggccggcgcttcgacgctgttgtccgccggcctgatgtcgccgcaggcgttcgagatcgagctggcgaaaatcaccggcgaagtcgagaaccagcagaagaaactcaagctgaccgaaatcgagcaggcgcgaaagcagaacctgcagaagatggaggacaaccagcagaagatcagggaatcggaagaagccgcgaaagaagcccagaagtccggtctggcagccaaaatctttggttggatcagtgcaatagcttcgatcatcgtcggcgcaatcatggtggcaaccggcgtcggcgcggccgcgggtgcactgatgatcgcgggcggtgtcatgggagtggtctcccagtcggtacagcaggcagccgcggacggattgatcagcaaggaagtgatggaaaagctcggcccggcactgatgggtatcgagatcgccgtcgcgctgctggcggcggtggtcagcttcggcggctcagcggtcggcgggctggccaagctgggcgcgaagatcggcggcaaggcggccgagatgaccgctagcctggcgagcaaggtcgccgacctgggcggcaagttcggcagtttggccggccaatcgctgtcgcactcgctgaaactcggcgtgcaggtttccgacctgaccctggacgtcgccaacggcgcggcccaggccactcattcgggattccaggcgaaggccgcgaaccgccaggccgacgtgcaggaatcgcgtgccgacctgaccaccctgcagggcgtgatcgagcgcctgaaggaagagctgagccgcatgctggaagcattccaggaaatcatggagcggatcttcgccatgctccaggccaagggtgaaaccctgcacaacctgtccagccgaccggcagcgatctga

SEQ ID NO: 13489 - DNA, 450 bp, Pseudomonas aeruginosa
gaggcgccccccatggatttaacgagcaaggtcaaccgactgcttgccgagttcgcaggccgtatcggtttgccttccctgtccctcgacgaagagggcatggcgagcctgctgttcgacgaacaggtgggcgtcaccctgttgctgctcgccgagcgcgagcgtctgttgctggaggccgatgtggcgggcatcgatgtgctgggcgaggggatctttcgccagctcgccagcttcaaccgccattggcaccgtttcgatctgcatttcggcttcgacgagctgaccgggaaggtccagttgtatgcgcagattctcgcagcgcaactgaccctcgaatgcttcgaggcgaccctggccaacctgctcgaccacgccgagttctggcaacgcctgctgccgtgcgacagcgatcgcgaggcggtcgctgcggtcggcatgagggtttga

SEQ ID NO: 13490 - DNA, 210 bp, Pseudomonas aeruginosa
aactggtacttttgttccgcttctaaagaaagctggattaattggcggaagccgactcgctctgcgaatcagcgcacgtcggataatcctgattattataaaatcgactccgtgctcatggctttgaaaatcaataaaacggagcgtattcatgcctctccgctaggtggggcattcaaggtacgacgggaagtgttggggttcttataa

SEQ ID NO: 13491 - DNA, 408 bp, Pseudomonas aeruginosa
gcggattggccactcgcctgggccaagggccctttgttgccgatcggacgggttcgtaccacctgcgcatcgacggacagagcgtcctgttgctgcgccagggcgacgacctgctgctggaaagcccgctggagcacgcccccctggacccgcagcgcgaccagcaggggttgctgcgggtgctgttgtcgcgggtcgccagttggagtcggcgctatccccaggccattgtcctggacgcggacgggcgcctgctgttgcaggcgcggctgggcctcgacggcctcgatcccgagcgactcgaacgggccctggccgccccaggtggggctgctcgaggcgctggcgccggagctggaaccgctgccccgcgggttgccgccgcaggctccggtgtggcgtccctga

SEQ ID NO: 13492 - DNA, 1359 bp, Pseudomonas aeruginosa
ccgacggcgcctgtcccaaggacggcgcctggtgcgtcggcgcggagcgcgggaattagcatggcctggaagatccgcttctacagcgggctgaaccagggcgccgaagtctcgctcggagagggccgggtggcgcttggcagcgatccgttgcaggccgacctggtgttgctcgacgagggcatcgcggcagtccacctggtgctcgaggtcgatgcccagggcgtgcgcctgctggaatgggcggagggctgcgagcctcgccaggacggccaggcgcaagtcgccggagcgatcctgcaggcgcttgccgggcagacctgcggcccgctgcgctgggcattctgcgacccgcagcggagttttcccgagcgtttccccgaagccgaggtgcagaccgcgccagtgcgccgcaagtcgtccgcccgtgccggcggggcctggctgctcggcgtcagcctggcgctggcgctgtgtctgctgggcatgctcgtcgaaccctggtcggcccgccagcacggcatggccggcgaggagccccaggcgaaggtgcgcgcctacctgcgcgagcagggcatgagcgaggtggatgtgcagcgccagggcgacagtctcctgctcggcggctacctggaggacaacgcccggcgcctggcgctacagcgctacctcgatggcagcggcgtggactaccgactggaagcacggagcatggaagacattcgccagggcgtggatttcatcctgcagaaattcggctatcggcagatcctcagcagcaacgcggacaagcctggctgggtccggctcaacggcgaactggcggaacaggacgaacgctgggcgcggatcgacgcattgctggagtccgaggtgccgggcctgctcggggtggaaaaccaggtccgggtggccggctcgcacctgcgccgcctcgagcgcctgctggcggacgccggcctcgaccggcaactgagtttccgcgagcgcggcgagcgcatcgagttgagcggcacgctcgacgaggtccagctcagcgccttctaccgcctgcagcgcgagttccagcaggaattcggcaaccgcccgagcctggagctgctcagtcgcggcaagcgcgccagcggcgacgaactggagttcacgattcgctcggtgtcgctggggcgggtgccctatgtagtgctcggcgacggccagaaatacccggtgggcgcctcgacatcccgcggtgtgcgaatcctcgccatcgagccggagtcgatcctggtggcccgcggcaagcagcgtttcatcatcaatctcaaaggggaggtgctccatgatgacagccttggaaacgcgactgtcggtcgctga

SEQ ID NO: 13493 - DNA, 426 bp, Pseudomonas aeruginosa
cggcacgcatgccgcagcgctccggcagcgtctgcaggcggcgctggcggagtgtcgccgggaactggccagaggcgccggcccggagcgcttccagttcctgcaacagcaggcccgggccctcgaaggcggtctcggcattctttcgcagctcacagaggactaagcatggcgcagatattcaaccccaacccggggaataccctcgataccgtggccaatgccctgaaggagcaggccaacgcagcgaacaaggacgtcaacgaagcgatcaaggccttgcaggggaccgacaatgccgacaacccggcgctgctggccgagctgcaacacaagatcaacaagtggtcggtcatctacaacatcaactcgacggtgacccgtgcgctgcgcgacctgatgcaaggcatcctgcagaagatctga

SEQ ID NO: 13494 - DNA, 984 bp, Pseudomonas aeruginosa
tccggatttccagcctggccaaccaggggcgctatcaggaagccctggccttcgcccatggcaatccctggccggcgctggagccctggttcgccttgtgcgagtggcacctggggctgggcgccgcgctggaccgcaggctggccgggctgggcggcagcagcgatcctgccctggccgacttcgccgccggcatgcgcgcccaggtgcggacatgagccgcatcgacacgccgccgggattcgccgtctatccgtcggccagtccaaaggcggcgaacctgccggctgtcgatcaggtgctggctttcgagcaggccctcggcggcgagccgcaggcggccggacgccgcctggccgggttggagaacggcgctctcggcgagcgcctgctgcagcgctttgcccagccgctgcaagggttggaggcggaccgcctggagctgaaggcgatgctccgtgcggaactgccgctgggacgccagcagcaaacctttctcctccagttgctcggtgcagtcgagcatgcgccgggcggcgaatacctggcgcaactggcgcgtcgcgaattgcaggtgctgatcccgctcaacggcatgctcgacaacctcgtgcgcaacagccacaaactcgacctggagtcatgatggatatctctcggatgggcgcccaggcgcagatcaccagtctcgaagaactctccggcggcccggccggcgcggcccacgtcgccgagttcgaacgggcgatgggcggtgccggcagcctgggcggcgacctgctcagcgaactggggcagatcagggagcgtttcagccaggccaagcaggagttgcaggtggagctgtcgacgcccggcgacgatcccaacagcctgatgcagatgcagtggtcgctgatgcgcatcaccatgcaggaagagctgatcgccaagaccgtcgggcgcatgagccagaacgtcgaaaccctgatgaagacccaatga

SEQ ID NO: 13495 - DNA, 687 bp, Pseudomonas aeruginosa
acaacggcatcgaaggactcagctacgaccgcatcagcgtggtgctggtgccgtcggccggggtccgccaggtcccgctggcgccacgcttcgagagtgtcttctcgatccaggtggcggagcactcgcgcggacgcctgctcggcctgttcggcctgctgctggcgttgctgctggcgagcaacctggcgcagttcttctggcaccggcaacggggctgagcggcgcgatgccattgacggcctaccagttgcgcttctgcccggcccgctacatccacgagtcgcacctgcccgcggtattgctgcggttgctgccggcgctgccggactggcggcgacagagcgttctcaacgcctggctgctggagcaactggaattggactgcgcgttccgcatgcccgcgcaactgggcgggctggccctttacccgcaggcggcgctggaacggaccctgggctggctcggcgcgctgctgcacggccaggccttgcggcaggtgctggacggtgcgcgggtacggcgcatccgcgcgcagatcggcgaacagggccagcgtttctgcctggagcagctcgacctgctcatcggtcgctggccgcccggctggcagcgggccttgccggaaaacccggaagaaggctatttccggcgctgcggcctggctttctggctggccgcctgtag

SEQ ID NO: 13496 - DNA, 645 bp, Pseudomonas aeruginosa
atgcttccatttgttgaactagacgccagtcgcgtacggctggcccccgggcaggccctgttgcgcgcccgcgactaccaggactacctcagcgccaaccgcctggtggaagcggcccgcgagcgtgccgccgaaatcgagcgcgaggcccacgaggtttaccaggagcagaagcgcctgggctgggaggccggactggaggaggcgcgtctgcgccaggccgggctgatccaggaaacgctactgcgctgcaatcgctactaccggcaggtcgatcgccagcttggcgaggtggtgctgcaggcggtgcgcaaggtgttgcgccactacgacgctgtcgagctgaccctggcggccacgcgcgaggcactggcattggtgagcaaccagaagcaggtgatcctgcacgtccagccggaacaactggccgcggtgcgcgagcaggtcgcccgggtgctcaaggatttccccgaggtgggctacctggaagtggtcggcgatgcccggctggaccagggcggttgcatcctggaaaccgagatcgggatcatcgacgcttcgctcgacagccagttggcggcgttgcaggccgcattgacggagagcgtggcgcggagcggcgaggaggaaggggacgccggttga

SEQ ID NO: 13497 - DNA, 1419 bp, Pseudomonas aeruginosa
gggaaccaggcgccgcccccggcccgggcgttggctccgggccgagggctgagacgctgccgttcgcccgcggcggcgacgctggcggtgcggtcggcgccttcagagcagggtgaagctgcggctttcggtttgcgccgaatccaggccgacgaagaccttgaactcgcccggctcggccgtgtgcctgagctggctgtcgtagaacttcaggtctgcctcgccgaggcggaagacgatctcccgcgattcgccgggctccagcatcaccttgcggaacccgcgcagttccttcaccggacggctgaggctggcgaccgggtcctgcagataaagctggaccaccgtggcgccggcgcgcttgccgctgttgctgagcgtgacccgcgcttccagggtagcgccgcgggccagccgttcgctggacaggcgcaggggcgagagactgaactcggtgtagctgaggccgtagccgaacgggtagagcgggccgttggcttcgtcgaaatagcgcgaggtgtatttgccggggttgtcgtggtccatcggccggccggtgttcaggtggttgtagtagaccggtacctggcccaccgagcgcgggaaggacatggtcagcttgccgctggggttgtgctcgccgaacagcacgtcggcgatggcattgccgccttcggtgccactgaaccaggtttccaggatcgcatcggcgttttcctgctcccagcccagcgacagcggtcggccgttcatcagcaccagcaccagcggcttgccggtggccttcagtgccttcagcagccgccgctggctggccgggatgcgcaggtcggtgcgactggaggcctcgtgggccatgccctgcgattcgccgaccacggcgaccaccaggtcggcgtcgcgcgcggtgcgcaaggcctcctcgagcatcgcctcggcggagcgcggatcgacctcgacttccgggttgtagctgttcaggtagtcgaggatcgcctggtcgccactgacgttggcacccttggcgtagagcagggtggcacgctcgccgacggcattggccaggccctggtagacggttaccgcctggcgtggcacgccggctgccgaccaactgccgatgacgtcgcgctggctcttggccagggggccgatcacggcgatccgcccctgtttcttcagcggcagcagaccgtcgcggttcttcagcaggaccagtccttcgcgagccacctcgcgggcggcctggcggtgcaggcggctctcggcgttggtgtcgaacggcgggtcgtccggcttgcccaggcgccggtagggatcggcgaacaggccgaggtcgtacttcaccgccagcacgtcgcggcaggcgcgatcgatgtcggcctggtcgatctcgccggccgccagcagcttcggtag

SEQ ID NO: 13498 - DNA, 819 bp, Pseudomonas aeruginosa
ccaggtcgagtagagatcgtcgttcatgttcatgtcgacaccggcctggatcgccaggcgcgtggcgtcccgctcgttgccggcgaggccgtgcttgatcagttccttcaccgcgccgtggtcactgatggtcagccccttgaagccccactgctggcgcaacaggtcggtcagcagccagcggttggcggtggcgggcacgccgttgatggtgttcagcgagaccatcaccgcgccggcgccggcgtccaccgcggccttgtagggcggcaggtagtcctggaacatgcgcggcaggctcatgtccacggtgttgtagtcgcggccgccttcggccgcgccgtacagggcgaagtgcttgaccgccgccatgatgctgtccggggcggccaggttggagccctggtaggcacggaccatcacgccggacagcagcgaggtcaggtaggtgtcttcgccgaagccttccgagacccgcccccagcgcgcgtcgcgggtgatgtcgaccatcggcgagaagctcatgtcgagcccgtcggcgctggcttcgagggcggagatccgcgcgctgcgggcgaccacctcggggtcccagctggcggccaggccgaggctgatggggaagatggtgcggtggccgtgggccacgtcgtaggcatggaacagcgggatcttcaggcggctatggcggacctgatcctgcatggcgcgaatgtccgggcgggtcacggtattgaagatggcgccgaccttgccggcgcggatgtccgccatcagcgcttccttgggatggtcggcgccgacgctgaccaggcgtag

SEQ ID NO: 13499 - DNA, 366 bp, Pseudomonas aeruginosa
atgtctcgacaggaggtgcgtctcatggaaaagcccttctcggatgatgtcagcgtgaatgtcctgcgtcgcatgaaagaaggcggcttcgacttcgcgcgcatccatcccatcgacttcttcgccatctttcccagtgagcgggaggctcgccaggcagcgggccagtttcgcggcgaatccctcagggcccaggtcgtcgctcgcgacgatggctcctggaacctgcaggtcagcaaggtgatgtatgccacccatgccgccatcggtgccttcgaacacgacctggaggaagtcgtggtgccgctgggcggcgtgctggacgggtggggcgtgacccaggaggtcacttcgctgcgtccgtga

SEQ ID NO: 13500 - DNA, 891 bp, Pseudomonas aeruginosa
cggcggcgggaccccggccgcgatcccgggccggggctcctgcgtcgggctttccttcctcgaaggctttccttcagactggggaaggaggtaagccatgagcgatattctgatcctgacccatgccgagttctgtccgccaggccatctgggtgccgtgctggcggagcgcggcctggacttccgcgtgatccgcgccgacctcggcgaactcgccggtctcgacgccgaacgcccgcgagcggtggcgatcatgggtgggccgatgagcgtcaacgacgacctgccctggttgcgcgacgaactggcgctgctgcgtcgcttcatcgagcggcgcatcccgctgatcggccattgcctcggcggccagttgctggcccgcgccctgggcgcgacggtgcggcaccagccctacaccgaaatgggctggcagcccatgcagcgggaaagccgcgacagtccatggctggccgggctgccggagcgcttctcgatcttccagtggcatggcgatgccttcgacctgccgcagggcgccgagcgcctgctgtccagcccgtggtgcgagaaccaggggttttcctggggtggtcacgtactcggcctgcaaggccatccggaaatgaccgaggaactggtgcggcgctggatcgccggctggccgcacctgctcgatccctcccagcccagccagcaatccgccgaggacatgctggccgggttgcctgccaggattgccgggctgaatcgggtggccgagggtttctaccgtcattggctgtcgctgatcgattgaccttcccggccgcgggcgcccccctggcactaccgccggtccgctttatcgctcgttcgagcgagacggctgtctgcatggaagggaggggataa

SEQ ID NO: 13501 - DNA, 1839 bp, Pseudomonas aeruginosa
cccgggtggcgttgcgcgaaggctcgctggtggtcaattcgtcccagggcggcggcaccaaggacacctgggtggtggaggaataagcatgctcagccggaccgcttccgacctgtactggatgtcgcgctacctggaacgcgcggagaacctcgcccgcatgctcgacgtcagctactcgctgtcgctgttgccgcaggaccgcaacggcggcggcctggacgaactggccatgccgctgctgatcaccggcaccctcgacgcctacctggagcgccacggcgaactggccgccgagcgcctgctgagtttcttcgccctcgacccggacaacccggcgagcatctacagctgcctggccgcagcgcgcgccagtgcccatgcggtacgcgggcggatcaccctggacatgtgggagaacatcaacgccacctggctggaaatgcgcggcatcgccgccgagggcatcctgcgctatggcatcagtcgtttctgcgaatgggtgaaggaccgctcgcacctgttccgcggcgcgaccttcgccaccagcatgcgcaacgatgcgttccgcttcatccgtctcggaaccttcatcgaacgcgccgacaataccttgcgcctgctcgatgcgcgctaccagacccagggcgaagcggcgctcgccggggcggacgagggcaccgcgcgcggctactaccagtggagcgcgctgctgcgggcgctatccgccttcgagggctacaccgagctgtaccgcgcctcgcccaacgcgcgcaacatcgccgaattgctgctgttgcgcgaggacgtgccgcgttcgctgctgtcctgcatcgaggaactgagcgagatcctttccggcctgcccggcgtcaacggccggccggcgcagcgcctggccgccgagctggaggcgcgggtgcgctacaccggcatcgacgaggtgctggagcagggcctgcatacctggatcaccgactacatcctgctggttcgccagttggccaacgccattcacagctcctacctggaggccgcatgagactctcgatcacccacgacaccacctatcgctacgaagaccgggtgcgcgccagcatccagtacctgcgcctgaccccgcaggacagcgagcgccagcacgtggtcgattggcgcctggacctgccgcgcccggcgcggccgctgcgcgatccatacggcaacatcctgcacgtcctgaccctggacgaaccgcatgagtcggtcctgatcgccgcccacggcctggtcgagatcgacgaggagcgcgaggtggagcacgatcgccagtcgccgttgccgttcctgcgcagcacccgcctgaccggcgccgatgccgagatgcgcgccttcgccgaacgcgccatgggcggccgcaaggatcgcggcggcctgctcgacctgatgcatgcgctgcacgagcatatcctctaccagccgggggcgacccgcgtcgacagcaccgccatcgaggccttcggcgcacgcgccggggtctgccaggaccatgcccatgccttcctcgcctgcatccgcagccagggtgtgccggggcgctatgtctccggctacctctacaccgaggacgacacgcacctggccagccatgcctgggccgaggcctggctcggcgacggctggtacagcttcgacgtgaccaaccggctcggccgtccggagcgccatctcaagctggccgtcggcctcgactacctggatgcctgcccggtgcgcggcttgcgccgtggcggcggttgcgagcagatgcatgcgcgggtgctggtcagcgcgccgctgctgcaggtgcagcaacagtga

SEQ ID NO: 13502 - DNA, 744 bp, Pseudomonas aeruginosa
ggaagattcgagatgacctactgtgtcgcgatgcacctggccgacggcttggtgttcgcctccgattcgcggaccaacgccgggatcgaccatatcgccaccttccgcaagctgttcaccttcggcacgcccggcgagcgcctgctggtggtgcagacggccggcaacctggcgacctcgcaatcggtgatcaacctgctgcagcagcgcatccgccgggacggcgccagcctgctcaacgtgccctcggtctacgacgccacggcgctggtcgccgagaccacccgcgaggtgctggcccgcgacggcggcaatctggccggcaataccgacctgagctgttccttcctggtcggcgggcagatcgccggcggaccgccggcgctgtacagcatctatccccagggcaacttcatccaggccacgccggacacgcctttcctgcaactgggcgaaagcaagtacggcaagccgatcctcgaccgcaacctgactttcgacacgccgctggagcaggccctgcgctgcgcgctggtgtcgttcgactcgaccatccgcagcaacctctcggtgggcatgccgctggacctgctggtctaccaccgcgacagcctgatcctgccggagggctaccgggtcaccgaggacgacgcctatttcagcgccatccgccgccagtggagcgccggcctgcacgacttgctggagcgcctgccgtcgccgccctcggcgtacaacatctga

SEQ ID NO: 13503 - DNA, 2199 bp, Pseudomonas aeruginosa
gcggcggcatgggcatcgccaccatcatcgagcgcgtgtgaagggagaaccggaatgactgacgctatccgttacgaaaaaggccaggacaacgtcgtcgtcctgaccatggacatgcccgggcagagcgccaacaccatgaacggtgtctaccgcgaggcgatggcgaagaccatcgcacggctggaggcggagaaagaggggatcgccggcgtggtgctgacctcggcgaagaagaccttcttcgccggcggcgatctcaacgagctgatcaaggtcaccaaggccgacgccccggccttctaccagggcatcctcgaactcaagggccaactgcggcgcctggagaccctcggcaagccggtggtcgccgcgatcaacggcgctgcgctgggcggcggctgggagatctgcctggcctgccaccaccgcatcgccctggacaatcccggcgtgcagctcggcctgccggaggtgactctcggcctgttgccgggcggcggcgggatcgtgcgcatggtgcgcctgcttggcctggagaaagccctgccgtacctcgccgaaggcaagaaggtgcgtccggcggaagcgctcaaggccgggctgatccacgaactggccgacagccccgaggaaatgctggagaaggcccgcgcctggatcctcgccaacccggcggcgaagcagccctgggacagcgccggctacaagattcccggcggtacgcctgccagtcccaacgtggcgcagatgctggccatcgcaccgtcggtgctgcgcgacaagaccaagggttgcttcccggcgcccgagaagatcatgtgcgcggcagtggagggcgcccaggtcgatttcgacaccgcgcaactgatcgaggcgcgctatttcaccgagctgaccaccggccaggtggcgaagaacatgatcggcaccttctggttccagctcaacgagatcaacgccggcaagtcgcggccgcaggggtatccggtgcgggcgacgaaaaaggtcggcgtgctcggcgccgggatgatgggcgcgggcatcgcctacgtatcggcggcggccggcatcgaggtggtgctcaaggacgtctcgctggaagcggcggagaagggcaaggcttattcggccaggctgctggacaagaaagttgcgcgcgggcacctgtccgccgagaagcgcgacgccttcctcgcgcggatcgtgccgagcgtcagcgaagccgacttcgaaggctgcgacctgatcatcgaggcggtcttcgaggaccgcgcgctgaaaggcaaggtcaccgccgaggccgagaagcatgccctggccgatgcggtagtggcgtccaatacctcgaccctgccgatcaccggtctggcccaggcggtggcgcggccggagaagttcatcggcctgcacttcttcagcccggtggacaagatgccgctggtggagatcatccgcggcgaaaagaccagcgacgaaaccctggcgcgcggtttcgactacgtactgcagatcaagaaaacgccgatcgtggtcaacgacagccgcggcttcttcacctcgcgggtattcggcaccttcaccaacgaaggcatcgccatgctcggcgaaggcgtgagcgccgcgatgatcgacaaccaggcgcgccaggccggtatgccggtggggccgctggcgatttccgacgaagtctccctgagcctgatgacccacatccgcaaccagaccgcccgcgacctcgaggccgagggcaaggctctgccgacgcaccctgcgttcgccgtgatcgacctgatggtcaatgagtacaagcgcccgggcaaggcggccggcgccggcttctacgactacccggcgaacggtaggaaacatctctgggcggaactcaagagccgcttcgagaagcccgatgcgcaaatatccgccgaggacgtacgcgaccgcctgctgttcatccaggccatcgagactgtgcgttgcgtggaggagggggtattgcactccaccgccgacgcgaacatcggctcgatcttcggtatcggtttcgccgcctggagcgggggcgccttgcagttcatcaaccagtacggcctgaaggacttcatcgcccgcgcccaatacctggtcgaacagtacggcgagcgcttcgagccgccggcgctgttgctggagaaggcggcgaagggcgagctgttctga

SEQ ID NO: 13504 - DNA, 741 bp, Pseudomonas aeruginosa
catcaggcgcgggtcgtcgaggaccagcggtccgctcacggccaccgaaagcgctttcgtgcccttgctgaattgccatttgtaaagctctccggaagacaccttgcgccagccgatgcaacggtggccgaacaattcctccgggctacccggcctgccttgccgtcggaagtaggccggggtggcgacgatggccaagcgcaggtccgggccgacccgcacggcgcgcatgccgtgctggaggtcttcgccgaggcggatgccggcgtcgaaaccggcttcgacgatattggcgaaaccctcgtccgccaccacttccagggtgatgccgggatagtcgcgggccagttcgccgaaacgtggcgcgaggacgagaccgatggcgtttcgcggtgcgttgattcgtaccaggccgtgaggcgtttcgcgaaagcggttaaggctgtccagcgcggcggcgatgtcttcgaacgccgggtccaggtgtgccagcaggtgctcgccggcctcggtcggcgagacgttgcgagtggtgcggttgagcaggcggatgccgagctgggtttccagttcgcgcagggtgtggctgagcgtcggcggggtcacgccgagggtggcggcggcgcggcggaaactgcgttcgcgagcgatggcgacgaaggcggcgagaccggcgagatcgggctttttcattggattattaaaataactcgatcagtgaaagagatttttccaggatag

SEQ ID NO: 13505 - DNA, 1026 bp, Pseudomonas aeruginosa
acagggtggaccggggaaaccgctcttttcagagccttccgacgaggtcgtacgatgcagcatgtccgtcttggcaatagcggcctgaaagtctcccggctctgcctggggtgcatgacctatggcgatccggcgtggcgtccatgggtgctggacgaggaacgggcgcgtccgttcattcgcgaggcgctggaagccgggatcgacttcttcgacagtgccgatatctattccaccggcgagagtgagcggatcctcggacgcgcgctcagggacttcgcgcagcgcgaggacctggtaatcgccaccaaggcgttctttcccatgagcgacaggcccaacgcctgcggcttgtcgcgcaagcatctgcttgccagcgtggatgcctcgctgcggcggttgggtacggactacctggatctcttcgtgatccatcgcttcgatccggaaaccccgatcgaggaaacctgcgaaaccctcgacagcctggtgcgtgccggcaaggtccgttacctcggcgcctcgtcgatgccggcctggcgcttcatgaagatgctcgccttccagcgccaccacggcctggcgcaattcatctcgatgcagagccagtacaacctgatcgttcgcgaggacgaggaggacctcgtgccgctgtgccgggaagaggggatcgcgttgacgccctggtcgccgctggcgcgtgggctgctggccggagcgcgaagcgccggcacgctgcggacccggacggacgaacaggccccgcgctggtacggcggcagggaggaagtcgagtcgaccctcggcgcgttggagaaactcgccgctgcccgcgggcttccaccggcgcaactcgccctggcctggctgcttggccggaacggtgtcgccgcgccgatcgtcggcctgtccaggccgcatcacctcgaggatgccctcgcggcgctgacgctggacctcgccgaagaggagtgcgccacgctggaggcgccgctcacggtgcgcgcccggaccccgcgctggtag

SEQ ID NO: 13506 - DNA, 648 bp, Pseudomonas aeruginosa
ggcgcacatcgacggagaaagcatgatgagacgacaggcttccgtgttgctgctggtatccatggtatcggcgaccgtcttgccggttttcgcccgtgcgccgggcgagcgcgagccgtcctgcgccgcgacgagcatcgtcctgccagcgggggcccggtatcccaacggcatcgcccatgccgccgatggaacgctgtacgtcggtctggtcaccagcgggcgcatcctgcgcaagcctcccgggggcgagtgggaatccttcttcgccggcagcccggcgatcttcgctgccaccgcgctgcggctggacgagccgcgtggcctgctctggggcaattcgccggacttcctacccgctggccggcgccggccgcatggggtgttcgccctggatctcgcgaccggtgccgtgcgccgatatctgaccctgcccggcgacgggatgggcaacgatctcgcggtggcgccggacggaacggtctacctgagcgaaacccgggatggcagcctgatgcggctgcggcccggggaaccggcgttccaggtgttgctgcgcgacagccgcctggccggccccggcggcctgggcgcggcgggcatcgtccgggtggacgacgacaccctgctggtcggcaacttcggtag

SEQ ID NO: 13507 - DNA, 1641 bp, Pseudomonas aeruginosa
cggggcgatccatgtcgtcgaaggggtcgccacgcgtccgcggctgcgcgagatggagctgccccgaacgctggagaatccggacggcatggcgctggctccggacggctcgctgatcgtgctggagaacgccatccgcagcggcgccggcaaggtgctgcggatcgccgagccgctcgctccagggcggcgcggcatcgaagtgatacgcgagggcctggagtcgccggtcaacctgaccgtcaccggacagggttgcgcctatgtcagcgagtcccgcattcgccaccgcctgttgccggggcgcgagggcgaggtgccggcgcgtttcctgatccaccggctgcccctggacgcggccgggggccgttgatcggccgctcaggcgttggcgaaacgaccttccagataggcgatgatctcgctggattcgtacatccagcgcacctggccgttttcctcgatgcgcaggcacggcaccttgaccttcccgccgccttccagcaaagcctggcgggcctgcggatcgttcatggcgtccttgagttgcatcggcaggttcagccggtgcatggcgcggcgtgtcttcacgcagaacggacaggcgcggaactggtagagcgacaggttccgcagcgcccgctcgacctcggcctgggcctcggcgctgcgctgcagcttgcgggggcggctgacgaagtcggcgaggataatcgcctgacccagtccgttacgtactgccttgagcaacatggcgtgtgcctcgcgggaaaaccgccagtttacgtggcggttccgggcatggggagtccttccgtctcctgtgcagatttctttacggctgggcgtctcgggaatctttctgccggctgcttgttttttggcgaatcgtccggatattcctttcgaggccagggcgacggttcccttgcccgcgctcctgtgttaattaaatcaaacgaaaacgacaataaccccacttcttcagagagtctttatgtcgctccgcatctgtatcctggaaaccgatatccttcgtcccgagctgatcgagcgctacgaaggctacggccggatgttccagcaactgttcgccaagcaaccgatcgccgccgaattcgtcatctacaacgtggtggaggggcgctatccggcggacgacgagcgcttcgacgcctacctggtgaccggcagcaaggccgactccttcggtcccgacccgtggatccagaccctgaagaccttcctcctggaccgctacgagcgcggcgacaagctcctcggcgtgtgtttcggccaccagttgctggccctgctgctcggtggcaaggccgagcgcgccagccagggctggggcatgggcatccaccagtaccagttgaacgaacgggccgactggatgagcccggcgctgccggacctgaccctgttgatcagccaccaggaccaggtcacccggctgccggaaaacgcgcgggtgatcgcttccagcgacttctgtccctatgccgcctacgccatcggcgaccaggtgctgtgcttccaggggcatcccgagttcgtccacgactactcccgcgaactgctcgaactacgccagcagcacctgggcgaggaactctatcgcaagggggtcgatag

SEQ ID NO: 13508 - DNA, 561 bp, Pseudomonas aeruginosa
aagatgcagggcggcgcacgaagcgcctgtcccgaagccaagaaggaaacgctcatgattcgtgaagttgaaggtgacattctgctttccggggcccaggtgatcgcccacggcatcgcgccccaggaccatttcgacagcggcctggccctcgccttgcgcgaacgctggccgtcgatggttcgcgactaccggcatgccgcccatgccagggcgcccgagccgggcggcatctgggtctgggccggggtcgacgagcagggcaagacccagtgcatcgtcaacctgatcacccagggcatgctgcacagcggtcgcagcgccaagccgggcaaggcgagcctggaggatgtcggccatgccctgcgcgagctggcccgctatgtgcgcagcgaaggggtgagcagcctggctctgccctgcgtggcgacgggagtgggcgggctggactggtccgaggtcaagccgctggtggttcgccacctgggcgacctggagatcccggtgattctctacgaggtctatcgcaagggcgtggcggccgaggaaaagctggcctga

SEQ ID NO: 13509 - DNA, 510 bp, Pseudomonas aeruginosa
gtctggccggggaagacagcaatatgggccctatcgttagtccggccttgcatgcggtgcaggtcacccgtttcgaggatgtccgccaggcgcgctcagccgccgggacgagaacggacgaagttatccggcggcctgctgaaggccggtacgcgggggcatcctcgcgaggaaccctatcaatcaggcgcgggtcgggttacgaacccgttgaggagatccaaagtgagcgagtccctgtccatccatcatgacgtgggcggccatcagttcgagacgacggtggatggccatcgtgcctatctggcgtatatggacctgggcaagcagacgctggacatctaccggaccttcgtaccggattcgctgcggggtcgcggtatcgccgccgcgctgaccgaacacgccctgcagtacgccgaccgcatgggctacagcgtgatcccgtcctgctcctacgtggagcgttacatcgagcgtcgccagcgtcaggccgatccggccgcctga

SEQ ID NO: 13510 - DNA, 1110 bp, Pseudomonas aeruginosa
aaaacgccgggcatcagcccggcgttttcgtttccgcctcgctcagccgcgctggcgtttcggcagcacgtccttgagcttggcgtgcatgctgcggatgctcttctcggtggtcgcccagtcgatgcatgcatcggtgatggagacgccgtactgaagttggtcgagatccttcggaatcggctggctgccccagcccaggtggctttccaccatcaggccgacgatcgagttgttgccttcgacgatctggttgctgacgttgtccatcaccagcggttgcagggccgggtccttgttggagttggcgtggctgcagtcgaccatgatgttcagcgggattttcgccttgttcaggtcctgctcgcagagcgcgacgctgaccgaatcgtagttcggcttgccgttgccgccgcgcaacaccacgtgaccatagcggttgcccttggtggtgacgatggatacgccgccctgctggttgatgccgaggaagcgatgcgggctggagaccgactgcagggcattgatcgccacggtcaggctgccatcggtgccgttcttgaagccgaccgcggaagacaggccggaggccatctcgcggtgggtctgcgattcggtggtacgggcgccgatcgccgaccagctgatcaggtcctgcaggtactgcggggaaatcgggtcgagcgcttcggtggcggtgggcaagcctttctcggcgaggtcgcggagcagttggcgaccgatgtgcaggccatcctggatcttgaacgagtcgtccaggtacggatcgttgatcaggcctttccagcccaccgtggtacgcggcttctcgaagtacacgcgcatcaccaggaacagcgtatccgccacttcggccgcgagcgccttgaggcggtcggcgtattcgtgggcggccttgatgtcgtggatggagcaggggccgatcaccacgaacagacggtggtccttgccatccaggatgtcgcgcaccacctggcgaccatgggccacggtctgcagggccttgtcggtcaggggaatttcacgcttgagctgctccggcgtgatcagggtctcgttggaggcaacgttaaggtcgtcgatctgtaa

SEQ ID NO: 13511 - DNA, 588 bp, Pseudomonas aeruginosa
tgcggtgcatggcttccggcgcctggcgccggtccaggcctaccattcggcgcaggacatgccgccctgcgactggttgctggtgggcgccaagaccaccggcaatcacgaactggcacccctgatccgcgcagcggcggcgccgggagccaaggttctgctgctgcagaacggtctgggcgtggaggagcggctgcggccgctgctgccggaaagcctgcatctgctgggcggcctctgcttcatctgtgtgcatcgcggcgaaccgggcgtgatcgagcaccaggcctacggcggagtgaatctcggctatcattccggaccggccgacgagcgacgccggcgcgagatcgtcgaggagggtgccgcgctgttccgcgagtccgggctggagtccacggcgatgcccgacctggagcaggcgcgctggcagaagctggtctggaacatcccctacaacgggctgtcggtattgctgaagagcagcaccgcgccgctgatggccaacgcggacagtcggtcgctgatcgaggcgatcatggaggaagtcatcggtgctgccggcgcctgcggcttcatcctgcctga

SEQ ID NO: 13512 - DNA, 1035 bp, Pseudomonas aeruginosa
tatggttatataccttcggttcttgatcgccggtcgcgacaaccttttcgaggaatctccatgaagcttcagcaattgcgctatatctgggaggttgcgcaccacgacctcaacgtctccgccacggcgcagagcctctatacttcgcagccgggcatcagcaagcagatccgcctgctggaggacgaactgggcgtcgaggtgttcgctcgcagcggcaagcacctgacccgggtgacgccggcgggggagcggatcatccataccgccggcgagatcctgcgcaaggtcgagagcatcaagcagatcgcccaggaattctccaacgagaagaagggcacgctgtccatcgccactacccacacccaggcgcgctatgcgctgcccaacgtgatcagcggcttcatcaagcagtacccggacgtctccctgcacatgcaccagggcacgccgatgcagatcgccgaaatggccgccgacggcaccgtcgacttcgccatcgccaccgaggcgctggagttgttcggcgacctgatcatgatgccctgctaccgctggaatcgctgcgtcatcgtgccccacgggcatccgctgaccaagctgccgaaactgaccctggaagccctggccgagcagccgatcgtcacctacgtgttcggcttcaccggccgctccaagctcgacgaagccttcagccagcgcggcctggtgcccaaggtggtattcaccgcggccgatgccgacgtgatcaagacctacgtgcggttgggcctgggggtcggcatcgtggcgcacatggcggtcgatccgaagctcgacaacgacctggtgatcctcgacgccagccacctgttcgagtccagcgtgaccaagatcggcttccgccgcggcaccttcctgcgcggcttcatgtgcgacttcatcgagaaattcgctccgcacctgacccgcgagctgctggccaaggccgtgcaatgccacaacaaggccgagctggacgagttgttcgacggcatcgaactgccggtctactga

SEQ ID NO: 13513 - DNA, 588 bp, Pseudomonas aeruginosa
caacccggacatcttcaccggcctcaaccgcctggtgcagtacgcaccgcccgggctggtcctggccctgggcacgcgttcgcagccggcgctgagcctggctacctggcgggccaagggactgttgctggaaatcggcctcgaggagctgcgcctcggcttcgaggaaacccgcgaatacctcgagcgcagcggtctctatctggacgagccctgcctgaaggcgctctatggccagaccgaaggctgggtggtgggcgtgcatctcgtcagcctgtggctgcgccagcaaccgcaggtgcaggaaatggccctgctcgacggcgacaagcaggcggtcagcgcctatctgctggcggcggtcttcgaacgcttgcctggcgacctgcaggaagcgctgctggcccttggcgttgccagccaattgagcggcgacctggccaacgccctgaccgggcgccaggacggccaggcgctgctggagcgcctggagtccatgcaattgttcctcctgccgctggatcgcgaacgccagtggtatcgcttccacctgctgttcgccgacttcctccgcaaccgcctgcgtga

SEQ ID NO: 13514 - DNA, 4401 bp, Pseudomonas aeruginosa
ctccgatccggaccgtttcaagcaactgcatttcaacgccagcctgtggttcaccaaccaccacatgccgacgttcgccatcgagcatgcctgtgcggcggaagacccggagatgatcgccgcgctggtcgacggatgcggactggaactgatcaaccgcggccagctcagcctgatctaccgttggcgcaagcatgtgccggacgaaatcgccgagcgctatccgatcctggtccttaccgatgtctggtcgcgggccagcgacctcagcctgggcgaggccaaccggatcatcgacgaactgctggcgcgctggggggagagccgcggcgacgggccgatgggcgaccagtacctctccgcgctggcggtgaaggcggtggtggcgttgcagaaggacgatctggaactgtgcatcgccctggctcgccgggtcgaagtccagctcgggcagaacgctgccttcctcgaagtggcggtgttgatcaccgccgcgctggcccaggtggtccgtggccagggcgaccaggcgcggcgcctgctggggctggcgcagcagcgcaatcatttcctcgaagggcgctacctggacatgcaactggccaacgtcgaggtgatcctcgcactcgagcagggccaggtgaaacaggcgcaactgctcatcgagcggctccgccagcgcgcccggccgctgttcgagaagtccaggagcgcgctggcgctgccgaccatcaccgaggccctgaccgcctactacaggatcgagctggacgggctggaagagcgcctgggctgggcgctcgggcatgtggatgtgatcaatccgatcgatttctatgcccagggacagatctgcctggcgcgcacccagcgcctgctgggacggccgaaggaggcgctggccagcctggcggcgatgcaggccctggcctcgcgcaatcagtcgtggcgcttcttcgcccaggccatggccgaagagatcaacctgatcctccaggacagcggccccgaccgcctgaagcgcgccgagcagcggttgaagagcgtggactggaacaagatggcggcacactaccgcaacatggccttcaacccggtcaactggtcgctgggcgtgagccgcgtgcgcctgttgcaggggcgaggacatttcagcgaggcgctgcacgagatcactcagttgcgcggcaccttgcagcccggctggcacggcctgcagcgcctgcgcctggatatcctggcggcgctcagctatcagcgcctgggctaccaggaacgggccaacagcctgctcggcgaatgcctgatcaatgccgaacgggaaggggtgcgcagcctcttcatcgaggaaggcgacggcattcgccagttgctccagcaactcgaatccaccgagcgccagccggcgctacagaccttcattcgcggcctgctcggcatctggcccgggcagggcgtgcgcaagccccaggatgcgctcgaggaaggcctgacggagcgcgagcgcgaagtggtctgcctggccgcacagggcctatccaacgaagaaatcggccagcgcctgtcgctggccctggggaccgtcaaatggcatctgcacaacatctacgaaaagctcaaggtgcgcaatcgcacccaggcgatccggcgagcccgcgagctgagcctgctctgaccatgggccatcgcgacggggttcccgccagcaccatcccgctgttgcagaccaagctgttcccgccaggcgccggagggttgccgctgcttccccgccaggcgctgatcgaccgcctgtacgaggcccgcgggcgacgcgcgatggtgctcagcgcgccggccggcttcggcaagagcaccatcctctgccagttgcgcctgcgcctgctggagcagggcgcggcggtggcatggttgtcctgcgacgagaccgacagcgaaccgcagcgtctgatccagtacctgctggcgagcatccagcgagtggtcccggcattcggcggcaataccgccaatctgctcggcaccgacgtcgcggtgccgctggagggcatcctggatgccttcctcgccgacctgcgtcgcctggaaggccccttgtacctgttcctcgacgatttccaccgcatccgccacgccgccttgccgcatggggttcgctacctgatcgagaacctgcccgatcacgtgcgggtggtggcctcgacccgcttccgcccgcgcttcctggtcgacgaaccgaccctcaagccctggaccttctgcctgagcgcggaagacctgcgactttcgcgcgaggagagcgatgcgtttctcctcgacctcaaggggctggagctgggcgagcgcgagctgaagctgctgttcaagcgcaccgaaggctggatcacggcgttgcacctggcggccctggccctcagtcgcaataccgaccgggaaggtttcctccgcgggctctccgggaccgaacggaacatcgccgactacctggcggaagacgtgctggccagcctgcccgccgacctgcagctgttcctcgaccagacctcggtgctcgacgagttcaatgcggaactgtgcaatgcgctgaccgggcgtcgcgacggcctggacatgctcatgcgcctgcagaacgagcagttgttcgtcatcgccctggacgaccagcgcgaatggttccgctaccaccatctgttcgccgagttcctccaggggcggctgtcccggcatgccgatccgaccccgttgctgcatgcggcggcgcgctggtgcgaggggcgcgacctggccgaccgggcgatcaagtacgcccttcgcgcccgcgactacctgttcgccgccgagttactggagcgccagggcgcgcgcctgatcgccggtaaccgggtgtacggcatcctcggcatgctcaacggcattcccgccgaggtgatccgcgagcatccggtgttccagatcttctacgcctggcaactggcgttcgagcaacgcttcgccgaggccgaggcgttgatcgaggaggtcagccaccgcctcttgcaggggcgcggcaaggtcatgcacttcgggctcggcgagttgctcgccgccgcccaggtgctcaaggccctggtgttgctctaccaggacaagctcgaagcctgcctgaaggtcgcccgtcactggctgtccatggttccgagcaaccagccggtgttccgcgccagcctgctctgcgtgcaggcttcggcgcatgcgctgctcggcgactacgccgaggccgccggcgccatcggttccgcgcgggaggacctgaaagtcgccgacagcgagtacctgcaggtggtgaccagcctgatcgaatccctgatctgcaaggagagtggcgatctggagcggggcagggcgatcgccgagtcggcgcgcaaccgggtcgagcaggtattcggccggcgcagccgggtcggcggacccttgtcgctggcctatgccgacctgctctacgagcaggaccggcatgccggcgtgctcgccgaactaccgctggcgacggtctggcgggatgtcgcgacgccggtggaactgctcagtcgcggccagttggtcatggccaaggcgcgcttcttctccggcgccgccgagcaggggctggcgcaactcgacgaatggctgagcggtctgctctcgcccggctacgagcgtgtctatgctcacgccatgagctgcaaggtgcagttcctgctgtggctgcgccgtccgaacgaagccgaacgggtctgcctgcaactggagcggcatcttgccgggctctccggcgagcggcatgccgacgcacagaccgccctggtcctggcggaggctcggctggcattgtccgagcgtcacgcggaacgcgcgcagagcaagctggaaagctgtctggccggctactcttccgcttaccagagggatcggcggctgcgtttgtccttgttactttctgtggcgtattggcagaaaggtaacagcgaaaaagccatcggcctgttcctcgccacgctcgaggaagcctggaatctcggctaccgccggctgttccaggacgacgcgttgtggctgttgccgatgtgggaaagctggagggaagcggaacccaagcgtgccgcggcctggcaggggctggccgacctgctccgcgagcagtgccggaagctctccgtggacccggaaagtttcgatgaaaatcaggatgttagccatcgcgaacgggaaatcctgcggctggtggcggcgggcttgtcgaaccgcgatatcgcgcaggcggtgcacctgtcggaagccaccatcaagtggcacctgcacaacctgttcgccaagctgggtgtgaagagcagaacgcaagccgtactaaagggtaaaagcctgggactgctgagcgaggcgtga

SEQ ID NO: 13515 - DNA, 549 bp, Pseudomonas aeruginosa
ggaagcagtaccggacctggagaccggcgagatgccggtcgatctgccggggacaggatgcaaacggcagtgccctggggcaaaccacacctgaacactggagaaataacaatgaaaaagcacctgttccttgcaactgctgttctggctgctcccttgctggcgcatgccgacctgaaagccatggacgatggcgcgctgtccgacgtgaccggccaggcaggcatcagcatttccggtactttccagggctccgtcggggccgtgacctacaccgataccgacaccaacggcggctccctgcggctggagaacatcagcctgccggcgctgaccatcgacgataccaagccgctgaccatcgacgtcgtcaccaccgatatcggcggcaagtcgacccagcaactggccatcggcctgccggccatcaccggcgacgtgaccgttggcgccatcaaggtgggcgacaccagcgccgccagcatcggctcgctgaccgtctccgggctgaacatggccggttccaccatcaaggtctggggtcactga

SEQ ID NO: 13516 - DNA, 840 bp, Pseudomonas aeruginosa
tccaggaaccgagtcgagacgcgaagacctcgccgaggcatcggcggggtctttctccgaaagaggtacgacggggcgatgttcgagattttgctgggaagtctgatcggactgttcgggttcacccagacggtcgataccaagccgcaaccgcagggcacggtcaacctcagccagcctctgacccccaatggaccctaccgcgaatcggtgcaactggagccgatgagccagttgcagttccgcaacgtcatccgccaggcctatgactacagctgcggctcggcggcgcttaccacgctgctggactactacctcgggcgcaacctcgaggaacgccaggtcatggaaggactgctgcgctatggcgaggccgataagattgtgcagcgccgcggtttctcgctgctcgacatgaagcgctacgccgctgcgctgggctacaagagcggtggttttcgcgccgagttcagcgacctggacgctctcgagcatccggcgctggtccccatccactatgccggcttcaagcatttcgtggtggtgcgcgatgtctacaacgatcacgtcttcgtcgccgatccggccttgggcaacatcagcttcacccggacgcgcttcgaggaaatctgggaccagaacgtcctgttcgtgatcttcccgagtgggcaggagccccgcaacgcgctggcgctgaacgatcgcgacatgcgcctggtggacgaccgcaccgtcagcctgctggcgttccgcgagtttccgcagatcaacaagatcactgaaaaccaggtccgtgagctgggcactggtggcgacgtcatacacctgcgcaccaagtag

SEQ ID NO: 13517 - DNA, 1221 bp, Pseudomonas aeruginosa
cctaccgtacgaccttctgagggctggagcatgatgcgcgcatccatcgtactttgcgtcttctccctggcgctgccggcatcttcgccgggctgggcctccggcgggcgctacctgacctgggtggacgacaatggcggggtgcacaacaccttcgtcgacggccagttcgaccgccagcagcgccaggcgcggcagcgcatcggccagagcgaccaggcgcgggtgctgaacaaggcggacaacgccacgcagtggccggggaacagcagcggaggggagagcaagcgtcgctactacacctggatcgatgccaacggcaacgtgcagaacagcttctatgccggcgcccaggtcgccggccagcgcgccgactacgtcctgcccaacggcgagcactccgccgaatacatcgacgccgaggccttcgagggcaagggtttcgttcgcagcgagaacggcagtccctactacacctgggtggacgagaagggccgcatgcacaactcgcagatcccgctcgaggagcgcgcggcgcgcttcaagcgggaggccgcgccttcgtcgcagatcgccttcaccgagggccggcagatcgagttcaagcagcgtccggcggcgttgcccgggctggatggcgccggccagcagagcgatgcgctgaaggctttgctcaagggcaccgagatgaccatcgacgatctctaccaggacctgcaacggcgctgctgcgagcagatcgccgagagcgacttcaccgaactggatgccgacgaaccgcgctacgaggagttgaaccgcttctcgccgagcttcgactttcccatgggcaggagcttctacgcggcgatccggctgccgcgctcccagggggtctacggcctgcgcatccgcagtttcgccaaccgccaggtggtctacccgtcgctgctgttcctcgacgagcacaagcggccgacccggctggtcagcgacgcggtgtacaagctgaacccggaaacctggtatcgctacgctttcatcgagggtacggtgccggtgcgggccaatcgcggcgagcgctacgtgctgctgctgaccaccgacgaggaccgctcgctgcaaaccctcgacaacaagccgttcaagcgtccgctacagggcctggcggtgaacgaggcgggtatgcaggtgcatgagcacgcccggcagggcggcttcgagctggccgtggtgcgttga

SEQ ID NO: 13518 - DNA, 921 bp, Pseudomonas aeruginosa
aacgaaattccatccaggggctcgaagcgttaccggaagcgggcaagggaccttggcggtgccgagccgctggccccggagcggttatttgaagcgccgttccacgcctttttcgacgaggatctttgcggaaatctcctccaccgagaaatgcgtggagttgatgtaggcgatgttttcgcggcggaacaggctttcgacctcgcgtacctcgaattcgcactgggcgaagctggcgtagcgactgttgggcttgcgctcgttgcgaatcgcggtgaggcgatcggggtcgatggtcaggccgaacagcttgtgcttgtactgcttgagggcgttcggcagttgcaggcgctccatgtcctcttccgtcaacgggtagttggcggcgcggatgccatactgcaaggccatgtacaggcaggtgggcgtcttgccgcagcgcgagacgccgaccaggatcaggtcggccttgtcgtagtagtgggtgcgggcgccgtcgtcgttgtcgagggcgaagttcaccgcctcgatgcgatccatgtagttggagttgtggccgatggagtgggacttgccgaccgaataggacgagtcggccgaaagctcctgttccagaggcgaaagaaaggtggcgaagatatcgatcatgaaaccgttggattgcgccaggaccgcccggatgtcgcggttcacgatggtatcgaagatgatcgggcgggccccgtccgactcggcagcattattgatttgctgtaccatggcgcgcgctttttcttcggtatcgatgtacggtctcgtcagtttgacgaagctgatgttctcgaactgtgccagaaggctttggcccagggtttcggcggtgataccggtgccgtccgagatgaagaatgcggttcgtttcatttgcaccgaaagccttaa

SEQ ID NO: 13519 - DNA, 2451 bp, Pseudomonas aeruginosa
gggccaggccagaatccagcggagctgctcctggccccgcttgagcttttccaattcaatagtggagagatcaccttggtagagtacgtagtttccctcgataagctcggcgtccatgatgtagagcatgtggggggcaagaacgcatccctcggcgagatgatcagcaacctggccggtgccggcgtttccgtacccggcggatttgccaccaccgcccaggcctaccgtgacttcctcgagcagagtggcctcaacgaccgtatccacgcggccctggacgccctggacgtcgacgacgtcaacgccctggccaagaccggcgcgcagatccgccagtgggtgatggaagccgagttcccggcccgtctcgacagcgagatccgccaggccttcgccgccctggccaacggcaacgacaacctcgccgtggcagtgcgttcctccgctaccgccgaagaccttccggacgcctcgttcgccggccagcaggaaaccttcctcaatatccgcggcgtggacaatgtgatccgcgcagcaaaagaggtcttcgcctccctgttcaacgaccgcgccatcgcctaccgcgtgcaccagggcttcgatcacaagctggtcgccttgtccgccggcgtgcagcgcatggtccgctcggaaaccggcaccgccggggtgatgttcaccctggacaccgaatccggcttccgcgacgtggtcttcatcaccggtgcctacggcctgggcgagaccgtggtccagggcgcggtgaaccccgacgagttctacgtccacaagccgaccctggaagccgggcgtccggccatcctgcgccgcaacctgggtagcaaggcgatcaagatgatctacggcgacgaagccaaggccggtcgctcggtcaaggtagtggacgtcgatcgcgccgatcgcgcccgcttcgccctgagcgacgccgaggtcaccgagctggccaagcaggccatgatcatcgagaagcactatggccgcccgatggacatcgaatgggccaaggacggtgacgacggcaagctgtacatcgtccaggcacgcccggaaaccgtgaagagccgcgccagcgccacggtcatggagcgctacctgctgaaagagaaggggaccgtcctggtggaagggcgtgccatcggccagcgcatcggtgccggtcctgtcaaggtgatcaacgacgtgtcggaaatggacaaggtccaaccgggtgacgtcctggtctccgacatgaccgacccggactgggagccggtgatgaagcgcgccagcgccatcgtcaccaaccgcggcgggcgtacctgccacgcggcgatcatcgctcgcgaactgggcatcccggcggtggtcggttgcggcaacgccacccagatcctgcaggatggccagggggtgaccgtttcctgtgccgaaggcgataccggcttcatcttcgaaggcgaactcggtttcgatgtgcgcaagaactcggtcgacgccatgcccgaccttccgttcaagatcatgatgaacgtcggcaatcccgatcgcgctttcgatttcgcccagttgccgaacgaaggcgtgggcctggcccgcctcgaattcatcatcaaccgcatgatcggcgtgcaccccaaggcattgctgaacttcgccggcctgccggcggacatcaaggaaagcgtggagaagcgcatcgcgggctatcccgatccggtcggcttctacgtcgagaaactggtggagggcatcagcaccctggccgcggcgttctggccgaagaaggtcatcgtgcgcctgtccgacttcaagtccaatgagtacgccaacctgatcggcggcaagctctacgagccggaagaagagaatccgatgctcggcttccgtggtgcctcgcgctacatcagcgagtcgttccgcgactgcttcgagctggagtgccgtgcgctgaagaaggtccgcaacgaaatgggcctgaccaacgtcgagatcatggtgcccttcgtgcgcaccctgggcgaggcgagccaggtggtcgagctgctggccgggaacggcctgaagcgcggcgagaacggccttaaggtcatcatgatgtgcgaactgccgtcgaacgccctgctggccgacgagttcctcgagttcttcgatggcttctccatcggttccaacgacctgacccagctgaccctgggcctggatcgcgattccggcatcgttgcccacctgttcgacgagcgcaatccggcggtgaagaagctgctggccaacgccatcgctgcctgcaacaaggccggcaagtacatcggcatctgcggccagggtccgtcggaccacccggacctggcccgctggctgatggagcagggcatcgagagcgtctcgctgaaccccgactcggtgctggatacctggttcttccttgccgaggggcaagaccaggcctga

SEQ ID NO: 13520 - DNA, 1047 bp, Pseudomonas aeruginosa
caccgccctttttcgtgcctcctgtacaagacaagcatgcaaagcagtagtcgcctctttcctgtcgccctggtcagcgccgagttgcgcgccgaccttaccgaagacatctatcgcctgaagcccggcaacagccccgatgccagcgtcgagctggtcgtaacccggcttggacagcaggccgccggcgagcggcgcggaccgcctgtgatcctcctgcacgggagtttttccaaccgccgcttctggtactcgccgcgtgcgctcggactaggtccttacctggcgcgggcggggttcgatgtctggctgccggaaatgcgcggccatggcctgtcgattcgcaacgatggttaccgggacaaccgggtcgccgactacgcgcgctacgacctgccggcgctggcctccttcatccacgagcagtgcgggcagccggcgcactggattggccactccctcggtggggtggtgctggcggcgggactgggcgggggttacctggatcaggcgcggatcgcttccgtggcgttgttcggtagccaggtcagcaccgcgcactggctgttcaggttgcccatggcaggcatcctcgcgcgcctgctgctgcgccgcgtcgatgcgctgtccggaagccgttggcggcaggggccggaagacgagccggtcggcctggcgctggaggtcctgcgttggcatgggctgttcggccgcttcggcgagccgggcaacgactggtggaaggggctcgccgcagtcgacgtaccgctattggcggtcgccggggctggggaccggcaggacccgtcctgggcctgtcgcaagttgttcgagcagttcgcctcgtccgagcgcgaatacctgttgctcggacgcgaggctggctacgccgaggactacgggcatatcgagatgctgatcggcaaggcggcccagctagaggtctggcccttggtggagcgctggctgcgccagcgatcgccggcgggcgacgaatccgcgtggagcgaggcgctagacgtatcggaagccggaatcagcggctaa

SEQ ID NO: 13521 - DNA, 795 bp, Pseudomonas aeruginosa
tcggcatcaacaacggttcgccgcatctggcgccggtttcccgtatttccgcgaaaaacgcatcttctgctgacaaggctgagtgaacatgcaattcgatatctggacccagagcttgctgaccgcgatgaacaccctgtggggcaagctggcaggcttcatccccaacctgctcggcgccctggtggtcgttctgctcggcttcgtcatcgccaagctgctcgatgcgctgctttccaagctgctggccaagctgggcctggaccggctgatgggtggcaccggcctgaccaagctgctggcccgggtcggcatccaggttccggtctcgacgctggtcggcaagatcgtctactggttcgtactgctcgtcttcctcgtatccgccgccgagtcgctcggcctgcagcgggtatccgccacgctggacgtcctcgccctgtacctgcccaaggtgttcggcgcggccctggtgctgatcgtcggcgtgctcctggcgcaactggtgaacagcgtcgtgcgcggcgcggcggacggcgtcggcctcgaatacgcgaacggcctggggcggatcgcccagtggctggtcatcatcatcagcatctcggtggcggtggggcagctcgaggtcaagaccgacctgctcaactacatcatcgccatcgccctgatcaccgtcggcctggccgctgcgctggccctgggcctgggcagccgcgaggtcgccgggcagatcattgcaggaatctacgtccgcgagctgtatcaggtcggacaacaggtgaaagtgggtga

SEQ ID NO: 13522 - DNA, 597 bp, Pseudomonas aeruginosa
tctcacttgaataagcctcaccccctgtcacagcggtatgacccacgccagctttccgatgaagagctggtcgagcgtgcgcactcggagctgttccacgtgacgcgcgcctatgaagaattgatgcggcgttaccagcgcacgctgttcaacgtctgtgcccgctacctgggcaacgaccgcgacgcggacgacgtgtgccaggaggtgatgctgaaagttttgtacgggttgaagaactttgagggcaagtcgaagttcaaaacgtggctatatagcatcacgtacaacgagtgcatcacgcagtaccgcaaggagcgccgcaagcgccgattgatggatgcgctcagcctcgacccgctggaggaggcttccgaggagaagtcgccgaaggttgaggagcggggcggattggatcgttggctcgtccatgtcaatccgatagatcgggagattctggttcttcgcttcgtcgcggaactggagtttcaggagatagcggatatcatgcacatgggtctgagtgcgacgaaaatgcgctacaagcgggcactggaccgcctgcgcgaaaagttttcagatgcgaccgaaacatag

SEQ ID NO: 13523 - DNA, 1056 bp, Pseudomonas aeruginosa
cggatgaaactgaagaacaccttaggcgttgtcatcggctcgctggttgccgcttcggcaatgaacgcctttgcccagggccagaactcggtagagatcgaagccttcggcaagcgctacttcaccgacagcgttcgcaacatgaagaacgcggacctgtacggcggctcgatcggttacttcctgaccgacgacgtcgagctggcgctgtcctacggtgagtaccatgacgttcgtggcacctacgaaaccggcaacaagaaggtccacggcaacctgacctccctggacgccatctaccacttcggtaccccgggcgtaggtctgcgtccgtacgtgtcggctggtctggctcaccagaacatcaccaacatcaacagcgacagccaaggccgtcagcagatgaccatggccaacatcggcgctggtctgaagtactacttcaccgagaacttcttcgccaaggccagcctcgacggccagtacggtctggagaagcgtgacaacggtcaccagggcgagtggatggctggcctgggcgtcggcttcaacttcggtggttcgaaagccgctccggctccggaaccggttgccgacgtttgctccgactccgacaacgacggcgtttgcgacaacgtcgacaagtgcccggataccccggccaacgtcaccgttgacgccaacggctgcccggctgtcgccgaagtcgtacgcgtacagctggacgtgaagttcgacttcgacaagtccaaggtcaaagagaacagctacgctgacatcaagaacctggctgacttcatgaagcagtacccgtccacttccaccaccgttgaaggtcacaccgactccgtcggcaccgacgcttacaaccagaagctgtccgagcgtcgtgccaacgccgttcgtgacgtactggtcaacgagtacggtgtagaaggtggtcgcgtgaacgctgttggttacggcgagtcccgcccggttgccgacaacgccaccgctgaaggccgcgctatcaaccgtcgcgttgaagccgaagtagaagctgaagccaagtaa

SEQ ID NO: 13524 - DNA, 648 bp, Pseudomonas aeruginosa
gtcagcggtatgccgcaggcagtggcgccagccagcccggcggtgatgccgttcactatctcgctgtctatcccgtgccgggccagccattcggcttcttcgccggcgcggccgaagatgcatggatcgccgcctttcaggcgcaccacgctgcgtccctggcgggcatgccgcagcatcaggcgctggatgaagtcctgcggtgtggagcggcagccgccgcgtttgccgacccggaccagccgggcggacggacagtgctccagtatgctcgggttgaccagatcgtcgaccatcaccacatccgcgtcctgcagggcgcgaactgccttcagggtcaacagttccggatcgccgggaacccgcacccaccagccagaccttaccgctcatcgtcgttctcctcaggcattcgccgccatgggcccggggggccgccagcagtctcttgatttccggtacgcaggagccgcagccggtgccgcagccgaactcgcgcttcaatccgtccaggtccaatccgcgggcgatgccgccgagcaccgtttgctggctgacgttctggcaactgcacagggtcttgccgcccgcaccctggctgggtcgtcccggtgccgcgccgagtggggcgagcagccagcggcgtag

SEQ ID NO: 13525 - DNA, 2670 bp, Pseudomonas aeruginosa
ctcgctatcggcccggccggtaagccagagctctttcaaccagtctcgggcgagggtttcgccggcgagccggacggcgacgatgcgcccgtcttcgaggcgcacgcgcttgccgatggcgcgccgtgggtcgtcgtaggcgaggatcggcccgtcgagcaattcgagttggcgatctatccgctccagcaggtctgcgccaggtgcctcatggtgtgcggcgctgaccagcagggcggggcgctcgcgtccggcgagactgaagctggcgtggtcgaagacttcgcacagcgcacggagggcctcgaaacgcgcctggatatcggtttccaccagcgcgaacaggcgccagggcagttcgacggattcgacctgaaccccggcgtgcttgagttcgggttgtttcgacagggggtcgaacgccggcagggtcaggacattgcagcccaggcccttgaggaagcgatcgccccagtgcatcggcaggaaggcctggccggggcgcaccgagtcgtctgcactcactggcaggatcagggcgccacgccggctcttcaggcgcacgagctgcccgtcctgcagttggcggcggcgcagttcctcgggatgcaggtgcaccagggcctcctcttcatggccgaacaggcgtgcgcaggtgccggtccggctcatgccgtgccactggtcgcgcaagcgtccggtattgagggtcagcgggtagcgcgcgtcacgtttttcctgggcggcgcggtagggttcggcgaccagttgcgcgcgtcccgaggcggtagggaagcggccgtctgcatagagccgtgcggtgccttgctccgcgccagtgggaaatggccattgctgcggccccaggcggtcgagcagtgcgtagctgaggccggaaagatcgaggtcgcggccggcggtaagcagcttgtattcgtcgaacaggctgcggctgtcggcaaaggcgaacaggccgggtttagcgggacgcaggtgcccttccaggcggcgcgcgaagtcgcagacgatgttccagtcctggcgcgcttcaccggggggcggaacggcccgacggacatgactgatccgccgttccgaattggtcacggagccttccttttctccccaggatgcggctggaagcaaaaggtcggcgtattggcaggtttccgtgccggcgaaggcttcctggaccaccacgaagggacagcgggcaagggcctcgtggatcttgcgctggtccggcagcgattgcgcggggttggtacaggcgatccaaagcgccttgatccggccgtcgtggaccgcatcgaacagctcgatggcgctgagaccgggggacgtgggcaactgttccacaccccagtagtgcgccacctcggcgcgatggccgggatcggcggcttcgcggtggccgggcagcaggttggccaggctgccggtctcgcgaccgcccatggcgttcggctggccggtgagggaaaacggcccgcatccggcgcggccgatcttgccggtagccaggtgcaggttgatcagcgcgctgttcttggcgctgccggcgctggactggttgagccccatgcaccagagcgaaaggaagcgcggcgaacggccgatccattcggcgcagcgctgcaggtcggcgcggtcgatgccgcagatgtcggcgacggcggccggggtgtagtcgcgcaccagttccttcaggtcggcgaaaccctcggtatgctcggcgatgaacgaacggtcgatccagtcctcccagagcaggatatgcaggatgccgtggaacagtgcgacgtcggtgccgggcagcagcgccaggtgcaggtcggccagctcgcaggtgtcggtgcgccgcgggtcgatcaccacgatgcgcatctccggccgagcggccttggcggcttccaggcgacggaacaggaccgggtgggcgaaggccatgttgctgccggcgatcagcacgcaatcggcgcagtcgaggtcttcgtagctgcacggcggtgcgtcggcgcccaggctgcgcttgtagccgaccaccgccgaggacatgcacaggcgcgaattgctgtcgatgttgttggtgccgaccagggcccgcgccagcttgttgaaggcgtagtagtcctcggtcagcaactggccggagatatagaaggccacgctgtccggcccatgttcgcgaatggtctcggcgaaacgcccggcggcatgttccagggcactctcccagtcgctgcgagcccgcgccagttgcttgccgaggcgcagttgggggtacagcgcgcgggcctggaggtcgccggtcaggtgcaggctggcgcctttgctgcagagtctgccgaagttggccgggtgccgaggatcgccttgcacgccgaggatgcgttcgccgtcgtgttcgatcaggacgccacaacccacgccgcagtagcagcaggtcgaagcggtggtgcgcagcggggaatctgtcgacatgctcggctcctgttatcggcgagagatcaggcgcacagcgccacgctgtccaggccgagcagcacccgcccgttctccacccgcaccgggtggcgatgggcgcagccctggtccggggccacggcttcgccgctctccagttcgatctgccagttgtgcaacggacaggccactcgcttgccgtag

SEQ ID NO: 13526 - DNA, 2496 bp, Pseudomonas aeruginosa
ggggagggccgccgtgggacggcccggacaagggattcagacgttttccagttgcttgagcggaatccgttcgaactccttcttcaattgcggctgttcgatgcgctgcttccatgggtcctgctcgaaggacagggcgaattgcaggcggtcgttgagcgccttgcggttttccgcgtcctcgaccaccgccttgcggatgtgctccatgccgacccgctgcaggtaatgcaccgtgcgctccagatagaaggcttcctcgcggtagagctggaggaaggcgccgttgtattcgcgcacctcttcggcggtcttgagcttgacgaagaactccgcgacctcggtcttgatcccgccgttgccgccgatgtacatctcccagccggagtccacgccgatgatgccgacgtccttgatcccggcctcggcgcagttgcgcgggcagccggagaccgccagcttgaccttgtgcggcgaccacatgttgaacaggtcgtgttccagatcgatgcccagctgcgtcgagttctgcgtgccgaagcggcagaactcgctgccgacgcaggtcttcacggtgcggatggatttgccgtaggcatgtccggagggcatgtcgaggtctttccagatggccggcaggtcgtccttcttcacccccagcaggtcgatgcgctggccaccggtgaccttgaccatcggcacctggtacttgtcggcgacgtcggcgatgcgccgcaactcggcggcgttggtcacgccaccccacatccgcggtaccaccgagtaggtgccgtccttctggatgttggcgtgggcgcgttcgttgatcaggcgcgactgcggatcgtccttggcttctcccggccaggtcgagatcaggtagtagttcagggccggacggcaggtggcacagccgttcggggtcttccagtccatgaagcgcatggcggcgtcgagactggtcagccggtgttcgcgaatggccttgcggatctgcccgtggttgaggtcgctgcagccgcagatggccttctcgctcttcggcttgacgtcggcggcgccgccgacggtgctgatcaggatctgttccaccaatcccgcgcaggagccacaggagctggcggccttggtgtgtttcttgacttcgtcgacgctgaacaggccgtgttcttgtatggccttgacgatggtgcccttgcagacgccgttgcagccgcatacttcggccgtgtcgggcatgctcgcggcgctgttctggccctggtggccgacatcgccgagggcgttctcgccgaacatcaggtggtcgcggatctgcgcgacgttgtggttctcgcggatctgccggaagtaccagccgccgtcggcggtgtcgccgtagagacaggcgccgaccagtacatcgtccttgatcaccagcttcttgtagacgccgccgatggggtcggaaagggtgatggtttcgctgccttcgccgccgatgaagtcgccggcggagaacaggtcgataccggtcaccttgagcttggtcgaggtcaccgagccctggtagcgggcgtagccgagatgagccaggtggttggcgcagaccttggcctgctcgaacagcggcgcaaccaggccgtaggcgatgccacggtggttggcgcattcgccgaccgcatagatgcgtgggtcgtaggtctgcagggtgtcgttgaccaggatgccgcggttgcaggggatgcccgcgctttcggccagctcggtattggggcggatgccggcggccattaccaccaggtcggcgggaatcacgtcgccgtcgttgaactgcacggcacagacccggccgctgccgttgtccatcagttcctgggtctgggtgttcaggcggaagcggatgccgcgggcttccagcgcgccttgcaggagtttgccggcggtgcggtccagttggcgttccagcagccagtcggagaggtgcacgacggtcacgtccatgccgcgttgcttgaggccgttggccgcctccaggccgagcaggccgccgccgatcaccaccgcgtggctgtgggtccgggcgcagtcgatcatggcctgggtgtcggcgatgtcgcggtagccgatcacgccctgcaggcgattgccgggtatcggcaggatgaaggggagcgagccggtggccagcagcaggcggtcgtactcggcctcgctgccgtccgcggcgaccaccctgcggcggacccggtcgatctgcaccaccttgcggtcgaggaggagcttgatgccgttttccgcataccagttgaggtcgttgaggacgatttcctcgaaggtctgctcgccggccagcaccggggacagcaggatgcggttgtagttgggatggggctcggcgccgaacaccgtgatgtcgtagaagtccgagttgagcttgagcagttcttccagggtacggaccccggccatgccgttgccgaccatcaccagcttgatcttcttcatgcggagtag

SEQ ID NO: 13527 - DNA, 1227 bp, Pseudomonas aeruginosa
  unsure (177): Identity of nucleotide at the above locations are unknown.
ccagcggttctgcgccagcagcaggcggtccagggactgcacgatggcccaggtttccggagtcgcatagtaatccagggccagcgcttgcaggctgctgcgcgccgccaggccgccatcggcgcactggctgacaccgtcggcgatggccagcaggtgtcccttgctggcggccanggccggcgccggggtgaccacccgcagcgcatcctggttttccgtgcgaggcccgcaggcgctggcctcgccaatgctcagtcgcagccccacgctcagacccgcgcggcggtgaccgcggccgagcccccaggtggtgcgccagcgccgcttcaccccgtggaggccgaaccaggccagcacgccgagactggcgaacagccacaggccgagctggtagtcgccggtgctttgcttgatcgcgccgaggccggcagtcaggcagaagccgccgatgccgccggccatgccgatcagcccggtcatcacgccgatttccttgtggaagcgctgcggtaccaactggaacaccgcgccattgccggcaccgagactgagcatggcgaccacgaacaggccgagggcggccatcgcgctggacaagtggaaaccgaccgcggcgatgcagatggcggccagggtgtacaccatcagcaggctgcggatgccgccgatgcgatcggcgagggcgccaccgagcgggcgcatcaggctgccggcgaagacgcaggcggcggtgtagtagccggcggtcaccgggttcaggccgtactggtcgtggaaatagccgggcagggtgctggccaggccgaggaagccgccgaaggtgacgctgtagaagaacatgaaccaccagctgtcgcggtcgccgagggctttcaggtaatcgcccatggccttgggcgccggccgctgcggggcgttgcgcgcgaccatggcgaacaccaggagggtcaggacgagcggcagcagggcgaagccgaacacgttgttccagccgaacgcggcggccaggccgggggcgaagagggcggcgagcacggtgccggagttgcccgcgccggcgatgcccatggccttgccctggtgttgcggcgggtaccattgcgatgcgagcggcagggccacggcgaaggatgccccggcgaagccgaggaacaaccccagcagcagtgcctgctcatagctgttcacgcccagcagccaggcggccgcgagggcggccgatga

SEQ ID NO: 13528 - DNA, 1284 bp, Pseudomonas aeruginosa
agctcaggtcgaaatagagaaacgccgcgaacagggtcggcgcatggccggccttccagaagctgttgttcatcgaacacctcgtatccagcggaatcggggcggaacggccgcccggcggaagttgcatcgctacaaggtgagcgtccgacagcggaccacccacccgccccgacgctggggcgaaacgacgaagacgccacgggcctctgccgggaaggagaggccgcgcgacgtctttgtcggggatgggtaaccgccgttggctaccgtcaggcaggacgtagcaagctctttgccaagttgtcgaaagcgcggcgtagagcggttgcagggacaaccatggcgtcgggcgtgcacgccgcggtggcaggcgtcgggggcttgcacagggctggggcggcgcgtccgtgcgccgtcggcggttcagcgatgggcggtgttcaggtggtagatggtcacgcggctgccttcgccgctgtcgccggcgttgtcgttcacgtaggcgccggccttgaaatagagcaactggtcgttccaggcgctgccgagggtctggtagtaagcgtcctcttcgccgtcctggctgcgtgcgcgcaccgccaactcgccgctggaggtgacgcgcaggctgtagttgaagcgctcgcccaggcgtacctgctcgaggatcgacacgttgcggctataggaatcgtccgggtggttgcgtaccagcgcctcgacccggccgaggccttcctcgggcttgtagtagtactgcagcttcaccagaggttcgccgtcgtcggtctgtggcgacttgctgtggatctggccgatgatcaccttgttcttcgaggggaccttctcgacgctcatggtcacccgcaattcgttgtcggcctgccagtagtaccagttgtcgaggctgccgtcggcctgggtttcgcgcagttcggtgcgaggataggtgctgtcctcggtgtgcgagccgtcgatgggcacccagaagaccaggccgccatcgttgccttgctggaagtaccggctctggtagccgttgttgagttgctgggtggtgatcacctgcggggtgggttcggtgggaatggtaaggttccaggtgctgagatcgatcatgctgagcatctcctgaccgctgagtcggcggtgcggttcgggcggacgcctgcggctcctagccctgggcgtccactgcgggcctccctggtcatgctagtcgagggtggcgagggggtagctcccagaacggatagggccgttccgggcgcacgagcatag

SEQ ID NO: 13529 - DNA, 747 bp, Pseudomonas aeruginosa
cccaagggccgtcgcggcatcgcggtacagcgcggtctgctggaccctgcgggcgatgcccaggtagtccgggtcttcgcgcagcaggccccagcggcggaactgggtcatgaaccacatgccatccgagagccagggccggttgacttcgccgtcggcgtagaaacgcagcggatgtgggtcctgccaggcgttgccgaggccgtcctggtagcggccgaagaagcgcggctggatcgcgccgagcggagcgtcgacatagtcgcggccgctgatcagttgcgcggtgcccaggcggttctcggcgttctgttcgatgaagcggctggcgtcgaggaccgccatgaccagcgcgcgggcggtgttcgggtaggcgtcgacgaaggcgcgggtagtgccgaggaccttttccgggtggtccggccagatcgcctggctggtggcgatggtgaagccctggccctggtccacggccagggcgccccaggggccgccggcgcagaacccgtcgatgcgcccggcctggagatggccgaccatctgcgccggtggaaccaccacactgtgcacgtcgtgcagcgtatgcagaccgatgctcgggagcccagtagttcagccagagcgcgtgggtaccggtggggaaaggtctgccccagggtcaggcgtgcaccattctggcgccgatgccggagcagtgcctcccgcactggtcacgccagcttgcttcaggcggttcggaaagattga

SEQ ID NO: 13530 - DNA, 678 bp, Pseudomonas aeruginosa
aaccgatgtccagggcgctcttttccggtgcgtcggaaccgccggcccaggcctggctgcgtatcgctctgtctgtcatcaccacctcaagtgcgggagggcggcgcgggccgtcccgttttccagtgcgccggcgccgtcgtcggcgcgcttttccatagctgccacagcaagcgctatgccaggcggcgcggggggtttcgccgggcaagaaaaagccccgcacggggcggggcttgttcgacgcgtcgctggatcaggcctggacgaccgggatcttggcgttcgcagccgcttcgcggaactcggcgatctggtcgaagctcaggtagcggtagacgtcggcagccatgctgtcgatgtccttcgcgtaggccatgtactcctccacggtcggcagtttgccgaggatcgaggagaccgccgccagctcggccgatgccaggaacacatcggtggcatcgcccagacggttcgggaagttacgggtcgaagtggagaccacggtggaaccggtctggacgcgagcctggttgcccatgcacagcgagcagcccggcatttccatgcgcgcgccagccttgccgtagatgccgtagtagccttcctcggtcagctggtgggcgtccatcttggtcggcggagccagccacagacgggtcgggatgccgcccttga

SEQ ID NO: 13531 - DNA, 831 bp, Pseudomonas aeruginosa
atgcgcgtaccgccgtcggccacctggcgcagggactgggcgatggagcgctggaaggcgtccatgccgtcgtcgccgatccaggcttcgaagaagtcgccgaggatgtacagggcctcggcccggcgggcgcgctcatcgaggaaagacagaaacgcccgggtgatgtccgggcgttccgcttcgagatgcaggtccgagatgaacaggacgctcatcgcttcattcttcgacgatttcggccttctcgatgatcacgtcctcggccggcacgtcctggtggccgctgcgcatggtggtggccacgcccttgatcttgttgaccacgtccatgccctcgaccacttcgccgaagacggcatagccccagccctgggtggtgggggcggtatggttgaggaaatcgttgtcggcgacgttgatgaagaactgcgcgctggccgaatgcgggtccatggtacgagccatggcgatgctgccgaccttgttggtcaggccgttgttggcttcgttcttgatcggtgcgcgagtgggcttctgcttcatgcccggctcgaaaccgccgccctggatcatgaagttgttgatcacgcggtggaagacggtgttgtcgtagtggccgcttttcacgtactccttgaagttcgccgcggtttccggggctttctcttcatcgagcttcagggtgatgacgccatggttggtatgcagcttgatcatgtgggtaatccgctttgtcgtgaaaatcgaaggcctgtcagggggttgacagcttcggctatgataagcgctttgatttgcccggcctaccctggtcgggcgagagcatga

SEQ ID NO: 13532 - DNA, 669 bp, Pseudomonas aeruginosa
tccaggcgcgcctggaggcgcgggcggcgaagaactgggcggagtccgaccggattcgcgatcggctcaccgccatgggcgtcgtgctggaggatggcaagggcggcactacctggcgcctggccgactgaacccgcagcgataaatgaaaagccccgcgaacgcggggcttttcattaccggcgacctcagtcgtgcaggtgttcggcggcgtgcagggtattttccagcaggcaggcgcgggtcatcggcccgacgccgcccggcaccggggtgatccagctggcgcgttgcgctgccacttcgtattccacgtcgccgaccaggcggccgtcggcctggcggttgatgccgacgtcgatgacgatggcgccttccttgatccactcgcccttgaccagtcccggcttgccggcagcgaccaccaccaggtcggcgcgcgacacatggtcggccaggtcgcgggtgaagcggtgggtcacggtgacggtgcagccacccagcagcaactccagagccatgggccggccgacgatgttcgaggcgccgaccacgaccgcatccatgccgtacaggtcggcgccggtgctggcgagcagggtcatgatgcctttcggggtgcaggggcgcaggaggggcatgcgctgggccaggcggccgatgttgtag

SEQ ID NO: 13533 - DNA, 228 bp, Pseudomonas aeruginosa
agcgacatgtcgatgaaatggaccgagcagcgcttgcgcaaggctctcaagcagatggcgaacaatcatgaatcggctgcggtcgaggtcatgcgcgccgtcgagcgggcgaacgatccgaagctggcgcagcgcctgctcgaggtgatcgagcagatgcaccaggatgccgatgcgctgcgctccatcgacgacgaaatcgccagcggcgtgatccgttgccaatga

SEQ ID NO: 13534 - DNA, 780 bp, Pseudomonas aeruginosa
aagattgttaagcctccgctgtcaacggggtcgctcccaggtcaggcggaaggaggcgcctccttgcggcgtttccagcgcttccgcatagccgccgtgccattgcgcgacccggcggacgatcgccaggcccaggccgaagccgccggtgctgcgatcgcggctgtcgtccaggcgcgaaaagggttcgaagatcttctgccgggcgtccgccggtatcccggggccgtcgtcgttgacccgtatctgacagctgtcgccttgatcgaggagggcgatttcgacgcgcgagtgtgcgtggcgaatggcgttgcgcagcaggttgatcactgcgcgcgccatgaagcgaggctcgatgcggatctgttcgacctggcaggcgctgatctcgcaggtgactccggcggcttcggcttccagggcgacgtcggcgacgacgctatccagccagctcgcggcgtcgacgatttcccggtggctcccgacgttgccgtgctccaggcgggcgtaggtcagcagttcggagaccatttcctccagttcgccgagatcggcgcgcatgtcctctatcaggtcgtggcgtacttcggcgtcgacctgcttgttcaattgctcgagttcgaaggacaggcgggagatcggcgtgcgcaattcgtgggataccgcgttggtcagttcacgctggttgctgatcaggctttcgatgcggtcggccatctggttgaagtgctgggccagggtgcggatgtcggagcgtcggaaaatgcgcgtgcgcgatga

SEQ ID NO: 13535 - DNA, 2280 bp, Pseudomonas aeruginosa
caggtagaggcgcaggaacaggcgcagcattcagagctcccagcccagcgggttgaacaggtagcccttgccccagacggtcttgatccggaccggctcgcgcggattgtccttcagtttattgcgcagcttgctgatgcagacgtcgacgctgcggttcaggccgtcgaagccgatgccgcggatctggttgaggatctcgtcgcgggaaagtatttcccctgcctggctggccagcagccagagcagctcgaactccatcgtggtcagttcgatgccgaggccttcgagttccgcttcgcgccgccgtcggtcgatgttcagcttgccgaatgtcaggctttccggggaggcgggaaggggcgcgtgccggcgcatcagggcgcgcaggcgggcgagcagcaccggtggctcgatcggcttgatcacgtagtcgtcggcgccggactccaggccgaggatgtgatcgagatcgtcctcctgggcggtgagtatgaggatcggcaggttcgcgacccggcggatctcccggcacacctgcagaccattctgtccggggagcatgaggtcgagaaccaccacttgcggtttgaagtcgaggaaagcggcgaacgcggcatcaccgcgatgcacctggcgcacttcgaaaccatgctgggaaaggaaactggcgatcaggcgggcgagcttctggtcgtcttcgacgagcaataccttgctgagggtagggcagtccatagggtttcatcggtcggagcggaatcggctggcattatatgcgcccgcttccggcgaagctccagcgactcgttcgagatcgggctgcgatcggcggaagcggccggaaacaccccggggatccgcctgcaccctggcggggtgacttctgcttttccctctactagaatgcatgcccttgattctgggagccggaaggaccggcttacgtctgtgcaacgaggaatatccatgcaagtttctgttgaaagcacttccgctcttgagcgccgcatgaccgttggtgtgcctgccgagcgtatcgagaccgaagtcaacaagcgtctgcagcagaccgcccgtcgtgccaagattccaggtttccgccccggcaaggtgccgatgagtgtcattcgtcagcgctacgaagcttccgcgcgccaggaagccatgggcgatctgatccaggaaaccttctacgaagccgtggtcgagcagaagctgaatccggccggttcgccgtcggtagagcccaagtccttcgagaaaggcaaggacctggaatacatcgcaaccttcgaagtcttcccggaatttaccgtttccggcctggaagacatcaaggtcgagcgcctgcaggccgaagtttccgatgctgatgtcgacaacatgctcgatgtcctgcgcaagcagaacacccgtttcgaagtggtcgagcgtgccgcccagaacgatgaccagttgaacatcgacttcgtcggcaagatcgacggcgaagccttcgccggcggttccgccaagggcaccctgctggtactgggctccggtcgcatgatcgccggcttcgaagaagggctggtgggggcgaaggccggtgaagagcgtgtgctcaacctgaccttccccgaggactaccagaacctggacctggccaacaaggctgccgagttcaccgttaccgtcaatagcgtagccgagcccaagctgccggaactgaacgaagagttcttcgctctgttcggcgtgaaggaaaccggtctcgatggcttccgcgccgaagtgcagaagaacatggagcgcgagctgcgccaggcgatcaagtccaaggtcaagaaccaggtcatggaaggtctgctgcaggccaacccgatcgaagtgcccaaggccctgatcggcaacgaagtgaaccgtctgcgcgtgcaggccgtccagcagttcggcggcaacatcaagcctgaccaactgccggccgagctgttcgaagagcaggccaagcgccgtgtggtgctgggcctgatcgtcgccgaagtggtcaagcagcacgagctgaaggccgacgaaggtcgcgttcgcgaaatgatcgaggaaatggcctcggcctaccaggagcccgagcaggtcgtcgcctggtacttcaagaacgagccccagctgaacgaagtccgttctgttgtactggaagaacaagtcgtagatactgtcctgcaaaaggccactgtgaccgataagcaggtatcctacgaagaagcggtcaagccggccgaagctccgcaagcggcctga

SEQ ID NO: 13536 - DNA, 651 bp, Pseudomonas aeruginosa
tcgcaagacatgtctcgcaactcttttattccgcacgttcccgatatccaggccgccggtggcctggtgcccatggtggtggagcagtccgcccgcggcgagcgcgcctacgacatctattcgcgcctgctgaaggagcggatcatcttcctggtcggccaggtcgaggactacatggccaacctggtggttgcccagttgctgttcctggaggctgaaaatcccgagaaggacattcatctctacatcaactcgccgggtggttcggtgactgccgggatgtccatctacgacaccatgcagttcatcaagcccaacgtctcgaccacctgtatcggtcaggcgtgcagcatgggtgccctgctgcttgcgggcggtgccgccggcaagcgctactgcctgccgcattcgcggatgatgatccaccagccgctgggcggtttccagggccaggcctcggatatcgagatccatgccaaggaaattctcttcatcaaggagcgtctgaaccagatcctggcgcaccacaccggccagcccctggacgtcattgcccgcgataccgatcgtgaccgcttcatgagcggtgacgaagctgtcaagtatggcctgatcgacaaggtcatgacccagcgcgacctggccgtctaa

SEQ ID NO: 13537 - DNA, 498 bp, Pseudomonas aeruginosa
cgggtctgcggatcgagcccgacctccaccagcgcgtcgatgatcgcctgctcctgttcggcctcgctgccgatcctatggatgcgcaggccttcgccgacgatctcgccgacacacatgcgtgggctgaggctgccatatgggtcctggaacaccacctgcatctcgcggcgcagcgggcgcacgtcatgttgcgcgagaccgtccagccgggtgccttcgaagcggatgccgccctggctttccagcagccgcaggattgccaggccaagggtcgacttgcccgagccgctttcgccaacgatgcccagcgtctgcccgcggggtagttcgaaattgaccccgtcgaccgccttgacgtggtccacggtgcggcggaacacgcctttgcggatcgggaaccagacccgcaggtcgtccaccgccaacagggtttcaccgggcgggttgctcgccggcgcaccgctgggctcggcgttgagcagctcgcgggtatag

SEQ ID NO: 13538 - DNA, 1263 bp, Pseudomonas aeruginosa
ggcagcaggcgcaggatcgagtgggcggtcaccgacttgcccgagccgctttcgccgaccagggccagggtctcgccctggcggatgtcgaagctgacgccttcgaccacccgctggcgttgctcgccggagaggaattcgacggcgaggtcgcggatttccagaatgttctcgctcatctcatttcctcgggtcgaaagcgtcgcgggcggcttcgccgatgaacaccagcaggctcagcatgaccgccagcaccacgaaggcggaaatgcccagccagggtgcctggaggttggacttgccctgggcgaccaactcgcccagcgacggcgcgccgggcggcaggccgaagccgaggaagtccagggaggtgagggtgccgatggcgccggtgaggatgaacggcatgaaggtcagggtcgagatcatcgcgttcggcaggatgtgacggaacatgatggcgctgttgcgcatgccgagggcccgggcggcgcggacgtattccaggttgcgcccgcggaggaactcggcgcggaccacgtccaccaggctcatccaggaaaacagcagcatgatgcccagcagccaccagaagttcggctggacgaagctggccaggatgatcagcaggtagagcaccggcagccccgaccagacttccaggaaacgctggccgagcaggtcgacccagccgccgtagtagccttgcagggcgccgacggtgacgccgatcagagaactgagcacggtcagggtcagggcgaagaggatcgacacgcggaagccgtagatcacccgggcgagcacgtcgcgggcctggtcgtcggtgcccagccagttttccgccgacggcggggcgggggcgggaaccttcagctcgtagttgatggtgtcgtagctgtaggggatcggcggccaaagcacccagccgtccttctcggcgatcagttggctgatgtaggggctcttgtagttggcttccagggggaattcgccgccgaaggtggtttccgggtagcgtttgaagaccgggaagtaccagccgccgtcgtaatgcacgaccagcggtttgtcgttggcgatcagttcggcgccgaggctgccgacgaacaggatgaggaacagccagagcgaccaccagccacgcttgttgctcttgaagcgggcccagcggcgctggttgatgggagacaggcgcatcggattactcccggttctcgaagtcgatgcgcggatcgaccagggtgtagacgatatcgctga

SEQ ID NO: 13539 - DNA, 1047 bp, Pseudomonas aeruginosa
cgcgcgctccttgaacacggcgcgacgggtgttcatgaacaacgcctgggtctggctggggatctggtgcgggatttccgtgcggatcacatcgccgcgcagaaccgcggggaagcgatagttgttcagccagttcttcgcctggtgctcgatgtagaagtcgaactcgccggccttgaaggcttcgaaggcgacgccgttgtcccggtagaagtccaccacgacccggtcgaaattgtatttgccgcggttcaccggcagtttttcgccccaccagcccttcacgcgttcgaacaccaggcggcgcccgggatcgacctcgacgatgcgatagggaccgctgcccagcggcgcggtgaaggtggtggcgcggaagtcgcgatccttccagtaatgctgcggcagcaccggaagctcgcccaggcgcaggatcagcagcgggttgccggagcgccgcaggacgaaacgcacccggtggggggtgaggatatcgacccgcttcacctcctgcaggtaggtgcggtacatcgggtgcccctgcttgaccagggtgcgataggaaaaggccacgtcgctggcggtgatcggcctgccgtcgtggaagcgcgcttccggccgcaggttgaataccacccagctgcggttttccgcgtattccacgctcttcgcgatcaggccatagctggaggctggttcgtcgccggacgggtcgtacaggccggtgcccaccatcaatggttcgttcagctcgttgactccgtactggaggaaatcgccggtgccgatcgggctggtgcctttcagggtgtaggggttgagcgtgtcgaagctgcccgaggccatcaggcgcaaggtgccgcctttgggggcgtcgggattggtccagtcgaagtgctggaaattggccggatacttgagcgtgccgaattgggcataaccatggctctgggtaatcgcggcgaagctgggcaggctcacggccaggccgaggatcaggaaggagaggcgacgcatcaggcgtgtgtccgggtccttggctatttttga

SEQ ID NO: 13540 - DNA, 2298 bp, Pseudomonas aeruginosa
gccgaccggcggggttcgcccgcctgctgctcgggatcaacaatgtataaagacctcaaatttcccgtcctcatcgtccatcgcgacatcaaggccgacaccgttgccggcgaacgcgtgcggggcatcgcccacgaactggagcaggacggcttcagcattctctccaccgccagctccgccgaggggcgcatcgtcgcttccacccaccacggcctggcctgcattctggtcgccgccgaaggtgccggggaaaaccagcgcctgctgcaggatgtggtcgaactgatccgcgtggcccgcgtgcgggcgccgcaattgccgatcttcgccctcggcgagcaggtgaccatcgagaacgcgccggccgagtccatggccgacctgcaccagttgcgcggcatcctctacctgttcgaagacaccgtgccgttcctcgcccgccaggtcgcccgggcggcgcgcaactacctggccgggctgctgccgccattcttccgtgcgctggtcgagcacaccgcgcagtccaactattcctggcatacgccgggccacggcggcggtgtcgcctatcgcaagagtccggtgggacaggcgttccaccagttcttcggggagaacacgctgcgttccgacctgtcggtctcggtccccgagctgggatcgctgctcgaccataccggccccctggccgaggccgaggaccgtgccgcgcgcaatttcggcgccgaccataccttcttcgtgatcaatggcacttccaccgcgaacaagatcgtctggcactccatggtcggtcgcgaagacctggtgctggtggaccgcaactgccacaagtcgatcctccactcgatcatcatgaccggggcgataccgctctacctgactccggaacgcaacgaactggggatcatcgggccgatccctctgagcgaattcagcaaggagtcgatcgccgcgaagatcgccgccagcccgctggcgcgcggccgcgagccgaaggtgaagctggcggtggtgaccaactccacctacgacggcctgtgctacaacgccgagctgatcaagcagaccctcggcgacagcgtcgaggtgttgcacttcgacgaggcttggtacgcctatgccgcgttccacgagttctacgacggacgctatggcatgggcacctcgcgcagcgaggagggacccctggtgttcgccacccactccacgcacaagatgctcgccgccttcagccaggcctcgatgatccacgtgcaggatggcgggacccggaagctggacgtggcgcgcttcaacgaagccttcatgatgcacatctcgacctcgccgcagtacggcatcatcgcttcgctggacgtggcttcggcgatgatggaagggcccgccgggcgttcgctgatccaggagaccttcgacgaggccctcagcttccgccgggccctggccaacgtacggcagaacctggaccggaacgactggtggttcggcgtctggcagccggagcaggtggagggcaccgatcaggtcggcacccatgattgggtgctggagccgagcgccgactggcacggcttcggcgatatcgccgaagactacgtgctgctcgatccgatcaaggtcaccctgaccaccccgggcttgagcgccggcggcaagctcagcgagcaggggattccggctgccatcgtcagccgcttcctctgggagcgcgggctggtggtggagaaaaccggtctctactccttcctggtgctgttctcgatgggcatcaccaagggcaagtggagcaccctggtcaccgaactgctcgaattcaagcgctgttacgacgccaacctgccggtgctcgacgtcttgccctccgtggcccaggccggcggcaagcgctacaacggagtgggcctgcgcgacctcagcgacgccatgcacgccagttaccgcgacaacgccacggcgaaggccatgaagcgcatgtacacggtgctgccggaggtcgcgatgcggccgtccgaggcctacgacaagctggtgcgcggcgaggtcgaggcggtaccgatcgctcggttggaagggcgcatcgcggccgtcatgctggtaccctatccgccgggtatcccgctgatcatgccgggtgagcgcttcaccgaggcgacccgctcgatcctcgactatctcgagttcgcgcggaccttcgagcgcgccttccctggtttcgactccgatgtgcacggcctgcagcatcaggacggaccgtccgggcgctgctataccgttgaatgcataaaagaatga

SEQ ID NO: 13541 - DNA, 1053 bp, Pseudomonas aeruginosa
cgccatccagaccatgcggccgtacgacaggcgcaccagcggggcgatggaggaggtcagcaggaagaggaacgccgcctggccgttgggcgtcgctacgctgggcaggttggtgccggtattgatcgccaccgccagggtatcgaaatgctcgcggctcatgtggccggcatccagcgcctgtttcacctcggtgatgtagatggtggcgacgaatacgttgtcgctgatcgccgagagcaggccgttggcgatgaacagcatgcccggctggcgttccgtcggcagcgccagcaccgcctggatgatcggggtgaacaggtgctgctggtggatcaccgcgaccaccgcgaagaacaccaccagcagcgcagtgaacggcagggcctcctggaaggcgcggccgatctggtgttcgtcggtgacgccggtgaaggcagtgatcagcacgatcaccaacaggccgatcaggccgacctcggcgacatgcagggccagcccgacgatcagtaccagcgccgccagggcctgcaccagcagcgcggccttctgctgcgctccgcgtttgcggctttcgctggcggcgtactcggcgagcacctggcgcaccgccgccggcaactgggcgccatagccgaagcggcggctcttctccagcagcacgcaggtcagcaggccggccgccagtaccggcatggataccggcgcgacctggcggaagaactcgacgaaatgccagccggcctcgtggccgatcagcaggttctgcggctctcccaccagggtgcagacgccgcccagcgcggtgccgaccgccgcgtgcatgagcaggctgcggaggaaggcgcggaattcctcgagatgggcccggtgcagctcggggacctggcggtcggtggcgggatcgtagtcctcgctggcgcgctgccccgaagcgacccggtgatacacggcgaagaatgccaccgccacgctgatcaccacggcggtcacggtgagggcgtcgaggaaggccgagaggagggcggccagcaggcagaacaggagcgatag

SEQ ID NO: 13542 - DNA, 840 bp, Pseudomonas aeruginosa
cagcgcagttgctctgccgaggactatcgccgtgaccgagtacaacgcattccgtgtggagctggcagacaagatcgcccacgtccagatcaaccgtccggacaagatcaatgccatgaaccaggacttctggcgcgagatcatcgagatcttccgctgggtcgacgataccgacgaagtgcgggtggtcgtgctgtccggggcgggcaagcatttttcctcggggatcgacctgatgctgctggcccaggtcggcagccaactgggcaaggacgtcggccgcaacgccgacgccctgcgtcgcaagattctcgagctgcaggcctcgttcaacgcggtcgacaactgccgcaagccggtgctcgcggcgatccagggctactgcctgggcggcgccatcgacctggtctcggcctgcgacatgcgctactcgaccgccgacgcgcagttctcgatcaaggagatcgacatcggcatggccgccgacgtcggcaccctgcagcgcctgccgcggatcatcggcgatggcatgatgcgcgagctggcctacaccgggcgcatggtcgacggcgaagaggcacggagcatcggcctggtcaatcgtacctacgcggaccaggccgcattgatggatggggtcttcgaactggcgcggcagatcgccgcgaagtcgccgatcgccatccgtggtaccaaggaaatgatccgctatatgcgcgaccaccgggtcgacgacggcctcgagtacgtcgctacctggaacgccgccatgctccagtccgccgacctgcgggtggcgatggccgcgcatatggccaagcagaagccggaattcgctga

SEQ ID NO: 13543 - DNA, 939 bp, Pseudomonas aeruginosa
gcagttcattgccgagcggcagaacggcagcctgctgcagcacgccgtcgaatgcctgcaacagatccgcggcaccctcaacctgatcgagctggccggcgccgagctgctggcccaggaagccctgcagctggcgaccgacattcccaccggcgtcagcgaggagcgcgacggccagctggcagccctgggcaacgccctgtacgtgctgcgccgctacctggagaacgtcgaggccaatcgccaggagatccccgagctgctcttgccggcgatcaacgaagtgcgctgtgccgcagggcagccggcgctgccggaaagcttcttcttcagcgcccgcctggatatcccgcggccgccgagcactgccatcgaccacctgccttccgaagccgaactgggcgaggaaagccggcggatgcgccacatgtaccagatcggcctgctcggcctgatccgcgaacagaacctctatcccagcctcaagctgatgggccgcgcgctggcgcgcctcgacagcctgcacggcggggtggcccgttcgcggctgtgctggatcggcgccgcggcgatcgagtcgatcgtcgatggccaactgttgccgcgcaagtcgcgcaagcaactgttctcgcgcatcgaccgcgagctcaagcaattgctgatcggcccggcctacgaggcgccgcgccatctgctcaaggaactgctttacctggtggcgctgtccgacggccagggcccgcgttcgcgcgaggtccgcgaactgcatgggctggcgccgctgccgttcaccgaccacctgctggaagaggaatcgcagcgcctgtccggccccggccagtcggtgatgcgttcgctgtccacggcgatccgcgaggaactcgccggggtcaaggacatgctcgacctgatcgagcgcggcgtggcccagccggatag

SEQ ID NO: 13544 - DNA, 1506 bp, Pseudomonas aeruginosa
cctgaccaacctgcatgcgcaactgggcaagctgagcaagaccctcggcatggtcggcctgaactcggccggcaccgccctgcagacccagctacccaccgtggccgcctgggctgccagcggcgtcgccgattcgccgccggcgttgctgcgcctggccgatgcggtgctctacgtggaaagcatggtcggcaacctcgaacgcggcgagcgccgcatcatccggccgactccggcggagcccgggcaggaagccgatgcgttcgccgtgcaccagttggccgaggcgcgcatcgtggtgatcgaggaggccaaggccggcctggccctggccaagcgtgcgatcaccgcgtacctggaatccaatggcgacaagctcaacctggccaacgtcccggccagcctgcaggcggtccggggcggtctctggttcctcggtcaggagcgcgccgcgctgctggtcggcggctgcgccgactacatccagcagcgcatgatcgagaccgcgcagatgccttcggagcagatgctggaaaccctcgccgacgccctgaccagtctcgaatactatctcgagggcggtgccgtgctgcgtccgcagggccagccggacgtcctcgacctggccagcgccagcgtcaaggcgctcggactgccggtggccgcctgatggccggcgagttccgctggcaggcaggtcggccggctaccgcccaggtcggcggctgggtgctcgcgcactgtcagcagcgcttcctccaggacgacaacggcctgctgttcccccgcgaatggctgaagcgccaggaactcccgctgctcgccgaacatggggtcggccattggcagggcgagccggtctacgtgctggaactggacgagccgatcgagctgccgggcatggcctgggcgccgttgcggcagttcatgctgcacggcgatttcgatcagttctgcatgctcggctatgccagccagatcggcatctgggcacgtcacaaccggttctgcggcaattgcggcacacgcatgcagacgcaggaccacgagcgggtgatgcagtgtccgcagtgcgggctgcaccagtacccgcgcctgtcgccgagcatgatcgtcctggtgacccggggcgacgaggtgttgctggcgcgttcgccgcgcttcgtgccgggggtatacagtaccctggccggcttcgtcgaggccggcgagtcggtggagcagtgcgtggtccgcgaggtgcgcgaagaggtcggggtggaggtcgccaatctcgaatacatcggcagccagaactggccgttcccgcattcgctgatgctcggtttccacgccgagtacgtgtccggcgagatcgtcccgcaggaggacgagatcgaggacgcccagtggttctccctcgatgccttgccgccgctaccggcgcagcgctcgatcgcccggcacctgatcgacctgtacctggcgcgccgctcaggcgccgctgaaccagtgctgccaggctag

SEQ ID NO: 13545 - DNA, 1656 bp, Pseudomonas aeruginosa
ccgcgcggtcagcgccaggaccaccaggatgaacaccgggcgaatgaacttcgccccgccgccgatggcggtgcgcgcgccgaaataggcgccgaccatcagcgacgcacccatgcacaggccgagcaaccagatcacctggccggaggcgacgaacaccgccagcgccactatgttgctgacgaagttcatgctccgcgccacaccgctggcgcggaccaggtccagcgggtacatgagcagcgagctgacggtccagaacgctccggtgcccggtcccgccacgccgtcgtaaaagcccagggcgaggccctgcggccactggcgcttgcgtccgagcggcgcatcggcgtccagcggcgccttcggcgtgccgccgaagagcatgtagaggccgcaggtgaataccaccaccgggagcatccggttcagccactcggcgggcagcaggtgagccgcccaggcgcctatggcggcgccgatcgcggtggcgagcaaaccgttgcgccacttcccgggatggaacagcttgcgccggtagaaggtgtagctggcggtcgccgcaccgaaggtcgagctcagcttgttggtacccagcgccaggtgcggcgggaccccggcggtgagcagcgcagggatggtcaacaggccgccgccgccggcgatggcgtcgatgaagccggcgagaaaggccaccacggccaggatgatcagggtgctggggtctatcgcgagttcgaagggcatgaaaaaccggacctgcttccaatcgggaaacggcctcgctggccgtcgggaggaggggtgcgcataatgcccgcaatttcacgcagaaggaatcgcttgcatgcagtacgacggtctggcctgggcattcgcgttactggccttgctggccgccctggtcgcggtgcgcatcctcttcgaacgcacctggttcctcggctggctgcgcggcacctgcggcttggccttcgtcgccgtggcggcgctgctgctggtgctcgcctgggacctgcgcagctattcgctgctcaagcccgagcagccgatggccaccctgagcttccaggccgaagggccgcagcgctaccgggtgctgatccaggagggcgccaacgagcgcagcgtggtgctggacggcgaactctggcaactggacgcgcggattttccgctggaaggggctggccgcgttgatcggtctggcgccgggctatcgcctcgacgcgctcagcggccgcttcctggccctcgagcagcagtcccggggccgccgcctgggcttgtcgcagagtccgctgggggtcgatctctggcgctggctgcgggccggcgagcacgacctgttcctgttcgagccgctggcggggcgggtgactttcctgccgatggcggacaaggcggtgttcgcggtgaactacggcgtcgccgggctgcttgccgagccgatgaacctggcggccgaggaggcgctcagggactggcgctaggccatgcgaaaagccggggcggcggcgatcgcctgggcggtttcgcgaaagcgttcgatgagttccgacggcgtgcggtaggccagcgccagccgatagggaattcgcgcccgccgcccttgcaggggacgaaaggtgacccccggcgggcgcaacggttgtag

SEQ ID NO: 13546 - DNA, 1995 bp, Pseudomonas aeruginosa
aatgaaaagagggagccctggctccctcttcgcgcgttcgccgttccgtcaggaaaggaagccgccgtcgacgttcagcgccacgccggtggtgtagctggacgcttcgctagccaggtagagcacggcgcctgccatttcgctcggctcggccacgcgcttgagcgggatgcgctgcagggcgaggttgcggatcgcgtcgttcttcaccagcgccgaagcgaacttggtgtcggtcaaccctggcaggagggcgttgcagcggatgccgaactgcgcgcattccttggcgaagaccttggtcatgctgatcacggcggccttggtcaccgagtagatgccctggaactcgccgggcgatacgccattgatcgaggccacgttgatgatgctgccgccgccgtgttccttcatcagcttgccgccctcgatggacatgaagtagtagccgcggatgttgacgtcgacggtcttctggaaggcgccgaggtcggtttccagtacgttgcagaactgcgggttggtggcggcgttgttgaccaggatgtcgaggcggccgaactgctcgcggatctgtgcgaagacgttctggatctgctccatctcgccgatgtggcaggcgatcgcggtggccttgccgccctccgcggtgatcgcgtcggcgaccgcctggcagccatcgatcttgcggctcgagacgatcacgtgggcgccttgctgggccagcagcttggctatcgcctcgccgatgccgcggctggcgccggaaacgaaggcgatcttgccgtcgaggtcgaacaggtgggtcttggacatgggctatccccttgtagtggtcggttacaggcgggagcgctcgatggcctgcaggctcatctgctccagcagcttgttcatctgcacgaactgggcgaaacgcttgtcctgggtctgcccgtggtagtagcggtagtagatctgctggacgatgccggcaagacggaacaggccataggtgtagtagaagtccaggttgtcgatcggtgggatcccggcccgctcggcgtagtagtcggcgaactctcggcgggtcagcatgcccggcaggtggctgggctggcggcgggtcagctgcaccggagccgggtcgccggcttccacccagtaggcgagggtattgccgaggtccatcagcggatcgccgagggtggccagttcccagtccagcacgccgatgatctgcatcgggttttccgggtcgaggatcacgttgtcgaagcggtagtcgttgtgcacgatgcccggcttgtggtgatcggccggctgcttgtccttgagccaggccttgaccggttcccagagcggcgcgtcgggggtcagggccttctcgtagcggtcggtccagccggcgatctggcgctgcacgtagccgtccgggcggcccaggtcggccagtccgcaggcggcgtagtcgacgttgtgcagttcgacgaacttgtcgatgaagctcttgcacaggctgcgggtctgttgttcgtcgagattcagctcaggcggcagttcggcgcgcaggatgatgcccttgacccgttccatgacgtagaactcggcgccgatcaccgactcgtcggtgcagtagaggtaggctttcgggcagtaggggaagcctgcgttcaactggttcaggatgcggtattcgcggcccatgtcgtgggccgacttggccttgtggccgaatggcgggcgacgcaggacgaactcctggcgcggatactcgatcaggtaggtcaggttggacgcgccaccggggaactggctgatcttcggggtgccttcgaggccggggatatgggctttcaggtacgggtcgatgacggcggcgtcgagttcttcgccggcgcggatgcgagtggattggtcggtcagcgacatggggttcccttctcgtggtgccacggcggagccgcgggagccggtgcgcgcatcaggctgcgcaatgatggtgaccggcgataa

SEQ ID NO: 13547 - DNA, 615 bp, Pseudomonas aeruginosa
tcagcgtttcgacgattatcgacaaggaccgacatgggccgttcttcccgcaaagacgagattctccaggccgccctggcctgcttcagcgagcatggcgtagacgccaccaccatcgagatgatccgcgaccgttccggagcgagcatcggtagcctctaccaccatttcggcaacaaggaacgcatccatggcgaactgtacctggccgggatcggccagtacgcggcgttgctcgaagccggcttcgccagggcgcgcagcgccgaggaaacggtcaggttgctggtcaccagctacatcgactgggtcgtggcgaatcccgactgggcacgcttcatcctgcacagccgcgggcgggtggaggcgggggagctgggcgagcgcctgcgggccgacaaccaggcgcacttcgcacggatccatgcggcgctggcgggatatcgggccgagggcctgttccgcgagatgccggacgactgctttgcttcggtggtgatcggcccggcccacgatcttgcccgccagtggctggccgggcgaacccgggtggcgttggccgactgtcgcgaactgctggcgcaggtggcctgggacagcgtgcgggcggcctga

SEQ ID NO: 13548 - DNA, 738 bp, Pseudomonas aeruginosa
gcctcgccggcttccaccagttcttccgggctcagcggcggcgccttgggcaacagttgccggcgcagttcggcgcgggtgctgtgcagggacagggcgagggcgggcttcacccgttgccggggcaggcgctcgaacacgcgggggtcgccgacggtggagaacaccaggttcttgtggccgatgccgccatcggtgccgagcaggtcgatggcttcgaggacgttgtcgaggttgtgcgccggctcgcccatgcccatgaacaccactttcttcaccgctcgccggcgccgcgccaggaccacctgggcgaccatctccaggctgccgacctggcgcagcaggccgctgcggccggtcatgcagaacacgcagccgaccgcgcagccgacctgggtcgagacgcacagcccaccgcgcggcagcagcacgctttccaccatctgccggtcggccagttccaccagcaggcgcgacgagccgtcgctcgccggatgctcgctgtgcaggcgggcgatgccttccagttccgctgctacctggggcagaccatggcgtacgcccagcggcaggaagtcctcggcccgctggcgggcggtgcaggcatcgagggcgcggccctgcagccaggcgcggacgatcctcccgcaatgcaggggcttggcgccgagatcggcgaggcgctggtggaggtcttggctacgcatggggcgcgcatcctaccattgcccgtcatga

SEQ ID NO: 13549 - DNA, 369 bp, Pseudomonas aeruginosa
ggcggtatggccggcgccgacgtgctatcgttgcgctccgctccaccgcagcaacggaaccgttccatgaaattcgtccaccagcgcgaacacctcaacgaagacgacatcgtggtcatcgagtgctcgcagcaatgcaatatccgcctgatgaacgacgccaatttccgcagtttcaagaatggcgggcggcatagctaccatggcggcgccttcgaccgcttcccggcgaagatcaaggtgcccagcaccgggttctggaacatcaccatcgataccgtgacccggcgcccgatcagcgtgacgcgcaagccgaacttcaagtggacgatcaagttcgtgcgccgttccggttcgcagttcacctga

SEQ ID NO: 13550 - DNA, 2319 bp, Pseudomonas aeruginosa
aatcgcccgtcgccgagtgaggagtggttcatgttgccaagaccgttggttgggttggccttcgttttgtcgtcttttatccagtctgtttccgctgctgaaatttcctatagccgtgacgtccagccgatctttaccgccaagtgcgtcgcctgccacgcctgctacgattcgccctgccagctcaacctgagcagcgccgagggcgcgcagcgcggcgccaaccaactgccggtctacgacggcacgcggaccaaggcgcaggaaaccacccgcctgtacctcgatgcgcacggtgccgacgcctggcggcgcaaggacttctggtcggtgctcgaatcgcaggatggccaggccgcactgatggcgcggatgctcgagcttggccacagccagccgttgcagccgaatgcgaagatccccgaaggcctggacatttcgatcaaccgcgccaaccagtgcccgacgccggccagcatcgatgcgttcatccgcaagaacccaggttccggcatgcctttcgcggtggccgggctgagcgacgacgaatacgccaccttgcagaagtggctggccgcgggcgccccggtcgaccagcagccgttgcggccgaccgccgccgaggcgcgccaggtggccagctgggagcgtttcctcaaccagcctggggccaagcagagcctggtctcgcgctggctctacgagcacctgttcctggcgcacctgtatttcccggagcagggcgcgcccggccacttcttccagctggtgcgttcgcgcacgcccagcggccagccgatcgacccgatcccgacccggcgtcccaacgacgatccgggcaacagcttctattaccgcctctggccgatccagggcgtgatcgtacacaagacgcacatcacctatccgctgacggcgaagaagctggaacgcgtccaggagctgttcttcggcacccagtggaacaccgacaaggttcccggctacggcgtgcagagccgcgccaacccgttcgccaccttcgccgcgatcccgccacgggcgcgctaccagttcatgctggataacgccgaatacttcacccgtaccttcatccgcgggccggtgtgccgtggacagatcgccaccgacgtgatccgcgacaacttctgggtggtattccaggaccccgagcaggacctgttcgtcaccgacgccaacttccgcgcgcagagcgagccgctgctggccttgccggggcagatcgacgagctgaagaacctgctcggcctgtggagcgcctaccgggacaagcgcaacgagtacgaagacctgcgccaggacgtctacgccgacgcgccgccgccgacctggaacacgctctggcacggcaacgacaacgccctgctgagcatcttccgccagttcgacagcgcctcggtgcgcaagggcctgcttggcgaggtaccgcagaccctgtggctgatggactacccgctgttcgagcgaacctactacgggctggtggtgaacttcgatgtcttcggcaacgtctcgcaccaggcgcagacgcggctgtacttcgacctgatccgcaacggcgccgagcagaacttcctccgcctgatgccggtcgacgcgcgccagccgttgctcgacgactggtaccagaacagcggcaagctgaagatgtggatggactaccaggccttcgacgatgacacgccgagcgcgctgggattgccggagaagcagccgaagaaggccttcgccgaagaactgctgcgtcgctacggcgacctcaatgcgcgtcccgacccgatcaaccgctgcctggacggcaactgctatcgaccgggcatcgaccgcgaactgcaggacgccgagcaggccttcagtcgcctggtgagccggccggcggccggcctcaaggtcatcgagcgcttccccgaggcgaccatgctgcggatacgtacgtccagcggcaagcgcgaggtctataccgtgctgcgcaaccgcgcgcacagcaatgtcgccttcatgctcggcgagtcgctgcgctaccagccgggcctggacaccctgacgatctacccgggcgtgctgtccagctacccgaacttcatgttcgatctgccggcgacggatgccgaggccttcgtcggcgccctggaggcggcgaagagcggcgaggacttcgacaaggtggtcgaacgctggggcgtgcgccgcagcaatccgcagttctggagctacttccacgatctcgaggcgtacatccgcgaaaccgagccggtcgaggcgggcgcactggacatgaaccgctacgagaacctctga

SEQ ID NO: 13551 - DNA, 1209 bp, Pseudomonas aeruginosa
ggcagaagaggcgaccgcaaggtcgcctttttcgttgccggcgtttcagcgcgacagcgtccgcgttcgtcgtaccggccagagcagtgtcagcgccaccagcagcgccggccagaccagcaggttcaccgcgttccagccaaggctggtgatcagggcgccggagccgaacgacatcagcgccgccaccaggctgttgccttgctccatcaatccttgcgcggcgccgcgctcgctttcggcgtggccctcgccgagcagggtggtgccggcgatgagcatcaggttccagccgctgcccagggccagcgaactgagcaggaaatgcgtgaccgactgcccgtccagggcgatgccggcacttgcggcgagcaggaacgcgccgagcagggcgacgcgacggttgccgatgcggtcgaccagcggtccggcgaagaacgccggaaggaacattcccagcacgtgccactggatgacccgactcgactgttccagcggcaggccgcagaagctcatggccagcggcgtggcgttcatgatcaggatcatcaacccgtgtccggccgcggtgcaggcgatggccgcgcggaccaccggccgccgcaacaggccgcctatgtcgcgccaggcgagtcgtgccgggcgtggcgcctggccttcgcggagcagagccatcagcagcaggccggcgagggccagcacggcgatcagcagataggcgccgacgaagggctgggccagcgcgttgcgcgaccacagcgccaggctcggcgccagcagcgcggcgagtactccgccggcgagcacgtaggcgctggcgcggcctttccgcccggcatccaccgcctccagcgcggcgaaccggtagtacatggccgaggcctggtagaccccgatgcccagcgcgccgagacagaaccagaggaaatcgccagtccagacaccggcggcgcagaccaggccgccgagcacgccgccgccggcgccgagcatcagcccgggacgtcggccgtggcgctgcatgaagtgcgacaacggctgcaccgccagcaggttgcccagcaccagcagggccaggggcagggttgccaggctgttcaacggcgccagctggacgccgaccagggcggtcagggttatgccgatcagcgagcaggaccagtacagggcctggccgcagaacagcaggagcagggtcgggttgcgtag

SEQ ID NO: 13552 - DNA, 420 bp, Pseudomonas aeruginosa
cgacgcgtcggctggaggcggggtgacgggctagcgcatcccgcggacgccttggccgggccagcagttcgccgccgcagttcgggcactggccgcccaggcggaccgtcgcgcagtcgcggcagaaggtgcactcgaaggtgcagatcagcgcgtcgccgctgtcgccgggcaggtcgcggtcgcagcactcgcagttggggcgcagttccagcatgggaaggtcctcggtgggagcgtcaggtcagcatgccgaagcgttcggcgtattcctgggggctgaccgaaagatgcttgtggaacgtccgccggaggttttccggatggccgaagccgcacagccgggacaccgtggcgatcgacgcctgggcgtcctgcagcagggcgcgcgcggcctccaggcgaacccgctcgacgtag

SEQ ID NO: 13553 - DNA, 777 bp, Pseudomonas aeruginosa
ggccgccgaccagggcggcgaccaggttgccgccgagcatcgaccagggttgcgccagggggctggaggcgagggcgaacagtagtacggcggatgcgccgagcggcgctgccaggcgcagcgccagttcgctgccgaacaacgcctggcaggcgaataccgcggcgagcgcgccgatgcaggcaccgagtccggcgcgcaggcagtcgcgcggtcgagcgttcagggtcagggggcggaagcctttcagccaggtgcgtacggcggtgctgggggagtcgttcatggaactcttcgaagcgaaagaaaggggccgttgccggccccgtaaggcactttcgtgctggaggcatccatccctggatgatggagtcggttcaggcgaggaacggcgggccggcggcctcgcgggattcctcgagggggcggaccacctgccggcagatcttgccggtatcccgggcgacccggcgggcggcctcgggatcgtcggcgaatggcagcagggcggcctgttcgcgttcctcgcgggtactgccggcgagcctgagggcgaggccgagcgccagggtggagaggcacagcagggacaacagcatgttcaggccccctggccggccgccaggaccggctgccgctggtcctgcgcgctgcgcagggtccgccaggtgttgtaggccatcagcagcatgccgctggcgaaggtggcgccgccgagcaggcgcaccacgtagcccggatggctggccaccagcgcctcgacgaacgagtaggtga

SEQ ID NO: 13554 - DNA, 879 bp, Pseudomonas aeruginosa
cgatgttttcggcaaggactgaagaggcacgcgtgcccgcaggaggttttcatgcccggccaccgcattaccctcaccggagaaaagcagacgctcctgatcaccctctacgccaaggcgctggatagccgcctggacgattccatcctccatgaccgtttcgccgaggaggcggtgcggcagatcgacttcgacttctccagggtcgccctcggcaagggcaacgaacgggccctggccatgcgctcgcattacttcgaccaggcctgccgcgacttcctcggccgccatcccgaggggcaggtgctcaacctcggttgcggcctggacagccgtatctaccgggtcgatccgccggccgagctgccctggttcgaccttgactatccggaagtcatggacctgcgcgagcgactctacccgccgcgcgccggcgcctatcgggcgctgcgccactcggtggacgacgacggctggctgcaaggggtgccgcgcgagcggcccgccctggtcctggccgaggggctgatgccctatctgcgggagtcccaggtgcgacgcctggtggaacgcctggtcgaccacctgggtagcggcgagctgctgttcgacggctacggccgcctcggcatcatgctgctgcgcctgtatccgccgctgcgcgagaccggggcgcaggtgcattggagcatcgacgacccgcgcgaactcgagcggtggcatccggccctgcgcttcatcgaggaggtcaccgactatgacccgcaggacgttgccaagctgccgcagtcgtcgcggctgatgctgccgatctacaacggcttcgccttcctgcggcggatggggcggctgatccgctaccgttggcccagggtctag

SEQ ID NO: 13555 - DNA, 927 bp, Pseudomonas aeruginosa
ttgcaactggtcccgcgagtaacgggtgatccgcgccagcagcggattgccgccggcatccaggcgcaccaggacgtgggccgcggtgtcggtatcgaccaattccaggacccgtaccggcaggcggttgaggatgctgctctgggcgtcgtcgcgcaggttcaggctgacgtcgcgcgcctgtaccttgaagcgcaggcgcttgccgggggccagcggggcgtgggcgacgcgcatttgcagcgcgctgccgggcaggaccagggtcagcaggccgtaggccgggtcgtggtcgctgaccgtgccctcgatcaccaccccggcatcgtcgtccagcgccagcggcaggtcgactcgcgccagggtttcgccgatcggcccgctggcgcggaccttgccgttctccagcagcaccaggtgatcggccaggcgcgccacttcgtctggcgagtggctgacatagagcaccgggatgtccagttcctcgtgcaggtgctcgagatagggcaggatctcgcccttgcgcttcaggtcgagggatgccagaggctcgtccatcagcagcaggcgcgggctggtgaggagggcccgggcgatgccgacgcgttgctgctcgccgccggagaggcgttccggcatgcgttccagcaggtgctcgatgcccagcagggcgcaggcctgttccagctcgacgcggcgttcggcggcggcgatgcgcttgagaccgaaggccaggttgcgccgcaccgtcaggtggcggaacaggttggcatcctggaacacgtagccgagggcacgccggtggggcgcgacgaagaggttgcggcggctgtcctgccaggtctcgccgttgatcgtcacctcgccctcggcggccttttccaggccggcgatacagcgcaggcaggtgctcttgccggagcctga

SEQ ID NO: 13556 - DNA, 2259 bp, Pseudomonas aeruginosa
tccagttctggccggcgcagcggcgctaccggatggtcgaggtcaagggaccgggcgaccgcctgcaggacaaccagttgcgctggctgcaattctgccgcgagcgggagatgccggtggcggtctgctacgtgcgctggcatgtcgatgactgagcagggcggcgaggcgctgtaccaggtggcggtgcgcgcgctttgcgagttcagcgccaagcgcggcgacctcgacctgcgcttcaccccgtcgcccagcgccctggaaggcatcgccggacataccctggtgacctcccggcgccccgctcactaccagcgcgaagtggcgctggacggacgctaccgtcacttgcaggtgcgcggccgggcggatggctacgatccgcaggcgaactgcctggaggaaatcaagacccaccgcggcgacctcgccctgcaaccggccaaccaccggcacctgcactgggcccaggccagggtctacggctggctgctctgcgccgaacggaagctggaggaagtcgaactggcgctggtctacctggaggtcggcagccagaaggagacccgcttcgtcgagcgggtgcgggccgacgagctgcggctgttcttcgagagccagtgccaggcgtttctcgcctgggccgagcaggaactggcgcaccgccagcggcgcgaccgcgaactggccgcgttacgctttccccacgccgaattccgccacggccagcggcaactggcggaggcggtgtacaaggccgcctccgccggttgttgcctgatggcccaggcgccgaccgggatcggcaagaccatcggcacgctgttcccgcaactcaaggcgatgcccgggcagcgcctggaccggctgttcttcctggccgccaagaccccgggccgggccctcgcgctgcatgccctgcgtagcctggaaggggagaccggcggactgccggtgcgggtgctggaactggtggcgcgggacaaggcctgcgagcacccggacaaggcctgccacggcgagtcctgtcccctggcccagggcttctacgaacgcctgccggcggcccgcgccgccgccgtggaggcgcgctggctggaccaggcgcggttgcgcgaggtggcgctggcgcaccgggtctgtccctactacctgggccaggaactggcgcgctggtgcgacctggcggtgggcgactacaactactacttcgatctcggcgccatgctccatggcctggcccaggtcaaccagtggcgggtggcggtactggtggacgaggcgcacaacctggtggagcgcggccggcggatgtattccgccgaactcgaccagggcgatttcctcggtgtgcgcaaaaccgccccggaggccctgaggaaaccgctggagcgcatccagcgtgcctggaacgaactggccaagacccaggcggacgactaccaggcctacgacgagcctccgcagaagctgctcctggccttgcagaacgcggtggcggcgatcaacgacctgctcgccgagcaaccgcaggcgctggagccggcgttgcaggagttctacttcgcgatcctgcagttcggccgtctcgccgagctgttcggcgagcattcgctgttcgacatcgagaagcgcccaggccgcaacggccgcagcctggcccggctgtgcctgcgcaacgtggtgccggcggcgtttctcgccgagcgcttcgccgccagccgctccaccgtgctgttctccgctacccttgggccgcgcgactattacgccgacctgctcggcctgccggcgggcacgccctggctggaagtggactcgccattcagcgccgagcaactggaggtgcacatacagcgtcgggtttccacgcgctatgcgcagcgccaggcatccctggcgcccatcgcagcgattctcggcgagcagtttcgccagcggccgggcaactacctggccttcttcagcagcttcgattacttgcagcaggcgctggacgtcttccgccaggcatacccgtgggtgccgtgctggagccagacgccacggatggacgaggcggagcgccgggtcttcctcgagcgcttcgtcgcgggcgggcgagggcatcggcttcgccgtgctcggcggtgccttcggcgaaggcatcgacctgcctggcgagcgcctgatcggcgccttcatcgcctccctcgggttgccccaggtgaatccggtgaacgagcagatccgcctgcgcatgcagcgcctgttcggtga

SEQ ID NO: 13557 - DNA, 246 bp, Pseudomonas aeruginosa
tcgcgtccccacgatttcccccgatccggatacgccatggcttccgctcccgacgctcttccccaggccctttcctccgacgacgctccggcccaggccgcgccgagcgacgccagcgcgttgctgaaggccgccctggcgaagaagaaccaggcccagctctatccgcagcggaagatccacgacaagggccagcgtcccggcatggcgccgcgcggtacccgtcgttcgatgggcaagcgctga

SEQ ID NO: 13558 - DNA, 576 bp, Pseudomonas aeruginosa
gccgcagccccatcccttatgctcgccgcccctgggcgagccgcgtcgatgcagcgcgcccgtttgccggaatccgcctgctgcatgtcgcgtcaccttccatcgtctttcgtttccctgcgcagcctggccgggcatgcgcccgctgtgctttgcgtgctgctgctggcgttgctcagcgccagcctggccagccagacgcgctcgctgcgccgcgagctggcggaattgcccgccgcagcggccccggcgccgccagccaacccttcagcggccccgcgcgcggcgttagccggcttgttcggtggcgctccgtcgccgcgcggcgcgacggcgggcgagcgtctgcaattgcgcctgctggcctgcttcctggcgcgtcgcgaggaccgctcggcggcgctgatcgcggtggccgggcgctcgcagcgcttcctgccgggcgccgaagtgcgccccggcaccgtgctgctggcggttcatcgcgaccatgtggtgctgcgcgaccagggttatgaagaacgtctgtatttccccaaagccgaaggggcagaaaccacccatgccacgttgtag

SEQ ID NO: 13559 - DNA, 594 bp, Pseudomonas aeruginosa
tacccgttccgcccagcgcctgtctccgctgttcctggtcctgtcgctggccgtcctcggcctggcgccgccggtccatccggcacctgccgagactgccgccgcgcaagaggaagagcagtggacgatcaacatgaaggatgccgagatcggcgacttcatcgagcaggtatcgagcatcagcggccagaccttcgtcgtcgatccgcgggtgaaggggcgggtcacggtggtatcccaggcgcggctcagcctggcggaggtctaccagctgttcctttcggtgctcgccacccatggctacgcggtgctgccgcagggcgaccacgcgcgtatcgtgccgaacatggaggcacgccaggacgccgcgcagaagaccgtccgcgatgggccgggcagcctggagacgcgggtggtccaggcgcatcagacctcggtggcggaactgatcccgatgatccggccgctggtcccggcccatggccatctggccgccgtaccgtcggccaacgcgctgatcgtcagcgaccgccgctccaacatcgagcgcatcgaggcgatcgtgcgcatcctcgaccgggccggcgaacatga

SEQ ID NO: 13560 - DNA, 525 bp, Pseudomonas aeruginosa
ctacagcatctacgacatgcgccatgcctgggtcgcggaaatcgccgaggtgctcgatcgcagcgtcaccccggccgccgggaagagcgccgccaccgtccaggtccttgccgacagccgcagcaaccgcctggtcctgctcggtccgccgcaggcgcgagcgcgcttgctgcggctggcgcagtcgctcgacgtcccctcgtcgcggtcggcgaacagccgggtgatccgcatgcgccatggcgacgccaagacccttgccgccaccctcggggagatcggcgaatcgctgcacggcgagcggggccaggatggccggggaagcggcaagcgcggcctgctggtgcgcgccgacgaatcgctgaatgccctggtgatcctcgccgacccggaggatgtcggcctgctcgaggacatcgtccgccagctcgacgtgccgcgcgcgcaactgctggtggaggcggcgatcgtcgagctgtccggcgagatcggcgacgccctcggggtgcaatgggcgctgcgtag

SEQ ID NO: 13561 - DNA, 1119 bp, Pseudomonas aeruginosa
cgacggccaggtcatcgtcctcggtggattgatccaggacgacctgcagcgcagcgattcgcgggtaccgctgctgggcgacatccccggcgtcggccggctgttccgctcgtcccgcgagacccgggtgaagcgcaacctgatggtcttcctgcgcccgagcatcgtccgcgatgccgccggcctggagcgcatcagccatggccgttaccgttccatccagttgctgcgcggtgccgccggcgaaccggcgcgcccgctgttcgaggatgccggcgccatcgacctgcgtcccgccgcccaggtcgcaccggcacctattggctcgccgcgcagctatccggctccagccccggtgctgatggagaagccgcgcctggcggacccggcgtccctgggcgacggtcgcggcggcgaggtgctggaggttcgccagggcacgcacgcgccgcagccgccgtcaccccagcgctacgccgtgcgattggtcgagggcagcagcgaagccttcatgcgcgcgctgatcgagcggcatccgggcctgtcgttgcgtttgcgccgcgaactgcgcgatggccaggagctgttcgcggtggagcggggcgactacctcgacccggagcaggcacgccgggccctggcggaactgcccgaaagcctgccgcgagggaaggcgcgggtgattgcgcatacgccgggaagcgccctgtgacggacttcgaatcctcgcgtcgcgctccgtccaccggattgtccggcgcgctgcggcggccgcgctccagcgcagcgccactgccagatctggcagttgtcgctggcggggacggaggctttagtagccgcacttttttccagggccgggcagtgggaccgcaatgcatggacgacatcgagaccagagtgaggaaactggtagccgcccggttcggcgtggaggaatgcgacatccggctggacagcgacttccgtaacgacttcggtgccgagtcgctcgaggtagtcgaactggtcatggccctggaagcggagttcggcgtcgagatcgccgatgacgatgcggaacggatcgagaccgtgcgccaggccatcgactatctcgaggaagccgtgccgacctga

SEQ ID NO: 13562 - DNA, 708 bp, Pseudomonas aeruginosa
ctccccctggaccaccggccgatgccgtggtcattccctgcgaaacgctgtgcgccacctcccgcccgtgccggcggcaaggtgcgcgacgtcccgcgcttcgattacgccggatcgtccagcccgccccgggccgatccggcttttttttgcccgccgccgcgattgcgaggcggccgccgtcggttggatttcctgaatcttcccgcgcctcgccggtcgaccgaacaagggcagcgtgccattcccggcgcgtgcccgccattcgtaacggaggtcgtcatggctacacgacggaaaacaacaccccaggaaatcgatgatatccaggaccgcatgggttcgatgcgcgagctcgatttcgacgagcgccgccaggcgcgtaaggcgcggatcggcgacgagcggcccgaggccgaggtggaggccgaattttcctcgcggcgggtacgcgaggcgggccacgctggcgggcagccggacgaggacgatggttaccaggataacgtcggcatggacgatctggcgccggaaaccctgatcgacgaaagcggcgcccgctcgccggccgagcgcggcggcgaatcgcccgcggacaagcgcctgagggtcgtgcatggcaacgagatcggagccggccacggcctcgacgaggccgagctggcgcgtcgtgatccgctcgacggttcctccgacgaggaacgctga

SEQ ID NO: 13563 - DNA, 429 bp, Pseudomonas aeruginosa
gcaacggccagcaggtcagcgccgacaccaagctcggcgtctatgccggcaacatcaacaccgcgctctgcgagggtggcagctccaccggaccgcacctgcatttctcgctgctctacaacggcgccttcgtttccctgcagggcgccagcttcggtccgtaccggatcaacgtcggcaccagcaactacgacaacgactgtcgccgctactatttctacaaccagagcgccggcaccacccattgcgctttccgtcctttgtacaaccccggcctggcgctctgagtcggcgcggggcccggctccagccgggctccgccgcgagcgaaacggcgctgaacagctggcgcgtcgctgccgccgcgcccggcgccaggctgaccgcgtgggccggcatgctcagccgcgccggggcagcagggcgtag

SEQ ID NO: 13564 - DNA, 792 bp, Pseudomonas aeruginosa
tcgccgcgcttgcggaaggcccagcggccggcgaggaaggtgaagctggcgaccagcacgagcatgatccagaagccttcaggatcgtcggcgaagggaatcccgccgacgttcatgccgaagaagccggcgacgatgttgatcggcagggccagcaccgtgaccatggtcagggtgaagaggatgcggttgttctgttcgttgagcttggccgcgatctcttcctgcagcagcttgatccgttcgcccagggcggtcaggtcgctgatcaccagggagaactcctcggtggcttcgcgcaactcacgcaggtcggcatcctgtagccattccggcggtcggttgagcaggcgcagcagcgaaccgggctccagcgccagcaggcgttgcaggcgtaccagcacgcgccgcatggcgccgaggtcggcgcggttggcggagaggcgcagggccagtagctggtcctcgatgcggtccactgcgacgctggtttcgcggacgatctgggtcagcacgtcgccctggtcgcgcaacaggtggatcagcaactgcaggggcgaacggaaaggttcgccgtgcttcaccgaagagcgcagcttgtccaccgagcgcagcggttgcgctcgtgcactgaccagcagccggccacgggcgcagacccacagggtggcgacgtccgaagagaccaggccgaagttgaagaccacgtcgttgaccactgccagcagcgccgagtcgacgtgttcgatgcgcgtcgagcgcgacccctcgcgcaggctttcgaagaaataa

SEQ ID NO: 13565 - DNA, 717 bp, Pseudomonas aeruginosa
cccggctggcaacgccagcccgccggcccaggtcaccgctccggacactaccgccccggcgccggctaccgacgtgcaggtggcgccggacggcagcagcgtcaccggcaaggccgaacccggctcgacggtgggcgtcgataccgacggcgacggccagccggacaccaccgtggtggtcggccccggcggcagcttcgaggttccgctgaacccgccgctgaccaatggcgagacggtgacggtgatcgttaccgacccggccggcaacaacagcaccccggtgaccgtcgaggcgccggacaccacagccccggcgccggccaccgacgtgcaggtggcgccggacggcagcagcgtcaccggcaacgcagagccgggcgccaccgtcggtgtcgacaccgatggcgacggccagccggacaccaccgtggtggtcggccccggcggcaggttcgaggtcccgctgaacccgccgctgaccaatggcgagacggtgacggtgatcgttaccgacccggccggcaacagcagcaccccggtcaccgccgaagctcccgacttccccgacgcgccccaggtcaatgccagcaacggcagcgtcctcagcggtacggcggaagcgggcgtgaccatcgtgatcaccgacggcaacggcaatccgatcggccagaccagcgccgatgccaacggcaactggagcttcacccccggtag

SEQ ID NO: 13566 - DNA, 1287 bp, Pseudomonas aeruginosa
ccaactgccggatggcaccgtggtcaatgtggtggccagggacgccgccggcaacagcagcccggcgacctccatcaccgtcgacggcgtggcgccgaacgcgccggtggtcgagccgagcaacggcagcgaactcagcgggactgccgaaccgggcagcagcgtgaccctgaccgacggcaatggcaatccgatcggccagaccaccgccgatgccaacggcaactggtctttcacgccgtccaccccgctgccggacggtaccgtggtcaacgtggtggccagggatgccgccggcaacagcagtccgccggccagcgttaccgtggatgccgtcgcgccggccacgcccaccgtcgatccgagcaacggtacgaccctcagcggcaccgccgagccgggcgctaccgtgaccctgaccgacggcaacggcaacccgattggccaggtcaccgccgacggcagcggcaactggaccttcaccccgagcacgccgttgcccaacggcacggtggtcaacgccacggctaccgacccgtccggcaacgccagttcgccggccagcgtcaccgtggaccccgtggcaccggccacgccagtggtcaacccgagcaacggcaccacgctcagcggcaccgccgagccgggcgccaccgtgaccctggccgatggcaacggcaatcccatcgggcaggtcaccgccgatggcagcggcaactggagcttcactccgaccacgccgttgcccaacggcaccgtggtcaacgccacggccaccgacgcctccggcaacaccagtgcgggcagcagtgtcaccgtggactcggtagccccggccacgccagtgatcaaccccagcaacggcaccacgctcagcggcaccgccgagccgggcagcagcgtgaccctgaccgatggcaacggcaacccgatcggccaggtcaccgccgacggcagcggcaactggagcttcaccccgtccacgccgctggcggatggaaccgtggtcaacgccacggccaccgatccggcgggcaacaccagcggccagggcagcaccaccgtcgatggcgtggcgccgaccacgccgaccgtcaacctgagcaacggcagcagcctcagcggcactgcggaaccgggcagcacggtgatcctcaccgacggcaacggcaatccgatcgccgaggtcaccgccgacggcagcggcaactggacctacaccccgtccacgccgatcgccaacggcaccgtggtcaacgtggtggcccaggacgccgccggcaatag

SEQ ID NO: 13567 - DNA, 735 bp, Pseudomonas aeruginosa
cagcccgggcgccagcgtcaccgtggactcgcaagccccggcggctccggtggtcaacccgagcaacggcaccacgctcagcggcaccgccgagccgggcgctaccgtgagcctgaccgacggcaacggcaacccgattggccaggtcaccgccgacggcagtggcaactggagcttcacaccgggcacgccgctggccaacggcaccgtggtcaacgccacggccagcgacccgaccggcaataccagcgctccggccagcaccaccgtggactcggtggcgccggccgcgccggtggtcaatccgagcaacggagtcgtcatcagcggcaccgccgaaccgggcgccaccgtgaccctgaccgatggcagcggcaatccgatcgggcaggtcaccgccgacggcagcggcaactggagcttcaccccgtccacgccgctggcggatggaaccgtggtcaacgccaccgctaccgacccggccggcaataccggcggccagggcagcactaccgtggacgccatcgcgccggccacgccgaccgtcaacctgagcaatggcagcagcctcagcggcactgcggaaccgggcagcacggtgatcctcaccgacggcaacggcaatccgatcgccgaggtcaccgccgacggcagcggcaactggacctacaccccgtccacgccgatcgccaacggtactgtggtcaacgtggtggccgaggacgccgccggtaa

SEQ ID NO: 13568 - DNA, 909 bp, Pseudomonas aeruginosa
cagcagcccgccggcgacggtgaccgtcgattccagcgcgccgccggcgccggtgatcaacccgagcaacggcgtcgtcatcagcggcaccgccgaggccggtgccaccgtgaccctcaccgatgccggcggcaacccgatagggcaggtcaccgccgacggcagcggcaactggagcttcacgccgggcacgccgccggccaacggcacggtgatcgtcgccacggccaccgacccgaccggcaataccggcccgcaggccgccaccacggtggacgcggtggcgccgccggcgccggtgatcgatccgagcaacggcacgaccatcagcggcaccgcggaggccggggccaaggtgatcctcaccgacggcaacggcaacccgatcggcgaaaccaccgccgacggcagcggcaactggaccttcacgcccgccacgccgctggccaacggcacggtggtcaacgccgtggcccaggaccctgcgggcaataccggcccgcagggcagcactaccgtggacgcggtggcgccgaacacgcctgtggtcaatccgagcaacggcaacctgctcaacggtaccgccgagccgggcagcaccgtgaccttgaccgacggcaacggcaacccgatcggccagaccaccgccgatggcagcggcaactggagcttcacgcccggctcgcaactacccaacggcaccgtggtcaacgtgaccgcgagcgacgccgccggcaataccagcgctcccgctaccacgacggtggattcctcgctgccgtcgatcccgcaggtggatccgagcaacggttcggtgatcagcggcaccgcggacgccggcaacaccatcatcatcaccgatggcaacggcaacccgattggccaggtcaccgccgacggcagcggtaa

SEQ ID NO: 13569 - DNA, 642 bp, Pseudomonas aeruginosa
ctggtccttcactccaggcatcccgctgccggatggcacggtggtcaacgtggtggcgcgcagcccaagcaatgtcgacagtgcgccggcggtgatcactgtggatggcgtggccccggcggcgccggtgatcgatccgagcaacggcaccgagataagcggtaccgcggaggccggcgcgacggtgatcctcaccgatggcggcggcaacccgatcggccaggccaccgccgacggcagcggcaactggacgttcaccccgggcaccccgctggccaacggcaccgtgatcaacgccgtggcccaggacccggccggcaataccagcggtccggccagcgtcaccgtcgatgccatcgccccgccggcgccggtgatcaatccgagcaacggagtcgtcatcagcggtacggcggaagccggggccacggtgatcctcaccgacggcaacggcaacccgatcggccaggtcaccgccgacggcagcggcaagtgggctttcacgcccgccacgccgttggccaatggcacggtgatcaatgcgctggcccaggacgccgccggcaacaacagcagtcccaccagcgccaccgtcgactcgctggcgccagcagccccggtgatcgatccgagcaacggtag

SEQ ID NO: 13570 - DNA, 1074 bp, Pseudomonas aeruginosa
cgtgatcgccggtaccgccgaggctggtgccacggtgatcctcaccgacggcaacggcaacccgatcggccaggtcaccgccgatggcagcggcaactggagcttcacgcccggcacgccgctgtccaatggcacggtggtcaatgcggtggcccaggacgctgccggcaacaccagcggcccggccagcaccacggtggactcggtggcgccggccgcgccggtgatcgacccgagcaacggcagcgtgatcgccggtaccgcggaagccggtgcgacggtgatcctcaccgatggcggcggcaacccgatcggccaggccaccgccgatggcagcggcaactggagcttcaccccgggcacgccgctggccaacggcacggtgatcaatgcggtggcccaggatccggccggcaataccagcggcccgaccagcaccacggtggacgcggtggccccggccaccccggtggtcaacccgagcaacggcagcgtgatcgccggtaccgcggaagccggcgccacggtgatcctcaccgacggcggcggcaacccgatcggccaggtcaccgccgacggcagcggcaactggagcttcacgcccggcacgccgctggccaacggctcggtgatcaatgcgctggcccaggacgccgccggcaacaccagcggcccggccagcaccacggtggactcggtagccccggccaccccggtgctcgatccgagcaacggtacggtgatcagcggtaccgccgaagccggggccacggtgatcctcaccgacggcggcggcaacccgatacggcaggccaccgccgatggcagcggcaactggagcttcactccgggcacaccgctgaccaacggcacggtgatcaatgcggtggcccaggacgccgccggcaacaccagcggtccggtcagcaccacagtggacgcggtggccccggccaccccggtgatcgacccgagcaatggtgtcaaactcagcggcaccgccgaacccggcgtccgggtgatcctcaccgatggcaatggcaacccgatcggccagaccctcgccgacggtag

SEQ ID NO: 13571 - DNA, 1308 bp, Pseudomonas aeruginosa
cggcaactggaccttcacaccgggcacgccgctggccaacggcacggtggtcaacgccgtggcccaggacccggccggcaataccagcggtccggccagcaccacggtggatacggtggcgccggccacgccggtgatcaatgccagcaacggcagcgtgatcaccggcaccgccgaggtcggcgccaaagtgatcctcaccgacggcaacggcaacccgatcggcgagaccaccgccgacggcagtggcaactggaccttcacccccggcacgccgctggccaacggtacggtgatcaacgccgtcgccgaagacgccgcgggcaacgccagcggtccggccagcaccacggtggactcggtggcgccgtccgctccgctgctgagcatcagcgccgacggcgcgctgctgaccggcaccgccgagccgaacagtcaggtgcgtatcgtggtcaacggcgacaccgccaacccgatcacggtcaccgtcgacggcgccggcaacttcagcctgccgttcgcgccgccgctgatcaccggcgaactgatcgccggggttgccgtggacgccgccggcaacgtcagcgggccggccaccatcaacgcgccggacctggcgccgccgaccatcagcgtgccggaagccgccgatacctggatcaacgccgcggagatcggggacggcatccaggtcgatgtgacggtccgtccgaccatgcaggtcggccaggtggtcacggtcaagttcgccgggcagaacggctacgaggccgaggtcagccataccctcaccgccggcgacatcgccgccggcaacctgaccctgaccctgacgcctcccggcggcatgggcccgttcccggagggcgcctcgaccgtcaccgccgacatcaacggcggcaccgcgtcgaccccggtgccgttcaccatcgacaccattccgccggcgaccccggtgctgtccctggtcggcaacatcctgactatctcggcggagccagggaccgagttgacggtcaccgtcgacgtcggcggggtgaccgccaccgccacggtgaccgccgacaacagcgggctggcgtcgctgaacctgctcaccgacctggacatcgacttcagttgggaccagttgctcaatgcccaggtgtcggtggtcggacgcgacccggccggcaacccgagcaacacggcgagcatcggcgtcggcaccagcatcgagcaaccggtgaccatcggcaacttcggcctcgacgtcagcctcaacccgctgaacccgcgtttcggtttcagcggaaccaccgagcctga

SEQ ID NO: 13572 - DNA, 561 bp, Pseudomonas aeruginosa
ctccagcgtggtgatccgggtcatcaccccggcgttgaacgtcgaattgctgccgatccaggcggattcgtccggaaacttctcgctgaacctgctgagcccgaccatcctcacccagttggggctgaacatcaccgacatcctcaacctcggctcgcagatctcgttcaacctggtgtccaccgactccaatggcaacgacagcgccgcctacgggatcaccctgacccccaacggactgtcgctcaatatcggccagatcgatgtcaacggtacttccggcgacgacgtgctgtccggcgccaacggcagttcggagcacatcaacggcggcgacggcagcgacctgatcttcaacgtgggcaccggcgatcacgtggtggccggcaacggcaacgacaccatccagatcaccgcgaccgatttcgtcagcatcgatggcggcgccgggttcgacaccctggtcctggccaacggcatcgacctcgactacaacgccgtcggcgtcggcacgctcagcaacctcgagcgcatcgacctcggcaagggcgactcgggtag

SEQ ID NO: 13573 - DNA, 666 bp, Pseudomonas aeruginosa
cgtgctgaccctgaccgcggcggaggtggatgccatcaccgatgccaacaacacgttgcagatcaccggcgagaacaacgacaccctgaacgtggtgggcgcggtgaataccggtaccacgcaactgatcaacggcattacctacgacgtctacaccttcggcagtaccaccctgctgatcgaggacaacacggtacaggtcgtggtctgatgcgcgggcgcaggcagtacgcgcgcaagggacggcggcatgggaagggagccatctggctcctttccctgggtctgccgatgttcgcgtcggccatgcccctcgaccaggcggtcagggcagggctggcgatccacccggaagtacgatccgcgatggccgaagcggaccgtgcaggcaccgaggtggagatggccaaaggggggtactacccctccgtgacgatgtccggggggccgcaggagttcgacttcggcgagatcgtctacgatctcaccgcgtcgcagatgctgtacgactggggtcgggtgacgagcaaggtcgacagcgccagcgcgacccagcgcaagctgtccgaggcggtgctggtggcgcgcgacgatgcggcgctggatatcgtcgagacctacctcgacgtgcttgcctcggagcgccgggtggaggcggtgcgctaa

SEQ ID NO: 13574 - DNA, 822 bp, Pseudomonas aeruginosa
cacatccagcgcctcgacggcatccgcgagatgacccaggcgcgcggcggcgacggctacgccgaccgcagcgagctggatcgcgccaatctggaactgtcgcgggcccaggagcagttgtcgctggagaagggcaacctgcaggacgcgcgcaaccagtacgcgatcctggtcggccaggagcccgccgacctggtggagcccgagccgatgtcgctgcaacgctacctggcggccagcgatatggcgcgggtgatccgcgaatcgcctttgcagcgcaaggccctggaggacgccaatgtcgccgaggccgaggtccgcgaggccaaggcgtcgctgctgccgcaactgaacctggaggccagcgcgctgcgccgggagatcggcgggcatccggaaagcgactcggtggtatccctgcgcttccgcatggacaccttccaggggctttccaacttccgccggccgaccgccgcgcagcagcgcctggagtcggcgaaatggagcgccgacgcgatgcagcgcgacatccgccggcaactgcagaacctcttcgacaacggcgacacgctgcgctggcgggaacagtcgctgacccagcaggtgaccgagtcggagcaggtcggcgagttgtatcgcgaacagttcgaggttggccggcgcgacgtgatcgacctgctcaacgtgcagcgcgagcggttcgaggcagagcggcaactgatcaacctgcggatcgaacgcaagcgcatcgagtatcgggcggccgcgcaagtcggcctgttgggtccgctattggagaaccggctgaatcatggaagctga

SEQ ID NO: 13575 - DNA, 2292 bp, Pseudomonas aeruginosa
cgtcgtgatcctcaaccacgaccccatcgtcgacccgttgcgccagggcttgttgctgctctgccggcagcttggccgaccgctcggcgacgccgaactggtggacggcatgccgctggagcacggtcgcctgccgttgcacctggtggcccgcgcgttgcgccgcgccgacatcaccgcccaggtcacccgccagccgttgcgccggatcgatcgctacctgctgccggccctgctgctgctcgacgacggccgcgccctggtgctggtgggcaacgacggcgagcacgccgaggtgctggtaccgcagagcgacggcggaagccagaggatgccgctggccgagctggaagcgctgtacagcggcacggcggtcttcgccaagtgccgctaccggccggacgggcgggtcggcgactacgccagcgccttgcccgaacactggttcttcggcccgctcaagcggctctggcgttcctacgccgaggtcaccgccgcggcgttggtggccaacgtcctggcggtcgcctcggcactgttcgccatgcaggtctacgaccgcgtggtgcccaacgcggcgttcgacaccctgtggatcctcgccagcggcgtggccctggcgatcgtcctcgacggtgtcctgcggatcatgcgcggccacctgctcaacgtgctcggcaagcgcctcgacctgcaactctcgaccctgctgttctcccgcgtgctgagcacccgggtcgccgccaagccggcgtcgatgggcgccttcagtacccaggtgcgggagttcgagtcggtgcgcgagttctttacctcgtccagcgcggcgctgatcagcgacctgccgttcgtggcgatcttcctgctgatcatcgccgtgatcggcggccatgtggtctgggtgccgctggtggcctgcgtgctgatgatcctgccggggctgctgacccagcgcctgctcggccacctgtcgcggcagaacctgcgcgaaggggcgatgaagaacggcgtgctgctggaagccttcgagcacctggagacggtcaaggcgacccgcgccgaaggccgctgcctgcaccagtgggaaaccctgaccggcgaactggccggtacggcgatgaagacccataccctggcctcgaccctgagctactcggcgagcatcgtccagcagctctgctacgtcggcgtggtggtcttcggcgtctatcggatcagcgagggcgcgatgaccgtcggcggcctggtggcctgctcgatcctcgcctcgcgggccatcgcaccgctgtcgcaggcggccggcatcctcggtcgctggcagcacaccaaggtggcgatggaaggcctcgaccaactgatgagcgccgagcaggagcgaccccagggcaagcgcttcgtgcacaaggagcgcctgcagggacattaccgcctggagggcgtgcgcatggcccacggcgacagcccgccggtggtcgacgtgcaggccctgaacatccgcgccggcgagcgggtggcgctgctcggcggcaacggcgccggcaagtcgaccctgctgcgcctgctcagcggcctgctcgacgcgcaggcgggacgcctgctgctggacgacgtcagcctgacccagatcgacccggccgaccgccagcgcggtatcggctacctgccgcaggacgtggcgctgttccatggcagcctgcgcgacaacctcaacctggagaacgccgcgctgggcgacgaggaactgctggagaccctcgacggggtcggcctgggcgccttcgtccgcggccacccgctggggctggacatgccgatccagggcaacgccagcctgtccggcggccaacgccaggccgtcgggctggcccgggtgctgctacaggaccctccgatcctgctgctcgacgagccgaccgcggccttcgaccagggcagcgagaaacaggtcatcgactacctgcagcaatggttgggcaagcgcaccctggtcatcaccacccacaagaaaagcatgctcgccctggtcgagcgtgcggtggtcctgcgccagggcagggtgatcatggacggcccgctggagcaggtggtgcagggcaaccaggtacaggcaccgcaggccgccgaaggaggcaaccatggactctgaccgcgacgccgccgccctgcgccggcaactggccgacccgttgctggcggctacccacccggtctaccggccgctgctctggaccctgctcggttgcgtgctgctgttcatcggctgggcggcctgggcgcaactggacgaggtga

SEQ ID NO: 13576 - DNA, 732 bp, Pseudomonas aeruginosa
tcttcggcatcgagatgccgttcctctacctctgggcggtgtcgctacgggagaatggctgggcgggtttcgtcgaggcgacgctgttcgtctccctgctgctggtcggactgttctacctgcaccgggtcggcgccctcgactggtcgccggagcgccggcggaaaaagccgcacgactagtcgtggaggatcaccagcaggtagcggcaggcttgcccggcggtggcgaaggtcaccgcgcggtcgacgccgaagtccaggcggtcgccgcgttgcaggtggaacgattgctcgccgtaatccacccgcagcgcaccctcgaccagccacaggcgctgccggtagggccggccgccccagcggggatagtcgaggcgggcgttcgccgggatctccacttccaccatctcgcagccgctgcgcggatcgcgagcgccgacctggcggcggcggtagccgctggccgggtcttcccacacttcctgctgcgcgcgccggcagagcggttcggccggcgcctgcgcgtcgccgagcagctcggagagggcgacccccaggccgccggcgagacggccgaggacgctggcggtggggctgctttggttgcgctcgatgcgcgagatcatcgccttgctcaccgcgcagcgttcggccagttgggcgagggtcagctcgcgctccttgcgcagggcggctaggcgtcgggcaatcagttcgtcgatatccatga

SEQ ID NO: 13577 - DNA, 531 bp, Pseudomonas aeruginosa
tgccggacggcacgccctgtcccaccacctatttctacaagcgcctggctgctgccggctgaccgaagatgccagcgttcccaaggcaggccgggtagaatcggcggatgcgagagattcggggtcgatggtggagttactgcaagggttcgtcctgacccggcactggcgcgatacgccggccggcacggaagtcgcgttctggctggcgaccgagcagggcccgcggcaggtgcggctgccgccgcagccgtcggtggcgttcgtcctcgccgagcagcgcgggcgcgtcgagtccctgctcgccggggagactggcgccgagctgcggccgctggcgctgcgcgacttccagcagcggccggtgctcggcctgtactgccagcagcatcgccaactgatgaatctggagaaacgcttgcgccaggccggcgtcgaggtgttcgaggccgatatccggccgccggagcgctacctgatggagcgcttcatcaccgcgccggtcagcctggaggcgagtgtcgaggctga

SEQ ID NO: 13578 - DNA, 1119 bp, Pseudomonas aeruginosa
ctacaagagcctgtatccgtcgatcatccgtaccttcctgatcgatccggtcggcctggtggaaggcctgcgccagccggacgacgagcactcggtggaaggctttcgcggcgcccgcttctcgcgtacccggcattgcctgccggccatcgtcgcacgggtctgggagggccgcgaggcggccaagcgcgaacgcaaccagccgctctcgcaggcgttgaagatcatcatgaacgccttctacggggtgctgggttccagcggctgccgcttcttcgacccgcgcctggcctcgtccatcaccctgcgcgggcatcggatcatgcgccgtacccgcgagctgatcgaggccgagggctatacggtgatctatggcgataccgactccaccttcgtctggctcggcagcccccgcgccgaggaggaggccgcggccatcggccgggcgctggtggcgcgggtcaacgactggtggcgcgagcacctgaaagaagaattcggcctcgacagcgccctcgagctgcaattcgagacccattaccggcgttttctcatgcccaccgtgcgcggcgccgaggagggcagcaagaaacgctacgccggcctggtgcgccgcgccgacggtggcgaggagatggtcttcaagggcctggagaccgtgcgcaccgactggtcgccgctggcccagcgcttccagcaggaactctacctgcgcatcttcaatcgccagccctaccaggactacgtgcgcgattacgtacgacggaccctggccggcgagctggacgacctgctggtctaccgcaagcgcctgcgccggcgcctcgacgattaccagcgcaacgtgccgccgcatgtgcgcgcggcgcgcatcgccgacgactacaacctcgagcgcgggcgcccgcggcagtaccagagcggcggctggatcagctacgtgatcagcgtcgccggtcccgagccgctcgaggcgcggcgttcggccatcgactacgagcactacgtgggcaagcagttgcagccggtggccgacgccatcctgccgttcgtcggcgacgatttcgccactttggtcgaccggcagatggcactattctgaggctcattggcggatga

SEQ ID NO: 13579 - DNA, 1326 bp, Pseudomonas aeruginosa
ctgtcgctgcaaggccgcatgtcggcgcaggtcgattcgctgtcatcgcgcagcggggcgttggcggcgcagcctgccagcaggcaggctgcgagaagggcgagtattttcatgacgattcccgcgtggagattcttttccggcgcgccagaactcgaccggtcgctacccgttacgcaggccggtcggtacgctctggcgctgtcggtgcccgtgtcgccggccgggtgctgtcatgggggatgggagagcgcaggcggagaagtcgtcccgcgaaaggctggggaggcgtgtgtcagggtcccctggaagcgggcctgggatatcccggaaaggctcgtcgtggggcgaactgtcgaagacgttgacatgctgaaccaccacttccgtgtctgttctgcaactgtctatagaccgccgggggatgggtgtcaaagtgccacttcgcagccttccgcatggtggatggctgcgaaggagagtcgatcaggccagttgcgccgggtcgagcatgtcgctttcgaaggtcatccagccgccgttctcgctggccgcgccgtcgaggatcgggccgtagtaggtgaggccgatggtcaggctgaagcagatgtgggtagcgttctccggggcgtccagctggccttcgaagtgcagcttgagcacgcccggctcgacgctttccaggccgatggcgacgttcgggttgtccacggcctcgctttcgcggccgcgttgctcggcgctgacggtgagggtcacggtgtctcggtacatgtcttgctccagttggcgtggggccggcgtcgccagcgcggcggacagactactggcagacgcgccggctggccagtgctggctgcggtaggcgccgcgcggggcctgggaatcattcgccggcggcgcagtccaactgcgcatcaccaaccgacccccgaggggatgatgaagctacccgtgctcgctgtattgggcgccgcgctgctgttgagcgcctgcgcgaagaaggaggccgaggcctgtgcctcgccggacgtgaaagaccaactgatgcggatcttcctccagggcgcgatcaccgagcgctcgccggagttcaaggacagcgcgttgcgcgacgtggcgatcctcgagaaggatcccgacagcggcgtgctgtcctgcgtcggcaccctcagcgtgccggccggccagcaggtggtcgagggcgtcctgcaataccgcatcgccccggtggccaagtccgactacgactacctgctgctggataccgccggcgccaacaccaccgccctggcgcagcgcctgaacaaggcgctcggccagtaa

SEQ ID NO: 13580 - DNA, 2340 bp, Pseudomonas aeruginosa
agggcgcaggaccaactggcggtccgtcgcgtcgggggcgtcgtcggcgatacggatgtacgcgccgcgggcccagagttcgttgagatcggtggcgccgtcgaacggcaggccggaattgcgggtggacagcgcgtagcgcgagttgtcgaagtccgccaggtcgatgaccatccgcagggtcgcggcgatccgtgtgttgaacgggttggccgggtcgctgtagtccaagcgcccgacgttgacgctgaagttgtcgccgcccttgttgttcttcaggtcgaacagcgcgcgcaacggggtcttgtggaagggcacgtgctcggcgagggcggcgtgcgcctcgccccacttccagccgctcggcgcgcttccgtgggcggctcgcagttcgtcgagggcgcggcgcagcgactggttcagcttgaggtcgcagccttgttcctggccgcaccagaagcgcaggtcggcctggccgtcgaggatcagccggaggaatccgtcgtagttgcgctggttccagccgctggccagcaactgcgtgccgatcctcggttgcagcagctcgcgggtgaaggcgcgtacccagtagccggcgatcagtggcgcggccaggtcggcggcggcctggtggttccagccctggagcagggcgaaggcctcgctggcgcgcagttcggggtcgctgacctgctccagcatcttcggcaacaggctcgccatcacgctggagaactcgtcgttctgcaactccaagctgtcttccagggtgcgctggccggggccgccgagccactcgcggatgcgttcgtagcggtagggcaggacccagtcgtggccgaagtcgaaggcattgtcgggcggcacgatgcgctggttcgccgtggcgatgaacccttcgcgggggttgaggctgcgtggcttggcgctttccggaacgtagccgacccagtcgtagcggctctcccagccgggcgagggggccaggccatggaggtcgtcgtcggcgccgcggagcggtacgcgaccggcggagacgtagccgatgttgccctcgacgtcggcatagaccatgttctgcggcggtacgccgaagtcggcggcggcgtcgaggaactgttcccagccttcggcccggttgatcgccagcaggctcgggaaggtcttgtcgtgacggtcgaggccggtccaggcgagggcgatcaccagccggtcgcgctgcgcctgcggcagccgcgccggttcgtagatgtcgctgatcaccgggccgtggcgggtgctgcggacctccagcgagaccgtctcgccgtcgcgcacggcgatgcgttccaagcgcgtctcgaagggccggtagccgtccggggtcaggtagcgccgcgggtcctggggatcgacgcgctccaggtaggcgtcctggatgtgcaagccggtattggtgtagccccaggcgatgcgctggttatggccgatgacgaacagcggggcgccggcgaagttggcgccggtgaggctcaggccggggatcttcatgctggccaggtagaaggccgccgggttggtcaggcgcaggtgcggatcgttggccagcagcggcttgccggtggcgctgcggttggcggagaccacccagttgttcgaaccgatgccctcgacgttggaaccgggcagttgccccagcagcttgccggcgtccggcgtgccgcgcagggagcggtacaggctggcgtagtcgcgggtggccggcggccgctcgcccggatagggggcgaacacctcgttgatccgcgccaggtccaggtgctcggccagcgccaggcgctgcaactgcatgcccaggttggcgctcagggtccaggaatagagcaggtgcagggacaggctgtccaccggcccccagggccccggccgttcgtggcgcaccaggctgaattccagcggcagcgccgccggggccagctccagataggcgttgatcccgtcgctgtagcgttgcagcaggacgcgcgtgggcgcgtccaggttggcgtagatgccctcggcggtgcgtcggaagcccagggtgcgggcgaacctgtccatcggcagggtcttgacgccgaacacttcggagagcgtcccgccggcatagcggcgggcgaactccatctgccacaggcgatccctggcgtggctgtagccgagcaggaaatagccgtcctccaggctctgcgcgcggatatgcgggacgccggcggcgtcccaggcgatccgcccctcgtgttccaggccatggccgacctggatctcgccgtacttgaagcccagcgggacggccagcaggtagaccgcgcaggccagtag

SEQ ID NO: 13581 - DNA, 759 bp, Pseudomonas aeruginosa
agaaccgaatcctgccgggatcgattgttgactggtgaagctggcatgcatgatgagagagagggatatctcgagattttgtcaagaataacaaccgaggaagagttcttctccctggttctcgagatatgcggtaattatggattcgaattcttttcattcggtgcgcgggcgcctttcccgctgaccgcacctaaatatcatttcttgtccaattacccaggggaatggaaaagcagatatatctccgaagactacacatccatcgacccgatcgtgcgccatggtctcctggaatacaccccgctgatctggaatggcgaagacttccaggagaaccgtttcttctgggaggaagcgctgcatcacggcatccgtcacggctggtcgatcccggtccgcggcaagtacgggctgatcagcatgctgtccctggtgcgttccagcgagagcatcgccgccacggaaatcctggagaaggaatccttcctgctctggatcaccagcatgctgcaggctaccttcggcgacctgctggcgccgcgcatcgtcccggaaagcaatgtgcgcctgaccgccagggaaaccgagatgctcaagtggaccgcggtgggcaagacctacggcgagatcggcctgatcctgtcgatcgaccagcgcacggtgaagttccatatcgtcaatgcgatgcgcaagctcaactccagcaacaaggcggaggccaccatgaaggcttacgccatcggcctgctcaactga

SEQ ID NO: 13582 - DNA, 540 bp, Pseudomonas aeruginosa
cggtattcccacctgattaatgtttattccaattcaagaggagatatgacgatgctcgataatgccattccccaaggtttcgaagacgccgtggagttgcgcaggaagaatcgcgagacggtggtcaagtatatgaacaccaaaggccaggatcgcctgcgccgccatgaacttttcgtcgaggacggctgtggcggtttatggaccaccgataccggctcgcccatcgtcattcgtggcaaggacaagctggccgagcacgcggtgtggtcgctgaaatgcttcccggattgggagtggtacaacatcaaggtcttcgagaccgacgatcccaaccacttctgggtcgagtgcgacggccacggcaagatcctcttccccggctatcccgagggctactacgagaaccacttcctgcattccttcgagctggacgacggcaagatcaagcgcaaccgcgaattcatgaacgtcttccagcaattgcgcgccctgagcattccggtcccgcagatcaaacgcgaaggcattcccacctga

SEQ ID NO: 13583 - DNA, 495 bp, Pseudomonas aeruginosa
tccgcgtcgggcgcatcgccgggcagtacgccaagccgcgttccaagccgcacgagcaggtcggcgagcagaccctgccggtctatcgcggcgacatggtcaacggccgcgaggcccatgccgaacagcgccgggccgatccgcagcggatcctcaagggctatgcggcggcgcgcaacatcatgcgccacctgggctgggacgccgcgtccgggcaggaggcgaatgcctcgccggtctggaccagccacgagatgctgctgctcgactacgacctgtcgatgctgcgcgaggacgagcagcgccgggtctatctcggttcgacccactggccgtggatcggcgagcgcacccgccaggtcgacggcgcccatgtggcgctgctggccgaggtgctcaacccggtggcctgcaaggtcggcccggaaatcggccgcgaccagttgctggcgctctgcgagcgcctcgacccgcgccgcgagccggggcgcctga

SEQ ID NO: 13584 - DNA, 753 bp, Pseudomonas aeruginosa
acaccggatacaacctattggagcttcacaactagtcctccgcagggcgggacgggagggcggctggatgggcggtcagagcagttcccgggcctgggcgacgatcgccgcgaagttgtcgccgagggcggcgatctcggcgcgttgcagatccgcggcgctcaggaccccgccgttcagggtgggtatgtcgcgggtggcgcaggcgctatcggcgagggtgcagcggtagccgtagtccttggccgcgcgcacggtggtgctgacgctggaatgggtcatgaagccgcagacgatcaggtcgagacggccgtggttctgcagcaggtcgtgcagctcggtgccggagaaggcattgggcaggcgtttctccacgactttttccccggcttccggttgcagttccgggaggaactggccgcgcggcccttgcggatcgaacaggccgccctggatacccaggtggcgtacatgcacgatgggcgtaccgctggcgcgggccgcctgcaccagcacgccgatctccgcggcggcggcgtcgaggcctggcaggcgcagggcgccgctgcggtactcttcctgggcatcgatgatcagcaaggtgctctgccgaaggggggctggcgggtagccgcgtccgctgatctgcaaaagggtgagcggatgaggcatgtcactactcctgagaaggcacatgcctttcattctggcccctatcggcgagcctgtgaacctttgccgcatgcgcactaa

SEQ ID NO: 13585 - DNA, 678 bp, Pseudomonas aeruginosa
agtggtatggacttcccgcgctggaggccagctccggcgcgatcggctagaatgtcgcccttttgtgcgttgcgaggagcaattccgtcatgtccgagtcccgtctgctcaccctgcgcgactacatccgctgggctgtcagccgtttccacgccgccggcctgttcttcggtcacggcaccgacaatgcctgggacgaggcgcgccacctggttctgggctccctgcaccttccctgggaaatttctgacagctacctggattgccgcctggaagacgatgaacgcgccgagttggcggagatcctccggcggcgcatcgaggaacggattccggcggcctacctgctgggcgaagcctggttctgcgggattccattcagcgtcgacgaacgcgtgctggtgccgcgctcgcctatcgccgaacttatcgaacagcgcttcgcgccctggctgccggccgagccggcgcgaatcctcgacctctgcaccggttccggctgcatcggcatcgcctgcgcctatgcgttcgagcaggcggaggtggtgctcgccgacctgtccttcgatgcgctggaggtggccaacgtcaatatcgagcgccacgacctcggcgagcgggtctacaccgtccagggcgacggtttcgccgggcttcccggccagcgcttcgacctga

SEQ ID NO: 13586 - DNA, 480 bp, Pseudomonas aeruginosa
gcaccagttgcgagtcgggcttggctcgctggagcgcctcggcgtcggcgacgccgacctggatgtcattgcggccctggacgatcagggtcgggatgcgcaggcggccgaacgcgcgggccgggtcttcgcggaacagcgagatcaggtacggctgcacgctggggcggagcaggttggcgagcgccggcgggatatcgccgcgggtctccccggccttcagcgaagccagcaccgagtcggcctggcgcagttgcgccggcggcaggcgaccgcgcagttgctcgcgcaacacccggtcgatgggttggccgctgccggcgatggcgatcaattcctcggccggcgtgcgaggcgccgccaggctggcgatcagcgcgccttcgctatggccgaccaggatcagccgggagaagcgcgggtcgcgggccagccgctcgctccaggcgaccacgtcgtcgacataggcgccgacgctga

SEQ ID NO: 13587 - DNA, 405 bp, Pseudomonas aeruginosa
ggtcttcctcgcgtggcgccgccgccaggctgcgggcgactccccgcttgtcgtagcgcacgctggcgattccgcgttcggccagggcctcggcgagacgcagcaggtagcggttgttgccgccgaaggggttgttgccgtcgcggtcggtgggaccggagccggcgaccagcaggaccaccggcggcggcacggcgctgcgcggcagcagcaaggagccgcgcagcacgccgtgcccggtgtccaggtcgtaggggcggtgcaggatgctgttgggagcggcgtgggccaggctggcgagcaggcagaacagggcgaggagggcgcgcggcatggaggtcttcatgggccgatgatagcgctttgatcgcgtcctccggggaaggttcgcaggcccgtccttga

SEQ ID NO: 13588 - DNA, 1140 bp, Pseudomonas aeruginosa
cgggtatactccgatgtctttccctgtcgtcctcacgcggagcctcgcatgtccggcaacacctacggcaagctcttcaccgtcaccaccgcaggcgaaagccacggcccggcgctggtcgccatcgtcgatgggtgccccccggggctggaactgtccgcccgggacctgcaacgcgacctcgaccggcgcaagcccggcaccagccggcacaccacccagcgccaggaagccgacgaggtggagattctttccggggtgttcgagggcaagaccaccggcacgccgatcggcctgctgatccgcaacaccgaccagaagtccaaggactactcggcgatcaaggacctgttccgcccggcccatgccgactacacctaccaccacaagtacggcgtgcgcgactaccgcggcggcggccgttcctcggcgcgcgagaccgccatgcgcgtggccgccggggctatcgccaagaaatacctggcgggcctgggcatccaggtgcgcggctacatgagccagctcgggccgatcgagattccgttcaggagctgggacagcgtcgagcagaatgccttcttcagccccgacccggacaaggtgccggagctggaggcctacatggaccaattgcgccgcgaccaggattcggtcggggcgaagatcaccgtggttgccgaaggcgtgccgccgggcctgggcgagccgatcttcgaccgcctggacgccgaactggcgcatgcgctgatgagcatcaacgcggtgaagggcgtggagatcggcgccggcttcgccagcatcgcccagcgcggcaccgagcaccgcgacgaactgaccccgcaaggcttcctgtcgaacaatgccggcggcatcctcggcgggatctcctccggccagccgatcgtcgcccacctggcgctgaagccgacctccagcatcaccactcccgggcgctcgatcgataccgccggcgagccggtggacatgatcaccaagggccgtcacgacccgtgcgtcggcatccgcgccacgccgatcgccgaggcgatgatggccatcgtcctgctcgaccaattgctgcgccagcgtgggcagaacgccgacgtgcgcgtcgacacgccggtcctgccgcagctgtga

SEQ ID NO: 13589 - DNA, 717 bp, Pseudomonas aeruginosa
ctggaacagcctgggccctgcctggaccttcgccatcgccagcctggcagccttgctggcagccgctatcatcagtacccgtttgcaagaggtgcgggcatgaacgacaaccgtgaacagctgacccagcagatcatcgacgccggccggttcctctacggccgcggctggtcgccggcaaccagcagcaactactccgcgcgcctggacgaacagcgcgcgctgctcaccgtctcgggcaagcacaagggccagttgggcttcgacgacgtgctggccaccgacctggccggcaacagcctagaaccgggcaagaaaccctcggcggagaccctcctgcacacccagctgtatgcctggaacccggcgatcggcgcggtgctgcatacccactcggtgaatgccaccgtgctttcccgcctggtccgcggcgaccgcctggtgctgcaggactacgaactgcagaaggccttcgccggggtcaccacccacgaaggccaggtcgaggtgccgatcttcgacaacgaccaggacatcgcccgcctggccagccgcgtgcagccctggctggaggcgcatccgcactgcccggggtatttgatccgcggccacgggctgtacacttggggcgcgcgcatgagcgatgccctgcgtcaggtggaagctttcgagtttctgttcgagtgtgaactgaaagtactgagtctgagccgatga

SEQ ID NO: 13590 - DNA, 552 bp, Pseudomonas aeruginosa
acagcgaccacccgcagaaggccgaattgcgcgccaagttcctcgacgagcaccgccatggcgaagacgaggtgcgcttcttcgtcgccgggcgcggcctgttcgtcctgcatatcgaggagcatgtctacgccgtgctctgcgagcgcaacgaccttatctcggtgccggccggcacccgccactggttcgacatgggcgagcacccgcatttcgtcgccgtgcgcctgttcaacaacccggagggctgggtcgcccagttcaccggcgacgacatcgccagccgcttccccctgctggaagactgagcgaggcaccgtcccatccgtcaccatccgcgcccccggtcctgccgggggcggtttcatccggagtccgcatgaccatcaaagccatcctcaccgacatcgaaggcaccaccagcgcggtcagcttcgttttcgacgtgctgtttccctatgccgcccggcacctgccggacttcgtccgcgaacacgccggagagaccgaggtagccgcacagttggcggcggtgcgtgccgagagcggtga

SEQ ID NO: 13591 - DNA, 879 bp, Pseudomonas aeruginosa
gtgcatcgaatgctgaccaaacgattgcgccagaacggcgtagtagtctcctgcctgctcggtagcgtcctcttcatcgccctggccttcctcggctggcagcgtttcgccccggcagccaccgtatccggctggacctaccgggtagtgctcgaggacattccccacgtcagcgccctggcccgcgacccggacggcctgctctacgtgagccaggagttgcaggacggcaagggcctggtgttccgcatcgccgccgatggcagccgcgatacggtgctcgacgggctgtccaagcccgacggcatggccagcttccgcgacggcatcgcgatcagccaggagcagggcgcctcgccggtgttctggtggcatgcccagcaggcccggccgctgttcgacggcatccaggtggagggcgtcgccagcgacggccgctacctgtacgccgccgaggatcgcgacctggacgggcggattctccgctacgacccggagaccggcggactgacggtactgcgcgagggattgcagcgctccgaaggggtggccgcctgcccggacggaagcgtcttctacacggaaaagaaacgtggccacgtcatgcgtctgcatgagggggccgaggacgaggtggtgctgaacggactgaatgcaccgagctttttgttgtgcgacagcgaaggcctgtggatcaccgaggactcgacgcataacgcgcgagccttgctgctgccgcccgacgggccgctgcaggtgatcgcacggcgcctgcgttccgcacagtccatactgcccatcgggcccggccgctacctgctggccgagcaggggcgggaccgcattctggaaatcgaacgacagaagagcgaattgtaa

SEQ ID NO: 13592 - DNA, 255 bp, Pseudomonas aeruginosa
ggccgcggtgcgccgcgagttcaccccgccggcggcgaataccctgccgatccgcaacgtggtggtggtcctgctggaaagcttcccccggccctatttttgggcccctgggggcccccgggcaacatcaccccgtatttccaaaaacgggtcaaggaatgcctgctgtttcaccagttcttctccaacggcacccatacccaccagggcatgttcgccaccatggcctgcttccccaacctgccgggcttctaa

SEQ ID NO: 13593 - DNA, 1365 bp, Pseudomonas aeruginosa
gcaccaccaccagcgccgcgaccagcaggaccggcgccagcaggtagaggagctcctggagaaggttctccaggatggtctccagcgcctggcgaaacggcaggtcgatgtactcggcgggcagcaggagcagcttgccgagatgctccaggtagtagtcggaaaagcccatcagcagcgccaccagcgacaggatcaacgcgctggagacaatttccttgctcttcaccacctggccttgccggcgggcgtcgcgcagcttcttcgccgtgggctgctcggtcttctcggcgctcatggcgtctccagcacgggacgcagcaggcgcagcgggtcgacggcgagcagcagggcatcgtaggcgtgctccatgaggatgcccaggtagagcaccagcagcaggctggccaccaggctcttgatcggcatggcgaggatgaacacgttcagcgacggggcgaagcggctgaccagcgccaggccgaactcggcgaggaacatggcgatcagcagcggcgcggcgaacagcgcgcagagcatcagcatctgcgagaattgcgcgtagaagaatgccacccattggctgccgagctgcgggaagaaactgctcaccggccaactggcatagctcctgaacagcgagccgaccagcgcgaggaaggcgccgccggagaagaacagggtgatcagcgtctgcgtcagcaacagcccggtggggctggtctggctgcccaggctggggttgaaggtcgaggcgagtgccgcgccacgctggttgtcgatgatgaagccggtcgcttccatggcccagaagggaatggtggcgacgaagccgatgagcaggccgagcagcacttccttgccgatcagcagggcgatgtccagcgcgccgagggccggcggcaggctgccggcgacgatcgggtaggcgaacagcgccagcgaacaggccacgccgttgcgcaccaggccgccgcccagggtctgcttagccagcaccggcaggaccacgaagcaactgatgatccgcggcagcagcaggctgtaggtcagcagcagttgctgcaggtcctggacgctcatcgcaccagcggcaccttcagcagggtcatttcggcgaaacggtacagctcgccgcccagccagccgctggtggcgaacagtaccaccaccacggccaccagcttggcgacgaagccgagggtctgctcctggatctgggtgagcgcctggaccagcgataccagggtgccgatcagggccgcgaccagtaccggcggcagcgacaggaccagcaccagccacagggtctggttggtgaagtggaggatgtcggcgctgctcatggtcagcctccgtagctga

SEQ ID NO: 13594 - DNA, 1017 bp, Pseudomonas aeruginosa
acgggaccagcgcgagcagggccaggccgaggatcaggccgagctcgtcgggcaattggatcatgcttcgtcgtgtccgaacaggcgggttacgcgcaccccgagccgatcctggagcctgaccagttcgccgataccgaggcagcgctggttggcgaggatgcgcacttcgccgtccagggcactgtcgagatcgagcagcgagcctggctgcagggtggagagggtatgcaggtccagggtgcggcggccgacctcgaagctgaccgggatcggcagttggtcgagttcgtgcaggtcctcgccgtcggcgagggagggggtgtcgtgcatgtcgagcagttccagttgcgtggagtggagttggcagcgcgcccaggggcgtccttcgagaacccccagcagcgctgcgtcggggcgatgaccggcaggcagcagcaacaggtcgccgggctccagggtgcgcagctcgctggcgtccagcggcaggccgggccattgcagcgacaggcgcagcggtatggccaggcgttgcgccgaggggcgcggcggcaggcgtgccagcagcgtcgcgggatcgccgtcgagccagagcgccaggcgctggtcgtcgcgttccaggctcaaacgcaggcccatcgcagcgcgtggttgcgccgggctcaggccgtaccagaccaggccgggaaagacgttgccttcgcgctccagcaaggccagttgcagggccgccggcaggctggcgaaggctgcctcctgcaggttcggcgcgagccagtgggcgagcgccggagcctggcagagaaagcgcaggggcaggccgtcccacgccaggctcagttcgagatcgacgtcgggggcggcctgggcgatgtccaggcgcgcttgcaaagcgttgccggcatagtggcgacggcaacgcgcgagacgtcgctggagatccagttcggcgcggctggcgagcggcaggtcgaggtccgtaccgttcattcggcttgccactcttcatgcaggtag

SEQ ID NO: 13595 - DNA, 1098 bp, Pseudomonas aeruginosa
cgacgttgccgcgagcgctggccgctgtcctgctgctggttgaaggtgagttgcaccggttgttccggatgcagccgttgcaggcgttcgagcaactcgccacgggcttgctggagaaacgccaggctgccggggctggcactgatctcgacctgcaactggccatggccatgcaggacctgcacctccacggcgccgagctggggcagtcgcacctgcaggcgcgccgcatggctttcggctgcgctggcgacctggatgcgcccctgcacggcatcgagcaggcgcgcgagatcggccagcggcagtggccggctcccgctcgatgccagcaggcgtgccaccaggcggtcgccgggggtttgcatggcaggcagtggcacaggcgcttggtcgtcggggggcagtgcggatggatcggtttctccgggttgccgacgctcctctccgcggccttcgccgcccgctgtcggcgcgggcggcgaatcctggacactggcctgcgccgtggacgcgacctcggctgcggttttcgccgggaagccggggccgggctgtggccgctcatgcgtccgacctgcgatttgcgggtgggaggacaccggcaccagcggcggttcgtcgaccggaggcgccgaaacgctggccggctcccgggcttgcgtggacgccgcgacgcgcgcggagaccgccggcgcttgccgtgctaccgatccggacggcgacactgttggcgttggcgttggcgttggcgttggcgttggcgttggcgttggcgttggcgttgcgtccgcggcaactggcacgggggcttgccgagtggtcggcggccggtcggcggcaggcgccgcgggctggtcggcgagaggcgtcgaggtcggcgcgtcggctgtcgcggcgggctcttcggcctctgtcgtttcgtcgcccttgtcgaacggtggcctgggcgccggcggtcggtgcgcgggcagggcctgttcgaaggcgatctgctgcgcgcgcagcggcggaaggggggcaggggtgtcggacgacacgagcggagccgtatccacggcgttcagcttgagcatggccaggtctcgtggcgggtga

SEQ ID NO: 13596 - DNA, 1323 bp, Pseudomonas aeruginosa
attcttccagttcgccttcctcgctgcgttcgcgcagcccctggcgctcggcgtcgacgtggcgctccagttcggcgaacttctccagttgccgctggcgttccagcagttctcgccggcactgccgcaggcgctcgcgctccccttcgaggcgctgcgcggtctcggcgcagtcctgttccaggccggcttccttttcccgcagcagtcctacctgctgctgccaggcttccaggcgccggcggtcgagcatggccgcctggcaggcgagaaacagccgttgctcttcggccagtcgccagtcgcggtagtcccgttgcgccgcctggcgctcggtgtgttcctgcgccgcggcgcgaacccgtagcaattggcggccctgggcgcgctcggcccggtccaggcgcaggcgtcggacgcgcaacagcagcgccaggctcatgcgcagaggctccgcaactgcgcgcaggcctgtgcgtaatcgctggtttcgtgggtaccctggcgcagccactggcggatcgccgcgatcttctcgatggcctggtcggcttcgctgtcctggcctttctggtattcgccgatcttcagcagcaactcgacttcctcgtacttcgccagccattcgcgcaagcgtccggccgcatggcgctgatcgtcgtcgacgatctggttcatgacccggctcaccgagtgcagcacgtcgatggccggatagtggttggcggcggccagcttgcgcgacagcacgatgtgcccgtcgagaatcgagcgggtctcgtcggccaccggctcgctcatgtcgtcgccttccaccagcacggtgtagagcgcggtgatcgagccccgctcggattgcccggcacgctccatcaagcgtggcagcgcggcgaacaccgatggcggatagccgcggcgggtgggcggttcaccggccgccaggccgatttcgcgctgggccctggcgaagcgggtcagcgagtccatcagcagcaggacgcggcgtccctggtcgcggaaatactcggcgatgctggtggcgacgaaaccggccttggcgcgctccatcgccggtcggtcggaagtggcgaccaccagcaccgagcggcgcagcccctgttcgccgaggtcgctttcgatgaactcgcggacttcgcgaccgcgttcgccgaccagggcgagtaccgtcacatccacctcggcattgcgcaccaggctggccagcagggtgctcttgccgccgccggcggcagcgaagatgcccatgcgctggccttcgccgcaggtcagcaggccgtcgatggcgcgcacacccagcgatag

SEQ ID NO: 13597 - DNA, 960 bp, Pseudomonas aeruginosa
cgccaggctctggtcgggattgcgcaactggcagagttcgccgatgcgcacgccgggcaccacggccttgagcagggttccggtgacctgggtgacccgcccgcggatctggatcggccggcagccttcgatggcgtggcgcatccggacgatgagaggagagagaggcgcgggcatggcggatcggttcggctggagtcggcgcgcactatagagaaagcctcgcgcgacgaatttcagtgccagccgggagtttttagaaatcggttgccgccgcggctaaaaaaaaccggccgatattggcatcggcggcaccgggccggttcctatactgcgccgcctttgcagaccaggagccacagccacgatggacatcctccagagttcctccgccgcgcccctcgcgccgcgggaagcggccaacgcccccgcgcagcaggccggcggcagcttccagggcgagcgcgtccactacgtctccgtttcgcagtcgctggccgatgccgcggaagagctgaccttcgccttttccgagcgcgccgagaaatccctggccaagcgccgcctgagcgacgcccatgcgcgcctgagcgaagtccaggccatgctgcaggagtactggaagcgcattccggacctggaaagccagcagaagctcgaggcgctgatcgcccacctgggcagcggtcaactgagcagcctggcgcagctcagcgcttacctggagggcttctccagcgagatcagccagcgcttcctggcgctgtcgcgggcgcgcgacgtcctggccgggcggccggaggcgcgggcgatgctggcgctggtcgaccaggcgttgctgcggatggccgacgagcagggcctggagatcgaactcggcctgcgcatcgagccgctggccgccgaggcttccgccgccggtgtcggcgatatccaggcgctgcgcgatacctaccgtga

SEQ ID NO: 13598 - DNA, 789 bp, Pseudomonas aeruginosa
atgcctgccagatggcactcgacctggcgatcgagcgcgaagaggagcagcagcatggactgggttgagctggccgtcgcgcagttctgccaggacctgcgggtgagcgtaccggcgccgctggcgcgcgtggtgcaactggatttcgaggacagcggcaccttgcagctggaacgccatggcgaacagttgtcgctctggctggcctgtgacctggcctggcaccaggcctatcgcggcaccctgcgggcgttgcgccctgtgccatgcgcgcgcggccgggagcctgccgctgcgttgcgcctggagcggcgaatcgcgcctgctgctgtgcatcaccctggaagcccggcaggtcggcatcccgacgttgcaccaggccttgcaggcgctgcgctcggcgcgcagcgaagtgctcgccgcatgagccgggtcggtgcctggcacatcggcatcgaacgactcgacctggcgcatgccgagccgttcgcgccgcccctgccggagcgccatctgctggcgcccgacggccggccggtggagacccacgtcgccagcctgtatcccgcgcagcaggcgcaacagcgcctgttcgactacgcccggccccagctggagttccacggcctgctgcgccccggcgacttccgccaggcgctgcgcgatctccgcctggccctcacgctgccccgccagccggccctgcaggccgcggcctgcctgctcggcgagcgcgatgaagaccagcgactgctgcaaatggccccgaacctgttgcacaaggtatga

SEQ ID NO: 13599 - DNA, 1077 bp, Pseudomonas aeruginosa
atcgatgacgttgaaacagacgcaacagcgcctgttgctgatgctgggctggttgcacctgcaatgcggccagccgcgacgcgcccaggtgttgctggaggccttgctgagcgttgcgccggagcgccgcgacgggcgccgcgccttgctcctggcgttgctccagcaaggcctcggcgagcccgccgtgcgcctgtgccggcagttgcaggaggatggcgaggaggagcccggtctgtggctttgcctgagccgtgccgaacagctcgccgggcgtctcgacgcggcgcgtgccgcgcacgcccgggcgctggagctggaggcgcgggaatgaacgacctgagcgggcttctcggccgggtcggcgagcgcaaggacatcctgctggtggtgttgctgctggcggtggtgttcatgatggtgctgccgctgccaccgctgctgctggacatcctcatcgccgtcaacatcaccatctccgtggtcctgctgatgatgtcggtgtacatcggctcgccgttgcagttctcggtgttcccggcggtgctgctgatcaccacgctgttccgcctggcgctgtcggtgagcaccacgcggatgatcctgctgcaggccgacgcggggcagatcgtcaacaccttcggcagcttcgtggtcggcggcaacctggtggtgggcatcatcatcttcctgatcatcaccatcgtgcagttcctggtgatcaccaagggtgccgagcgggtcgccgaggtcagcgcgcgcttttccctggatgccatgccaggcaagcagatgagcatcgacggcgacatgcgtgccggcgtgatcgatgtcaacgaggcgcgggcgcggcgcgcggtgatcgaaaaggaaagccagatgttcggctccatggacggcgcgatgaagttcgtcaagggcgacgccatcgccgggctgatcatcatcgtcgtcaacatcctcggcggcatcgccatcggcgtcacgcagaagggcctgagcaccgccgacgcgctgcaactgtacgcggtgctgaccgtcggcgatggctggtctcgcaggtgccggcgttgctga

SEQ ID NO: 13600 - DNA, 1371 bp, Pseudomonas aeruginosa
tcgccatcaccgccgggatctcgtccccgggtgtcttccgacgaatcggcggacctcggcagcgacatcggcgaacaggtggtggcgcagcccaaggcgctgctgatcggcggcctgttgctggtgctgttcggcctgattcccggtgtcccgaccctgaccttcctggctctcgcgctgctggttggcggcggcggctacttcatgctctggcgccagcgggcccatgccagcgccggttcccgcgacctgccggcgctgctcgcgcagggcgccggagcgccatcggccaaggcgcgtggcaaggctggcggcggcaagccgaaggccgggcgtctcgccgagcaggaagaattcgccctcaccgtgccgttgctgatcgacgtcgatgccagcctccaggaacgtctcgaggcgatgtcgctgaacgaggagctggtgcgggtacgacgcgcgttgtacctggatttcggcgtgccgttcccgggtatccacttgcgcttcaacgaagcgatgggcgatggcgaatacctggtgcagctacaggaggtcccggtcgcgcgcggatgcctgcggccgggctggttgctggtgcgcgaacgcgccgcgcagctggaactgctcgcggtcccccacgagccggcagagctgcaggtgccgggagaagaggcgagctgggtggagcaggcgcatcaggatcgcctggagcgttccggctgtgcctgcctgggcctggagcaggtgctcacctggcacctgtcccatgtgctgcgggagtacgccgaggatttcatcggcatccaggagacgcgctacctgctggagcagatggagcagggttacggcgagctggtgaaggaggcgcagcggatcgttcccctgcagcggatgaccgagattctccagcgcctggtcggcgaggacatctcgatccgcaacatgcgggcgatcctcgaggcgatggtggagtgggggcagaaggagaaggacgtggtgcagctcaccgagtacatccgcagcagcctcaagcgctacatctgctacaagtactccagcggcaacaatatccttcccgcctatctgctggaccaggcggtggaggagcagatccgcggtggcatccgccagaccagcgccggcagctacctggccctcgacccggcgataacccaggccttcctcgagcgcgtgcggcagaccgtcggcgatctcgcgcagatgcagaaccggccggtgctgatcgtttccatggatatccgccgctacgtgcgcaagctggtggagagcgactatgccgggctgccggtgctgtcctaccaggagctgacccagcagatcaacatccagccgcttggcaggatcgtgttgtga

SEQ ID NO: 13601 - DNA, 972 bp, Pseudomonas aeruginosa
gccgcatgctggaagcattccaggaaatcatggagcggatcttcgccatgctccaggccaagggtgaaaccctgcacaacctgtccagccgaccggcagcgatctgaggagacgtcacatgatcgatacgcaatattccctggcggctacccaggccgcgatcccctccgagccgatcgctcccggcgccgccgggcgttccgtcggcacgccgcaagcggctgcggagctggcgcaggcgccggccacgcggggcgaccgggtcgagctgaacgctccgcgccaggcgctcgacccggtgcgcatggaagcggccggcagcgagctggacagcagcgtcgagcttctgctgattctcttccgcatcgcgcagaaggcgcgcgagctgggcgtgctccagcgcgacaacgagaaccaggcgatcatccacgcgcagaaggcgcaggtggacgagatgcgcagcggtgccacgctgatgatcgccatggcggtgatcgccggcgtcggcgcattggcctcggcggtggtcggcagcctcggcgcgttgaagaacggcaaggccatcagtcaagagaagaccctgcagaagaacatcgatgggcgcaacgaactgatcgacgcgaagatgcaggcgctgggcaagacctccgacgaggatcgcaagatcgtcggcaaggtctgggcggcggaccaggcgcaggacagtgtggccttgcgtgcggcgggccgtgccttcgagagccgcaacggcgccctgcaggtggccaacacggtgatccagtccttcgtccagatggccaacgcctcggtccaggtgcgccagggcgaatcgcaggcgagcgcccgggaaggagaggtcaacgccaccatcgggcagagccagaagcagaaggtcgaggaccagatgagcttcgatgccggcttcatgaaggacgtcctgcagctcatccagcagtacacccagagccataa

SEQ ID NO: 13602 - DNA, 684 bp, Pseudomonas aeruginosa
gggtttgagtggccccatgaaaatcgaatcgatttcgccggtgcagccgtcccaagacgcaggagccgagacggtggggcatttcgaggggcgttcggtgacccgcgcggccgttcgcggcgacgaccgttccagcgtggccgggctggcgcgctggctggcgcgcaacgtggctggcgatccgcgcagcgagcaggccttgcagcgcctcgccgacggcgacggcacgccgctggaggcgcgcacggtccggcgcaggtgaggtgctggatgctgttgccgctggcgttgctgctcggcggttgcgtcagccagcccgcgccgatgtcgccgaaggtgacggtgggcggttcggtgggcggcgtttccctgcaggcgcgccaggcgcaactcaggctgcgcctgtatgccgtcgttcagggaaggatgcaaacgattgccgagcggcgctaccgggtgtccgggttgccgttgcgctatgcgttcgatctggaggtcgacaggttggagggcgaggcattgtacctacgcaccgagctttcctgggtgggcgtcgcggcggtccaggcgagcgcctggcagcgggtggcggcgggcgtcgatgagcgggtccggctggttcggcgcgactgttttccgaattgtacggccgctcgcccggaagaaagatctggcaacgattga

SEQ ID NO: 13603 - DNA, 882 bp, Pseudomonas aeruginosa
gtggggcattcaaggtacgacgggaagtgttggggttcttataatatgcaaggagccaaatctcttggccgaaagcagataacgtcttgtcattggaacattccaactttcgaatacagggtaaacaaggaagagggcgtatatgttctgctcgagggcgaactgaccgtccaggacatcgattccactttttgcctggcgcctggcgagttgcttttcgtccgccgcggaagctatgtcgtaagtaccaagggaaaggacagccgaatactctggattccattatctgcccagtttctacaaggcttcgtccagcgcttcggcgcgctgttgagtgaagtcgagcgttgcgacgagcccgtgccgggcatcatcgcgttcgctgccacgcctctgctggccggttgcgtcaaggggttgaaggaattgcttgtgcatgagcatccgccgatgctcgcctgcctgaagatcgaggagttgctgatgctcttcgcgttcagtccgcaggggccgctgctgatgtcggtcctgcggcaactgagcaaccggcatgtcgagcgtctgcagctattcatggagaagcactacctcaacgagtggaagctgtccgacttctcccgcgagttcggcatggggctgaccaccttcaaggagctgttcggcagtgtctatggggtttcgccgcgcgcctggatcagcgagcggagaatcctctatgcccatcagttgctgctcaacagcgacatgagcatcgtcgacatcgccatggaggcgggcttttccagtcagtcctatttcacccagagctatcgccgccgtttcggctgcacaccgagccgctcgcggcaggggaaggacgaatgccgggctaaaaataactga

SEQ ID NO: 13604 - DNA, 2103 bp, Pseudomonas aeruginosa
gtccggaatcatcagtgcgcggcaactggcgttgctgcagcggatgctgccgcgcctgcggctggagcaactgttccgctgcgagtggttgcagcagcgcctggcgcgcggcctggcgctggggcgcgaagaggtgcggcagattctcctctgcgcggcgcaggacgacgacggctggtgcgccgaactgggcgaccgggtcaacctcgccgtgccgcagtcgatgatcgactgggtcctgctgccggtctatggctggtgggaaagcctgctcgaccaggcgatccccggctggcgcctgtcgctggtggagctggagacccagtcccggcaactgcgagtcaagtccgaattctggtcccgcgtggccgagctggagccggagcaggcccgcgaggaactggccagggtcgccaagtgccaggcgcgcacccaggaacaggtggccgaactggccggcaagctggagacggcttcggcactggcgaagagcgcctggccgaactggcagcggggcatggcgacgctgctcgccagcggcgggctggccggcttcgagccgatccccgaggtcctcgaatgcctctggcaacctctctgccggctggacgacgacgtcggcgcggcggacgccgtccaggcctggctgcacgaacgcaacctgtgccaggcacaggatcacttctactggcagagctgagcggccggcgaaagccggccctaccgaggaatcatggatcatctgttgagcggattggccactcgcctgggccaagggccctttgttgccgatcggacgggttcgtaccacctgcgcatcgacggacagagcgtcctgttgctgcgccagggcgacgacctgctgctggaaagcccgctggagcacgcccccctggacccgcagcgcgaccagcaggggttgctgcgggtgctgttgtcgcgggtcgccagttggagtcggcgctatccccaggccattgtcctggacgcggacgggcgcctgctgttgcaggcgcggctgggcctcgacggcctcgatcccgagcgactcgaacgggccctggccgccccaggtggggctgctcgaggcgctggcgccggagctggaaccgctgccccgcgggttgccgccgcaggctccggtgtggcgtccctgatgcgccgcctgctgatcggcggactgctggcgctgctgcctggcgcggtcttgcgcgcgcagccgctggactggcccagcctgccttacgactatgtggcgcagggcgaaagcctgcgcgacgtgttggccaacttcggcgccaactacgatgcctcggtgatcgtcagcgacaaggtcaacgaccaggtcagcggtcgcttcgacctggaaagcccgcaggccttcctgcagttgatggcctccctctacaacctcggctggtactacgacggcaccgtgctgtacgtattcaagaccaccgagatgcaatcgcggctggtgaggctggagcaggtcggcgaggccgagctgaagcgcgcgctgaccgccgccggcatctgggagccgcgcttcggctggcgtgccgacccttccgggcggctggtgcacgtgtccggtccggggcgctatctcgaactggtcgagcagaccgcccaggtgctggagcagcaatacaccctgcgcagcgaaaagaccggcgacctcagcgtggagatcttcccgctgcgctatgcggtcgccgaggaccgcaagatcgagtaccgcgacgacgagatcgaggcgccgggcatcgccagcatcctctcgcgggtgctcagcgatgccaacgtggttgcggtgggcgacgagccgggcaagctgcgcccgggaccgcaatcgagccatgcggtggtccaggcggaaccgtcgctgaatgcggtggtggtgcgcgaccacaaggaccggttgcccatgtatcgccgcctgatcgaagccctcgaccggccctcggcgcggatcgaggtcggcttgtcgatcatcgacatcaatgccgagaacctcgcccagctgggcgtcgactggagcgccgggattcgcctgggcaacaacaagtcgatccagatccgcaccaccggccaggatag

SEQ ID NO: 13605 - DNA, 804 bp, Pseudomonas aeruginosa
tgcaaggcatcctgcagaagatctgaacatggacacttcactgatacgcgaattggcggaactggcgctggccggcagcgggcagcactgccacgaagaggcgctgtgcatcgccgagtggctggagcgcctcggacaggacgaagcggcgcggctgatccggatttccagcctggccaaccaggggcgctatcaggaagccctggccttcgcccatggcaatccctggccggcgctggagccctggttcgccttgtgcgagtggcacctggggctgggcgccgcgctggaccgcaggctggccgggctgggcggcagcagcgatcctgccctggccgacttcgccgccggcatgcgcgcccaggtgcggacatgagccgcatcgacacgccgccgggattcgccgtctatccgtcggccagtccaaaggcggcgaacctgccggctgtcgatcaggtgctggctttcgagcaggccctcggcggcgagccgcaggcggccggacgccgcctggccgggttggagaacggcgctctcggcgagcgcctgctgcagcgctttgcccagccgctgcaagggttggaggcggaccgcctggagctgaaggcgatgctccgtgcggaactgccgctgggacgccagcagcaaacctttctcctccagttgctcggtgcagtcgagcatgcgccgggcggcgaatacctggcgcaactggcgcgtcgcgaattgcaggtgctgatcccgctcaacggcatgctcgacaacctcgtgcgcaacagccacaaactcgacctggagtcatga

SEQ ID NO: 13606 - DNA, 1266 bp, Pseudomonas aeruginosa
cgagatgctggcgctgttgcgttcggagggcgtttccgcggacaagcaggcggacaaggatggcaccgtgcgcctgctggtggaggaatcggatatcgccgaggcggtggaggtgctcaagcgcaagggctatccgcgggagaacttctccacgctgaaggatgtgtttcccaaggacgggctgatttcctcgcccatcgaagagcgcgcgcggctcaactacgccaaggcccaggagatttcccataccctttccgagatcgatggcgtgctggtggcgcgggtccatgtggtgctgccagaggagcgcgacggactgggcaggaagtcctcgccggcatcggcctcggtgttcatcaagcacgccgccgacgtgcaactggatgcctacgtgccgcagatcaagcaactggtgaacaacggcatcgaaggactcagctacgaccgcatcagcgtggtgctggtgccgtcggccggggtccgccaggtcccgctggcgccacgcttcgagagtgtcttctcgatccaggtggcggagcactcgcgcggacgcctgctcggcctgttcggcctgctgctggcgttgctgctggcgagcaacctggcgcagttcttctggcaccggcaacggggctgagcggcgcgatgccattgacggcctaccagttgcgcttctgcccggcccgctacatccacgagtcgcacctgcccgcggtattgctgcggttgctgccggcgctgccggactggcggcgacagagcgttctcaacgcctggctgctggagcaactggaattggactgcgcgttccgcatgcccgcgcaactgggcgggctggccctttacccgcaggcggcgctggaacggaccctgggctggctcggcgcgctgctgcacggccaggccttgcggcaggtgctggacggtgcgcgggtacggcgcatccgcgcgcagatcggcgaacagggccagcgtttctgcctggagcagctcgacctgctcatcggtcgctggccgcccggctggcagcgggccttgccggaaaacccggaagaaggctatttccggcgctgcggcctggctttctggctggccgcctgtagcgatgccgactgcggtttctcgcggcgcctgcgcctgcgcctggaggccatgccggccccggcggactggaccttcgacgaacaacggcgatccctggcgcggaccctgtgcctgaaggtcgcccgacaagcgagcgatgaatgcttccatttgttgaactag

SEQ ID NO: 13607 - DNA, 462 bp, Pseudomonas aeruginosa
ccagcaccgccagccagccgttgtcgatgcctcggccggcggcgccgcagaagctgcccagggggaactgcgcggcggccatcccggtgtagtgcatgccgacgatggcgcagcccatcaccagggcggcgccggcgcggaccaggacgatgcgccggctgccatggcgcaggcggaaggcgatccacagcgcggcgccggaggcgatcaccgcgatcaggatggagaggccgagccacagcgggtcgtagacgatccccggcatcatcagcagggcggccatcccggtgtagtgcatggcggcgatgccgctgcccatcagcagggcgcccagcgccaggcgttgccaggggagttccgcctggcacaccagccagagggcgaaggccgaactgccgacggccagcagcagcgacagcagggtcaggcccaggtcgtagccgagcgggatcggcaggctga

SEQ ID NO: 13608 - DNA, 702 bp, Pseudomonas aeruginosa
gccatgagcgatattctgatcctgacccatgccgagttctgtccgccaggccatctgggtgccgtgctggcggagcgcggcctggacttccgcgtgatccgcgccgacctcggcgaactcgccggtctcgacgccgaacgcccgcgagcggtggcgatcatgggtgggccgatgagcgtcaacgacgacctgccctggttgcgcgacgaactggcgctgctgcgtcgcttcatcgagcggcgcatcccgctgatcggccattgcctcggcggccagttgctggcccgcgccctgggcgcgacggtgcggcaccagccctacaccgaaatgggctggcagcccatgcagcgggaaagccgcgacagtccatggctggccgggctgccggagcgcttctcgatcttccagtggcatggcgatgccttcgacctgccgcagggcgccgagcgcctgctgtccagcccgtggtgcgagaaccaggggttttcctggggtggtcacgtactcggcctgcaaggccatccggaaatgaccgaggaactggtgcggcgctggatcgccggctggccgcacctgctcgatccctcccagcccagccagcaatccgccgaggacatgctggccgggttgcctgccaggattgccgggctgaatcgggtggccgagggtttctaccgtcattggctgtcgctgatcgattga

SEQ ID NO: 13609 - DNA, 1743 bp, Pseudomonas aeruginosa
cgtcgaatcgccgagcgtggtggtattgacgccgggacgtttcaacagcgcctacttcgaacacgccttcctcgcccgcgagatgggcgtggaactggtcgaaggcgccgatctgttcgtccgcgacgagcgggtctacatgcgcacgacggccggaccgcaaccggtggacgtgatctaccgaaggatcgacgacgccttcctcgacccgctggcgttcaacccggattcgctgctcggcgtgcccggcctgctggccgcctaccgggccggcaacctggtgctggccaacgcgatcggtaccggggtggccgacgacaagtcgatctatccctacgtgccggacatgatccgcttctacctcggcgaagacccgctactgcacaacgtgccgacctggcaatgtcgcaagccgaaggaactggcgcacgtcctggcgcacctgccggagctggtggtgaaggagacccagggttccggcggctacggcatgctggtcggaccggcggccagccgggaggaaatcgagctgttccgcgagcgcctgaaggctcgcccggaggcctatatcgcgcaaccgacgctgtccctgtcgacctgtccgaccttcgtcgagagcggcgtcgcgccgcgccatatcgacctgcggccgttcgtcctgtcggcgccggatcgggttcgcctggtgcctggcgggctgacccgggtggcgttgcgcgaaggctcgctggtggtcaattcgtcccagggcggcggcaccaaggacacctgggtggtggaggaataagcatgctcagccggaccgcttccgacctgtactggatgtcgcgctacctggaacgcgcggagaacctcgcccgcatgctcgacgtcagctactcgctgtcgctgttgccgcaggaccgcaacggcggcggcctggacgaactggccatgccgctgctgatcaccggcaccctcgacgcctacctggagcgccacggcgaactggccgccgagcgcctgctgagtttcttcgccctcgacccggacaacccggcgagcatctacagctgcctggccgcagcgcgcgccagtgcccatgcggtacgcgggcggatcaccctggacatgtgggagaacatcaacgccacctggctggaaatgcgcggcatcgccgccgagggcatcctgcgctatggcatcagtcgtttctgcgaatgggtgaaggaccgctcgcacctgttccgcggcgcgaccttcgccaccagcatgcgcaacgatgcgttccgcttcatccgtctcggaaccttcatcgaacgcgccgacaataccttgcgcctgctcgatgcgcgctaccagacccagggcgaagcggcgctcgccggggcggacgagggcaccgcgcgcggctactaccagtggagcgcgctgctgcgggcgctatccgccttcgagggctacaccgagctgtaccgcgcctcgcccaacgcgcgcaacatcgccgaattgctgctgttgcgcgaggacgtgccgcgttcgctgctgtcctgcatcgaggaactgagcgagatcctttccggcctgcccggcgtcaacggccggccggcgcagcgcctggccgccgagctggaggcgcgggtgcgctacaccggcatcgacgaggtgctggagcagggcctgcatacctggatcaccgactacatcctgctggttcgccagttggccaacgccattcacagctcctacctggaggccgcatga

SEQ ID NO: 13610 - DNA, 942 bp, Pseudomonas aeruginosa
ccaaggggttcccgtgctcgccgagttgttcgccgtgatggcgcccgtgctgttcggcgccggtgtcggttacgtctgggtccgtctcggacacgcctatccgaccgagttcgtttcgcgcatcgtgttcaacatcggttcgccatgcctgatcctcgccaccctggcgcatacccgggtggacctgcacagtttcggccggatggccctggccagcgcgctgatctgcgtctgcatggctgcgctgggctgggcggcggcgcgcctcgggcgccaggagtggcaggtgctggtgccggcctacagcttcccgaatgtcggcaacatgggcctgccggtgtgcctgtatgcgttcggcgaggcggggatgaccctggcggtggcgttctacctgatcatgtcgatcggcaacttcagcctcggcgtgttctggatgagcggcgagcgctcctggcgctcgctgctgggcaatccgatcctgctcagcgtgctgctggccttgttgttgatggggctcgacctgcaactgccacgctggatggcgaataccgtcgacctgatggccgggctgaccattccgctgatgctgatcaccctcggcgtgtccctggccagcatccgcccgcggcaactgggcaatggcttcttctatggcggcctgcgtcttctgctgggggcgctggtgggctggtcggtggcgctggcgttgcaattgccgccgctggcgcagggggtgctggtggtgcagtcgtcgatgccggtggcggtgttcaactatctctacgccttgcgcggcaatcgttcgccggatcaggtcgccagcctggtgctgtgttcgaccttgctgtcgttcgccttcattccgctgctgctgacctggtggctgcctgcgctgcgctgaccgcgaggcggtgcgcagcgtgcaggcagcaggtgccctag

SEQ ID NO: 13611 - DNA, 663 bp, Pseudomonas aeruginosa
gcggaggcccgctcggccggacgagaacaggataagagagaccgccatgaccgacgcattcatttacgacgccgtgcgtactccccgcggcaagggcaagaaggatggcgcgctgcacagcgtcaagccggtgaacctgatggccgggctgttgcgcgcggtccagcggcgcaacgacctggataccgcccaggtcgacgatatcgtgctcggctgcgtgacgccggtgggcgaccagggcgccgatatcgccaagaccgcggcgctggtggccgactgggacgaacaggttgccggcgtgcagatcaaccgtttctgcgcctccggcctggaggcggtgaacctgggggcgatgaaggtacgctccggcttcgaggacctggtcctggtcggtggcgtcgagtccatgtcacgcgtgccgatgggctccgacggcggcgcctgggcactggatccggaaaccaacctgcacaccagcttcgtcccgcaagggatcggcgccgacctgatcgccaccctggaaggcttcagtcgcgccgatgtcgatgccttcgccctgcgctcccagcagaaggccgccaaggcccgcgccgaagggctgttcggcaagtcgctggtgccggtcgccgaccagaatggcatcgtcctgctcgaccacgatga

SEQ ID NO: 13612 - DNA, 1098 bp, Pseudomonas aeruginosa
cgctggacctcgccgaagaggagtgcgccacgctggaggcgccgctcacggtgcgcgcccggaccccgcgctggtagggcgcacatcgacggagaaagcatgatgagacgacaggcttccgtgttgctgctggtatccatggtatcggcgaccgtcttgccggttttcgcccgtgcgccgggcgagcgcgagccgtcctgcgccgcgacgagcatcgtcctgccagcgggggcccggtatcccaacggcatcgcccatgccgccgatggaacgctgtacgtcggtctggtcaccagcgggcgcatcctgcgcaagcctcccgggggcgagtgggaatccttcttcgccggcagcccggcgatcttcgctgccaccgcgctgcggctggacgagccgcgtggcctgctctggggcaattcgccggacttcctacccgctggccggcgccggccgcatggggtgttcgccctggatctcgcgaccggtgccgtgcgccgatatctgaccctgcccggcgacgggatgggcaacgatctcgcggtggcgccggacggaacggtctacctgagcgaaacccgggatggcagcctgatgcggctgcggcccggggaaccggcgttccaggtgttgctgcgcgacagccgcctggccggccccggcggcctgggcgcggcgggcatcgtccgggtggacgacgacaccctgctggtcggcaacttcggtagcggggcgatccatgtcgtcgaaggggtcgccacgcgtccgcggctgcgcgagatggagctgccccgaacgctggagaatccggacggcatggcgctggctccggacggctcgctgatcgtgctggagaacgccatccgcagcggcgccggcaaggtgctgcggatcgccgagccgctcgctccagggcggcgcggcatcgaagtgatacgcgagggcctggagtcgccggtcaacctgaccgtcaccggacagggttgcgcctatgtcagcgagtcccgcattcgccaccgcctgttgccggggcgcgagggcgaggtgccggcgcgtttcctgatccaccggctgcccctggacgcggccgggggccgttga

SEQ ID NO: 13613 - DNA, 771 bp, Pseudomonas aeruginosa
ttaaatcaaacgaaaacgacaataaccccacttcttcagagagtctttatgtcgctccgcatctgtatcctggaaaccgatatccttcgtcccgagctgatcgagcgctacgaaggctacggccggatgttccagcaactgttcgccaagcaaccgatcgccgccgaattcgtcatctacaacgtggtggaggggcgctatccggcggacgacgagcgcttcgacgcctacctggtgaccggcagcaaggccgactccttcggtcccgacccgtggatccagaccctgaagaccttcctcctggaccgctacgagcgcggcgacaagctcctcggcgtgtgtttcggccaccagttgctggccctgctgctcggtggcaaggccgagcgcgccagccagggctggggcatgggcatccaccagtaccagttgaacgaacgggccgactggatgagcccggcgctgccggacctgaccctgttgatcagccaccaggaccaggtcacccggctgccggaaaacgcgcgggtgatcgcttccagcgacttctgtccctatgccgcctacgccatcggcgaccaggtgctgtgcttccaggggcatcccgagttcgtccacgactactcccgcgaactgctcgaactacgccagcagcacctgggcgaggaactctatcgcaagggggtcgatagcctggcgggggaccaccagggcaccgtcgtcgccgaatggatgatgcgtttcgtcgcgcgccagccgaccggcgcctga

SEQ ID NO: 13614 - DNA, 750 bp, Pseudomonas aeruginosa
cggttgcccttggtggtgacgatggatacgccgccctgctggttgatgccgaggaagcgatgcgggctggagaccgactgcagggcattgatcgccacggtcaggctgccatcggtgccgttcttgaagccgaccgcggaagacaggccggaggccatctcgcggtgggtctgcgattcggtggtacgggcgccgatcgccgaccagctgatcaggtcctgcaggtactgcggggaaatcgggtcgagcgcttcggtggcggtgggcaagcctttctcggcgaggtcgcggagcagttggcgaccgatgtgcaggccatcctggatcttgaacgagtcgtccaggtacggatcgttgatcaggcctttccagcccaccgtggtacgcggcttctcgaagtacacgcgcatcaccaggaacagcgtatccgccacttcggccgcgagcgccttgaggcggtcggcgtattcgtgggcggccttgatgtcgtggatggagcaggggccgatcaccacgaacagacggtggtccttgccatccaggatgtcgcgcaccacctggcgaccatgggccacggtctgcagggccttgtcggtcaggggaatttcacgcttgagctgctccggcgtgatcagggtctcgttggaggcaacgttaaggtcgtcgatctgtaaatcagccatcgtggtactcaatcaggtcacgggcgccggccgccgggaggccccctgcgaaagggcgcaggcatga

SEQ ID NO: 13615 - DNA, 615 bp, Pseudomonas aeruginosa
agttcgcaaacggggagacgaaccttaacgtgtcgggccgggcctagacaatgggcgggacgcggttcgccggtgttttccccgctctgcgcacgttttcttcgttgctccgggccaaggctgccagcggagttgcaggtgaggccgccgcggacgatattgtgcaggtgctgcggaggggcgcgccttgcgcgtatccgctggccgaggagggcgccagcgctatcgcaggagccgaagcctacggatgatggtcgggccccatttcttcctttctatcgaggtcagcagcgtgccgtccctggaactcaccgatctggacgccgaccggcagttgcttgccctggaaggggtttcgctgttggtattcaccagcgaaggctgcgcgtcgtgccgctgggcccggcgccatctccccgcgatggacctgcccatcgagcgcctgtgctgggtggacgccggccgcaatggcggcctggtggaacgctacggcgtctttcacctgccggccctgttcatggtccgcgacggccgcttccatggcgcactgaacgttccgctgcaccaggaagccttgcggggtgcggtgctggcggggtcgaccgctttacctga

SEQ ID NO: 13616 - DNA, 960 bp, Pseudomonas aeruginosa
ggagttgccctgatggattcaaagcagcaacggatcggcgtcatcggtacgggagccatcggcggcttctatggattgatgctggcgcatgccggtcacgacgtgcattttctcctgcgcagcgagttcgaggcggtcaatcgcgccggactcagcctgaatagtgcggtgcatggcttccggcgcctggcgccggtccaggcctaccattcggcgcaggacatgccgccctgcgactggttgctggtgggcgccaagaccaccggcaatcacgaactggcacccctgatccgcgcagcggcggcgccgggagccaaggttctgctgctgcagaacggtctgggcgtggaggagcggctgcggccgctgctgccggaaagcctgcatctgctgggcggcctctgcttcatctgtgtgcatcgcggcgaaccgggcgtgatcgagcaccaggcctacggcggagtgaatctcggctatcattccggaccggccgacgagcgacgccggcgcgagatcgtcgaggagggtgccgcgctgttccgcgagtccgggctggagtccacggcgatgcccgacctggagcaggcgcgctggcagaagctggtctggaacatcccctacaacgggctgtcggtattgctgaagagcagcaccgcgccgctgatggccaacgcggacagtcggtcgctgatcgaggcgatcatggaggaagtcatcggtgctgccggcgcctgcggcttcatcctgcctgagggctatgcggaccaactgctggcggcgaccgagcggatgcccgactatcggccgagcatgtaccacgacttcgcccatgggcggccattggagctggcggcgatctatgccgcgcccctggcccgcgctgctgctgcgggctaccggatgcccagggtcgaggcgctgtaccaggcgttgcgcttcctcgaagcacaaccgcgctga

SEQ ID NO: 13617 - DNA, 540 bp, Pseudomonas aeruginosa
tctgctaatgaggcccgccgcgcaggctgtcgaggaggccgcatgattcgttcgattctctacgccaccgatctggggctctatgctccctatgtcctgcaacacgccctgtcgctgacccgcgcctacaacgccgagctctatgtcgtccatgtggtggagcccctcgggctgttcgccgagtcggtcctgcagacctaccttgacaccgagcgtctccaggacctgcgggcgcaagggctggacaacgtcatggaaagcatcgagaagcgggtcctggaagggtttcgcgatgaactcggcgagttgccccaggatgcggcgctggtcaagagcgtgcgggtggtgcagggcgacccgccgcagatgatcctcgatgaggcggaaaagctggccgtggacctgatcgtcgccggcagccatagccacggcactcaactcgacacgccgctgggccggactgccgcgcgtctggtgcaactggcggaggtaccggtgtacctggtgccgatgttgcagcaccgtagtcgcgacctgtag

SEQ ID NO: 13618 - DNA, 771 bp, Pseudomonas aeruginosa
cctggaaggcgtgctggttccggaaatctggatcgcgttcgcggaaaaaaccggtatcgacgccttgaaggcgaccacccgggacattccggactacgacgtgctgatgaagcagcgcctgcgcatcctcgacgaacatggtctgaagctgggcgacatccaggaggtgatcgccaccctgaagccgctggagggggcggtggaattcgtcgactggctgcgcgagcgcttccaggtggtgatcctctccgacaccttctacgagttctcccagccgctgatgcgccagctgggcttcccgaccctgttgtgccacaagctggagatcgacggcagcgaccgggtggtcggctatcaattgcgccagaaggatcccaagcggcagtcggtgatcgccttcaagagcctctactaccgggtgatcgccgcaggcgactcctacaacgacaccaccatgctttccgaggcccacgccggcatcctgttccatgccccggaaaacgtgatccgcgagtttccccagttccccgcggtgcatacctacgaagacctcaagcgcgagttcctcaaggcttccagccgttcgctgagtctgtagccgcgccgccgatgaaagagcccgcggaacgcgggctcttttctattccggggacgctgtcccggccatcccttccagggtttccagcagcacccggaccttgtccagggtttcctggtactcgtcctcccagtgcgagtcggcgacgatgccgccgccgccccagcaactga

SEQ ID NO: 13619 - DNA, 2811 bp, Pseudomonas aeruginosa
agccatttcttcagtttacgtaagaagggtgatctgctaattatggaaatatcccacggagatttggctccgtaccacaatgataatgacacagggatacaggccgtggatgcagtacaggatccagcagccggcagcctttcgcgctccagaatagtgccgcctcaggtgccagccgaatattctcttcgccccgcgatccgcaacctgctggatcgcaatccccattcacgcgttctgatgttttccgcacctgccggcttcggcaagacctgcgcgctcgccgccctggccagggagcgcactgtagcagaccaggcggtggcctggctgtcgctggccgaagaagacgacgaccccgcccgtttctgccggcagctcatcgaggcgctgggcgaagccgtgccgcagcttggcgacgacgcccagacctacctgcagaacaccatgcgggtcccggtggtggcggtgatcgaaagcctgctcggcgatctcgatcgctatgcgcggccgttgctgctggtgctggacgacctgcacctggttagcaacccggacatcttcaccggcctcaaccgcctggtgcagtacgcaccgcccgggctggtcctggccctgggcacgcgttcgcagccggcgctgagcctggctacctggcgggccaagggactgttgctggaaatcggcctcgaggagctgcgcctcggcttcgaggaaacccgcgaatacctcgagcgcagcggtctctatctggacgagccctgcctgaaggcgctctatggccagaccgaaggctgggtggtgggcgtgcatctcgtcagcctgtggctgcgccagcaaccgcaggtgcaggaaatggccctgctcgacggcgacaagcaggcggtcagcgcctatctgctggcggcggtcttcgaacgcttgcctggcgacctgcaggaagcgctgctggcccttggcgttgccagccaattgagcggcgacctggccaacgccctgaccgggcgccaggacggccaggcgctgctggagcgcctggagtccatgcaattgttcctcctgccgctggatcgcgaacgccagtggtatcgcttccacctgctgttcgccgacttcctccgcaaccgcctgcgtgactccgatccggaccgtttcaagcaactgcatttcaacgccagcctgtggttcaccaaccaccacatgccgacgttcgccatcgagcatgcctgtgcggcggaagacccggagatgatcgccgcgctggtcgacggatgcggactggaactgatcaaccgcggccagctcagcctgatctaccgttggcgcaagcatgtgccggacgaaatcgccgagcgctatccgatcctggtccttaccgatgtctggtcgcgggccagcgacctcagcctgggcgaggccaaccggatcatcgacgaactgctggcgcgctggggggagagccgcggcgacgggccgatgggcgaccagtacctctccgcgctggcggtgaaggcggtggtggcgttgcagaaggacgatctggaactgtgcatcgccctggctcgccgggtcgaagtccagctcgggcagaacgctgccttcctcgaagtggcggtgttgatcaccgccgcgctggcccaggtggtccgtggccagggcgaccaggcgcggcgcctgctggggctggcgcagcagcgcaatcatttcctcgaagggcgctacctggacatgcaactggccaacgtcgaggtgatcctcgcactcgagcagggccaggtgaaacaggcgcaactgctcatcgagcggctccgccagcgcgcccggccgctgttcgagaagtccaggagcgcgctggcgctgccgaccatcaccgaggccctgaccgcctactacaggatcgagctggacgggctggaagagcgcctgggctgggcgctcgggcatgtggatgtgatcaatccgatcgatttctatgcccagggacagatctgcctggcgcgcacccagcgcctgctgggacggccgaaggaggcgctggccagcctggcggcgatgcaggccctggcctcgcgcaatcagtcgtggcgcttcttcgcccaggccatggccgaagagatcaacctgatcctccaggacagcggccccgaccgcctgaagcgcgccgagcagcggttgaagagcgtggactggaacaagatggcggcacactaccgcaacatggccttcaacccggtcaactggtcgctgggcgtgagccgcgtgcgcctgttgcaggggcgaggacatttcagcgaggcgctgcacgagatcactcagttgcgcggcaccttgcagcccggctggcacggcctgcagcgcctgcgcctggatatcctggcggcgctcagctatcagcgcctgggctaccaggaacgggccaacagcctgctcggcgaatgcctgatcaatgccgaacgggaaggggtgcgcagcctcttcatcgaggaaggcgacggcattcgccagttgctccagcaactcgaatccaccgagcgccagccggcgctacagaccttcattcgcggcctgctcggcatctggcccgggcagggcgtgcgcaagccccaggatgcgctcgaggaaggcctgacggagcgcgagcgcgaagtggtctgcctggccgcacagggcctatccaacgaagaaatcggccagcgcctgtcgctggccctggggaccgtcaaatggcatctgcacaacatctacgaaaagctcaaggtgcgcaatcgcacccaggcgatccggcgagcccgcgagctgagcctgctctga

SEQ ID NO: 13620 - DNA, 1209 bp, Pseudomonas aeruginosa
acgatcgcgacatgcgcctggtggacgaccgcaccgtcagcctgctggcgttccgcgagtttccgcagatcaacaagatcactgaaaaccaggtccgtgagctgggcactggtggcgacgtcatacacctgcgcaccaagtagcagatacccaaaaacaagaacaatctctggggatagcgccatgagaatcagggggtacacatgcgcggcggcgctgatgctgtctatcagcggtttgtccgttgccgaggaagcctcggtcgaccaggcccgtgacgcgctggccaagaagaatgacgatgccgacagcgccaaggcgctggaggaggtcttccaggccgccgagaagagctacaccttgctgaagaagggcgagcggaccctgacctacggtttcgactacgcgctggtgcgcgaccagcggctgaccctggtgccgctgaccaagaccagtggcggcacgcagatctacggcctcgccggccggcagagccagtcccagcacaccttcaccaactccttcaccttcgactacgggatctgggacaacctcaccttcagtttccgcctgccgctggtagccaagtacgacaccgagatggatacccacgcctacagcctcggcgacgtttccgcgaccttgcgctggcagccctgggcggcggtgcgcgggcggccggtcaccacgctgtataccaccatcggcctgccgaccggcgacagtccctacaagaccaacctggacaaggacatctccaccggcaacggctactacagcctgggcttcggcgcgaacatgtcctatgtgatcgacccggtggtcctctacggctcgctcggctacacctggaacctgccggtggacgacgtgcaccagaccctggccgacaactcccagctggagaaggtctcgcccggcaacacgatcaacttcaacatgggcatggcctacgcgctgtcctacgacgtctcgctggcgacttcgtaccagatggcctacacgctgaagaaccgctaccacaccactgccggtacgttcgagtcgtccgaacagaccagtagcatcatgaacttctcgctcggcttgcggacgtcaccggactacatcgtcaacgtcaacgccggtttcggcctcacggaagactcgccggatgtactgctggggttatccgtacccctcgatatcaaagggctgaaggcccagtaa

SEQ ID NO: 13621 - DNA, 432 bp, Pseudomonas aeruginosa
acaaggcggacaacgccacgcagtggccggggaacagcagcggaggggagagcaagcgtcgctactacacctggatcgatgccaacggcaacgtgcagaacagcttctatgccggcgcccaggtcgccggccagcgcgccgactacgtcctgcccaacggcgagcactccgccgaatacatcgacgccgaggccttcgagggcaagggtttcgttcgcagcgagaacggcagtccctactacacctgggtggacgagaagggccgcatgcacaactcgcagatcccgctcgaggagcgcgcggcgcgcttcaagcgggaggccgcgccttcgtcgcagatcgccttcaccgagggccggcagatcgagttcaagcagcgtccggcggcgttgcccgggctggatggcgccggccagcagagcgatgcgctga

SEQ ID NO: 13622 - DNA, 588 bp, Pseudomonas aeruginosa
cgcaaatggcggctccggtcacgccggcgccgccggggcgggcggccgatgttcctccggagctgcccgagccgatcccttcacccacaggagcttcccatgcattacgtcactcccgatctgtgcgatgcctatcctgagctggtccaggtcgtcgaacccatgttcagcaacttcggcggccgcgactccttcggcggcgagatcgtcaccatcaagtgcttcgaagacaactcgttggtcaaggagcaggtcgacaaggacggcaagggcaaggtcctggtcgtcgatggcggtggttcgctgcgccgcgccctgctgggcgacatgctggccgagaaagcggcgaagaacggctgggaagggatcgtcgtgtatggctgcatccgtgacgtcgacgtgatcgcccagaccgacctcggcgtccaggccctggccagtcatccgctgaagaccgacaagcgcggcatcggcgatctgaacgtcgccgtgaccttcggcggcgtcaccttccgccccggcgagttcgtgtatgccgacaacaacggcatcatcgtttctccgcaggccttgaagatgcccgaatag

SEQ ID NO: 13623 - DNA, 981 bp, Pseudomonas aeruginosa
cgagcgcggcctgatctatggctacgtcctcaacgggcgcggcggcggacgccgtgtcggacgcaaccagatagcggtgctcgacctgctgccggaggaaagcctttggctgcactgggaccgcggcgtgccggaagcgcaggcctggctgcgggattccgcggggctcagcgagttcgcctgcgatctgctgctggaggaggcgactcgcccccgtttgctcgatctcggggccgaaagcctgctggtgttcctccgtggagtgaacctgaatccgggcgcggagccggaagacatggtttcgctgcgggtattcgccgacgcgcgccgggtgatctcgctgcgcctgcggccgctgaaggcggtggccgatctgctcgaggacctggaggcggggaaagggccgaagacagcatccgaggtcgtgtactacctcgcgcactacctgaccgatcgcgtcgacacgctgatcagcggcatagccgaccagctcgatgctgtcgaggagctggtcgaggcggacgagcgcgccagtcccgaccagcaccagttgcgtaccctgcgccgccggtcggcggggttgcggcgctacctggcgccgcagcgggacatctactcgcaactggcgcgctacaagctgtcctggttcgtcgaggacgacgccgattactggaacgagctgaacaaccggctgacgcggaatctcgaagaactcgagttgatacgggagcgcatcagcgtcctgcaggaagccgagtcgcggcgaatcaccgaacggatgaaccgcaccatgtatctccttggtataatcaccggctttttcctgccgatgagcttcgtcaccggcctgctgggaatcaatgtcggcggcattccaggggcggatgcaccgcatgggttctggctggcctgcctgctgatcggcggggtcgccaccttccagtggtgggtatttcgtcggctgcgctggctctgacgtga

SEQ ID NO: 13624 - DNA, 831 bp, Pseudomonas aeruginosa
gtgaacatgcaattcgatatctggacccagagcttgctgaccgcgatgaacaccctgtggggcaagctggcaggcttcatccccaacctgctcggcgccctggtggtcgttctgctcggcttcgtcatcgccaagctgctcgatgcgctgctttccaagctgctggccaagctgggcctggaccggctgatgggtggcaccggcctgaccaagctgctggcccgggtcggcatccaggttccggtctcgacgctggtcggcaagatcgtctactggttcgtactgctcgtcttcctcgtatccgccgccgagtcgctcggcctgcagcgggtatccgccacgctggacgtcctcgccctgtacctgcccaaggtgttcggcgcggccctggtgctgatcgtcggcgtgctcctggcgcaactggtgaacagcgtcgtgcgcggcgcggcggacggcgtcggcctcgaatacgcgaacggcctggggcggatcgcccagtggctggtcatcatcatcagcatctcggtggcggtggggcagctcgaggtcaagaccgacctgctcaactacatcatcgccatcgccctgatcaccgtcggcctggccgctgcgctggccctgggcctgggcagccgcgaggtcgccgggcagatcattgcaggaatctacgtccgcgagctgtatcaggtcggacaacaggtgaaagtgggtgacgttgaaggcactattgaagagataggtacggtcaagaccatcctgctgacggaagagggagagcttgtgtcgctggccaaccgtctactgctcgatcagcgagttaccagccgctga

SEQ ID NO: 13625 - DNA, 321 bp, Pseudomonas aeruginosa
tgcgccacctcggcgcgatggccgggatcggcggcttcgcggtggccgggcagcaggttggccaggctgccggtctcgcgaccgcccatggcgttcggctggccggtgagggaaaacggcccgcatccggcgcggccgatcttgccggtagccaggtgcaggttgatcagcgcgctgttcttggcgctgccggcgctggactggttgagccccatgcaccagagcgaaaggaagcgcggcgaacggccgatccattcggcgcagcgctgcaggtcggcgcggtcgatgccgcagatgtcggcgacggcggccggggtgtag

SEQ ID NO: 13626 - DNA, 423 bp, Pseudomonas aeruginosa
gtctgcagggtgtcgttgaccaggatgccgcggttgcaggggatgcccgcgctttcggccagctcggtattggggcggatgccggcggccattaccaccaggtcggcgggaatcacgtcgccgtcgttgaactgcacggcacagacccggccgctgccgttgtccatcagttcctgggtctgggtgttcaggcggaagcggatgccgcgggcttccagcgcgccttgcaggagtttgccggcggtgcggtccagttggcgttccagcagccagtcggagaggtgcacgacggtcacgtccatgccgcgttgcttgaggccgttggccgcctccaggccgagcaggccgccgccgatcaccaccgcgtggctgtgggtccgggcgcagtcgatcatggcctgggtgtcggcgatgtcgcggtag

SEQ ID NO: 13627 - DNA, 3720 bp, Pseudomonas aeruginosa
gcgtcgacgaaggcgcgggtagtgccgaggaccttttccgggtggtccggccagatcgcctggctggtggcgatggtgaagccctggccctggtccacggccagggcgccccaggggccgccggcgcagaacccgtcgatgcgcccggcctggagatggccgaccatctgcgccggtggaaccaccacactgtgcacgtcgtgcagcgtatgcagaccgatgctcgggagcccagtagttcagccagagcgcgtgggtaccggtggggaaaggtctgccccagggtcaggcgtgcaccattctggcgccgatgccggagcagtgcctcccgcactggtcacgccagcttgcttcaggcggttcggaaagattgatcgcctggccgttttggcacagtcccatgagcaccgccatctcgcttgccgcgctgccgccgaggccgagctggacgccgtagacaagcccgtacaggcactgcgcggcatccagctcgccgctgagcagcttgtcgcgcaaggtggcccaggacggttggcgcctgagattgagcgtgaggccgtagggctgggcgaagccctgggtggcggccacgatcagcgaggccgaatcggtcagcgccatgaaaccgatgtccagggcgctcttttccggtgcgtcggaaccgccggcccaggcctggctgcgtatcgctctgtctgtcatcaccacctcaagtgcgggagggcggcgcgggccgtcccgttttccagtgcgccggcgccgtcgtcggcgcgcttttccatagctgccacagcaagcgctatgccaggcggcgcggggggtttcgccgggcaagaaaaagccccgcacggggcggggcttgttcgacgcgtcgctggatcaggcctggacgaccgggatcttggcgttcgcagccgcttcgcggaactcggcgatctggtcgaagctcaggtagcggtagacgtcggcagccatgctgtcgatgtccttcgcgtaggccatgtactcctccacggtcggcagtttgccgaggatcgaggagaccgccgccagctcggccgatgccaggaacacatcggtggcatcgcccagacggttcgggaagttacgggtcgaagtggagaccacggtggaaccggtctggacgcgagcctggttgcccatgcacagcgagcagcccggcatttccatgcgcgcgccagccttgccgtagatgccgtagtagccttcctcggtcagctggtgggcgtccatcttggtcggcggagccagccacagacgggtcgggatgccgcccttgaccttgtccagcagcttgccggcggcgcggaagtgaccgatgttggtcatgcaggagccgatgaacacttcatcgatcttgcggccctgtacgctcgacagcagacgcgcgtcgtccggatcgttcggcgcgcagagcaccggctccttgacgtcggccaggtcgatctcgatcaccgcggcgtactcggcgtccttgtcggcttccagcagctccggcttggccagccaggcttccatcgcctgggcgcgacgctccagggtgcgcgggtcgccgtagccttcgccgatcatccagcgcagcagggtgatgttggacttcaggtactcggcgatcgcctgttccggcagcttgatggtgcagccggcggcggaacgctcggccgaggcgtcggacagctcgaaggcctgctccacggtcaggtcgttgaggccttcgatctcgaggatgcggccggagaagatgttcttcttgcccttcttctcgacggtcagcaggccctgctggatcgcgtagtaagggatcgcatggaccaggtcacgcagggtgatgcccggttgcagcttgcccttgaagcgcaccagcaccgactccggcatgtccagcggcatcacgccggtggcggcggcgaaggccaccaggccggagccggccgggaacgagatgccgatcgggaagcgggtgtgcgagtcgccgccggtaccaacggtatcgggcagcagcatgcggttcagccagctgtggatgatgccgtcgcccggacgcagcgacacgccgccacgggtcatgatgaagtcgggcagggtgtggtgggtcttgacgtcgatcggcttcggataggccgcggtgtggcagaaggactgcatcaccaggtcggcggagaagccgaggcaggcgaggtccttcagttcgtcgcgggtcatcgggccggtggtgtcctgggaaccgacggtggtcatcttcggttcgcagtaggtgcccgggcgcacgccctggccttccggcagaccgcaggcgcggccgaccattttctgcgccagggtgaagcccttgccgctatcggccggtgcttccggcttgcggaacaggtcggaggcgcccaggcccagctcggcgcgggccttctcggtcaggccacggccgacgatcagcgggatacggccgccggcgcggacttcgtcgagcaggaccggggtcttcagctcgaaggtggtgaccacttcgccgctgtcgtggcgagcgaccttgccttcataggggtatacgtcgatgacgtcgcccatggccaggttggtgcagtcgaactcgatcggcagggcgccggcatcttccatggtgttgtagaagatcggtgcgatcttggtgccgaagcagaagccgccggcacgcttgttcggcacgaacggaatgtcgtcgccgaagaaccacagcaccgagttggtggcggatttgcgcgaggaaccggtgccgaccacgtcgccgacgtaggcgaccgggaagcccttggccttgaccgcttcgatctgcttcagcggaccgaccgaacccggctggaccggctcgatgccgtcgcgggccatcttcagcatggccagggcgtgcagcgggatgtccgggcgcgaccaggcgtcgggggccggggagaggtcgtcggtgttggtttcgccggggaccttgaatacggtgagcgtcagcttttccgggacttccggcttggccttgaaccactcgccatcggcccaggattgcagcacggacttggccgcggcattgcccttcttggcgcgctcggcgacgtcgtggaaggcgtcgaacatcagcagggtgtgcttcagctgttcggcggcggtgttggccagttcggcgtcgtccagcagctcgaccagggtggcgatgttgtagccgccctgcatggtgcccagcagctcggcggcacgttgcttgtcgataaggggggaggtggcttcgcccttgacgatggcggaaaggaaaccggccttgacgtaggcggcttcgtcgacgcccggcggtacgcggttggtgatcaggtcaaggaggaattcttcttcgccggccggcgggttcttcagcagctcgaccaggcctgcggtctgttcggcgttcagcggttggggcacgacaccctgggcggcacgctcttctacgtgtttgcggtaggcttcaagcacagtatttccctcatcagtggtcccgggggacacgtatccaggaaccgacgcagatccgctcgtcaggcccaggtggacggtaatccaccaacctacgagggcatcggcaggttccagacagaagctgttttcaaagttttacgccggcgggctggggtggggctggcgagacgcttgagggaggcgccgtcgccagcgtacctgccggaaactgtgctcgtgacgctttga

SEQ ID NO: 13628 - DNA, 513 bp, Pseudomonas aeruginosa
ttagacaaagggctaagatgccgctttgttttcgttgtcccggccatgtcttcgcaaagaatcaaaaccccctgcgtagggctttgctccacggtatacggcgacctggtatgccgtggctgcaagcgtttccaccatgaggtggtcaactggaacctctacgacgccgaggaaaagcgggctgtctggagtcgccttgagcagttgctggcccaggtgatggccgccaagctggaagtcttcgacgccgcgcgcctgcgcctgcaactggagcagcggcagatccgtttcgtccccgagcagtctccctattgctgggcctaccagttgatcgcccgcggttcccggctgatcaaccagatcgaagcctacggcgtggcactgctgccggaattccgcgactggagcctgccggacctgcgcgatgccatcgaccgggaattcttcctgctgtcggaagcgcattaccagcgctacatcgcgccctcgttcctgcaggcgatcgacagatag

SEQ ID NO: 13629 - DNA, 624 bp, Pseudomonas aeruginosa
gtgacctgcaccatgttgcccgagatcgaccaattccttgcctgttccactcccgccgcctgggtcgaggcggccctggagcgccaggacgtcatgctgctggaccacaaggcctgcgagatgaaggccgcggcgacggcgatgcaactgatcggcaagtactccggccgcctggacctggtgaacaagatgagccgcctggcgcgcgaggagctgcgccacttcgagcaggtgctggcgatcctgaagaaacgcggtatcccggtggtcaatgtcagcgcctcccgctacgcctcggcgctgcgcgacctggtgcgcaagcatgagccgcagcggctgaccgatacgctggtggtcggcgccttcatcgaggcgcgttcctgcgagcgcttcgccgccctggtgccgcacctggacgcggagctggcgaaattctacggcggtttgctgaagtccgagtcgcggcatttccaggactacctgaagctggcctaccagtacggcgacgaggccgacgtggagcggacgatcgaggtggtgcgggccaaggaggccgagctgatcagcagtccggacaacgaattccgcttccacagcggccacccggtgggcctggtggcctga

SEQ ID NO: 13630 - DNA, 1422 bp, Pseudomonas aeruginosa
gccggaaacaagaaagcgccccgcggggcgctttttttgctgcctggatcagtccttgaccttgaggtcgagggccaggtcgcgggcggccttggtcgccagaacgcccatcagctggccgatctcgtcctggcggctcgccgcgccgttggcgccggcgcccatcattacgctggggacgggggcctgggcggcggcttcggcccagaccttgttgatcgcgatcagcgcgtcgagcttcggctgcaacgcgccgtccgccttgatcaccgcttcgcgggcgtaagcctcggcgtcggcggtgatcttggtggcctgggcggtcaccgtggccttgtcgcgcagcagttcggcggtctgcttctcgatctcggcgcgctgcttctcgcgctcggcgttgatcaccgccaattgcttgtcggtttccgcctgggtggtgcgttcgatctggtcgcgcagggtttcctggcgcttggcctcgacttccttctcgccgcgggcggtgaccagcagcttttcctcttcttccttcaggcggttctgccgcgccaccgccagctcggcgagcgcctgctggaccttgaccatgcgctgcttgtactgcgggttgggatcgacgttggtgatccgcgcttccaccacctcgacgccgaacttgcggaactgctgttgcttgcgtaccgggatgcccttggcatcggtgaccttctcggtgacgaactggctggcgttgttgtcgccgaacgctccctgctcggtgccggcctggaggatcgcggtctggtgcggaatggcgccgcgcggcccgcggacttccttgcgcttgatcaggtacaggccgtcgttgagctggttctcgaactcggcggcgaattcgctgcgggctccggcgtagtagtcgtcggcgctcatcagcgaagcggtggcctggagggtttccttgatcgccggcaccagtgcggtgcggatgaaattgtccgggttgcggtattcctgggccatcttcaggaacggctcgccgccgggcaggcgaaagcgcgcggaagattcgaccttggcgtcgacgttgccgaggaacacgatcgggaaagcctcgatggtggcgccgaggccgtcgttgtccggattggtgtcgttatcgtccatgaccagcacggactgcacgctgatggccttcttccaggtggtggcgcgaccgaaccacttggtcgcgtagccgacgtcatcgacgatcttctcgtcgccgaagatggtccttacgtgggtcatgaagccggcttcgttatagaagaacacgccgttgaacaggccgaagccgagggcgagcatgccgaggggggcggcgacgaacttgatcaggtttcccttcgagatgatcacgatcattccttgatgcggggtgggggagcgcgatcctgctga

SEQ ID NO: 13631 - DNA, 1182 bp, Pseudomonas aeruginosa
caagatcatcaatcgcgccaacgagaacggcgagccgttcgatgtgctgaccgagcgcatgatcgcggcgatgcacgaggacgaggcccggctgaacatcctcaagccggaccaggagccacgcgccaccgatcacatcgccggcatgcacgcgatgatccagaccctgatcgacaagggctatgcctacgcgccgggcaacggggacgtgtactaccgggtcggcaagttcgctggctacggcaagttgtcgcggcggcgggtcgaggacctgcgcatcggtgcgcggatcgagccgggcgaagcgaaggaggatccgctcgatttcgtgctctggaagggcgccaagcctggcgaaccgagctggtcgtcgccctggggcgaggggcgcccgggctggcacatcgaatgctcggtgatgtccacctgctgcctgggcgattccttcgacatccatggcggtggcaacgacctggagttccctcatcacgagaacgagatcgcccagagcgaggccgcgaccggcaagccctacgccaagtcctggctgcactgcgggatgatcaccatcaacggcgagaagatgtccaagtcgctgggcaatttcttcaccatccgcgaagtgctggagaaatatcaccccgaagtggtgcgttacctgctgatcgccagccattaccgcagtccgatcaactactcggaggagaacctgcgcgaggccaaggcggccctggaccgtttctacaacgcgctcaaggggctgcccgaggcggcgccggcggaagcggcggagtatgtcgagcgcttcgccgcggcgatggacgacgacttcaataccgcgggtgcctgctcggtgctgttcgagctggcgcgggaggtcaatcgtctgcgcgaaagcgacctgtcggcggcggccgcgctggccgcgcgcctgaagcagttggctggcctgctgggggtgctgcaactggagccggaagccttcctgcaggcgggcgccgagggcaaggtcgatgcggccgaggtcgaggcgctgatccaggcgcgcctggaggcgcgggcggcgaagaactgggcggagtccgaccggattcgcgatcggctcaccgccatgggcgtcgtgctggaggatggcaagggcggcactacctggcgcctggccgactgaacccgcagcgataa

SEQ ID NO: 13632 - DNA, 546 bp, Pseudomonas aeruginosa
tgcctttcggggtgcaggggcgcaggaggggcatgcgctgggccaggcggccgatgttgtagggatggaaaccgtccacgtccttgtccgggtggatgcgctccagcagcagggaggcgtccaggtgggcgggcaggggtagctggaccaggatgccgtcgatggcggggtcgtcgttcaggcggtcgatcagggccagcaggtcgtcctggctggtttcggcgggaagatcgtaggcctgggagagaaagccgacttcctcgcagtccttgcgcttgtgcgccacatagacctgagaggccggatcggtgccgaccaggatcaccgccaggccgggaacgcgcaggccttgctggcggcgctcggtcacgcgttgggctatctgctggcgaaggttggcggcgatcgctttgccgtcgatcagttgtgcggtcatgtcggaagggtaaccatcgaatcgggtggaaaaaggacgcgcattttcgcatggacgccgcccggggcaaaggaggcgacccgtggatttgccgtaactcctttatatag

SEQ ID NO: 13633 - DNA, 2463 bp, Pseudomonas aeruginosa
ccccatcttaggctgaaaggtcttcctatctgtttcgtggccaagtgccgctgtagagccgacattatgaaaacactcgtcgaattgcccttgctgccgctacgtgacgtggtggtgtacccgcacatggtcatcccgttgttcgtcggtcgggaaaagtccatcgaggccctggaggcagcgatgaccggcgacaagcaaatcctcctgctggcgcagaaaaaccccgcggacgatgatccgggcgaagatggcctgtaccgcatgggtacggtcgctaccgtgctgcagttgctcaagctgccggatggcaccgtcaaggtgctggtcgaaggcgagcagcgcggccaggtcgagcgcttcatcgaggaagaagggcacattcgtgccgcggtccaggccatcgacgacgccaatgtcggcgagcgcgaggccgaggtcttcactcgcagcctgctgagccagttcgagcaatacgtccagttgggcaagaaagtccccgccgaggtgctttcctcgctgaacagcatcgacgagccgagcaggctggtcgataccatggccgcgcacatggcgctgaagatcgagcagaagcaggacatcctggagatcaccgacctgtcgtcgcgggtcgagcatgtcctggcgctgctggatgccgagatcgacctgctgcaggtggaaaagcgcatccgcggccgggtcaagaagcagatggagcgcagccagcgcgagtactacctgaatgagcagatgaaggccattcagaaggaactcggcgatatcgacgaagggcacaacgaagtcgaggagctgaagaagcgcatcgacgccgccggcctgaccaaggaggcgcacaccaaggccactgccgagctgaacaagctcaagcagatgtcgccgatgtcggcggaagccaccgtggtgcgttcctacatagactggctgctgaacgtgccgtggaaggccgagagcaaggtgcgccatgatctcgccaaggcggaagacatcctcgatgccgaccattacggcctggaagaggtcaaggagcgcattctcgagtatctcgccgtgcaaaagcgggtgaagaagctcaagggcccggtcctttgcctggtggggccgcccggcgtgggcaagacctccctggccgaatccatcgctcgcgccaccaatcgcaagttcgtgcgcatggcgctcggcggcgtgcgtgacgaggccgagatccgcggtcaccgtcgtacctatatcggctccatgccgggccgcctgatccagaagatgaccaaggtcggcgtgcgcaacccgctgttcctcctcgacgaaatcgacaagatgggcagcgacatgcgcggggatcccgcctcggcgctgctcgaggtgctcgacccggagcagaaccacaacttcaacgatcactacctggaggtcgactacgacctgtccgacgtgatgttcctctgcaccgcaaactcgatgaacatcccagcgcccctgctggatcggatggaagtcatccgcctgccgggctacaccgaggacgagaaggtcaacatcgcctccaagtacctgattccgaagcaggtccaggccaacggcctgaagaagggcgagctgaccttcgaggaaggcgccctgcgcgacatcattcgttactacacccgcgaagccggggtgcgcagcctcgagcggcagatcgccaaggtctgccgcaaggcggtgaaggagcatgccaagctcaagcgtatccaggcggtggtgtccagcgagacgctggagaactacctcggcgtgcgcaagttccgttatggcctcgccgaacagcaggaccagatcggccaggtgaccgggctggcctggacccaggtcggcggcgagctgctcaccatcgaggcggccgtggtacccggcaagggccagttgaccaagaccggatcgctgggcgacgtgatggcggaatcgatcaccgcggcgttgaccgtggtgcgcagccgcgcccagagcctaggaatcgcggcggacttccacgagaagcgcgacatccatatccacgttccggaaggcgctacgccgaaggatggcccgagcgcaggcatcggcatgtgcacggcgctggtttcggcgatcacgcagatcccggtgcgcgccgacgtggcaatgaccggggagatcaccctgcgtgggcaggtgctggcgatcggcgggctgaaagaaaaacttttggcggcgcaccgcggcgggatcaagacggtgatcattcccgaggaaaatgttcgcgacctgaaggaaattccggacaatattaagagtgatctggttattaaaccggttaaatggattgacgaagtcctgcaaattgcgctgcaatacgccccggagcccttgcccgatgcggctccggagatggttgcaaaggatgaaaaacgcgagcctgattccaaggagcgaattagcacgcattag

SEQ ID NO: 13634 - DNA, 312 bp, Pseudomonas aeruginosa
cacatagaaacatactcaacagaaataaggggacttagagtgaacaagtcggaactgatcgatgcaattgccgcatctgctgatatcccgaaagctgttgccggtcgcgcactggacgcagtgatcgagtccgtcactggcgccctgaaggctggtgactccgtcgtgctggttggtttcggcaccttcgctgtcaaagagcgcgctgctcgcaccggtcgcaacccgcaaactggcaagccgatcaagatcgccgctgccaagatcccgggcttcaaagccggtaaagccctgaaggatgctgtcaactaa

SEQ ID NO: 13635 - DNA, 2097 bp, Pseudomonas aeruginosa
gcgtcttttgggactcgttctacccaggtcggccaaggctggcctggctgcggagcggtagttcagtcggttagaataccggcctgtcacgccgggggtcgcgggttcgagtcccgtccgctccgccagttacgagaaggcgcatcctcggatgcgcctttcttatatccgcatctcttacccacgccgcgccgcccaagacggctggtcgtggcagtttttgggggctgcatgctgcagaacatcagggataattcccagggctggatcgccaagaccatcattggcgtgatcatcgttctcctgtcgctgaccggcttcgacgcgatcatccgggccaccgaccactccaacgtggccgccaaggtcaacggcgacgatatcagtctcaatgaagtccaacaggccgtggacatgcagcgtcgccagctgctgcaacgcctgggcaaggatttcgatccatccatgctggatgacaagctgctcaaggaagcggccctgaaggggctgatcgagcgtaccctgctgctccaggccgccaaggacgacaagttcgccttctccgaccaggcgctggaccagttgatcctgcaaactcccgagttccaggtcgacggcaagttcaacgcggatcgcttcgaccaggtcatccgccagatgaactacagccgcatgcagttccgccagatgctcggccaggaaatgctcatcggccagcttcgcgccggcctggcgggcaccggtttcgtcaccgacaacgaattgcagtccttcgctcgcctcgagaagcagacccgcgacttcgccaccctggcgatcaaggccgacgcttccaagagcagcgtgagcgaggacgaggtgaaggccttctacgaaggccacaagagcgagttcatgactcccgagcaggtggtcgtcgaatacgtggaactgaagaagtcctccttcttcgaccaggtcaaggtgaagcaggaagacctcgaggcgttgtaccagaaggaaatcgccaacctctccgagcagcgcgatgccgcccacatcctgatcgaggtgaacgacaaggtcggcgacgagcaggccaaggcgaagatcgacgagatcaaggctcgcctggccaagggcgaggatttcgccgcgctggccaaggagttctcccaggatatcggctcggccgccaccggcggcgacctgggctacgccggccgcggcgtgtacgaccccgcgttcgaggaggcgctgtatgcgctgaagcaaggtgaggtatccgccccggtgaagactccgtacggctaccacctgatcaagctgctgggcgtgcaggcgccggaagtaccgagcctggaaagcctcaagccgaagctcgaggacgaactgaagaaacagatggtcgagcagcgcttcgtcgaggctaccaaggacttggaaagctccgcctacgaagccgccgacctgagccagccggcgcaggaaatgggcctgaaggtccagaccagccagccgttcggacgttcggggggcgacggcatcgctgccaaccgccagatcgtgcagaccgcgttcagcgccgaggtgctggaagaagcggccaacagtggcgccatcgagctggatccggacaccgtggtggtgctgcgggtcaaggaacacaacaagccgaaggagcaaccgctggagcaggtcgcggcgaacatccgcgagcgcctggccgccgaaaaggccgccgaggaggcgcagaagcgtggcgaggccctgatcgcagagctgcgtgaaggccgtacctcttccgcagcgggggagtcgtggaaagtggtcgaggcggcctcccgcggccaggaaggcgtcgatccgaaactgctccaggcggtgttccgcatgcagcgtccggaggccaaggacaagccttcgctctctggcgtgaccctggccaatggcgattacgtggtgatccgcctgaatggcgtcagcgagccggaggaggctatctccgacgacgagaaggccatgtaccgccgcttcctggcttcgcgcagcggacaggcagacttcgccgccttccgccgtcagttgcaggacaaggcggaagtcgagaaatactga

SEQ ID NO: 13636 - DNA, 252 bp, Pseudomonas aeruginosa
cgtcgagcgcggtggtcggttcgtcggcgatcagcagttgcggctcgcaggccagggccatggcgatcatcacccgctgccgctggccgccggagagttcgtgtggataggctttcaggcgcttggccggctcggggatgccgaccagctcgagcagttcgagaattctcgcgctggccttggcgccacccaggcccttgtgcagggcgaggacctcggcgagctgcttctcgatggtatgcagcggattga

SEQ ID NO: 13637 - DNA, 3138 bp, Pseudomonas aeruginosa
tgcacgaccagcggtttgtcgttggcgatcagttcggcgccgaggctgccgacgaacaggatgaggaacagccagagcgaccaccagccacgcttgttgctcttgaagcgggcccagcggcgctggttgatgggagacaggcgcatcggattactcccggttctcgaagtcgatgcgcggatcgaccagggtgtagacgatatcgctgatcagcttcatgaccagcccgaacagggtgaagatgaacagcgtgccgaagaccaccgggtagtcgcggttcatagccgcttcgaagctgagcaggccgaggccgtcgagggagaagatcacctcgatcaacagcgaaccggtgaagaagatccccagcagcgcagccggcaggccggcaatcaccagcagcatggcgttgcggaatacgtgcccgtagagcacgcggcgttcggtcaggcccttggcgcgggcggtgaccacgtattgcttgccgatctcgtcgaggaagctgttcttggtcagcagcgtgatggtggcgaagttgccgatcaccagggcggttaccggcaaggccaggtgccagaaatagtcgagcaccttgccgccgaggctgagctggtcgaagttgttcgaggtcaggccgcgcagggggaaccagtcccagtagctgccgccggcgaacagcaccaccagcaggatggcgaagaggaaggcgggaatggcgtagccgacgatgatcgccgagctggtccagatgtcgaagacgctgccatggcggaccgccttggcgatccccagcgggatcgacaccaggtacatgatcagcgtgctccagagcccgagcgagatcgacaccggcaatttctcgatgatcaggtcggtgaccttggcgtcgcggaagaagctctgcccgaagtccaggtgcaggtagttcttcagcatgatcatgaagcgctcgggggccgacttgtcgaagccgtacatgcgctcgatctctttcaccagctccgggtccaggccttgcgcgccgcggtattgcgagccggccacggcgacttcgccgccgccgccggagatgcgcccggtggcgccgccggaagcggcgtcgaagccttccagcttggcgatcatctgctccaccggaccgccgggagcggcctggatgatgatgaagttgatcagcaggatgccgaacagggtagggacgatcagcagcaggcgccgcaggatataggagagcatgcggcgttactcccgttccggctcggcgtcttgcgtggcttcggcttgcgccttgctcggcagcgccttgtcgctggtctgccaccaggtcatcaggccccagtcgtagagtggcgtcaccttcggccggccgaaacggttccagtaggcgacccgccaggtatcgacgtagtagttaggaaccacgtagtagccccacgacagtacgcggtcgagggcgcgggtatggtcgatcaggctttgccgcgagtcggactggatcaggctttccaccaggctgtcgatggccgggtccttgaggccgatgaagttgcggctgccggccttgtcggcgctgctggaatgccagaactctcgctgttcgttgcctggcgagttggattgcggccaggtcgccgaggtcatgtcgaaatcccgcgagcgcaggcggttgacgaactgcgagacgtcgacgcgacggatctgcatgtcgatgccaagttcggccaggttgcgcttgaacggcaggatgacccgttccatgttggcctggaacagcatgaactcgaagctcagtggctggccgtcgggacctaccatgcggttgttctcgatcctgtagccggcctcggtgagcaactggtaggccttgcgtcgctgctcgcggatcaccccactgccgtcgttgaccggattctggaagacctggtcgaaggcctcgtcgggaatcttgccgcgcagcggttcgaggatcttcagctcggcttcgctgggcaactggtgggcggccatctccgagttctcgaaatagctgttggtgcgcttgtaggagctgaagaacagctgcttgttcgaccattcgaagtcgaacagcaggctgatcgcctggcgtacccggcggtcctggaacaccgggcggcggatattgaaggcgaagccctgcatccccaccgggttgtggttgtggatgctggccttgatgaagcgcccgtcgcgcaatgccggcgactcgtagccggtggcccagtccttcgccgaatattcgaggttgacgtcgtactggccggccttgaaggcttccagggcgaccgacatgtcgcgataggagtcgatggtgatggtgtcgaagttatagagtccgcgggagaccggaaggtccttggcccaccagtccttgactcgctcgtagctgatggagcgtcccggatcgaccttggcgatgcggtaggggccgctgcccaccggaatttccatgccggtcttggaaaagtcgcggtcggcccaccagtgtttcggcaggatcgcgatctggccgaggatcagcggcagttcgcggttgccggcgtgcttgaagtcgaagcgcacgcgaagcttgtcctcggcgaccaccttgtcgacgtccgcatagtagttgcggtacatcgggtcgcccttgctcaccagcgtctcgaaggtgaacaccacgtcttcggcggtgaccggcgtgccatcgctgaaacgggcctgggggcgcaggtagaagcgcacgtagctgttgtccggtgccttctcgatcttctccgcgagcaagccgtattcggtgaacggctcgtcctgcgactggaaggccagggtgtcgtagatcaggcccagcgaaggggccgagacgcccttgccgatgaacgggttaaggctgtcgaagccgccgaagtcggcctggcggaggatgccgcctttcggcgcatccggattcacgtagtcgaaatgcttgaaatcggcgggatacttcggaggctcatcgtagagcgtcagtgcatgtttcggggcggcgaggagcgggccgcagcagccgagcagcagggctgccagcagaggggtgaagcggggacggatcatcgggacgtctccaggtttttctgccaccacgcgcgcaggcccagggtgtag

SEQ ID NO: 13638 - DNA, 1275 bp, Pseudomonas aeruginosa
tattgcttattttcccgtcgtgccggcgtccgtcgccgcgaaggggaagacgctggaggtacgcatgaacgaaccgcaagccttcgcccagaccgatgccgagtggctggcatcgatcaaccgggcgcgcgactggttccagggcccgctgggcagcctgatgctggccgaggagcgacgcctgttgtgcgacgagctgacccgttacttcggtggctacctggtgcactacggaccgcatgccgaactgccgccgagcaccgggcagattcagcgcggtgtgcgcctggggccgccgctgccgggcgtggacatcgcctgcgaagagggcgcctggccgctcagcgaacatgccgcggacgtggtcctgctgcaacacggcctggatttctgcctgtcgcctcaccgtctcctgcgcgaagccgcgcgtaccgttcgtccgggcggccacctgctgctgatcggcatcaacccatggagcctgtggggcatccgtcattatttcgccggggatgccttgcgccaggcccgctgcattcctccgtcgcgggcctgcgactggctcaacctgctgggcttcgcgctggagaaacggcgcttcgggtgctatcgtccgccgcttgcgtcggcagcctggcaatcgcgcctggctcgcctggagcgctggggcgacgcctggcagtcttcgggcgccggcttctatctattggtggcacgcaagctggtcgtggggttgcgcccgttgcgccagagcaagcgcgaaccgcgcggtcagctggtgcccatgccggtggcgaaagtcagccggcgagattccgaaatttaggcatgacagataaagaacaggtagtgatctataccgacggcgcctgcaagggcaaccctgggcgcggcggctggggggcgttgctcctctacaagggcgccgagcgagagctttggggcggcgagccggacaccaccaacaaccgcatggaactgatggcggcgatccaggcgctggcggcactcaagcgttcctgtccgatccgtctgatcaccgactcggaatacgtgatgcgcggcatcaccgaatggttgccgaactggaagaagcgcggctggaagaccgccagcaagcagccggtcaagaatgccgacctctggcaggccctggatgagcaggtcgcccggcaccaggtggagtggcagtgggtccgcgggcataccggcgatcccggcaacgagcgggccgaccagttggccaaccgtggcgtcgccgaattgccgcgctga

SEQ ID NO: 13639 - DNA, 462 bp, Pseudomonas aeruginosa
cgatccgataagcgctgcgcatcgttgtcgctccgtagcagggcagagaggtccatgctcctcgctggcgggagaggaggcaagcgcggcgcgccgacttgtgttgccgcgaccttttcttacaagggcaagccgccgggggttacgcgcgtgccggcaagtctctaccctgagccgaccggcggggttcgcccgcctgctgctcgggatcaacaatgtataaagacctcaaatttcccgtcctcatcgtccatcgcgacatcaaggccgacaccgttgccggcgaacgcgtgcggggcatcgcccacgaactggagcaggacggcttcagcattctctccaccgccagctccgccgaggggcgcatcgtcgcttccacccaccacggcctggcctgcattctggtcgccgccgaaggtgccggggaaaaccagcgcctgctgcaggatgtggtcgaactga

SEQ ID NO: 13640 - DNA, 918 bp, Pseudomonas aeruginosa
tgcagcatcgacatttggctcgcccttgttatagttgcgggattttccgcacaacaaaaatctctgcgttctgacagcgcagttgctctgccgaggactatcgccgtgaccgagtacaacgcattccgtgtggagctggcagacaagatcgcccacgtccagatcaaccgtccggacaagatcaatgccatgaaccaggacttctggcgcgagatcatcgagatcttccgctgggtcgacgataccgacgaagtgcgggtggtcgtgctgtccggggcgggcaagcatttttcctcggggatcgacctgatgctgctggcccaggtcggcagccaactgggcaaggacgtcggccgcaacgccgacgccctgcgtcgcaagattctcgagctgcaggcctcgttcaacgcggtcgacaactgccgcaagccggtgctcgcggcgatccagggctactgcctgggcggcgccatcgacctggtctcggcctgcgacatgcgctactcgaccgccgacgcgcagttctcgatcaaggagatcgacatcggcatggccgccgacgtcggcaccctgcagcgcctgccgcggatcatcggcgatggcatgatgcgcgagctggcctacaccgggcgcatggtcgacggcgaagaggcacggagcatcggcctggtcaatcgtacctacgcggaccaggccgcattgatggatggggtcttcgaactggcgcggcagatcgccgcgaagtcgccgatcgccatccgtggtaccaaggaaatgatccgctatatgcgcgaccaccgggtcgacgacggcctcgagtacgtcgctacctggaacgccgccatgctccagtccgccgacctgcgggtggcgatggccgcgcatatggccaagcagaagccggaattcgctgattga

SEQ ID NO: 13641 - DNA, 1728 bp, Pseudomonas aeruginosa
tgccgttgtatattcttgcgcgggaggcgcactaggccgatggtcacaggagccacgtccctcagtctggtgcgcgacgagttgttcgccaccatggaacaggccgaacagggtcttgagcagttcattgccgagcggcagaacggcagcctgctgcagcacgccgtcgaatgcctgcaacagatccgcggcaccctcaacctgatcgagctggccggcgccgagctgctggcccaggaagccctgcagctggcgaccgacattcccaccggcgtcagcgaggagcgcgacggccagctggcagccctgggcaacgccctgtacgtgctgcgccgctacctggagaacgtcgaggccaatcgccaggagatccccgagctgctcttgccggcgatcaacgaagtgcgctgtgccgcagggcagccggcgctgccggaaagcttcttcttcagcgcccgcctggatatcccgcggccgccgagcactgccatcgaccacctgccttccgaagccgaactgggcgaggaaagccggcggatgcgccacatgtaccagatcggcctgctcggcctgatccgcgaacagaacctctatcccagcctcaagctgatgggccgcgcgctggcgcgcctcgacagcctgcacggcggggtggcccgttcgcggctgtgctggatcggcgccgcggcgatcgagtcgatcgtcgatggccaactgttgccgcgcaagtcgcgcaagcaactgttctcgcgcatcgaccgcgagctcaagcaattgctgatcggcccggcctacgaggcgccgcgccatctgctcaaggaactgctttacctggtggcgctgtccgacggccagggcccgcgttcgcgcgaggtccgcgaactgcatgggctggcgccgctgccgttcaccgaccacctgctggaagaggaatcgcagcgcctgtccggccccggccagtcggtgatgcgttcgctgtccacggcgatccgcgaggaactcgccggggtcaaggacatgctcgacctgatcgagcgcggcgtggcccagccggatagcctgaccaacctgcatgcgcaactgggcaagctgagcaagaccctcggcatggtcggcctgaactcggccggcaccgccctgcagacccagctacccaccgtggccgcctgggctgccagcggcgtcgccgattcgccgccggcgttgctgcgcctggccgatgcggtgctctacgtggaaagcatggtcggcaacctcgaacgcggcgagcgccgcatcatccggccgactccggcggagcccgggcaggaagccgatgcgttcgccgtgcaccagttggccgaggcgcgcatcgtggtgatcgaggaggccaaggccggcctggccctggccaagcgtgcgatcaccgcgtacctggaatccaatggcgacaagctcaacctggccaacgtcccggccagcctgcaggcggtccggggcggtctctggttcctcggtcaggagcgcgccgcgctgctggtcggcggctgcgccgactacatccagcagcgcatgatcgagaccgcgcagatgccttcggagcagatgctggaaaccctcgccgacgccctgaccagtctcgaatactatctcgagggcggtgccgtgctgcgtccgcagggccagccggacgtcctcgacctggccagcgccagcgtcaaggcgctcggactgccggtggccgcctga

SEQ ID NO: 13642 - DNA, 678 bp, Pseudomonas aeruginosa
tgcccgcaatttcacgcagaaggaatcgcttgcatgcagtacgacggtctggcctgggcattcgcgttactggccttgctggccgccctggtcgcggtgcgcatcctcttcgaacgcacctggttcctcggctggctgcgcggcacctgcggcttggccttcgtcgccgtggcggcgctgctgctggtgctcgcctgggacctgcgcagctattcgctgctcaagcccgagcagccgatggccaccctgagcttccaggccgaagggccgcagcgctaccgggtgctgatccaggagggcgccaacgagcgcagcgtggtgctggacggcgaactctggcaactggacgcgcggattttccgctggaaggggctggccgcgttgatcggtctggcgccgggctatcgcctcgacgcgctcagcggccgcttcctggccctcgagcagcagtcccggggccgccgcctgggcttgtcgcagagtccgctgggggtcgatctctggcgctggctgcgggccggcgagcacgacctgttcctgttcgagccgctggcggggcgggtgactttcctgccgatggcggacaaggcggtgttcgcggtgaactacggcgtcgccgggctgcttgccgagccgatgaacctggcggccgaggaggcgctcagggactggcgctag

SEQ ID NO: 13643 - DNA, 1038 bp, Pseudomonas aeruginosa
agagggggttgtgtggagttcattgccgaatatgcgggctttctggccaggaccgtgaccgtgctggcggcgatcatcgtggtgctggtggtgatcgtcgccctgcgcggccgcggccggcgcggcgcaggcgggcacctcgacgtgcagaagctcaacgatttctacaaggacctgcgcgagcgggtccgccacagcgtcctcgacaaggccagcctcaaggccttgcgcaaggaggagagcaaggcggcgaagcaggcgaagaaacatcctgaacagaagtcgcgggtctacgtgctcgatttcgacggcgacatcaaggcctcggctaccgagcaactgcgccacgaagtgactgcggtgctgagcatggcgggcaaggacgacgaggtggtgctgcgcctggaaagcggcggtggcatggtccatggctacggcctggcggcctcgcaactggcgcgcatccgccaggccggcgtgccgctgaccgtgtgcgtcgacaaggtggcggccagcggcggctacatgatggcctgcatcggcgatcggatcctttccgcgcccttcgccatcctcggctcgatcggcgtggtggcgcagttgcccaacgtccaccggctgttgaagaagcacgatattgacttcgaggtgcttaccgccggcgaatacaagcgtacgctgacggtattcggcgagaacaccgagaagggccgggaaaagttccaggaggacctggaggtgacccacgaactgttcaagaacttcgtggcccactaccggccgcaactgaacatggacgagatcgccaccggcgaggtctggctgggccaggccgcactgggcaagctgctggtggacgaactcaagaccagcgacgagtacctggccgagcaggccagggagcgcgatgtctaccaggtgcaattcgtcgagcgcaagagcctgcaggaacgcgtcggcctggccgccagcgtggttatcgaccgcgtgctggtgacctggtgggggcggctcaaccagcagaagttctggcaatag

SEQ ID NO: 13644 - DNA, 1086 bp, Pseudomonas aeruginosa
gccggcgccgacagggacgaacacgctgtcttcagggttttcacgagaggaggtcgaaatggctgtattcaaggcgttgtgggtgacggaagcgccccacggcgtttacgaaacgcaggtggtcgagcgcgataccggcgacctgccggcgggcgacgtactgatccgcgtgcagtattcctcgctgaactacaaggatgcgctgtccgccagcggcaaccgtggggtgacccgcaagtacccgcatacccccggcatcgatgccgccggtgtggtcgccgagtcctcggtggccgagttcgcggccggcgacgaggtgatcgtcaccggctacgacctgggcatgaacaccgccggcggtttcggccagtacatccgcgtgcccgcggcctgggtgatcaagcgcccgcaaggcctgagcctgcgcgaggcgatgatcctcggcaccgccggcctgaccgcggcgctctgcgtcgaaaagctggagcgcagcggcctgcgccccgaccatggctcggtgctggtcaccggcgccagcggcggggtcggcagtatcgccgtggaactgctggccaagctcggctacaccgtggcggccgccaccggcaagctggagcaggccgagttcctcaaccgcctgggggccaagcagattctcgatcgcgccaccgtggccgatggcgtcgacaagccgttgctcaaggaacagtgggccggcgcggtggacaccgtcggcggcgacatcctcttcaacgtggtcaagtcgttgcagtacggcggcagcgtcgcctgctgcggcctgaccgccggcgccggcttcaaggcctcggtgctgccgttcatcctgcgcggggtcaacctgctcggggtggactcggtggagctgccgctggtggtcaaggcatccatgtgggacaagctgtcgctgcaatggaagctcgacaacctcgaagaggtggcgcgcgagatcgccctcgaagagctgccgggggcgatcaaccagatcctcgccggcaagctggtcggccgggtgctggtcaacctcggctgagggcgttaccggagcccagctccggcaacaggtag

SEQ ID NO: 13645 - DNA, 222 bp, Pseudomonas aeruginosa
ccgcttcgcaacggcgcctttcttgagcgatgggcggcgctggtcttaactggagagtgcctttcgatgtcttcgtcccgatacccacaagaaacagggggagtcatgagcgagccgagcaaaacccaggaaaaccgcgacagcgtggtcgacgcccgcgcggccttcgtcctgatcctgctggtggtggctaccgcggtgttctgggtcagccaccagtga

SEQ ID NO: 13646 - DNA, 576 bp, Pseudomonas aeruginosa
cgcgcaagccgaacttcaagtggacgatcaagttcgtgcgccgttccggttcgcagttcacctgagggcgcgcgtcccatgagtgcgaaaatggacgagcaggcgcttctggcgttgctccgcgagctggccatcgacagccagcgggtcgagcatccggccatcgcctccatcgaggaatattacgcgcagggcatcgaattgcccgaccagggcatcaagaacctgttcctgcgcaaccgcaagggtactcgccactacctggtgctgctcgacgagcgcaaggaggccgacctgccgggcatcgccgaacagatcggcgaaagccgcctgtcgttcgcctcggtcgagcgcctgcgcgaatacctcggcgtcgaactgggctgcgtgacgcctttcgcgctggtcaacgatccgcggcacagggtcgaggtgttgctcgacgatgccattcgccaggaccagttgctcggtttccacccgttggtgaataccgccaccgagtgcatccgctacgcagacctgctggcctttctcgcccacacggggcatgaaccgcgcctgatccgggtgtag

SEQ ID NO: 13647 - DNA, 1344 bp, Pseudomonas aeruginosa
actgtcggcatatttgcgaggagttgccatgagcgccatcaccattaccgaagctgcccaagcgtatctggccgagttgctggagaagcagagcaccccgggtatcggcattcgtatcttcatcacccagccgggtacccagtacgcggaaacctgcatcgcctactgcaagccgggcgaggaaaaggtcgaggacaccgccatcgccctgaaggacttcactgcctggatcgatgcggtcagcgagcccttcctcgaagacgcggtggtggactacgccaccgaccgcatgggcggccaactgaccatcaaggcgccgaacgccaaggtgccgatggtcaacgaggacagcccgatcaccgaacgcatcaactactacctgcagaccgagatcaatcccgggctggccagccacggcggacaggtgagcctggtcgacgtggtcgaggacaacatcgccgtgttgcgtttcggcggcggttgccagggctgcgggatggtcgacatgaccctcaaggatggcgtcgagaagaccctgatcgagcgtattcccgaactgaagggcgtgcgcgacgtgaccgaccacagcaacaaggagaacgcctactactgaggcgtttccgtaaggcagaagaggcgaccgcaaggtcgcctttttcgttgccggcgtttcagcgcgacagcgtccgcgttcgtcgtaccggccagagcagtgtcagcgccaccagcagcgccggccagaccagcaggttcaccgcgttccagccaaggctggtgatcagggcgccggagccgaacgacatcagcgccgccaccaggctgttgccttgctccatcaatccttgcgcggcgccgcgctcgctttcggcgtggccctcgccgagcagggtggtgccggcgatgagcatcaggttccagccgctgcccagggccagcgaactgagcaggaaatgcgtgaccgactgcccgtccagggcgatgccggcacttgcggcgagcaggaacgcgccgagcagggcgacgcgacggttgccgatgcggtcgaccagcggtccggcgaagaacgccggaaggaacattcccagcacgtgccactggatgacccgactcgactgttccagcggcaggccgcagaagctcatggccagcggcgtggcgttcatgatcaggatcatcaacccgtgtccggccgcggtgcaggcgatggccgcgcggaccaccggccgccgcaacaggccgcctatgtcgcgccaggcgagtcgtgccgggcgtggcgcctggccttcgcggagcagagccatcagcagcaggccggcgagggccagcacggcgatcagcagatag

SEQ ID NO: 13648 - DNA, 1251 bp, Pseudomonas aeruginosa
tccgtatgcgcgccagttgcgcaccggctttcgttggttgcggttcgaaaaggagctggaaaacgagtttcgcgagtttctcagctggaactcgctgatgcagcggcgcgctgccatcggggtggcgttcctgatctgggcgctgttcatcgtggccgactggatgatggtggacatccgcctgcaccccagcctgttcgagcaactgctgggcgtgcgcctgggaatgatcggcctgctgctggtggtctggccggcggccttcctgcccagcctgcgcaaggtcggcgatgccatcgcgccctactgcctgctgctgatcaacctggcggtgctggcctgcgacgtgctgttcgagtggcatggggtgccgcgcttcacccaactgggcgcgaccctgggcatcctcgcggtgttcttcccgctcggcctggcgttctgggcctgcgtgcgcctggcgttgctgtgcctggccctgaacctggcggtattcctgcttttcggcggcgaagagaacctgcgtaccaacctgctgaatacgctctacaacggcctggtggtgctgatctgttcgttcgccctgtacctgcaggactacgcccagcgcgagcagttcctcggccggcggctgctgggcatgatggccgaacaggacagcctcaccggcctggtcaaccgacgctactacgagctgctcgcccagcgggccctggagcagggcgcccgcgaagaaaagggagtggcgctgatcctggtggatgtcgacgacttcaaggcctacaacgaccactacgggcatccggccggcgatgccgccctgcgccagcttggcgtcgtgctccggcagggcgcgcggcggccgctggatatcgccgcgcgcctgggcggggaggagttcgccgtgttgctctacgacagcgaggagggcaacaccctggccatcgccgagcgcctgcggcaggcggtggaggcgctgggcatcgagcacctgggctccagcgccggcccctgcctgaccatcagcctgggggtggcctattcgacctccggcatgggcctggacgcgctctatcgcgaggccgaccgcgcgctctacgaggccaaggatgcagggcgcaacgcggtgcgcgtggcgttccggcagcacgaccgcctcgaatagaggaaacgaaaaaaggcgcccgtgggcgcctttcgtcgtatggaacggctcagccttggctgggcatactccagtcctgcaggttgtag

SEQ ID NO: 13649 - DNA, 672 bp, Pseudomonas aeruginosa
ctggatgcggcgcctgcgcgaggcgattcccggccacgccgtgcgggtcgagatcggccagggtgccgacctgctcaagcaactggagcagggcgcgctggacgccgcgctggtctaccagccggaatactggccggggctgcaggtcgagcagttgctggaggaaaagctggtgatggtgcgttccgtgctatccgcggagccttatctgtatgtcgactggggcccggatttccgcagccagcacgatgccgcgctgccggaccgggccaaggccgcgctagcctgcaacctcggtccgctggccctgcagtacatcatgcagaacggcggcagcggttatttccgtacccgggtggtgagcagctacctggatggcggcaccctgcaacgggtcgagcaggcgccggagttcgcctacccgacctacatggtgtactcccgcgagcgcctgtcgccgaccctgcgccatgcgttccagttgctgcgcgaagtggtccgcgaggacagcgactggtcgcagcgctgggactacgtgatctgatcggcctggcccaggtgctgcagccagttgcggtagagcgcggcgatcaggtcggtctggctgacgatgccgaccaggtagccggcttcgttgagcaccggcaggcagtgcaggccttcgtcggatag

SEQ ID NO: 13650 - DNA, 1452 bp, Pseudomonas aeruginosa
gaggggagctttattcgtctccaacgaataatgttgctattacagtgcaaaattattgaattgaaacggaggaggacttccggggcagggcgcacaaccgcttcgtgggatgtgcgccagggcggctatccgccctccgcgatggcgctgccggcgatggcaggctcagccagtctttttcttcttcggcagcaggcgcttgaccagcagcaccaccgccaggaccaccgcgccggcgacgatgccgaacaggaagttcagcagggtcggggtgatcgccgccagcatcgggcccagcgtggcgatgccggcgacgctctgcgcggcctgttcgatggcgtggtggaccaccgggattccgtgggtgaggatgccgccgccgaccatgaacatcgccgccatgccgaccaccgacaggcctttcatcaggtacggcgcggtgcgcaggatggcgccgccgagcccttgggcgaagccgctgtcgcgcttggacagatagaggccggcgtcgtccagcttgacgatgccggcgaccaggccgtagacgccgatggtcatcaccagggcgatgccgaccagcaccagtacctgggtggtgaagctggactcggcgacggtacccagggtgatggcgatgatttccgcggagaggatgaagtcggtacggatcgcgccgccgatcttctgcttttccagggcggccacgtcgacattggccgccagcgctgcctcgtcggcgtgctcgtcgtcatggggcaggtatttgtgggcgatcttctcgaagccttcgaagcacaggtaggcgccaccgagcatcagcagcgggatcaccgcccagggcgcgaaggcgctgatcaacagcgcggcggggacgaggatcgccttgttccgcagcgagcccttggctaccgcccagaccaccggcagttcgcggtcggcgttgaccccggtgacctgctgggcgttgagggccaggtcgtcgccgaggacaccggcggtcttcttcgcggcgaccttggtcatcagcgagacgtcgtcgagcaccgcggcaatatcgtcgaggagggtgaggaggctggctccggccatcttgggtttccttactgggtggtgggcaccgccatcttggcggggtgtgtatttgacaccggatcgcggcggcggaacagtgcctcgcgttggagcgcgggagccgccgcacagttcattggcgcaggcgttcgagcgaggtttgccagggccaggcgggcgatggccagctcggcttcggtctcctcgcggctgccgtcctcgtcgaaccaggccgccgagagtccggtccaggccaggatccattgcagcaggcggcggcgctgcaggccgctggcggcgattacgatctccagctggcgctcgaaacggccgggcgcctgggcggtcttcgcgtcgggattggtgaacaggttggcgtag

SEQ ID NO: 13651 - DNA, 1467 bp, Pseudomonas aeruginosa
gcgcggcggaagcgcaggcgcaggccgtccatctcaggcccagcccggccggcggcgccggcccgaatagagggcgaggaggacgacgaaggagaacgccaccatgccgccggccaggcagtgggcctgggcgtattccatggcttcgacgtgatcgaatatctgcaccgagaccacgcgggttttctccgggatgttgccgccgatcatcagcaccacgccgaactcgccgacggtatgggcgaagccgaggatcgcggcggtgacgaaacccggccgggccagcggcaggaccacgctgaagaaacggtcgacggggctcgcgcgcagggtcgcggcagcctccagcggtttctcgccgatcgcctcgaaggcgttctgcaacggttgcacgacgaagggcagcgagtagaacaccgaaccgaccaccagaccggcgaaggtgaagggcagggtgccgagaccgaggctctgggtgagctggccgatgaaaccgttgggacccatgctgaccagcaggtagaagccgatcaccgtcggcggcagcaccagcggcagggccaccaccgcgccgatcggccccttcagccaggagcgggtgcgcgccagccaccaggcgatgggcgtgccgatcagcagcaggaggagggtggtgagcgaagccagctcgatggtcagccagatggccgccaggtccgtactgtcgagtggcaacgccatgcaggtcccgccttagagttcgtagccgtaggacttgatcagcgcggcggccttggcgcccttcaggtagtcgaccagggccttggcggcggcgttgtccttgcccttgttgaggatgaccgcgtcctggcggatcgggtcgtgcagctcggcgggaacgatccaggccgagccggttgcgactttaccatccttgtagatctgcgacagggcgacgaagcccagttcggcgttgccgctggaaacgaactggtaggcctggctgatgttctggccttccaccagcttcggcccgagcgtggcggcgaggccgagcttgtccatcgcctgggtggcggcgaggccgtagggcgcggtcttcgggttggcgatggacaggtgcctgaagctgccactcttcagcacttcacccttggcgtcgacgtagccggccttgggcgaccagagtgccagggtgccgatggcataggtgaagcgcgagccgggcacgatctcgccttcctgctccagtttcgccggagtgctgtcgtcggcggagaggaaaacctggaacggcgcgccgttcttgatctgcgtatagaactggccggtggcaccgtaggcggcaaccagcctgtgcccggtgtctttctcgaattccttggcgatggcctggatcggcgcggtgaagttggccgcgacggcgacctgcacctcgtcggcgctggcggccagggatacggcgctggcgaggagggcgagcaatag

SEQ ID NO: 13652 - DNA, 1089 bp, Pseudomonas aeruginosa
acagtaccaggctccgcttcccgtgaattccccagcgcttcccgaacccttctactacctgcacaacttccgcgcggtgctcgcctggatcggcgaacgctatgccgatctgctcgacgatcaggaacgtgccttcatcgccgcgttcgccgagctgcccgaggccagccaggccctgctggtgcgcatggtgatgcgcaagggcacgctgttccgcgaaggcaagctggcctatgccgagatcggcgacacgcgcgccgccgtgcaaccgctgttggcattgggctgggtggacgcgcagccgaccctggaactggcgcaactgttcggcttgctgaagaaggacgaattgtcgcagctgttcagggaccatctcgggcgcgcgaacctgcgcaaggatgcgctgctggaacggctccagccgttgttccccgaggcgcggcggctcgccgagtggcaggccgacttcgccgaaccggtctacgagttgcgctgcatggcgctctgcgaccgcttgcggttgatgtatttcggcaacctgtggcaggactggtcggagtttgtccttgccgacctgggtatctatcgttacgaaagcgtcgagttttccgccgactcccgcggctttcgcctgcgcgccgacgtcgacgcctatctccacctgttcgattgccgccagcgcttcgacctcggcgagccgctggaggaactgctcgccggcctgccgggcgaaccctacgccaatccctggctggaagggcggcgggtcaagctgctgttccagttcgcccagcactgcgaaaagcagcgggatttcgacctggcccagcggctctatcgccaatccagccaccccggcgcgcgcctgcgggcgattcgcagcctggaacgcggcgagcgcttcgccgaagcccatgcattggcgcgggaggccagctgtgcgccggaaagcgacgccgaacgccagggcctggcccgattgctgccgcgcctgcaaggcaagctcggcctgccgcgacaggcgcgggcggcggctccggaaatcgaccgcctggacctgtgcctggcgttcccgagcgaaccctgtag

SEQ ID NO: 13653 - DNA, 1047 bp, Pseudomonas aeruginosa
ggaaaccgctggagcgcatccagcgtgcctggaacgaactggccaagacccaggcggacgactaccaggcctacgacgagcctccgcagaagctgctcctggccttgcagaacgcggtggcggcgatcaacgacctgctcgccgagcaaccgcaggcgctggagccggcgttgcaggagttctacttcgcgatcctgcagttcggccgtctcgccgagctgttcggcgagcattcgctgttcgacatcgagaagcgcccaggccgcaacggccgcagcctggcccggctgtgcctgcgcaacgtggtgccggcggcgtttctcgccgagcgcttcgccgccagccgctccaccgtgctgttctccgctacccttgggccgcgcgactattacgccgacctgctcggcctgccggcgggcacgccctggctggaagtggactcgccattcagcgccgagcaactggaggtgcacatacagcgtcgggtttccacgcgctatgcgcagcgccaggcatccctggcgcccatcgcagcgattctcggcgagcagtttcgccagcggccgggcaactacctggccttcttcagcagcttcgattacttgcagcaggcgctggacgtcttccgccaggcatacccgtgggtgccgtgctggagccagacgccacggatggacgaggcggagcgccgggtcttcctcgagcgcttcgtcgcgggcgggcgagggcatcggcttcgccgtgctcggcggtgccttcggcgaaggcatcgacctgcctggcgagcgcctgatcggcgccttcatcgcctccctcgggttgccccaggtgaatccggtgaacgagcagatccgcctgcgcatgcagcgcctgttcggtgacggctacgactactcctacctgtatccgggactgcagaaggtggtccaggccgccgggagggtgatccgcagccgcagcgatcgcggcgtggtgcacctgatcgacgaccgtttcgcccaggccaaggtgcgccggttgctgccgggctggtggcaactgcgttga

SEQ ID NO: 13654 - DNA, 2487 bp, Pseudomonas aeruginosa
tcgcggtggccgggcgctcgcagcgcttcctgccgggcgccgaagtgcgccccggcaccgtgctgctggcggttcatcgcgaccatgtggtgctgcgcgaccagggttatgaagaacgtctgtatttccccaaagccgaaggggcagaaaccacccatgccacgttgtagtacccgttccgcccagcgcctgtctccgctgttcctggtcctgtcgctggccgtcctcggcctggcgccgccggtccatccggcacctgccgagactgccgccgcgcaagaggaagagcagtggacgatcaacatgaaggatgccgagatcggcgacttcatcgagcaggtatcgagcatcagcggccagaccttcgtcgtcgatccgcgggtgaaggggcgggtcacggtggtatcccaggcgcggctcagcctggcggaggtctaccagctgttcctttcggtgctcgccacccatggctacgcggtgctgccgcagggcgaccacgcgcgtatcgtgccgaacatggaggcacgccaggacgccgcgcagaagaccgtccgcgatgggccgggcagcctggagacgcgggtggtccaggcgcatcagacctcggtggcggaactgatcccgatgatccggccgctggtcccggcccatggccatctggccgccgtaccgtcggccaacgcgctgatcgtcagcgaccgccgctccaacatcgagcgcatcgaggcgatcgtgcgcatcctcgaccgggccggcgaacatgactacagcatctacgacatgcgccatgcctgggtcgcggaaatcgccgaggtgctcgatcgcagcgtcaccccggccgccgggaagagcgccgccaccgtccaggtccttgccgacagccgcagcaaccgcctggtcctgctcggtccgccgcaggcgcgagcgcgcttgctgcggctggcgcagtcgctcgacgtcccctcgtcgcggtcggcgaacagccgggtgatccgcatgcgccatggcgacgccaagacccttgccgccaccctcggggagatcggcgaatcgctgcacggcgagcggggccaggatggccggggaagcggcaagcgcggcctgctggtgcgcgccgacgaatcgctgaatgccctggtgatcctcgccgacccggaggatgtcggcctgctcgaggacatcgtccgccagctcgacgtgccgcgcgcgcaactgctggtggaggcggcgatcgtcgagctgtccggcgagatcggcgacgccctcggggtgcaatgggcgctgcgtagcgggcatgtcgccggcggcgctggcttcgccgacagcgggttgtccatcggcaccctgctgggcgcgttgcaggccggcaagccgccggcagagctgcccgacggtgcgatagtcggcctcggcagtcgcgatttcggcgcactggtcaccgcgctgagccgcaatagccgcagcaacctgctgtcgacgccgagcctgctgaccctggacaaccagaaggcggaaatcctggtcggccagaacgtgccgttccagaccggcagctacaccaccagcgccagcggttcgagcaatccgttcaccactgtcgagcgcaaggatatcggggtgaccctcaaggtcacgccgcacatcggcgaggaccgcatgctgcgcctggagatcgagcaggaaatatcctccatcgcgccaaccgccaccctggcggcgaaggcggtggacctggtgaccaacaagcgctcgatcaagagcaccgtactggctgacgacggccaggtcatcgtcctcggtggattgatccaggacgacctgcagcgcagcgattcgcgggtaccgctgctgggcgacatccccggcgtcggccggctgttccgctcgtcccgcgagacccgggtgaagcgcaacctgatggtcttcctgcgcccgagcatcgtccgcgatgccgccggcctggagcgcatcagccatggccgttaccgttccatccagttgctgcgcggtgccgccggcgaaccggcgcgcccgctgttcgaggatgccggcgccatcgacctgcgtcccgccgcccaggtcgcaccggcacctattggctcgccgcgcagctatccggctccagccccggtgctgatggagaagccgcgcctggcggacccggcgtccctgggcgacggtcgcggcggcgaggtgctggaggttcgccagggcacgcacgcgccgcagccgccgtcaccccagcgctacgccgtgcgattggtcgagggcagcagcgaagccttcatgcgcgcgctgatcgagcggcatccgggcctgtcgttgcgtttgcgccgcgaactgcgcgatggccaggagctgttcgcggtggagcggggcgactacctcgacccggagcaggcacgccgggccctggcggaactgcccgaaagcctgccgcgagggaaggcgcgggtgattgcgcatacgccgggaagcgccctgtga

SEQ ID NO: 13655 - DNA, 1308 bp, Pseudomonas aeruginosa
cgacctgttcctctacggtcgcgacgccgaggcgttcgacctcgaggcctacctggcggtgaatgcgccggcgctgcgcgacaagagcgaatacctggagcactggagcggctactacagcatcaacccgaaagtgttgctgaccctgatggtcatgcaatccgggccgttgggggcgccggacgagcgcgccttggcggcgccgctgggacggctgtcggcgaaacgcggcttcgatgcccaggtccgcgacgtgttgcagcagttgtcgcggcgctactacggtttcgaggaataccagttgcgccaggcggctgcgcgcaaggccgtcggcgaggacggcctgaacgcggcatcggccgcgctgctcggtctgttgcgagagggggcgaaggcctccgccgtgcaaggcggcaatccgctcggcgcctacgcgcagaccttccagcgcctgttcggcaccccggccgcggaactcctgcagccgcgcaaccgcgtggcccggcaactccaggcgaaggccgcgctggcgccgccatccaacctgatgcaattgccctggcgccagggctattcctggcagcccaacggagcgcattcgaacaccggctcgggctatccgtactcgtccttcgatgcgtcctacgactggccgcgctggggcagtgcgacctacagcgtggtcgccgcccacgccggtacggtacgggtgctgtcgcgctgccaggtacgggtgacccaccccagcggctgggcgaccaactactaccatatggaccagatccaggtgagcaacggccagcaggtcagcgccgacaccaagctcggcgtctatgccggcaacatcaacaccgcgctctgcgagggtggcagctccaccggaccgcacctgcatttctcgctgctctacaacggcgccttcgtttccctgcagggcgccagcttcggtccgtaccggatcaacgtcggcaccagcaactacgacaacgactgtcgccgctactatttctacaaccagagcgccggcaccacccattgcgctttccgtcctttgtacaaccccggcctggcgctctgagtcggcgcggggcccggctccagccgggctccgccgcgagcgaaacggcgctgaacagctggcgcgtcgctgccgccgcgcccggcgccaggctgaccgcgtgggccggcatgctcagccgcgccggggcagcagggcgtaggcgtcgcgaaccacatccttgccgtagtggcgttccaggcggcggacgacgaagtgaccgcgcgccatggcctggaaatggttcatga

SEQ ID NO: 13656 - DNA, 8211 bp, Pseudomonas aeruginosa
aagctgctatttctggattacatggtgcggccgttcggtcgctgcttgacaagaggaatgtcggaaatgtcgatccaggcgaaagttacccctatcgatcagagtatttcttctgcggctgccgtcgaggttccggaaaacgggatactcaaactctcccagagcagtaatgtcgcgctcgatgtcgcaccggagtcggtggcgggatactcgaagagcggttcggacctgatcgtccagctgaagaccggggaaagcgtccggatcgccaacttctatgcggaaggccagccttccagccaactgttcctggccgacaaggacaagctggtggcggtagatctgccgccggtcgctgccgacgggccgctgatggccggctacatcccgcaggaaagcctggccggtttcgagtcgctgaccggcgccggtgtgctcggtggcatgagcgcagggactgcgctgctggtcggtgcggcggccatcggcgccggggtggcgatttccaacagcagcggcggcggtggcggcggcggttcttcggtgcccccggacaccactccgccgaaggcggccagcggcctgaagatagcgcctgacggcagcagcatcagcggccaggccgaggccggcgcgagcgtcggcatcgataccaatggcgacggcaagccggacctcaccgtgatcgccgatgccaacggcaatttcaccgctccgctgaacccgccgctgaccaatggccagacggtcaccgtggtggtcactgacccggctggcaacgccagcccgccggcccaggtcaccgctccggacactaccgccccggcgccggctaccgacgtgcaggtggcgccggacggcagcagcgtcaccggcaaggccgaacccggctcgacggtgggcgtcgataccgacggcgacggccagccggacaccaccgtggtggtcggccccggcggcagcttcgaggttccgctgaacccgccgctgaccaatggcgagacggtgacggtgatcgttaccgacccggccggcaacaacagcaccccggtgaccgtcgaggcgccggacaccacagccccggcgccggccaccgacgtgcaggtggcgccggacggcagcagcgtcaccggcaacgcagagccgggcgccaccgtcggtgtcgacaccgatggcgacggccagccggacaccaccgtggtggtcggccccggcggcaggttcgaggtcccgctgaacccgccgctgaccaatggcgagacggtgacggtgatcgttaccgacccggccggcaacagcagcaccccggtcaccgccgaagctcccgacttccccgacgcgccccaggtcaatgccagcaacggcagcgtcctcagcggtacggcggaagcgggcgtgaccatcgtgatcaccgacggcaacggcaatccgatcggccagaccagcgccgatgccaacggcaactggagcttcacccccggtagccaactgccggatggcaccgtggtcaatgtggtggccagggacgccgccggcaacagcagcccggcgacctccatcaccgtcgacggcgtggcgccgaacgcgccggtggtcgagccgagcaacggcagcgaactcagcgggactgccgaaccgggcagcagcgtgaccctgaccgacggcaatggcaatccgatcggccagaccaccgccgatgccaacggcaactggtctttcacgccgtccaccccgctgccggacggtaccgtggtcaacgtggtggccagggatgccgccggcaacagcagtccgccggccagcgttaccgtggatgccgtcgcgccggccacgcccaccgtcgatccgagcaacggtacgaccctcagcggcaccgccgagccgggcgctaccgtgaccctgaccgacggcaacggcaacccgattggccaggtcaccgccgacggcagcggcaactggaccttcaccccgagcacgccgttgcccaacggcacggtggtcaacgccacggctaccgacccgtccggcaacgccagttcgccggccagcgtcaccgtggaccccgtggcaccggccacgccagtggtcaacccgagcaacggcaccacgctcagcggcaccgccgagccgggcgccaccgtgaccctggccgatggcaacggcaatcccatcgggcaggtcaccgccgatggcagcggcaactggagcttcactccgaccacgccgttgcccaacggcaccgtggtcaacgccacggccaccgacgcctccggcaacaccagtgcgggcagcagtgtcaccgtggactcggtagccccggccacgccagtgatcaaccccagcaacggcaccacgctcagcggcaccgccgagccgggcagcagcgtgaccctgaccgatggcaacggcaacccgatcggccaggtcaccgccgacggcagcggcaactggagcttcaccccgtccacgccgctggcggatggaaccgtggtcaacgccacggccaccgatccggcgggcaacaccagcggccagggcagcaccaccgtcgatggcgtggcgccgaccacgccgaccgtcaacctgagcaacggcagcagcctcagcggcactgcggaaccgggcagcacggtgatcctcaccgacggcaacggcaatccgatcgccgaggtcaccgccgacggcagcggcaactggacctacaccccgtccacgccgatcgccaacggcaccgtggtcaacgtggtggcccaggacgccgccggcaatagcagcccgggcgccagcgtcaccgtggactcgcaagccccggcggctccggtggtcaacccgagcaacggcaccacgctcagcggcaccgccgagccgggcgctaccgtgagcctgaccgacggcaacggcaacccgattggccaggtcaccgccgacggcagtggcaactggagcttcacaccgggcacgccgctggccaacggcaccgtggtcaacgccacggccagcgacccgaccggcaataccagcgctccggccagcaccaccgtggactcggtggcgccggccgcgccggtggtcaatccgagcaacggagtcgtcatcagcggcaccgccgaaccgggcgccaccgtgaccctgaccgatggcagcggcaatccgatcgggcaggtcaccgccgacggcagcggcaactggagcttcaccccgtccacgccgctggcggatggaaccgtggtcaacgccaccgctaccgacccggccggcaataccggcggccagggcagcactaccgtggacgccatcgcgccggccacgccgaccgtcaacctgagcaatggcagcagcctcagcggcactgcggaaccgggcagcacggtgatcctcaccgacggcaacggcaatccgatcgccgaggtcaccgccgacggcagcggcaactggacctacaccccgtccacgccgatcgccaacggtactgtggtcaacgtggtggccgaggacgccgccggtaacagcagcccgccggcgacggtgaccgtcgattccagcgcgccgccggcgccggtgatcaacccgagcaacggcgtcgtcatcagcggcaccgccgaggccggtgccaccgtgaccctcaccgatgccggcggcaacccgatagggcaggtcaccgccgacggcagcggcaactggagcttcacgccgggcacgccgccggccaacggcacggtgatcgtcgccacggccaccgacccgaccggcaataccggcccgcaggccgccaccacggtggacgcggtggcgccgccggcgccggtgatcgatccgagcaacggcacgaccatcagcggcaccgcggaggccggggccaaggtgatcctcaccgacggcaacggcaacccgatcggcgaaaccaccgccgacggcagcggcaactggaccttcacgcccgccacgccgctggccaacggcacggtggtcaacgccgtggcccaggaccctgcgggcaataccggcccgcagggcagcactaccgtggacgcggtggcgccgaacacgcctgtggtcaatccgagcaacggcaacctgctcaacggtaccgccgagccgggcagcaccgtgaccttgaccgacggcaacggcaacccgatcggccagaccaccgccgatggcagcggcaactggagcttcacgcccggctcgcaactacccaacggcaccgtggtcaacgtgaccgcgagcgacgccgccggcaataccagcgctcccgctaccacgacggtggattcctcgctgccgtcgatcccgcaggtggatccgagcaacggttcggtgatcagcggcaccgcggacgccggcaacaccatcatcatcaccgatggcaacggcaacccgattggccaggtcaccgccgacggcagcggtaactggtccttcactccaggcatcccgctgccggatggcacggtggtcaacgtggtggcgcgcagcccaagcaatgtcgacagtgcgccggcggtgatcactgtggatggcgtggccccggcggcgccggtgatcgatccgagcaacggcaccgagataagcggtaccgcggaggccggcgcgacggtgatcctcaccgatggcggcggcaacccgatcggccaggccaccgccgacggcagcggcaactggacgttcaccccgggcaccccgctggccaacggcaccgtgatcaacgccgtggcccaggacccggccggcaataccagcggtccggccagcgtcaccgtcgatgccatcgccccgccggcgccggtgatcaatccgagcaacggagtcgtcatcagcggtacggcggaagccggggccacggtgatcctcaccgacggcaacggcaacccgatcggccaggtcaccgccgacggcagcggcaagtgggctttcacgcccgccacgccgttggccaatggcacggtgatcaatgcgctggcccaggacgccgccggcaacaacagcagtcccaccagcgccaccgtcgactcgctggcgccagcagccccggtgatcgatccgagcaacggtagcgtgatcgccggtaccgccgaggctggtgccacggtgatcctcaccgacggcaacggcaacccgatcggccaggtcaccgccgatggcagcggcaactggagcttcacgcccggcacgccgctgtccaatggcacggtggtcaatgcggtggcccaggacgctgccggcaacaccagcggcccggccagcaccacggtggactcggtggcgccggccgcgccggtgatcgacccgagcaacggcagcgtgatcgccggtaccgcggaagccggtgcgacggtgatcctcaccgatggcggcggcaacccgatcggccaggccaccgccgatggcagcggcaactggagcttcaccccgggcacgccgctggccaacggcacggtgatcaatgcggtggcccaggatccggccggcaataccagcggcccgaccagcaccacggtggacgcggtggccccggccaccccggtggtcaacccgagcaacggcagcgtgatcgccggtaccgcggaagccggcgccacggtgatcctcaccgacggcggcggcaacccgatcggccaggtcaccgccgacggcagcggcaactggagcttcacgcccggcacgccgctggccaacggctcggtgatcaatgcgctggcccaggacgccgccggcaacaccagcggcccggccagcaccacggtggactcggtagccccggccaccccggtgctcgatccgagcaacggtacggtgatcagcggtaccgccgaagccggggccacggtgatcctcaccgacggcggcggcaacccgatacggcaggccaccgccgatggcagcggcaactggagcttcactccgggcacaccgctgaccaacggcacggtgatcaatgcggtggcccaggacgccgccggcaacaccagcggtccggtcagcaccacagtggacgcggtggccccggccaccccggtgatcgacccgagcaatggtgtcaaactcagcggcaccgccgaacccggcgtccgggtgatcctcaccgatggcaatggcaacccgatcggccagaccctcgccgacggtagcggcaactggaccttcacaccgggcacgccgctggccaacggcacggtggtcaacgccgtggcccaggacccggccggcaataccagcggtccggccagcaccacggtggatacggtggcgccggccacgccggtgatcaatgccagcaacggcagcgtgatcaccggcaccgccgaggtcggcgccaaagtgatcctcaccgacggcaacggcaacccgatcggcgagaccaccgccgacggcagtggcaactggaccttcacccccggcacgccgctggccaacggtacggtgatcaacgccgtcgccgaagacgccgcgggcaacgccagcggtccggccagcaccacggtggactcggtggcgccgtccgctccgctgctgagcatcagcgccgacggcgcgctgctgaccggcaccgccgagccgaacagtcaggtgcgtatcgtggtcaacggcgacaccgccaacccgatcacggtcaccgtcgacggcgccggcaacttcagcctgccgttcgcgccgccgctgatcaccggcgaactgatcgccggggttgccgtggacgccgccggcaacgtcagcgggccggccaccatcaacgcgccggacctggcgccgccgaccatcagcgtgccggaagccgccgatacctggatcaacgccgcggagatcggggacggcatccaggtcgatgtgacggtccgtccgaccatgcaggtcggccaggtggtcacggtcaagttcgccgggcagaacggctacgaggccgaggtcagccataccctcaccgccggcgacatcgccgccggcaacctgaccctgaccctgacgcctcccggcggcatgggcccgttcccggagggcgcctcgaccgtcaccgccgacatcaacggcggcaccgcgtcgaccccggtgccgttcaccatcgacaccattccgccggcgaccccggtgctgtccctggtcggcaacatcctgactatctcggcggagccagggaccgagttgacggtcaccgtcgacgtcggcggggtgaccgccaccgccacggtgaccgccgacaacagcgggctggcgtcgctgaacctgctcaccgacctggacatcgacttcagttgggaccagttgctcaatgcccaggtgtcggtggtcggacgcgacccggccggcaacccgagcaacacggcgagcatcggcgtcggcaccagcatcgagcaaccggtgaccatcggcaacttcggcctcgacgtcagcctcaacccgctgaacccgcgtttcggtttcagcggaaccaccgagcctgactccagcgtggtgatccgggtcatcaccccggcgttgaacgtcgaattgctgccgatccaggcggattcgtccggaaacttctcgctgaacctgctgagcccgaccatcctcacccagttggggctgaacatcaccgacatcctcaacctcggctcgcagatctcgttcaacctggtgtccaccgactccaatggcaacgacagcgccgcctacgggatcaccctgacccccaacggactgtcgctcaatatcggccagatcgatgtcaacggtacttccggcgacgacgtgctgtccggcgccaacggcagttcggagcacatcaacggcggcgacggcagcgacctgatcttcaacgtgggcaccggcgatcacgtggtggccggcaacggcaacgacaccatccagatcaccgcgaccgatttcgtcagcatcgatggcggcgccgggttcgacaccctggtcctggccaacggcatcgacctcgactacaacgccgtcggcgtcggcacgctcagcaacctcgagcgcatcgacctcggcaagggcgactcgggtagcgtgctgaccctgaccgcggcggaggtggatgccatcaccgatgccaacaacacgttgcagatcaccggcgagaacaacgacaccctgaacgtggtgggcgcggtgaataccggtaccacgcaactgatcaacggcattacctacgacgtctacaccttcggcagtaccaccctgctgatcgaggacaacacggtacaggtcgtggtctga

SEQ ID NO: 13657 - DNA, 2175 bp, Pseudomonas aeruginosa
atcatggaagctgagaaaaccccggataacgtcgtgatcctcaaccacgaccccatcgtcgacccgttgcgccagggcttgttgctgctctgccggcagcttggccgaccgctcggcgacgccgaactggtggacggcatgccgctggagcacggtcgcctgccgttgcacctggtggcccgcgcgttgcgccgcgccgacatcaccgcccaggtcacccgccagccgttgcgccggatcgatcgctacctgctgccggccctgctgctgctcgacgacggccgcgccctggtgctggtgggcaacgacggcgagcacgccgaggtgctggtaccgcagagcgacggcggaagccagaggatgccgctggccgagctggaagcgctgtacagcggcacggcggtcttcgccaagtgccgctaccggccggacgggcgggtcggcgactacgccagcgccttgcccgaacactggttcttcggcccgctcaagcggctctggcgttcctacgccgaggtcaccgccgcggcgttggtggccaacgtcctggcggtcgcctcggcactgttcgccatgcaggtctacgaccgcgtggtgcccaacgcggcgttcgacaccctgtggatcctcgccagcggcgtggccctggcgatcgtcctcgacggtgtcctgcggatcatgcgcggccacctgctcaacgtgctcggcaagcgcctcgacctgcaactctcgaccctgctgttctcccgcgtgctgagcacccgggtcgccgccaagccggcgtcgatgggcgccttcagtacccaggtgcgggagttcgagtcggtgcgcgagttctttacctcgtccagcgcggcgctgatcagcgacctgccgttcgtggcgatcttcctgctgatcatcgccgtgatcggcggccatgtggtctgggtgccgctggtggcctgcgtgctgatgatcctgccggggctgctgacccagcgcctgctcggccacctgtcgcggcagaacctgcgcgaaggggcgatgaagaacggcgtgctgctggaagccttcgagcacctggagacggtcaaggcgacccgcgccgaaggccgctgcctgcaccagtgggaaaccctgaccggcgaactggccggtacggcgatgaagacccataccctggcctcgaccctgagctactcggcgagcatcgtccagcagctctgctacgtcggcgtggtggtcttcggcgtctatcggatcagcgagggcgcgatgaccgtcggcggcctggtggcctgctcgatcctcgcctcgcgggccatcgcaccgctgtcgcaggcggccggcatcctcggtcgctggcagcacaccaaggtggcgatggaaggcctcgaccaactgatgagcgccgagcaggagcgaccccagggcaagcgcttcgtgcacaaggagcgcctgcagggacattaccgcctggagggcgtgcgcatggcccacggcgacagcccgccggtggtcgacgtgcaggccctgaacatccgcgccggcgagcgggtggcgctgctcggcggcaacggcgccggcaagtcgaccctgctgcgcctgctcagcggcctgctcgacgcgcaggcgggacgcctgctgctggacgacgtcagcctgacccagatcgacccggccgaccgccagcgcggtatcggctacctgccgcaggacgtggcgctgttccatggcagcctgcgcgacaacctcaacctggagaacgccgcgctgggcgacgaggaactgctggagaccctcgacggggtcggcctgggcgccttcgtccgcggccacccgctggggctggacatgccgatccagggcaacgccagcctgtccggcggccaacgccaggccgtcgggctggcccgggtgctgctacaggaccctccgatcctgctgctcgacgagccgaccgcggccttcgaccagggcagcgagaaacaggtcatcgactacctgcagcaatggttgggcaagcgcaccctggtcatcaccacccacaagaaaagcatgctcgccctggtcgagcgtgcggtggtcctgcgccagggcagggtgatcatggacggcccgctggagcaggtggtgcagggcaaccaggtacaggcaccgcaggccgccgaaggaggcaaccatggactctga

SEQ ID NO: 13658 - DNA, 1263 bp, Pseudomonas aeruginosa
ccgcgacgccgccgccctgcgccggcaactggccgacccgttgctggcggctacccacccggtctaccggccgctgctctggaccctgctcggttgcgtgctgctgttcatcggctgggcggcctgggcgcaactggacgaggtgacccgcggcgacggtcgggtcgtgccgttcagccgcatccagaagatccaaagcctggagggcggcatcctcgaccgcctgctggtgaaggagggcgacctggtggaagtcggccagccgctggtgcgcctcgacgagacgcgcttcctcaccaacttccaggagtcggcgaaccaggccagcgtgctgcgcgcggccattgcccggctcgacgccgaggtgctaggcaagaagagcatcgagttcccgccggacgtcgatcccgaggggccgctggcgcgttccgaacgcgagctgttcaagtcgcgccgcgacaaactggtggagggcacccaggcgatccagcggcagatccacctggcgcagagccagctcgacctggttcgcccgctggtggccaagcgtgcggtgagccagatggaggcgctcaagctgagccaggacatcgccaccctcagcggcaagctgaccgagctgaaaagcacctatttccaggatgcctataccgagcgcgcacagcgcaaggccgatctcagcgccctggaaccgatcgtccagcagcgccaggaccagttgcgccgcaccgagatcctgtcgccagtgcgcgggcgggtgaacaccgtgctgatcaacacccgcggcggggtgatccagcccggcgagccgatcatggaagtgatcccggtagaggagcgtctgctggtggaggcgaagatcaagccgcgcgacgtggccttcctggttcccggcatgccggccaaggtgaagatcaccgcctacgactacaccatctacggcgacctcaagggcaccctggagcagatcagtgccgacaccatcgaggaggacaccccgcatggcaaggagtcctactaccaggtgctgatcaagaccgatggcagccagttgaagcgcggcgaggaggtattgccgatcattccggggatggtcgccgaggtggacatcctcagcggcaagcgcagcgtgctcaactacctgctgcggccgctgatcaaggcgcgcctttactgaggcgtgcaggacaggcccggtcggtggaaacgtgccagccgcttccctgtagccatggcgagctacgtaggcggtggcgctggtaa

SEQ ID NO: 13659 - DNA, 1347 bp, Pseudomonas aeruginosa
cgcccgcccgggcggcacgcactttcagccggaagcgggacgacccgttttccctctttcattgcgcggggacgaccctgcagagaggctgaaaatggcgtggatctatctcttgctcgccggtgtcttcgaaatcgtctgggccacggccatgaaggagtcggccggcttcacccgcctgtggccaagcctggtcaccctgctgttcatgatcctcagcttcggcctgctggccgtttccatgaaaaccctgcccctcggcacggcctacaccatctgggtcggcatcggtgcggtcggcgccttcgccctgggcatcctgctcttcggcgaaagcccgagcccgttgcggctgctggcggtggggctgatcgtggccggcatcgtcattctcaagctggcgacccggcagggctgaggggcgaccatcatgtacgcatccttcgctcccgcgacctgggccttgctcgcctacctcttcggcgcgctcgccctttgcctgctcatgctggggttgggccgggtgctgggcggccgatcgcatggccgggcgaagaacctgccgttcgagtcgggggtggattccaccggctcgtcgcgcttgcgcttctcggtcaagtacgcgttggtcgccatgctgttcgtgatcttcggcatcgagatgccgttcctctacctctgggcggtgtcgctacgggagaatggctgggcgggtttcgtcgaggcgacgctgttcgtctccctgctgctggtcggactgttctacctgcaccgggtcggcgccctcgactggtcgccggagcgccggcggaaaaagccgcacgactagtcgtggaggatcaccagcaggtagcggcaggcttgcccggcggtggcgaaggtcaccgcgcggtcgacgccgaagtccaggcggtcgccgcgttgcaggtggaacgattgctcgccgtaatccacccgcagcgcaccctcgaccagccacaggcgctgccggtagggccggccgccccagcggggatagtcgaggcgggcgttcgccgggatctccacttccaccatctcgcagccgctgcgcggatcgcgagcgccgacctggcggcggcggtagccgctggccgggtcttcccacacttcctgctgcgcgcgccggcagagcggttcggccggcgcctgcgcgtcgccgagcagctcggagagggcgacccccaggccgccggcgagacggccgaggacgctggcggtggggctgctttggttgcgctcgatgcgcgagatcatcgccttgctcaccgcgcagcgttcggccagttgggcgagggtcagctcgcgctccttgcgcagggcggctag

SEQ ID NO: 13660 - DNA, 3081 bp, Pseudomonas aeruginosa
gcgtcgggcaatcagttcgtcgatatccatgagtggccctggcggatttttctcgtccatgatagtcactgtccaatatattggaaattcgcccttgcattggagcttgcccgcgatgaccgaaccgacgattcgccgcctggctggcgaggagatcctggcgcgcctggacgaactggccgaggtactgctggactgcgtggaaggcggggcttcggtcagcttcatgtggccgttgccgcgggagcgggcgctggccttctggcgcggcgtcggcgagagcgtggcgggcgacgaacgcctgctgctggtggcggaagcggaggggcggatcgtcggtaccgtgcaactgctcctcgaccaaccgccgaaccagtcgcaccgcgccgacgtggcgaagatgctggtgcaccggcgtgcgcgtcggcgcggcatcggcgaggcgctgatgggcgagctggaccggctcgcccgggcctgcggcaagtccctgctggtgctggatacggtcagcggcagcgccgccgaacggctgtacctgaagaccggctggacacgggtcggggaaatcccggactacgccctgatgccggacggcacgccctgtcccaccacctatttctacaagcgcctggctgctgccggctgaccgaagatgccagcgttcccaaggcaggccgggtagaatcggcggatgcgagagattcggggtcgatggtggagttactgcaagggttcgtcctgacccggcactggcgcgatacgccggccggcacggaagtcgcgttctggctggcgaccgagcagggcccgcggcaggtgcggctgccgccgcagccgtcggtggcgttcgtcctcgccgagcagcgcgggcgcgtcgagtccctgctcgccggggagactggcgccgagctgcggccgctggcgctgcgcgacttccagcagcggccggtgctcggcctgtactgccagcagcatcgccaactgatgaatctggagaaacgcttgcgccaggccggcgtcgaggtgttcgaggccgatatccggccgccggagcgctacctgatggagcgcttcatcaccgcgccggtcagcctggaggcgagtgtcgaggctgacggcagcctgctcgcccggcgcctgaagccggctccggactatcgcccgcgcctgcgcctggtgtcgctggacatcgagaccaacgcccgcggcgatctctactccatcgccctggaaggctgcggccagcgccaggtatacatgctcggcccggccaacggcgatgccgcggccgtggatttccgcctcgactattgcgacagccgtgccgggctgctggaacgtctcaaccagtggctggccgagcacgatcccgacgccatcatcggctggaacctggtgcagttcgacctgcgcgtcctgcatgagcatgcccagcgcctgaaggtgccgctgcgcctggggcgtggcggcgacgaaatgggctggcgcgagcacggcagccgcaacaaccactttttcgccgcggcggccggccgcctgatcatcgatggcatcgaggcgctgcgctcggcgacctggagcttcccctcgttcagcctggagaacgtcgcccggaccctgctcggcgaaggcaaggcgatcgacaatccgtaccagcggatggacgagatcgatcgcatgttcgccgaggacaagccggccctcgcgcactacaacctgaaggactgcgaattggtgacgcggatcttcgcccgtaccgaactgctcgacttcctcctcgaacgggccaccgtcaccggcctgccggcggaccgcagcggcggctcggtggcggccttcacccacctgtacatgccgttgatgcaccgcgccggcttcgtcgccccgaacctcggcgagaagcgtccggaagccagtcccggcggcttcgtcatggactcgcggccgggcctctacgaatcggtgctggtgcttgactacaagagcctgtatccgtcgatcatccgtaccttcctgatcgatccggtcggcctggtggaaggcctgcgccagccggacgacgagcactcggtggaaggctttcgcggcgcccgcttctcgcgtacccggcattgcctgccggccatcgtcgcacgggtctgggagggccgcgaggcggccaagcgcgaacgcaaccagccgctctcgcaggcgttgaagatcatcatgaacgccttctacggggtgctgggttccagcggctgccgcttcttcgacccgcgcctggcctcgtccatcaccctgcgcgggcatcggatcatgcgccgtacccgcgagctgatcgaggccgagggctatacggtgatctatggcgataccgactccaccttcgtctggctcggcagcccccgcgccgaggaggaggccgcggccatcggccgggcgctggtggcgcgggtcaacgactggtggcgcgagcacctgaaagaagaattcggcctcgacagcgccctcgagctgcaattcgagacccattaccggcgttttctcatgcccaccgtgcgcggcgccgaggagggcagcaagaaacgctacgccggcctggtgcgccgcgccgacggtggcgaggagatggtcttcaagggcctggagaccgtgcgcaccgactggtcgccgctggcccagcgcttccagcaggaactctacctgcgcatcttcaatcgccagccctaccaggactacgtgcgcgattacgtacgacggaccctggccggcgagctggacgacctgctggtctaccgcaagcgcctgcgccggcgcctcgacgattaccagcgcaacgtgccgccgcatgtgcgcgcggcgcgcatcgccgacgactacaacctcgagcgcgggcgcccgcggcagtaccagagcggcggctggatcagctacgtgatcagcgtcgccggtcccgagccgctcgaggcgcggcgttcggccatcgactacgagcactacgtgggcaagcagttgcagccggtggccgacgccatcctgccgttcgtcggcgacgatttcgccactttggtcgaccggcagatggcactattctga

SEQ ID NO: 13661 - DNA, 465 bp, Pseudomonas aeruginosa
cagttgtccctcgaggatttccatgaagcccgtccagccgcgcaacgaggcctccacctgggccgcgtcgcggtgcgccggcgactgccggaccaggctcatgaaggcatagctccacgagcggttgaggtcggaggcctgccagtccagccactggtcgacccgcgcgcgcggcgccgcctgctgcggatagaggcgttcgccggcatagcggttggccaggtagcggatgatgctgttggattcccagagcaccagttcgccgtcgcgcagcaccggcaccatggcgttcgggttgagggcgaggaattccgccgcgtgggtgtcgcggaagccgctgccccagtcttcgcggcggtagggcaggtccagttcggcgcaggtccagagcaccttgcgcacgttgatcgaagaggcctttccgagaatctccagcatggcgatggcgcgtccttgggcggatag

SEQ ID NO: 13662 - DNA, 873 bp, Pseudomonas aeruginosa
cgaacgatggcgccacgctcgccaatggatgcggcgtgcccgagagccagtgcagcgcggccatcggcgcggtcagcaggagcaccaccagcaggggcgcctggcgttgcgcaaggccgtggcggcggccgagacattgcaacaggtacaggccgaagcgcgtcgccaggagactcgcggcgccctggagcagggcggcgacgcccatcccggccaggccgccgtcctggttggcataggccgcccaggcgccgtagagcaccgcggccggcagcgccgccagccacgggtcgtcggagcgctgcgcgagtccgctcaccggatgatcctctgctgcacgtagggttcggcaccgggcgcgaggcggaccatgcagaggatctggtcgctgctgccgacgtgggcgacgaagtggtcgttggtcctggcgtggctggacatcgccatgcgcgggaagaaatccggggcgacgctgcgttgcccgccgggtatcaggccggtttccgcatccaggcgcaggttggcggacagcgtgccgaccacgtcgagggccaggtcgaccatgtccgggttctggcgcggcgcttccaggtccgggtacagcgtcgctcccggaatccgcgcgctgagggcgcggaacatgttgtagaccaccgggttgtaggtcttcgccacgatcagcggcggcagcccgccgttgcgctcgctgacctggcgcaggaagaactggttgatccgcttgaacaggctggtgcggtggtagcggtcgaccaccatcgccgtccacaggtagaggaagcgtgtcgagccgcggacgaagtccttcgcgcccaggatgccgatgatccgttcgccctccgggtcggtcgctag

SEQ ID NO: 13663 - DNA, 492 bp, Pseudomonas aeruginosa
acagttcatcttgcatggcgcaggcgctccctcgttacaggtagtcggttcggatgtagagcgtcgggacggtcgcgaagaacgagtagaacggctccatccggtagtgatcgacggccagcacgacgaagttgtcgaagcgctcgccgaagagttttcccatcaatgcgtactcggcggcctgggagacgaagctggcccagatctgctcgcgcgactggctggcgaaccatttctcgtagagcggcaggcgcgacaggaagatcgattccagggccgggtagtccagcccggtctggccgtagtcgccctgttccaggcgctggacgatctcgccgtgggcccggtgccagccgtcctcgccgccgcacatctcgaagaaagagcaggtcgcggccgggcagggcagggccccggcgatccgctcgagctggcgctcgaccttgccgaggaaaccctcgcgggtctcgccggtggcggggttgcggttga

SEQ ID NO: 13664 - DNA, 621 bp, Pseudomonas aeruginosa
aactttggagacgctccgaagcgggcaacttttgcccggaaaaagcttcacggcaatttctccggcctgtcatcccgatgtcttctttccggtatggatgccagtcgattcgaactggcggagattcgcaccatgcgagagtaccaacggttgaaagggtttaccgacaacctggaattgcgtcggcgcaaccgtgccacggtcgagcactacatgcgcatgaagggggccgaacggttgcagcggcacagcctgttcgtcgaggacggctgcgccggcaactggaccacggaaagcggcgaacccctggttttccggggccatgagagcctcaggcggctcgccgagtggctcgagcgctgcttccccgactgggagtggcacaacgtgcggatcttcgagaccgaggatccgaaccacttctgggtcgagtgcgacgggcgcggcaaggcgctggtcccggggtatccggagggctattgcgagaaccactacatccattccttcgaactcgagaacggccggataaaacgcaatcgcgagttcatgaacccgatgcagaaattgcgtgcattgggaatagccgttccacaaataaaacgtgacggtattcccacctga

SEQ ID NO: 13665 - DNA, 894 bp, Pseudomonas aeruginosa
gcattccggtcccgcagatcaaacgcgaaggcattcccacctgaggccatcctggaaggggtgaactatggacgatctattgcaacgcgtacggcgctgcgaagcgctgcagcaacccgaatggggcgatccgtcgcgcctgcgcgacgtgcaggcgtacatgcgcggcagtccggcgctgatccgcgccggcgacatcctggccctgcgcgcgaccctggcgcgggtcgcccgcggcgaggcgctggtggtgcagtgcggcgactgcgccgaggacatggacgaccaccatgccgagaacgtggcgcgcaaggctgccgtgttggaactgatggccggcgccgtgcgcctggccggccggcggccggtgatccgcgtcgggcgcatcgccgggcagtacgccaagccgcgttccaagccgcacgagcaggtcggcgagcagaccctgccggtctatcgcggcgacatggtcaacggccgcgaggcccatgccgaacagcgccgggccgatccgcagcggatcctcaagggctatgcggcggcgcgcaacatcatgcgccacctgggctgggacgccgcgtccgggcaggaggcgaatgcctcgccggtctggaccagccacgagatgctgctgctcgactacgacctgtcgatgctgcgcgaggacgagcagcgccgggtctatctcggttcgacccactggccgtggatcggcgagcgcacccgccaggtcgacggcgcccatgtggcgctgctggccgaggtgctcaacccggtggcctgcaaggtcggcccggaaatcggccgcgaccagttgctggcgctctgcgagcgcctcgacccgcgccgcgagccggggcgcctgacgctgatcgcgcggatgggcgcgcataa

SEQ ID NO: 13666 - DNA, 1086 bp, Pseudomonas aeruginosa
gttggggcaggcccgcgggattggggaacgcattgggaaacgttgtccgggggtgttcttccaggtgcagcccgggggcccacgccgccggagccggacacggccaggggggaacgcggccacttcctgggcgatgagcgccaccaggcgggttttgttgccgcagggcgcgacgatggtgttgccgtgcatcgggtcgttcagccaaatcaccgggtggccggccgcgcgcaccgattccaccagcggcggcaggcgctcgcagaccttatgcgcgcccatccgcgcgatcagcgtcaggcgccccggctcgcggcgcgggtcgaggcgctcgcagagcgccagcaactggtcgcggccgatttccgggccgaccttgcaggccaccgggttgagcacctcggccagcagcgccacatgggcgccgtcgacctggcgggtgcgctcgccgatccacggccagtgggtcgaaccgagatagacccggcgctgctcgtcctcgcgcagcatcgacaggtcgtagtcgagcagcagcatctcgtggctggtccagaccggcgaggcattcgcctcctgcccggacgcggcgtcccagcccaggtggcgcatgatgttgcgcgccgccgcatagcccttgaggatccgctgcggatcggcccggcgctgttcggcatgggcctcgcggccgttgaccatgtcgccgcgatagaccggcagggtctgctcgccgacctgctcgtgcggcttggaacgcggcttggcgtactgcccggcgatgcgcccgacgcggatcaccggccgccggccggccaggcgcacggcgccggccatcagttccaacacggcagccttgcgcgccacgttctcggcatggtggtcgtccatgtcctcggcgcagtcgccgcactgcaccaccagcgcctcgccgcgggcgacccgcgccagggtcgcgcgcagggccaggatgtcgccggcgcggatcagcgccggactgccgcgcatgtacgcctgcacgtcgcgcaggcgcgacggatcgccccattcgggttgctgcagcgcttcgcagcgccgtacgcgttgcaatag

SEQ ID NO: 13667 - DNA, 1959 bp, Pseudomonas aeruginosa
ggaagaggagataaatatgatttattacttgatcggagtggcgctattcatcttcatgctggaacagttggttcccggctggaaattgcccaaggtgagcacctgggtggcccgggtgatcttcctcaacatcgtccaggtgtcgatcgccctgctcgccggcatcacctggaacaaatggatgatggggcacagcctgctgcacacctcggatgccctgccaccactgctggccggcttcgccgcctacttcgtcaacaccttcgtcacctactggtggcatcgcgcgcgccacgccaacgacacgctctggcggctgttccaccagttgcaccacgcgccgcaacgcatcgaggtattcacctccttctacaagcatccgaccgagatggtcttcaactcgctgctgggcagcttcgtcgcctacgtggtgatgggcatcagcatcgaggccggcgcctactacatcatgttcgccgcgctcggcgagatgttctaccactcgaacctgcgcaccccgcacgtcctcggctacctgttccagcgcccggagatgcaccgcatccaccaccagcgcgaccgccacgagtgcaactacagcgacttcccgatctgggacatgttgttcggcacctacgagaacccccgccgcatcgacgagccgcagggcttcgccggcgacaaggagcagcagttcgtcgacatgctgctgttccgcgacgtgcacagcctccccggaaaaacccagcccgcccccgtcctggtcaagcccgacgtcaggtgaacgccatgattccagacatcgattcccgtctcagccggaacatattgaaatccatctcgtatggcctccccctcgccgaagtggtccccgaccatacctatgcgcaactggaaacgcgcctcggcgaactgaaacgcaggtatctggagctgcgcatctcccacggcgcgcgcgagctgccgttcagcaactacctgttctacctgatcctccagtcgcgccaccaggaattcgacttcaagctgcgccagggcaactcggtggtcaccaacatccaccgattcaagagcaagggacgcatcccgtccctgaccaccctgctcctggccgatgcggtcaacgccaagagcgagctggagctcaagcatccggacatcccgcagctcgaccgccacgctcgcgacatcgagcgctggctggccgccggcaacgtcatgccgcccagcgagcgggccctgcgcggcctggttgaggcgctggagcgcgccgctggcgaaggccgtccgttgcacctggtgagcgcggtatgcccggactactcgcactccagcgatgccgagggcaagccgcgctacaccttcgagcgagtcggcgaccagcccggcctggccggcgccaagctggtcagcgccggccaggcggtggcggagctggccagggcgcgccaagtggaaatccgccacgcgatcctcggcggcgagttcgagtacctatcgttcaaccgcaaccccgccaccggcgagacccgcgagggtttcctcggcaaggtcgagcgccagctcgagcggatcgccggggccctgccctgcccggccgcgacctgctctttcttcgagatgtgcggcggcgaggacggctggcaccgggcccacggcgagatcgtccagcgcctggaacagggcgactacggccagaccgggctggactacccggccctggaatcgatcttcctgtcgcgcctgccgctctacgagaaatggttcgccagccagtcgcgcgagcagatctgggccagcttcgtctcccaggccgccgagtacgcattgatgggaaaactcttcggcgagcgcttcgacaacttcgtcgtgctggccgtcgatcactaccggatggagccgttctactcgttcttcgcgaccgtcccgacgctctacatccgaaccgactacctgtaa

SEQ ID NO: 13668 - DNA, 1293 bp, Pseudomonas aeruginosa
cgagggagcgcctgcgccatgcaagatgaactgttcaagacccgatactccaagtacggatacggcatcgacgtgcgccgtacctacaaggacctgccctgccagccgttctggacctgggtcaccggcaagtcgctgaacgaccgcccgccgcgacggccgaaagacaccctgctcaagccctggcagctctacctgcacatcagttggggctacgcggtgttcttcctcgcggtgatctacggccagcaactgctcgcctcgcagcagccactgtggctgaagtgcctgttgggcgcgctgatcatgtgcctggtggtcaaccgccagcgtggcttcctccataccttccactacaccacccatggcgccagcctggagaacaaggcgctggcccgcttcacctgcaagtggatcctgtcgatcccgatcctgcacaccccgcgcgacgagtacgtgaagctgcacgtgaacgaacaccacagcgtgcgcaccttcaataccgagcacgacgtcgacctggtcttcatgaaacagcacggcttctacaagggcatgtccgagagcgccttctggacccgcctggtgctcgcgcccttccatccggcgcggatcctcgagcacctgaagttccgtttcgacgtcagcttcgtctccgccccgcgccacgagcgcgtcagccgggcgctctactgggctgcgctgctcggcctggtgtacgccagcggctacctggaggcgttcgcgctgttctacctgttcccgatcttcatcctcacccagtactcgtcgtggatccagcacgtctccgagcacctctggttcgcccgcaacgagcacggcctgccgcgcttcctgcactacggctcgctgagctggggacgcttcctcggccgcccctacccggccgacaagcagggcctggccttcgccctggcgttcgttcgctggagcctgggcgtgctgctgatcgacatcccgctgcgggtgttctccttcatgcaggacctgcccagccacgacttccaccatcgcaagccgggagtgaacttctggcgcatcgcgccggagcgcgcggccaacgaggcgcgcccctcgaagttcggcccgatgaccgagacctggggcatgtgggagaacttcctgatcctgcgcgaccacctctgccgcggccagtcggacccgttcggaatcgtcgactggtaccgcgagaaccatgcccggctcgctccggagaccgatgccgccaaccagccccacaccaaccaacccgcatcccaggctaccgcctga

SEQ ID NO: 13669 - DNA, 1218 bp, Pseudomonas aeruginosa
tcacacaggaaaccccatgaatactcagattgcccagatcacccagagcctggcagccaacggctgcgcctatatcacccccagcgacgcgctctacgacgagcaggactgggaactgatgaaccaggtcctggccaactcgaccctgccgtgggagaagatcctgatcggcgacgccgacgaggagaacgacctctacgtggcccgtttcatgaccgaccgcgaccgtcccacggtggtcaaccatgcgctgtcggagctgatcatcccgcgcgtctgcaacgacaacgtgatgagcctgttccgcaagctgatgggcgacgacgccttctacgtccggcgcatgcaggtgaaccggatgaaggccggctcgttcatcggccggcacctggataccgacagcaacccggactaccagtactccatcgtcctgcagctcggcacctacttctccggcggccagttcgtggtctacgaccgcgacggcaacctgcgcaacgacatcaagccggagccgcgctcggtgatcatcagcgactgcagctatccccacgaggtccagcaggtgaccgccggcgagcgcgtctcgctggtgttcttcgtcagtcgccatgcggaccggaaccggcgggtctattgacccgtcggcgtggagactcgaagcgatgtcgaagaacgcacgttacgcctggcgcctgtccctcggcggcctgctgctggggctactggcctgcgcggtctacctgctggccgtcccgctgggcttcaagtacggcgagatccaggtcggccatggcctggaacacgaggggcggatcgcctgggacgccgccggcgtcccgcatatccgcgcgcagagcctggaggacggctatttcctgctcggctacagccacgccagggatcgcctgtggcagatggagttcgcccgccgctatgccggcgggacgctctccgaagtgttcggcgtcaagaccctgccgatggacaggttcgcccgcaccctgggcttccgacgcaccgccgagggcatctacgccaacctggacgcgcccacgcgcgtcctgctgcaacgctacagcgacgggatcaacgcctatctggagctggccccggcggcgctgccgctggaattcagcctggtgcgccacgaacggccggggccctgggggccggtggacagcctgtccctgcacctgctctattcctggaccctga

SEQ ID NO: 13670 - DNA, 480 bp, Pseudomonas aeruginosa
tcgccctcgcctggaccggcctcgaccgtcacgacaagaccttcccgagcctgctggcgatcaaccgggccgaaggctgggaacagttcctcgacgccgccgccgacttcggcgtaccgccgcagaacatggtctatgccgacgtcgagggcaacatcggctacgtctccgccggtcgcgtaccgctccgcggcgccgacgacgacctccatggcctggccccctcgcccggctgggagagccgctacgactgggtcggctacgttccggaaagcgccaagccacgcagcctcaacccccgcgaagggttcatcgccacggcgaaccagcgcatcgtgccgcccgacaatgccttcgacttcggccacgactgggtcctgccctaccgctacgaacgcatccgcgagtggctcggcggccccggccagcgcaccctggaagacagcttggagttgcagaacgacgagttctccagcgtga

SEQ ID NO: 13671 - DNA, 1428 bp, Pseudomonas aeruginosa
agaacaacaagggcggcgacaacttcagcgtcaacgtcgggcgcttggactacagcgacccggccaacccgttcaacacacggatcgccgcgaccctgcggatggtcatcgacctggcggacttcgacaactcgcgctacgcgctgtccacccgcaattccggcctgccgttcgacggcgccaccgatctcaacgaactctgggcccgcggcgcgtacatccgtatcgccgacgacgcccccgacgcgacggaccgccagttggtcctgcgcccttcagccccttcctccggcgagccacgaccatgaccagcgatccgcagaaaaacgccttcgacctcgactactccagccgcgaacggcagttccccgagggcttcaagcgcaagatagtcgccgacctgcaagagggaatgccgcagttcgacgtgctgcaatacttcggcaaccagccggatatcttcgagacctacgaccacctggtgctagcgaccgacccggagggcgaacggatcatcggcatcctgggcgcgaaggacttcgtccgcggctcgacacgcttcctctacctgtggacggcgatggtggtcgaccgctaccaccgcaccagcctgttcaagcggatcaaccagttcttcctgcgccaggtcagcgagcgcaacggcgggctgccgccgctgatcgtggcgaagacctacaacccggtggtctacaacatgttccgcgccctcagcgcgcggattccgggagcgacgctgtacccggacctggaagcgccgcgccagaacccggacatggtcgacctggccctcgacgtggtcggcacgctgtccgccaacctgcgcctggatgcggaaaccggcctgatacccggcgggcaacgcagcgtcgccccggatttcttcccgcgcatggcgatgtccagccacgccaggaccaacgaccacttcgtcgcccacgtcggcagcagcgaccagatcctctgcatggtccgcctcgcgcccggtgccgaaccctacgtgcagcagaggatcatccggtgagcggactcgcgcagcgctccgacgacccgtggctggcggcgctgccggccgcggtgctctacggcgcctgggcggcctatgccaaccaggacggcggcctggccgggatgggcgtcgccgccctgctccagggcgccgcgagtctcctggcgacgcgcttcggcctgtacctgttgcaatgtctcggccgccgccacggccttgcgcaacgccaggcgcccctgctggtggtgctcctgctgaccgcgccgatggccgcgctgcactggctctcgggcacgccgcatccattggcgagcgtggcgccatcgttcgtcatcggctggctctacttcgccctctgggcgcgccaccgcccgggccgccggcaaaccagccgcgcctag

SEQ ID NO: 13672 - DNA, 1530 bp, Pseudomonas aeruginosa
cagcacccggccggcgacacgggcaccgacagcgccagagcgtaccgaccggcctgcgtaacgggtagcgaccggtcgagttctggcgcgccggaaaagaatctccacgcgggaatcgtcatgaaaatactcgcccttctcgcagcctgcctgctggcaggctgcgccgccaacgccccgctgcgcgatgacagcgaatcgacctgcgccgacatgcggccttgcagcgacagctactacgaacgccatccgaactacgagatcggcttcgtcgaatacagcgagcgcggcaacgacttcgcgcctgccagaacgcaacgcctgatcgaccagctaaagcgctactccgcccggggggacatcgccatggtggtgtttattcacggttggaagcacaacgcgggacgggacgacggcaacgtcgccagcttcaacaaggcactcgccaatctcgcctcctccggggtgctgggcaaacgcaggctggtcggcctctatgttggctggcggggcaagtcgatgcatggcctgtatagcgagaacctgacctactgggacaggaaggccgtcgccgaggaagtcggccggggtggcgtcgccgagttgctcgcccagttggaacggatcgatcgcaaggacaggaactatctggtgatcgtcggccacagcttcggcggcgcaatcaccctcggcgcacttcacgacccgttgctcgaacgcctgctggctctccaggacggtcagcggatacgcgccttcggcgacgcggtaatcatgctgaatccggcgatagaggccaatcagggcctgttgctcaaggagaacagcctcaaggtcggcgccctgggagcccggccgccgccgctgctgtacgtcatcagttcccacggcgacagcgccacccacttcgccttcccgctcggccaatgggtcggcgtcaacctcacctggagccaggtggacctggacaggacctacaacggaacccgctatcgcctccgggaagaagacctggataccaccgccctcggcaactacagcctgtatcggaccgccctgctgatcgaccgcgagtgcccgctgccggatggcagcgacaactgcgcgccaagaccgcccgaaccacgggtgatcgacgacaccgatatcggcaaatggcgcttcaggagcttctgcagcgcggacggcggcaacgccgatccggcgctgccgcgcatgccctgctacagcaacgagccggtcaacttcatctacacctcgcagtccttcatcgccgaccacaacgatatcttcaacgaccaggtgatcgccttcatggccaccgccgtcagcaaggccatctacgaacgtacggctggcgcctcctactaccgggagtgccacgacccggtgcggaagaacttctcgttcggcaagtgcttcgacttccactacctcaaagccacggccatgcaccggcggctgcaacggcaactctcggaacccggcacccgcagcgaacaggacgtcctctatgaaaaccctctctag

SEQ ID NO: 13673 - DNA, 813 bp, Pseudomonas aeruginosa
cctgctcctgatcggcttcgccgtcgttctgctcgccccgcggatggcgcccgccgccagcgccgccgaagacaaggccacctattgcggctccggcttcacccagtatctggttccggacgacgtcgcgggctgctcgctcagcgaggcctgccgcctgcacgatatctgctacggccgctgcgacaaggacggcgacctctacggcagcgcctactgcgcgcaaagcgaaaagtccgaagcccgcaacatgagcaagcagcagtgcgacgccaggctgcaggccgacatcgccgcacagaacggcaacagccgcctgtgccgcgcggtgggaggcgtctaccgggtattcgtgaagcacctggggcaaggtccgttcaatggccgggaggcactggacatctacctgaaggtcatgcaatcggcgcccagcgcagccgacgccgacgcccgcctcgaagccatccatcagctacagaagcagggcctgaccgacgccaaggaaatccgttacgacgccgagcgtatcgtcatcccactcaacaggcccgtggaatcgccgttgaccaacggctcggacactctcgtcctgccgcgcaacctcgaccgggaacggctgcgccagctggaccagcggctcatccgccaatgagcctcagaatagtgccatctgccggtcgaccaaagtggcgaaatcgtcgccgacgaacggcaggatggcgtcggccaccggctgcaactgcttgcccacgtagtgctcgtagtcgatggccgaacgccgcgcctcgagcggctcgggaccggcgacgctga

SEQ ID NO: 13674 - DNA, 1731 bp, Pseudomonas aeruginosa
agcgctccatcaggtagcgctccggcggccggatatcggcctcgaacacctcgacgccggcctggcgcaagcgtttctccagattcatcagttggcgatgctgctggcagtacaggccgagcaccggccgctgctggaagtcgcgcagcgccagcggccgcagctcggcgccagtctccccggcgagcagggactcgacgcgcccgcgctgctcggcgaggacgaacgccaccgacggctgcggcggcagccgcacctgccgcgggccctgctcggtcgccagccagaacgcgacttccgtgccggccggcgtatcgcgccagtgccgggtcaggacgaacccttgcagtaactccaccatcgaccccgaatctctcgcatccgccgattctacccggcctgccttgggaacgctggcatcttcggtcagccggcagcagccaggcgcttgtagaaataggtggtgggacagggcgtgccgtccggcatcagggcgtagtccgggatttccccgacccgtgtccagccggtcttcaggtacagccgttcggcggcgctgccgctgaccgtatccagcaccagcagggacttgccgcaggcccgggcgagccggtccagctcgcccatcagcgcctcgccgatgccgcgccgacgcgcacgccggtgcaccagcatcttcgccacgtcggcgcggtgcgactggttcggcggttggtcgaggagcagttgcacggtaccgacgatccgcccctccgcttccgccaccagcagcaggcgttcgtcgcccgccacgctctcgccgacgccgcgccagaaggccagcgcccgctcccgcggcaacggccacatgaagctgaccgaagccccgccttccacgcagtccagcagtacctcggccagttcgtccaggcgcgccaggatctcctcgccagccaggcggcgaatcgtcggttcggtcatcgcgggcaagctccaatgcaagggcgaatttccaatatattggacagtgactatcatggacgagaaaaatccgccagggccactcatggatatcgacgaactgattgcccgacgcctagccgccctgcgcaaggagcgcgagctgaccctcgcccaactggccgaacgctgcgcggtgagcaaggcgatgatctcgcgcatcgagcgcaaccaaagcagccccaccgccagcgtcctcggccgtctcgccggcggcctgggggtcgccctctccgagctgctcggcgacgcgcaggcgccggccgaaccgctctgccggcgcgcgcagcaggaagtgtgggaagacccggccagcggctaccgccgccgccaggtcggcgctcgcgatccgcgcagcggctgcgagatggtggaagtggagatcccggcgaacgcccgcctcgactatccccgctggggcggccggccctaccggcagcgcctgtggctggtcgagggtgcgctgcgggtggattacggcgagcaatcgttccacctgcaacgcggcgaccgcctggacttcggcgtcgaccgcgcggtgaccttcgccaccgccgggcaagcctgccgctacctgctggtgatcctccacgactagtcgtgcggctttttccgccggcgctccggcgaccagtcgagggcgccgacccggtgcaggtagaacagtccgaccagcagcagggagacgaacagcgtcgcctcgacgaaacccgcccagccattctcccgtag

SEQ ID NO: 13675 - DNA, 2208 bp, Pseudomonas aeruginosa
aggcctgacgccatgaacagcaagatcgatctgagcaacgccctgcccggctcgcgccgcggcttcctcaaaggcgccgcggtggtcggcctgaccatcggcttccagtggagcggagcccggcgtgccctcgccgcggccctgccggacgccggcttcgcgcccaacgccttcctgcggatcgccccggacgacagtgtcacggtgatcgccaagcacgtggagatgggccagggcgcctataccggtatcgccaccatcgtcgccgaggaactcgacgcggactggagcaaggtccgcgtggaaagcgcgcccgccgacgccaagcgctacgccaacctggccttcggcaccatgcagggcaccggcggcagttcggcgatggccaactcctggatgcaattgcgcgaggccggggccaaggcgcgcgcgatgctggtcgaggccgccgcccgccagtggcgagtgccggccaccgaactgcgcacccgcgacggcttcgtcgaacatccggccagccagcgcaaggccagctacggttcgctggccgctgcggcggcggaactgccggtgccggaaaaagtgcaattgaaggatcccaaggacttccgcctgatcggtcaccaggcgccgcgcgtcgacgttcccggcaagaccgacggcagtgcgcaattcaccctcgacgtcagcctgcccggcatgctggtcgccctgctccagcgcccgccgctgttcggcgccacggtgaaatcgttcgacgccacggcgaccagggcgattccgggggtggtcgaggtggtccaggtgccgcacggcgtggcggtggtcgccaagggcttctgggcggcgaagcaaggccgcgacgcgctcaaggtcgagtgggacgagagcaaggccgagaagcgtggttccgaggcgctgatggcggagtaccgcaagctcgccgagcaacccggcaagcccgcgcgcagggacggcgacgccgccaaggcggtggccggggcgacccgcaggatcgccgccagctacgagttcccgttcctcgcccatgcgccgatggagccgctggacgcggtggtcaggctgaccgccgacagctgcgagatctgggccggcgaccagttccagaccgtcgaccagggcaacgcggcgcgcaccgccgggctgaagccggagcaggtgaagatcaatacgctctacgccggcggcagcttcggccggcgcgccaacgcctggtcggactatatcgtcgaggcggtatcgatcgccaaggcgctgggcgccaacggcgtgccggtgaagctgcaatggacccgcgaggacgacatccacggcggtttctaccggccgatgtactaccaccggctcgaagccgggctcgacgccgacggcaagctggtcggctggcaacatcgcatcgtcggccagtcgatcctggaaggcacgccgttcgccgcggtgatggtcaaggacggcatcgacgccacctcggtggaaggcgccgccaacctgccctatgcggtgcccaatgtctcggtcgagctgagcaccacccaggtcggcgtgccggtcctgtggtggcgggtggtcggcagctcgcacacggtctacgcggtggaggcgttcatcgacgaggcggcgcaggccgccggcaaggacccctacctgttccgccacgacctgctggcagagcagccgcgcctgcgcggcgtgctcgaactggctgcggaaaaggccggctgggacccgtccaggccgctgcccgccgggcgcgggcgcgggatcgcggtgaccgaggcattcaagaccttcgtcgcccaggtggtcgaggtctcggtggacaaggacggcaagctgaaggtcgagcgggtggtctgtgcggtggactgtggcatcccgatcaacccggacgtgatcgccgcgcagatggagggcggcatcggcttcggcctcggcgcgatcctgcacagcgcgatcaccctgaaggacggcaaggtcgagcagaacaacttcgacggctaccaggtgctgcggatcgccgagatgcccaaggtcgaagtgcacatcgtgccctccggcgaagcgcccaccggggtcggcgaacccggtgtggcgcccatcggcccggcgctggccaatgcgatcttcgccgccaccgggcaacgcctgtacaacctgcccttccccacctccttcgccaaggcctga

SEQ ID NO: 13676 - DNA, 1377 bp, Pseudomonas aeruginosa
ctggcggctgtgcctgatggcgctggccttcgaggaccaactggccggcctggacctcggcaaggttctgcgcatgtgcgtggtccacgacctcggcgaagcgatccacggcgacatccccgccgtcgagcaagcggcgcacccggacaagggcgaacaggaacgcgccgacctgttgcagctgacccgtcatctggacacgccgctgcgcgatcgcctgctcgccctgtgggacgaatacgagcgcggcgagtccgccgaagccctggcagtgaaggccctggacaagctggaaaccctgctccagcacacccagggcgacaatccggcggacttcgactatgccttcaacctcgactacggccgtcgctataccgaccgcgcaccgctgttcaagaccctgcgcgagctactcgacgccaggacccgacagcgcctcgcagctcggcgcgatgcctagcgtgcgcccgcccgggcagcgttaccagcgccaccgcctacgtagctcgccatggctacagggaagcggctggcacgtttccaccgaccgggcctgtcctgcacgcctcagtaaaggcgcgccttgatcagcggccgcagcaggtagttgagcacgctgcgcttgccgctgaggatgtccacctcggcgaccatccccggaatgatcggcaatacctcctcgccgcgcttcaactggctgccatcggtcttgatcagcacctggtagtaggactccttgccatgcggggtgtcctcctcgatggtgtcggcactgatctgctccagggtgcccttgaggtcgccgtagatggtgtagtcgtaggcggtgatcttcaccttggccggcatgccgggaaccaggaaggccacgtcgcgcggcttgatcttcgcctccaccagcagacgctcctctaccgggatcacttccatgatcggctcgccgggctggatcaccccgccgcgggtgttgatcagcacggtgttcacccgcccgcgcactggcgacaggatctcggtgcggcgcaactggtcctggcgctgctggacgatcggttccagggcgctgagatcggccttgcgctgtgcgcgctcggtataggcatcctggaaataggtgcttttcagctcggtcagcttgccgctgagggtggcgatgtcctggctcagcttgagcgcctccatctggctcaccgcacgcttggccaccagcgggcgaaccaggtcgagctggctctgcgccaggtggatctgccgctggatcgcctgggtgccctccaccagtttgtcgcggcgcgacttgaacagctcgcgttcggaacgcgccagcggcccctcgggatcgacgtccggcgggaactcgatgctcttcttgcctag

SEQ ID NO: 13677 - DNA, 348 bp, Pseudomonas aeruginosa
gcaggcgcagcagggtcgacttgccggcgccgttgccgccgagcagcgccacccgctcgccggcgcggatgttcagggcctgcacgtcgaccaccggcgggctgtcgccgtgggccatgcgcacgccctccaggcggtaatgtccctgcaggcgctccttgtgcacgaagcgcttgccctggggtcgctcctgctcggcgctcatcagttggtcgaggccttccatcgccaccttggtgtgctgccagcgaccgaggatgccggccgcctgcgacagcggtgcgatggcccgcgaggcgaggatcgagcaggccaccaggccgccgacggtcatcgcgccctcgctga

SEQ ID NO: 13678 - DNA, 462 bp, Pseudomonas aeruginosa
tgctgctgccgtcaggcgctatcttcaggccgctggccgccttcggcggagtggtgtccgggggcaccgaagaaccgccgccgccaccgccgccgctgctgttggaaatcgccaccccggcgccgatggccgccgcaccgaccagcagcgcagtccctgcgctcatgccaccgagcacaccggcgccggtcagcgactcgaaaccggccaggctttcctgcgggatgtagccggccatcagcggcccgtcggcagcgaccggcggcagatctaccgccaccagcttgtccttgtcggccaggaacagttggctggaaggctggccttccgcatagaagttggcgatccggacgctttccccggtcttcagctggacgatcaggtccgaaccgctcttcgagtatcccgccaccgactccggtgcgacatcgagcgcgacattactgctctgggagagtttga

SEQ ID NO: 13679 - DNA, 1194 bp, Pseudomonas aeruginosa
cacttcccggcacctcgtagttcgtcggcgcgaggcgacggcaagacgaccccgacagttccaacggaaagcatcgccgggcatcccgcgaagcggccttcatcgtcctgcaatcaaagcgtcatcgtcacgatgccaagttatccaaccgatcctctcccgcgagcgaccatgcatcacggtatctccccgccccaggacgccgacctgttcggcctgatctacggtttccgtttccgccccggcgaagcggggcgggaaatcgactcggttaccgccctcgcctgcctgcggcaggctcgcgaggaggcgccggacgagttcctctggctgcacctgaacctcgcccatgccgcctgcgagcgctggatgaagaagcatctggaactgccggattatttcttcgaaagcctgcgcgaggggtcgcgctcgacgcgcatcgaacacgtcgactcggcgctgctggcagtggtcaacgacgtggtcttcaacttcggcctggtctcttcggacgtcgccaccctgtgggtctgcgcccgtggccggctgctggtcagtgcacgagcgcaaccgctgcgctcggtggacaagctgcgctcttcggtgaagcacggcgaacctttccgttcgcccctgcagttgctgatccacctgttgcgcgaccagggcgacgtgctgacccagatcgtccgcgaaaccagcgtcgcagtggaccgcatcgaggaccagctactggccctgcgcctctccgccaaccgcgccgacctcggcgccatgcggcgcgtgctggtacgcctgcaacgcctgctggcgctggagcccggttcgctgctgcgcctgctcaaccgaccgccggaatggctacaggatgccgacctgcgtgagttgcgcgaagccaccgaggagttctccctggtgatcagcgacctgaccgccctgggcgaacggatcaagctgctgcaggaagagatcgcggccaagctcaacgaacagaacaaccgcatcctcttcaccctgaccatggtcacggtgctggccctgccgatcaacatcgtcgccggcttcttcggcatgaacgtcggcgggattcccttcgccgacgatcctgaaggcttctggatcatgctcgtgctggtcgccagcttcaccttcctcgccggccgctgggccttccgcaagcgcggcgactattga

SEQ ID NO: 13680 - DNA, 822 bp, Pseudomonas aeruginosa
gttgaccgaccaccgtcagccggaccttccatgagcctttcccccgccgatctcaagcaactccaggccgccaagaacctgctggagaaccctggactcaccgcgcaactcaccagcctgctgggcacgccgatcgaatacggcctgaagaagctgccgcggaaggtcaacgagaagctcggttcggtgatcgagggagcgctgctgaaagtcgcccgctcggccaccgccactctccaggaaaacgccagcggtcaaccggcgaaccgcctgcataccctcggcgccgccgtttccggtggcgtcggcggcttcttcgggccgctggcgatgctggtcgaggtgccggtcaccaccggcatcatcttccgttccatcgccgacatcgcgcgcagcgagggcgagtcgatcagggacatggacaccctgatggcctgtatcgaagtcttcgccctcggcggcaaatccgcctcggacgacgcgtcggagtccggctactacgcggtgcgtacggcgctggcccagcaggtcaaggcggccgccgacttcctcggcaaggacgccggcagcaagaaggccgcgccgatgctcctggccctggtgcgcaaggtcgccgagcgcctgggcgtgcagtattcggaaaagcttgcggcgcagatcgtgcccatcgtcggtgccctcggcggcgcggcgatcaacacggtgttcatgaaccatttccaggccatggcgcgcggtcacttcgtcgtccgccgcctggaacgccactacggcaaggatgtggttcgcgacgcctacgccctgctgccccggcgcggctga

SEQ ID NO: 13681 - DNA, 1239 bp, Pseudomonas aeruginosa
gcatgccggcccacgcggtcagcctggcgccgggcgcggcggcagcgacgcgccagctgttcagcgccgtttcgctcgcggcggagcccggctggagccgggccccgcgccgactcagagcgccaggccggggttgtacaaaggacggaaagcgcaatgggtggtgccggcgctctggttgtagaaatagtagcggcgacagtcgttgtcgtagttgctggtgccgacgttgatccggtacggaccgaagctggcgccctgcagggaaacgaaggcgccgttgtagagcagcgagaaatgcaggtgcggtccggtggagctgccaccctcgcagagcgcggtgttgatgttgccggcatagacgccgagcttggtgtcggcgctgacctgctggccgttgctcacctggatctggtccatatggtagtagttggtcgcccagccgctggggtgggtcacccgtacctggcagcgcgacagcacccgtaccgtaccggcgtgggcggcgaccacgctgtaggtcgcactgccccagcgcggccagtcgtaggacgcatcgaaggacgagtacggatagcccgagccggtgttcgaatgcgctccgttgggctgccaggaatagccctggcgccagggcaattgcatcaggttggatggcggcgccagcgcggccttcgcctggagttgccgggccacgcggttgcgcggctgcaggagttccgcggccggggtgccgaacaggcgctggaaggtctgcgcgtaggcgccgagcggattgccgccttgcacggcggaggccttcgccccctctcgcaacagaccgagcagcgcggccgatgccgcgttcaggccgtcctcgccgacggccttgcgcgcagccgcctggcgcaactggtattcctcgaaaccgtagtagcgccgcgacaactgctgcaacacgtcgcggacctgggcatcgaagccgcgtttcgccgacagccgtcccagcggcgccgccaaggcgcgctcgtccggcgcccccaacggcccggattgcatgaccatcagggtcagcaacactttcgggttgatgctgtagtagccgctccagtgctccaggtattcgctcttgtcgcgcagcgccggcgcattcaccgccaggtaggcctcgaggtcgaacgcctcggcgtcgcgaccgtagaggaacaggtcgtcattcagcggcagggccacgctgggcagttgcaactggccgagtaa

SEQ ID NO: 13682 - DNA, 582 bp, Pseudomonas aeruginosa
tcgatggcctggcgcacggtctcgatccgttccgcatcgtcatcggcgatctcgacgccgaactccgcttccagggccatgaccagttcgactacctcgagcgactcggcaccgaagtcgttacggaagtcgctgtccagccggatgtcgcattcctccacgccgaaccgggcggctaccagtttcctcactctggtctcgatgtcgtccatgcattgcggtcccactgcccggccctggaaaaaagtgcggctactaaagcctccgtccccgccagcgacaactgccagatctggcagtggcgctgcgctggagcgcggccgccgcagcgcgccggacaatccggtggacggagcgcgacgcgaggattcgaagtccgtcacagggcgcttcccggcgtatgcgcaatcacccgcgccttccctcgcggcaggctttcgggcagttccgccagggcccggcgtgcctgctccgggtcgaggtagtcgccccgctccaccgcgaacagctcctggccatcgcgcagttcgcggcgcaaacgcaacgacaggcccggatgccgctcgatcagcgcgcgcatga

SEQ ID NO: 13683 - DNA, 606 bp, Pseudomonas aeruginosa
ccagtgcgccgaaatcgcgactgccgaggccgactatcgcaccgtcgggcagctctgccggcggcttgccggcctgcaacgcgcccagcagggtgccgatggacaacccgctgtcggcgaagccagcgccgccggcgacatgcccgctacgcagcgcccattgcaccccgagggcgtcgccgatctcgccggacagctcgacgatcgccgcctccaccagcagttgcgcgcgcggcacgtcgagctggcggacgatgtcctcgagcaggccgacatcctccgggtcggcgaggatcaccagggcattcagcgattcgtcggcgcgcaccagcaggccgcgcttgccgcttccccggccatcctggccccgctcgccgtgcagcgattcgccgatctccccgagggtggcggcaagggtcttggcgtcgccatggcgcatgcggatcacccggctgttcgccgaccgcgacgaggggacgtcgagcgactgcgccagccgcagcaagcgcgctcgcgcctgcggcggaccgagcaggaccaggcggttgctgcggctgtcggcaaggacctggacggtggcggcgctcttcccggcggccggggtga

SEQ ID NO: 13684 - DNA, 1503 bp, Pseudomonas aeruginosa
gcaatcgagcgcctgttcgagcagttcctcgccaagcagttcccagtagacgaagggcgactgcaggccgaacttgtcgcggtagcgacagcggatcgcgtcgcggtagctgccgtcctccagccgtcccaggcaggcctcgaacagggcggcgcggcgctggcggaagtcggcgctgtgcaggtccgccggcgcgctgtggaagggatggaagaacgccccaggaacggcggcgaagatcgcctcccagcagagcagtccgaacagcgaattgatcaggccgttctcgacgtagtgcaccgcgcaatcgggctcttccaggtgctcgcggaccgcccactcgacgctacagggttcgctcgggaacgccaggcacaggtccaggcggtcgatttccggagccgccgcccgcgcctgtcgcggcaggccgagcttgccttgcaggcgcggcagcaatcgggccaggccctggcgttcggcgtcgctttccggcgcacagctggcctcccgcgccaatgcatgggcttcggcgaagcgctcgccgcgttccaggctgcgaatcgcccgcaggcgcgcgccggggtggctggattggcgatagagccgctgggccaggtcgaaatcccgctgcttttcgcagtgctgggcgaactggaacagcagcttgacccgccgcccttccagccagggattggcgtagggttcgcccggcaggccggcgagcagttcctccagcggctcgccgaggtcgaagcgctggcggcaatcgaacaggtggagataggcgtcgacgtcggcgcgcaggcgaaagccgcgggagtcggcggaaaactcgacgctttcgtaacgatagatacccaggtcggcaaggacaaactccgaccagtcctgccacaggttgccgaaatacatcaaccgcaagcggtcgcagagcgccatgcagcgcaactcgtagaccggttcggcgaagtcggcctgccactcggcgagccgccgcgcctcggggaacaacggctggagccgttccagcagcgcatccttgcgcaggttcgcgcgcccgagatggtccctgaacagctgcgacaattcgtccttcttcagcaagccgaacagttgcgccagttccagggtcggctgcgcgtccacccagcccaatgccaacagcggttgcacggcggcgcgcgtgtcgccgatctcggcataggccagcttgccttcgcggaacagcgtgcccttgcgcatcaccatgcgcaccagcagggcctggctggcctcgggcagctcggcgaacgcggcgatgaaggcacgttcctgatcgtcgagcagatcggcatagcgttcgccgatccaggcgagcaccgcgcggaagttgtgcaggtagtagaagggttcgggaagcgctggggaattcacgggaagcggagcctggtactgttcatgcatacagataccagcgcccccacggcttggcaatgcgcatccgatcaagcgtcgccggcctga

SEQ ID NO: 13685 - DNA, 1155 bp, Pseudomonas aeruginosa
caacgaaacctgccccgtatcggtcccgatgaagaagatccgccaacgcaacctgcaactgatcctcgacgccgcctgcgaagtcttcgccgactgcggcttcagcgccgcccggctcagcgacgtcgccgagcgcgccggcgtggcgaaggccaacgtgctctattactaccgctccaaggcgcaactctacgaggcggtgctggacagcatcgtcgagcccctgctggaagcctcccggccattcgccggcgaccagccgcccgccgaggcgctacgcgcctacgtcgacaacaagatgcgcatcggcgccgagcggccgcacgcggccagggtcttctcctgcgagatcatgcgcggcgcgccgcgcatgccggcgccgctgctggaacgcctcgacgcccaggcggaacgcaacgccgagcgcatccgccagtggatcgacgaaggcctgctggcgccgctggatccgtaccacctgctgctcaacctgtgggcgatgaccgagtcctatgcccttggcggctggcaactggcgcgcctcaccggccaggccgggctggacgcgagcgactaccggcaggcggcggaaaacatcgtccgcctggtctgcgccggctgcctggcactccccggcgaggccgcgccgcgtcggcgtttccgcgcgctggccggctgagcgacttgcgccggatcaatttccgcgtagcgctatattccaaaagccatagcgaacccctaagcttgcgccagccccgtccgccaacttcgttcgcccccacaggagcactccatgaccacccgcctgccccagctattgctcgccctcctcgccagcgccgtatccctggccgccagcgccgacgaggtgcaggtcgccgtcgcggccaacttcaccgcgccgatccaggccatcgccaaggaattcgagaaagacaccgggcacaggctggttgccgcctacggtgccaccggccagttctatacgcagatcaagaacggcgcgccgttccaggttttcctctccgccgacgacagcactccggcgaaactggagcaggaaggcgagatcgtgcccggctcgcgcttcacctatgccatcggcaccctggcactctggtcgcccaaggccggctacgtcgacgccaagggtga

SEQ ID NO: 13686 - DNA, 1029 bp, Pseudomonas aeruginosa
agggtgatcaggagcgtctgcttttctccggtgagggtaatgcggtggccgggcatgaaaacctcctgcgggcacgcgtgcctcttcagtccttgccgaaaacatcgctatgcttcggcaatgattgccctggagtcacgaatgaaagccaactccgatgaactgcaaagcttcgtcagtgtagtcgacagcggttccatcagcgccgccgcggaacagatgggactgaccgcctcggccgtcagccggaccctctcgcgcctcgagcacaagctcggcaccaccctgctcaaccgcaccacccggcgcatggagctgaccgaggaaggccgctacttcctcgaccaggcacggcagatcctgcagcagatggaggcgctcgaggaacgcctggccctgcgccggcagagccccgccgggcgcctgcggatcaacgccgcctcgcccttcatgctgcacgcggtggtgccgcacatcggcgagttccgccggctgtacccggacatccagctcgaactcaacaccaacgacctgatcatcgacctgttggagcaacgcaccgacgtggcgatccgcatcggtgcgctcagcgactccaccctgcacgcgcgcccgctgggcgccagccgcctgcacatcctcgccagcccggagtacctggcccgccacggcacgccggcgagcatcgaggggctgcgagggcacaccctgctcggcttcacccagcccgagcacctcaaccgctggccggtggtgcacgccgacggcgatcgcctggagatccagccggatatctctgcctccagcggcgagacgctccgccaactggtcctgagccaccagggcatcgcctgcctggccagcttcatgaccgaccgcgatatccaggacgggcgcctggtgccgctgttcgccgaacagatgagcgaataccggcaaccgatccacgccgtctactatcgcaactcgcaactggcgctgcgcatccagtgcttcctcgacttcatccagcagcgcctgggcgcctga

SEQ ID NO: 13687 - DNA, 696 bp, Pseudomonas aeruginosa
cgacgagcacgccgacgaggcagcgctggcggccaatgtcgacgtggccgccctggaaaagcagaagatcggcggcgcgatccgtaccgacttcatcctctccgcggaaatcatcgccatcaccctgggtaccgtcgccgagtccagcttcaccacccaggtactggtgctggtcggcatcgccctggtgatgaccatcggcgtctacggcctggtcgccggcatcgtcaagctggacgacgccggcctctatctgtccaagcgcgacagcggcttcgcccaagggctcggcggcgccatcctgcgcaccgcgccgtacctgatgaaaggcctgtcggtggtcggcatggcggcgatgttcatggtcggcggcggcatcctcacccacggaatcccggtggtccaccacgccatcgaacaggccgcgcagagcgtcgccggcatcgccacgctgggcccgatgctggcggcgatcaccccgaccctgctgaacttcctgttcggcatcgtcgccggcgcggtggtcctggcggtggtgctgctggtcaagcgcctgctgccgaagaagaaaaagactggctgagcctgccatcgccggcagcgccatcgcggagggcggatagccgccctggcgcacatcccacgaagcggttgtgcgccctgccccggaagtcctcctccgtttcaattcaataa

SEQ ID NO: 13688 - DNA, 1500 bp, Pseudomonas aeruginosa
accgactccatcatccagggatggatgcctccagcacgaaagtgccttacggggccggcaacggcccctttctttcgcttcgaagagttccatgaacgactcccccagcaccgccgtacgcacctggctgaaaggcttccgccccctgaccctgaacgctcgaccgcgcgactgcctgcgcgccggactcggtgcctgcatcggcgcgctcgccgcggtattcgcctgccaggcgttgttcggcagcgaactggcgctgcgcctggcagcgccgctcggcgcatccgccgtactactgttcgccctcgcctccagccccctggcgcaaccctggtcgatgctcggcggcaacctggtcgccgccctggtcggcggcctcagcgcctattggttcggacacgatctggccccggccctggtcggcatggccctcggcatgctgctgatgttcgccctgcgctgcctgcatccgccgagctgcgcgctggccctgagcgtggccctcaacccgtccctgagcgaactcggcatcgacgtggtctggccgatcctgctctccaccctggtgctgatcggctgcgcgctgctctacaacaacctgatgcgctctccctacccgcgcccctaccagtcgccgcgggccaatctccatggcacccgcgacctggcgccgagcgcgcgtacggacttctccgcccgggacctggaccaggcgctgcaggacttcggcgaatacgtcgacatcacccgcgacgacctcgagcgactgatccaccataccgagcgctacgccttgcgccggcgcatgggcgagctgaccgcggcacggatcatgtcccgcgacgtgcagaccgccagcaccgagaccttcatcgacgacgcctggaagcagttgcaggaacaccgtctgaaggccctgccggtgctcgacgagcatcggcggctggccggcatcgtcacccagagcgacctgctcaagcacttccgccccgacggcagcccgttcaagcgcctgcgcttcctgcgcgggaccaagctgaagacgatcatgaccaccccggtggtctgcgtacaggccgacacccacgccgtcgaactggtctcgctgctatccgacgaaggcctgcactgcctgccggtgctcaacgaagccggctacctggtcggcatcgtcagccagaccgacctgatcgccgcgctctaccgcaactggctgcagcacctgggccaggccgatcagatcacgtagtcccagcgctgcgaccagtcgctgtcctcgcggaccacttcgcgcagcaactggaacgcatggcgcagggtcggcgacaggcgctcgcgggagtacaccatgtaggtcgggtaggcgaactccggcgcctgctcgacccgttgcagggtgccgccatccaggtagctgctcaccacccgggtacggaaataaccgctgccgccgttctgcatgatgtactgcagggccagcggaccgaggttgcaggctag

SEQ ID NO: 13689 - DNA, 1653 bp, Pseudomonas aeruginosa
tcgatcgcactggcacccgcctgctgggccgtgcacgcattccgagctccgcctactccgatccggagcagcttgccggcctgctgcaacaggcacgcgaagaactcagccacaacggctacaacctgcaggactggagtatgcccagccaaggctgagccgttccatacgacgaaaggcgcccacgggcgccttttttcgtttcctctattcgaggcggtcgtgctgccggaacgccacgcgcaccgcgttgcgccctgcatccttggcctcgtagagcgcgcggtcggcctcgcgatagagcgcgtccaggcccatgccggaggtcgaataggccacccccaggctgatggtcaggcaggggccggcgctggagcccaggtgctcgatgcccagcgcctccaccgcctgccgcaggcgctcggcgatggccagggtgttgccctcctcgctgtcgtagagcaacacggcgaactcctccccgcccaggcgcgcggcgatatccagcggccgccgcgcgccctgccggagcacgacgccaagctggcgcagggcggcatcgccggccggatgcccgtagtggtcgttgtaggccttgaagtcgtcgacatccaccaggatcagcgccactcccttttcttcgcgggcgccctgctccagggcccgctgggcgagcagctcgtagtagcgtcggttgaccaggccggtgaggctgtcctgttcggccatcatgcccagcagccgccggccgaggaactgctcgcgctgggcgtagtcctgcaggtacagggcgaacgaacagatcagcaccaccaggccgttgtagagcgtattcagcaggttggtacgcaggttctcttcgccgccgaaaagcaggaataccgccaggttcagggccaggcacagcaacgccaggcgcacgcaggcccagaacgccaggccgagcgggaagaacaccgcgaggatgcccagggtcgcgcccagttgggtgaagcgcggcaccccatgccactcgaacagcacgtcgcaggccagcaccgccaggttgatcagcagcaggcagtagggcgcgatggcatcgccgaccttgcgcaggctgggcaggaaggccgccggccagaccaccagcagcaggccgatcattcccaggcgcacgcccagcagttgctcgaacaggctggggtgcaggcggatgtccaccatcatccagtcggccacgatgaacagcgcccagatcaggaacgccaccccgatggcagcgcgccgctgcatcagcgagttccagctgagaaactcgcgaaactcgttttccagctccttttcgaaccgcaaccaacgaaagccggtgcgcaactggcgcgcatacggattatccggcagaccagcctgtaccaggctgtcgcgtgcaagcatgctgactcccctacctcggaccgaacgctgaaacaggcctggacgacaataccctggcgcctctgcagcgatgagtcaaaaagccatcaccctttaccagacaatagggcatgcggcgtgccgaggcgataccaaccatcggcgcagcgggacgccccgggcgagcgaatggcaagatccgtgggccgactggcattgcggccaggcccgaaggacgccagactgccgccatcgccatga

SEQ ID NO: 13690 - DNA, 1014 bp, Pseudomonas aeruginosa
ggttgtgccatgcccgaaccgcgcctgattgcctgcctgatctatcccgacgtgatgagcctggacgtgaccggaccgctgcaggtattcgcctcggccaacgtcgaacgccagcgccagggcctgccgcctttctaccggatacaggtgctcggcgagcgtagcgaagcggtgcccagttccgcgggcatccgcatctgcgccgacctcgcctggcgcgactgtccgccggaaagcctggacaccctgttggtgcccggcggcctcggtgtcgaggcgcagacccgcaacgccgacctactcgcctggctgaaagccgccgaaccgtgcatacggcggctcggctcggtgtgttcgggagcgctgatcctggccgccgccggggttctcgacgggcgcccggcgaccacccactgggccgacgtggcgacgctgcgccaggggtttcccggcgtccatgtgcaaggcgaccgcctgcatacctacgacccgcggtgccgcgacggcgacgcccacatcttcacctcggccggcgtcacggcgggaatcgacctggccctggcgctggtcgaggccgacctcggccgcagcctggcgctcagcgtcgcgcgacgcctggtgatgttcctcaagcgtcctggcggccaggcccagttcagcgcctggctgaccccggaaccgagccgcaccccgcgtctggccgcgctgctggagtggattcccgccaacctcgccggcgacctgtccctggaagccctcgccgaccaggcctgcatgagcccgcgtacgctgtcccgggtatttctccaggaactgggcgtggcgcccggtcgctacgtcgagcgggttcgcctggaggccgcgcgcgccctgctgcaggacgcccaggcgtcgatcgccacggtgtcccggctgtgcggcttcggccatccggaaaacctccggcggacgttccacaagcatctttcggtcagcccccaggaatacgccgaacgcttcggcatgctgacctga

SEQ ID NO: 13691 - DNA, 741 bp, Pseudomonas aeruginosa
cactgctctggccggtacgacgaacgcggacgctgtcgcgctgaaacgccggcaacgaaaaaggcgaccttgcggtcgcctcttctgccttacggaaacgcctcagtagtaggcgttctccttgttgctgtggtcggtcacgtcgcgcacgcccttcagttcgggaatacgctcgatcagggtcttctcgacgccatccttgagggtcatgtcgaccatcccgcagccctggcaaccgccgccgaaacgcaacacggcgatgttgtcctcgaccacgtcgaccaggctcacctgtccgccgtggctggccagcccgggattgatctcggtctgcaggtagtagttgatgcgttcggtgatcgggctgtcctcgttgaccatcggcaccttggcgttcggcgccttgatggtcagttggccgcccatgcggtcggtggcgtagtccaccaccgcgtcttcgaggaagggctcgctgaccgcatcgatccaggcagtgaagtccttcagggcgatggcggtgtcctcgaccttttcctcgcccggcttgcagtaggcgatgcaggtttccgcgtactgggtacccggctgggtgatgaagatacgaatgccgatacccggggtgctctgcttctccagcaactcggccagatacgcttgggcagcttcggtaatggtgatggcgctcatggcaactcctcgcaaatatgccgacagtttacgccaatcggtacttgcggataa

SEQ ID NO: 13692 - DNA, 699 bp, Pseudomonas aeruginosa
cttcgaggaaacagggatatgtttcgactcgccgcgccccatccgcgcccgttcgcgtgcgccccacgtcccctcttcgccgctttccgcctgctgtcgtcaggcggcgcttccgttcgcgcccggcgcggcctggtccatcctttcgccgccctggcggcccaacggagaacccgccccatgaaactgctcgccggcagcttcgccgctctcttcctgagcctttcggcccaggcggcggactgtactttcacccagctggaaatcgtgccccagttcggctcgccgaacatgttcggcggcgaggacgagcacgtccgcgtgatgttcagcaacgaggatcccaacgacgacaaccccgatgcctttcccgaaccgccggtctacctggccgaccgcgacagcggcaacgattgccgcatagaggacggcggcatctggtcgcgcggcggcgtgttcctgagccaggacggccggcgcgtgctgatgcatgaattcagcggctccagcgccgagctggtgtcctacgacagcgctacctgcaaggtggtgcaccgcgaggacatctccggccagcgctgggcggtggacaaggacgggctgcgcctgggtcagaaatgctcgggcgaatccgtcgacagctgcgcgaaggtcgtgaagcgttcgctcgcgccgttctgccagaccgcaaagaaatga

SEQ ID NO: 13693 - DNA, 3795 bp, Pseudomonas aeruginosa
atgaaattcatggtccgaccacccccggccggaaagcccctgcctttgttatgcttttcacctttccgcccactgacgccaggtccatccatgtccagcccgctcaccgatcgcagcgcccgcctgcaagccctccagcacgccctcagggaacgtatcctgatcctcgatggcggcatgggcaccatgatccagagctacaagctggaagaggccgactaccgcggcgagcgcttcgccgactggccgagcgacgtgaaaggcaacaacgacctcttgctgctgagccgcccggacgtgatccaggccatcgagaaggcctacctcgacgccggcgccgacatcctcgagaccaacaccttcaacgccacccaggtgtcccaggccgactacggcatgcagtcgctggcctacgaactcaacctcgaaggggcgcgcctggcccgccaggtggcggacgcgaagaccgccgagaccccggacaagccgcgcttcgtcgccggcgtgctcggcccgaccagccgcacctgctcgatttccccggacgtgaacaaccccggctaccgcaacgtcaccttcgacgaactggtggagaactacgtcgaggcgacccgcggcctgatcgaaggcggcgccgacctgatcctgatcgagaccatcttcgacaccctcaacgccaaggcggcgatcttcgccgtccagggcgtgttcgaggaactcggcgtggagctgccgatcatgatctccggaaccatcaccgacgcctccggccgcaccctgtcgggccagaccaccgaggccttctggaactcggtgcggcatgcccggccgatctcggtaggcctgaactgcgccctcggcgccaaggaattgcggccgtacatcgaggaactgtcgaccaaggccgacactcatgtctcggcccaccccaacgccggcctgccgaacgccttcggcgaatacgacgaatcgccggcggaaatggccgtggtggtcgaggaattcgccgccgccggcttcctcaatatcgtcggcggctgctgcggcaccaccccggcgcacatcgaggcgatcgccaaggcagtggccaagtacccgccgcgggccatcccggagattccccgggcctgtcgcctgtccggcctggagccgttcaccatcgaccgcagctcgctgttcgtcaacgtcggcgagcgcaccaacatcaccggttcggccaagttcgcccggctgatccgcgaggaaaactacgcggaagctctcgaggtcgcccagcagcaggtggaagccggcgcccaggtgatcgacatcaacatggacgaaggcatgctggactcgaaggcggccatggtcaccttcctcaacctgatcgcctccgagcccgacatctcgcgcgtgccgatcatgatcgactcctccaagtgggaagtgatcgaggccggcctgaagtgcatccagggcaagggcatcgtcaactcgatctcgatgaaggaaggcgtcgaggccttcaagcaccatgcccgcctgtgcaagcgctacggcgccgcggtggtggtgatggccttcgacgaggacggccaggccgacacccaggcgcgcaaggaagaaatctgcaagcgctcctacgacatcctggtcgacgaagtcggcttcccaccggaagacatcatcttcgatgcgaacatcttcgccatcgccaccggcatcgaggaacacaacaactacgcggtcgatttcatcaacgcctgcgcctacatccgcgaccacctgccctacgccctgagctcgggcggggtgtccaacgtgtccttctcgttccgcggcaacaacccggtgcgcgaggcgatccactcggtgttcctctactacgcgatccgcaacggcctgaccatgggcatcgtcaacgccggccagctggaaatctacgacgagattccgaaagcgctgcgcgaccgggtcgaggacgtggtgctcaaccgcacgcccgaggccaccgaggccctgctggcgatcgccgacgactacaagggcggcggcgcggtcaaggaggccgaggacgaggaatggcgcagctacagtgtcgagaagcgcctcgagcatgcgctggtcaagggcatcaccacctggatcgtcgaggacaccgaggaatgccgccagcagtgtgcgcgtcccatcgaggtcatcgaaggtccgctgatgtccgggatgaacgtggtcggcgacctgttcggcgccggcaagatgttcctcccgcaggtggtcaagtccgcgcgagtgatgaaacaggcggtggcccacctgattcccttcatcgaggcggagaaaggcgataagccggaagccaagggcaagatcctgatggccacggtgaagggcgacgtgcacgacatcggcaagaacatcgtcggcgtggtgctcggctgcaacggctatgacgtggtcgacctcggcgtgatggtgccggcggagaagatcctgcagaccgccatcgccgagaaatgcgacatcatcggcctgtctggcctgatcacgccgtcgctggacgagatggtccacgtcgccaaggaaatgcagcggcagaatttccagttgccgctgatgatcggcggcgccactacctcgaaggcgcataccgcggtgaagatcgatccgcagtacagcaacgacgcggtggtctacgtcaccgacgcctcgcgcgcggtaggcgtggccaccagcctgctgtccaaggagctgaaggccgactacgtggcccgcacccgcgccgactacgcggtggtccgcgaacgcacggccaaccgcagcgcccgcaccgagcggctgagctacgaacaggcgatcgccaacaagccggcgttcgactgggccggctaccaggcgccgacgccttccttcaccggcgtcagggtgctcgacgagatcgacctcgcggtgctcgccgagtacatcgactggacgccgttcttcatttcctgggacctggccggcaagtacccgcgcatcctcaccgacgaagtggtcggcgaggccgccacctcgttgttcaacgacgcccaggcgatgctgaagaagctgatcgacgagaagctgatcaaggcccgcgcggtgttcggcttctggccggccaaccaggtcgagcacgacgacctggaggtctacggcgccgatggcgagaccctcgccaccctgcaccacctgcggcagcagacgatcaagccggacggcaagccgaacctgtcgctggccgatttcgtcgcgccgaaggaaagcggcgtgcgcgactacatcggcggcttcatcaccaccgccgggatcggcgccgaggaagtggccaaggcgtacgaagccaagggcgacgactacaacagcatcatggtcaaggcgctcgccgaccgcctcgccgaagcctgcgccgagtggctgcacgagcgggtgcgcaaggagtactggggctacgcccgcgacgagcacctcgacaacgaggccttgatcaaggagcaatacgtcggcatccgcccggcaccgggctacccggcctgccccgaccataccgagaaaggcaccctgttcgaactgctcgatccgcagggcctgtccggcgtcagcctgaccgagcactacgcgatgttccccgccgcggcggtcagcggttggtatttcgcccacccgcaggcgcagtacttcgcggtcggcaagatcgacaaggaccaggtggaacgctacagccagcgcaagggccaggaagccagcgtcagcgagcgctggctggcgccgaaccttggctacgatgactga

SEQ ID NO: 13694 - DNA, 1053 bp, Pseudomonas aeruginosa
gatgcgcgccccatgcgtagccaagacctccaccagcgcctcgccgatctcggcgccaagcccctgcattgcgggaggatcgtccgcgcctggctgcagggccgcgccctcgatgcctgcaccgcccgccagcgggccgaggacttcctgccgctgggcgtacgccatggtctgccccaggtagcagcggaactggaaggcatcgcccgcctgcacagcgagcatccggcgagcgacggctcgtcgcgcctgctggtggaactggccgaccggcagatggtggaaagcgtgctgctgccgcgcggtgggctgtgcgtctcgacccaggtcggctgcgcggtcggctgcgtgttctgcatgaccggccgcagcggcctgctgcgccaggtcggcagcctggagatggtcgcccaggtggtcctggcgcggcgccggcgagcggtgaagaaagtggtgttcatgggcatgggcgagccggcgcacaacctcgacaacgtcctcgaagccatcgacctgctcggcaccgatggcggcatcggccacaagaacctggtgttctccaccgtcggcgacccccgcgtgttcgagcgcctgccccggcaacgggtgaagcccgccctcgccctgtccctgcacagcacccgcgccgaactgcgccggcaactgttgcccaaggcgccgccgctgagcccggaagaactggtggaagccggcgaggcctacgcccgccgggtcgactatccgatccagtaccaatggaccctgctcgaagggatcaacgacagcctggaggaaatggacggcatcctgcgcctgctcaagggccgcttcgcggtgatgaacctgatcccctacaacagcatggacggcgacgcctaccggcgcccgagcggggagcggatcgtcgagctggtgcgctacctgcacagccgcggcgtgctgaccaaggtgcgcaactcggccggccaggacatcgacggcggctgcgggcaactgcgcgccagggccacgcagggcacggcggaacgacgcatccccgcccgccaggcctga

SEQ ID NO: 13695 - DNA, 1695 bp, Pseudomonas aeruginosa
cgcagtaagccgcatagcctgacagcaggaatattcatgtacgtatacgacgagtacgaccaacggatcgtcgaggaccgcgtcaagcagttccgcgaccagacccgccgttacctggcgggtgaattgaccggtgaggagttccgcccgctgcgcctgcagaacggtctctatatccagcgctatgccccgatgctgcgcatcgccgttccctatggcctgctctcctcgcgccaactgcgcaagctggcgcagatcgcccgcgactacgacaagggctacgcccacatcagcacccggcagaacgtgcagttcaactggccggagctggaagacgtgccggaaatcctcgccgagctggccaccgtgcagatgcacgcgattcagaccagcggcaactgcatccgcaacaccaccaccgaccagttcgccggcgtcgcccgcgacgagctggtggacccgcgcccctggtgcgagatcatccgccaatggtcgaccttccaccccgagttcgcccacctgccgcgcaagttcaagatcgcggtgaacggcgcggtgagcgaccgtgccgccatcgaagtgcacgacatcggcctggaggcggtgaagaacgaggccggcgagctcggcttccgcgtctcggtcggcggcggcctgggccgaacccccatcgtcggcagcttcatcaatgaattcctgccctggcagcacctgctcggctacctggatgccatcctgcgcgtctacaaccgctatggccggcgcgacaacaagtacaaggcgcggatcaaaatcctggtcaaggcgctgaccccggaagtcttcgccgagcgcgtcgaggccgaatgggccaacctcaaggacggaccgagcaccctcaccgaggcggaagtccagcgcgtcgccgcgcatttcgtcgatccggcctacaaggccctcgacgacctcgacgagtccctcgcccggctcgacgcggagcaccccggcttcgcccgctggcgcgcacgcaacaccttcgcccacaagaagcccggctacgtcgctgtgacgctctcgctgaagcccaccggcaccgcgccgggagacgtcaccgacaaacagctggaggccatcgccgatctcgccgaccgctacagcttcggcgaggtgcgcaacagccataatcagaacatcattctcgccgacgtcgagcagggcgaactcttcgccctctggggcgaactccgcgaactgggcttcgccacccccaacgtcggcctgctgaccgacatcatctgctgccccggcggcgacttctgctccctggccaacgccaagtcgatcccgatcgccgaagccatccagcgccgcttcgacaatctcgactatctattcgacatcggcgacatcgacctgaacatctccggttgcatgaacgcctgcggccatcaccatgtcggccacatcggcatcctcggggtcgacaagaaaggcgcggagttctaccaggtctccctcggcggcagctcggcgcgcgacgccagcctcgggcagatcctcggcccgtccttcgcccaggagcagatggccgacgtgatcgacaagatcatccaggtctacgtggaacgccggaccgaggaagaacccttcatcgacaccttccgccgtatcggtatcgacccgttcaaggagcgcgtatatgcagcgaatcattaa

SEQ ID NO: 13696 - DNA, 864 bp, Pseudomonas aeruginosa
ggaccgccaggtggtcgacgaccgctggcacttgctgcccaaggacgcgaccctggaaagcgtacccaacagcgacgacgtgatcatcccgctggccctgtggctcgagcacggcccggccctgcgcggccgcgacggcggcctgggggtctggctggacgcggacgaggagccggaaagcatcgccggcgacctcgacaggttccaggtgatcgcggtgaacttccccgcctttaccgatggccgcggcttcagcagcgcgcgcctgctgcgcgagcgctacggctacaagggcgagatccgcgcgatcggcgacgtgctgcgcgaccagctgttcttcatgcgccgctgcggcttcgacgcctacgccatccgtgccgaccgcagcccggaagacgccctggccagcctggacgacttcagcgaggtctaccagacctcggtggagcagccgctaccgctgttccgccgccgcggctgacccccgccctgacgaaaaagccccgcagccgcggggctttttcattcccgaggtcacggacgcctcaggccgcccgcacgctgtcccaggccacctgcgccagcagttcgcgacagtcggccaacgccacccgggttcgcccggccagccactggcgggcaagatcgtgggccgggccgatcaccaccgaagcaaagcagtcgtccggcatctcgcggaacaggccctcggcccgatatcccgccagcgccgcatggatccgtgcgaagtgcgcctggttgtcggcccgcaggcgctcgcccagctcccccgcctccacccgcccgcggctgtgcaggatgaagcgtgcccagtcgggattcgccacgacccagtcgatgtag

SEQ ID NO: 13697 - DNA, 1194 bp, Pseudomonas aeruginosa
tgtcccgacgcagcatcgagtcgctgctgggcttctaccgcgaagcgccgaaaaccgcctggcgcatcgctcccgaggaaatcggcgcccgccacatcggccatttcggcttcttccggccgcagttcgccgaatcgctatgggcgggctacctgttgccggagctgggctccggtaacgccctcagccgaggttgaccagcacccggccgaccagcttgccggcgaggatctggttgatcgcccccggcagctcttcgagggcgatctcgcgcgccacctcttcgaggttgtcgagcttccattgcagcgacagcttgtcccacatggatgccttgaccaccagcggcagctccaccgagtccaccccgagcaggttgaccccgcgcaggatgaacggcagcaccgaggccttgaagccggcgccggcggtcaggccgcagcaggcgacgctgccgccgtactgcaacgacttgaccacgttgaagaggatgtcgccgccgacggtgtccaccgcgccggcccactgttccttgagcaacggcttgtcgacgccatcggccacggtggcgcgatcgagaatctgcttggcccccaggcggttgaggaactcggcctgctccagcttgccggtggcggccgccacggtgtagccgagcttggccagcagttccacggcgatactgccgaccccgccgctggcgccggtgaccagcaccgagccatggtcggggcgcaggccgctgcgctccagcttttcgacgcagagcgccgcggtcaggccggcggtgccgaggatcatcgcctcgcgcaggctcaggccttgcgggcgcttgatcacccaggccgcgggcacgcggatgtactggccgaaaccgccggcggtgttcatgcccaggtcgtagccggtgacgatcacctcgtcgccggccgcgaactcggccaccgaggactcggcgaccacaccggcggcatcgatgccgggggtatgcgggtacttgcgggtcaccccacggttgccgctggcggacagcgcatccttgtagttcagcgaggaatactgcacgcggatcagtacgtcgcccgccggcaggtcgccggtatcgcgctcgaccacctgcgtttcgtaaacgccgtggggcgcttccgtcacccacaacgccttgaatacagccatttcgacctcctctcgtga

SEQ ID NO: 13698 - DNA, 753 bp, Pseudomonas aeruginosa
tcctcataccctcgcggaactttcacccgccgaggtccgcccgtgggcagcatctacctgattcgacatggccaggcgtcgttcggtgccgacgactacgacgtgctgtcgccgaccggcatccgccaggcggaaatcctcggcgaccacctgctgaacctcggcgtccgtttcgaccgcgtcctcagcggcggcttgcgccgccagcagcacaccgcccgcgccgccctcgaacgcctggagtcctccgggctggccacgccggagctggaagtcgatccggcgttcaacgaattcgaagccgacgcggtgatccgcgcgcacctgccggacctgctcgatgagcagccggaagccttgcacatccttcgccatgcggccgagcatcgggccgagttccagcgcctgttctccaccatcatcgcgcgctgggtttccggcaaccatgagaaagatgggctggaaagctggcaggaattcctcgataaggtccatgacggtcttcgtcgtctgctggcgcaggccagcggcaaggacagggtcgccgtgttcacctccggcggtaccattaccgccctgctccagctgatcgtcggcgttccgccgctcaaggccttcgagctgaactggcagatcgtcaatacctcgctgactcgcctgaaattccgcggcgaggaagtgtccctggcttccttcaacagtcacgtgcacctggaactgttgaaggcgccggaactcatcacctatcgatga

SEQ ID NO: 13699 - DNA, 333 bp, Pseudomonas aeruginosa
aagaaaggaatagaacccatgaccaccgttgctgacatcgtctccaccatgaaaagcaagttcaacgccagcgcggccgccggcctggatctggtgttccagttcaacatcgaagacggcgacaaccactacctggtcgttaaggatggtacctgcgaagtggtacagggcgacgccgagaaccccaacgtcaccctgatcatggacagcgaaaccctgaagggcatcaccagcggcgagaccgacggcatgcaggccttcatggccggcaagctgcgcgccgaaggcgacatgatgctggcgatgaagctgggcgaactgttcccggtctga

SEQ ID NO: 13700 - DNA, 507 bp, Pseudomonas aeruginosa
cctggcagcactggttcagcggcgcctgagcggcgcgccaggtacaggtcgatcaggtgccgggcgatcgagcgctgcgccggtagcggcggcaaggcatcgagggagaaccactgggcgtcctcgatctcgtcctcctgcgggacgatctcgccggacacgtactcggcgtggaaaccgagcatcagcgaatgcgggaacggccagttctggctgccgatgtattcgagattggcgacctccaccccgacctcttcgcgcacctcgcggaccacgcactgctccaccgactcgccggcctcgacgaagccggccagggtactgtatacccccggcacgaagcgcggcgaacgcgccagcaacacctcgtcgccccgggtcaccaggacgatcatgctcggcgacaggcgcgggtactggtgcagcccgcactgcggacactgcatcacccgctcgtggtcctgcgtctgcatgcgtgtgccgcaattgccgcagaaccggttgtga

SEQ ID NO: 13701 - DNA, 1221 bp, Pseudomonas aeruginosa
acgcggcgagaactcgtccggtcgcaccgccagcagttgcaacagcgcggcggtgcagaacgcgtaggggaccaccccggtcatggtgccgagcaggatgatcacgttgaacacatcgaccaggtcgccatgcccgtcgaccatcaccagcgccgtcaccagcagccccgaggccagcaggccgtgggccggcgcgccgttcttgttgagctggccgagcgactcagggaacagcccgtcgcgcgccggagccaccgggatctggccctgcaacaggacccagccattgagcgcgcccaggcaggcgatcaccgccccggcagccaccaggtagtagccccagtcgcccatcaggatccgtgccgcgtcggcgaacggcgaggtggagcgggccagcacctccggcggcatcaggccctgcaccgcagtgatagagaggatgtagagggccgccgcggccagcgtgccgaacagggtcgcgcggggaatggtgcggcgcgggtcctcgacgtcgtcggccggcacggtggccgactccaggccgatgaacgaccaaagggtcagcgccgcggtggtggcgatcgcctgggcatagcccatgttcggcagctcgctgcgcgccgggatcgccaggtgctcgggattgaagtggaaccagccgaggataccgaccagcaacaacggcagcagcttgaggatggtcagcaggttctgcaccacgctgaaggtgccgatgcctcgcaggttgatcagggtgcacagccagatcgcggcgatggccacgcagaccatcagcagcggatccgccagcgccgggatgaacacccgcaggtagccgaccagggtcacggcgatcgccgcgttgccgatccaggcggctttccagtaggtccaggcgcacaggtagccggcgaagctgccgaaaccgtcgcgggtataggcgtaggggccgccggcgccggggttgacccgcgccaggcgggcgaaggtcagcgccagcagcaccgcgccggtgctcgacaccagccagccgaacaggctgagcccgccgaacgccgccaggctggagggaagcaggaagactcccgaaccgaccatgttgccgatcaccagcgcgctgcaggtccagaaccccatgccgcgcttgccggccttctctccccccgccatcgacaccccttagcctgtcggcctcattcttttatgcattcaacggtatag

SEQ ID NO: 13702 - DNA, 510 bp, Pseudomonas aeruginosa
cccccggcggcttgcccttgtaagaaaaggtcgcggcaacacaagtcggcgcgccgcgcttgcctcctctcccgccagcgaggagcatggacctctctgccctgctacggagcgacaacgatgcgcagcgcttatcggatcgtcagcgatcactatgcggcctctagccgtgggaacctcgccggaatgctggcggacatggacgaacgcaccgaatggacggaaatggccggtttcccgctggccggcacctatgtcggcgcggccgccatcggcgccggtgtgttccaggccttgcagcgggactgggagggcttcagggtcgagatcgagcgcctgatcgacggcggcgacagcgtggtcgccgtcggtcgatatgcagcgacccaccgtcgcagcggcaagtcgttcaaagcgcgtgtggcacacgtatggacggtagaggacggcaggatccgccgtttcgagcagttctgcgacaccttgctggtggaccgggcgacacgctga

SEQ ID NO: 13703 - DNA, 708 bp, Pseudomonas aeruginosa
cggaccacctgccgacttctcgatcaccgccagccgcgccgcatgcgcagccagctcttcggcgttggcgcgcagcaccggggtggctacccgcgccggatcgagccgacggatcgggctgaccatcggccggccgctgccgtcgccttccgcgccgctgccggccagcgacaggctggtctggccgccggtcatcgccaggtagacgtcggcgaggatctcggcgtcgagcaacgcgccgtgcaggtcgcgaccggagttgtccacgccgtagcgcttgcacaacgcatcgaggttgttgcgctggcccggatggcgctcgcgggccatcagcagggtatccagcaccgagcagtactcggtcacgtccgagcggtcctgctggcccagcagggcgaactcgttgttgatgaagccgatatcgaacgccgcgttgtggatgatcagctgggcgccgcggatgaattcgaagaaatcgttggcgacctcgcggaagcgcggcttgtccttcaggtattcgttggtgatgccgtggacggcgatcgccccttcgtcgacctcgcgatcgggttgcaggtagacgtggaagtggcgaccggtcaggcggcgcccctccagctcgacacagccgatctcgatgatccggtgaccatcggtcaccggcatgccggtggtttcggtatccagtacgacgctacgcatctatag

SEQ ID NO: 13704 - DNA, 1380 bp, Pseudomonas aeruginosa
ctactacgtcgatacctggcgggtcgcctactggaaccgtttcggccggccgaaggtgacgccactctacgactggggcctgatgacctggtggcagaccagcgacaaggcgctgccgagcaaggcgcaagccgaagccacgcaagacgccgagccggaacgggagtaacgccgcatgctctcctatatcctgcggcgcctgctgctgatcgtccctaccctgttcggcatcctgctgatcaacttcatcatcatccaggccgctcccggcggtccggtggagcagatgatcgccaagctggaaggcttcgacgccgcttccggcggcgccaccgggcgcatctccggcggcggcggcgaagtcgccgtggccggctcgcaataccgcggcgcgcaaggcctggacccggagctggtgaaagagatcgagcgcatgtacggcttcgacaagtcggcccccgagcgcttcatgatcatgctgaagaactacctgcacctggacttcgggcagagcttcttccgcgacgccaaggtcaccgacctgatcatcgagaaattgccggtgtcgatctcgctcgggctctggagcacgctgatcatgtacctggtgtcgatcccgctggggatcgccaaggcggtccgccatggcagcgtcttcgacatctggaccagctcggcgatcatcgtcggctacgccattcccgccttcctcttcgccatcctgctggtggtgctgttcgccggcggcagctactgggactggttccccctgcgcggcctgacctcgaacaacttcgaccagctcagcctcggcggcaaggtgctcgactatttctggcacctggccttgccggtaaccgccctggtgatcggcaacttcgccaccatcacgctgctgaccaagaacagcttcctcgacgagatcggcaagcaatacgtggtcaccgcccgcgccaagggcctgaccgaacgccgcgtgctctacgggcacgtattccgcaacgccatgctgctggtgattgccggcctgccggctgcgctgctggggatcttcttcaccggttcgctgttgatcgaggtgatcttctccctcgacggcctcggcctgctcagcttcgaagcggctatgaaccgcgactacccggtggtcttcggcacgctgttcatcttcaccctgttcgggctggtcatgaagctgatcagcgatatcgtctacaccctggtcgatccgcgcatcgacttcgagaaccgggagtaatccgatgcgcctgtctcccatcaaccagcgccgctgggcccgcttcaagagcaacaagcgtggctggtggtcgctctggctgttcctcatcctgttcgtcggcagcctcggcgccgaactga

SEQ ID NO: 13705 - DNA, 1668 bp, Pseudomonas aeruginosa
gcctgctggtgttcatcggcgaagccgcccgcgacgctttcgacccgaggaaatgagatgagcgagaacattctggaaatccgcgacctcgccgtcgaattcctctccggcgagcaacgccagcgggtggtcgaaggcgtcagcttcgacatccgccagggcgagaccctggccctggtcggcgaaagcggctcgggcaagtcggtgaccgcccactcgatcctgcgcctgctgccctactccgtcgccagccacccagcaggcagcatccactaccagggcgaggatctgctcaagctcccggaacggcgcctgcgcgggatccgcggcaaccgcatcgccatggtcttccaggaacccatgacctcgctcaatccgctgcataccatcgagaagcagctcgccgaggtcctcgccctgcacaagggcctgggtggcgccaaggccagcgcgagaattctcgaactgctcgagctggtcggcatccccgagccggccaagcgcctgaaagcctatccacacgaactctccggcggccagcggcagcgggtgatgatcgccatggccctggcctgcgagccgcaactgctgatcgccgacgaaccgaccaccgcgctcgacgtcaccgtccagttgaagatcctcgatctgctcaaggacctgcaggcacgcctgggcatgtccctgctgctgatcacccacgacctcaacctggtccggcgcatcgcccaccgcgtctgcgtcatgcaacaagggcggatcgtcgagcaggcttcctgccaggaactcttcgcagccccgcgacacccctatacccgcgagctgctcaacgccgagcccagcggtgcgccggcgagcaacccgcccggtgaaaccctgttggcggtggacgacctgcgggtctggttcccgatccgcaaaggcgtgttccgccgcaccgtggaccacgtcaaggcggtcgacggggtcaatttcgaactaccccgcgggcagacgctgggcatcgttggcgaaagcggctcgggcaagtcgacccttggcctggcaatcctgcggctgctggaaagccagggcggcatccgcttcgaaggcacccggctggacggtctcgcgcaacatgacgtgcgcccgctgcgccgcgagatgcaggtggtgttccaggacccatatggcagcctcagcccacgcatgtgtgtcggcgagatcgtcggcgaaggcctgcgcatccataggatcggcagcgaggccgaacaggagcaggcgatcatcgacgcgctggtggaggtcgggctcgatccgcagacccgctaccgttacccccacgaattctccggcggccagcgccagcgcatcgccatcgcccgggcactggtgctgaaaccggcactgatcctgctcgacgaaccgacctcggcgctcgaccgcaccgtgcagcgccaggtcgtggaattgctgcggcaactgcagggcaagtacaacctcacctacctgttcatcagccacgacctggcggtggtcaaggcgctcagccaccagttgatggtggttcgacatggcaaggtggtggaacagggcagcgccgaagcggttttcgcctcgccgcaacatccctatacgcagcaattgctggaggctgccttcatggccccggcaagcgcggaaaactga

SEQ ID NO: 13706 - DNA, 819 bp, Pseudomonas aeruginosa
gttgcagacaaggaacggaccatgggatttctcacaggaaaacgcgccctgatcgtcggagtcgccagcaagctctccatcgcttccggcatcgccgccgccatgcaccgggaaggcgccgaactggccttcacctaccagaacgacaagctcaggggccgggtggaggagttcgccagtggctggggctcgcggccggagctgtgcttcccctgtgacgtggccgacgacagccagatcgaagcggtgttcgccgccctgggcaagcactgggacggcctggacatcatcgtccactccgtcggattcgctccaggcgatcagctcgacggcgacttcaccgcggtgaccacccgcgagggcttccgcatcgcccacgacatcagcgcctacagcttcatcgccctggccaaggccggacgggaaatgatgaagggccgcaacggcagcctgctgaccctctcctacctgggcgccgaacggaccatgccgaactacaacgtaatgggcctggccaaggccagcctggaggccggggtccgctacctggccggcagcctgggcgcggaaggcacccgggtcaatgcggtttccgccgggccgatccgaacgctcgccgcctccgggatcaagagcttccgcaagatgctggccgccaacgagcggcagacgccgctgcggcgcaacgtcaccatcgaggaagtcggcaatgccggcgccttcctctgttcggacctggccagcggtatcagcggcgagatcctctacgtcgatggcggcttcaacactaccgccatgggcccgctggacgacgactga

SEQ ID NO: 13707 - DNA, 1227 bp, Pseudomonas aeruginosa
acgcaagccacgtgcaccggtcttgcgttcgagcgccttgcgggcaaccgccttgagtgcgtccggacggaattcgagatcgacgccttccatttcgaacagcttggcgtactgcttggtgagagcgttcttcggctcggtcaggatctgcatgagcgcagcctcgtcgagctcatcaagagtcgcgatcaccggcaaacgccctacaaactcgggaataagaccgaacttgacgagatcttccggttcgacttccttgaacgcctcgccgaccttcttgcccatctcctgactgcgcacttcggcattgaaaccgatgccgccgcgcgcggaacggttctggatgacccgctccagaccggcgaaagcgccgccgcagatgaacaggatgttgcgcgtatcgacctgcaggaactcctgctgcggatgcttgcgaccgccctgcggcggtaccgaggcaacggtgccctcgatgagcttcagcagggcctgctgcacaccctcgccggaaacgtcgcgagtgatggaggggttgtccgatttccgggagatcttgtcgatctcgtcgatgtagacgatgcccatctgggccttctccacatcgtaatcgcacttctgcaagagcttctggatgatgttctcgacatcctcgcccacgtagcccgcttccgtcagcgtggtcgcatcggcgatggtgaacggcacgttcagcagacgtgcgagggtctcggccagcagggtcttgcccgagccggttgggccgatcatcagaatgttgctcttgccgagctcgatatcgtccttcttgtcacgctggttgaggcgcttgtagtggttgtataccgctaccgccagaaccttcttggcccgctcctgcccgatcacgtactgatcgaggatggtgcggatctctttcggcgccggaagtttgtgcccactactttccgcctgcgcttcctgcacctcctcgcggatgatgtcattgcacaggtcgacacactcgtcgcagataaagaccgaggggccggcaatcaacttgcgcacttcgtgctggctcttgccgcagaaggagcaatacagcagcttgccgttgtcctcgccgttgcgggtatcagtcattcgatcgatccaatgggtagcttcaaacacaagatgaaggcaattgtgggcattttcaagcccacgaggcggccgaatgtctcgaccgccagtattgcggagccttag

SEQ ID NO: 13708 - DNA, 468 bp, Pseudomonas aeruginosa
gccgaggccatttcctcgatcatttcgcgaacgcgaccttcgtcggccttcagctcgtgctgcttgaccacttcggcgacgatcaggcccagcaccacacggcgcttggcctgctcttcgaacagctcggccggcagttggtcaggcttgatgttgccgccgaactgctggacggcctgcacgcgcagacggttcacttcgttgccgatcagggccttgggcacttcgatcgggttggcctgcagcagaccttccatgacctggttcttgaccttggacttgatcgcctggcgcagctcgcgctccatgttcttctgcacttcggcgcggaagccatcgagaccggtttccttcacgccgaacagagcgaagaactcttcgttcagttccggcagcttgggctcggctacgctattgacggtaacggtgaactcggcagccttgttggccaggtccaggttctggtag

SEQ ID NO: 13709 - DNA, 435 bp, Pseudomonas aeruginosa
tcctcggggaaggtcaggttgagcacacgctcttcaccggccttcgcccccaccagcccttcttcgaagccggcgatcatgcgaccggagcccagtaccagcagggtgcccttggcggaaccgccggcgaaggcttcgccgtcgatcttgccgacgaagtcgatgttcaactggtcatcgttctgggcggcacgctcgaccacttcgaaacgggtgttctgcttgcgcaggacatcgagcatgttgtcgacatcagcatcggaaacttcggcctgcaggcgctcgaccttgatgtcttccaggccggaaacggtaaattccgggaagacttcgaaggttgcgatgtattccaggtccttgcctttctcgaaggacttgggctctaccgacggcgaaccggccggattcagcttctgctcgaccacggcttcgtag

SEQ ID NO: 13710 - DNA, 285 bp, Pseudomonas aeruginosa
tcaacctgctgcgcaacgccattcgccacgcacactcgcgcgtcgaaatcgccctcctcgatcaaggcgacagctgtcagatacgggtcaacgacgacggccccgggataccggcggacgcccggcagaagatcttcgaacccttttcgcgcctggacgacagccgcgatcgcagcaccggcggcttcggcctgggcctggcgatcgtccgccgggtcgcgcaatggcacggcggctatgcggaagcgctggaaacgccgcaaggaggcgcctccttccgcctga

SEQ ID NO: 13711 - DNA, 846 bp, Pseudomonas aeruginosa
cagcgggtcgcttactgcctccctggcccggcaagcggcgtcgctcatgctgcaggtcaaacagggcgctcgtcgccccgccgtacagcccacccccgcgcgcgcccccgcactgaaggtgccgagcccggaggaccggcgacagctatacggtcgctacgcaacccgccaaggccagattcgcctgtacgagcgcaggggtcgcctgtacgcggatttcggcgaacaacgcgtggaactgttgcgcgacacctcgggctggctgcagatgagaaaaagactgctggggttctggcctgtcggcgtggacagcgccggacagttgcaactggacgtggtcagctacggccaacgccgaatcctggtgtcccgccgccacgaccagaccgcctacctcggcgagcgcatcgagccgacatccctgccccaggcctggaccgaagccgtcggcacctaccgcgtcgccagcacgggccggcacagctacctgaacggcctgagcatcaggatcgaagacggcttcctgctggtgcgcgggcaagccggaggaacccgctccggcgagttcatcctgcaacccatcgacagcgcacacgccgtcctggccggcagcggccagggcctgggagacaccttcagtcgcgacttcgacggtctgaacgcgctcggctaccgcttcgcccagcaagacaccaaggcacgtccctggctgcaacggaaggagtccccatgagaagcccctacctgtgcctcgccggcacgctcgccagcctctgctccgccgctgtcgccgaagagtggcatgacagcatcggcccgagcgccctggtggaataccgtttctga

SEQ ID NO: 13712 - DNA, 957 bp, Pseudomonas aeruginosa
aggagttacggcaaatccacgggtcgcctcctttgccccgggcggcgtccatgcgaaaatgcgcgtcctttttccacccgattcgatggttacccttccgacatgaccgcacaactgatcgacggcaaagcgatcgccgccaaccttcgccagcagatagcccaacgcgtgaccgagcgccgccagcaaggcctgcgcgttcccggcctggcggtgatcctggtcggcaccgatccggcctctcaggtctatgtggcgcacaagcgcaaggactgcgaggaagtcggctttctctcccaggcctacgatcttcccgccgaaaccagccaggacgacctgctggccctgatcgaccgcctgaacgacgaccccgccatcgacggcatcctggtccagctacccctgcccgcccacctggacgcctccctgctgctggagcgcatccacccggacaaggacgtggacggtttccatccctacaacatcggccgcctggcccagcgcatgcccctcctgcgcccctgcaccccgaaaggcatcatgaccctgctcgccagcaccggcgccgacctgtacggcatggatgcggtcgtggtcggcgcctcgaacatcgtcggccggcccatggctctggagttgctgctgggtggctgcaccgtcaccgtgacccaccgcttcacccgcgacctggccgaccatgtgtcgcgcgccgacctggtggtggtcgctgccggcaagccgggactggtcaagggcgagtggatcaaggaaggcgccatcgtcatcgacgtcggcatcaaccgccaggccgacggccgcctggtcggcgacgtggaatacgaagtggcagcgcaacgcgccagctggatcaccccggtgccgggcggcgtcgggccgatgacccgcgcctgcctgctggaaaataccctgcacgccgccgaacacctgcacgactga

SEQ ID NO: 13713 - DNA, 3141 bp, Pseudomonas aeruginosa
aaagccccgcgttcgcggggcttttcatttatcgctgcgggttcagtcggccaggcgccaggtagtgccgcccttgccatcctccagcacgacgcccatggcggtgagccgatcgcgaatccggtcggactccgcccagttcttcgccgcccgcgcctccaggcgcgcctggatcagcgcctcgacctcggccgcatcgaccttgccctcggcgcccgcctgcaggaaggcttccggctccagttgcagcacccccagcaggccagccaactgcttcaggcgcgcggccagcgcggccgccgccgacaggtcgctttcgcgcagacgattgacctcccgcgccagctcgaacagcaccgagcaggcacccgcggtattgaagtcgtcgtccatcgccgcggcgaagcgctcgacatactccgccgcttccgccggcgccgcctcgggcagccccttgagcgcgttgtagaaacggtccagggccgccttggcctcgcgcaggttctcctccgagtagttgatcggactgcggtaatggctggcgatcagcaggtaacgcaccacttcggggtgatatttctccagcacttcgcggatggtgaagaaattgcccagcgacttggacatcttctcgccgttgatggtgatcatcccgcagtgcagccaggacttggcgtagggcttgccggtcgcggcctcgctctgggcgatctcgttctcgtgatgagggaactccaggtcgttgccaccgccatggatgtcgaaggaatcgcccaggcagcaggtggacatcaccgagcattcgatgtgccagcccgggcgcccctcgccccagggcgacgaccagctcggttcgccaggcttggcgcccttccagagcacgaaatcgagcggatcctccttcgcttcgcccggctcgatccgcgcaccgatgcgcaggtcctcgacccgccgccgcgacaacttgccgtagccagcgaacttgccgacccggtagtacacgtccccgttgcccggcgcgtaggcatagcccttgtcgatcagggtctggatcatcgcgtgcatgccggcgatgtgatcggtggcgcgtggctcctggtccggcttgaggatgttcagccgggcctcgtcctcgtgcatcgccgcgatcatgcgctcggtcagcacatcgaacggctcgccgttctcgttggcgcgattgatgatcttgtcatcgatatcggtgatgttgcgcacgtacgtcaggtcgtagccacggtggcgcaaccagcgggtgatcacgtcgaacgccaccatgctgcggccgtggcccagatggcagtagtcgtacacggtcatgccgcacacgtacatgcgtacctggttgccgaccagcggcgtgaagacttctttggtcttgctcagcgtgttgtagatctgcagcacggtctttcctcagccctgtccccaggagtcacgcagggtgacggtacggttgaacaccggcttgcccggcctggagtccttcaggtcggcgacgaaatagccttcgcgctcgaactggaagcgatcctccgggttcgcctggcccagcgacggctcggcgcgacagccggccagtacctgcagggagtcggcgttgatgttgtcgaggaagctgccgccctcttccgccttctccggattggccgagcggaacagccgatcgtacaggcgcacttcgcactcgacgctgccctcggccggcacccagtggatcacgcccttgaccttgcggccttccgggttcttgcccagggtgtccggatcgtagctgcagcgcagttcgacgatattgccgtcggcatccttgatcgcttcgtcggcacggatcacgtagctgccgcgcagacgcacctcgccaccggggatcaggcgcttgtagccggccggcgggacttcctcgaagtcaccggcatcgatgaacagctcgcgaccgaacggcagtacgcgcactcccatgtcttccttcggatgacgcggcaactcgaggttctccacctgcccttcggggtagttggtgatcaccaccttgagcggtttcagcacgcacatggcacgcggcgcggtggcgtccaggtggtcgcggatgctgaactcgagcatgccgatgtcgaccacgccgctggcacggttcaccccgatcatctcgcagaagttgcggatcgactccggggtgtagccgcggcggcgatagccggacagggtcgacatgcgcggatcgtcccagccgctgacatggccttcgtcgaccaattgcttgagcttgcgcttgctggtcacggtgtagttcaggttgagccgggagaattcgtactggcgcggttgcgcaggtaccggcaggttggccaggaaccactcgtagagcggacgatggtcttcgaattccagggtgcagatcgaatgggtgatgccctcgatggcgtccgactgaccgtgggtgaagtcgtagctcgggtagatgcaccacttgtcgccggtctggtggtgatgcgcatggcggatgcggtacaggatcggatcgcgcaggttcatgttcggcgaacccatgtcgatcttcgcccgcagcgaacgggcgccgtcggggaactcaccggccttcatgcgggcgaacaggtcgaggttctcctccaccgaacggtcacggtaagggctgttgcggcccggctcggtgagggtgccgcggtattcgcgcatttcctcgggaccgaggtcgcagacgaacgccttgccggccttgatcagctcgatggcccaggcatgcaactggtcgaaatagttggaggcatagcagacctcgccggaccactggaagcccagccacttgatgtcggcctcgatggcatcgatgtactcctggtcttccttggccgggttggtgtcatcgaagcgcagatggcaatcgccagcgaattcctgggccaggccgaagttcaggcagatcgacttggcgtggccgatgtgcaggtaaccgttgggctccggggggaaacgggtgacgatcttcgcgtgcttgccggcatccaggtcggcttgaacgatctggcgcaggaagttcggggcggcggtggtctctggcttgctcatgggatccttggtcatgctctcgcccgaccagggtag

SEQ ID NO: 13714 - DNA, 759 bp, Pseudomonas aeruginosa
tcatcgagaaggccgaaatcgtcgaagaatgaagcgatgagcgtcctgttcatctcggacctgcatctcgaagcggaacgcccggacatcacccgggcgtttctgtctttcctcgatgagcgcgcccgccgggccgaggccctgtacatcctcggcgacttcttcgaagcctggatcggcgacgacggcatggacgccttccagcgctccatcgcccagtccctgcgccaggtggccgacggcggtacgcgcatctacctgatgcacggcaatcgcgacttcctcattggcaaggcgttctgccgcgaggccggatgcacgctgctgcccgacccgagcgtgatcgacctgtacggcgagccggtattgctgatgcacggggacagcctgtgcacccgagacgaggcctacatgcgcctgcgccgctggctgcgcaacccgctcacgctctgggtactgcgccacctgccgctggccacccggcacaagctggcacgcaagctgcgcaaggaaagccgcgcgcagacccgcatgaaagccgtcgacatcatcgatgtcacgcccgaagaagtgccccgggtcatgcgcgggcatggcgtgcgtaccctgatccacggccacactcatcggccggccgaacacccgctggacatcgacggccagcccgcccggcgcatcgtgctcggcgactgggaccgccagggctgggccctggagatcgacgccaacggccatcgccaggcgcccttcccgctctga

SEQ ID NO: 13715 - DNA, 1197 bp, Pseudomonas aeruginosa
cgacaccaatccggacaacgacggcctcggcgccaccatcgaggctttcccgatcgtgttcctcggcaacgtcgacgccaaggtcgaatcttccgcgcgctttcgcctgcccggcggcgagccgttcctgaagatggcccaggaataccgcaacccggacaatttcatccgcaccgcactggtgccggcgatcaaggaaaccctccaggccaccgcttcgctgatgagcgccgacgactactacgccggagcccgcagcgaattcgccgccgagttcgagaaccagctcaacgacggcctgtacctgatcaagcgcaaggaagtccgcgggccgcgcggcgccattccgcaccagaccgcgatcctccaggccggcaccgagcagggagcgttcggcgacaacaacgccagccagttcgtcaccgagaaggtcaccgatgccaagggcatcccggtacgcaagcaacagcagttccgcaagttcggcgtcgaggtggtggaagcgcggatcaccaacgtcgatcccaacccgcagtacaagcagcgcatggtcaaggtccagcaggcgctcgccgagctggcggtggcgcggcagaaccgcctgaaggaagaagaggaaaagctgctggtcaccgcccgcggcgagaaggaagtcgaggccaagcgccaggaaaccctgcgcgaccagatcgaacgcaccacccaggcggaaaccgacaagcaattggcggtgatcaacgccgagcgcgagaagcagcgcgccgagatcgagaagcagaccgccgaactgctgcgcgacaaggccacggtgaccgcccaggccaccaagatcaccgccgacgccgaggcttacgcccgcgaagcggtgatcaaggcggacggcgcgttgcagccgaagctcgacgcgctgatcgcgatcaacaaggtctgggccgaagccgccgcccaggcccccgtccccagcgtaatgatgggcgccggcgccaacggcgcggcgagccgccaggacgagatcggccagctgatgggcgttctggcgaccaaggccgcccgcgacctggccctcgacctcaaggtcaaggactgatccaggcagcaaaaaaagcgccccgcggggcgctttcttgtttccggctcaggccaccaggcccaccgggtggccgctgtggaagcggaattcgttgtccggactgctga

SEQ ID NO: 13716 - DNA, 888 bp, Pseudomonas aeruginosa
ccacaagcactcagggagacgatcatgcaagccattcgcagcatcctcgtggtgattgaaccggaccagctggaaggtctcgccctgaaacgggcacaactgatcgccggcgtgacccagtcgcacctgcacctgctggtctgcgagaagcgccgcgaccacagcgccgctctcaacgacctggcccaggagctgcgcgaggaaggctacagcgtctcgaccaaccaggcctggaaggactccctgcaccagaccatcatcgccgagcaacaggccgaaggctgcgggctgatcatcaagcagcactttcccgacaacccgctgaaaaaggccatcctcaccccggacgactggaagctgctgcgcttcgcgccctgtccggtactgatgaccaagaccgcccggccctggacgggcggaaagatcctcgccgcggtcgacgtcggcaacaacgacggcgagcaccgctccctgcacgccgggatcatcagccatgcctacgacatcgccggcctggccaaggccacgctgcacgtgatcagcgcccacccctcgccgatgctctcctccgccgacccgaccttccagctcagcgaaaccatcgaggcccgctatcgcgaggcctgccgcaccttccaggccgagtacggtttcagcgacgaacaattgcacatcgaggaaggtccggccgacgtgctgatcccgcgcaccgcgcagaagctcgacgcggtggtcaccgtgatcggcaccgtggcgcgcaccgggttgtccggcgcgctgatcggcaataccgcggaagtggtgctggataccctggaaagcgacgtgctggtgttgaagccggacgacatcatcgcccacctggaggagctggccagcaaggagtga

SEQ ID NO: 13717 - DNA, 798 bp, Pseudomonas aeruginosa
cctgatcaccaaccgcgtaccgccgggcgtcgacgaagccgcctacgtcaaggccggtttcctttccgccatcgtcaagggcgaagccacctccccccttatcgacaagcaacgtgccgccgagctgctgggcaccatgcagggcggctacaacatcgccaccctggtcgagctgctggacgacgccgaactggccaacaccgccgccgaacagctgaagcacaccctgctgatgttcgacgccttccacgacgtcgccgagcgcgccaagaagggcaatgccgcggccaagtccgtgctgcaatcctgggccgatggcgagtggttcaaggccaagccggaagtcccggaaaagctgacgctcaccgtattcaaggtccccggcgaaaccaacaccgacgacctctccccggcccccgacgcctggtcgcgcccggacatcccgctgcacgccctggccatgctgaagatggcccgcgacggcatcgagccggtccagccgggttcggtcggtccgctgaagcagatcgaagcggtcaaggccaagggcttcccggtcgcctacgtcggcgacgtggtcggcaccggttcctcgcgcaaatccgccaccaactcggtgctgtggttcttcggcgacgacattccgttcgtgccgaacaagcgtgccggcggcttctgcttcggcaccaagatcgcaccgatcttctacaacaccatggaagatgccggcgccctgccgatcgagttcgactgcaccaacctggccatgggcgacgtcatcgacgtatacccctatga

SEQ ID NO: 13718 - DNA, 927 bp, Pseudomonas aeruginosa
tcgacgggcgcacctgggacggcagcgaccccgccggctacgcccgcagcttcccgatccacgccctggccgaaaccggccagggcatcgccccctgaccctggtgcgcccgccatgctgcgtatcctgctgatcgacgacacgccgaagaaagtcggacgcctcagggccgccctgctcgagagcggtttcgaagtggtggacgagtcagggctgaccatcgacctgccggcgcgcgtcgaagcgctgcgtcccgacgtgatcctgatcgacacggagtctcccggccgcgacgtgatggagcaggtctgcctggtcagccgcgaccagccgcgcccgatcgtgatgttcaccgacgagcacgatccgggagtgatgcgccgcgccatccagtccggggtcagcgcctacatcgtcgaaggcatccaggccagccgcctgcaaccgatcctcgacgtggccatggcgcgctttcgagagcgaccaggcgctgcgtgctcaactgcaggcgcgcgaggcgcagctggccgagcgcaagcgcatcgagttggccaagggcctgctgatgaagatgaagcattgcggcgaggaggaggcctacacgctgatgcggcgccaggccatgagccgccagcagaagctgatccaggtcgccgagcagatcatcgccatgcacgacatgctcggcggctgaatccggctgggcagctggcgatcatatcgccagccaccctgctggcccccggcgcagagcggcgcggctatgctcgtgcgcccggaacggccctatccgttctgggagctaccccctcgccaccctcgactagcatgaccagggaggcccgcagtggacgcccagggctaggagccgcaggcgtccgcccgaaccgcaccgccgactcagcggtcaggagatgctcagcatga

SEQ ID NO: 13719 - DNA, 237 bp, Pseudomonas aeruginosa
acagctatgagcaggcactgctgctggggttgttcctcggcttcgccggggcatccttcgccgtggccctgccgctcgcatcgcaatggtacccgccgcaacaccagggcaaggccatgggcatcgccggcgcgggcaactccggcaccgtgctcgccgccctcttcgcccccggcctggccgccgcgttcggctggaacaacgtgttcggcttcgccctgctgccgctcgtcctga

SEQ ID NO: 13720 - DNA, 435 bp, Pseudomonas aeruginosa
  unsure (78): Identity of nucleotide at the above locations are unknown.
gcattggcgaggccagcgcctgcgggcctcgcacggaaaaccaggatgcgctgcgggtggtcaccccggcgccggccntggccgccagcaagggacacctgctggccatcgccgacggtgtcagccagtgcgccgatggcggcctggcggcgcgcagcagcctgcaagcgctggccctggattactatgcgactccggaaacctgggccatcgtgcagtccctggaccgcctgctgctggcgcagaaccgctggctacaggccaacggcggcggccagccgctgctcaccaccctcaccgccctggtgctgcgcggcacccgctacaccctggcccacgtcggcgattgccgggcctacctgtggcgcgacggcgagttgctccggcagaccagcgaccacgtctgggaacagccgcacatgcaacacgtgctga

SEQ ID NO: 13721 - DNA, 279 bp, Pseudomonas aeruginosa
agggctgagaggcaccagcccggtgcgatacgccccggcacggggcagaaagaccgcggtgaggccccgcgttatccctgcaaggccatggagataggcaatagcgcaagttggcacggcgcctgcttgggttctcccgacaatcgacaacaaagcgcctgcctcaacgacgaggcggcgtttcccgaccgaacgggacctggacaaaggcgtcctgctggcaacagcgggacgccttttttgtttgcgccaaccttatgcaggagctactccgcatga

SEQ ID NO: 13722 - DNA, 357 bp, Pseudomonas aeruginosa
tggtcggcaacggcatggccggggtccgtaccctggaagaactgctcaagctcaactcggacttctacgacatcacggtgttcggcgccgagccccatcccaactacaaccgcatcctgctgtccccggtgctggccggcgagcagaccttcgaggaaatcgtcctcaacgacctcaactggtatgcggaaaacggcatcaagctcctcctcgaccgcaaggtggtgcagatcgaccgggtccgccgcagggtggtcgccgcggacggcagcgaggccgagtacgaccgcctgctgctggccaccggctcgctccccttcatcctgccgatacccggcaatcgcctgcagggcgtga

SEQ ID NO: 13723 - DNA, 486 bp, Pseudomonas aeruginosa
agacctgcgtcggcagcgagttctgccgcttcggcacgcagaactcgacgcagctgggcatcgatctggaacacgacctgttcaacatgtggtcgccgcacaaggtcaagctggcggtctccggctgcccgcgcaactgcgccgaggccgggatcaaggacgtcggcatcatcggcgtggactccggctgggagatgtacatcggcggcaacggcgggatcaagaccgaggtcgcggagttcttcgtcaagctcaagaccgccgaagaggtgcgcgaatacaacggcgccttcctccagctctaccgcgaggaagccttctatctggagcgcacggtgcattacctgcagcgggtcggcatggagcacatccgcaaggcggtggtcgaggacgcggaaaaccgcaaggcgctcaacgaccgcctgcaattcgccctgtccttcgagcaggacccatggaagcagcgcatcgaacagccgcaattga

SEQ ID NO: 13724 - DNA, 426 bp, Pseudomonas aeruginosa
agaaggagttcgaacggattccgctcaagcaactggaaaacgtctgaatcccttgtccgggccgtcccacggcggccctccccctaccggagtgaaccgatgaactggctggatatctgcgccctcgatgaaatcaacccgctgggctcgcgcgtggtcgccggcccgaaaggcgacatcgccatcttccgcgccgccgacgaccaggtcttcgccctcgatgaccgctgcccgcacaagggcggcccgctgtcccagggcctgatctacggcaagcgagtggcctgtccgttgcacaactggcagatcgaactggagagcggcgaagccgtggccccggaccagggctgcgcccatcgccacccggtgcgggtggagaacgggcgggtgctgctcggcctggacagcgtggcgctgtgcgcctga

SEQ ID NO: 13725 - DNA, 735 bp, Pseudomonas aeruginosa
gcggtaaggtctggctggtgggtgcgggttcccggcgatccggaactgttgaccctgaaggcagttcgcgccctgcaggacgcggatgtggtgatggtcgacgatctggtcaacccgagcatactggagcactgtccgtccgcccggctggtccgggtcggcaaacgcggcggctgccgctccacaccgcaggacttcatccagcgcctgatgctgcggcatgcccgccagggacgcagcgtggtgcgcctgaaaggcggcgatccatgcatcttcggccgcgccggcgaagaagccgaatggctggcccggcacgggatagacagcgagatagtgaacggcatcaccgccgggctggctggcgccactgcctgcggcataccgctgacctaccgcggcatcagccgcggcgtgaccctggtgaccgcgcatacccaggacgacagcccgctggcctgggaagccctggcacgcagcggtaccacgctggtggtctacatgggcgtcgcccgactcgcggagatccaggccgggctgctggctggaggcatggccgaggatacgccgctggcgatgatcgagaacgccaccttgggcaaccagcgcgaatgccgcagcaacctcggcgagctactgcgggacgccggacgtttcgccttgaaaagcccggcgatcctggtgatcggcgaagtaacccgcgacatcgtgtcgcaaccgatttccctgagcgcctga

SEQ ID NO: 13726 - DNA, 1461 bp, Pseudomonas aeruginosa
agcctgccagcttgccccacagggtgttcatcgcggtcagcaagctctgggtccagatatcgaattgcatgttcactcagccttgtcagcagaagatgcgtttttcgcggaaatacgggaaaccggcgccagatgcggcgaaccgttgttgatgccgatcatcagcgcctgcagccagtgccccatgaggctgaacaggtcaccggcgccgacctggcgattggcggtcttcagcacccgtcccagacgcgcgtcgtcgtccggctggggagccgaagccttgagcaggtcccgcagggactcttcgaacggatcgtgcatgcgcacctcatgtctgtacgagggagtgacgccctctcctcaccccaggtcacgtcagagccagcgcagccgacgaaatacccaccactggaaggtggcgaccccgccgatcagcaggcaggccagccagaacccatgcggtgcatccgcccctggaatgccgccgacattgattcccagcaggccggtgacgaagctcatcggcaggaaaaagccggtgattataccaaggagatacatggtgcggttcatccgttcggtgattcgccgcgactcggcttcctgcaggacgctgatgcgctcccgtatcaactcgagttcttcgagattccgcgtcagccggttgttcagctcgttccagtaatcggcgtcgtcctcgacgaaccaggacagcttgtagcgcgccagttgcgagtagatgtcccgctgcggcgccaggtagcgccgcaaccccgccgaccggcggcgcagggtacgcaactggtgctggtcgggactggcgcgctcgtccgcctcgaccagctcctcgacagcatcgagctggtcggctatgccgctgatcagcgtgtcgacgcgatcggtcaggtagtgcgcgaggtagtacacgacctcggatgctgtcttcggccctttccccgcctccaggtcctcgagcagatcggccaccgccttcagcggccgcaggcgcagcgagatcacccggcgcgcgtcggcgaatacccgcagcgaaaccatgtcttccggctccgcgcccggattcaggttcactccacggaggaacaccagcaggctttcggccccgagatcgagcaaacgggggcgagtcgcctcctccagcagcagatcgcaggcgaactcgctgagccccgcggaatcccgcagccaggcctgcgcttccggcacgccgcggtcccagtgcagccaaaggctttcctccggcagcaggtcgagcaccgctatctggttgcgtccgacacggcgtccgccgccgcgcccgttgaggacgtagccatagatcaggccgcgctcgtcacccgactcgtacgcttgcattgcgcttcccttggtaaaacgaccatttcgacagtaaaaacacaagtccggtaccagtcaattcatggacttgcggcacaaccttaa

SEQ ID NO: 13727 - DNA, 693 bp, Pseudomonas aeruginosa
atgtcttcggtaaggtcggcgcgcaactcggcgctgaccagggcgacaggaaagaggcgactactgctttgcatgcttgtcttgtacaggaggcacgaaaaagggcggtgttacccgccctttccggatacagcgaggaccgatcaggcctggtcttgcccctcggcaaggaagaaccaggtatccagcaccgagtcggggttcagcgagacgctctcgatgccctgctccatcagccagcgggccaggtccgggtggtccgacggaccctggccgcagatgccgatgtacttgccggccttgttgcaggcagcgatggcgttggccagcagcttcttcaccgccggattgcgctcgtcgaacaggtgggcaacgatgccggaatcgcgatccaggcccagggtcagctgggtcaggtcgttggaaccgatggagaagccatcgaagaactcgaggaactcgtcggccagcagggcgttcgacggcagttcgcacatcatgatgaccttaaggccgttctcgccgcgcttcaggccgttcccggccagcagctcgaccacctggctcgcctcgcccagggtgcgcacgaagggcaccatgatctcgacgttggtcaggcccatttcgttgcggaccttcttcagcgcacggcactccagctcgaagcagtcgcggaacgactcgctgatgtag

SEQ ID NO: 13728 - DNA, 594 bp, Pseudomonas aeruginosa
cccgcgatgcgcttctccacgctttccttgatgtccgccggcaggccggcgaagttcagcaatgccttggggtgcacgccgatcatgcggttgatgatgaattcgaggcgggccaggcccacgccttcgttcggcaactgggcgaaatcgaaagcgcgatcgggattgccgacgttcatcatgatcttgaacggaaggtcgggcatggcgtcgaccgagttcttgcgcacatcgaaaccgagttcgccttcgaagatgaagccggtatcgccttcggcacaggaaacggtcaccccctggccatcctgcaggatctgggtggcgttgccgcaaccgaccaccgccgggatgcccagttcgcgagcgatgatcgccgcgtggcaggtacgcccgccgcggttggtgacgatggcgctggcgcgcttcatcaccggctcccagtccgggtcggtcatgtcggagaccaggacgtcacccggttggaccttgtccatttccgacacgtcgttgatcaccttgacaggaccggcaccgatgcgctggccgatggcacgcccttccaccaggacggtccccttctctttcagcaggtag

SEQ ID NO: 13729 - DNA, 594 bp, Pseudomonas aeruginosa
cgcagggttttccgtcacggactggacagcgatcgcaagatcgacccgccgaacgcgacaccaaccaggacttatgaaactcaagcccttagctcccctgctctgcctattcatcgccgtaccaggcctgagcgtagccgccgaaaagacggtctacggcctgaacgaatacgcgcgcatcaacgacccggacatccagctggccgccaagctcgacaccggcgccaagaccgcctccctcagcgcccgcgacatcaagcgtttcaagcgcgacggcgaaacctgggtgcgcttctacctggccaccgacaacgccgacgacaccccgatcgagaagcccctggcgcggatcagcaagatcaagcgccgccacggcgacttcaaccccgacgagggcaaggcctataccgcccgtccggtgatcgagctgcaggtctgcatgggcaaggcgattcgcaccatcgaagtgaacctgaccgaccgaagtgcattccaatacccgcttttgatcggctcggaggccttgaagaaattcgacgcactggtcgatccgagcttgaaatactcggccgggaaacccggctgcaaacctga

SEQ ID NO: 13730 - DNA, 1536 bp, Pseudomonas aeruginosa
gtaaacgacatgcgctctctcaacctgcatctgaaagtcctgatcgccatcctgctgaccctgggtgtggcgatcaccgcctatcagattttcgtccagggtattcccgttaccgaagccgaaaccgatgacctctggaacatcgatgccaaggtcgacttcgtcgccacgccgaaaaccccggtcaaggtgcagatgttcgttccgccgttgagccaggactacgtcagcctcaacgaaagcttcgtctccaacaattacggcgtcagcatcaatcgcgccgacggcaatcgcaaggtgacctggtccgcccgccgcgccaacggcaagcagaccctgtactaccgcctggtgctgaccaagcgctacaccggcgagaagaccaaggagaaaggcccgatcttccgcgacagcctgcccctggaaggcccggagaagatcgccgcagaagccctgctggcccccattcgccagcactcggccgacgtcgagaccttcgtcagcgaagccatcaagcgcgccaacaacggcaacgacgacaacgtcaagctgctgatggccggcgacaccagcctggaaaagaaagcgcatatcgtcgaaaccctgctgtccatcgctcacgtgccgatggagcgggtccataccatccgcctggtcgccgacctgcaacagagcccggaactgtggctgcgcagcttcaacggcgagaactggctgtatttcaacgtggtcaccggcgaacagggcctgccctccgatcgcctgatctggtggcttggcgatgagccgctgatgaccatcgacggcggcaagaaggcccaggtcagcttcagcctgaacagcagcgagatgaacgccatccgcctggccaagctgtccgacgagaacaccgaggcggccttcctcgagtactccctgtacggcctgccgctgtccacccagcagaccttccagatcatgatcatgatcccgatcggcgtgctggtgatcctgatcctgcgcaacctgatcggcctgcagaccctcggcaccttcaccccggtgctgatcgccctggccttccgcgagaccggcctgcaatggggtatcgccctgttcaccgtgatcaccgccctgggcctgtcgctgcgctcctatctcgagcacctgaagctgcagatgctgccgcgcctctcggtggtgctgaccttcgtggtggtgatgatcgcggtgatcagcctgttcagccacaagctcggcttcgagagcggcctgtcgatcgccctgttcccgatggtgatcctgaccatgaccatcgaacgcctgtcgatcacctgggaagagcgcggcggcggccatgcgatgaaggtggccatcggcaccctgttcgcggcatcgctggcgcacatcctcatgcgcatcccggaactggtgtacttcatcttcaccttcccggccgtgctgctgatcctggtcgccttcatgctcgccatgggccgctaccgcggctaccgcctgaccgagctgttccgcttcaaggccctgctcaaggactga

SEQ ID NO: 13731 - DNA, 987 bp, Pseudomonas aeruginosa
accatgtcgatctggaagacctggaaagacctgaccgcgaaaggcgtgatgggcatcaaccgacgcaatgccgattacgtcctgaagtacaacaagcggcacctgtatccggtggtggacgacaagatcatcaccaaggaacgcgcgctcgaggccggcatccacgtgccggagatgtacggcatcatcgagaccgagaaaggcatcgacaagctcaacgagatcatcggcgagcacaacgatttcgtcatcaagccggcgcagggcgccggcggcgacggcatcatggtgatcgccgaccgcttcgagggccgctacaagaccgtgtcggggaagatcgtcagccacgaggagatcgagcaccacatctcgagcatcctctccggcctctactccctcggcggtcatcgcgaccgcgtactgatcgagtaccgggtgacccccgaccagatcttcaagagcatcagctacgaaggtgtgccggacatccgcatcatcgtgctgatgggctacccggtgatggccatgctgcgcctgccgacccggcagtcgggcggcaaggccaacctgcaccagggcgccatcggcgtgggcgtcgacctggccaccggcgtcaccctgcgcggcacctggctgaacaacaagatcgccaagcacccggacaccaccaacgcggtggacggtgtgcaactgccgaactgggacggcttcatgaagctggcggccggttgctacgagttgtcgggcctcggctacatcggcgtggacatggttctcgaccaggagaaaggcccgctgatcctagaactcaacgcccgcccgggcctgaacatccagatcgccaacgacagcggcctggtgcaccgctgccacgccgtcgaggcgcgactggaagaactcaaggcgaaaggcatcgaagagtccgcggaagagcgcgtacgcttctcccagcaactgttcggccacgtccagcagcaacagggctga

SEQ ID NO: 13732 - DNA, 1731 bp, Pseudomonas aeruginosa
cgcccgccggaggcccagcccggcgaagatgccggcagcgccagggagaagacgcaaagtacgatggatgcgcgcatcatgctccagccctcagaaggtcgtacggtaggtcatggcgaaaatataggctttcaccgtggtgtccacgtccagtcccgcgtaagggttgtacaccaggttgtcgagcccggtgcagttcaggttgcagctggtatcggccttgacgctctgcttggtgacgaagtagttgaaaccgacatcgatcaccgtgtccttgtcccactggtagcccagccccaggccgtagagattggcatcgccgatcggcaccaggatatccgcctggcccttggggatcgccgaaggccggtattcgtagccggcgcgcagctgcaaacggtcgttgacgtcgtactgcacgcccatggcccagctccaggtatcgcggtagccgcggtcgagggtgatgctgtggctggtggcgtccttcgagtcgaggtacttggcgatgcgcagcaggtcgagctcgcggtcgaactcgatcttgaactcgttccagtcgctgtagccgttccatttcaggtcgaagttgaattgccacttcttgaacgggcgcagcttcacgccggtggagaaggcatccggatagaccatgttcatcgtggcgttgccatgctcttcgtcgacgttcccgtaggggaacatctggccgaggatcgcaccgccgagcgacttgtgcaccccggtccagaaaccctgccagccctggccgtagtcgacccggtacttgcccttgagcttcatccgcgactcgctctggtaggtcgcgccccaggcgaaccagtcggtgggctcccagagcacgccgaggttgaagctgggcgaaagcgactgttgcatgtccaggtcgatattggccaggttctggaacggaccgatattgccgccgcagacgttgaagaacacctcgaggatctcctgcattcccggcaggcaaccgatctccttggtctgctgcaacagcccgagcaactggttcggcgcccggaaatcctcgttcaacgctactgcctggtgggagaaacccacagacaggccgaccgacagctcgtcgttgacctggtaggccagggtcggcgagaagtaggtgagccgctgcaacgacacctcgcgtccctggtagcgcgccggatcgctatcggaatcgcggctgtagcccagcgcttgcggggtgtagacgttggtggcgaaggtgaacttggagcccggcgggttgatcgagattccggccagcggcgccaccagcaacggcacgtcggtcatgccgccgagaccgggcaggtacatggtcggggtcagggtccggctgtggctgttggcgaccgggtcgtcgcgcaggccgaaggtgccttcgccgtagttcggcggcgccttgaagccggcgcggatgtccatcaccccggtgagcagcttcacggtcgcctggcggcccttcatcctggtcagcgccgccgggttgtagtgcaccgaatcgatgccggtctcgtcggcggtcacggcgttgccgagggccatggctttcgggttgccgatggtcaggtcgttggccatctgcgcgccggccggcggaatccaggccaggcacacccctgccagcgccagccagagcggcgcaatgcgcatcttcataacaggcctcgctcgcgggttactgggccttcagccctttga

SEQ ID NO: 13733 - DNA, 1431 bp, Pseudomonas aeruginosa
agaaatggctctaggatcgacgattccggcgaactagaattcctgactgtcccactacccccactttccatgcccagttgtcatgttcaccccctgccctaccatagcgacccaagctgtctctttgccatcatccatgaggcgcccggtgcggtgatgctcgattcgggtcgccccatcgctacccgtggacgctatgaccttatgagcgcctggccattggcagaactggcgccgctgcccgacgaatcggccaaccgcttcttcgcccgcctacgcgaagcggccggaagcctgggccccgcgcagctgccagcgccgtacgaactgcccttcgccggcggtctgctgggctatttatcctacgacctgggtcggcgcatcgagcgcatcggcgaacacgcccgcgatgacctgggcctgccgctggcctccgtcggcctgtatgcctgggcgctgatcagcgaccaccaggccggcaccagccaactggtattccacccgcgattggacgagcgcgaacgccagcgcctgatcgccctgttcagcgaggaaacgcaaggcgcggccggcaacttcaagcttctgggaaaattccgacggagcatcagcgcatccgactatcggcaggcgatccgccgcatccaggactacatccaggcaggcgactgctaccaggtgaactatagccagcgcttccaggccgcttgcagcggctcgccgtggccggcctatcgcgccctgcgcgaggcctgcccgacgccgttctccggctacctgcgactggccgacggcgcgatcctcagcctgtcgccggagcgcttcctcaagctcgacaagggcaaggtggaaacccggccgatcaagggcacccgcccgcgcggcaagacccccgaggaggacatggcgctggcggcgtcgctgctggccagccccaaggaccgcgcggaaaacctgatgatcgtcgacctgctgcgcaacgacatcggacgcagttgccaacctggcagcgtacgggtaccggagctgttcgccctggaaagctatcccaacgtgcatcacctggtgagcagcgtcaccggcgaactggcgccgggcaaggacgccctcgacctgctggaaggcagcttccccggcggctcgatcaccggcgcgccgaagattcgcgccatgcagatcatcgacgaactggaaccgagccgacgcggcatctactgcggcagcctgttctacctcgacgtgcgcggcgagatggacagctcgatcgccatccgcaccctgctggtcaggaacggccaggtcagttgctggggcggcggcggcatcgtcgccgactcgcactgggaggacgagtaccaggaaaccctggacaaggtccgggtgctgctggaaaccctggaagggatggccgggacagcgtccccggaatag

SEQ ID NO: 13734 - DNA, 426 bp, Pseudomonas aeruginosa
tcagtaaggcctgaaaccgtcgatagagcgtatgcaatcggggtaaagtgcaggtcgaaccccgagcggagacccagcatgcgcatcaccatggtcaagaaagtcctcgccaacggcgaggactgccgcaagtgcaaggaagtccggcaacgcctggaacaaggcggctacctgccgcgcatccatcgcaccctggtggccgacgaacgcgacccgaacagcgcaggctggatggtcgccgcccaatatggcgtagagaccgcgccgttcttcgtggttcgccacgacgacgggcgcgaacaggtctacaccgtgttcatgagcttcctccatgaagtcctcgaaccgcgagccgagcagtccgcggacgctgatcgcgaagcgctggccaggctggccggtcgcgacaatctcgacatgctctga

SEQ ID NO: 13735 - DNA, 216 bp, Pseudomonas aeruginosa
cattcccaaggaaaaccggaggtcatcatgaaacgcaacgtcttcgccgccattctcctcggcatggctaccaccctcgcagtgcaagccagcttcgccgacgaatccagcctgatggaaaaccgcatggtccaactgaaccagcacgccatcgagcaggcccagcagcaacaggccacggcgccaaccgcgagcgacaccgatgcgcagggttga

SEQ ID NO: 13736 - DNA, 843 bp, Pseudomonas aeruginosa
tcgcgaaccatcgacggccagcgttcgcgcaaggcgagggccaggccgctgtcgaaatggtcctggggcgcgatgccgtgggcgatcacctgggccccggaaagcagaatgtcaccttcaacttcacgaatcatgagcgtttccttcttggcttcgggacaggcgcttcgtgcgccgccctgcatctttcaccgtacgccttgcccgccggcgccagttgatgcgtatcaaagacggccggtcccatccgctacgggccgactagactgcatgcgagggaaccttggaggcacctcgcctctccattggattccagcctcgtgccgtctcatccatgacaaggaaacaaccgccatgccgaaatggattgcactttgcctgatcccgctgttggcaagctgcgccacctgccgccaggacagcgacagggaaaaactgctgtacgagaacgacatgctgcaggcgaaactgatcatcgtcgccaacgaccgcgatcgcctgccgctggcccaggccctgctggagcgcgcggcgcgcgacgaccgcagcggcgaggcggacttctaccaggccgtgctgatcgctcgccgcgacggccaggccagcgattgcgagcgcatcacccgcctcctcgaacgttccgccgagcgacgctacccgctggccaacgcgatgctctacaagatctacgccgagcccttcctgttgccgcgcgccgacattcccaaggccgagacctatcgccaggcctacgccgagctgccggtcgcgcgcagcggctacccctccttcgagcgagcccggcaggtggtcgatcgcctgctcgcgccgacttcgtcctga

SEQ ID NO: 13737 - DNA, 888 bp, Pseudomonas aeruginosa
cgcgacaattcgttatccaatcgaattcttctccgcgatcctatgcccatccgaggtatcgatcacggaagccgccatgaaacgtcgcagcccacgccattacgcccgcaacaccgccctggccaccctgggtctgtacgccatcctcatgctggtcgtgttgagcctcgtcgccggcgccgaaagcgccaggaacgccacaccggacaacgacaccgccacgaccttctccaaccagatcggccaggccctgccaggcctgctctcggggttgaacagtcgacgcgccggttgaacgccggcttctttcccgggaaacagcatgagaaggcaaacacggaaattctggatcgtcgccgccctggcgatattgaccaatggctactcgctactcggcctcgcccaaggctcggcaggcgcactggcgcgcaccatcgaatgcaaccaggcgatggtccgcgcgctggcggccaacctggcgctgaagctgcagagcggcaccccgccggcacgcccgcagcgctggatcccggagcgcttcatcctcgactgcccggcctgaaacgaaaacgccgccaaccccgggaggctggcggcgctcgcatggcgcggggccggctcaggcgccggtcggctggcgcgcgacgaaacgcatcatccattcggcgacgacggtgccctggtggtcccccgccaggctatcgacccccttgcgatagagttcctcgcccaggtgctgctggcgtagttcgagcagttcgcgggagtagtcgtggacgaactcgggatgcccctggaagcacagcacctggtcgccgatggcgtaggcggcatagggacagaagtcgctggaagcgatcacccgcgcgttttccggcagccgggtga

SEQ ID NO: 13738 - DNA, 567 bp, Pseudomonas aeruginosa
ccccgccgacgctcagccacaccctgcgcgaactggaaacccagctcggcatccgcctgctcaaccgcaccactcgcaacgtctcgccgaccgaggccggcgagcacctgctggcacacctggacccggcgttcgaagacatcgccgccgcgctggacagccttaaccgctttcgcgaaacgcctcacggcctggtacgaatcaacgcaccgcgaaacgccatcggtctcgtcctcgcgccacgtttcggcgaactggcccgcgactatcccggcatcaccctggaagtggtggcggacgagggtttcgccaatatcgtcgaagccggtttcgacgccggcatccgcctcggcgaagacctccagcacggcatgcgcgccgtgcgggtcggcccggacctgcgcttggccatcgtcgccaccccggcctacttccgacggcaaggcaggccgggtagcccggaggaattgttcggccaccgttgcatcggctggcgcaaggtgtcttccggagagctttacaaatggcaattcagcaagggcacgaaagcgctttcggtggccgtga

SEQ ID NO: 13739 - DNA, 873 bp, Pseudomonas aeruginosa
cggatagcgtcagtcattccggttctcccttcacacgcgctcgatgatggtggcgatgcccatgccgccgcctacgcagagggtggccaggccgtagcgcaggttgcgccgctccagttcgtcgagcagcgtgccgaggatgatgcagccggtggcgccgagcgggtggcccatggcgatggcgccgccgttgacgttgaccttgctttccgccacgcccatgtccttcatgaacttcatcaccaccgaagcgaacgcctcgttgacttcgaacaggtcgatgtcttccaccttcaggccggccttggccagggccttgcgggtcgccggcgcggggccggtaagcatgatggtggggtcggtggaggtcaccgcggtagcgacgatccgcgcccgcgccttcaggcccagttcgcggcccttggcctcggagccaatgagcatggcgctggcgccgtcgacgatccccgagctgttgcccggcgtatgcacgtgctcgatgcgctcgacctggctgtacttgcgcagcgcggtggcgtcgaagcccatctgccccatcatctcgaaactcggtttgagcgcggcgagcccttccagggtggagtcggcgcgaatgaactcatcgtggtcgagcaggacgatgccattctggtcggcgaccggcaccagcgacttgccgaacagcccttcggcgcgggccttggcggccttctgctgggagcgcagggcgaaggcatcgacatcggcgcgactgaagccttccagggtggcgatcaggtcggcgccgatcccttgcgggacgaagctggtgtgcaggttggtttccggatccagtgcccaggcgccgccgtcggagcccatcggcacgcgtga

SEQ ID NO: 13740 - DNA, 1566 bp, Pseudomonas aeruginosa
tccgctagggcacctgctgcctgcacgctgcgcaccgcctcgcggtcagcgcagcgcaggcagccaccaggtcagcagcagcggaatgaaggcgaacgacagcaaggtcgaacacagcaccaggctggcgacctgatccggcgaacgattgccgcgcaaggcgtagagatagttgaacaccgccaccggcatcgacgactgcaccaccagcaccccctgcgccagcggcggcaattgcaacgccagcgccaccgaccagcccaccagcgcccccagcagaagacgcaggccgccatagaagaagccattgcccagttgccgcgggcggatgctggccagggacacgccgagggtgatcagcatcagcggaatggtcagcccggccatcaggtcgacggtattcgccatccagcgtggcagttgcaggtcgagccccatcaacaacaaggccagcagcacgctgagcaggatcggattgcccagcagcgagcgccaggagcgctcgccgctcatccagaacacgccgaggctgaagttgccgatcgacatgatcaggtagaacgccaccgccagggtcatccccgcctcgccgaacgcatacaggcacaccggcaggcccatgttgccgacattcgggaagctgtaggccggcaccagcacctgccactcctggcgcccgaggcgcgccgccgcccagcccagcgcagccatgcagacgcagatcagcgcgctggccagggccatccggccgaaactgtgcaggtccacccgggtatgcgccagggtggcgaggatcaggcatggcgaaccgatgttgaacacgatgcgcgaaacgaactcggtcggataggcgtgtccgagacggacccagacgtaaccgacaccggcgccgaacagcacgggcgccatcacggcgaacaactcggcgagcacgggaaccccttggttagccagctatgcaatggcccgcatgctaccgcgaggcccccgttccgtgccaatctctcgctccatgtcataaccggcggatgcacgaggaacccgcatgcctgtcactctcccgcgcctggcgttgctaggtgccctgctcttccctgtggctgccgcctgggccgccgagctccgcctggaactgccggggggcacgcagacctggagcagcgaagaactgctcaggcatccgcaggcccgcgacctggacatcccggccgacgtcgcctaccgccggaacatgcgctaccgcgccgtgccactggcggcgttgttgaaaggcgtgcatcccgaagaccatttgcaggccgtggccagcgacggcttcgccgccgagttgccggccaccccgctgctcgccgaacagggctcgcaagcctggctggcgatagaggatccgcagcgcccctggccgccgctgggcgccggcaagccgtccgccgggccgttctatctggtctggagcaaacccgaggaaaaacgcatcggtccggagcaatggcccttccaggtcgtccgcatccgctaccagtcccctctggccgaacgcttcccggccctgctgccggccgctga

SEQ ID NO: 13741 - DNA, 1227 bp, Pseudomonas aeruginosa
cgggtcttcgccgaggtagaagcggatcatgtccggcacgtagggatagatcgacttgtcgtcggccaccccggtaccgatcgcgttggccagcaccaggttgccggcccggtaggcggccagcaggccgggcacgccgagcagcgaatccgggttgaacgccagcgggtcgaggaaggcgtcgtcgatccttcggtagatcacgtccaccggttgcggtccggccgtcgtgcgcatgtagacccgctcgtcgcggacgaacagatcggcgccttcgaccagttccacgcccatctcgcgggcgaggaaggcgtgttcgaagtaggcgctgttgaaacgtcccggcgtcaataccaccacgctcggcgattcgacgtcactggcccgcttgagggtgtcgagcaacaggtccgggtagtggtcgatcggcgccacgcgctggcggacgaacagctcggggaacaggcgcatcatcatcttgcggttttccagcatgtaggaaacaccgctgggcgtgcgcaggttgtcctccagcacgtagtagttgccgctgccgtcgcggaccaggtcgaccccggcaatgtgcgcgtagacgttgcccggcaggtccagtccctgcatcgccagttggtactggtcgttggccaggacctgctcggcaggaatcacgccggccttgaggatgcgctgttcgtggtagagatcggcgaggaacaggttcagcgcctggacgcgctggatgcagccggcctcgatgtgcgcccactccgccgcgggaatgctgcgcgggatggtgtcgaaggggatcaggcgctcggtgccctgctcgtcgccgtacagggtgaaggtgatgccggcgcggtggaacagcaggtcggcttcacgccggcgttgcagcagttgctcttcaggggtgtcggccagccagcgagcgaattcccgataatgcgagcggcattcgccgccagcatcgtgcatctcgtcgtaaaacatgcgtgccatgccggactccttgtcgtcacgaacgatggggaactcgcaaagcccgtgccagcgcgcggatcacggctcgtcggcgattcgcagggtcggcgcggcgggttcgccccagtctggtgcatcctgcccacagggagaggaagggcgccccgttcgacggcatgcgcgccccgcggccacggaccggcatcgacctgccgatcgcgaagcgacctgtgggaccgataa

SEQ ID NO: 13742 - DNA, 2181 bp, Pseudomonas aeruginosa
gcaagattccgcctgcgccggcgaccgttggtcctgcccgatggcattggcgaaagcgactcgtgcaataatatcaggttgatatcaaccacttctctcccgctatcccgttcggacgctttcatgcttatcagcagctacaaccaggttcttgtcgccttttccctgattgtggccatcctggcgtcctacaccgctctcgacatggccggccgggtgaccctggcgaaaggccgcgaggcgctctcctggctgatcggcggcgctttcgccatgggcttcggcatctggtcgatgcatttcgtcggcatgctcgccttcagcctgccgatcccgctcggctacgacctgggcctgaccctgctgtcgctgctgctggccgtcggcagttcggccttcgccctctggctggtgtgccaggcggaactcccctggcaacgcctggcgctgggcgccctgctgatgggcagcggcatcgccgccatgcactacaccgggatggccgccctgctgatgatgccggggatcgtctacgacccgctgtggctcggcctctccatcctgatcgcggtgatcgcctccggcgccgcgctgtggatcgccttccgcctgcgccatggcagccggcgcatcgtcctggtccgcgccggcgccgccctggtgatgggctgcgccatcgtcggcatgcactacaccgggatggccgccgcgcagttccccctgggcagcttctgcggcgccgccggccgaggcatcgacaacggctggctggcggtgctggtcatcgtgatcaccctggcggtgatcgccatcgccctgatcgtctcggtgctggactcgcgcctcgaggcacgtacctcggtgctcgccacctccctcgcacgagccaaccgcgagctgatccagttggccctgcacgacaacctgaccaagctgcccaaccgcatgctcctcgacgaccgcctggagcatgcgatccagcaggcgatccgcgacgatcgccggttcgccgtgctgttcatggacctggacggcttcaaggcggtcaacgatgcctacggccatcacctcggcgacctgttgctgatcgaagtcgccgagcgtatccgcgccaacgtccgcgcccaggacaccatcgcccgcctcggcggcgacgagttcgtcctgctgatcgaggcccgagagcccgccgacgccgcgaccctggccgagaagctggtgaagcggatcagccagccgtaccagatatcccgccacgaggtgcggatctcggcgagcatcggcatcgcgctctaccccggcgacgggcagacccgccacgaactgatgatcaatgccgacgcggcgatgtatcacgccaaggaccagggacggaacggctactgcttcttcgagagttcgatgaacgccaacgcccaggaacagttgcaactgctccatgacctgcgccaggccctggagcgccggcagttggtcttgcactaccaacccaaggtactggcgccgaacggaccgatggtcggcgtggaagcgctgctgcgctgggagcatccgcaacacggactgatcccccccgaccagttcctgccgctggcggaaaaaaccggcctgatcgtgcagatcggcgagtgggtgctcgacgaagcctgccggcagatgcgcctctggctggacggcgggcatgcggagtggaacatcgcggtgaacctttcggccctgcagttcgcccatgccggcctggtcgactcggtgcgcaacgcactcctgcgccacagcctggagcccagccacctgatcctcgaggtgaccgaatcgaccgccatgcgcgatgccgatgccagcctggtgatcctcgagcagttgtcggcgatgggcgtcggcatctccatcgacgacttcggcaccggctactccagcctgctctatctcaagcgcctgccggcgagcgaactgaagatcgaccgtggcttcatcaacgagctggcccacgacagcgacgacgccgcaatcgtctcggcgatcgtcgccctcggccgcacgctgaacctgaagatcgtcgccgagggcgtggaaaccgaggcccagcaggagttcctgacccgcctcggctgcaattcgctgcaaggcttcctgctcggcaggccgatgccggccgagcagttgctcgccagcgtcgcctga

SEQ ID NO: 13743 - DNA, 1269 bp, Pseudomonas aeruginosa
gaacgctctgtcgccgccagtccggcagcgccggcagcaaccgcagcaataccgcgggcaggtgcgactcgtggatgtagcgggccgggcagaagcgcaactggtaggccgtcaatggcatcgcgccgctcagccccgttgccggtgccagaagaactgcgccaggttgctcgccagcagcaacgccagcagcaggccgaacaggccgagcaggcgtccgcgcgagtgctccgccacctggatcgagaagacactctcgaagcgtggcgccagcgggacctggcggaccccggccgacggcaccagcaccacgctgatgcggtcgtagctgagtccttcgatgccgttgttcaccagttgcttgatctgcggcacgtaggcatccagttgcacgtcggcggcgtgcttgatgaacaccgaggccgatgccggcgaggacttcctgcccagtccgtcgcgctcctctggcagcaccacatggacccgcgccaccagcacgccatcgatctcggaaagggtatgggaaatctcctgggccttggcgtagttgagccgcgcgcgctcttcgatgggcgaggaaatcagcccgtccttgggaaacacatccttcagcgtggagaagttctcccgcggatagcccttgcgcttgagcacctccaccgcctcggcgatatccgattcctccaccagcaggcgcacggtgccatccttgtccgcctgcttgtccgcggaaacgccctccgaacgcaacagcgccagcatctcgttaccttccttctggctgatcccggtatagagttcgaccttgcacccgcccaacgccaggaccagcgccaggagcgccatgcgcgacagacctttcaccgttcgcctcattgggtcttcatcagggtttcgacgttctggctcatgcgcccgacggtcttggcgatcagctcttcctgcatggtgatgcgcatcagcgaccactgcatctgcatcaggctgttgggatcgtcgccgggcgtcgacagctccacctgcaactcctgcttggcctggctgaaacgctccctgatctgccccagttcgctgagcaggtcgccgcccaggctgccggcaccgcccatcgcccgttcgaactcggcgacgtgggccgcgccggccgggccgccggagagttcttcgagactggtgatctgcgcctgggcgcccatccgagagatatccatcatgactccaggtcgagtttgtggctgttgcgcacgaggttgtcgagcatgccgttga

SEQ ID NO: 13744 - DNA, 708 bp, Pseudomonas aeruginosa
gcgggatcagcacctgcaattcgcgacgcgccagttgcgccaggtattcgccgcccggcgcatgctcgactgcaccgagcaactggaggagaaaggtttgctgctggcgtcccagcggcagttccgcacggagcatcgccttcagctccaggcggtccgcctccaacccttgcagcggctgggcaaagcgctgcagcaggcgctcgccgagagcgccgttctccaacccggccaggcggcgtccggccgcctgcggctcgccgccgagggcctgctcgaaagccagcacctgatcgacagccggcaggttcgccgcctttggactggccgacggatagacggcgaatcccggcggcgtgtcgatgcggctcatgtccgcacctgggcgcgcatgccggcggcgaagtcggccagggcaggatcgctgctgccgcccagcccggccagcctgcggtccagcgcggcgcccagccccaggtgccactcgcacaaggcgaaccagggctccagcgccggccagggattgccatgggcgaaggccagggcttcctgatagcgcccctggttggccaggctggaaatccggatcagccgcgccgcttcgtcctgtccgaggcgctccagccactcggcgatgcacagcgcctcttcgtggcagtgctgcccgctgccggccagcgccagttccgccaattcgcgtatcagtga

SEQ ID NO: 13745 - DNA, 477 bp, Pseudomonas aeruginosa
gcgcgcaccttcgcctggggctcctcgccggccatgccgtgctggcgggccgaccagggttcgacgagcatgcccagcagacacagcgccagcgccaggctgacgccgagcagccaggccccgccggcacgggcggacgacttgcggcgcactggcgcggtctgcacctcggcttcggggaaacgctcgggaaaactccgctgcgggtcgcagaatgcccagcgcagcgggccgcaggtctgcccggcaagcgcctgcaggatcgctccggcgacttgcgcctggccgtcctggcgaggctcgcagccctccgcccattccagcaggcgcacgccctgggcatcgacctcgagcaccaggtggactgccgcgatgccctcgtcgagcaacaccaggtcggcctgcaacggatcgctgccaagcgccacccggccctctccgagcgagacttcggcgccctggttcagcccgctgtag

SEQ ID NO: 13746 - DNA, 3222 bp, Pseudomonas aeruginosa
aagcggatcttccaggccatgctaattcccgcgctccgcgccgacgcaccaggcgccgtccttgggacaggcgccgtcggtcacccgccagccctcctgcgcacccatccggcagggcgtgaggaacgaaccctggccggcctggcgcaagcgctcctgttcggccctggccggcgccagcgcctggcagcgggcgctaccgagcagcttgcgcaacgacaggctctggttcgacaactcgtcgatttcaagcaggccgccgcgcaggtcgcgacggttgttcagcgccaggtaatggccgacgccatcgtcgatcagccgcggctcgatgaggaacagccgcaccgagcggcgcacggtgtccgcggtagtgcggaacagcgcgccgagatagggaatgtcgccgagccagggtaccttgcgctggctctggctcagttcgtcgcggtagatgccgccgatcagcaggctctggccatggcccacgcgggcgatggtatcgatcaccgtgcggttgatcgtggggatcttgtccaggccggcgctattgggtttctggctgccgtcctcgatgtgcaggctgaggctgatctccggcgtatcgccgagagtcaccactcgcggcgtcattttcagcatggtgccgtaggtgatcgccttcagctcggccacccgctcacccgtgacccgcacatagtaggtttcgctctggtcgagcaccgcctgggtattctcctgggtcagcagggtcggccgggatccgatctgcgcctgcccctggctctgcaacagggtgaccttggccagcaggaaatccagcccgcgactgtccaccaggctgccgaccgccccgttaccggcgccgccgccctcctcgctatcctggccggtggtgcggatctggatcgacttgttgttgcccaggcgaatcccggcgctccagtcgacgcccagctgggcgaggttctcggcattgatgtcgatgatcgacaagccgacctcgatccgcgccgagggccggtcgagggcttcgatcaggcggcgatacatgggcaaccggtccttgtggtcgcgcaccaccaccgcattcagcgacggttccgcctggaccaccgcatggctcgattgcggtcccgggcgcagcttgcccggctcgtcgcccaccgcaaccacgttggcatcgctgagcacccgcgagaggatgctggcgatgcccggcgcctcgatctcgtcgtcgcggtactcgatcttgcggtcctcggcgaccgcatagcgcagcgggaagatctccacgctgaggtcgccggtcttttcgctgcgcagggtgtattgctgctccagcacctgggcggtctgctcgaccagttcgagatagcgccccggaccggacacgtgcaccagccgcccggaagggtcggcacgccagccgaagcgcggctcccagatgccggcggcggtcagcgcgcgcttcagctcggcctcgccgacctgctccagcctcaccagccgcgattgcatctcggtggtcttgaatacgtacagcacggtgccgtcgtagtaccagccgaggttgtagagggaggccatcaactgcaggaaggcctgcgggctttccaggtcgaagcgaccgctgacctggtcgttgaccttgtcgctgacgatcaccgaggcatcgtagttggcgccgaagttggccaacacgtcgcgcaggctttcgccctgcgccacatagtcgtaaggcaggctgggccagtccagcggctgcgcgcgcaagaccgcgccaggcagcagcgccagcagtccgccgatcagcaggcggcgcatcagggacgccacaccggagcctgcggcggcaacccgcggggcagcggttccagctccggcgccagcgcctcgagcagccccacctggggcggccagggcccgttcgagtcgctcgggatcgaggccgtcgaggcccagccgcgcctgcaacagcaggcgcccgtccgcgtccaggacaatggcctggggatagcgccgactccaactggcgacccgcgacaacagcacccgcagcaacccctgctggtcgcgctgcgggtccaggggggcgtgctccagcgggctttccagcagcaggtcgtcgccctggcgcagcaacaggacgctctgtccgtcgatgcgcaggtggtacgaacccgtccgatcggcaacaaagggcccttggcccaggcgagtggccaatccgctcaacagatgatccatgattcctcggtagggccggctttcgccggccgctcagctctgccagtagaagtgatcctgtgcctggcacaggttgcgttcgtgcagccaggcctggacggcgtccgccgcgccgacgtcgtcgtccagccggcagagaggttgccagaggcattcgaggacctcggggatcggctcgaagccggccagcccgccgctggcgagcagcgtcgccatgccccgctgccagttcggccaggcgctcttcgccagtgccgaagccgtctccagcttgccggccagttcggccacctgttcctgggtgcgcgcctggcacttggcgaccctggccagttcctcgcgggcctgctccggctccagctcggccacgcgggaccagaattcggacttgactcgcagttgccgggactgggtctccagctccaccagcgacaggcgccagccggggatcgcctggtcgagcaggctttcccaccagccatagaccggcagcaggacccagtcgatcatcgactgcggcacggcgaggttgacccggtcgcccagttcggcgcaccagccgtcgtcgtcctgcgccgcgcagaggagaatctgccgcacctcttcgcgccccagcgccaggccgcgcgccaggcgctgctgcaaccactcgcagcggaacagttgctccagccgcaggcgcggcagcatccgctgcagcaacgccagttgccgcgcactgatgattccggactcacgatacaaactgctcgatgcgtaacccggcacccgaccccgcgagcgggcgtccgagcccaccacggatacccgcctgccggcgaacaccgcttctcgggagtactgcttatcgtcttcctgctccattctctgccttggcttcctcactacattgcgcgctcgtcagagcctgcaatttgggccgattctactcatgcagccgctaccgggctttcaaaaaacgtcagttatttttag

SEQ ID NO: 13747 - DNA, 447 bp, Pseudomonas aeruginosa
ttcgcagagcgagtcggcttccgccaattaatccagctttctttagaagcggaacaaaagtaccagttttattattcgaggccttccctgacaacgaacgagacttgcacttctttaatctccatacgcactttccgaaacagcaggcaatgtatcaatcgttgccagatctttcttccgggcgagcggccgtacaattcggaaaacagtcgcgccgaaccagccggacccgctcatcgacgcccgccgccacccgctgccaggcgctcgcctggaccgccgcgacgcccacccaggaaagctcggtgcgtaggtacaatgcctcgccctccaacctgtcgacctccagatcgaacgcatagcgcaacggcaacccggacacccggtagcgccgctcggcaatcgtttgcatccttccctgaacgacggcatacaggcgcagcctga

SEQ ID NO: 13748 - DNA, 921 bp, Pseudomonas aeruginosa
gtggcctgggccgcgccgttggcgacgtccagggtcaggtcggaaacctgcacgccgagtttcagcgagtgcgacagcgattggccggccaaactgccgaacttgccgcccaggtcggcgaccttgctcgccaggctagcggtcatctcggccgccttgccgccgatcttcgcgcccagcttggccagcccgccgaccgctgagccgccgaagctgaccaccgccgccagcagcgcgacggcgatctcgatacccatcagtgccgggccgagcttttccatcacttccttgctgatcaatccgtccgcggctgcctgctgtaccgactgggagaccactcccatgacaccgcccgcgatcatcagtgcacccgcggccgcgccgacgccggttgccaccatgattgcgccgacgatgatcgaagctattgcactgatccaaccaaagattttggctgccagaccggacttctgggcttctttcgcggcttcttccgattccctgatcttctgctggttgtcctccatcttctgcaggttctgctttcgcgcctgctcgatttcggtcagcttgagtttcttctgctggttctcgacttcgccggtgattttcgccagctcgatctcgaacgcctgcggcgacatcaggccggcggacaacagcgtcgaagcgccggccagcacaacctgccgcgccagtccggcatcctcgcccactgcttgcaccaggctggcgatctccgcacgattggcgacctccaggcgctgctggctggctgcggacggcggcgtcagcgccacccccgtgccgctcgcggaagccgcggccggcgccgccaggcgctccacccgcagactctcgacatacctcgcgaccggcctgccgagcgccgggacatccccggcgtcggccaccccgtag

SEQ ID NO: 13749 - DNA, 750 bp, Pseudomonas aeruginosa
gccgacaccaggaactcgcgcagatcccactgcgcaccgggctgccgacgtgcctgcaggacttcgcggagtacctcgaggccctgccccggaggcgcggagggattggccgcgagcaaccaggcaagcgccttgagcacttgcgcctcgctcagcggctggccggcgtgggccagcacgatccgctcgctgcgcaacagggccagcagttcctcctgctcggcactggcaggcgccgccgacgcggccaggagctcgtccaggaacagctcgcgagcggcattaaggtttctgacttccatcgtgattcctcagatcaacaagccacgcatcggcgtcggacgccgcggccgggtaccctgctcgccctgcgtcggctgggaactgcgcatgcgccgcagttcggccagcagctcctcttcggcggctcgcgccagctctcgctccggcgcctggaacagcagctcgccggcgtccgcggcaagccccaggccttgccacatttccgccagcaggcggccgcgttcctcgctgtcgcgaatcgccagttcggcggcctggacggtcgcccgcagggtgtcttcggtgtattcgttcatgtcgtccatggtagggatcgacgttgccggagcctgtcaggcacggtcgggtttttgtcgttttcgcaggcttcgctgcgtcaccacccgcccggcctccagctcgaaccagccgtcggcgggctcggcggcgccggtccagcggcgatag

SEQ ID NO: 13750 - DNA, 738 bp, Pseudomonas aeruginosa
gggccaggcggagatcgcgcagcgcctggcggaagtcgccggggcgcagcaggccgtggaactccagctggggccgggcgtagtcgaacaggcgctgttgcgcctgctgcgcgggatacaggctggcgacgtgggtctccaccggccggccgtcgggcgccagcagatggcgctccggcaggggcggcgcgaacggctcggcatgcgccaggtcgagtcgttcgatgccgatgtgccaggcaccgacccggctcatgcggcgagcacttcgctgcgcgccgagcgcagcgcctgcaaggcctggtgcaacgtcgggatgccgacctgccgggcttccagggtgatgcacagcagcaggcgcgattcgccgctccaggcgcaacgcagcggcaggctcccggccgcgcgcgcatggcacagggcgcaacgcccgcagggtgccgcgataggcctggtgccaggccaggtcacaggccagccagagcgacaactgttcgccatggcgttccagctgcaaggtgccgctgtcctcgaaatccagttgcaccacgcgcgccagcggcgccggtacgctcacccgcaggtcctggcagaactgcgcgacggccagctcaacccagtccatgctgctgctcctcttcgcgctcgatcgccaggtcgagtgccatctggcaggcattcaaaagattctggcgctgctcgtcgtcgccgaacacttcgaccggcaacaggcggtag

SEQ ID NO: 13751 - DNA, 963 bp, Pseudomonas aeruginosa
accgcccacccgccgcggctatccgccatcggtgttcgccgcgctgccacgcttgatggagcgtgccgggcaatccgagcggggctcgatcaccgcgctctacaccgtgctggtggaaggcgacgacatgagcgagccggtggccgacgagacccgctcgattctcgacgggcacatcgtgctgtcgcgcaagctggccgccgccaaccactatccggccatcgacgtgctgcactcggtgagccgggtcatgaaccagatcgtcgacgacgatcagcgccatgcggccggacgcttgcgcgaatggctggcgaagtacgaggaagtcgagttgctgctgaagatcggcgaataccagaaaggccaggacagcgaagccgaccaggccatcgagaagatcgcggcgatccgccagtggctgcgccagggtacccacgaaaccagcgattacgcacaggcctgcgcgcagttgcggagcctctgcgcatgagcctggcgctgctgttgcgcgtccgacgcctgcgcctggaccgggccgagcgcgcccagggccgccaattgctacgggttcgcgccgcggcgcaggaacacaccgagcgccaggcggcgcaacgggactaccgcgactggcgactggccgaagagcaacggctgtttctcgcctgccaggcggccatgctcgaccgccggcgcctggaagcctggcagcagcaggtaggactgctgcgggaaaaggaagccggcctggaacaggactgcgccgagaccgcgcagcgcctcgaaggggagcgcgagcgcctgcggcagtgccggcgagaactgctggaacgccagcggcaactggagaagttcgccgaactggagcgccacgtcgacgccgagcgccaggggctgcgcgaacgcagcgaggaaggcgaactggaagaattcacccgccacgagacctggccatgctcaagctga

SEQ ID NO: 13752 - DNA, 2313 bp, Pseudomonas aeruginosa
cacggcaagcgccggcggtctccgcgcgcgtcgcggcgtccacgcaagcccgggagccggccagcgtttcggcgcctccggtcgacgaaccgccgctggtgccggtgtcctcccacccgcaaatcgcaggtcggacgcatgagcggccacagcccggccccggcttcccggcgaaaaccgcagccgaggtcgcgtccacggcgcaggccagtgtccaggattcgccgcccgcgccgacagcgggcggcgaaggccgcggagaggagcgtcggcaacccggagaaaccgatccatccgcactgccccccgacgaccaagcgcctgtgccactgcctgccatgcaaacccccggcgaccgcctggtggcacgcctgctggcatcgagcgggagccggccactgccgctggccgatctcgcgcgcctgctcgatgccgtgcaggggcgcatccaggtcgccagcgcagccgaaagccatgcggcgcgcctgcaggtgcgactgccccagctcggcgccgtggaggtgcaggtcctgcatggccatggccagttgcaggtcgagatcagtgccagccccggcagcctggcgtttctccagcaagcccgtggcgagttgctcgaacgcctgcaacggctgcatccggaacaaccggtgcaactcaccttcaaccagcagcaggacagcggccagcgctcgcggcaacgtcgctacctgcatgaagagtggcaagccgaatgaacggtacggacctcgacctgccgctcgccagccgcgccgaactggatctccagcgacgtctcgcgcgttgccgtcgccactatgccggcaacgctttgcaagcgcgcctggacatcgcccaggccgcccccgacgtcgatctcgaactgagcctggcgtgggacggcctgcccctgcgctttctctgccaggctccggcgctcgcccactggctcgcgccgaacctgcaggaggcagccttcgccagcctgccggcggccctgcaactggccttgctggagcgcgaaggcaacgtctttcccggcctggtctggtacggcctgagcccggcgcaaccacgcgctgcgatgggcctgcgtttgagcctggaacgcgacgaccagcgcctggcgctctggctcgacggcgatcccgcgacgctgctggcacgcctgccgccgcgcccctcggcgcaacgcctggccataccgctgcgcctgtcgctgcaatggcccggcctgccgctggacgccagcgagctgcgcaccctggagcccggcgacctgttgctgctgcctgccggtcatcgccccgacgcagcgctgctgggggttctcgaaggacgcccctgggcgcgctgccaactccactccacgcaactggaactgctcgacatgcacgacaccccctccctcgccgacggcgaggacctgcacgaactcgaccaactgccgatcccggtcagcttcgaggtcggccgccgcaccctggacctgcataccctctccaccctgcagccaggctcgctgctcgatctcgacagtgccctggacggcgaagtgcgcatcctcgccaaccagcgctgcctcggtatcggcgaactggtcaggctccaggatcggctcggggtgcgcgtaacccgcctgttcggacacgacgaagcatgatccaattgcccgacgagctcggcctgatcctcggcctggccctgctcgcgctggtcccgttcatcgcggtgatggcgacctccttcatcaagatgaccgtggtcttctcgctgctgcgcaacgccctgggcgtccagcagattccgccgaacatggcgatgtacgggctggcgatcatcctcagcctgtacgtgatggcaccggtcggcttcgccacccgcgactacctgcgcaaccacgacgtcagcctgagcgactcggcatcggtggaacgctttctcgacgagggcatggcgccctaccggaacttcctcaagcggcagatccaggagcgcgaacacaccttcttcatggaaagcacccgccaggtctggcccagcgaatacgccgagcggctcgacccggacagcctgctgatcctgctgccggccttcacagtcagcgaactgacccgtgccttcgagatcggcttcctgatctacctgcccttcatcgccatcgacctgatcatctccaacatcctcctggcgatgggcatgatgatggtgtcgccgatgaccatttccctgccgttcaagctgctcctgttcgtcctcctcgacggctgggcgcggctgacccacggcctggtcatcagctacggaggctga

SEQ ID NO: 13753 - DNA, 1740 bp, Pseudomonas aeruginosa
gcagaccctgggcggcggcctggtgcgcaacggcgtggcctgttcgctggcgctgttcgcctacccgatcgtcgccggcagcctgccgccggccctcggcgcgctggacatcgccctgctgatcggcaaggaagtgctgctcggcctgctcatcggcttcgtcgccaccattcccttctgggccatggaagcgaccggcttcatcatcgacaaccagcgtggcgcggcactcgcctcgaccttcaaccccagcctgggcagccagaccagccccaccgggctgttgctgacgcagacgctgatcaccctgttcttctccggcggcgccttcctcgcgctggtcggctcgctgttcaggagctatgccagttggccggtgagcagtttcttcccgcagctcggcagccaatgggtggcattcttctacgcgcaattctcgcagatgctgatgctctgcgcgctgttcgccgcgccgctgctgatcgccatgttcctcgccgagttcggcctggcgctggtcagccgcttcgccccgtcgctgaacgtgttcatcctcgccatgccgatcaagagcctggtggccagcctgctgctggtgctctacctgggcatcctcatggagcacgcctacgatgccctgctgctcgccgtcgacccgctgcgcctgctgcgtcccgtgctggagacgccatgagcgccgagaagaccgagcagcccacggcgaagaagctgcgcgacgcccgccggcaaggccaggtggtgaagagcaaggaaattgtctccagcgcgttgatcctgtcgctggtggcgctgctgatgggcttttccgactactacctggagcatctcggcaagctgctcctgctgcccgccgagtacatcgacctgccgtttcgccaggcgctggagaccatcctggagaaccttctccaggagctcctctacctgctggcgccggtcctgctggtcgcggcgctggtggtggtgctcagccatgtcggccagtacggtttcctgctcagcctcgacagcgtcaagccggacctgaagaagatcaacccggtggagggcgcgaagaagatcttctcgatccggagcctggtggagttcctcaagtcgaccctgaaggtcgccctgctctccctgctggtctggctgaccttgcagggcaacctggccagcctcctgcggattcccgcctgcgggctggactgcgtggcaccggtgagcgggctgatgctcaggcagctgatgctggtctgcgcggtcggcttcctggcgattgccgtcgccgactacgccttcgaacgccaccagcactacaagcagttgcgcatgagcaaggacgaggtgaagcgcgagtacaaggagatggagggcagtccggagatcaagagcaagcgccggcaattccatcaggaactgcaatcgagcaacctgcgcgcggatgtccggcgctcctcggtgatcgtcgccaacccgacccacgtcgccatcggcatacgctatcgacgcggcgaaacgcccctgccgctggtcaccctgaagcacaccgacgccctggccctgcgggtccggcgcatcgccgaggaagaaggaatcccggtgctgcaacgaattccgctggcacgggcgctgctgcgcgacggcaatgtcgaccagtacataccggcggacctgatccaggccaccgccgaagtcctgcgctggctggaaagccagcagacggatacgccctga

SEQ ID NO: 13754 - DNA, 951 bp, Pseudomonas aeruginosa
caggtcgaaccccgccggcggatggcgccggctgcgccggacaggtatcgtctgcccatgagccagcctacctctcccctcgtcctgcacctgccctaccagtcaccctgggaatggcgccagttccaccagcatttcgccctgcgcctgctcgccggtgtcgaaagcctgggtgacgaccactatgcccgcagcttccgggccaacggtcgcccggcctggttcgaggtgcgaccgctggcggaacgccaggtcctggcgctgagcctcagcccgtccgcccatgccctggccgccgaactcgaggcacgggtccgccggatgttcgacctggacagcgacccggccgccatcgcccggcatttcgccggggatcccctgctcggcccgctggtggccgccaatccgggactgcgcctgccggtggccttcgatcccttcgaacaggcggtgcgcgccatcgtcggccagcaggtcacggtgaaggccgcggtgaccatcaccgggcgcctgatccagcgcctcggcgagccgctggaagatctcggttacgacggcatcagccacctgttcccgacgcccgccgcgctggcgcaagccaacctcgacggcatcggcatgcccggcaagcgggtacagacgctgcaacgcttcgccgcggcgatcgcctcgggagagctgagcctggacctggcggacggccccgaggccctggtggagcgcctctgcgcgttgcccggcatcggcccctggaccgccgaatacatagccctgcgtgccatgggcgaagccgacgccttccccgccgccgacctcggcctgctgaaatccacggtctgggggccgcaaggcatcgatgcgcgcagcctgaaggcccgcgccgaggcctggcggccttggcgcgcctacgccgcgatccacctgtggcaccactacgccgcaggcggctaa

SEQ ID NO: 13755 - DNA, 702 bp, Pseudomonas aeruginosa
ccggcgcgttcactccacgaggatgtcggcgaagctggccaccgtcggatggccgtccaggctgccgccttcgcgggccaggccgagcgtgcgcatgcccgcgtcgcgcgcggcgtccagctcctgcaccacgtcggaaaggaaaaggatttccgcggccggcaggccgatggccccggcgatccgcgcataggaggcgctttcccgcttcggcccgctggtagtgtcgaagtagccggaaaacagcgggcccaggtcgccggcctcggaacagccgaagatcagcttctgcgcctggatcgagccggaggaatagacgtacaggtccagcccacgggccttccactcgcgcagcgcctgcaccgcgtccgggtagacgtggcccttcaattgaccgtcgcggtagccctgggcccagaccatgccttgcagggccttcagcggcgtcgccttgcggtcctcggcgatccattgcaggaggatcgcgatcgcccgctcgacatcggcgtccgcctcaccgctctcggcacgcaccgccgccaactgtgcggctacctcggtctctccggcgtgttcgcggacgaagtccggcaggtgccgggcggcatagggaaacagcacgtcgaaaacgaagctgaccgcgctggtggtgccttcgatgtcggtgaggatggctttgatggtcatgcggactccggatga

SEQ ID NO: 13756 - DNA, 1377 bp, Pseudomonas aeruginosa
tctgctgggtcagctgttcacggttgtcgttcatgcccgcacctcttgcaaacgggtactgatgatagcggctgccagcaaggctgccaggctggcgatggcgaaggtccaggcagggcccaggctgttccagctatagccggaatacagcgcgcccagggctccgccggtaccggccagcgcagcatacagggcctggccctggccctgctggcgcgggccgaagctacgctgcacgaaatggatggcagccgcatgaaaactgccgaaggtggcggcatgcagcgtctgggcaaagaccagcagcgccaggctgtcggccaggttgccgagaagcagccagcgcaacgacgccagcaggaagctcgcggccagcacctggcacaggctgaagcgttgcagcaggcgtggcatggcgaggaacaacatgacctcggcgaccacccccagcgcccagagcagaccgatcagcgcccggctgtagcccagcgattccaggtgcagggtcaggaaggtgtagtacggcccatgggacagctgcatcaggcacacgcacaggtagaacgccagcacgcccggctggcgcaactgggcgaggaagccgccctcgccttcgcgcggttcgcgatgggccggctgggcattgggcacccaccagctgcacagcacgatgccgagcatgatacccagcagcgtcgccgggtagacatccaggctcaggcgctcgaacagcgcgccgagaccgaccacggtgcagatgaaaccgatcgagccccacaggcgaatccggctgtagctggcgctgcgctcgcgcaggtgggccagggtgatgacctcgaactgcggcagcacggcgtgccagaagaacgcgtgcaacgccatcaccaaggccagccaggcgtagctgtggctgacgaagatcagcgagaagcccagcgccgtgcataccgcgccgaagcgcacgatggtcaggcgctggccgctgcggtcgcccagccagccccacaggttgggcgcgacgcaacccatcagcatgggaatcgccaccagctcgccgatgcgcggactggggaagcccaggtgatggaaatacagggcgaggaacggcgccgtggcgccgagcaggctgaaatagaagaaatagaagctggacaggcgccagtagggaaccgcgctggtcacgatccgccgttcacccgtcccgcatcgctgcctgccacagccctcacagctgcggcaggaccggcgtgtcgacgcgcacgtcggcgttctgcccacgctggcgcagcaattggtcgagcaggacgatggccatcatcgcctcggcgatcggcgtggcgcggatgccgacgcacgggtcgtgacggcccttggtga

SEQ ID NO: 13757 - DNA, 1119 bp, Pseudomonas aeruginosa
agagcttgccgtaggtgttgccggacatgcgaggctccgcgtgaggacgacagggaaagacatcggagtatacccgtcaaggacgggcctgcgaaccttccccggaggacgcgatcaaagcgctatcatcggcccatgaagacctccatgccgcgcgccctcctcgccctgttctgcctgctcgccagcctggcccacgccgctcccaacagcatcctgcaccgcccctacgacctggacaccgggcacggcgtgctgcgcggctccttgctgctgccgcgcagcgccgtgccgccgccggtggtcctgctggtcgccggctccggtcccaccgaccgcgacggcaacaaccccttcggcggcaacaaccgctacctgctgcgtctcgccgaggccctggccgaacgcggaatcgccagcgtgcgctacgacaagcggggagtcgcccgcagcctggcggcggcgccacgcgaggaagacctcagcgtcggcgcctatgtcgacgacgtggtcgcctggagcgagcggctggcccgcgacccgcgcttctcccggctgatcctggtcggccatagcgaaggcgcgctgatcgccagcctggcggcgcctcgcacgccggccgaggaattgatcgccatcgccggcagcggccaacccatcgaccgggtgttgcgcgagcaactgcgcggtcgcctgccgccggcgcaactgcgccaggccgactcggtgctggcttcgctgaaggccggggagacccgcggcgatatcccgccggcgctcgccaacctgctccgccccagcgtgcagccgtacctgatctcgctgttccgcgaagacccggcccgcgcgttcggccgcctgcgcatcccgaccctgatcgtccagggccgcaatgacatccaggtcggcgtcgccgacgccgaggcgctccagcgagccaagcccgactcgcaactggtgctcatcgacggcatgaaccacatcctgcggatcgccccgagcaccggtctccagcagctttccgcctacaacgacccgaacctgccgctggcccggcaactggtcgaggcggtcagccgcttcatcctgcgcggcgcagaggcggaaaaaggccgctga

SEQ ID NO: 13758 - DNA, 465 bp, Pseudomonas aeruginosa
catgcctcatccgctcacccttttgcagatcagcggacgcggctacccgccagccccccttcggcagagcaccttgctgatcatcgatgcccaggaagagtaccgcagcggcgccctgcgcctgccaggcctcgacgccgccgccgcggagatcggcgtgctggtgcaggcggcccgcgccagcggtacgcccatcgtgcatgtacgccacctgggtatccagggcggcctgttcgatccgcaagggccgcgcggccagttcctcccggaactgcaaccggaagccggggaaaaagtcgtggagaaacgcctgcccaatgccttctccggcaccgagctgcacgacctgctgcagaaccacggccgtctcgacctgatcgtctgcggcttcatgacccattccagcgtcagcaccaccgtgcgcgcggccaaggactacggctaccgctgcaccctcgccgatag

SEQ ID NO: 13759 - DNA, 810 bp, Pseudomonas aeruginosa
aagttccgcatggcgtccgcccctaaggaagaggagataaatatgatttattacttgatcggagtggcgctattcatcttcatgctggaacagttggttcccggctggaaattgcccaaggtgagcacctgggtggcccgggtgatcttcctcaacatcgtccaggtgtcgatcgccctgctcgccggcatcacctggaacaaatggatgatggggcacagcctgctgcacacctcggatgccctgccaccactgctggccggcttcgccgcctacttcgtcaacaccttcgtcacctactggtggcatcgcgcgcgccacgccaacgacacgctctggcggctgttccaccagttgcaccacgcgccgcaacgcatcgaggtattcacctccttctacaagcatccgaccgagatggtcttcaactcgctgctgggcagcttcgtcgcctacgtggtgatgggcatcagcatcgaggccggcgcctactacatcatgttcgccgcgctcggcgagatgttctaccactcgaacctgcgcaccccgcacgtcctcggctacctgttccagcgcccggagatgcaccgcatccaccaccagcgcgaccgccacgagtgcaactacagcgacttcccgatctgggacatgttgttcggcacctacgagaacccccgccgcatcgacgagccgcagggcttcgccggcgacaaggagcagcagttcgtcgacatgctgctgttccgcgacgtgcacagcctccccggaaaaacccagcccgcccccgtcctggtcaagcccgacgtcaggtga

SEQ ID NO: 13760 - DNA, 528 bp, Pseudomonas aeruginosa
gcgcggtatgcccggactactcgcactccagcgatgccgagggcaagccgcgctacaccttcgagcgagtcggcgaccagcccggcctggccggcgccaagctggtcagcgccggccaggcggtggcggagctggccagggcgcgccaagtggaaatccgccacgcgatcctcggcggcgagttcgagtacctatcgttcaaccgcaaccccgccaccggcgagacccgcgagggtttcctcggcaaggtcgagcgccagctcgagcggatcgccggggccctgccctgcccggccgcgacctgctctttcttcgagatgtgcggcggcgaggacggctggcaccgggcccacggcgagatcgtccagcgcctggaacagggcgactacggccagaccgggctggactacccggccctggaatcgatcttcctgtcgcgcctgccgctctacgagaaatggttcgccagccagtcgcgcgagcagatctgggccagcttcgtctcccaggccgccgagtacgcattga

SEQ ID NO: 13761 - DNA, 786 bp, Pseudomonas aeruginosa
tcctgcgcgaccacctctgccgcggccagtcggacccgttcggaatcgtcgactggtaccgcgagaaccatgcccggctcgctccggagaccgatgccgccaaccagccccacaccaaccaacccgcatcccaggctaccgcctgatcacacaggaaaccccatgaatactcagattgcccagatcacccagagcctggcagccaacggctgcgcctatatcacccccagcgacgcgctctacgacgagcaggactgggaactgatgaaccaggtcctggccaactcgaccctgccgtgggagaagatcctgatcggcgacgccgacgaggagaacgacctctacgtggcccgtttcatgaccgaccgcgaccgtcccacggtggtcaaccatgcgctgtcggagctgatcatcccgcgcgtctgcaacgacaacgtgatgagcctgttccgcaagctgatgggcgacgacgccttctacgtccggcgcatgcaggtgaaccggatgaaggccggctcgttcatcggccggcacctggataccgacagcaacccggactaccagtactccatcgtcctgcagctcggcacctacttctccggcggccagttcgtggtctacgaccgcgacggcaacctgcgcaacgacatcaagccggagccgcgctcggtgatcatcagcgactgcagctatccccacgaggtccagcaggtgaccgccggcgagcgcgtctcgctggtgttcttcgtcagtcgccatgcggaccggaaccggcgggtctattga

SEQ ID NO: 13762 - DNA, 2226 bp, Pseudomonas aeruginosa
ccagcgcatcgcctggggctacaccaataccggcttgcacatccaggacgcctacctggagcgcgtcgatccccaggacccgcggcgctacctgaccccggacggctaccggcccttcgagacgcgcttggaacgcatcgccgtgcgcgacggcgagacggtctcgctggaggtccgcagcacccgccacggcccggtgatcagcgacatctacgaaccggcgcggctgccgcaggcgcagcgcgaccggctggtgatcgccctcgcctggaccggcctcgaccgtcacgacaagaccttcccgagcctgctggcgatcaaccgggccgaaggctgggaacagttcctcgacgccgccgccgacttcggcgtaccgccgcagaacatggtctatgccgacgtcgagggcaacatcggctacgtctccgccggtcgcgtaccgctccgcggcgccgacgacgacctccatggcctggccccctcgcccggctgggagagccgctacgactgggtcggctacgttccggaaagcgccaagccacgcagcctcaacccccgcgaagggttcatcgccacggcgaaccagcgcatcgtgccgcccgacaatgccttcgacttcggccacgactgggtcctgccctaccgctacgaacgcatccgcgagtggctcggcggccccggccagcgcaccctggaagacagcttggagttgcagaacgacgagttctccagcgtgatggcgagcctgttgccgaagatgctggagcaggtcagcgaccccgaactgcgcgccagcgaggccttcgccctgctccagggctggaaccaccaggccgccgccgacctggccgcgccactgatcgccggctactgggtacgcgccttcacccgcgagctgctgcaaccgaggatcggcacgcagttgctggccagcggctggaaccagcgcaactacgacggattcctccggctgatcctcgacggccaggccgacctgcgcttctggtgcggccaggaacaaggctgcgacctcaagctgaaccagtcgctgcgccgcgccctcgacgaactgcgagccgcccacggaagcgcgccgagcggctggaagtggggcgaggcgcacgccgccctcgccgagcacgtgcccttccacaagaccccgttgcgcgcgctgttcgacctgaagaacaacaagggcggcgacaacttcagcgtcaacgtcgggcgcttggactacagcgacccggccaacccgttcaacacacggatcgccgcgaccctgcggatggtcatcgacctggcggacttcgacaactcgcgctacgcgctgtccacccgcaattccggcctgccgttcgacggcgccaccgatctcaacgaactctgggcccgcggcgcgtacatccgtatcgccgacgacgcccccgacgcgacggaccgccagttggtcctgcgcccttcagccccttcctccggcgagccacgaccatgaccagcgatccgcagaaaaacgccttcgacctcgactactccagccgcgaacggcagttccccgagggcttcaagcgcaagatagtcgccgacctgcaagagggaatgccgcagttcgacgtgctgcaatacttcggcaaccagccggatatcttcgagacctacgaccacctggtgctagcgaccgacccggagggcgaacggatcatcggcatcctgggcgcgaaggacttcgtccgcggctcgacacgcttcctctacctgtggacggcgatggtggtcgaccgctaccaccgcaccagcctgttcaagcggatcaaccagttcttcctgcgccaggtcagcgagcgcaacggcgggctgccgccgctgatcgtggcgaagacctacaacccggtggtctacaacatgttccgcgccctcagcgcgcggattccgggagcgacgctgtacccggacctggaagcgccgcgccagaacccggacatggtcgacctggccctcgacgtggtcggcacgctgtccgccaacctgcgcctggatgcggaaaccggcctgatacccggcgggcaacgcagcgtcgccccggatttcttcccgcgcatggcgatgtccagccacgccaggaccaacgaccacttcgtcgcccacgtcggcagcagcgaccagatcctctgcatggtccgcctcgcgcccggtgccgaaccctacgtgcagcagaggatcatccggtga

SEQ ID NO: 13763 - DNA, 855 bp, Pseudomonas aeruginosa
ccgcgccgatggccgcgctgcactggctctcgggcacgccgcatccattggcgagcgtggcgccatcgttcgtcatcggctggctctacttcgccctctgggcgcgccaccgcccgggccgccggcaaaccagccgcgcctagccggcgcccccgctcgagccgctccccgtcggcgggatcggcccgtatactcggagccttcctatccgcccaaggacgcgccatcgccatgctggagattctcggaaaggcctcttcgatcaacgtgcgcaaggtgctctggacctgcgccgaactggacctgccctaccgccgcgaagactggggcagcggcttccgcgacacccacgcggcggaattcctcgccctcaacccgaacgccatggtgccggtgctgcgcgacggcgaactggtgctctgggaatccaacagcatcatccgctacctggccaaccgctatgccggcgaacgcctctatccgcagcaggcggcgccgcgcgcgcgggtcgaccagtggctggactggcaggcctccgacctcaaccgctcgtggagctatgccttcatgagcctggtccggcagtcgccggcgcaccgcgacgcggcccaggtggaggcctcgttgcgcggctggacgggcttcatggaaatcctcgagggacaactgctacgcaccggcgcctatgtcgccggcgagaccttcagcctggccgacatcgccatcggcctgtcggtcaaccgctggtacgagacgccgttcgagcatccgtcgctgccagcggtgcgcgcctattacgagcgcctcggcgcccgtcccggcttcctcgcccacggccgcaacggcgtaccctga

SEQ ID NO: 13764 - DNA, 876 bp, Pseudomonas aeruginosa
tcgccttcatggccaccgccgtcagcaaggccatctacgaacgtacggctggcgcctcctactaccgggagtgccacgacccggtgcggaagaacttctcgttcggcaagtgcttcgacttccactacctcaaagccacggccatgcaccggcggctgcaacggcaactctcggaacccggcacccgcagcgaacaggacgtcctctatgaaaaccctctctagcctgctcctgatcggcttcgccgtcgttctgctcgccccgcggatggcgcccgccgccagcgccgccgaagacaaggccacctattgcggctccggcttcacccagtatctggttccggacgacgtcgcgggctgctcgctcagcgaggcctgccgcctgcacgatatctgctacggccgctgcgacaaggacggcgacctctacggcagcgcctactgcgcgcaaagcgaaaagtccgaagcccgcaacatgagcaagcagcagtgcgacgccaggctgcaggccgacatcgccgcacagaacggcaacagccgcctgtgccgcgcggtgggaggcgtctaccgggtattcgtgaagcacctggggcaaggtccgttcaatggccgggaggcactggacatctacctgaaggtcatgcaatcggcgcccagcgcagccgacgccgacgcccgcctcgaagccatccatcagctacagaagcagggcctgaccgacgccaaggaaatccgttacgacgccgagcgtatcgtcatcccactcaacaggcccgtggaatcgccgttgaccaacggctcggacactctcgtcctgccgcgcaacctcgaccgggaacggctgcgccagctggaccagcggctcatccgccaatga

SEQ ID NO: 13765 - DNA, 2349 bp, Pseudomonas aeruginosa
tgccatctgccggtcgaccaaagtggcgaaatcgtcgccgacgaacggcaggatggcgtcggccaccggctgcaactgcttgcccacgtagtgctcgtagtcgatggccgaacgccgcgcctcgagcggctcgggaccggcgacgctgatcacgtagctgatccagccgccgctctggtactgccgcgggcgcccgcgctcgaggttgtagtcgtcggcgatgcgcgccgcgcgcacatgcggcggcacgttgcgctggtaatcgtcgaggcgccggcgcaggcgcttgcggtagaccagcaggtcgtccagctcgccggccagggtccgtcgtacgtaatcgcgcacgtagtcctggtagggctggcgattgaagatgcgcaggtagagttcctgctggaagcgctgggccagcggcgaccagtcggtgcgcacggtctccaggcccttgaagaccatctcctcgccaccgtcggcgcggcgcaccaggccggcgtagcgtttcttgctgccctcctcggcgccgcgcacggtgggcatgagaaaacgccggtaatgggtctcgaattgcagctcgagggcgctgtcgaggccgaattcttctttcaggtgctcgcgccaccagtcgttgacccgcgccaccagcgcccggccgatggccgcggcctcctcctcggcgcgggggctgccgagccagacgaaggtggagtcggtatcgccatagatcaccgtatagccctcggcctcgatcagctcgcgggtacggcgcatgatccgatgcccgcgcagggtgatggacgaggccaggcgcgggtcgaagaagcggcagccgctggaacccagcaccccgtagaaggcgttcatgatgatcttcaacgcctgcgagagcggctggttgcgttcgcgcttggccgcctcgcggccctcccagacccgtgcgacgatggccggcaggcaatgccgggtacgcgagaagcgggcgccgcgaaagccttccaccgagtgctcgtcgtccggctggcgcaggccttccaccaggccgaccggatcgatcaggaaggtacggatgatcgacggatacaggctcttgtagtcaagcaccagcaccgattcgtagaggcccggccgcgagtccatgacgaagccgccgggactggcttccggacgcttctcgccgaggttcggggcgacgaagccggcgcggtgcatcaacggcatgtacaggtgggtgaaggccgccaccgagccgccgctgcggtccgccggcaggccggtgacggtggcccgttcgaggaggaagtcgagcagttcggtacgggcgaagatccgcgtcaccaattcgcagtccttcaggttgtagtgcgcgagggccggcttgtcctcggcgaacatgcgatcgatctcgtccatccgctggtacggattgtcgatcgccttgccttcgccgagcagggtccgggcgacgttctccaggctgaacgaggggaagctccaggtcgccgagcgcagcgcctcgatgccatcgatgatcaggcggccggccgccgcggcgaaaaagtggttgttgcggctgccgtgctcgcgccagcccatttcgtcgccgccacgccccaggcgcagcggcaccttcaggcgctgggcatgctcatgcaggacgcgcaggtcgaactgcaccaggttccagccgatgatggcgtcgggatcgtgctcggccagccactggttgagacgttccagcagcccggcacggctgtcgcaatagtcgaggcggaaatccacggccgcggcatcgccgttggccgggccgagcatgtatacctggcgctggccgcagccttccagggcgatggagtagagatcgccgcgggcgttggtctcgatgtccagcgacaccaggcgcaggcgcgggcgatagtccggagccggcttcaggcgccgggcgagcaggctgccgtcagcctcgacactcgcctccaggctgaccggcgcggtgatgaagcgctccatcaggtagcgctccggcggccggatatcggcctcgaacacctcgacgccggcctggcgcaagcgtttctccagattcatcagttggcgatgctgctggcagtacaggccgagcaccggccgctgctggaagtcgcgcagcgccagcggccgcagctcggcgccagtctccccggcgagcagggactcgacgcgcccgcgctgctcggcgaggacgaacgccaccgacggctgcggcggcagccgcacctgccgcgggccctgctcggtcgccagccagaacgcgacttccgtgccggccggcgtatcgcgccagtgccgggtcaggacgaacccttgcagtaa

SEQ ID NO: 13766 - DNA, 1098 bp, Pseudomonas aeruginosa
tccgggatttccccgacccgtgtccagccggtcttcaggtacagccgttcggcggcgctgccgctgaccgtatccagcaccagcagggacttgccgcaggcccgggcgagccggtccagctcgcccatcagcgcctcgccgatgccgcgccgacgcgcacgccggtgcaccagcatcttcgccacgtcggcgcggtgcgactggttcggcggttggtcgaggagcagttgcacggtaccgacgatccgcccctccgcttccgccaccagcagcaggcgttcgtcgcccgccacgctctcgccgacgccgcgccagaaggccagcgcccgctcccgcggcaacggccacatgaagctgaccgaagccccgccttccacgcagtccagcagtacctcggccagttcgtccaggcgcgccaggatctcctcgccagccaggcggcgaatcgtcggttcggtcatcgcgggcaagctccaatgcaagggcgaatttccaatatattggacagtgactatcatggacgagaaaaatccgccagggccactcatggatatcgacgaactgattgcccgacgcctagccgccctgcgcaaggagcgcgagctgaccctcgcccaactggccgaacgctgcgcggtgagcaaggcgatgatctcgcgcatcgagcgcaaccaaagcagccccaccgccagcgtcctcggccgtctcgccggcggcctgggggtcgccctctccgagctgctcggcgacgcgcaggcgccggccgaaccgctctgccggcgcgcgcagcaggaagtgtgggaagacccggccagcggctaccgccgccgccaggtcggcgctcgcgatccgcgcagcggctgcgagatggtggaagtggagatcccggcgaacgcccgcctcgactatccccgctggggcggccggccctaccggcagcgcctgtggctggtcgagggtgcgctgcgggtggattacggcgagcaatcgttccacctgcaacgcggcgaccgcctggacttcggcgtcgaccgcgcggtgaccttcgccaccgccgggcaagcctgccgctacctgctggtgatcctccacgactag

SEQ ID NO: 13767 - DNA, 384 bp, Pseudomonas aeruginosa
tcgccaagcacgtggagatgggccagggcgcctataccggtatcgccaccatcgtcgccgaggaactcgacgcggactggagcaaggtccgcgtggaaagcgcgcccgccgacgccaagcgctacgccaacctggccttcggcaccatgcagggcaccggcggcagttcggcgatggccaactcctggatgcaattgcgcgaggccggggccaaggcgcgcgcgatgctggtcgaggccgccgcccgccagtggcgagtgccggccaccgaactgcgcacccgcgacggcttcgtcgaacatccggccagccagcgcaaggccagctacggttcgctggccgctgcggcggcggaactgccggtgccggaaaaagtgcaattga

SEQ ID NO: 13768 - DNA, 375 bp, Pseudomonas aeruginosa
aggacggcaaggtcgagcagaacaacttcgacggctaccaggtgctgcggatcgccgagatgcccaaggtcgaagtgcacatcgtgccctccggcgaagcgcccaccggggtcggcgaacccggtgtggcgcccatcggcccggcgctggccaatgcgatcttcgccgccaccgggcaacgcctgtacaacctgcccttccccacctccttcgccaaggcctgagcgagacgcccgccggcagctccacggctgccggcgcggcgcgggcggccctccgaggatcgccgccgaccatacgggtctccccggtgtcgcgccgatttgcctccgcccggcgtcgggcgcagacttcagcgtccattcgcccgcgtag

SEQ ID NO: 13769 - DNA, 561 bp, Pseudomonas aeruginosa
ccaagcatgaccgagcctctcccttcttcgtccctgggccccgccctgcgtcgctggcgcctgctgcaccgggtcaagcaaacgcatgccgccgaattgctcggcgtggcgcaatcgaccatctcgcgctgggagtccggtacccaggcgctgctggtggaggaacgggcacgcctggagcgtctgctcggcgcccgcctggaagccgccgccgaccaggcactggcccgcctggtcgaggccaacccgcaacccgtgcacctgatctgcgacctcacccatcgcctgttggcctgttcgccggcacgcgccgcgcaattcggcgtgcctctcggcgaactgctcgaccgttcgctgtggccctattgcagcgaggaaatcctccgccaggaagccaccctcgaggaactcggctggcgcgaactgctggcaccgccggcgctggagttcgccagcggagcgaacgcctcggccatcgtgccgatccggcgcagccgttgccgctggacccgcatgaccctctcggacggacgcgcggtgcgcctggtggaaaccctctga

SEQ ID NO: 13770 - DNA, 666 bp, Pseudomonas aeruginosa
cgtcgccacggatattttatccatggaccttcagcaccgccgcgcctaggcttgcaggctcgtttcaccggtagcggaggccgcgccatgtccctcgaactgctgagcaaccgcctcgaattcctccgcgaagccgagcgcctgaaagacgtcctgcgctccgcgcacacctcctccggccgcccggaaagcaccgccgaacatagctggcggctgtgcctgatggcgctggccttcgaggaccaactggccggcctggacctcggcaaggttctgcgcatgtgcgtggtccacgacctcggcgaagcgatccacggcgacatccccgccgtcgagcaagcggcgcacccggacaagggcgaacaggaacgcgccgacctgttgcagctgacccgtcatctggacacgccgctgcgcgatcgcctgctcgccctgtgggacgaatacgagcgcggcgagtccgccgaagccctggcagtgaaggccctggacaagctggaaaccctgctccagcacacccagggcgacaatccggcggacttcgactatgccttcaacctcgactacggccgtcgctataccgaccgcgcaccgctgttcaagaccctgcgcgagctactcgacgccaggacccgacagcgcctcgcagctcggcgcgatgcctag

SEQ ID NO: 13771 - DNA, 1992 bp, Pseudomonas aeruginosa
cagcacccgggccagcccgacggcctggcgttggccgccggacaggctggcgttgccctggatcggcatgtccagccccagcgggtggccgcggacgaaggcgcccaggccgaccccgtcgagggtctccagcagttcctcgtcgcccagcgcggcgttctccaggttgaggttgtcgcgcaggctgccatggaacagcgccacgtcctgcggcaggtagccgataccgcgctggcggtcggccgggtcgatctgggtcaggctgacgtcgtccagcagcaggcgtcccgcctgcgcgtcgagcaggccgctgagcaggcgcagcagggtcgacttgccggcgccgttgccgccgagcagcgccacccgctcgccggcgcggatgttcagggcctgcacgtcgaccaccggcgggctgtcgccgtgggccatgcgcacgccctccaggcggtaatgtccctgcaggcgctccttgtgcacgaagcgcttgccctggggtcgctcctgctcggcgctcatcagttggtcgaggccttccatcgccaccttggtgtgctgccagcgaccgaggatgccggccgcctgcgacagcggtgcgatggcccgcgaggcgaggatcgagcaggccaccaggccgccgacggtcatcgcgccctcgctgatccgatagacgccgaagaccaccacgccgacgtagcagagctgctggacgatgctcgccgagtagctcagggtcgaggccagggtatgggtcttcatcgccgtaccggccagttcgccggtcagggtttcccactggtgcaggcagcggccttcggcgcgggtcgccttgaccgtctccaggtgctcgaaggcttccagcagcacgccgttcttcatcgccccttcgcgcaggttctgccgcgacaggtggccgagcaggcgctgggtcagcagccccggcaggatcatcagcacgcaggccaccagcggcacccagaccacatggccgccgatcacggcgatgatcagcaggaagatcgccacgaacggcaggtcgctgatcagcgccgcgctggacgaggtaaagaactcgcgcaccgactcgaactcccgcacctgggtactgaaggcgcccatcgacgccggcttggcggcgacccgggtgctcagcacgcgggagaacagcagggtcgagagttgcaggtcgaggcgcttgccgagcacgttgagcaggtggccgcgcatgatccgcaggacaccgtcgaggacgatcgccagggccacgccgctggcgaggatccacagggtgtcgaacgccgcgttgggcaccacgcggtcgtagacctgcatggcgaacagtgccgaggcgaccgccaggacgttggccaccaacgccgcggcggtgacctcggcgtaggaacgccagagccgcttgagcgggccgaagaaccagtgttcgggcaaggcgctggcgtagtcgccgacccgcccgtccggccggtagcggcacttggcgaagaccgccgtgccgctgtacagcgcttccagctcggccagcggcatcctctggcttccgccgtcgctctgcggtaccagcacctcggcgtgctcgccgtcgttgcccaccagcaccagggcgcggccgtcgtcgagcagcagcagggccggcagcaggtagcgatcgatccggcgcaacggctggcgggtgacctgggcggtgatgtcggcgcggcgcaacgcgcgggccaccaggtgcaacggcaggcgaccgtgctccagcggcatgccgtccaccagttcggcgtcgccgagcggtcggccaagctgccggcagagcagcaacaagccctggcgcaacgggtcgacgatggggtcgtggttgaggatcacgacgttatccggggttttctcagcttccatgattcagccggttctccaatagcggacccaacaggccgacttgcgcggccgcccgatactcgatgcgcttgcgttcgatccgcaggttga

SEQ ID NO: 13772 - DNA, 861 bp, Pseudomonas aeruginosa
gcaggtcgatcacgtcgcgccggccaacctcgaactgttcgcgatacaactcgccgacctgctccgactcggtcacctgctgggtcagcgactgttcccgccagcgcagcgtgtcgccgttgtcgaagaggttctgcagttgccggcggatgtcgcgctgcatcgcgtcggcgctccatttcgccgactccaggcgctgctgcgcggcggtcggccggcggaagttggaaagcccctggaaggtgtccatgcggaagcgcagggataccaccgagtcgctttccggatgcccgccgatctcccggcgcagcgcgctggcctccaggttcagttgcggcagcagcgacgccttggcctcgcggacctcggcctcggcgacattggcgtcctccagggccttgcgctgcaaaggcgattcgcggatcacccgcgccatatcgctggccgccaggtagcgttgcagcgacatcggctcgggctccaccaggtcggcgggctcctggccgaccaggatcgcgtactggttgcgcgcgtcctgcaggttgcccttctccagcgacaactgctcctgggcccgcgacagttccagattggcgcgatccagctcgctgcggtcggcgtagccgtcgccgccgcgcgcctgggtcatctcgcggatgccgtcgaggcgctggatgtgttagcgcaccgcctccacccggcgctccgaggcaagcacgtcgaggtaggtctcgacgatatccagcgccgcatcgtcgcgcgccaccagcaccgcctcggacagcttgcgctgggtcgcgctggcgctgtcgaccttgctcgtcacccgaccccagtcgtacagcatctgcgacgcggtga

SEQ ID NO: 13773 - DNA, 4131 bp, Pseudomonas aeruginosa
ccgcctggtcgaggggcatggccgacgcgaacatcggcagacccagggaaaggagccagatggctcccttcccatgccgccgtcccttgcgcgcgtactgcctgcgcccgcgcatcagaccacgacctgtaccgtgttgtcctcgatcagcagggtggtactgccgaaggtgtagacgtcgtaggtaatgccgttgatcagttgcgtggtaccggtattcaccgcgcccaccacgttcagggtgtcgttgttctcgccggtgatctgcaacgtgttgttggcatcggtgatggcatccacctccgccgcggtcagggtcagcacgctacccgagtcgcccttgccgaggtcgatgcgctcgaggttgctgagcgtgccgacgccgacggcgttgtagtcgaggtcgatgccgttggccaggaccagggtgtcgaacccggcgccgccatcgatgctgacgaaatcggtcgcggtgatctggatggtgtcgttgccgttgccggccaccacgtgatcgccggtgcccacgttgaagatcaggtcgctgccgtcgccgccgttgatgtgctccgaactgccgttggcgccggacagcacgtcgtcgccggaagtaccgttgacatcgatctggccgatattgagcgacagtccgttgggggtcagggtgatcccgtaggcggcgctgtcgttgccattggagtcggtggacaccaggttgaacgagatctgcgagccgaggttgaggatgtcggtgatgttcagccccaactgggtgaggatggtcgggctcagcaggttcagcgagaagtttccggacgaatccgcctggatcggcagcaattcgacgttcaacgccggggtgatgacccggatcaccacgctggagtcaggctcggtggttccgctgaaaccgaaacgcgggttcagcgggttgaggctgacgtcgaggccgaagttgccgatggtcaccggttgctcgatgctggtgccgacgccgatgctcgccgtgttgctcgggttgccggccgggtcgcgtccgaccaccgacacctgggcattgagcaactggtcccaactgaagtcgatgtccaggtcggtgagcaggttcagcgacgccagcccgctgttgtcggcggtcaccgtggcggtggcggtcaccccgccgacgtcgacggtgaccgtcaactcggtccctggctccgccgagatagtcaggatgttgccgaccagggacagcaccggggtcgccggcggaatggtgtcgatggtgaacggcaccggggtcgacgcggtgccgccgttgatgtcggcggtgacggtcgaggcgccctccgggaacgggcccatgccgccgggaggcgtcagggtcagggtcaggttgccggcggcgatgtcgccggcggtgagggtatggctgacctcggcctcgtagccgttctgcccggcgaacttgaccgtgaccacctggccgacctgcatggtcggacggaccgtcacatcgacctggatgccgtccccgatctccgcggcgttgatccaggtatcggcggcttccggcacgctgatggtcggcggcgccaggtccggcgcgttgatggtggccggcccgctgacgttgccggcggcgtccacggcaaccccggcgatcagttcgccggtgatcagcggcggcgcgaacggcaggctgaagttgccggcgccgtcgacggtgaccgtgatcgggttggcggtgtcgccgttgaccacgatacgcacctgactgttcggctcggcggtgccggtcagcagcgcgccgtcggcgctgatgctcagcagcggagcggacggcgccaccgagtccaccgtggtgctggccggaccgctggcgttgcccgcggcgtcttcggcgacggcgttgatcaccgtaccgttggccagcggcgtgccgggggtgaaggtccagttgccactgccgtcggcggtggtctcgccgatcgggttgccgttgccgtcggtgaggatcactttggcgccgacctcggcggtgccggtgatcacgctgccgttgctggcattgatcaccggcgtggccggcgccaccgtatccaccgtggtgctggccggaccgctggtattgccggccgggtcctgggccacggcgttgaccaccgtgccgttggccagcggcgtgcccggtgtgaaggtccagttgccgctaccgtcggcgagggtctggccgatcgggttgccattgccatcggtgaggatcacccggacgccgggttcggcggtgccgctgagtttgacaccattgctcgggtcgatcaccggggtggccggggccaccgcgtccactgtggtgctgaccggaccgctggtgttgccggcggcgtcctgggccaccgcattgatcaccgtgccgttggtcagcggtgtgcccggagtgaagctccagttgccgctgccatcggcggtggcctgccgtatcgggttgccgccgccgtcggtgaggatcaccgtggccccggcttcggcggtaccgctgatcaccgtaccgttgctcggatcgagcaccggggtggccggggctaccgagtccaccgtggtgctggccgggccgctggtgttgccggcggcgtcctgggccagcgcattgatcaccgagccgttggccagcggcgtgccgggcgtgaagctccagttgccgctgccgtcggcggtgacctggccgatcgggttgccgccgccgtcggtgaggatcaccgtggcgccggcttccgcggtaccggcgatcacgctgccgttgctcgggttgaccaccggggtggccggggccaccgcgtccaccgtggtgctggtcgggccgctggtattgccggccggatcctgggccaccgcattgatcaccgtgccgttggccagcggcgtgcccggggtgaagctccagttgccgctgccatcggcggtggcctggccgatcgggttgccgccgccatcggtgaggatcaccgtcgcaccggcttccgcggtaccggcgatcacgctgccgttgctcgggtcgatcaccggcgcggccggcgccaccgagtccaccgtggtgctggccgggccgctggtgttgccggcagcgtcctgggccaccgcattgaccaccgtgccattggacagcggcgtgccgggcgtgaagctccagttgccgctgccatcggcggtgacctggccgatcgggttgccgttgccgtcggtgaggatcaccgtggcaccagcctcggcggtaccggcgatcacgctaccgttgctcggatcgatcaccggggctgctggcgccagcgagtcgacggtggcgctggtgggactgctgttgttgccggcggcgtcctgggccagcgcattgatcaccgtgccattggccaacggcgtggcgggcgtgaaagcccacttgccgctgccgtcggcggtgacctggccgatcgggttgccgttgccgtcggtgaggatcaccgtggccccggcttccgccgtaccgctgatgacgactccgttgctcggattgatcaccggcgccggcggggcgatggcatcgacggtgacgctggccggaccgctggtattgccggccgggtcctgggccacggcgttgatcacggtgccgttggccagcggggtgcccggggtgaacgtccagttgccgctgccgtcggcggtggcctggccgatcgggttgccgccgccatcggtgaggatcaccgtcgcgccggcctccgcggtaccgcttatctcggtgccgttgctcggatcgatcaccggcgccgccggggccacgccatccacagtgatcaccgccggcgcactgtcgacattgcttgggctgcgcgccaccacgttgaccaccgtgccatccggcagcgggatgcctggagtgaaggaccagttaccgctgccgtcggcggtgacctggccaatcgggttgccgttgccatcggtgatgatgatggtgttgccggcgtccgcggtgccgctgatcaccgaaccgttgctcggatccacctgcgggatcgacggcagcgaggaatccaccgtcgtggtagcgggagcgctggtattgccggcggcgtcgctcgcggtcacgttgaccacggtgccgttgggtag

SEQ ID NO: 13774 - DNA, 4188 bp, Pseudomonas aeruginosa
ttgcgagccgggcgtgaagctccagttgccgctgccatcggcggtggtctggccgatcgggttgccgttgccgtcggtcaaggtcacggtgctgcccggctcggcggtaccgttgagcaggttgccgttgctcggattgaccacaggcgtgttcggcgccaccgcgtccacggtagtgctgccctgcgggccggtattgcccgcagggtcctgggccacggcgttgaccaccgtgccgttggccagcggcgtggcgggcgtgaaggtccagttgccgctgccgtcggcggtggtttcgccgatcgggttgccgttgccgtcggtgaggatcaccttggccccggcctccgcggtgccgctgatggtcgtgccgttgctcggatcgatcaccggcgccggcggcgccaccgcgtccaccgtggtggcggcctgcgggccggtattgccggtcgggtcggtggccgtggcgacgatcaccgtgccgttggccggcggcgtgcccggcgtgaagctccagttgccgctgccgtcggcggtgacctgccctatcgggttgccgccggcatcggtgagggtcacggtggcaccggcctcggcggtgccgctgatgacgacgccgttgctcgggttgatcaccggcgccggcggcgcgctggaatcgacggtcaccgtcgccggcgggctgctgttaccggcggcgtcctcggccaccacgttgaccacagtaccgttggcgatcggcgtggacggggtgtaggtccagttgccgctgccgtcggcggtgacctcggcgatcggattgccgttgccgtcggtgaggatcaccgtgctgcccggttccgcagtgccgctgaggctgctgccattgctcaggttgacggtcggcgtggccggcgcgatggcgtccacggtagtgctgccctggccgccggtattgccggccgggtcggtagcggtggcgttgaccacggttccatccgccagcggcgtggacggggtgaagctccagttgccgctgccgtcggcggtgacctgcccgatcggattgccgctgccatcggtcagggtcacggtggcgcccggttcggcggtgccgctgatgacgactccgttgctcggattgaccaccggcgcggccggcgccaccgagtccacggtggtgctggccggagcgctggtattgccggtcgggtcgctggccgtggcgttgaccacggtgccgttggccagcggcgtgcccggtgtgaagctccagttgccactgccgtcggcggtgacctggccaatcgggttgccgttgccgtcggtcaggctcacggtagcgcccggctcggcggtgccgctgagcgtggtgccgttgctcgggttgaccaccggagccgccggggcttgcgagtccacggtgacgctggcgcccgggctgctattgccggcggcgtcctgggccaccacgttgaccacggtgccgttggcgatcggcgtggacggggtgtaggtccagttgccgctgccgtcggcggtgacctcggcgatcggattgccgttgccgtcggtgaggatcaccgtgctgcccggttccgcagtgccgctgaggctgctgccgttgctcaggttgacggtcggcgtggtcggcgccacgccatcgacggtggtgctgccctggccgctggtgttgcccgccggatcggtggccgtggcgttgaccacggttccatccgccagcggcgtggacggggtgaagctccagttgccgctgccgtcggcggtgacctggccgatcgggttgccgttgccatcggtcagggtcacgctgctgcccggctcggcggtgccgctgagcgtggtgccgttgctggggttgatcactggcgtggccggggctaccgagtccacggtgacactgctgcccgcactggtgttgccggaggcgtcggtggccgtggcgttgaccacggtgccgttgggcaacggcgtggtcggagtgaagctccagttgccgctgccatcggcggtgacctgcccgatgggattgccgttgccatcggccagggtcacggtggcgcccggctcggcggtgccgctgagcgtggtgccgttgctcgggttgaccactggcgtggccggtgccacggggtccacggtgacgctggccggcgaactggcgttgccggacgggtcggtagccgtggcgttgaccaccgtgccgttgggcaacggcgtgctcggggtgaaggtccagttgccgctgccgtcggcggtgacctggccaatcgggttgccgttgccgtcggtcagggtcacggtagcgcccggctcggcggtgccgctgagggtcgtaccgttgctcggatcgacggtgggcgtggccggcgcgacggcatccacggtaacgctggccggcggactgctgttgccggcggcatccctggccaccacgttgaccacggtaccgtccggcagcggggtggacggcgtgaaagaccagttgccgttggcatcggcggtggtctggccgatcggattgccattgccgtcggtcagggtcacgctgctgcccggttcggcagtcccgctgagttcgctgccgttgctcggctcgaccaccggcgcgttcggcgccacgccgtcgacggtgatggaggtcgccgggctgctgttgccggcggcgtccctggccaccacattgaccacggtgccatccggcagttggctaccgggggtgaagctccagttgccgttggcatcggcgctggtctggccgatcggattgccgttgccgtcggtgatcacgatggtcacgcccgcttccgccgtaccgctgaggacgctgccgttgctggcattgacctggggcgcgtcggggaagtcgggagcttcggcggtgaccggggtgctgctgttgccggccgggtcggtaacgatcaccgtcaccgtctcgccattggtcagcggcgggttcagcgggacctcgaacctgccgccggggccgaccaccacggtggtgtccggctggccgtcgccatcggtgtcgacaccgacggtggcgcccggctctgcgttgccggtgacgctgctgccgtccggcgccacctgcacgtcggtggccggcgccggggctgtggtgtccggcgcctcgacggtcaccggggtgctgttgttgccggccgggtcggtaacgatcaccgtcaccgtctcgccattggtcagcggcgggttcagcggaacctcgaagctgccgccggggccgaccaccacggtggtgtccggctggccgtcgccgtcggtatcgacgcccaccgtcgagccgggttcggccttgccggtgacgctgctgccgtccggcgccacctgcacgtcggtagccggcgccggggcggtagtgtccggagcggtgacctgggccggcgggctggcgttgccagccgggtcagtgaccaccacggtgaccgtctggccattggtcagcggcgggttcagcggagcggtgaaattgccgttggcatcggcgatcacggtgaggtccggcttgccgtcgccattggtatcgatgccgacgctcgcgccggcctcggcctggccgctgatgctgctgccgtcaggcgctatcttcaggccgctggccgccttcggcggagtggtgtccgggggcaccgaagaaccgccgccgccaccgccgccgctgctgttggaaatcgccaccccggcgccgatggccgccgcaccgaccagcagcgcagtccctgcgctcatgccaccgagcacaccggcgccggtcagcgactcgaaaccggccaggctttcctgcgggatgtagccggccatcagcggcccgtcggcagcgaccggcggcagatctaccgccaccagcttgtccttgtcggccaggaacagttggctggaaggctggccttccgcatagaagttggcgatccggacgctttccccggtcttcagctggacgatcaggtccgaaccgctcttcgagtatcccgccaccgactccggtgcgacatcgagcgcgacattactgctctgggagagtttgagtatcccgttttccggaacctcgacggcagccgcagaagaaatactctgatcgataggggtaactttcgcctggatcgacatttccgacattcctcttgtcaagcagcgaccgaacggccgcaccatgtaatccagaaatag

SEQ ID NO: 13775 - DNA, 504 bp, Pseudomonas aeruginosa
agcgtgcggcagcgcactccaaccgagccgaatcgatcacagaacgccaggcgtcggaaatacttcgatacagtctgcgcgctcagcgttcctcgtcggaggaaccgtcgagcggatcacgacgcgccagctcggcctcgtcgaggccgtggccggctccgatctcgttgccatgcacgaccctcaggcgcttgtccgcgggcgattcgccgccgcgctcggccggcgagcgggcgccgctttcgtcgatcagggtttccggcgccagatcgtccatgccgacgttatcctggtaaccatcgtcctcgtccggctgcccgccagcgtggcccgcctcgcgtacccgccgcgaggaaaattcggcctccacctcggcctcgggccgctcgtcgccgatccgcgccttacgcgcctggcggcgctcgtcgaaatcgagctcgcgcatcgaacccatgcggtcctggatatcatcgatttcctggggtgttgttttccgtcgtgtag

SEQ ID NO: 13776 - DNA, 2466 bp, Pseudomonas aeruginosa
cggcggctgcggcgcgtgcgtgccctggcgaacctccagcacctcgccgccgcgaccgtcgcccagggacgccgggtccgccaggcgcggcttctccatcagcaccggggctggagccggatagctgcgcggcgagccaataggtgccggtgcgacctgggcggcgggacgcaggtcgatggcgccggcatcctcgaacagcgggcgcgccggttcgccggcggcaccgcgcagcaactggatggaacggtaacggccatggctgatgcgctccaggccggcggcatcgcggacgatgctcgggcgcaggaagaccatcaggttgcgcttcacccgggtctcgcgggacgagcggaacagccggccgacgccggggatgtcgcccagcagcggtacccgcgaatcgctgcgctgcaggtcgtcctggatcaatccaccgaggacgatgacctggccgtcgtcagccagtacggtgctcttgatcgagcgcttgttggtcaccaggtccaccgccttcgccgccagggtggcggttggcgcgatggaggatatttcctgctcgatctccaggcgcagcatgcggtcctcgccgatgtgcggcgtgaccttgagggtcaccccgatatccttgcgctcgacagtggtgaacggattgctcgaaccgctggcgctggtggtgtagctgccggtctggaacggcacgttctggccgaccaggatttccgccttctggttgtccagggtcagcaggctcggcgtcgacagcaggttgctgcggctattgcggctcagcgcggtgaccagtgcgccgaaatcgcgactgccgaggccgactatcgcaccgtcgggcagctctgccggcggcttgccggcctgcaacgcgcccagcagggtgccgatggacaacccgctgtcggcgaagccagcgccgccggcgacatgcccgctacgcagcgcccattgcaccccgagggcgtcgccgatctcgccggacagctcgacgatcgccgcctccaccagcagttgcgcgcgcggcacgtcgagctggcggacgatgtcctcgagcaggccgacatcctccgggtcggcgaggatcaccagggcattcagcgattcgtcggcgcgcaccagcaggccgcgcttgccgcttccccggccatcctggccccgctcgccgtgcagcgattcgccgatctccccgagggtggcggcaagggtcttggcgtcgccatggcgcatgcggatcacccggctgttcgccgaccgcgacgaggggacgtcgagcgactgcgccagccgcagcaagcgcgctcgcgcctgcggcggaccgagcaggaccaggcggttgctgcggctgtcggcaaggacctggacggtggcggcgctcttcccggcggccggggtgacgctgcgatcgagcacctcggcgatttccgcgacccaggcatggcgcatgtcgtagatgctgtagtcatgttcgccggcccggtcgaggatgcgcacgatcgcctcgatgcgctcgatgttggagcggcggtcgctgacgatcagcgcgttggccgacggtacggcggccagatggccatgggccgggaccagcggccggatcatcgggatcagttccgccaccgaggtctgatgcgcctggaccacccgcgtctccaggctgcccggcccatcgcggacggtcttctgcgcggcgtcctggcgtgcctccatgttcggcacgatacgcgcgtggtcgccctgcggcagcaccgcgtagccatgggtggcgagcaccgaaaggaacagctggtagacctccgccaggctgagccgcgcctgggataccaccgtgacccgccccttcacccgcggatcgacgacgaaggtctggccgctgatgctcgatacctgctcgatgaagtcgccgatctcggcatccttcatgttgatcgtccactgctcttcctcttgcgcggcggcagtctcggcaggtgccggatggaccggcggcgccaggccgaggacggccagcgacaggaccaggaacagcggagacaggcgctgggcggaacgggtactacaacgtggcatgggtggtttctgccccttcggctttggggaaatacagacgttcttcataaccctggtcgcgcagcaccacatggtcgcgatgaaccgccagcagcacggtgccggggcgcacttcggcgcccggcaggaagcgctgcgagcgcccggccaccgcgatcagcgccgccgagcggtcctcgcgacgcgccaggaagcaggccagcaggcgcaattgcagacgctcgcccgccgtcgcgccgcgcggcgacggagcgccaccgaacaagccggctaacgccgcgcgcggggccgctgaagggttggctggcggcgccggggccgctgcggcgggcaattccgccagctcgcggcgcagcgagcgcgtctggctggccaggctggcgctga

SEQ ID NO: 13777 - DNA, 411 bp, Pseudomonas aeruginosa
cctgggccaggccatggagcatggcgccgagatcgaagtagtagttgtagtcgcccaccgccaggtcgcaccagcgcgccagttcctggcccaggtagtagggacagacccggtgcgccagcgccacctcgcgcaaccgcgcctggtccagccagcgcgcctccacggcggcggcgcgggccgccggcaggcgttcgtagaagccctgggccaggggacaggactcgccgtggcaggccttgtccgggtgctcgcaggccttgtcccgcgccaccagttccagcacccgcaccggcagtccgccggtctccccttccaggctacgcagggcatgcagcgcgagggcccggcccggggtcttggcggccaggaagaacagccggtccaggcgctgcccgggcatcgccttga

SEQ ID NO: 13778 - DNA, 843 bp, Pseudomonas aeruginosa
aagggttcgggaagcgctggggaattcacgggaagcggagcctggtactgttcatgcatacagataccagcgcccccacggcttggcaatgcgcatccgatcaagcgtcgccggcctgacgacgactatccaggcacaaggcgttcgttatataaaaatattaacaacgaaacctgccccgtatcggtcccgatgaagaagatccgccaacgcaacctgcaactgatcctcgacgccgcctgcgaagtcttcgccgactgcggcttcagcgccgcccggctcagcgacgtcgccgagcgcgccggcgtggcgaaggccaacgtgctctattactaccgctccaaggcgcaactctacgaggcggtgctggacagcatcgtcgagcccctgctggaagcctcccggccattcgccggcgaccagccgcccgccgaggcgctacgcgcctacgtcgacaacaagatgcgcatcggcgccgagcggccgcacgcggccagggtcttctcctgcgagatcatgcgcggcgcgccgcgcatgccggcgccgctgctggaacgcctcgacgcccaggcggaacgcaacgccgagcgcatccgccagtggatcgacgaaggcctgctggcgccgctggatccgtaccacctgctgctcaacctgtgggcgatgaccgagtcctatgcccttggcggctggcaactggcgcgcctcaccggccaggccgggctggacgcgagcgactaccggcaggcggcggaaaacatcgtccgcctggtctgcgccggctgcctggcactccccggcgaggccgcgccgcgtcggcgtttccgcgcgctggccggctga

SEQ ID NO: 13779 - DNA, 807 bp, Pseudomonas aeruginosa
gcttgcgccagccccgtccgccaacttcgttcgcccccacaggagcactccatgaccacccgcctgccccagctattgctcgccctcctcgccagcgccgtatccctggccgccagcgccgacgaggtgcaggtcgccgtcgcggccaacttcaccgcgccgatccaggccatcgccaaggaattcgagaaagacaccgggcacaggctggttgccgcctacggtgccaccggccagttctatacgcagatcaagaacggcgcgccgttccaggttttcctctccgccgacgacagcactccggcgaaactggagcaggaaggcgagatcgtgcccggctcgcgcttcacctatgccatcggcaccctggcactctggtcgcccaaggccggctacgtcgacgccaagggtgaagtgctgaagagtggcagcttcaggcacctgtccatcgccaacccgaagaccgcgccctacggcctcgccgccacccaggcgatggacaagctcggcctcgccgccacgctcgggccgaagctggtggaaggccagaacatcagccaggcctaccagttcgtttccagcggcaacgccgaactgggcttcgtcgccctgtcgcagatctacaaggatggtaaagtcgcaaccggctcggcctggatcgttcccgccgagctgcacgacccgatccgccaggacgcggtcatcctcaacaagggcaaggacaacgccgccgccaaggccctggtcgactacctgaagggcgccaaggccgccgcgctgatcaagtcctacggctacgaactctaa

SEQ ID NO: 13780 - DNA, 699 bp, Pseudomonas aeruginosa
ggcgggacctgcatggcgttgccactcgacagtacggacctggcggccatctggctgaccatcgagctggcttcgctcaccaccctcctcctgctgctgatcggcacgcccatcgcctggtggctggcgcgcacccgctcctggctgaaggggccgatcggcgcggtggtggccctgccgctggtgctgccgccgacggtgatcggcttctacctgctggtcagcatgggtcccaacggtttcatcggccagctcacccagagcctcggtctcggcaccctgcccttcaccttcgccggtctggtggtcggttcggtgttctactcgctgcccttcgtcgtgcaaccgttgcagaacgccttcgaggcgatcggcgagaaaccgctggaggctgccgcgaccctgcgcgcgagccccgtcgaccgtttcttcagcgtggtcctgccgctggcccggccgggtttcgtcaccgccgcgatcctcggcttcgcccataccgtcggcgagttcggcgtggtgctgatgatcggcggcaacatcccggagaaaacccgcgtggtctcggtgcagatattcgatcacgtcgaagccatggaatacgcccaggcccactgcctggccggcggcatggtggcgttctccttcgtcgtcctcctcgccctctattcgggccggcgccgccggccgggctgggcctga

SEQ ID NO: 13781 - DNA, 1239 bp, Pseudomonas aeruginosa
gatggacggcctgcgcctgcgcttccgccgcgcctaccccggcttcgaactggacatcgacctggctcttcccggtcgtggcgtgaccgctctgttcggccattcaggctccggcaagagcacctgcctgcgctgtatcgccggcctggaaaaggccgccgagggcgaggtgacgatcaacggcgagacctggcaggacagccgccgcaacctcttcgtcgcgccccaccggcgtgccctcggctacgtgttccaggatgccaacctgttccgccacctgacggtgcggcgcaacctggccttcggtctcaagcgcatcgccgccgccgaacgccgcgtcgagctggaacaggcctgcgccctgctgggcatcgagcacctgctggaacgcatgccggaacgcctctccggcggcgagcagcaacgcgtcggcatcgcccgggccctcctcaccagcccgcgcctgctgctgatggacgagcctctggcatccctcgacctgaagcgcaagggcgagatcctgccctatctcgagcacctgcacgaggaactggacatcccggtgctctatgtcagccactcgccagacgaagtggcgcgcctggccgatcacctggtgctgctggagaacggcaaggtccgcgccagcgggccgatcggcgaaaccctggcgcgagtcgacctgccgctggcgctggacgacgatgccggggtggtgatcgagggcacggtcagcgaccacgacccggcctacggcctgctgaccctggtcctgcccggcagcgcgctgcaaatgcgcgtcgcccacgccccgctggcccccggcaagcgcctgcgcttcaaggtacaggcgcgcgacgtcagcctgaacctgcgcgacgacgcccagagcagcatcctcaaccgcctgccggtacgggtcctggaattggtcgataccgacaccgcggcccacgtcctggtgcgcctggatgccggcggcaatccgctgctggcgcggatcacccgttactcgcgggaccagttgcaactacgacccggccagctgttgtgggcgcagatcaagtcggtggcggtgctcgcctgaccccggcttcgcctgcggcgcctagaccctgggccaacggtagcggatcagccgccccatccgccgcaggaaggcgaagccgttgtagatcggcagcatcagccgcgacgactgcggcagcttggcaacgtcctgcgggtcatagtcggtga

SEQ ID NO: 13782 - DNA, 1980 bp, Pseudomonas aeruginosa
gcgaataccggcaaccgatccacgccgtctactatcgcaactcgcaactggcgctgcgcatccagtgcttcctcgacttcatccagcagcgcctgggcgcctgagaccgaccgtgaacgaatccctcgatttctcgccctacctcgagcgctgggcgttgcaacccgacggcgagcccttcgccacccacagcagccgcctgctgccggtgcgccatcgcggcgcagcggcgatgctgaagatatccagtgccgaagaagagcgtttcggccacgtactgctcaactggtgggacggccagggcgcggccagggtgctggcctacgaccaccaggcgctgctgatggagcgtgccaccggcgggcgctcgctgctggagatggtcaggcgcggcgacgacgacgaggctacgcgtatcctctgccaggccatcgaacgcatccatgccccgcgcccgggtccgttgccagagctgaccccgctggagcgctggttcgactcgctgtatgccgccgagcgccgctacggcgggctctacgtcgactgcgcgaatgccgcccgctacctgctggagaccgctcgcgaacagcgcccgctgcatggcgacatccaccacggcaatgtgctcgacttcggcgagcgcggctggcaagtcatcgaccccaagcggctctacggcgagcgcggctacgactacgccaacctgttcaccaatcccgacgcgaagaccgcccaggcgcccggccgtttcgagcgccagctggagatcgtaatcgccgccagcggcctgcagcgccgccgcctgctgcaatggatcctggcctggaccggactctcggcggcctggttcgacgaggacggcagccgcgaggagaccgaagccgagctggccatcgcccgcctggccctggcaaacctcgctcgaacgcctgcgccaatgaactgtgcggcggctcccgcgctccaacgcgaggcactgttccgccgccgcgatccggtgtcaaatacacaccccgccaagatggcggtgcccaccacccagtaaggaaacccaagatggccggagccagcctcctcaccctcctcgacgatattgccgcggtgctcgacgacgtctcgctgatgaccaaggtcgccgcgaagaagaccgccggtgtcctcggcgacgacctggccctcaacgcccagcaggtcaccggggtcaacgccgaccgcgaactgccggtggtctgggcggtagccaagggctcgctgcggaacaaggcgatcctcgtccccgccgcgctgttgatcagcgccttcgcgccctgggcggtgatcccgctgctgatgctcggtggcgcctacctgtgcttcgaaggcttcgagaagatcgcccacaaatacctgccccatgacgacgagcacgccgacgaggcagcgctggcggccaatgtcgacgtggccgccctggaaaagcagaagatcggcggcgcgatccgtaccgacttcatcctctccgcggaaatcatcgccatcaccctgggtaccgtcgccgagtccagcttcaccacccaggtactggtgctggtcggcatcgccctggtgatgaccatcggcgtctacggcctggtcgccggcatcgtcaagctggacgacgccggcctctatctgtccaagcgcgacagcggcttcgcccaagggctcggcggcgccatcctgcgcaccgcgccgtacctgatgaaaggcctgtcggtggtcggcatggcggcgatgttcatggtcggcggcggcatcctcacccacggaatcccggtggtccaccacgccatcgaacaggccgcgcagagcgtcgccggcatcgccacgctgggcccgatgctggcggcgatcaccccgaccctgctgaacttcctgttcggcatcgtcgccggcgcggtggtcctggcggtggtgctgctggtcaagcgcctgctgccgaagaagaaaaagactggctga

SEQ ID NO: 13783 - DNA, 1425 bp, Pseudomonas aeruginosa
cagaaaagatccggacggctacaactacgacgtcgtccgccagttcaccttgatgaccctggtctggggcatcctcggcatgggcctgggggtgttcatcgccgcccaactggtctggccggcgctcaacctcgacctgccctggaccagcttcggccgcatccgcccgatccacaccagcctggtgatcttcgccttcggcggcagcgcgttgttcgccacctccttctacgtggtgcagcgcaccagcggcgtgcggctgatctccgatgccctggcgcgcttcgtgttctggggctggcaggcggcgatcgtggggatgatcgtcagctacccgtgggctataccacctccaaggaatacgccgagatggaatggccgctggcgctgtggctggcgatcctctgggtggtctatgcatacctgttcttcggcaccttcaccgttcgcaaggtgaagcacataaacgtcggcaactgcttctacggcgctttcatcatcgtcaccgcgatggtccatatggtgaaccacgcattgctgccggtgagcctgggcaagtcgtactcggcctattccggcgccacggacgcgatgatccagtggtggtacgggcacagcgtggtcggcttcatcctctcggtcggcttcctcggcatgatgtactacttggtgcccaagcaggccgggcgaccgatctactcctatcgcctgtccatcgtgcatttctgggcgatcatctcgatctacatctgggccggtccgcaccacctgcactacaccgcgctgccggattgggcgcagtcgctgggcatggtgatgtcgctgatcctcctggcaccgagctggggcggcatgatcaacggcatgatgaccctctccggggcctggcataagttgcgcgacgacccgatcctgcgcttcctggtggtgtccctggcgttctacggcatgtccaccttcgaaggcccgatgatggcgatcaagacggtcaactcgctgtcccactacaccgactggaccatcggccatgtccacgccggcgccctcggctgggtggcgatgatctccatcggcacgctctaccacatgatcccgaaactctggggccgcgagcggatgcacagcgtcggcctgatcaacgcgcacttctggctggccaccatcggcaccgtgctgtacatcgcctcgatgtgggtcaacggcatcacccagggcctgatgtggcgggcggtcaacgaggacggcacgctcacctactcgttcgtcgaggcgctggtggccagccatccgggctacgtggtgcgcctgctcggcggcgccaccttcgccagcggcatgctgctgatggcctacaacacctggcggaccctgcgcagcgcgcaggaccagcggcagccggtcctggcggccggccagggggcctga

SEQ ID NO: 13784 - DNA, 1473 bp, Pseudomonas aeruginosa
acatgctgttgtccctgctgtgcctctccaccctggcgctcggcctcgccctcaggctcgccggcagtacccgcgaggaacgcgaacaggccgccctgctgccattcgccgacgatcccgaggccgcccgccgggtcgcccgggataccggcaagatctgccggcaggtggtccgccccctcgaggaatcccgcgaggccgccggcccgccgttcctcgcctgaaccgactccatcatccagggatggatgcctccagcacgaaagtgccttacggggccggcaacggcccctttctttcgcttcgaagagttccatgaacgactcccccagcaccgccgtacgcacctggctgaaaggcttccgccccctgaccctgaacgctcgaccgcgcgactgcctgcgcgccggactcggtgcctgcatcggcgcgctcgccgcggtattcgcctgccaggcgttgttcggcagcgaactggcgctgcgcctggcagcgccgctcggcgcatccgccgtactactgttcgccctcgcctccagccccctggcgcaaccctggtcgatgctcggcggcaacctggtcgccgccctggtcggcggcctcagcgcctattggttcggacacgatctggccccggccctggtcggcatggccctcggcatgctgctgatgttcgccctgcgctgcctgcatccgccgagctgcgcgctggccctgagcgtggccctcaacccgtccctgagcgaactcggcatcgacgtggtctggccgatcctgctctccaccctggtgctgatcggctgcgcgctgctctacaacaacctgatgcgctctccctacccgcgcccctaccagtcgccgcgggccaatctccatggcacccgcgacctggcgccgagcgcgcgtacggacttctccgcccgggacctggaccaggcgctgcaggacttcggcgaatacgtcgacatcacccgcgacgacctcgagcgactgatccaccataccgagcgctacgccttgcgccggcgcatgggcgagctgaccgcggcacggatcatgtcccgcgacgtgcagaccgccagcaccgagaccttcatcgacgacgcctggaagcagttgcaggaacaccgtctgaaggccctgccggtgctcgacgagcatcggcggctggccggcatcgtcacccagagcgacctgctcaagcacttccgccccgacggcagcccgttcaagcgcctgcgcttcctgcgcgggaccaagctgaagacgatcatgaccaccccggtggtctgcgtacaggccgacacccacgccgtcgaactggtctcgctgctatccgacgaaggcctgcactgcctgccggtgctcaacgaagccggctacctggtcggcatcgtcagccagaccgacctgatcgccgcgctctaccgcaactggctgcagcacctgggccaggccgatcagatcacgtag

SEQ ID NO: 13785 - DNA, 330 bp, Pseudomonas aeruginosa
ccgaggaagtgctcgccgtcggcggtcaggcgcgcgcccgcgcggttgcgcacgaacagccggcagccgagttgcccttcgaggttctggatgcgcgcggtgacggcggtctgggtcaggtgcaggcgttccgcggcagcgacgaagctaccgctgcgggcgatctccaggaaggtacgggcgaggtcgatatccatgcgaagcggtccgctgccacaggtgggccgccattctaggctgtgcaggcgcgggcagcgagcgcaaggcggcctggccgccctcctggagttctgcgacaaaacaccgcgcctagccgcttcggcacgctaa

SEQ ID NO: 13786 - DNA, 270 bp, Pseudomonas aeruginosa
cctgacgctcccaccgaggaccttcccatgctggaactgcgccccaactgcgagtgctgcgaccgcgacctgcccggcgacagcggcgacgcgctgatctgcaccttcgagtgcaccttctgccgcgactgcgcgacggtccgcctgggcggccagtgcccgaactgcggcggcgaactgctggcccggccaaggcgtccgcgggatgcgctagcccgtcaccccgcctccagccgacgcgtcgtcaggcccggcggttgtccggagtga

SEQ ID NO: 13787 - DNA, 1239 bp, Pseudomonas aeruginosa
cgccatgctgctacgcaacccgaccctgctcctgctgttctgcggccaggccctgtactggtcctgctcgctgatcggcataaccctgaccgccctggtcggcgtccagctggcgccgttgaacagcctggcaaccctgcccctggccctgctggtgctgggcaacctgctggcggtgcagccgttgtcgcacttcatgcagcgccacggccgacgtcccgggctgatgctcggcgccggcggcggcgtgctcggcggcctggtctgcgccgccggtgtctggactggcgatttcctctggttctgtctcggcgcgctgggcatcggggtctaccaggcctcggccatgtactaccggttcgccgcgctggaggcggtggatgccgggcggaaaggccgcgccagcgcctacgtgctcgccggcggagtactcgccgcgctgctggcgccgagcctggcgctgtggtcgcgcaacgcgctggcccagcccttcgtcggcgcctatctgctgatcgccgtgctggccctcgccggcctgctgctgatggctctgctccgcgaaggccaggcgccacgcccggcacgactcgcctggcgcgacataggcggcctgttgcggcggccggtggtccgcgcggccatcgcctgcaccgcggccggacacgggttgatgatcctgatcatgaacgccacgccgctggccatgagcttctgcggcctgccgctggaacagtcgagtcgggtcatccagtggcacgtgctgggaatgttccttccggcgttcttcgccggaccgctggtcgaccgcatcggcaaccgtcgcgtcgccctgctcggcgcgttcctgctcgccgcaagtgccggcatcgccctggacgggcagtcggtcacgcatttcctgctcagttcgctggccctgggcagcggctggaacctgatgctcatcgccggcaccaccctgctcggcgagggccacgccgaaagcgagcgcggcgccgcgcaaggattgatggagcaaggcaacagcctggtggcggcgctgatgtcgttcggctccggcgccctgatcaccagccttggctggaacgcggtgaacctgctggtctggccggcgctgctggtggcgctgacactgctctggccggtacgacgaacgcggacgctgtcgcgctgaaacgccggcaacgaaaaaggcgaccttgcggtcgcctcttctgccttacggaaacgcctcagtag

SEQ ID NO: 13788 - DNA, 594 bp, Pseudomonas aeruginosa
ggtcgccgtagcgacgcagcagttcttcggcgaaggccttcttcggctgcttctccggcaatcccagcgcgctcggcgtgtcatcgtcgaaggcctggtagtccatccacatcttcagcttgccgctgttctggtaccagtcgtcgagcaacggctggcgcgcgtcgaccggcatcaggcggaggaagttctgctcggcgccgttgcggatcaggtcgaagtacagccgcgtctgcgcctggtgcgagacgttgccgaagacatcgaagttcaccaccagcccgtagtaggttcgctcgaacagcgggtagtccatcagccacagggtctgcggtacctcgccaagcaggcccttgcgcaccgaggcgctgtcgaactggcggaagatgctcagcagggcgttgtcgttgccgtgccagagcgtgttccaggtcggcggcggcgcgtcggcgtagacgtcctggcgcaggtcttcgtactcgttgcgcttgtcccggtaggcgctccacaggccgagcaggttcttcagctcgtcgatctgccccggcaaggccagcagcggctcgctctgcgcgcggaagttggcgtcggtga

SEQ ID NO: 13789 - DNA, 660 bp, Pseudomonas aeruginosa
gtgatacatggacagtctcgatcaatgcatcgtcaacgcctgcaagaacagctgggacaagagctacctggccggcaccccgaacaaggacaactgttccggcttcgtccagtcggtggccgccgagctgggcgtaccgatgccccgcggcaacgccaacgccatggtcgacggcctggagcagagctggaccaagctcgcctccggcgccgaggccgcgcagaaggcggcccagggcttcctggtgatcgccggcctgaagggccgcacctacgggcacgtcgcggtggtcatcagcggtccgctgtatcggcagaagtacccgatgtgctggtgcggcagcatcgccggcgcggtcggccagagccagggcctgaagtcggtcggccaggtgtggaatcgcaccgaccgcgaccgcctcaactactacgtctactccctggccagttgcagcctgcccagggccagttgattcaggccgtgctgcgaatgagccagactcattcgcagcacgattccccacgagcatcccgactccactcgcccgtcccttcgccgcctgcctgcgcactccgacctccgcattccgcccgtatactgcgacaaaacggcgccagggatttttccggcccgcgaatgaacatccttcaacttgaatga

SEQ ID NO: 13790 - DNA, 264 bp, Pseudomonas aeruginosa
actctcagggcaggtatggaaaagggaggaccaccgatgggtatcgagacggaagaaccgaaccagaagccgccgaccttctggcagatgctgcatagcgtgatggctgccgccttcggcgtacagagcgggcgaaaccgcgcccgcgatttcacccacggcaagcccgtgcacttcatcatgctgggcctgctcttcaccctggtgttcgtgctgttgctggccgggatcgtgaaactggtgctgagcctcagcggcctgtga

SEQ ID NO: 13791 - DNA, 417 bp, Pseudomonas aeruginosa
ccggtgaggagttccgcccgctgcgcctgcagaacggtctctatatccagcgctatgccccgatgctgcgcatcgccgttccctatggcctgctctcctcgcgccaactgcgcaagctggcgcagatcgcccgcgactacgacaagggctacgcccacatcagcacccggcagaacgtgcagttcaactggccggagctggaagacgtgccggaaatcctcgccgagctggccaccgtgcagatgcacgcgattcagaccagcggcaactgcatccgcaacaccaccaccgaccagttcgccggcgtcgcccgcgacgagctggtggacccgcgcccctggtgcgagatcatccgccaatggtcgaccttccaccccgagttcgcccacctgccgcgcaagttcaagatcgcggtga

SEQ ID NO: 13792 - DNA, 600 bp, Pseudomonas aeruginosa
tcgacaagatcatccaggtctacgtggaacgccggaccgaggaagaacccttcatcgacaccttccgccgtatcggtatcgacccgttcaaggagcgcgtatatgcagcgaatcattaaggaccgccaggtggtcgacgaccgctggcacttgctgcccaaggacgcgaccctggaaagcgtacccaacagcgacgacgtgatcatcccgctggccctgtggctcgagcacggcccggccctgcgcggccgcgacggcggcctgggggtctggctggacgcggacgaggagccggaaagcatcgccggcgacctcgacaggttccaggtgatcgcggtgaacttccccgcctttaccgatggccgcggcttcagcagcgcgcgcctgctgcgcgagcgctacggctacaagggcgagatccgcgcgatcggcgacgtgctgcgcgaccagctgttcttcatgcgccgctgcggcttcgacgcctacgccatccgtgccgaccgcagcccggaagacgccctggccagcctggacgacttcagcgaggtctaccagacctcggtggagcagccgctaccgctgttccgccgccgcggctga

SEQ ID NO: 13793 - DNA, 510 bp, Pseudomonas aeruginosa
aataaatttctaaccttcgtatactgccccggtgcgcacacatcttcaatcctgaaacgcccggagttttccatgagtcagatgatgcagatgtaccagcaggtcggcccggctcagttcagcgccatgatcggccagttcgcaccctatttcgccagcatcgccccgcagttcgtcgaactgcgtcccggctatgccgaagtcaccttccccaagcgccgcgaggtgctgaaccatatcggcacggtgcatgccatcgccctgtgcaatgccgccgaactggccgccgggaccatgaccgacgcctcgattcccgccggccatcgctggattccgcgcggcatgaccgtcgagtacctggccaaggccactggcgacgtgcgcgcggtggccgacggcagccagatcgactggcaagccaccggcaacctggtggtgccggtggtcgcctatgtcgacgacaagccggtattccgcgccgagatcaccatgtacgtcagccaggcctga

SEQ ID NO: 13794 - DNA, 474 bp, Pseudomonas aeruginosa
cgccctcagccgaggttgaccagcacccggccgaccagcttgccggcgaggatctggttgatcgcccccggcagctcttcgagggcgatctcgcgcgccacctcttcgaggttgtcgagcttccattgcagcgacagcttgtcccacatggatgccttgaccaccagcggcagctccaccgagtccaccccgagcaggttgaccccgcgcaggatgaacggcagcaccgaggccttgaagccggcgccggcggtcaggccgcagcaggcgacgctgccgccgtactgcaacgacttgaccacgttgaagaggatgtcgccgccgacggtgtccaccgcgccggcccactgttccttgagcaacggcttgtcgacgccatcggccacggtggcgcgatcgagaatctgcttggcccccaggcggttgaggaactcggcctgctccagcttgccggtggcggccgccacggtgtag

SEQ ID NO: 13795 - DNA, 1266 bp, Pseudomonas aeruginosa
acgccgtggggcgcttccgtcacccacaacgccttgaatacagccatttcgacctcctctcgtgaaaaccctgaagacagcgtgttcgtccctgtcggcgccggcctattgccagaacttctgctggttgagccgcccccaccaggtcaccagcacgcggtcgataaccacgctggcggccaggccgacgcgttcctgcaggctcttgcgctcgacgaattgcacctggtagacatcgcgctccctggcctgctcggccaggtactcgtcgctggtcttgagttcgtccaccagcagcttgcccagtgcggcctggcccagccagacctcgccggtggcgatctcgtccatgttcagttgcggccggtagtgggccacgaagttcttgaacagttcgtgggtcacctccaggtcctcctggaacttttcccggcccttctcggtgttctcgccgaataccgtcagcgtacgcttgtattcgccggcggtaagcacctcgaagtcaatatcgtgcttcttcaacagccggtggacgttgggcaactgcgccaccacgccgatcgagccgaggatggcgaagggcgcggaaaggatccgatcgccgatgcaggccatcatgtagccgccgctggccgccaccttgtcgacgcacacggtcagcggcacgccggcctggcggatgcgcgccagttgcgaggccgccaggccgtagccatggaccatgccaccgccgctttccaggcgcagcaccacctcgtcgtccttgcccgccatgctcagcaccgcagtcacttcgtggcgcagttgctcggtagccgaggccttgatgtcgccgtcgaaatcgagcacgtagacccgcgacttctgttcaggatgtttcttcgcctgcttcgccgccttgctctcctccttgcgcaaggccttgaggctggccttgtcgaggacgctgtggcggacccgctcgcgcaggtccttgtagaaatcgttgagcttctgcacgtcgaggtgcccgcctgcgccgcgccggccgcggccgcgcagggcgacgatcaccaccagcaccacgatgatcgccgccagcacggtcacggtcctggccagaaagcccgcatattcggcaatgaactccacacaaccccctctctactgttgacgcacccgtctacgggcgacacgattgcgcaagcatacccaggccaccgacgggcggccagcgatgccactgcctggagagcctttgcagggcgcgcccggagcagccgataa

SEQ ID NO: 13796 - DNA, 1419 bp, Pseudomonas aeruginosa
gctgaatctcgacgaacaacagacccgcagcctgtgcaagagcttcatcgacaagttcgtcgaactgcacaacgtcgactacgccgcctgcggactggccgacctgggccgcccggacggctacgtgcagcgccagatcgccggctggaccgaccgctacgagaaggccctgacccccgacgcgccgctctgggaaccggtcaaggcctggctcaaggacaagcagccggccgatcaccacaagccgggcatcgtgcacaacgactaccgcttcgacaacgtgatcctcgacccggaaaacccgatgcagatcatcggcgtgctggactgggaactggccaccctcggcgatccgctgatggacctcggcaataccctcgcctactgggtggaagccggcgacccggctccggtgcagctgacccgccgccagcccagccacctgccgggcatgctgacccgccgagagttcgccgactactacgccgagcgggccgggatcccaccgatcgacaacctggacttctactacacctatggcctgttccgtcttgccggcatcgtccagcagatctactaccgctactaccacgggcagacccaggacaagcgtttcgcccagttcgtgcagatgaacaagctgctggagcagatgagcctgcaggccatcgagcgctcccgcctgtaaccgaccactacaaggggatagcccatgtccaagacccacctgttcgacctcgacggcaagatcgccttcgtttccggcgccagccgcggcatcggcgaggcgatagccaagctgctggcccagcaaggcgcccacgtgatcgtctcgagccgcaagatcgatggctgccaggcggtcgccgacgcgatcaccgcggagggcggcaaggccaccgcgatcgcctgccacatcggcgagatggagcagatccagaacgtcttcgcacagatccgcgagcagttcggccgcctcgacatcctggtcaacaacgccgccaccaacccgcagttctgcaacgtactggaaaccgacctcggcgccttccagaagaccgtcgacgtcaacatccgcggctactacttcatgtccatcgagggcggcaagctgatgaaggaacacggcggcggcagcatcatcaacgtggcctcgatcaatggcgtatcgcccggcgagttccagggcatctactcggtgaccaaggccgccgtgatcagcatgaccaaggtcttcgccaaggaatgcgcgcagttcggcatccgctgcaacgccctcctgccagggttgaccgacaccaagttcgcttcggcgctggtgaagaacgacgcgatccgcaacctcgccctgcagcgcatcccgctcaagcgcgtggccgagccgagcgaaatggcaggcgccgtgctctacctggctag

SEQ ID NO: 13797 - DNA, 1359 bp, Pseudomonas aeruginosa
caaccgtatccaccgcctgacgccggcaggccgcgcgttcctcgacgaagcccggcgcaccctggcccaggccgaacgcaccctggcggccgcgcgcagcgccgccagcggacgcagaacgttgcgcctggcgttcgtcgacagcaccatcaatattctgctaccgcgcatactccaggcgttccgccaccagcatggcgcgctggacttccagctccaggaagacaccaccgcggggcaactggaggcgttgcgcgaagaccgcatcgatgccggcctgatcgttctgccggtcgactgccagcccggcctgtacacacatctactggtggacggcgacatgcgcgtggcattgcccgaagggcatcggctggcacgccatgcgcgcctgcgcctggaacaactggccggagaaccctggctgctgtttccacggcactatgggccgggcatgcacgacctgatcgtcgccgcctgcgcggcagccggcttcgtcccggaggtggtgcaggaggcgcggcagatgcagaccatcgccgggctggtggccggcggcatcggcgtcgcgctagtgccttcgctgctacaaccgttgcgcccgccgggggtcacctttcgtcccctgcaagggcggcgggcgcgaattccctatcggctggcgctggcctaccgcacgccgtcggaactcatcgaacgctttcgcgaaaccgcccaggcgatcgccgccgccccggcttttcgcatggcctagcgccagtccctgagcgcctcctcggccgccaggttcatcggctcggcaagcagcccggcgacgccgtagttcaccgcgaacaccgccttgtccgccatcggcaggaaagtcacccgccccgccagcggctcgaacaggaacaggtcgtgctcgccggcccgcagccagcgccagagatcgacccccagcggactctgcgacaagcccaggcggcggccccgggactgctgctcgagggccaggaagcggccgctgagcgcgtcgaggcgatagcccggcgccagaccgatcaacgcggccagccccttccagcggaaaatccgcgcgtccagttgccagagttcgccgtccagcaccacgctgcgctcgttggcgccctcctggatcagcacccggtagcgctgcggcccttcggcctggaagctcagggtggccatcggctgctcgggcttgagcagcgaatagctgcgcaggtcccaggcgagcaccagcagcagcgccgccacggcgacgaaggccaagccgcaggtgccgcgcagccagccgaggaaccaggtgcgttcgaagaggatgcgcaccgcgaccagggcggccagcaaggccagtaa

SEQ ID NO: 13798 - DNA, 1461 bp, Pseudomonas aeruginosa
cgcgaatgcccaggccagaccgtcgtactgcatgcaagcgattccttctgcgtgaaattgcgggcattatgcgcacccctcctcccgacggccagcgaggccgtttcccgattggaagcaggtccggtttttcatgcccttcgaactcgcgatagaccccagcaccctgatcatcctggccgtggtggcctttctcgccggcttcatcgacgccatcgccggcggcggcggcctgttgaccatccctgcgctgctcaccgccggggtcccgccgcacctggcgctgggtaccaacaagctgagctcgaccttcggtgcggcgaccgccagctacaccttctaccggcgcaagctgttccatcccgggaagtggcgcaacggtttgctcgccaccgcgatcggcgccgccataggcgcctgggcggctcacctgctgcccgccgagtggctgaaccggatgctcccggtggtggtattcacctgcggcctctacatgctcttcggcggcacgccgaaggcgccgctggacgccgatgcgccgctcggacgcaagcgccagtggccgcagggcctcgccctgggcttttacgacggcgtggcgggaccgggcaccggagcgttctggaccgtcagctcgctgctcatgtacccgctggacctggtccgcgccagcggtgtggcgcggagcatgaacttcgtcagcaacatagtggcgctggcggtgttcgtcgcctccggccaggtgatctggttgctcggcctgtgcatgggtgcgtcgctgatggtcggcgcctatttcggcgcgcgcaccgccatcggcggcggggcgaagttcattcgcccggtgttcatcctggtggtcctggcgctgaccgcgcggctagcctggcagcactggttcagcggcgcctgagcggcgcgccaggtacaggtcgatcaggtgccgggcgatcgagcgctgcgccggtagcggcggcaaggcatcgagggagaaccactgggcgtcctcgatctcgtcctcctgcgggacgatctcgccggacacgtactcggcgtggaaaccgagcatcagcgaatgcgggaacggccagttctggctgccgatgtattcgagattggcgacctccaccccgacctcttcgcgcacctcgcggaccacgcactgctccaccgactcgccggcctcgacgaagccggccagggtactgtatacccccggcacgaagcgcggcgaacgcgccagcaacacctcgtcgccccgggtcaccaggacgatcatgctcggcgacaggcgcgggtactggtgcagcccgcactgcggacactgcatcacccgctcgtggtcctgcgtctgcatgcgtgtgccgcaattgccgcagaaccggttgtgacgtgcccagatgccgatctggctggcatagccgagcatgcagaactgatcgaaatcgccgtgcagcatga

SEQ ID NO: 13799 - DNA, 2094 bp, Pseudomonas aeruginosa
ctgggtctgcagggcggtgccggccgagttcaggccgaccatgccgagggtcttgctcagcttgcccagttgcgcatgcaggttggtcaggctatccggctgggccacgccgcgctcgatcaggtcgagcatgtccttgaccccggcgagttcctcgcggatcgccgtggacagcgaacgcatcaccgactggccggggccggacaggcgctgcgattcctcttccagcaggtggtcggtgaacggcagcggcgccagcccatgcagttcgcggacctcgcgcgaacgcgggccctggccgtcggacagcgccaccaggtaaagcagttccttgagcagatggcgcggcgcctcgtaggccgggccgatcagcaattgcttgagctcgcggtcgatgcgcgagaacagttgcttgcgcgacttgcgcggcaacagttggccatcgacgatcgactcgatcgccgcggcgccgatccagcacagccgcgaacgggccaccccgccgtgcaggctgtcgaggcgcgccagcgcgcggcccatcagcttgaggctgggatagaggttctgttcgcggatcaggccgagcaggccgatctggtacatgtggcgcatccgccggctttcctcgcccagttcggcttcggaaggcaggtggtcgatggcagtgctcggcggccgcgggatatccaggcgggcgctgaagaagaagctttccggcagcgccggctgccctgcggcacagcgcacttcgttgatcgccggcaagagcagctcggggatctcctggcgattggcctcgacgttctccaggtagcggcgcagcacgtacagggcgttgcccagggctgccagctggccgtcgcgctcctcgctgacgccggtgggaatgtcggtcgccagctgcagggcttcctgggccagcagctcggcgccggccagctcgatcaggttgagggtgccgcggatctgttgcaggcattcgacggcgtgctgcagcaggctgccgttctgccgctcggcaatgaactgctcaagaccctgttcggcctgttccatggtggcgaacaactcgtcgcgcaccagactgagggacgtggctcctgtgaccatcggcctagtgcgcctcccgcgcaagaatatacaacggcatcaatcagcgaattccggcttctgcttggccatatgcgcggccatcgccacccgcaggtcggcggactggagcatggcggcgttccaggtagcgacgtactcgaggccgtcgtcgacccggtggtcgcgcatatagcggatcatttccttggtaccacggatggcgatcggcgacttcgcggcgatctgccgcgccagttcgaagaccccatccatcaatgcggcctggtccgcgtaggtacgattgaccaggccgatgctccgtgcctcttcgccgtcgaccatgcgcccggtgtaggccagctcgcgcatcatgccatcgccgatgatccgcggcaggcgctgcagggtgccgacgtcggcggccatgccgatgtcgatctccttgatcgagaactgcgcgtcggcggtcgagtagcgcatgtcgcaggccgagaccaggtcgatggcgccgcccaggcagtagccctggatcgccgcgagcaccggcttgcggcagttgtcgaccgcgttgaacgaggcctgcagctcgagaatcttgcgacgcagggcgtcggcgttgcggccgacgtccttgcccagttggctgccgacctgggccagcagcatcaggtcgatccccgaggaaaaatgcttgcccgccccggacagcacgaccacccgcacttcgtcggtatcgtcgacccagcggaagatctcgatgatctcgcgccagaagtcctggttcatggcattgatcttgtccggacggttgatctggacgtgggcgatcttgtctgccagctccacacggaatgcgttgtactcggtcacggcgatagtcctcggcagagcaactgcgctgtcagaacgcagagatttttgttgtgcggaaaatcccgcaactataacaagggcgagccaaatgtcgatgctgcactatgtgatgcacggcacgcccattga

SEQ ID NO: 13800 - DNA, 1722 bp, Pseudomonas aeruginosa
taccgcaatctcttcgatgattgcgctaaacgcttgatccaacgaaagtcctgctggcattttcagtcttttccttgccgtggagtccatcgtgagcagtcccctgagccaggctttcgcacagaacttcctcgggcattcgccgcgctggtacaagctgacggtgctcgccttcctcttgctcaaccccctgctgctatggctggccgggccggtgacaagcgcctgggtgctggtcggcgagttcatcttcaccctggccatggcgctgaaatgctatccgctacagccgggtggcctgttggtgctggaggcgctgctgcttggcctggctacccccgaggcgctctatgcggaattgcagcacaacttcccggtgctcctgctgctgatgttcatggtcgccggcatctacttcatgaaggacctgctgctcctgctgttttcccgcctgctgctcggcgtgcgctcgaagaccctgctatcgctcctgttctgcctgctggccgccctcctctcggccttcctcgacgccctcaccgtgaccgccgtggtgatcagcgtggcggtggcattcttcgccgtgtatcaccgggtcgcttcggggcagcgcgccagcgaggactacgatcccgccaccgaccgccaggtccccgagctgcaccgggcccatctcgaggaattccgcgccttcctccgcagcctgctcatgcacgcggcggtcggcaccgcgctgggcggcgtctgcaccctggtgggagagccgcagaacctgctgatcggccacgaggccggctggcatttcgtcgagttcttccgccaggtcgcgccggtatccatgccggtactggcggccggcctgctgacctgcgtgctgctggagaagagccgccgcttcggctatggcgcccagttgccggcggcggtgcgccaggtgctcgccgagtacgccgccagcgaaagccgcaaacgcggagcgcagcagaaggccgcgctgctggtgcaggccctggcggcgctggtactgatcgtcgggctggccctgcatgtcgccgaggtcggcctgatcggcctgttggtgatcgtgctgatcactgccttcaccggcgtcaccgacgaacaccagatcggccgcgccttccaggaggccctgccgttcactgcgctgctggtggtgttcttcgcggtggtcgcggtgatccaccagcagcacctgttcaccccgatcatccaggcggtgctggcgctgccgacggaacgccagccgggcatgctgttcatcgccaacggcctgctctcggcgatcagcgacaacgtattcgtcgccaccatctacatcaccgaggtgaaacaggcgctggatgccggccacatgagccgcgagcatttcgataccctggcggtggcgatcaataccggcaccaacctgcccagcgtagcgacgcccaacggccaggcggcgttcctcttcctgctgacctcctccatcgccccgctggtgcgcctgtcgtacggccgcatggtctggatggcgctaccctacaccctggtgatgggcggcctgggctggtgggcggtcagtcattggctttgagcgtcggcactccgttgacctggttgcgccattgccgccaggtgtacatcgggataccggccatcagcaccaggaagccccagaagatcgcctgctggccggtgccatacagcgcccatagcgagtag

SEQ ID NO: 13801 - DNA, 594 bp, Pseudomonas aeruginosa
tcacgaagaaggtatggtcggcgccgaaattgcgcgcggcacggtcctcggcctcggccagggggccggtatggtcgagcagcgatcccagctcggggaccgagaccgacaggtcggaacgcagcgtgttctccccgaagaactggtggaacgcctgtcccaccggactcttgcgataggcgacaccgccgccgtggcccggcgtatgccaggaatagttggactgcgcggtgtgctcgaccagcgcacggaagaatggcggcagcagcccggccaggtagttgcgcgccgcccgggcgacctggcgggcgaggaacggcacggtgtcttcgaacaggtagaggatgccgcgcaactggtgcaggtcggccatggactcggccggcgcgttctcgatggtcacctgctcgccgagggcgaagatcggcaattgcggcgcccgcacgcgggccacgcggatcagttcgaccacatcctgcagcaggcgctggttttccccggcaccttcggcggcgaccagaatgcaggccaggccgtggtgggtggaagcgacgatgcgcccctcggcggagctggcggtggagagaatgctga

SEQ ID NO: 13802 - DNA, 570 bp, Pseudomonas aeruginosa
ccatcggtcaccggcatgccggtggtttcggtatccagtacgacgctacgcatctatagagcctttctctgtttcgctgcagccgcggctgctgaacgcttgtttcggtgtggccgctcagcgcggcaattcggcgacgccacggttggccaactggtcggcccgctcgttgccgggatcgccggtatgcccgcggacccactgccactccacctggtgccgggcgacctgctcatccagggcctgccagaggtcggcattcttgaccggctgcttgctggcggtcttccagccgcgcttcttccagttcggcaaccattcggtgatgccgcgcatcacgtattccgagtcggtgatcagacggatcggacaggaacgcttgagtgccgccagcgcctggatcgccgccatcagttccatgcggttgttggtggtgtccggctcgccgccccaaagctctcgctcggcgcccttgtagaggagcaacgccccccagccgccgcgcccagggttgcccttgcaggcgccgtcggtatagatcactacctgttctttatctgtcatgcctaa

SEQ ID NO: 13803 - DNA, 732 bp, Pseudomonas aeruginosa
gcaatactatgcgccaatgacttctgcttagcgacatcgacccatgatacagatcgacgccctgtccgccttcaacgacaactacatctggctgttgcaagatgcgacaagccgtcgctgcgcggtggtcgaccccggcgacgccaagccggtggaagcctggctggccgcccatcccgactggcggttgagcgatatcctggtgacccaccaccatcacgaccacgtcggcggcgtcgcggccctgaaggaactgaccggcgcgcgggttctcggcccggccaacgagaagatcccggcccgcgacctggcgctggaagacggcgaacgggtcgaggtgctcggcctggtcttcgagatcttccacgtgcccggccataccctcggccatatcgcctactaccacccggcggagacgccgctgctgttctgcggcgacaccctgttcgccgccggctgcggccgtctcttcgaaggcaccccggcgcagatgcatcattccctggcgcgactggccgcgctgccggccaacacccgggtctactgcacccacgagtacacgctgagcaacctgcgcttcgcgctggcggtggagcccgacaacgcagcgctgcgggaacgcttcgaggaagcgacccggctgcgcgaacgggaccgcatcaccctgccgtcggaaatctcgctggaattgtcgaccaatccatttcttcgcgtttcggaaaaatctgttaa

SEQ ID NO: 13804 - DNA, 1632 bp, Pseudomonas aeruginosa
atttttgcccggaacagcactcagccgatgccgccacagacacgtaaaacccccgatctagacgccctggctcgcgccgttcgggtgtccatcctgctcatcgccggtgcgctcgccggctgccagggcagcggccagatcaagggggaggcccaggccaaagcagcacgtcccggcgcccgagccgtcgacgtccagttcaacccctcctggctgcatacccagcccggccagaacgccgcctacaacgacatctgggaccgcatgcgcgacggtttccagctccaggatgcgatcagcaccaacccgcgcatcgaacgccagcgcctctggttcctcagcaaccagtcgttcctcgaacaatcgagcgcgcgcggcagcctctacatgcactacgtggtcgagcgcctggaagaacgcaacatgccgctcgaactggcgctgctgccggtcatcgaaagcgcctataaccccttcgccctgtcgcgcagcaacgccgccggcctctggcagttcattcccgccaccggccagcatttcaacctgcgccagaccaatttctacgacggtcgccgcgacatcaccgcctcgaccaatgccgccctgacctatctcgagcgcctgcacgacatgttcaacggcgactggatgctcgccctggcggcctacaacgccggcgaaggcactgtcagccgcgccatcgaacgcaacgagaaactgggcctgccgaccgactactggaacctgccgctgccgcaggaaacccaggactacgtacccaagctgctcgccctctcacagatcgtcatggcgccggattcctacggcatcagcctgaacccgatcaacaacgagccctacttccaggccgtccgggtcaagcgcgggatcgacctgtccagcgtcgccgcgctggcgaacctggacgaggacgagctgtaccagctgaacccggcctacaagcgccgcgtgaccatggacggcccccagcaactgttggtgccaatggagaaagcggcgttcctgaccgcctcgctggacaccctcaagccgaaggaagtcaccgcctggcagcaataccgggtgcgtagcggcgacagcctgcacagcatcgccaaccgctatcggatcaccgtagcggagctcaagagcgccaaccgcctgtccagcaaccacctgcgcaagggccagcaactgagcatccccgggcagatcgccggcggcgccgtcaagccggtctaccagcaactcgcccgacaggcttccaccccggccaggacccgctcctataaggtcaagaacggcgacagcctgtggcagatcgcccgcaacaacggcgtcgacgtcaacgacctgaagcgctggaacggcctggacaagcacgccctgaaggtcggccagaccctcaagctgcaaggcggcacccaggccctggcggcccgcaagggaaacgccgccggcaagcgcgacagcgccacctactacaaggtcaagcaaggcgactcgatgtacctgatcgccaagcgcttcaatgtcgaaatgaagcacctgcagcgctggaacccgcgcagcaagcaggcgctcaagcccggccagaccctgaccctgtacctggacaccgcgagccgctga

SEQ ID NO: 13805 - DNA, 1290 bp, Pseudomonas aeruginosa
cgattcgttgtcaaaaatagccaaggacccggacacacgcctgatgcgtcgcctctccttcctgatcctcggcctggccgtgagcctgcccagcttcgccgcgattacccagagccatggttatgcccaattcggcacgctcaagtatccggccaatttccagcacttcgactggaccaatcccgacgcccccaaaggcggcaccttgcgcctgatggcctcgggcagcttcgacacgctcaacccctacaccctgaaaggcaccagcccgatcggcaccggcgatttcctccagtacggagtcaacgagctgaacgaaccattgatggtgggcaccggcctgtacgacccgtccggcgacgaaccagcctccagctatggcctgatcgcgaagagcgtggaatacgcggaaaaccgcagctgggtggtattcaacctgcggccggaagcgcgcttccacgacggcaggccgatcaccgccagcgacgtggccttttcctatcgcaccctggtcaagcaggggcacccgatgtaccgcacctacctgcaggaggtgaagcgggtcgatatcctcaccccccaccgggtgcgtttcgtcctgcggcgctccggcaacccgctgctgatcctgcgcctgggcgagcttccggtgctgccgcagcattactggaaggatcgcgacttccgcgccaccaccttcaccgcgccgctgggcagcggtccctatcgcatcgtcgaggtcgatcccgggcgccgcctggtgttcgaacgcgtgaagggctggtggggcgaaaaactgccggtgaaccgcggcaaatacaatttcgaccgggtcgtggtggacttctaccgggacaacggcgtcgccttcgaagccttcaaggccggcgagttcgacttctacatcgagcaccaggcgaagaactggctgaacaactatcgcttccccgcggttctgcgcggcgatgtgatccgcacggaaatcccgcaccagatccccagccagacccaggcgttgttcatgaacacccgtcgcgccgtgttcaaggagcgcgcgctacgccaggcgctgggcgagatgttcgacttcgaatggaccaatcgcgccctcttcagcaattcctacctgcgctcgcgcagctactacccgaacagcgaattcgccgccagcggcgtcccggagggccaggaatggctgtacctgtcgccgtaccgcaagcaattgccggcgcagttgttcaaacagccgttcagcctgccgaccaccgaggggcgcggcattccccgtga

SEQ ID NO: 13806 - DNA, 2355 bp, Pseudomonas aeruginosa
aaagggcgaaccgctgcgcttcgaaatcctgctggtcaatccgagcctggagcgtattctccagccctatcgcgaaaacctcgccagcatcggcatcgacgcgcgcctgcgcaccgtcgaccgcgcccaatacaagcagcgcctggaccagttcgactacgacatgatcctcatgaccctgccacagaccctcagtcccggcctggaacagtggcagtacttccactccagccaggtgaaggtcaagggcagcaagaattacgcgggcatcgccaacccggtggtcgacgccatgctcaaccgcctgctcggcgcccacagccgcgacgaacaggtcgccgccgcgcgcgccctggaccggaccttgctctggcagtactacagcattcccaactggtacctcaattcgcaccgtctggcgtaccgcaaccgcttcgccttcgtcgccaccccgccctacaccctgggcctgcgcgcgtggtggcagaaaaacctggagacgtcccgatgatccgtccccgcttcacccctctgctggcagccctgctgctcggctgctgcggcccgctcctcgccgccccgaaacatgcactgacgctctacgatgagcctccgaagtatcccgccgatttcaagcatttcgactacgtgaatccggatgcgccgaaaggcggcatcctccgccaggccgacttcggcggcttcgacagccttaacccgttcatcggcaagggcgtctcggccccttcgctgggcctgatctacgacaccctggccttccagtcgcaggacgagccgttcaccgaatacggcttgctcgcggagaagatcgagaaggcaccggacaacagctacgtgcgcttctacctgcgcccccaggcccgtttcagcgatggcacgccggtcaccgccgaagacgtggtgttcaccttcgagacgctggtgagcaagggcgacccgatgtaccgcaactactatgcggacgtcgacaaggtggtcgccgaggacaagcttcgcgtgcgcttcgacttcaagcacgccggcaaccgcgaactgccgctgatcctcggccagatcgcgatcctgccgaaacactggtgggccgaccgcgacttttccaagaccggcatggaaattccggtgggcagcggcccctaccgcatcgccaaggtcgatccgggacgctccatcagctacgagcgagtcaaggactggtgggccaaggaccttccggtctcccgcggactctataacttcgacaccatcaccatcgactcctatcgcgacatgtcggtcgccctggaagccttcaaggccggccagtacgacgtcaacctcgaatattcggcgaaggactgggccaccggctacgagtcgccggcattgcgcgacgggcgcttcatcaaggccagcatccacaaccacaacccggtggggatgcagggcttcgccttcaatatccgccgcccggtgttccaggaccgccgggtacgccaggcgatcagcctgctgttcgacttcgaatggtcgaacaagcagctgttcttcagctcctacaagcgcaccaacagctatttcgagaactcggagatggccgcccaccagttgcccagcgaagccgagctgaagatcctcgaaccgctgcgcggcaagattcccgacgaggccttcgaccaggtcttccagaatccggtcaacgacggcagtggggtgatccgcgagcagcgacgcaaggcctaccagttgctcaccgaggccggctacaggatcgagaacaaccgcatggtaggtcccgacggccagccactgagcttcgagttcatgctgttccaggccaacatggaacgggtcatcctgccgttcaagcgcaacctggccgaacttggcatcgacatgcagatccgtcgcgtcgacgtctcgcagttcgtcaaccgcctgcgctcgcgggatttcgacatgacctcggcgacctggccgcaatccaactcgccaggcaacgaacagcgagagttctggcattccagcagcgccgacaaggccggcagccgcaacttcatcggcctcaaggacccggccatcgacagcctggtggaaagcctgatccagtccgactcgcggcaaagcctgatcgaccatacccgcgccctcgaccgcgtactgtcgtggggctactacgtggttcctaactactacgtcgatacctggcgggtcgcctactggaaccgtttcggccggccgaaggtgacgccactctacgactggggcctgatgacctggtggcagaccagcgacaaggcgctgccgagcaaggcgcaagccgaagccacgcaagacgccgagccggaacgggagtaa

SEQ ID NO: 13807 - DNA, 1089 bp, Pseudomonas aeruginosa
cgccgcatgctctcctatatcctgcggcgcctgctgctgatcgtccctaccctgttcggcatcctgctgatcaacttcatcatcatccaggccgctcccggcggtccggtggagcagatgatcgccaagctggaaggcttcgacgccgcttccggcggcgccaccgggcgcatctccggcggcggcggcgaagtcgccgtggccggctcgcaataccgcggcgcgcaaggcctggacccggagctggtgaaagagatcgagcgcatgtacggcttcgacaagtcggcccccgagcgcttcatgatcatgctgaagaactacctgcacctggacttcgggcagagcttcttccgcgacgccaaggtcaccgacctgatcatcgagaaattgccggtgtcgatctcgctcgggctctggagcacgctgatcatgtacctggtgtcgatcccgctggggatcgccaaggcggtccgccatggcagcgtcttcgacatctggaccagctcggcgatcatcgtcggctacgccattcccgccttcctcttcgccatcctgctggtggtgctgttcgccggcggcagctactgggactggttccccctgcgcggcctgacctcgaacaacttcgaccagctcagcctcggcggcaaggtgctcgactatttctggcacctggccttgccggtaaccgccctggtgatcggcaacttcgccaccatcacgctgctgaccaagaacagcttcctcgacgagatcggcaagcaatacgtggtcaccgcccgcgccaagggcctgaccgaacgccgcgtgctctacgggcacgtattccgcaacgccatgctgctggtgattgccggcctgccggctgcgctgctggggatcttcttcaccggttcgctgttgatcgaggtgatcttctccctcgacggcctcggcctgctcagcttcgaagcggctatgaaccgcgactacccggtggtcttcggcacgctgttcatcttcaccctgttcgggctggtcatgaagctgatcagcgatatcgtctacaccctggtcgatccgcgcatcgacttcgagaaccgggagtaa

SEQ ID NO: 13808 - DNA, 684 bp, Pseudomonas aeruginosa
tcacccacgacctcaacctggtccggcgcatcgcccaccgcgtctgcgtcatgcaacaagggcggatcgtcgagcaggcttcctgccaggaactcttcgcagccccgcgacacccctatacccgcgagctgctcaacgccgagcccagcggtgcgccggcgagcaacccgcccggtgaaaccctgttggcggtggacgacctgcgggtctggttcccgatccgcaaaggcgtgttccgccgcaccgtggaccacgtcaaggcggtcgacggggtcaatttcgaactaccccgcgggcagacgctgggcatcgttggcgaaagcggctcgggcaagtcgacccttggcctggcaatcctgcggctgctggaaagccagggcggcatccgcttcgaaggcacccggctggacggtctcgcgcaacatgacgtgcgcccgctgcgccgcgagatgcaggtggtgttccaggacccatatggcagcctcagcccacgcatgtgtgtcggcgagatcgtcggcgaaggcctgcgcatccataggatcggcagcgaggccgaacaggagcaggcgatcatcgacgcgctggtggaggtcgggctcgatccgcagacccgctaccgttacccccacgaattctccggcggccagcgccagcgcatcgccatcgcccgggcactggtgctga

SEQ ID NO: 13809 - DNA, 2331 bp, Pseudomonas aeruginosa
tgggcctggccaaggccagcctggaggccggggtccgctacctggccggcagcctgggcgcggaaggcacccgggtcaatgcggtttccgccgggccgatccgaacgctcgccgcctccgggatcaagagcttccgcaagatgctggccgccaacgagcggcagacgccgctgcggcgcaacgtcaccatcgaggaagtcggcaatgccggcgccttcctctgttcggacctggccagcggtatcagcggcgagatcctctacgtcgatggcggcttcaacactaccgccatgggcccgctggacgacgactgatcaccccgcccatgaaaaatggccgcttcgagcggcctttttcatgggcggaataaagaaaaggccgcgtaagcggccttttctctgcatctcggtctcagtatttctcgacttccgccttgtcctgcaactgacggcggaaggcggcgaagtctgcctgtccgctgcgcgaagccaggaagcggcggtacatggccttctcgtcgtcggagatagcctcctccggctcgctgacgccattcaggcggatcaccacgtaatcgccattggccagggtcacgccagagagcgaaggcttgtccttggcctccggacgctgcatgcggaacaccgcctggagcagtttcggatcgacgccttcctggccgcgggaggccgcctcgaccactttccacgactcccccgctgcggaagaggtacggccttcacgcagctctgcgatcagggcctcgccacgcttctgcgcctcctcggcggccttttcggcggccaggcgctcgcggatgttcgccgcgacctgctccagcggttgctccttcggcttgttgtgttccttgacccgcagcaccaccacggtgtccggatccagctcgatggcgccactgttggccgcttcttccagcacctcggcgctgaacgcggtctgcacgatctggcggttggcagcgatgccgtcgccccccgaacgtccgaacggctggctggtctggaccttcaggcccatttcctgcgccggctggctcaggtcggcggcttcgtaggcggagctttccaagtccttggtagcctcgacgaagcgctgctcgaccatctgtttcttcagttcgtcctcgagcttcggcttgaggctttccaggctcggtacttccggcgcctgcacgcccagcagcttgatcaggtggtagccgtacggagtcttcaccggggcggatacctcaccttgcttcagcgcatacagcgcctcctcgaacgcggggtcgtacacgccgcggccggcgtagcccaggtcgccgccggtggcggccgagccgatatcctgggagaactccttggccagcgcggcgaaatcctcgcccttggccaggcgagccttgatctcgtcgatcttcgccttggcctgctcgtcgccgaccttgtcgttcacctcgatcaggatgtgggcggcatcgcgctgctcggagaggttggcgatttccttctggtacaacgcctcgaggtcttcctgcttcaccttgacctggtcgaagaaggaggacttcttcagttccacgtattcgacgaccacctgctcgggagtcatgaactcgctcttgtggccttcgtagaaggccttcacctcgtcctcgctcacgctgctcttggaagcgtcggccttgatcgccagggtggcgaagtcgcgggtctgcttctcgaggcgagcgaaggactgcaattcgttgtcggtgacgaaaccggtgcccgccaggccggcgcgaagctggccgatgagcatttcctggccgagcatctggcggaactgcatgcggctgtagttcatctggcggatgacctggtcgaagcgatccgcgttgaacttgccgtcgacctggaactcgggagtttgcaggatcaactggtccagcgcctggtcggagaaggcgaacttgtcgtccttggcggcctggagcagcagggtacgctcgatcagccccttcagggccgcttccttgagcagcttgtcatccagcatggatggatcgaaatccttgcccaggcgttgcagcagctggcgacgctgcatgtccacggcctgttggacttcattgagactgatatcgtcgccgttgaccttggcggccacgttggagtggtcggtggcccggatgatcgcgtcgaagccggtcagcgacaggagaacgatgatcacgccaatgatggtcttggcgatccagccctgggaattatccctgatgttctgcagcatgcagcccccaaaaactgccacgaccagccgtcttgggcggcgcggcgtgggtaa

SEQ ID NO: 13810 - DNA, 426 bp, Pseudomonas aeruginosa
ctggcggagcggacgggactcgaacccgcgacccccggcgtgacaggccggtattctaaccgactgaactaccgctccgcagccaggccagccttggccgacctgggtagaacgagtcccaaaagacgcttagttgacagcatccttcagggctttaccggctttgaagcccgggatcttggcagcggcgatcttgatcggcttgccagtttgcgggttgcgaccggtgcgagcagcgcgctctttgacagcgaaggtgccgaaaccaaccagcacgacggagtcaccagccttcagggcgccagtgacggactcgatcactgcgtccagtgcgcgaccggcaacagctttcgggatatcagcagatgcggcaattgcatcgatcagttccgacttgttcactctaagtccccttatttctgttga

SEQ ID NO: 13811 - DNA, 495 bp, Pseudomonas aeruginosa
caagggcccaaaaacagtgtcaagaatacctaccgactaatgcgtgctaattcgctccttggaatcaggctcgcgtttttcatcctttgcaaccatctccggagccgcatcgggcaagggctccggggcgtattgcagcgcaatttgcaggacttcgtcaatccatttaaccggtttaataaccagatcactcttaatattgtccggaatttccttcaggtcgcgaacattttcctcgggaatgatcaccgtcttgatcccgccgcggtgcgccgccaaaagtttttctttcagcccgccgatcgccagcacctgcccacgcagggtgatctccccggtcattgccacgtcggcgcgcaccgggatctgcgtgatcgccgaaaccagcgccgtgcacatgccgatgcctgcgctcgggccatccttcggcgtagcgccttccggaacgtggatatggatgtcgcgcttctcgtggaagtccgccgcgattcctag

SEQ ID NO: 13812 - DNA, 1905 bp, Pseudomonas aeruginosa
gctctgggcgcggctgcgcaccacggtcaacgccgcggtgatcgattccgccatcacgtcgcccagcgatccggtcttggtcaactggcccttgccgggtaccacggccgcctcgatggtgagcagctcgccgccgacctgggtccaggccagcccggtcacctggccgatctggtcctgctgttcggcgaggccataacggaacttgcgcacgccgaggtagttctccagcgtctcgctggacaccaccgcctggatacgcttgagcttggcatgctccttcaccgccttgcggcagaccttggcgatctgccgctcgaggctgcgcaccccggcttcgcgggtgtagtaacgaatgatgtcgcgcagggcgccttcctcgaaggtcagctcgcccttcttcaggccgttggcctggacctgcttcggaatcaggtacttggaggcgatgttgaccttctcgtcctcggtgtagcccggcaggcggatgacttccatccgatccagcaggggcgctgggatgttcatcgagtttgcggtgcagaggaacatcacgtcggacaggtcgtagtcgacctccaggtagtgatcgttgaagttgtggttctgctccgggtcgagcacctcgagcagcgccgaggcgggatccccgcgcatgtcgctgcccatcttgtcgatttcgtcgaggaggaacagcgggttgcgcacgccgaccttggtcatcttctggatcaggcggcccggcatggagccgatataggtacgacggtgaccgcggatctcggcctcgtcacgcacgccgccgagcgccatgcgcacgaacttgcgattggtggcgcgagcgatggattcggccagggaggtcttgcccacgccgggcggccccaccaggcaaaggaccgggcccttgagcttcttcacccgcttttgcacggcgagatactcgagaatgcgctccttgacctcttccaggccgtaatggtcggcatcgaggatgtcttccgccttggcgagatcatggcgcaccttgctctcggccttccacggcacgttcagcagccagtctatgtaggaacgcaccacggtggcttccgccgacatcggcgacatctgcttgagcttgttcagctcggcagtggccttggtgtgcgcctccttggtcaggccggcggcgtcgatgcgcttcttcagctcctcgacttcgttgtgcccttcgtcgatatcgccgagttccttctgaatggccttcatctgctcattcaggtagtactcgcgctggctgcgctccatctgcttcttgacccggccgcggatgcgcttttccacctgcagcaggtcgatctcggcatccagcagcgccaggacatgctcgacccgcgacgacaggtcggtgatctccaggatgtcctgcttctgctcgatcttcagcgccatgtgcgcggccatggtatcgaccagcctgctcggctcgtcgatgctgttcagcgaggaaagcacctcggcggggactttcttgcccaactggacgtattgctcgaactggctcagcaggctgcgagtgaagacctcggcctcgcgctcgccgacattggcgtcgtcgatggcctggaccgcggcacgaatgtgcccttcttcctcgatgaagcgctcgacctggccgcgctgctcgccttcgaccagcaccttgacggtgccatccggcagcttgagcaactgcagcacggtagcgaccgtacccatgcggtacaggccatcttcgcccggatcatcgtccgcggggtttttctgcgccagcaggaggatttgcttgtcgccggtcatcgctgcctccagggcctcgatggacttttcccgaccgacgaacaacgggatgaccatgtgcgggtacaccaccacgtcacgtag

SEQ ID NO: 13813 - DNA, 408 bp, Pseudomonas aeruginosa
atcatcaggggttgcgacgagccatcgatgacactctcatcgatgaccaccttgctgacatcctgctgggagggaatctcgtacatggtatcgagaaggataccttcgagaattgaacgcaagccacgtgcaccggtcttgcgttcgagcgccttgcgggcaaccgccttgagtgcgtccggacggaattcgagatcgacgccttccatttcgaacagcttggcgtactgcttggtgagagcgttcttcggctcggtcaggatctgcatgagcgcagcctcgtcgagctcatcaagagtcgcgatcaccggcaaacgccctacaaactcgggaataagaccgaacttgacgagatcttccggttcgacttccttgaacgcctcgccgaccttcttgcccatctcctga

SEQ ID NO: 13814 - DNA, 432 bp, Pseudomonas aeruginosa
cgtcgtcgccgacgtcgccctggaagccgaagccgccggagtcacctgcgagatcagcgcctgccaggtcgaacagatccgcatcgagcctcgcttcatggcgcgcgcagtgatcaacctgctgcgcaacgccattcgccacgcacactcgcgcgtcgaaatcgccctcctcgatcaaggcgacagctgtcagatacgggtcaacgacgacggccccgggataccggcggacgcccggcagaagatcttcgaacccttttcgcgcctggacgacagccgcgatcgcagcaccggcggcttcggcctgggcctggcgatcgtccgccgggtcgcgcaatggcacggcggctatgcggaagcgctggaaacgccgcaaggaggcgcctccttccgcctgacctgggagcgaccccgttgacagcggaggcttaa

SEQ ID NO: 13815 - DNA, 1872 bp, Pseudomonas aeruginosa
catgggacacctcgcctttccgccaggtgttccatgtttcgtgcaatgcatctttcccttctcggctgcctgctcggcaccagcggctgccacggactgccgcccgccccgccagcgccgagcgccgccgtgggcaactacggcgaggtcatcgactatctgcaacgccacatccgccgggaaatggaaaggcaggacgtgcccggcctggccctggcattggtcgacgaccagcaactggtctgggcccgcggtttcggctatgccgaccgacagcacaggatcaacgccagcgagcacaccgcattccacgccggcgacctgtccaagctactgatcgccagcgcgaccctgcaactggccgaacgcggccaactctctctcgacgccccgctccaggacaccttgcgcgagttctacgtacgctcacgcttccatgccgaccagagcgaggcggatcgcgcgatcactttccgccggctgctcagccaccagtccggccttcctggcgaacacctgccgcccctgttcggcgaacgcccgagctcactcggccaactgccggcgaaagtatccggcgtctggctgagcaatccgccgggaacccaggtcgcctattccaaccttggctacgagctggtcggcgcggctatcgagcgcaacaccggaaagcacttcgagcagcacatgcgggagcacctgctggaccctttgcagatgactcgttccagcttcgccaggaacgccctgccccaggcgcaacgcgcccaaggctacagcggcggcggtcgccccggctccgccgccgccagcgacctcccggtcaacgacctgtggagcagcccggtcgacctcagccgcttcgtccgcatgctgttcgccaacgggcgccacaaggagcgccagcttctccggaaacactccgtcgaggagatgttccgccagcagaacgccggcaatgccctggacttcgactgccaggtgggcctggcctggttcctcagcccgtgcggctccgcaccgctggaaggaggcatccgtcactatgagtacgccagcgccacccgaggattcagcgcccatctgattctgctgccggaacagcgcctcgccgccattgtcatgagcaacgccgatgacagcgggtcgcttactgcctccctggcccggcaagcggcgtcgctcatgctgcaggtcaaacagggcgctcgtcgccccgccgtacagcccacccccgcgcgcgcccccgcactgaaggtgccgagcccggaggaccggcgacagctatacggtcgctacgcaacccgccaaggccagattcgcctgtacgagcgcaggggtcgcctgtacgcggatttcggcgaacaacgcgtggaactgttgcgcgacacctcgggctggctgcagatgagaaaaagactgctggggttctggcctgtcggcgtggacagcgccggacagttgcaactggacgtggtcagctacggccaacgccgaatcctggtgtcccgccgccacgaccagaccgcctacctcggcgagcgcatcgagccgacatccctgccccaggcctggaccgaagccgtcggcacctaccgcgtcgccagcacgggccggcacagctacctgaacggcctgagcatcaggatcgaagacggcttcctgctggtgcgcgggcaagccggaggaacccgctccggcgagttcatcctgcaacccatcgacagcgcacacgccgtcctggccggcagcggccagggcctgggagacaccttcagtcgcgacttcgacggtctgaacgcgctcggctaccgcttcgcccagcaagacaccaaggcacgtccctggctgcaacggaaggagtccccatga

SEQ ID NO: 13816 - DNA, 390 bp, Pseudomonas aeruginosa
aacatcgcctgcttcttgccgattcgccgaatggcgcacccggcaggactcgaacctgcgaccatccgcttagaaggcggatgctctatccagctgagctacgggcgctttattcatctgcattcaatgctgagcgcaaactttaagctctggcaatcacaaagtcagcaaccgacttgctttacctcttaccctgcgtccggctgtgctcggcaagcggggcgcatgttatacagggggcgaaaggccgtcaacgggttttttaaaaaaattcagctatataaaggagttacggcaaatccacgggtcgcctcctttgccccgggcggcgtccatgcgaaaatgcgcgtcctttttccacccgattcgatggttacccttccgacatga

SEQ ID NO: 13817 - DNA, 540 bp, Pseudomonas aeruginosa
cccgcgcctgcctgctggaaaataccctgcacgccgccgaacacctgcacgactgaggtcgccggtaatgaaaagccccgcgttcgcggggcttttcatttatcgctgcgggttcagtcggccaggcgccaggtagtgccgcccttgccatcctccagcacgacgcccatggcggtgagccgatcgcgaatccggtcggactccgcccagttcttcgccgcccgcgcctccaggcgcgcctggatcagcgcctcgacctcggccgcatcgaccttgccctcggcgcccgcctgcaggaaggcttccggctccagttgcagcacccccagcaggccagccaactgcttcaggcgcgcggccagcgcggccgccgccgacaggtcgctttcgcgcagacgattgacctcccgcgccagctcgaacagcaccgagcaggcacccgcggtattgaagtcgtcgtccatcgccgcggcgaagcgctcgacatactccgccgcttccgccggcgccgcctcgggcagccccttgagcgcgttgtag

SEQ ID NO: 13818 - DNA, 1614 bp, Pseudomonas aeruginosa
tccacggccacactcatcggccggccgaacacccgctggacatcgacggccagcccgcccggcgcatcgtgctcggcgactgggaccgccagggctgggccctggagatcgacgccaacggccatcgccaggcgcccttcccgctctgacccaccccaggcccgccatgcgggcctttcagcgaagcattatgcgattcgcattttttccgccgtccatcttgacgtcgcgggccacctttcagcaggatcgcgctcccccaccccgcatcaaggaatgatcgtgatcatctcgaagggaaacctgatcaagttcgtcgccgcccccctcggcatgctcgccctcggcttcggcctgttcaacggcgtgttcttctataacgaagccggcttcatgacccacgtaaggaccatcttcggcgacgagaagatcgtcgatgacgtcggctacgcgaccaagtggttcggtcgcgccaccacctggaagaaggccatcagcgtgcagtccgtgctggtcatggacgataacgacaccaatccggacaacgacggcctcggcgccaccatcgaggctttcccgatcgtgttcctcggcaacgtcgacgccaaggtcgaatcttccgcgcgctttcgcctgcccggcggcgagccgttcctgaagatggcccaggaataccgcaacccggacaatttcatccgcaccgcactggtgccggcgatcaaggaaaccctccaggccaccgcttcgctgatgagcgccgacgactactacgccggagcccgcagcgaattcgccgccgagttcgagaaccagctcaacgacggcctgtacctgatcaagcgcaaggaagtccgcgggccgcgcggcgccattccgcaccagaccgcgatcctccaggccggcaccgagcagggagcgttcggcgacaacaacgccagccagttcgtcaccgagaaggtcaccgatgccaagggcatcccggtacgcaagcaacagcagttccgcaagttcggcgtcgaggtggtggaagcgcggatcaccaacgtcgatcccaacccgcagtacaagcagcgcatggtcaaggtccagcaggcgctcgccgagctggcggtggcgcggcagaaccgcctgaaggaagaagaggaaaagctgctggtcaccgcccgcggcgagaaggaagtcgaggccaagcgccaggaaaccctgcgcgaccagatcgaacgcaccacccaggcggaaaccgacaagcaattggcggtgatcaacgccgagcgcgagaagcagcgcgccgagatcgagaagcagaccgccgaactgctgcgcgacaaggccacggtgaccgcccaggccaccaagatcaccgccgacgccgaggcttacgcccgcgaagcggtgatcaaggcggacggcgcgttgcagccgaagctcgacgcgctgatcgcgatcaacaaggtctgggccgaagccgccgcccaggcccccgtccccagcgtaatgatgggcgccggcgccaacggcgcggcgagccgccaggacgagatcggccagctgatgggcgttctggcgaccaaggccgcccgcgacctggccctcgacctcaaggtcaaggactga

SEQ ID NO: 13819 - DNA, 801 bp, Pseudomonas aeruginosa
tccaggcagcaaaaaaagcgccccgcggggcgctttcttgtttccggctcaggccaccaggcccaccgggtggccgctgtggaagcggaattcgttgtccggactgctgatcagctcggcctccttggcccgcaccacctcgatcgtccgctccacgtcggcctcgtcgccgtactggtaggccagcttcaggtagtcctggaaatgccgcgactcggacttcagcaaaccgccgtagaatttcgccagctccgcgtccaggtgcggcaccagggcggcgaagcgctcgcaggaacgcgcctcgatgaaggcgccgaccaccagcgtatcggtcagccgctgcggctcatgcttgcgcaccaggtcgcgcagcgccgaggcgtagcgggaggcgctgacattgaccaccgggataccgcgtttcttcaggatcgccagcacctgctcgaagtggcgcagctcctcgcgcgccaggcggctcatcttgttcaccaggtccaggcggccggagtacttgccgatcagttgcatcgccgtcgccgcggccttcatctcgcaggccttgtggtccagcagcatgacgtcctggcgctccagggccgcctcgacccaggcggcgggagtggaacaggcaaggaattggtcgatctcgggcaacatggtgcaggtcactcattctggaaagggcctgccatgacgctggtcggggcaggaaaggcggagcattatacggaagctgcggcggtcgggcaggccgacccgtttgatatgcatcaagagcagcggctggattgcgtctag

SEQ ID NO: 13820 - DNA, 2748 bp, Pseudomonas aeruginosa
aactttgaaaacagcttctgtctggaacctgccgatgccctcgtaggttggtggattaccgtccacctgggcctgacgagcggatctgcgtcggttcctggatacgtgtcccccgggaccactgatgagggaaatactgtgcttgaagcctaccgcaaacacgtagaagagcgtgccgcccagggtgtcgtgccccaaccgctgaacgccgaacagaccgcaggcctggtcgagctgctgaagaacccgccggccggcgaagaagaattcctccttgacctgatcaccaaccgcgtaccgccgggcgtcgacgaagccgcctacgtcaaggccggtttcctttccgccatcgtcaagggcgaagccacctccccccttatcgacaagcaacgtgccgccgagctgctgggcaccatgcagggcggctacaacatcgccaccctggtcgagctgctggacgacgccgaactggccaacaccgccgccgaacagctgaagcacaccctgctgatgttcgacgccttccacgacgtcgccgagcgcgccaagaagggcaatgccgcggccaagtccgtgctgcaatcctgggccgatggcgagtggttcaaggccaagccggaagtcccggaaaagctgacgctcaccgtattcaaggtccccggcgaaaccaacaccgacgacctctccccggcccccgacgcctggtcgcgcccggacatcccgctgcacgccctggccatgctgaagatggcccgcgacggcatcgagccggtccagccgggttcggtcggtccgctgaagcagatcgaagcggtcaaggccaagggcttcccggtcgcctacgtcggcgacgtggtcggcaccggttcctcgcgcaaatccgccaccaactcggtgctgtggttcttcggcgacgacattccgttcgtgccgaacaagcgtgccggcggcttctgcttcggcaccaagatcgcaccgatcttctacaacaccatggaagatgccggcgccctgccgatcgagttcgactgcaccaacctggccatgggcgacgtcatcgacgtatacccctatgaaggcaaggtcgctcgccacgacagcggcgaagtggtcaccaccttcgagctgaagaccccggtcctgctcgacgaagtccgcgccggcggccgtatcccgctgatcgtcggccgtggcctgaccgagaaggcccgcgccgagctgggcctgggcgcctccgacctgttccgcaagccggaagcaccggccgatagcggcaagggcttcaccctggcgcagaaaatggtcggccgcgcctgcggtctgccggaaggccagggcgtgcgcccgggcacctactgcgaaccgaagatgaccaccgtcggttcccaggacaccaccggcccgatgacccgcgacgaactgaaggacctcgcctgcctcggcttctccgccgacctggtgatgcagtccttctgccacaccgcggcctatccgaagccgatcgacgtcaagacccaccacaccctgcccgacttcatcatgacccgtggcggcgtgtcgctgcgtccgggcgacggcatcatccacagctggctgaaccgcatgctgctgcccgataccgttggtaccggcggcgactcgcacacccgcttcccgatcggcatctcgttcccggccggctccggcctggtggccttcgccgccgccaccggcgtgatgccgctggacatgccggagtcggtgctggtgcgcttcaagggcaagctgcaaccgggcatcaccctgcgtgacctggtccatgcgatcccttactacgcgatccagcagggcctgctgaccgtcgagaagaagggcaagaagaacatcttctccggccgcatcctcgagatcgaaggcctcaacgacctgaccgtggagcaggccttcgagctgtccgacgcctcggccgagcgttccgccgccggctgcaccatcaagctgccggaacaggcgatcgccgagtacctgaagtccaacatcaccctgctgcgctggatgatcggcgaaggctacggcgacccgcgcaccctggagcgtcgcgcccaggcgatggaagcctggctggccaagccggagctgctggaagccgacaaggacgccgagtacgccgcggtgatcgagatcgacctggccgacgtcaaggagccggtgctctgcgcgccgaacgatccggacgacgcgcgtctgctgtcgagcgtacagggccgcaagatcgatgaagtgttcatcggctcctgcatgaccaacatcggtcacttccgcgccgccggcaagctgctggacaaggtcaagggcggcatcccgacccgtctgtggctggctccgccgaccaagatggacgcccaccagctgaccgaggaaggctactacggcatctacggcaaggctggcgcgcgcatggaaatgccgggctgctcgctgtgcatgggcaaccaggctcgcgtccagaccggttccaccgtggtctccacttcgacccgtaacttcccgaaccgtctgggcgatgccaccgatgtgttcctggcatcggccgagctggcggcggtctcctcgatcctcggcaaactgccgaccgtggaggagtacatggcctacgcgaaggacatcgacagcatggctgccgacgtctaccgctacctgagcttcgaccagatcgccgagttccgcgaagcggctgcgaacgccaagatcccggtcgtccaggcctga

SEQ ID NO: 13821 - DNA, 594 bp, Pseudomonas aeruginosa
tccagcgacgcgtcgaacaagccccgccccgtgcggggctttttcttgcccggcgaaaccccccgcgccgcctggcatagcgcttgctgtggcagctatggaaaagcgcgccgacgacggcgccggcgcactggaaaacgggacggcccgcgccgccctcccgcacttgaggtggtgatgacagacagagcgatacgcagccaggcctgggccggcggttccgacgcaccggaaaagagcgccctggacatcggtttcatggcgctgaccgattcggcctcgctgatcgtggccgccacccagggcttcgcccagccctacggcctcacgctcaatctcaggcgccaaccgtcctgggccaccttgcgcgacaagctgctcagcggcgagctggatgccgcgcagtgcctgtacgggcttgtctacggcgtccagctcggcctcggcggcagcgcggcaagcgagatggcggtgctcatgggactgtgccaaaacggccaggcgatcaatctttccgaaccgcctgaagcaagctggcgtgaccagtgcgggaggcactgctccggcatcggcgccagaatggtgcacgcctga

SEQ ID NO: 13822 - DNA, 831 bp, Pseudomonas aeruginosa
ccctggggcagacctttccccaccggtacccacgcgctctggctgaactactgggctcccgagcatcggtctgcatacgctgcacgacgtgcacagtgtggtggttccaccggcgcagatggtcggccatctccaggccgggcgcatcgacgggttctgcgccggcggcccctggggcgccctggccgtggaccagggccagggcttcaccatcgccaccagccaggcgatctggccggaccacccggaaaaggtcctcggcactacccgcgccttcgtcgacgcctacccgaacaccgcccgcgcgctggtcatggcggtcctcgacgccagccgcttcatcgaacagaacgccgagaaccgcctgggcaccgcgcaactgatcagcggccgcgactatgtcgacgctccgctcggcgcgatccagccgcgcttcttcggccgctaccaggacggcctcggcaacgcctggcaggacccacatccgctgcgtttctacgccgacggcgaagtcaaccggccctggctctcggatggcatgtggttcatgacccagttccgccgctggggcctgctgcgcgaagacccggactacctgggcatcgcccgcagggtccagcagaccgcgctgtaccgcgatgccgcgacggcccttgggctacgcctggacggcgccgacatgcgccgctcgacgctgatcgacgggcgcacctgggacggcagcgaccccgccggctacgcccgcagcttcccgatccacgccctggccgaaaccggccagggcatcgccccctgaccctggtgcgcccgccatgctgcgtatcctgctga

SEQ ID NO: 13823 - DNA, 318 bp, Pseudomonas aeruginosa
tgcgccgcgccatccagtccggggtcagcgcctacatcgtcgaaggcatccaggccagccgcctgcaaccgatcctcgacgtggccatggcgcgctttcgagagcgaccaggcgctgcgtgctcaactgcaggcgcgcgaggcgcagctggccgagcgcaagcgcatcgagttggccaagggcctgctgatgaagatgaagcattgcggcgaggaggaggcctacacgctgatgcggcgccaggccatgagccgccagcagaagctgatccaggtcgccgagcagatcatcgccatgcacgacatgctcggcggctga

SEQ ID NO: 13824 - DNA, 921 bp, Pseudomonas aeruginosa
ccgcaacgtgtcgatcctcgagcaggtacgcctgggcgagcgcttcaactacagcctgcgcgtcacctccagcggcgagttggcggtgcgcgcacgcagccaggacggcgaagaggacgcttactaccagaccctcggcagcgcctggaacgaccagttgctctatttcaaggccggcgcctacgtgaacgacaacgccggcgacagcggcgaaggcagccgcgtgaccatctaccacctgaacaccgcccatcgctgaaccgccgacggcgcacggacgcgccgccccagccctgtgcaagcccccgacgcctgccaccgcggcgtgcacgcccgacgccatggttgtccctgcaaccgctctacgccgcgctttcgacaacttggcaaagagcttgctacgtcctgcctgacggtagccaacggcggttacccatccccgacaaagacgtcgcgcggcctctccttcccggcagaggcccgtggcgtcttcgtcgtttcgccccagcgtcggggcgggtgggtggtccgctgtcggacgctcaccttgtagcgatgcaacttccgccgggcggccgttccgccccgattccgctggatacgaggtgttcgatgaacaacagcttctggaaggccggccatgcgccgaccctgttcgcggcgtttctctatttcgacctgagcttcatggtctggtacgtgctcggcccgctgggggtgcagattgccggcgacctgcaactgagcacccagcagcgcgcgatgatggtcgccacgccgatcctcgccggcgccgtactgcgcttcctgctcggcctgctggccgatcgctggtcgccgaagagcgccggcatcctcgcccaggtcatcgtcatcggccgccctcgcggccgcctggctgctgggcgtgaacagctatga

SEQ ID NO: 13825 - DNA, 2085 bp, Pseudomonas aeruginosa
  unsure (1001): Identity of nucleotide at the above locations are unknown.
gcaggcactgctgctggggttgttcctcggcttcgccggggcatccttcgccgtggccctgccgctcgcatcgcaatggtacccgccgcaacaccagggcaaggccatgggcatcgccggcgcgggcaactccggcaccgtgctcgccgccctcttcgcccccggcctggccgccgcgttcggctggaacaacgtgttcggcttcgccctgctgccgctcgtcctgaccctcctggtgttcgccatggtcgcgcgcaacgccccgcagcggccggcgcccaaggccatgggcgattacctgaaagccctcggcgaccgcgacagctggtggttcatgttcttctacagcgtcaccttcggcggcttcctcggcctggccagcaccctgcccggctatttccacgaccagtacggcctgaacccggtgaccgccggctactacaccgccgcctgcgtcttcgccggcagcctgatgcgcccgctcggtggcgccctcgccgatcgcatcggcggcatccgcagcctgctgatggtgtacaccctggccgccatctgcatcgccgcggtcggtttccacttgtccagcgcgatggccgccctcggcctgttcgtggtcgccatgctcagtctcggtgccggcaatggcgcggtgttccagttggtaccgcagcgcttccacaaggaaatcggcgtgatgaccgggctgatcggcatggccggcggcatcggcggcttctgcctgactgccggcctcggcgcgatcaagcaaagcaccggcgactaccagctcggcctgtggctgttcgccagtctcggcgtgctggcctggttcggcctccacggggtgaagcggcgctggcgcaccacctgggggctcggccgcggtcaccgccgcgcgggtctgagcgtggggctgcgactgagcattggcgaggccagcgcctgcgggcctcgcacggaaaaccaggatgcgctgcgggtggtcaccccggcgccggccntggccgccagcaagggacacctgctggccatcgccgacggtgtcagccagtgcgccgatggcggcctggcggcgcgcagcagcctgcaagcgctggccctggattactatgcgactccggaaacctgggccatcgtgcagtccctggaccgcctgctgctggcgcagaaccgctggctacaggccaacggcggcggccagccgctgctcaccaccctcaccgccctggtgctgcgcggcacccgctacaccctggcccacgtcggcgattgccgggcctacctgtggcgcgacggcgagttgctccggcagaccagcgaccacgtctgggaacagccgcacatgcaacacgtgctgacccgcgccctgggactggaccagcatctggtggtcgactatctggaaggcgatctggagcccggcagccagtggctactggtcagcgacggcgtctgggcgacgctgggcgacagcggcatccgcagcatcctgcgcaacgccgaggagccgcagcgcagcgccgaggccctggttcgcgccgcccacctggcaggcagccaggacaacgccagcgccctgctggtacgcgtggaagccgtgcccgcaggcagcctcggcgacgccctcgcgcaactgggccactggccactgccgccaccgctgaagcccgaccagctcttcgaaggctggcgggtccggcagttgctaggcgaatcccgccagtccctgctctaccgggtcgaagatggccagggccaaccctggctgctgaagacccttcccgccgcacgtgccgacgatccgctggcaacccaggccctgctgctcgaggaatggttcctgcgccgcgtccagggccggcatttccccgagctgtacggattggcgcaacgccagcatctgtattacctgatgcgcgagcaccccggagagactctcgccgagcgcttgcgcaaccatggcccgctgtcgctgccggagtggctggggctggccaaccagctgctgcgcgggcttggccagttgcatcgacgcaacctgctgcaccgcgacctcaagccggaaaatctccacctcggccgtga

SEQ ID NO: 13826 - DNA, 2685 bp, Pseudomonas aeruginosa
gcaatagcgcaagttggcacggcgcctgcttgggttctcccgacaatcgacaacaaagcgcctgcctcaacgacgaggcggcgtttcccgaccgaacgggacctggacaaaggcgtcctgctggcaacagcgggacgccttttttgtttgcgccaaccttatgcaggagctactccgcatgaagaagatcaagctggtgatggtcggcaacggcatggccggggtccgtaccctggaagaactgctcaagctcaactcggacttctacgacatcacggtgttcggcgccgagccccatcccaactacaaccgcatcctgctgtccccggtgctggccggcgagcagaccttcgaggaaatcgtcctcaacgacctcaactggtatgcggaaaacggcatcaagctcctcctcgaccgcaaggtggtgcagatcgaccgggtccgccgcagggtggtcgccgcggacggcagcgaggccgagtacgaccgcctgctgctggccaccggctcgctccccttcatcctgccgatacccggcaatcgcctgcagggcgtgatcggctaccgcgacatcgccgacacccaggccatgatcgactgcgcccggacccacagccacgcggtggtgatcggcggcggcctgctcggcctggaggcggccaacggcctcaagcaacgcggcatggacgtgaccgtcgtgcacctctccgactggctgctggaacgccaactggaccgcaccgccggcaaactcctgcaaggcgcgctggaagcccgcggcatccgcttccgcctgaacacccagacccaggaactgatggacaacggcagcggccgggtctgtgccgtgcagttcaacgacggcgacgtgattcccgccgacctggtggtaatggccgccggcatccgccccaataccgagctggccgaaagcgcgggcatcccctgcaaccgcggcatcctggtcaacgacaccctgcagacctacgacccacgcatctatgcggtcggcgaatgcgccaaccaccgtggcatcgcctacggcctggttgcgccgctgttcgagcaggccaaggtctgcgccaaccacctggctcatctcggctacgcccgctaccagggctcggtgacctcgaccaagctcaaggtgaccggtatcgacctgttctccgccggcgacttcatcggcggcgaaggcagcgaaaccatcaccctttccgaccccatcggcggcgtctacaagaagctggtgatcaaggacgatgtactggtcggcgcctgtctctacggcgacaccgccgacggcggctggtacttccggcagatccgcgagaaccacaacgtcgcgcagatccgcgaccacctgatgttcggcgagaacgccctcggcgatgtcggccaccagggccagaacagcgccgcgagcatgcccgacacggccgaagtatgcggctgcaacggcgtctgcaagggcaccatcgtcaaggccatacaagaacacggcctgttcagcgtcgacgaagtcaagaaacacaccaaggccgccagctcctgtggctcctgcgcgggattggtggaacagatcctgatcagcaccgtcggcggcgccgccgacgtcaagccgaagagcgagaaggccatctgcggctgcagcgacctcaaccacgggcagatccgcaaggccattcgcgaacaccggctgaccagtctcgacgccgccatgcgcttcatggactggaagaccccgaacggctgtgccacctgccgtccggccctgaactactacctgatctcgacctggccgggagaagccaaggacgatccgcagtcgcgcctgatcaacgaacgcgcccacgccaacatccagaaggacggcacctactcggtggtaccgcggatgtggggtggcgtgaccaacgccgccgagttgcggcgcatcgccgacgtcgccgacaagtaccaggtgccgatggtcaaggtcaccggtggccagcgcatcgacctgctgggggtgaagaaggacgacctgccggccatctggaaagacctcgacatgccctccggacatgcctacggcaaatccatccgcaccgtgaagacctgcgtcggcagcgagttctgccgcttcggcacgcagaactcgacgcagctgggcatcgatctggaacacgacctgttcaacatgtggtcgccgcacaaggtcaagctggcggtctccggctgcccgcgcaactgcgccgaggccgggatcaaggacgtcggcatcatcggcgtggactccggctgggagatgtacatcggcggcaacggcgggatcaagaccgaggtcgcggagttcttcgtcaagctcaagaccgccgaagaggtgcgcgaatacaacggcgccttcctccagctctaccgcgaggaagccttctatctggagcgcacggtgcattacctgcagcgggtcggcatggagcacatccgcaaggcggtggtcgaggacgcggaaaaccgcaaggcgctcaacgaccgcctgcaattcgccctgtccttcgagcaggacccatggaagcagcgcatcgaacagccgcaattgaagaaggagttcgaacggattccgctcaagcaactggaaaacgtctgaatcccttgtccgggccgtcccacggcggccctccccctaccggagtgaaccgatga

SEQ ID NO: 13827 - DNA, 1623 bp, Pseudomonas aeruginosa
tctacggcaagcgagtggcctgtccgttgcacaactggcagatcgaactggagagcggcgaagccgtggccccggaccagggctgcgcccatcgccacccggtgcgggtggagaacgggcgggtgctgctcggcctggacagcgtggcgctgtgcgcctgatctctcgccgataacaggagccgagcatgtcgacagattccccgctgcgcaccaccgcttcgacctgctgctactgcggcgtgggttgtggcgtcctgatcgaacacgacggcgaacgcatcctcggcgtgcaaggcgatcctcggcacccggccaacttcggcagactctgcagcaaaggcgccagcctgcacctgaccggcgacctccaggcccgcgcgctgtacccccaactgcgcctcggcaagcaactggcgcgggctcgcagcgactgggagagtgccctggaacatgccgccgggcgtttcgccgagaccattcgcgaacatgggccggacagcgtggccttctatatctccggccagttgctgaccgaggactactacgccttcaacaagctggcgcgggccctggtcggcaccaacaacatcgacagcaattcgcgcctgtgcatgtcctcggcggtggtcggctacaagcgcagcctgggcgccgacgcaccgccgtgcagctacgaagacctcgactgcgccgattgcgtgctgatcgccggcagcaacatggccttcgcccacccggtcctgttccgtcgcctggaagccgccaaggccgctcggccggagatgcgcatcgtggtgatcgacccgcggcgcaccgacacctgcgagctggccgacctgcacctggcgctgctgcccggcaccgacgtcgcactgttccacggcatcctgcatatcctgctctgggaggactggatcgaccgttcgttcatcgccgagcataccgagggtttcgccgacctgaaggaactggtgcgcgactacaccccggccgccgtcgccgacatctgcggcatcgaccgcgccgacctgcagcgctgcgccgaatggatcggccgttcgccgcgcttcctttcgctctggtgcatggggctcaaccagtccagcgccggcagcgccaagaacagcgcgctgatcaacctgcacctggctaccggcaagatcggccgcgccggatgcgggccgttttccctcaccggccagccgaacgccatgggcggtcgcgagaccggcagcctggccaacctgctgcccggccaccgcgaagccgccgatcccggccatcgcgccgaggtggcgcactactggggtgtggaacagttgcccacgtcccccggtctcagcgccatcgagctgttcgatgcggtccacgacggccggatcaaggcgctttggatcgcctgtaccaaccccgcgcaatcgctgccggaccagcgcaagatccacgaggcccttgcccgctgtcccttcgtggtggtccaggaagccttcgccggcacggaaacctgccaatacgccgaccttttgcttccagccgcatcctggggagaaaaggaaggctccgtgaccaattcggaacggcggatcagtcatgtccgtcgggccgttccgccccccggtga

SEQ ID NO: 13828 - DNA, 1407 bp, Pseudomonas aeruginosa
acggttggccagcgacacaagctctccctcttccgtcagcaggatggtcttgaccgtacctatctcttcaatagtgccttcaacgtcacccactttcacctgttgtccgacctgatacagctcgcggacgtagattcctgcaatgatctgcccggcgacctcgcggctgcccaggcccagggccagcgcagcggccaggccgacggtgatcagggcgatggcgatgatgtagttgagcaggtcggtcttgacctcgagctgccccaccgccaccgagatgctgatgatgatgaccagccactgggcgatccgccccaggccgttcgcgtattcgaggccgacgccgtccgccgcgccgcgcacgacgctgttcaccagttgcgccaggagcacgccgacgatcagcaccagggccgcgccgaacaccttgggcaggtacagggcgaggacgtccagcgtggcggatacccgctgcaggccgagcgactcggcggcggatacgaggaagacgagcagtacgaaccagtagacgatcttgccgaccagcgtcgagaccggaacctggatgccgacccgggccagcagcttggtcaggccggtgccacccatcagccggtccaggcccagcttggccagcagcttggaaagcagcgcatcgagcagcttggcgatgacgaagccgagcagaacgaccaccagggcgccgagcaggttggggatgaagcctgccagcttgccccacagggtgttcatcgcggtcagcaagctctgggtccagatatcgaattgcatgttcactcagccttgtcagcagaagatgcgtttttcgcggaaatacgggaaaccggcgccagatgcggcgaaccgttgttgatgccgatcatcagcgcctgcagccagtgccccatgaggctgaacaggtcaccggcgccgacctggcgattggcggtcttcagcacccgtcccagacgcgcgtcgtcgtccggctggggagccgaagccttgagcaggtcccgcagggactcttcgaacggatcgtgcatgcgcacctcatgtctgtacgagggagtgacgccctctcctcaccccaggtcacgtcagagccagcgcagccgacgaaatacccaccactggaaggtggcgaccccgccgatcagcaggcaggccagccagaacccatgcggtgcatccgcccctggaatgccgccgacattgattcccagcaggccggtgacgaagctcatcggcaggaaaaagccggtgattataccaaggagatacatggtgcggttcatccgttcggtgattcgccgcgactcggcttcctgcaggacgctgatgcgctcccgtatcaactcgagttcttcgagattccgcgtcagccggttgttcagctcgttccagtaa

SEQ ID NO: 13829 - DNA, 408 bp, Pseudomonas aeruginosa
tacacgacctcggatgctgtcttcggccctttccccgcctccaggtcctcgagcagatcggccaccgccttcagcggccgcaggcgcagcgagatcacccggcgcgcgtcggcgaatacccgcagcgaaaccatgtcttccggctccgcgcccggattcaggttcactccacggaggaacaccagcaggctttcggccccgagatcgagcaaacgggggcgagtcgcctcctccagcagcagatcgcaggcgaactcgctgagccccgcggaatcccgcagccaggcctgcgcttccggcacgccgcggtcccagtgcagccaaaggctttcctccggcagcaggtcgagcaccgctatctggttgcgtccgacacggcgtccgccgccgcgcccgttgaggacgtag

SEQ ID NO: 13830 - DNA, 468 bp, Pseudomonas aeruginosa
ttccggcttccgatacgtctagcgcctcgctccacgcggattcgtcgcccgccggcgatcgctggcgcagccagcgctccaccaagggccagacctctagctgggccgccttgccgatcagcatctcgatatgcccgtagtcctcggcgtagccagcctcgcgtccgagcaacaggtattcgcgctcggacgaggcgaactgctcgaacaacttgcgacaggcccaggacgggtcctgccggtccccagccccggcgaccgccaatagcggtacgtcgactgcggcgagccccttccaccagtcgttgcccggctcgccgaagcggccgaacagcccatgccaacgcaggacctccagcgccaggccgaccggctcgtcttccggcccctgccgccaacggcttccggacagcgcatcgacgcggcgcagcagcaggcgcgcgaggatgcctgccatgggcaacctga

SEQ ID NO: 13831 - DNA, 465 bp, Pseudomonas aeruginosa
ccagggcgacaggaaagaggcgactactgctttgcatgcttgtcttgtacaggaggcacgaaaaagggcggtgttacccgccctttccggatacagcgaggaccgatcaggcctggtcttgcccctcggcaaggaagaaccaggtatccagcaccgagtcggggttcagcgagacgctctcgatgccctgctccatcagccagcgggccaggtccgggtggtccgacggaccctggccgcagatgccgatgtacttgccggccttgttgcaggcagcgatggcgttggccagcagcttcttcaccgccggattgcgctcgtcgaacaggtgggcaacgatgccggaatcgcgatccaggcccagggtcagctgggtcaggtcgttggaaccgatggagaagccatcgaagaactcgaggaactcgtcggccagcagggcgttcgacggcagttcgcacatcatga

SEQ ID NO: 13832 - DNA, 678 bp, Pseudomonas aeruginosa
aatgcggcccgcatgcgcctggcggggcgcccggcatgcccggcctgccgagcgcaggtcgatgacgcagggttttccgtcacggactggacagcgatcgcaagatcgacccgccgaacgcgacaccaaccaggacttatgaaactcaagcccttagctcccctgctctgcctattcatcgccgtaccaggcctgagcgtagccgccgaaaagacggtctacggcctgaacgaatacgcgcgcatcaacgacccggacatccagctggccgccaagctcgacaccggcgccaagaccgcctccctcagcgcccgcgacatcaagcgtttcaagcgcgacggcgaaacctgggtgcgcttctacctggccaccgacaacgccgacgacaccccgatcgagaagcccctggcgcggatcagcaagatcaagcgccgccacggcgacttcaaccccgacgagggcaaggcctataccgcccgtccggtgatcgagctgcaggtctgcatgggcaaggcgattcgcaccatcgaagtgaacctgaccgaccgaagtgcattccaatacccgcttttgatcggctcggaggccttgaagaaattcgacgcactggtcgatccgagcttgaaatactcggccgggaaacccggctgcaaacctgatgcaaaacctgctgagtaa

SEQ ID NO: 13833 - DNA, 540 bp, Pseudomonas aeruginosa
agcgcgccgcgcgctcctcgagcgggatctgcgagttgtgcatgcggcccttctcgtccacccaggtgtagtagggactgccgttctcgctgcgaacgaaacccttgccctcgaaggcctcggcgtcgatgtattcggcggagtgctcgccgttgggcaggacgtagtcggcgcgctggccggcgacctgggcgccggcatagaagctgttctgcacgttgccgttggcatcgatccaggtgtagtagcgacgcttgctctcccctccgctgctgttccccggccactgcgtggcgttgtccgccttgttcagcacccgcgcctggtcgctctggccgatgcgctgccgcgcctggcgctgctggcggtcgaactggccgtcgacgaaggtgttgtgcaccccgccattgtcgtccacccaggtcaggtagcgcccgccggaggcccagcccggcgaagatgccggcagcgccagggagaagacgcaaagtacgatggatgcgcgcatcatgctccagccctcagaaggtcgtacggtag

SEQ ID NO: 13834 - DNA, 465 bp, Pseudomonas aeruginosa
gcagttccaccggcgtcgcgacatcccgccagaccgtcgccagcggtagttcggcgagcacgccggcatgccggtcctgctcgtagagcaggtcggcataggccagcgacaagggtccgccgacccggctgcgccggccgaatacctgctcgacccggttgcgcgccgactcggcgatcgccctgccccgctccagatcgccactctccttgcagatcagggattcgatcaggctggtcaccacctgcaggtactcgctgtcggcgactttcaggtcctcccgcgcggaaccgatggcgccggcggcctcggcgtagtcgccgagcagcgcatgcgccgaagcctgcacgcagagcaggctggcgcggaacaccggctggttgctcggaaccatggacagccagtgacgggcgaccttcaggcaggcttcgagcttgtcctggtagagcaacaccagggccttga

SEQ ID NO: 13835 - DNA, 2316 bp, Pseudomonas aeruginosa
cgccggctggcgctcggtggattcgagttgctggagcaactggcgaatgccgtcgccttcctcgatgaagaggctgcgcaccccttcccgttcggcattgatcaggcattcgccgagcaggctgttggcccgttcctggtagcccaggcgctgatagctgagcgccgccaggatatccaggcgcaggcgctgcaggccgtgccagccgggctgcaaggtgccgcgcaactgagtgatctcgtgcagcgcctcgctgaaatgtcctcgcccctgcaacaggcgcacgcggctcacgcccagcgaccagttgaccgggttgaaggccatgttgcggtagtgtgccgccatcttgttccagtccacgctcttcaaccgctgctcggcgcgcttcaggcggtcggggccgctgtcctggaggatcaggttgatctcttcggccatggcctgggcgaagaagcgccacgactgattgcgcgaggccagggcctgcatcgccgccaggctggccagcgcctccttcggccgtcccagcaggcgctgggtgcgcgccaggcagatctgtccctgggcatagaaatcgatcggattgatcacatccacatgcccgagcgcccagcccaggcgctcttccagcccgtccagctcgatcctgtagtaggcggtcagggcctcggtgatggtcggcagcgccagcgcgctcctggacttctcgaacagcggccgggcgcgctggcggagccgctcgatgagcagttgcgcctgtttcacctggccctgctcgagtgcgaggatcacctcgacgttggccagttgcatgtccaggtagcgcccttcgaggaaatgattgcgctgctgcgccagccccagcaggcgccgcgcctggtcgccctggccacggaccacctgggccagcgcggcggtgatcaacaccgccacttcgaggaaggcagcgttctgcccgagctggacttcgacccggcgagccagggcgatgcacagttccagatcgtccttctgcaacgccaccaccgccttcaccgccagcgcggagaggtactggtcgcccatcggcccgtcgccgcggctctccccccagcgcgccagcagttcgtcgatgatccggttggcctcgcccaggctgaggtcgctggcccgcgaccagacatcggtaaggaccaggatcggatagcgctcggcgatttcgtccggcacatgcttgcgccaacggtagatcaggctgagctggccgcggttgatcagttccagtccgcatccgtcgaccagcgcggcgatcatctccgggtcttccgccgcacaggcatgctcgatggcgaacgtcggcatgtggtggttggtgaaccacaggctggcgttgaaatgcagttgcttgaaacggtccggatcggagtcacgcaggcggttgcggaggaagtcggcgaacagcaggtggaagcgataccactggcgttcgcgatccagcggcaggaggaacaattgcatggactccaggcgctccagcagcgcctggccgtcctggcgcccggtcagggcgttggccaggtcgccgctcaattggctggcaacgccaagggccagcagcgcttcctgcaggtcgccaggcaagcgttcgaagaccgccgccagcagataggcgctgaccgcctgcttgtcgccgtcgagcagggccatttcctgcacctgcggttgctggcgcagccacaggctgacgagatgcacgcccaccacccagccttcggtctggccatagagcgccttcaggcagggctcgtccagatagagaccgctgcgctcgaggtattcgcgggtttcctcgaagccgaggcgcagctcctcgaggccgatttccagcaacagtcccttggcccgccaggtagccaggctcagcgccggctgcgaacgcgtgcccagggccaggaccagcccgggcggtgcgtactgcaccaggcggttgaggccggtgaagatgtccgggttgctaaccaggtgcaggtcgtccagcaccagcagcaacggccgcgcatagcgatcgagatcgccgagcaggctttcgatcaccgccaccaccgggacccgcatggtgttctgcaggtaggtctgggcgtcgtcgccaagctgcggcacggcttcgcccagcgcctcgatgagctgccggcagaaacgggcggggtcgtcgtcttcttcggccagcgacagccaggccaccgcctggtctgctacagtgcgctccctggccagggcggcgagcgcgcaggtcttgccgaagccggcaggtgcggaaaacatcagaacgcgtga

SEQ ID NO: 13836 - DNA, 462 bp, Pseudomonas aeruginosa
gcagcgtcaccggcgaactggcgccgggcaaggacgccctcgacctgctggaaggcagcttccccggcggctcgatcaccggcgcgccgaagattcgcgccatgcagatcatcgacgaactggaaccgagccgacgcggcatctactgcggcagcctgttctacctcgacgtgcgcggcgagatggacagctcgatcgccatccgcaccctgctggtcaggaacggccaggtcagttgctggggcggcggcggcatcgtcgccgactcgcactgggaggacgagtaccaggaaaccctggacaaggtccgggtgctgctggaaaccctggaagggatggccgggacagcgtccccggaatagaaaagagcccgcgttccgcgggctctttcatcggcggcgcggctacagactcagcgaacggctggaagccttgaggaactcgcgcttgaggtcttcgtag

SEQ ID NO: 13837 - DNA, 660 bp, Pseudomonas aeruginosa
tccggaatgtcccgggtggtcgccttcaaggcgtcgataccggttttttccgcgaacgcgatccagatttccggaaccagcacgccttccaggtcaagacaggcaatttccacaggactctcctcgaaattctctgaacgatggggtgacgacggacgcggcactctagcccctcgccgagggcaaggcaacgccggcttattcctggaatcaaggtcgacaggggtaaatggttatttagggccatatgccgccctttgctaccattcccgccacagagcgcaacagcgccgcccagcaccaggaccccagcccgatgagccagcctttcgaccttcccgccctcgcttccagccttgccgacaaatccccccaggacatcctgaaagccgccttcgagcacttcggcgacgagctgtggatctccttcagcggcgccgaggacgtcgtcctagtagacatggcctggaagctcaaccgcaacgtgaaggtgttcagcctcgacaccggtcgcctgcacccggaaacctatcgtttcatcgaccaggtccgcgaacactacggcatcgccatcgacgtgctttcccccgacccgcgcctgctcgaacccctggtgaaggaaaagggcctgttcagcttctaccgggacggccacggtga

SEQ ID NO: 13838 - DNA, 1635 bp, Pseudomonas aeruginosa
ttttgcacgctttttcaccagccgaccgctggcctacaggtcgcgactacggtgctgcaacatcggcaccaggtacaccggtacctccgccagttgcaccagacgcgcggcagtccggcccagcggcgtgtcgagttgagtgccgtggctatggctgccggcgacgatcaggtccacggccagcttttccgcctcatcgaggatcatctgcggcgggtcgccctgcaccacccgcacgctcttgaccagcgccgcatcctggggcaactcgccgagttcatcgcgaaacccttccaggacccgcttctcgatgctttccatgacgttgtccagcccttgcgcccgcaggtcctggagacgctcggtgtcaaggtaggtctgcaggaccgactcggcgaacagcccgaggggctccaccacatggacgacatagagctcggcgttgtaggcgcgggtcagcgacagggcgtgttgcaggacatagggagcatagagccccagatcggtggcgtagagaatcgaacgaatcatgcggcctcctcgacagcctgcgcggcgggcctcattagcagattagcagcaagcatccattctcctagcgttccctgctgtttcgggctttttccggcccgttggggtaaatcccttttctccctgcgagcgcggcgccggctggtcgccgcgctcggcccttcagcgcggttgtgcttcgaggaagcgcaacgcctggtacagcgcctcgaccctgggcatccggtagcccgcagcagcagcgcgggccaggggcgcggcatagatcgccgccagctccaatggccgcccatgggcgaagtcgtggtacatgctcggccgatagtcgggcatccgctcggtcgccgccagcagttggtccgcatagccctcaggcaggatgaagccgcaggcgccggcagcaccgatgacttcctccatgatcgcctcgatcagcgaccgactgtccgcgttggccatcagcggcgcggtgctgctcttcagcaataccgacagcccgttgtaggggatgttccagaccagcttctgccagcgcgcctgctccaggtcgggcatcgccgtggactccagcccggactcgcggaacagcgcggcaccctcctcgacgatctcgcgccggcgtcgctcgtcggccggtccggaatgatagccgagattcactccgccgtaggcctggtgctcgatcacgcccggttcgccgcgatgcacacagatgaagcagaggccgcccagcagatgcaggctttccggcagcagcggccgcagccgctcctccacgcccagaccgttctgcagcagcagaaccttggctcccggcgccgccgctgcgcggatcaggggtgccagttcgtgattgccggtggtcttggcgcccaccagcaaccagtcgcagggcggcatgtcctgcgccgaatggtaggcctggaccggcgccaggcgccggaagccatgcaccgcactattcaggctgagtccggcgcgattgaccgcctcgaactcgctgcgcaggagaaaatgcacgtcgtgaccggcatgcgccagcatcaatccatagaagccgccgatggctcccgtaccgatgacgccgatccgttgctgctttga

SEQ ID NO: 13839 - DNA, 723 bp, Pseudomonas aeruginosa
ggtctgcgccactccaccaaaaggaatcctgccatgagcgagttgatcagctaccagttcgaagacggcatcaccaccctgaccctcaacaacggcaaggtgaacgccatctccccggcggtgatcgacgccttcaaccaggctctcgaccaggccctgcaggacaaggccgtggtcatcgtcaccggccagccgggcatcctctccggtggctacgacctgaaggtcatgacctccggcccggagaatgccgtcaacctggtcgccgccggctcgaccctggctcgccgcctgctctcccatccctatccggtgatcgtcgcctgccccgggcacgcggtagccaagggcgccttcctgctgctctcggccgactaccggatcggcgtcgacgggccgttccagatcggcctgaacgaagtcgccatcggcatgaccatgcaccatgtcggcatcgaactggcccgcgatcgcctgcgcaagtcggcgttcacccgctcggtcatcaatgccgagatgttcagtccggccgctgcggtggatgccggcttcctcgacaccctggtcagcgccgaccagttgcaggaaagcgcgcgtgcagcggcccagcagttgaagaaactcaacatgaccgcgcatcgcaataccaagctcaaggtgcgcaaggcactgctggaaaccctcgaccaggcgatcgagctggacaagaagcacctgggctaa

SEQ ID NO: 13840 - DNA, 636 bp, Pseudomonas aeruginosa
tcgctcgccgcgacggccaggccagcgattgcgagcgcatcacccgcctcctcgaacgttccgccgagcgacgctacccgctggccaacgcgatgctctacaagatctacgccgagcccttcctgttgccgcgcgccgacattcccaaggccgagacctatcgccaggcctacgccgagctgccggtcgcgcgcagcggctacccctccttcgagcgagcccggcaggtggtcgatcgcctgctcgcgccgacttcgtcctgatccatcgggcccgaacccgggccccgcaacccgtaccggtcgttcggccaaagcatcatttctgtcgatagttaatagcgcgacaattcgttatccaatcgaattcttctccgcgatcctatgcccatccgaggtatcgatcacggaagccgccatgaaacgtcgcagcccacgccattacgcccgcaacaccgccctggccaccctgggtctgtacgccatcctcatgctggtcgtgttgagcctcgtcgccggcgccgaaagcgccaggaacgccacaccggacaacgacaccgccacgaccttctccaaccagatcggccaggccctgccaggcctgctctcggggttgaacagtcgacgcgccggttga

SEQ ID NO: 13841 - DNA, 267 bp, Pseudomonas aeruginosa
acgccggcttctttcccgggaaacagcatgagaaggcaaacacggaaattctggatcgtcgccgccctggcgatattgaccaatggctactcgctactcggcctcgcccaaggctcggcaggcgcactggcgcgcaccatcgaatgcaaccaggcgatggtccgcgcgctggcggccaacctggcgctgaagctgcagagcggcaccccgccggcacgcccgcagcgctggatcccggagcgcttcatcctcgactgcccggcctga

SEQ ID NO: 13842 - DNA, 405 bp, Pseudomonas aeruginosa
gcggcgcctccagcgtggcgcactcctcttcggcgaggtccagcgtcagcgccgcgagggcatcctcgaggtgatgcggcctggacaggccgacgatcggcgcggcgacaccgttccggccaagcagccaggccagggcgagttgcgccggtggaagcccgcgggcagcggcgagtttctccaacgcgccgagggtcgactcgacttcctccctgccgccgtaccagcgcggggcctgttcgtccgtccgggtccgcagcgtgccggcgcttcgcgctccggccagcagcccacgcgccagcggcgaccagggcgtcaacgcgatcccctcttcccggcacagcggcacgaggtcctcctcgtcctcgcgaacgatcaggttgtactggctctgcatcgagatga

SEQ ID NO: 13843 - DNA, 1122 bp, Pseudomonas aeruginosa
cgcaggttgcgccgctccagttcgtcgagcagcgtgccgaggatgatgcagccggtggcgccgagcgggtggcccatggcgatggcgccgccgttgacgttgaccttgctttccgccacgcccatgtccttcatgaacttcatcaccaccgaagcgaacgcctcgttgacttcgaacaggtcgatgtcttccaccttcaggccggccttggccagggccttgcgggtcgccggcgcggggccggtaagcatgatggtggggtcggtggaggtcaccgcggtagcgacgatccgcgcccgcgccttcaggcccagttcgcggcccttggcctcggagccaatgagcatggcgctggcgccgtcgacgatccccgagctgttgcccggcgtatgcacgtgctcgatgcgctcgacctggctgtacttgcgcagcgcggtggcgtcgaagcccatctgccccatcatctcgaaactcggtttgagcgcggcgagcccttccagggtggagtcggcgcgaatgaactcatcgtggtcgagcaggacgatgccattctggtcggcgaccggcaccagcgacttgccgaacagcccttcggcgcgggccttggcggccttctgctgggagcgcagggcgaaggcatcgacatcggcgcgactgaagccttccagggtggcgatcaggtcggcgccgatcccttgcgggacgaagctggtgtgcaggttggtttccggatccagtgcccaggcgccgccgtcggagcccatcggcacgcgtgacatggactcgacgccaccgaccaggaccaggtcctcgaagccggagcgtaccttcatcgcccccaggttcaccgcctccaggccggaggcgcagaaacggttgatctgcacgccggcaacctgttcgtcccagtcggccaccagcgccgcggtcttggcgatatcggcgccctggtcgcccaccggcgtcacgcagccgagcacgatatcgtcgacctgggcggtatccaggtcgttgcgccgctggaccgcgcgcaacagcccggccatcaggttcaccggcttgacgctgtgcagcgcgccatccttcttgcccttgccgcggggagtacgcacggcgtcgtaa

SEQ ID NO: 13844 - DNA, 846 bp, Pseudomonas aeruginosa
ccggcggatgcacgaggaacccgcatgcctgtcactctcccgcgcctggcgttgctaggtgccctgctcttccctgtggctgccgcctgggccgccgagctccgcctggaactgccggggggcacgcagacctggagcagcgaagaactgctcaggcatccgcaggcccgcgacctggacatcccggccgacgtcgcctaccgccggaacatgcgctaccgcgccgtgccactggcggcgttgttgaaaggcgtgcatcccgaagaccatttgcaggccgtggccagcgacggcttcgccgccgagttgccggccaccccgctgctcgccgaacagggctcgcaagcctggctggcgatagaggatccgcagcgcccctggccgccgctgggcgccggcaagccgtccgccgggccgttctatctggtctggagcaaacccgaggaaaaacgcatcggtccggagcaatggcccttccaggtcgtccgcatccgctaccagtcccctctggccgaacgcttcccggccctgctgccggccgctgacgccagcgcggaggtgcgcgccggcttcgccgtgttccagaagaactgcctggcctgccaccgtctcaacggtgccggcgacgcccagttcggcccggacctgaacctgccgtacaaccccaccgagtacttccagccgcaattcctcgcccgctacatccgcgacccgcaggcgctgcggcaatggccgcaggcgaagatgccggcgttcccggaacgggtgatcgacgaccaggagttgcgccagttgatcggctacctgcgccacatggccggccgcaaggcgggcgcggccggctga

SEQ ID NO: 13845 - DNA, 858 bp, Pseudomonas aeruginosa
cgcccgcagcagcgcgctccactggtagtagccgcgcgcggtgccctcgtccgccccggcgagcgccgcttcgccctgggtctggtagcgcgcatcgagcaggcgcaaggtattgtcggcgcgttcgatgaaggttccgagacggatgaagcggaacgcatcgttgcgcatgctggtggcgaaggtcgcgccgcggaacaggtgcgagcggtccttcacccattcgcagaaacgactgatgccatagcgcaggatgccctcggcggcgatgccgcgcatttccagccaggtggcgttgatgttctcccacatgtccagggtgatccgcccgcgtaccgcatgggcactggcgcgcgctgcggccaggcagctgtagatgctcgccgggttgtccgggtcgagggcgaagaaactcagcaggcgctcggcggccagttcgccgtggcgctccaggtaggcgtcgagggtgccggtgatcagcagcggcatggccagttcgtccaggccgccgccgttgcggtcctgcggcaacagcgacagcgagtagctgacgtcgagcatgcgggcgaggttctccgcgcgttccaggtagcgcgacatccagtacaggtcggaagcggtccggctgagcatgcttattcctccaccacccaggtgtccttggtgccgccgccctgggacgaattgaccaccagcgagccttcgcgcaacgccacccgggtcagcccgccaggcaccaggcgaacccgatccggcgccgacaggacgaacggccgcaggtcgatatggcgcggcgcgacgccgctctcgacgaaggtcggacaggtcgacagggacagcgtcggttgcgcgatatag

SEQ ID NO: 13846 - DNA, 1638 bp, Pseudomonas aeruginosa
ccacggcgcggtgaaggaactgatcaagcacggcctcgccggcaacgagcgggacgccacgcgcctggcgatccaggccggtgtcgacatgaacatgaacgacgatctctactcgacctggctaccgaagctgctggcggccggcgagatcgaccaggccgacatcgatcgcgcctgccgcgacgtgctggcggtgaagtacgacctcggcctgttcgccgatccctaccggcgcctgggcaagccggacgacccgccgttcgacaccaacgccgagagccgcctgcaccgccaggccgcccgcgaggtggctcgcgaaggactggtcctgctgaagaaccgcgacggtctgctgccgctgaagaaacaggggcggatcgccgtgatcggccccctggccaagagccagcgcgacgtcatcggcagttggtcggcagccggcgtgccacgccaggcggtaaccgtctaccagggcctggccaatgccgtcggcgagcgtgccaccctgctctacgccaagggtgccaacgtcagtggcgaccaggcgatcctcgactacctgaacagctacaacccggaagtcgaggtcgatccgcgctccgccgaggcgatgctcgaggaggccttgcgcaccgcgcgcgacgccgacctggtggtcgccgtggtcggcgaatcgcagggcatggcccacgaggcctccagtcgcaccgacctgcgcatcccggccagccagcggcggctgctgaaggcactgaaggccaccggcaagccgctggtgctggtgctgatgaacggccgaccgctgtcgctgggctgggagcaggaaaacgccgatgcgatcctggaaacctggttcagtggcaccgaaggcggcaatgccatcgccgacgtgctgttcggcgagcacaaccccagcggcaagctgaccatgtccttcccgcgctcggtgggccaggtaccggtctactacaaccacctgaacaccggccggccgatggaccacgacaaccccggcaaatacacctcgcgctatttcgacgaagccaacggcccgctctacccgttcggctacggcctcagctacaccgagttcagtctctcgcccctgcgcctgtccagcgaacggctggcccgcggcgctaccctggaagcgcgggtcacgctcagcaacagcggcaagcgcgccggcgccacggtggtccagctttatctgcaggacccggtcgccagcctcagccgtccggtgaaggaactgcgcgggttccgcaaggtgatgctggagcccggcgaatcgcgggagatcgtcttccgcctcggcgaggcagacctgaagttctacgacagccagctcaggcacacggccgagccgggcgagttcaaggtcttcgtcggcctggattcggcgcaaaccgaaagccgcagcttcaccctgctctgaaggcgccgaccgcaccgccagcgtcgccgccgcgggcgaacggcagcgtctcagccctcggcccggagccaacgcccgggccgggggcggcgcctggttccctcaaccggcgtccccttcctcctcgccgctccgcgccacgctctccgtcaatgcggcctgcaacgccgccaactggctgtcgagcgaagcgtcgatga

SEQ ID NO: 13847 - DNA, 237 bp, Pseudomonas aeruginosa
atatctgcgccatgcttagtcctctgtgagctgcgaaagaatgccgagaccgccttcgagggcccgggcctgctgttgcaggaactggaagcgctccgggccggcgcctctggccagttcccggcgacactccgccagcgccgcctgcagacgctgccggagcgctgcggcatgcgtgccgtcagcgaccgacagtcgcgtttccaaggctgtcatcatggagcacctcccctttga

SEQ ID NO: 13848 - DNA, 453 bp, Pseudomonas aeruginosa
ttttcgccagctcgatctcgaacgcctgcggcgacatcaggccggcggacaacagcgtcgaagcgccggccagcacaacctgccgcgccagtccggcatcctcgcccactgcttgcaccaggctggcgatctccgcacgattggcgacctccaggcgctgctggctggctgcggacggcggcgtcagcgccacccccgtgccgctcgcggaagccgcggccggcgccgccaggcgctccacccgcagactctcgacatacctcgcgaccggcctgccgagcgccgggacatccccggcgtcggccaccccgtagggcagtccggcgcgctcaagcgttatcggattcatatattcgatcctttctcgcggttacggcttccaacatggcgccggcacgcgcggccagggcctcgtgcgccggctgtgccgcggccagggcccgggccgagtag

SEQ ID NO: 13849 - DNA, 1284 bp, Pseudomonas aeruginosa
ggatcgacgttgccggagcctgtcaggcacggtcgggtttttgtcgttttcgcaggcttcgctgcgtcaccacccgcccggcctccagctcgaaccagccgtcggcgggctcggcggcgccggtccagcggcgatagaagcgcgccatgcgctcgccaggcagtgggctgccggccagcgccaggaccttgccgtagagacgctggcgcggccccagcgtatcgagcgtggcctccgccagcaggtacagcgcggcgaatggattggccaatccgctgcgcgcctgccgccgacgcaacatcacgatccagacccgctcgccgtcgcagcgccaggccagttcgcagccatgggccaggacctgccagccgagcgcgatcgaggtgtcgcgcaggcaatgcggacgcaccgccaggccgcgggcgagaaaccagggaatcagcggatcggcgctcacaacacgatcctgccaagcggctggatgttgatctgctgggtcagctcctggtaggacagcaccggcagcccggcatagtcgctctccaccagcttgcgcacgtagcggcggatatccatggaaacgatcagcaccggccggttctgcatctgcgcgagatcgccgacggtctgccgcacgcgctcgaggaaggcctgggttatcgccgggtcgagggccaggtagctgccggcgctggtctggcggatgccaccgcggatctgctcctccaccgcctggtccagcagataggcgggaaggatattgttgccgctggagtacttgtagcagatgtagcgcttgaggctgctgcggatgtactcggtgagctgcaccacgtccttctccttctgcccccactccaccatcgcctcgaggatcgcccgcatgttgcggatcgagatgtcctcgccgaccaggcgctggagaatctcggtcatccgctgcaggggaacgatccgctgcgcctccttcaccagctcgccgtaaccctgctccatctgctccagcaggtagcgcgtctcctggatgccgatgaaatcctcggcgtactcccgcagcacatgggacaggtgccaggtgagcacctgctccaggcccaggcaggcacagccggaacgctccaggcgatcctgatgcgcctgctccacccagctcgcctcttctcccggcacctgcagctctgccggctcgtgggggaccgcgagcagttccagctgcgcggcgcgttcgcgcaccagcaaccagcccggccgcaggcatccgcgcgcgaccgggacctcctgtag

SEQ ID NO: 13850 - DNA, 2049 bp, Pseudomonas aeruginosa
tggcgatcagcaacgccggcacctgcgagaccagccatcgccgacggtcagcaccgcgtacagttgcagcgcgtcggcggtgctcaggcccttctgcgtgacgccgatggcgatgccgccgaggatgttgacgacgatgatgatcagcccggcgatggcgtcgcccttgacgaacttcatcgcgccgtccatggagccgaacatctggctttccttttcgatcaccgcgcgccgcgcccgcgcctcgttgacatcgatcacgccggcacgcatgtcgccgtcgatgctcatctgcttgcctggcatggcatccagggaaaagcgcgcgctgacctcggcgacccgctcggcacccttggtgatcaccaggaactgcacgatggtgatgatcaggaagatgatgatgcccaccaccaggttgccgccgaccacgaagctgccgaaggtgttgacgatctgccccgcgtcggcctgcagcaggatcatccgcgtggtgctcaccgacagcgccaggcggaacagcgtggtgatcagcagcaccgccgggaacaccgagaactgcaacggcgagccgatgtacaccgacatcatcagcaggaccacggagatggtgatgttgacggcgatgaggatgtccagcagcagcggtggcagcggcagcaccatcatgaacaccaccgccagcagcaacaccaccagcaggatgtccttgcgctcgccgacccggccgagaagcccgctcaggtcgttcattcccgcgcctccagctccagcgcccgggcgtgcgcggcacgcgccgcgtcgagacgcccggcgagctgttcggcacggctcaggcaaagccacagaccgggctcctcctcgccatcctcctgcaactgccggcacaggcgcacggcgggctcgccgaggccttgctggagcaacgccaggagcaaggcgcggcgcccgtcgcggcgctccggcgcaacgctcagcaaggcctccagcaacacctgggcgcgtcgcggctggccgcattgcaggtgcaaccagcccagcatcagcaacaggcgctgttgcgtctgtttcaacgtcatcgattcataccttgtgcaacaggttcggggccatttgcagcagtcgctggtcttcatcgcgctcgccgagcaggcaggccgcggcctgcagggccggctggcggggcagcgtgagggccaggcggagatcgcgcagcgcctggcggaagtcgccggggcgcagcaggccgtggaactccagctggggccgggcgtagtcgaacaggcgctgttgcgcctgctgcgcgggatacaggctggcgacgtgggtctccaccggccggccgtcgggcgccagcagatggcgctccggcaggggcggcgcgaacggctcggcatgcgccaggtcgagtcgttcgatgccgatgtgccaggcaccgacccggctcatgcggcgagcacttcgctgcgcgccgagcgcagcgcctgcaaggcctggtgcaacgtcgggatgccgacctgccgggcttccagggtgatgcacagcagcaggcgcgattcgccgctccaggcgcaacgcagcggcaggctcccggccgcgcgcgcatggcacagggcgcaacgcccgcagggtgccgcgataggcctggtgccaggccaggtcacaggccagccagagcgacaactgttcgccatggcgttccagctgcaaggtgccgctgtcctcgaaatccagttgcaccacgcgcgccagcggcgccggtacgctcacccgcaggtcctggcagaactgcgcgacggccagctcaacccagtccatgctgctgctcctcttcgcgctcgatcgccaggtcgagtgccatctggcaggcattcaaaagattctggcgctgctcgtcgtcgccgaacacttcgaccggcaacaggcggtagagacgcttcagttcgcggaaaaaatggatctgccgggcgacgtcggccagcggcaacggctcgagcaacgcctgcacctcggcgacgccgacccagcgcttctcgagcaaggcgatga

SEQ ID NO: 13851 - DNA, 1425 bp, Pseudomonas aeruginosa
ccgcggcggcaaccgatttctaaaaactcccggctggcactgaaattcgtcgcgcgaggctttctctatagtgcgcgccgactccagccgaaccgatccgccatgcccgcgcctctctctcctctcatcgtccggatgcgccacgccatcgaaggctgccggccgatccagatccgcgggcgggtcacccaggtcaccggaaccctgctcaaggccgtggtgcccggcgtgcgcatcggcgaactctgccagttgcgcaatcccgaccagagcctggcgctactcgccgaggtcatcggcttccagcagcaccaggcgctgctcaccccgctcggcgagatgctcggggtttcctccaacaccgaagtcagccctaccggcggcatgcatcgcgtggcggttggcgagcacctgctcgggcaggtgctcgacggcctcggccgccccttcgacggcagcccgccggccgagccggcggcctggtatccggtctaccgggatgccccgcaaccgatgagccggcgcctgatagagcggccgctatcgctgggtgtgcgcgccatcgacggcctgctgacctgcggcgaaggccagcgcatgggcatcttcgctgccgccggcggcggcaagagcaccctgctggccagcctggtgcgcaatgccgaggtggatgtgacggtactcgccctggtcggcgaacgcggtcgcgaagtccgcgagttcatcgaaagcgacctcggcgaacaggggctgcgccgctcggtgctggtggtcgccacttccgaccgaccggcgatggagcgcgccaaggccggtttcgtcgccaccagcatcgccgagtatttccgcgaccagggacgccgcgtcctgctgctgatggactcgctgacccgcttcgccagggcccagcgcgaaatcggcctggcggccggtgaaccgcccacccgccgcggctatccgccatcggtgttcgccgcgctgccacgcttgatggagcgtgccgggcaatccgagcggggctcgatcaccgcgctctacaccgtgctggtggaaggcgacgacatgagcgagccggtggccgacgagacccgctcgattctcgacgggcacatcgtgctgtcgcgcaagctggccgccgccaaccactatccggccatcgacgtgctgcactcggtgagccgggtcatgaaccagatcgtcgacgacgatcagcgccatgcggccggacgcttgcgcgaatggctggcgaagtacgaggaagtcgagttgctgctgaagatcggcgaataccagaaaggccaggacagcgaagccgaccaggccatcgagaagatcgcggcgatccgccagtggctgcgccagggtacccacgaaaccagcgattacgcacaggcctgcgcgcagttgcggagcctctgcgcatga

SEQ ID NO: 13852 - DNA, 744 bp, Pseudomonas aeruginosa
gactgctgcgggaaaaggaagccggcctggaacaggactgcgccgagaccgcgcagcgcctcgaaggggagcgcgagcgcctgcggcagtgccggcgagaactgctggaacgccagcggcaactggagaagttcgccgaactggagcgccacgtcgacgccgagcgccaggggctgcgcgaacgcagcgaggaaggcgaactggaagaattcacccgccacgagacctggccatgctcaagctgaacgccgtggatacggctccgctcgtgtcgtccgacacccctgccccccttccgccgctgcgcgcgcagcagatcgccttcgaacaggccctgcccgcgcaccgaccgccggcgcccaggccaccgttcgacaagggcgacgaaacgacagaggccgaagagcccgccgcgacagccgacgcgccgacctcgacgcctctcgccgaccagcccgcggcgcctgccgccgaccggccgccgaccactcggcaagcccccgtgccagttgccgcggacgcaacgccaacgccaacgccaacgccaacgccaacgccaacgccaacgccaacgccaacagtgtcgccgtccggatcggtagcacggcaagcgccggcggtctccgcgcgcgtcgcggcgtccacgcaagcccgggagccggccagcgtttcggcgcctccggtcgacgaaccgccgctggtgccggtgtcctcccacccgcaaatcgcaggtcggacgcatga

SEQ ID NO: 13853 - DNA, 576 bp, Pseudomonas aeruginosa
gcggccacagcccggccccggcttcccggcgaaaaccgcagccgaggtcgcgtccacggcgcaggccagtgtccaggattcgccgcccgcgccgacagcgggcggcgaaggccgcggagaggagcgtcggcaacccggagaaaccgatccatccgcactgccccccgacgaccaagcgcctgtgccactgcctgccatgcaaacccccggcgaccgcctggtggcacgcctgctggcatcgagcgggagccggccactgccgctggccgatctcgcgcgcctgctcgatgccgtgcaggggcgcatccaggtcgccagcgcagccgaaagccatgcggcgcgcctgcaggtgcgactgccccagctcggcgccgtggaggtgcaggtcctgcatggccatggccagttgcaggtcgagatcagtgccagccccggcagcctggcgtttctccagcaagcccgtggcgagttgctcgaacgcctgcaacggctgcatccggaacaaccggtgcaactcaccttcaaccagcagcaggacagcggccagcgctcgcggcaacgtcgctacctgcatga

SEQ ID NO: 13854 - DNA, 945 bp, Pseudomonas aeruginosa
agagtggcaagccgaatgaacggtacggacctcgacctgccgctcgccagccgcgccgaactggatctccagcgacgtctcgcgcgttgccgtcgccactatgccggcaacgctttgcaagcgcgcctggacatcgcccaggccgcccccgacgtcgatctcgaactgagcctggcgtgggacggcctgcccctgcgctttctctgccaggctccggcgctcgcccactggctcgcgccgaacctgcaggaggcagccttcgccagcctgccggcggccctgcaactggccttgctggagcgcgaaggcaacgtctttcccggcctggtctggtacggcctgagcccggcgcaaccacgcgctgcgatgggcctgcgtttgagcctggaacgcgacgaccagcgcctggcgctctggctcgacggcgatcccgcgacgctgctggcacgcctgccgccgcgcccctcggcgcaacgcctggccataccgctgcgcctgtcgctgcaatggcccggcctgccgctggacgccagcgagctgcgcaccctggagcccggcgacctgttgctgctgcctgccggtcatcgccccgacgcagcgctgctgggggttctcgaaggacgcccctgggcgcgctgccaactccactccacgcaactggaactgctcgacatgcacgacaccccctccctcgccgacggcgaggacctgcacgaactcgaccaactgccgatcccggtcagcttcgaggtcggccgccgcaccctggacctgcataccctctccaccctgcagccaggctcgctgctcgatctcgacagtgccctggacggcgaagtgcgcatcctcgccaaccagcgctgcctcggtatcggcgaactggtcaggctccaggatcggctcggggtgcgcgtaacccgcctgttcggacacgacgaagcatga

SEQ ID NO: 13855 - DNA, 1086 bp, Pseudomonas aeruginosa
cccacggcctggtcatcagctacggaggctgaccatgagcagcgccgacatcctccacttcaccaaccagaccctgtggctggtgctggtcctgtcgctgccgccggtactggtcgcggccctgatcggcaccctggtatcgctggtccaggcgctcacccagatccaggagcagaccctcggcttcgtcgccaagctggtggccgtggtggtggtactgttcgccaccagcggctggctgggcggcgagctgtaccgtttcgccgaaatgaccctgctgaaggtgccgctggtgcgatgagcgtccaggacctgcagcaactgctgctgacctacagcctgctgctgccgcggatcatcagttgcttcgtggtcctgccggtgctggctaagcagaccctgggcggcggcctggtgcgcaacggcgtggcctgttcgctggcgctgttcgcctacccgatcgtcgccggcagcctgccgccggccctcggcgcgctggacatcgccctgctgatcggcaaggaagtgctgctcggcctgctcatcggcttcgtcgccaccattcccttctgggccatggaagcgaccggcttcatcatcgacaaccagcgtggcgcggcactcgcctcgaccttcaaccccagcctgggcagccagaccagccccaccgggctgttgctgacgcagacgctgatcaccctgttcttctccggcggcgccttcctcgcgctggtcggctcgctgttcaggagctatgccagttggccggtgagcagtttcttcccgcagctcggcagccaatgggtggcattcttctacgcgcaattctcgcagatgctgatgctctgcgcgctgttcgccgcgccgctgctgatcgccatgttcctcgccgagttcggcctggcgctggtcagccgcttcgccccgtcgctgaacgtgttcatcctcgccatgccgatcaagagcctggtggccagcctgctgctggtgctctacctgggcatcctcatggagcacgcctacgatgccctgctgctcgccgtcgacccgctgcgcctgctgcgtcccgtgctggagacgccatga

SEQ ID NO: 13856 - DNA, 423 bp, Pseudomonas aeruginosa
ggctgctcatcggctcagactcagtactttcagttcacactcgaacagaaactcgaaagcttccacctgacgcagggcatcgctcatgcgcgcgccccaagtgtacagcccgtggccgcggatcaaataccccgggcagtgcggatgcgcctccagccagggctgcacgcggctggccaggcgggcgatgtcctggtcgttgtcgaagatcggcacctcgacctggccttcgtgggtggtgaccccggcgaaggccttctgcagttcgtagtcctgcagcaccaggcggtcgccgcggaccaggcgggaaagcacggtggcattcaccgagtgggtatgcagcaccgcgccgatcgccgggttccaggcatacagctgggtgtgcaggagggtctccgccgagggtttcttgcccggttctag

SEQ ID NO: 13857 - DNA, 1263 bp, Pseudomonas aeruginosa
ggaaccgcgctggtcacgatccgccgttcacccgtcccgcatcgctgcctgccacagccctcacagctgcggcaggaccggcgtgtcgacgcgcacgtcggcgttctgcccacgctggcgcagcaattggtcgagcaggacgatggccatcatcgcctcggcgatcggcgtggcgcggatgccgacgcacgggtcgtgacggcccttggtgatcatgtccaccggctcgccggcggtatcgatcgagcgcccgggagtggtgatgctggaggtcggcttcagcgccaggtgggcgacgatcggctggccggaggagatcccgccgaggatgccgccggcattgttcgacaggaagccttgcggggtcagttcgtcgcggtgctcggtgccgcgctgggcgatgctggcgaagccggcgccgatctccacgcccttcaccgcgttgatgctcatcagcgcatgcgccagttcggcgtccaggcggtcgaagatcggctcgcccaggcccggcggcacgccttcggcaaccacggtgatcttcgccccgaccgaatcctggtcgcggcgcaattggtccatgtaggcctccagctccggcaccttgtccgggtcggggctgaagaaggcattctgctcgacgctgtcccagctcctgaacggaatctcgatcggcccgagctggctcatgtagccgcgcacctggatgcccaggcccgccaggtatttcttggcgatagccccggcggccacgcgcatggcggtctcgcgcgccgaggaacggccgccgccgcggtagtcgcgcacgccgtacttgtggtggtaggtgtagtcggcatgggccgggcggaacaggtccttgatcgccgagtagtccttggacttctggtcggtgttgcggatcagcaggccgatcggcgtgccggtggtcttgccctcgaacaccccggaaagaatctccacctcgtcggcttcctggcgctgggtggtgtgccggctggtgccgggcttgcgccggtcgaggtcgcgttgcaggtcccgggcggacagttccagccccggggggcacccatcgacgatggcgaccagcgccgggccgtggctttcgcctgcggtggtgacggtgaagagcttgccgtaggtgttgccggacatgcgaggctccgcgtgaggacgacagggaaagacatcggagtatacccgtcaaggacgggcctgcgaaccttccccggaggacgcgatcaaagcgctatcatcggcccatga

SEQ ID NO: 13858 - DNA, 420 bp, Pseudomonas aeruginosa
agacctccatgccgcgcgccctcctcgccctgttctgcctgctcgccagcctggcccacgccgctcccaacagcatcctgcaccgcccctacgacctggacaccgggcacggcgtgctgcgcggctccttgctgctgccgcgcagcgccgtgccgccgccggtggtcctgctggtcgccggctccggtcccaccgaccgcgacggcaacaaccccttcggcggcaacaaccgctacctgctgcgtctcgccgaggccctggccgaacgcggaatcgccagcgtgcgctacgacaagcggggagtcgcccgcagcctggcggcggcgccacgcgaggaagacctcagcgtcggcgcctatgtcgacgacgtggtcgcctggagcgagcggctggcccgcgacccgcgcttctcccggctga

SEQ ID NO: 13859 - DNA, 486 bp, Pseudomonas aeruginosa
cgatacccaaccggccgcagaagaagccgagaagaaaccgccgcacccctgggccgaactggccccggagcatttccgcctgctccgcctggcgccactgcccaccgaccgcgcgaccggcgcccgccccctgcgcttcgtccagctcggcagggtcgaacggcacagcgcggaccagagcctgctgcgcctgagcatccaggtgccaggcctgatgctgcgcaaggagcagaacctgctggaggtctgggccgatcatcgcaacaaggaagtgcgtttcggttcggacgccgggctcagcctggaacccttgaaccgcgggctgggccgtttcctgctggcccaggcgatcgcctgggcgcaacgacgctgggcccactacaaggtggaaggcggcgcactggcgctgaaggatggcctgaccgaagacgcacgcctgcgccgcgaccatttcatccgcgcccagggcttcgacgtcagctatga

SEQ ID NO: 13860 - DNA, 765 bp, Pseudomonas aeruginosa
cggaattgctcctcgcaacgcacaaaagggcgacattctagccgatcgcgccggagctggcctccagcgcgggaagtccataccactttagtgcgcatgcggcaaaggttcacaggctcgccgataggggccagaatgaaaggcatgtgccttctcaggagtagtgacatgcctcatccgctcacccttttgcagatcagcggacgcggctacccgccagccccccttcggcagagcaccttgctgatcatcgatgcccaggaagagtaccgcagcggcgccctgcgcctgccaggcctcgacgccgccgccgcggagatcggcgtgctggtgcaggcggcccgcgccagcggtacgcccatcgtgcatgtacgccacctgggtatccagggcggcctgttcgatccgcaagggccgcgcggccagttcctcccggaactgcaaccggaagccggggaaaaagtcgtggagaaacgcctgcccaatgccttctccggcaccgagctgcacgacctgctgcagaaccacggccgtctcgacctgatcgtctgcggcttcatgacccattccagcgtcagcaccaccgtgcgcgcggccaaggactacggctaccgctgcaccctcgccgatagcgcctgcgccacccgcgacatacccaccctgaacggcggggtcctgagcgccgcggatctgcaacgcgccgagatcgccgccctcggcgacaacttcgcggcgatcgtcgcccaggcccgggaactgctctga

SEQ ID NO: 13861 - DNA, 405 bp, Pseudomonas aeruginosa
ccatgtcgccgcgatagaccggcagggtctgctcgccgacctgctcgtgcggcttggaacgcggcttggcgtactgcccggcgatgcgcccgacgcggatcaccggccgccggccggccaggcgcacggcgccggccatcagttccaacacggcagccttgcgcgccacgttctcggcatggtggtcgtccatgtcctcggcgcagtcgccgcactgcaccaccagcgcctcgccgcgggcgacccgcgccagggtcgcgcgcagggccaggatgtcgccggcgcggatcagcgccggactgccgcgcatgtacgcctgcacgtcgcgcaggcgcgacggatcgccccattcgggttgctgcagcgcttcgcagcgccgtacgcgttgcaatagatcgtccatag

SEQ ID NO: 13862 - DNA, 822 bp, Pseudomonas aeruginosa
tgggcatcagcatcgaggccggcgcctactacatcatgttcgccgcgctcggcgagatgttctaccactcgaacctgcgcaccccgcacgtcctcggctacctgttccagcgcccggagatgcaccgcatccaccaccagcgcgaccgccacgagtgcaactacagcgacttcccgatctgggacatgttgttcggcacctacgagaacccccgccgcatcgacgagccgcagggcttcgccggcgacaaggagcagcagttcgtcgacatgctgctgttccgcgacgtgcacagcctccccggaaaaacccagcccgcccccgtcctggtcaagcccgacgtcaggtgaacgccatgattccagacatcgattcccgtctcagccggaacatattgaaatccatctcgtatggcctccccctcgccgaagtggtccccgaccatacctatgcgcaactggaaacgcgcctcggcgaactgaaacgcaggtatctggagctgcgcatctcccacggcgcgcgcgagctgccgttcagcaactacctgttctacctgatcctccagtcgcgccaccaggaattcgacttcaagctgcgccagggcaactcggtggtcaccaacatccaccgattcaagagcaagggacgcatcccgtccctgaccaccctgctcctggccgatgcggtcaacgccaagagcgagctggagctcaagcatccggacatcccgcagctcgaccgccacgctcgcgacatcgagcgctggctggccgccggcaacgtcatgccgcccagcgagcgggccctgcgcggcctggttga

SEQ ID NO: 13863 - DNA, 1284 bp, Pseudomonas aeruginosa
actgttcaagacccgatactccaagtacggatacggcatcgacgtgcgccgtacctacaaggacctgccctgccagccgttctggacctgggtcaccggcaagtcgctgaacgaccgcccgccgcgacggccgaaagacaccctgctcaagccctggcagctctacctgcacatcagttggggctacgcggtgttcttcctcgcggtgatctacggccagcaactgctcgcctcgcagcagccactgtggctgaagtgcctgttgggcgcgctgatcatgtgcctggtggtcaaccgccagcgtggcttcctccataccttccactacaccacccatggcgccagcctggagaacaaggcgctggcccgcttcacctgcaagtggatcctgtcgatcccgatcctgcacaccccgcgcgacgagtacgtgaagctgcacgtgaacgaacaccacagcgtgcgcaccttcaataccgagcacgacgtcgacctggtcttcatgaaacagcacggcttctacaagggcatgtccgagagcgccttctggacccgcctggtgctcgcgcccttccatccggcgcggatcctcgagcacctgaagttccgtttcgacgtcagcttcgtctccgccccgcgccacgagcgcgtcagccgggcgctctactgggctgcgctgctcggcctggtgtacgccagcggctacctggaggcgttcgcgctgttctacctgttcccgatcttcatcctcacccagtactcgtcgtggatccagcacgtctccgagcacctctggttcgcccgcaacgagcacggcctgccgcgcttcctgcactacggctcgctgagctggggacgcttcctcggccgcccctacccggccgacaagcagggcctggccttcgccctggcgttcgttcgctggagcctgggcgtgctgctgatcgacatcccgctgcgggtgttctccttcatgcaggacctgcccagccacgacttccaccatcgcaagccgggagtgaacttctggcgcatcgcgccggagcgcgcggccaacgaggcgcgcccctcgaagttcggcccgatgaccgagacctggggcatgtgggagaacttcctgatcctgcgcgaccacctctgccgcggccagtcggacccgttcggaatcgtcgactggtaccgcgagaaccatgcccggctcgctccggagaccgatgccgccaaccagccccacaccaaccaacccgcatcccaggctaccgcctgatcacacaggaaaccccatga

SEQ ID NO: 13864 - DNA, 2526 bp, Pseudomonas aeruginosa
ccgccggcgagcgcgtctcgctggtgttcttcgtcagtcgccatgcggaccggaaccggcgggtctattgacccgtcggcgtggagactcgaagcgatgtcgaagaacgcacgttacgcctggcgcctgtccctcggcggcctgctgctggggctactggcctgcgcggtctacctgctggccgtcccgctgggcttcaagtacggcgagatccaggtcggccatggcctggaacacgaggggcggatcgcctgggacgccgccggcgtcccgcatatccgcgcgcagagcctggaggacggctatttcctgctcggctacagccacgccagggatcgcctgtggcagatggagttcgcccgccgctatgccggcgggacgctctccgaagtgttcggcgtcaagaccctgccgatggacaggttcgcccgcaccctgggcttccgacgcaccgccgagggcatctacgccaacctggacgcgcccacgcgcgtcctgctgcaacgctacagcgacgggatcaacgcctatctggagctggccccggcggcgctgccgctggaattcagcctggtgcgccacgaacggccggggccctgggggccggtggacagcctgtccctgcacctgctctattcctggaccctgagcgccaacctgggcatgcagttgcagcgcctggcgctggccgagcacctggacctggcgcggatcaacgaggtgttcgccccctatccgggcgagcggccgccggccacccgcgactacgccagcctgtaccgctccctgcgcggcacgccggacgccggcaagctgctggggcaactgcccggttccaacgtcgagggcatcggttcgaacaactgggtggtctccgccaaccgcagcgccaccggcaagccgctgctggccaacgatccgcacctgcgcctgaccaacccggcggccttctacctggccagcatgaagatccccggcctgagcctcaccggcgccaacttcgccggcgccccgctgttcgtcatcggccataaccagcgcatcgcctggggctacaccaataccggcttgcacatccaggacgcctacctggagcgcgtcgatccccaggacccgcggcgctacctgaccccggacggctaccggcccttcgagacgcgcttggaacgcatcgccgtgcgcgacggcgagacggtctcgctggaggtccgcagcacccgccacggcccggtgatcagcgacatctacgaaccggcgcggctgccgcaggcgcagcgcgaccggctggtgatcgccctcgcctggaccggcctcgaccgtcacgacaagaccttcccgagcctgctggcgatcaaccgggccgaaggctgggaacagttcctcgacgccgccgccgacttcggcgtaccgccgcagaacatggtctatgccgacgtcgagggcaacatcggctacgtctccgccggtcgcgtaccgctccgcggcgccgacgacgacctccatggcctggccccctcgcccggctgggagagccgctacgactgggtcggctacgttccggaaagcgccaagccacgcagcctcaacccccgcgaagggttcatcgccacggcgaaccagcgcatcgtgccgcccgacaatgccttcgacttcggccacgactgggtcctgccctaccgctacgaacgcatccgcgagtggctcggcggccccggccagcgcaccctggaagacagcttggagttgcagaacgacgagttctccagcgtgatggcgagcctgttgccgaagatgctggagcaggtcagcgaccccgaactgcgcgccagcgaggccttcgccctgctccagggctggaaccaccaggccgccgccgacctggccgcgccactgatcgccggctactgggtacgcgccttcacccgcgagctgctgcaaccgaggatcggcacgcagttgctggccagcggctggaaccagcgcaactacgacggattcctccggctgatcctcgacggccaggccgacctgcgcttctggtgcggccaggaacaaggctgcgacctcaagctgaaccagtcgctgcgccgcgccctcgacgaactgcgagccgcccacggaagcgcgccgagcggctggaagtggggcgaggcgcacgccgccctcgccgagcacgtgcccttccacaagaccccgttgcgcgcgctgttcgacctgaagaacaacaagggcggcgacaacttcagcgtcaacgtcgggcgcttggactacagcgacccggccaacccgttcaacacacggatcgccgcgaccctgcggatggtcatcgacctggcggacttcgacaactcgcgctacgcgctgtccacccgcaattccggcctgccgttcgacggcgccaccgatctcaacgaactctgggcccgcggcgcgtacatccgtatcgccgacgacgcccccgacgcgacggaccgccagttggtcctgcgcccttcagccccttcctccggcgagccacgaccatga

SEQ ID NO: 13865 - DNA, 990 bp, Pseudomonas aeruginosa
tacccggcgggcaacgcagcgtcgccccggatttcttcccgcgcatggcgatgtccagccacgccaggaccaacgaccacttcgtcgcccacgtcggcagcagcgaccagatcctctgcatggtccgcctcgcgcccggtgccgaaccctacgtgcagcagaggatcatccggtgagcggactcgcgcagcgctccgacgacccgtggctggcggcgctgccggccgcggtgctctacggcgcctgggcggcctatgccaaccaggacggcggcctggccgggatgggcgtcgccgccctgctccagggcgccgcgagtctcctggcgacgcgcttcggcctgtacctgttgcaatgtctcggccgccgccacggccttgcgcaacgccaggcgcccctgctggtggtgctcctgctgaccgcgccgatggccgcgctgcactggctctcgggcacgccgcatccattggcgagcgtggcgccatcgttcgtcatcggctggctctacttcgccctctgggcgcgccaccgcccgggccgccggcaaaccagccgcgcctagccggcgcccccgctcgagccgctccccgtcggcgggatcggcccgtatactcggagccttcctatccgcccaaggacgcgccatcgccatgctggagattctcggaaaggcctcttcgatcaacgtgcgcaaggtgctctggacctgcgccgaactggacctgccctaccgccgcgaagactggggcagcggcttccgcgacacccacgcggcggaattcctcgccctcaacccgaacgccatggtgccggtgctgcgcgacggcgaactggtgctctgggaatccaacagcatcatccgctacctggccaaccgctatgccggcgaacgcctctatccgcagcaggcggcgccgcgcgcgcgggtcgaccagtggctggactggcaggcctccgacctcaaccgctcgtggagctatgccttcatga

SEQ ID NO: 13866 - DNA, 462 bp, Pseudomonas aeruginosa
cttcatcatcccctcgggggtcggttggtgatgcgcagttggactgcgccgccggcgaatgattcccaggccccgcgcggcgcctaccgcagccagcactggccagccggcgcgtctgccagtagtctgtccgccgcgctggcgacgccggccccacgccaactggagcaagacatgtaccgagacaccgtgaccctcaccgtcagcgccgagcaacgcggccgcgaaagcgaggccgtggacaacccgaacgtcgccatcggcctggaaagcgtcgagccgggcgtgctcaagctgcacttcgaaggccagctggacgccccggagaacgctacccacatctgcttcagcctgaccatcggcctcacctactacggcccgatcctcgacggcgcggccagcgagaacggcggctggatgaccttcgaaagcgacatgctcgacccggcgcaactggcctga

SEQ ID NO: 13867 - DNA, 981 bp, Pseudomonas aeruginosa
cgagaacctgacctactgggacaggaaggccgtcgccgaggaagtcggccggggtggcgtcgccgagttgctcgcccagttggaacggatcgatcgcaaggacaggaactatctggtgatcgtcggccacagcttcggcggcgcaatcaccctcggcgcacttcacgacccgttgctcgaacgcctgctggctctccaggacggtcagcggatacgcgccttcggcgacgcggtaatcatgctgaatccggcgatagaggccaatcagggcctgttgctcaaggagaacagcctcaaggtcggcgccctgggagcccggccgccgccgctgctgtacgtcatcagttcccacggcgacagcgccacccacttcgccttcccgctcggccaatgggtcggcgtcaacctcacctggagccaggtggacctggacaggacctacaacggaacccgctatcgcctccgggaagaagacctggataccaccgccctcggcaactacagcctgtatcggaccgccctgctgatcgaccgcgagtgcccgctgccggatggcagcgacaactgcgcgccaagaccgcccgaaccacgggtgatcgacgacaccgatatcggcaaatggcgcttcaggagcttctgcagcgcggacggcggcaacgccgatccggcgctgccgcgcatgccctgctacagcaacgagccggtcaacttcatctacacctcgcagtccttcatcgccgaccacaacgatatcttcaacgaccaggtgatcgccttcatggccaccgccgtcagcaaggccatctacgaacgtacggctggcgcctcctactaccgggagtgccacgacccggtgcggaagaacttctcgttcggcaagtgcttcgacttccactacctcaaagccacggccatgcaccggcggctgcaacggcaactctcggaacccggcacccgcagcgaacaggacgtcctctatga

SEQ ID NO: 13868 - DNA, 402 bp, Pseudomonas aeruginosa
tgcgcgagggccggcttgtcctcggcgaacatgcgatcgatctcgtccatccgctggtacggattgtcgatcgccttgccttcgccgagcagggtccgggcgacgttctccaggctgaacgaggggaagctccaggtcgccgagcgcagcgcctcgatgccatcgatgatcaggcggccggccgccgcggcgaaaaagtggttgttgcggctgccgtgctcgcgccagcccatttcgtcgccgccacgccccaggcgcagcggcaccttcaggcgctgggcatgctcatgcaggacgcgcaggtcgaactgcaccaggttccagccgatgatggcgtcgggatcgtgctcggccagccactggttgagacgttccagcagcccggcacggctgtcgcaatag

SEQ ID NO: 13869 - DNA, 495 bp, Pseudomonas aeruginosa
cgccctgcccgggcctttccgtggagaatcagcatgcccacctcgctcgtcctgaacggcaagaacgtcaccctcgacgtcgatcccaacatgcccctgctctgggccatccgggaaagcgccggcctgcacggcaccaagttcggctgcggcatggcccagtgcggtgcctgcaccgtgcagctggacggcaccgcggtacgttcctgcgtgctgccggtctccgcggtcgccggcaagcgcgtcaccaccatcgagggtatccagagcaagcccggcaaggccgtgcaggacgcctgggtcaagctccaggtaccgcagtgcggctactgccagtccggccagatcatgtccgccaccgcgctgctggagcagaacgccagccccagcgacgccgacatcgatgccgcgatgaacggcaacatctgccgctgcgccgcctatgtgcggatccgcgccgccatccacgaagccgccgacaccctgaaggcctga

SEQ ID NO: 13870 - DNA, 2361 bp, Pseudomonas aeruginosa
cgccatgaacagcaagatcgatctgagcaacgccctgcccggctcgcgccgcggcttcctcaaaggcgccgcggtggtcggcctgaccatcggcttccagtggagcggagcccggcgtgccctcgccgcggccctgccggacgccggcttcgcgcccaacgccttcctgcggatcgccccggacgacagtgtcacggtgatcgccaagcacgtggagatgggccagggcgcctataccggtatcgccaccatcgtcgccgaggaactcgacgcggactggagcaaggtccgcgtggaaagcgcgcccgccgacgccaagcgctacgccaacctggccttcggcaccatgcagggcaccggcggcagttcggcgatggccaactcctggatgcaattgcgcgaggccggggccaaggcgcgcgcgatgctggtcgaggccgccgcccgccagtggcgagtgccggccaccgaactgcgcacccgcgacggcttcgtcgaacatccggccagccagcgcaaggccagctacggttcgctggccgctgcggcggcggaactgccggtgccggaaaaagtgcaattgaaggatcccaaggacttccgcctgatcggtcaccaggcgccgcgcgtcgacgttcccggcaagaccgacggcagtgcgcaattcaccctcgacgtcagcctgcccggcatgctggtcgccctgctccagcgcccgccgctgttcggcgccacggtgaaatcgttcgacgccacggcgaccagggcgattccgggggtggtcgaggtggtccaggtgccgcacggcgtggcggtggtcgccaagggcttctgggcggcgaagcaaggccgcgacgcgctcaaggtcgagtgggacgagagcaaggccgagaagcgtggttccgaggcgctgatggcggagtaccgcaagctcgccgagcaacccggcaagcccgcgcgcagggacggcgacgccgccaaggcggtggccggggcgacccgcaggatcgccgccagctacgagttcccgttcctcgcccatgcgccgatggagccgctggacgcggtggtcaggctgaccgccgacagctgcgagatctgggccggcgaccagttccagaccgtcgaccagggcaacgcggcgcgcaccgccgggctgaagccggagcaggtgaagatcaatacgctctacgccggcggcagcttcggccggcgcgccaacgcctggtcggactatatcgtcgaggcggtatcgatcgccaaggcgctgggcgccaacggcgtgccggtgaagctgcaatggacccgcgaggacgacatccacggcggtttctaccggccgatgtactaccaccggctcgaagccgggctcgacgccgacggcaagctggtcggctggcaacatcgcatcgtcggccagtcgatcctggaaggcacgccgttcgccgcggtgatggtcaaggacggcatcgacgccacctcggtggaaggcgccgccaacctgccctatgcggtgcccaatgtctcggtcgagctgagcaccacccaggtcggcgtgccggtcctgtggtggcgggtggtcggcagctcgcacacggtctacgcggtggaggcgttcatcgacgaggcggcgcaggccgccggcaaggacccctacctgttccgccacgacctgctggcagagcagccgcgcctgcgcggcgtgctcgaactggctgcggaaaaggccggctgggacccgtccaggccgctgcccgccgggcgcgggcgcgggatcgcggtgaccgaggcattcaagaccttcgtcgcccaggtggtcgaggtctcggtggacaaggacggcaagctgaaggtcgagcgggtggtctgtgcggtggactgtggcatcccgatcaacccggacgtgatcgccgcgcagatggagggcggcatcggcttcggcctcggcgcgatcctgcacagcgcgatcaccctgaaggacggcaaggtcgagcagaacaacttcgacggctaccaggtgctgcggatcgccgagatgcccaaggtcgaagtgcacatcgtgccctccggcgaagcgcccaccggggtcggcgaacccggtgtggcgcccatcggcccggcgctggccaatgcgatcttcgccgccaccgggcaacgcctgtacaacctgcccttccccacctccttcgccaaggcctgagcgagacgcccgccggcagctccacggctgccggcgcggcgcgggcggccctccgaggatcgccgccgaccatacgggtctccccggtgtcgcgccgatttgcctccgcccggcgtcgggcgcagacttcagcgtccattcgcccgcgtagccaagcatga

SEQ ID NO: 13871 - DNA, 597 bp, Pseudomonas aeruginosa
ctcagggtcgaggccagggtatgggtcttcatcgccgtaccggccagttcgccggtcagggtttcccactggtgcaggcagcggccttcggcgcgggtcgccttgaccgtctccaggtgctcgaaggcttccagcagcacgccgttcttcatcgccccttcgcgcaggttctgccgcgacaggtggccgagcaggcgctgggtcagcagccccggcaggatcatcagcacgcaggccaccagcggcacccagaccacatggccgccgatcacggcgatgatcagcaggaagatcgccacgaacggcaggtcgctgatcagcgccgcgctggacgaggtaaagaactcgcgcaccgactcgaactcccgcacctgggtactgaaggcgcccatcgacgccggcttggcggcgacccgggtgctcagcacgcgggagaacagcagggtcgagagttgcaggtcgaggcgcttgccgagcacgttgagcaggtggccgcgcatgatccgcaggacaccgtcgaggacgatcgccagggccacgccgctggcgaggatccacagggtgtcgaacgccgcgttgggcaccacgcggtcgtag

SEQ ID NO: 13872 - DNA, 1305 bp, Pseudomonas aeruginosa
cggacccaacaggccgacttgcgcggccgcccgatactcgatgcgcttgcgttcgatccgcaggttgatcagttgccgctctgcctcgaaccgctcgcgctgcacgttgagcaggtcgatcacgtcgcgccggccaacctcgaactgttcgcgatacaactcgccgacctgctccgactcggtcacctgctgggtcagcgactgttcccgccagcgcagcgtgtcgccgttgtcgaagaggttctgcagttgccggcggatgtcgcgctgcatcgcgtcggcgctccatttcgccgactccaggcgctgctgcgcggcggtcggccggcggaagttggaaagcccctggaaggtgtccatgcggaagcgcagggataccaccgagtcgctttccggatgcccgccgatctcccggcgcagcgcgctggcctccaggttcagttgcggcagcagcgacgccttggcctcgcggacctcggcctcggcgacattggcgtcctccagggccttgcgctgcaaaggcgattcgcggatcacccgcgccatatcgctggccgccaggtagcgttgcagcgacatcggctcgggctccaccaggtcggcgggctcctggccgaccaggatcgcgtactggttgcgcgcgtcctgcaggttgcccttctccagcgacaactgctcctgggcccgcgacagttccagattggcgcgatccagctcgctgcggtcggcgtagccgtcgccgccgcgcgcctgggtcatctcgcggatgccgtcgaggcgctggatgtgttagcgcaccgcctccacccggcgctccgaggcaagcacgtcgaggtaggtctcgacgatatccagcgccgcatcgtcgcgcgccaccagcaccgcctcggacagcttgcgctgggtcgcgctggcgctgtcgaccttgctcgtcacccgaccccagtcgtacagcatctgcgacgcggtgagatcgtagacgatctcgccgaagtcgaactcctgcggccccccggacatcgtcacggaggggtagtacccccctttggccatctccacctcggtgcctgcacggtccgcttcggccatcgcggatcgtacttccgggtggatcgccagccctgccctgaccgcctggtcgaggggcatggccgacgcgaacatcggcagacccagggaaaggagccagatggctcccttcccatgccgccgtcccttgcgcgcgtactgcctgcgcccgcgcatcagaccacgacctgtaccgtgttgtcctcgatcagcagggtggtactgccgaaggtgtag

SEQ ID NO: 13873 - DNA, 3129 bp, Pseudomonas aeruginosa
ctgttcggctcggcggtgccggtcagcagcgcgccgtcggcgctgatgctcagcagcggagcggacggcgccaccgagtccaccgtggtgctggccggaccgctggcgttgcccgcggcgtcttcggcgacggcgttgatcaccgtaccgttggccagcggcgtgccgggggtgaaggtccagttgccactgccgtcggcggtggtctcgccgatcgggttgccgttgccgtcggtgaggatcactttggcgccgacctcggcggtgccggtgatcacgctgccgttgctggcattgatcaccggcgtggccggcgccaccgtatccaccgtggtgctggccggaccgctggtattgccggccgggtcctgggccacggcgttgaccaccgtgccgttggccagcggcgtgcccggtgtgaaggtccagttgccgctaccgtcggcgagggtctggccgatcgggttgccattgccatcggtgaggatcacccggacgccgggttcggcggtgccgctgagtttgacaccattgctcgggtcgatcaccggggtggccggggccaccgcgtccactgtggtgctgaccggaccgctggtgttgccggcggcgtcctgggccaccgcattgatcaccgtgccgttggtcagcggtgtgcccggagtgaagctccagttgccgctgccatcggcggtggcctgccgtatcgggttgccgccgccgtcggtgaggatcaccgtggccccggcttcggcggtaccgctgatcaccgtaccgttgctcggatcgagcaccggggtggccggggctaccgagtccaccgtggtgctggccgggccgctggtgttgccggcggcgtcctgggccagcgcattgatcaccgagccgttggccagcggcgtgccgggcgtgaagctccagttgccgctgccgtcggcggtgacctggccgatcgggttgccgccgccgtcggtgaggatcaccgtggcgccggcttccgcggtaccggcgatcacgctgccgttgctcgggttgaccaccggggtggccggggccaccgcgtccaccgtggtgctggtcgggccgctggtattgccggccggatcctgggccaccgcattgatcaccgtgccgttggccagcggcgtgcccggggtgaagctccagttgccgctgccatcggcggtggcctggccgatcgggttgccgccgccatcggtgaggatcaccgtcgcaccggcttccgcggtaccggcgatcacgctgccgttgctcgggtcgatcaccggcgcggccggcgccaccgagtccaccgtggtgctggccgggccgctggtgttgccggcagcgtcctgggccaccgcattgaccaccgtgccattggacagcggcgtgccgggcgtgaagctccagttgccgctgccatcggcggtgacctggccgatcgggttgccgttgccgtcggtgaggatcaccgtggcaccagcctcggcggtaccggcgatcacgctaccgttgctcggatcgatcaccggggctgctggcgccagcgagtcgacggtggcgctggtgggactgctgttgttgccggcggcgtcctgggccagcgcattgatcaccgtgccattggccaacggcgtggcgggcgtgaaagcccacttgccgctgccgtcggcggtgacctggccgatcgggttgccgttgccgtcggtgaggatcaccgtggccccggcttccgccgtaccgctgatgacgactccgttgctcggattgatcaccggcgccggcggggcgatggcatcgacggtgacgctggccggaccgctggtattgccggccgggtcctgggccacggcgttgatcacggtgccgttggccagcggggtgcccggggtgaacgtccagttgccgctgccgtcggcggtggcctggccgatcgggttgccgccgccatcggtgaggatcaccgtcgcgccggcctccgcggtaccgcttatctcggtgccgttgctcggatcgatcaccggcgccgccggggccacgccatccacagtgatcaccgccggcgcactgtcgacattgcttgggctgcgcgccaccacgttgaccaccgtgccatccggcagcgggatgcctggagtgaaggaccagttaccgctgccgtcggcggtgacctggccaatcgggttgccgttgccatcggtgatgatgatggtgttgccggcgtccgcggtgccgctgatcaccgaaccgttgctcggatccacctgcgggatcgacggcagcgaggaatccaccgtcgtggtagcgggagcgctggtattgccggcggcgtcgctcgcggtcacgttgaccacggtgccgttgggtagttgcgagccgggcgtgaagctccagttgccgctgccatcggcggtggtctggccgatcgggttgccgttgccgtcggtcaaggtcacggtgctgcccggctcggcggtaccgttgagcaggttgccgttgctcggattgaccacaggcgtgttcggcgccaccgcgtccacggtagtgctgccctgcgggccggtattgcccgcagggtcctgggccacggcgttgaccaccgtgccgttggccagcggcgtggcgggcgtgaaggtccagttgccgctgccgtcggcggtggtttcgccgatcgggttgccgttgccgtcggtgaggatcaccttggccccggcctccgcggtgccgctgatggtcgtgccgttgctcggatcgatcaccggcgccggcggcgccaccgcgtccaccgtggtggcggcctgcgggccggtattgccggtcgggtcggtggccgtggcgacgatcaccgtgccgttggccggcggcgtgcccggcgtgaagctccagttgccgctgccgtcggcggtgacctgccctatcgggttgccgccggcatcggtgagggtcacggtggcaccggcctcggcggtgccgctgatgacgacgccgttgctcgggttgatcaccggcgccggcggcgcgctggaatcgacggtcaccgtcgccggcgggctgctgttaccggcggcgtcctcggccaccacgttgaccacagtaccgttggcgatcggcgtggacggggtgtag

SEQ ID NO: 13874 - DNA, 738 bp, Pseudomonas aeruginosa
gtccagttgccgctgccgtcggcggtgacctcggcgatcggattgccgttgccgtcggtgaggatcaccgtgctgcccggttccgcagtgccgctgaggctgctgccattgctcaggttgacggtcggcgtggccggcgcgatggcgtccacggtagtgctgccctggccgccggtattgccggccgggtcggtagcggtggcgttgaccacggttccatccgccagcggcgtggacggggtgaagctccagttgccgctgccgtcggcggtgacctgcccgatcggattgccgctgccatcggtcagggtcacggtggcgcccggttcggcggtgccgctgatgacgactccgttgctcggattgaccaccggcgcggccggcgccaccgagtccacggtggtgctggccggagcgctggtattgccggtcgggtcgctggccgtggcgttgaccacggtgccgttggccagcggcgtgcccggtgtgaagctccagttgccactgccgtcggcggtgacctggccaatcgggttgccgttgccgtcggtcaggctcacggtagcgcccggctcggcggtgccgctgagcgtggtgccgttgctcgggttgaccaccggagccgccggggcttgcgagtccacggtgacgctggcgcccgggctgctattgccggcggcgtcctgggccaccacgttgaccacggtgccgttggcgatcggcgtggacggggtgtag

SEQ ID NO: 13875 - DNA, 2319 bp, Pseudomonas aeruginosa
gtccagttgccgctgccgtcggcggtgacctcggcgatcggattgccgttgccgtcggtgaggatcaccgtgctgcccggttccgcagtgccgctgaggctgctgccgttgctcaggttgacggtcggcgtggtcggcgccacgccatcgacggtggtgctgccctggccgctggtgttgcccgccggatcggtggccgtggcgttgaccacggttccatccgccagcggcgtggacggggtgaagctccagttgccgctgccgtcggcggtgacctggccgatcgggttgccgttgccatcggtcagggtcacgctgctgcccggctcggcggtgccgctgagcgtggtgccgttgctggggttgatcactggcgtggccggggctaccgagtccacggtgacactgctgcccgcactggtgttgccggaggcgtcggtggccgtggcgttgaccacggtgccgttgggcaacggcgtggtcggagtgaagctccagttgccgctgccatcggcggtgacctgcccgatgggattgccgttgccatcggccagggtcacggtggcgcccggctcggcggtgccgctgagcgtggtgccgttgctcgggttgaccactggcgtggccggtgccacggggtccacggtgacgctggccggcgaactggcgttgccggacgggtcggtagccgtggcgttgaccaccgtgccgttgggcaacggcgtgctcggggtgaaggtccagttgccgctgccgtcggcggtgacctggccaatcgggttgccgttgccgtcggtcagggtcacggtagcgcccggctcggcggtgccgctgagggtcgtaccgttgctcggatcgacggtgggcgtggccggcgcgacggcatccacggtaacgctggccggcggactgctgttgccggcggcatccctggccaccacgttgaccacggtaccgtccggcagcggggtggacggcgtgaaagaccagttgccgttggcatcggcggtggtctggccgatcggattgccattgccgtcggtcagggtcacgctgctgcccggttcggcagtcccgctgagttcgctgccgttgctcggctcgaccaccggcgcgttcggcgccacgccgtcgacggtgatggaggtcgccgggctgctgttgccggcggcgtccctggccaccacattgaccacggtgccatccggcagttggctaccgggggtgaagctccagttgccgttggcatcggcgctggtctggccgatcggattgccgttgccgtcggtgatcacgatggtcacgcccgcttccgccgtaccgctgaggacgctgccgttgctggcattgacctggggcgcgtcggggaagtcgggagcttcggcggtgaccggggtgctgctgttgccggccgggtcggtaacgatcaccgtcaccgtctcgccattggtcagcggcgggttcagcgggacctcgaacctgccgccggggccgaccaccacggtggtgtccggctggccgtcgccatcggtgtcgacaccgacggtggcgcccggctctgcgttgccggtgacgctgctgccgtccggcgccacctgcacgtcggtggccggcgccggggctgtggtgtccggcgcctcgacggtcaccggggtgctgttgttgccggccgggtcggtaacgatcaccgtcaccgtctcgccattggtcagcggcgggttcagcggaacctcgaagctgccgccggggccgaccaccacggtggtgtccggctggccgtcgccgtcggtatcgacgcccaccgtcgagccgggttcggccttgccggtgacgctgctgccgtccggcgccacctgcacgtcggtagccggcgccggggcggtagtgtccggagcggtgacctgggccggcgggctggcgttgccagccgggtcagtgaccaccacggtgaccgtctggccattggtcagcggcgggttcagcggagcggtgaaattgccgttggcatcggcgatcacggtgaggtccggcttgccgtcgccattggtatcgatgccgacgctcgcgccggcctcggcctggccgctgatgctgctgccgtcaggcgctatcttcaggccgctggccgccttcggcggagtggtgtccgggggcaccgaagaaccgccgccgccaccgccgccgctgctgttggaaatcgccaccccggcgccgatggccgccgcaccgaccagcagcgcagtccctgcgctcatgccaccgagcacaccggcgccggtcagcgactcgaaaccggccaggctttcctgcgggatgtag

SEQ ID NO: 13876 - DNA, 864 bp, Pseudomonas aeruginosa
ttcgtcggcgcgaggcgacggcaagacgaccccgacagttccaacggaaagcatcgccgggcatcccgcgaagcggccttcatcgtcctgcaatcaaagcgtcatcgtcacgatgccaagttatccaaccgatcctctcccgcgagcgaccatgcatcacggtatctccccgccccaggacgccgacctgttcggcctgatctacggtttccgtttccgccccggcgaagcggggcgggaaatcgactcggttaccgccctcgcctgcctgcggcaggctcgcgaggaggcgccggacgagttcctctggctgcacctgaacctcgcccatgccgcctgcgagcgctggatgaagaagcatctggaactgccggattatttcttcgaaagcctgcgcgaggggtcgcgctcgacgcgcatcgaacacgtcgactcggcgctgctggcagtggtcaacgacgtggtcttcaacttcggcctggtctcttcggacgtcgccaccctgtgggtctgcgcccgtggccggctgctggtcagtgcacgagcgcaaccgctgcgctcggtggacaagctgcgctcttcggtgaagcacggcgaacctttccgttcgcccctgcagttgctgatccacctgttgcgcgaccagggcgacgtgctgacccagatcgtccgcgaaaccagcgtcgcagtggaccgcatcgaggaccagctactggccctgcgcctctccgccaaccgcgccgacctcggcgccatgcggcgcgtgctggtacgcctgcaacgcctgctggcgctggagcccggttcgctgctgcgcctgctcaaccgaccgccggaatggctacaggatgccgacctgcgtga

SEQ ID NO: 13877 - DNA, 654 bp, Pseudomonas aeruginosa
cctgctggccgttgctcacctggatctggtccatatggtagtagttggtcgcccagccgctggggtgggtcacccgtacctggcagcgcgacagcacccgtaccgtaccggcgtgggcggcgaccacgctgtaggtcgcactgccccagcgcggccagtcgtaggacgcatcgaaggacgagtacggatagcccgagccggtgttcgaatgcgctccgttgggctgccaggaatagccctggcgccagggcaattgcatcaggttggatggcggcgccagcgcggccttcgcctggagttgccgggccacgcggttgcgcggctgcaggagttccgcggccggggtgccgaacaggcgctggaaggtctgcgcgtaggcgccgagcggattgccgccttgcacggcggaggccttcgccccctctcgcaacagaccgagcagcgcggccgatgccgcgttcaggccgtcctcgccgacggccttgcgcgcagccgcctggcgcaactggtattcctcgaaaccgtagtagcgccgcgacaactgctgcaacacgtcgcggacctgggcatcgaagccgcgtttcgccgacagccgtcccagcggcgccgccaaggcgcgctcgtccggcgcccccaacggcccggattgcatga

SEQ ID NO: 13878 - DNA, 429 bp, Pseudomonas aeruginosa
cggccatggctgatgcgctccaggccggcggcatcgcggacgatgctcgggcgcaggaagaccatcaggttgcgcttcacccgggtctcgcgggacgagcggaacagccggccgacgccggggatgtcgcccagcagcggtacccgcgaatcgctgcgctgcaggtcgtcctggatcaatccaccgaggacgatgacctggccgtcgtcagccagtacggtgctcttgatcgagcgcttgttggtcaccaggtccaccgccttcgccgccagggtggcggttggcgcgatggaggatatttcctgctcgatctccaggcgcagcatgcggtcctcgccgatgtgcggcgtgaccttgagggtcaccccgatatccttgcgctcgacagtggtgaacggattgctcgaaccgctggcgctggtggtgtag

SEQ ID NO: 13879 - DNA, 780 bp, Pseudomonas aeruginosa
ctgccggtctggaacggcacgttctggccgaccaggatttccgccttctggttgtccagggtcagcaggctcggcgtcgacagcaggttgctgcggctattgcggctcagcgcggtgaccagtgcgccgaaatcgcgactgccgaggccgactatcgcaccgtcgggcagctctgccggcggcttgccggcctgcaacgcgcccagcagggtgccgatggacaacccgctgtcggcgaagccagcgccgccggcgacatgcccgctacgcagcgcccattgcaccccgagggcgtcgccgatctcgccggacagctcgacgatcgccgcctccaccagcagttgcgcgcgcggcacgtcgagctggcggacgatgtcctcgagcaggccgacatcctccgggtcggcgaggatcaccagggcattcagcgattcgtcggcgcgcaccagcaggccgcgcttgccgcttccccggccatcctggccccgctcgccgtgcagcgattcgccgatctccccgagggtggcggcaagggtcttggcgtcgccatggcgcatgcggatcacccggctgttcgccgaccgcgacgaggggacgtcgagcgactgcgccagccgcagcaagcgcgctcgcgcctgcggcggaccgagcaggaccaggcggttgctgcggctgtcggcaaggacctggacggtggcggcgctcttcccggcggccggggtgacgctgcgatcgagcacctcggcgatttccgcgacccaggcatggcgcatgtcgtag

SEQ ID NO: 13880 - DNA, 1569 bp, Pseudomonas aeruginosa
ccgtcaccgaacaggcgctgcatgcgcaggcggatctgctcgttcaccggattcacctggggcaacccgagggaggcgatgaaggcgccgatcaggcgctcgccaggcaggtcgatgccttcgccgaaggcaccgccgagcacggcgaagccgatgccctcgcccgcccgcgacgaagcgctcgaggaagacccggcgctccgcctcgtccatccgtggcgtctggctccagcacggcacccacgggtatgcctggcggaagacgtccagcgcctgctgcaagtaatcgaagctgctgaagaaggccaggtagttgcccggccgctggcgaaactgctcgccgagaatcgctgcgatgggcgccagggatgcctggcgctgcgcatagcgcgtggaaacccgacgctgtatgtgcacctccagttgctcggcgctgaatggcgagtccacttccagccagggcgtgcccgccggcaggccgagcaggtcggcgtaatagtcgcgcggcccaagggtagcggagaacagcacggtggagcggctggcggcgaagcgctcggcgagaaacgccgccggcaccacgttgcgcaggcacagccgggccaggctgcggccgttgcggcctgggcgcttctcgatgtcgaacagcgaatgctcgccgaacagctcggcgagacggccgaactgcaggatcgcgaagtagaactcctgcaacgccggctccagcgcctgcggttgctcggcgagcaggtcgttgatcgccgccaccgcgttctgcaaggccaggagcagcttctgcggaggctcgtcgtaggcctggtagtcgtccgcctgggtcttggccagttcgttccaggcacgctggatgcgctccagcggtttcctcagggcctccggggcggttttgcgcacaccgaggaaatcgccctggtcgagttcggcggaatacatccgccggccgcgctccaccaggttgtgcgcctcgtccaccagtaccgccacccgccactggttgacctgggccaggccatggagcatggcgccgagatcgaagtagtagttgtagtcgcccaccgccaggtcgcaccagcgcgccagttcctggcccaggtagtagggacagacccggtgcgccagcgccacctcgcgcaaccgcgcctggtccagccagcgcgcctccacggcggcggcgcgggccgccggcaggcgttcgtagaagccctgggccaggggacaggactcgccgtggcaggccttgtccgggtgctcgcaggccttgtcccgcgccaccagttccagcacccgcaccggcagtccgccggtctccccttccaggctacgcagggcatgcagcgcgagggcccggcccggggtcttggcggccaggaagaacagccggtccaggcgctgcccgggcatcgccttgagttgcgggaacagcgtgccgatggtcttgccgatcccggtcggcgcctgggccatcaggcaacaaccggcggaggcggccttgtacaccgcctccgccagttgccgctggccgtggcggaattcggcgtggggaaagcgtaa

SEQ ID NO: 13881 - DNA, 399 bp, Pseudomonas aeruginosa
cctcgaccatccggtagcgccgctgcgccggccagaactggatcaggtccggcaggccggcgcggttgcccgggatatcctccagcaggcgttcgaaccaggcgcgcaggtgggccgccggtaggcaatcgagcgcctgttcgagcagttcctcgccaagcagttcccagtagacgaagggcgactgcaggccgaacttgtcgcggtagcgacagcggatcgcgtcgcggtagctgccgtcctccagccgtcccaggcaggcctcgaacagggcggcgcggcgctggcggaagtcggcgctgtgcaggtccgccggcgcgctgtggaagggatggaagaacgccccaggaacggcggcgaagatcgcctcccagcagagcagtccgaacagcgaattga

SEQ ID NO: 13882 - DNA, 393 bp, Pseudomonas aeruginosa
tcaggccgttctcgacgtagtgcaccgcgcaatcgggctcttccaggtgctcgcggaccgcccactcgacgctacagggttcgctcgggaacgccaggcacaggtccaggcggtcgatttccggagccgccgcccgcgcctgtcgcggcaggccgagcttgccttgcaggcgcggcagcaatcgggccaggccctggcgttcggcgtcgctttccggcgcacagctggcctcccgcgccaatgcatgggcttcggcgaagcgctcgccgcgttccaggctgcgaatcgcccgcaggcgcgcgccggggtggctggattggcgatagagccgctgggccaggtcgaaatcccgctgcttttcgcagtgctgggcgaactggaacagcagcttga

SEQ ID NO: 13883 - DNA, 405 bp, Pseudomonas aeruginosa
cccgccgcccttccagccagggattggcgtagggttcgcccggcaggccggcgagcagttcctccagcggctcgccgaggtcgaagcgctggcggcaatcgaacaggtggagataggcgtcgacgtcggcgcgcaggcgaaagccgcgggagtcggcggaaaactcgacgctttcgtaacgatagatacccaggtcggcaaggacaaactccgaccagtcctgccacaggttgccgaaatacatcaaccgcaagcggtcgcagagcgccatgcagcgcaactcgtagaccggttcggcgaagtcggcctgccactcggcgagccgccgcgcctcggggaacaacggctggagccgttccagcagcgcatccttgcgcaggttcgcgcgcccgagatggtccctga

SEQ ID NO: 13884 - DNA, 441 bp, Pseudomonas aeruginosa
tcctcgacgccgcctgcgaagtcttcgccgactgcggcttcagcgccgcccggctcagcgacgtcgccgagcgcgccggcgtggcgaaggccaacgtgctctattactaccgctccaaggcgcaactctacgaggcggtgctggacagcatcgtcgagcccctgctggaagcctcccggccattcgccggcgaccagccgcccgccgaggcgctacgcgcctacgtcgacaacaagatgcgcatcggcgccgagcggccgcacgcggccagggtcttctcctgcgagatcatgcgcggcgcgccgcgcatgccggcgccgctgctggaacgcctcgacgcccaggcggaacgcaacgccgagcgcatccgccagtggatcgacgaaggcctgctggcgccgctggatccgtaccacctgctgctcaacctgtgggcgatga

SEQ ID NO: 13885 - DNA, 336 bp, Pseudomonas aeruginosa
agagtggcagcttcaggcacctgtccatcgccaacccgaagaccgcgccctacggcctcgccgccacccaggcgatggacaagctcggcctcgccgccacgctcgggccgaagctggtggaaggccagaacatcagccaggcctaccagttcgtttccagcggcaacgccgaactgggcttcgtcgccctgtcgcagatctacaaggatggtaaagtcgcaaccggctcggcctggatcgttcccgccgagctgcacgacccgatccgccaggacgcggtcatcctcaacaagggcaaggacaacgccgccgccaaggccctggtcgactacctga

SEQ ID NO: 13886 - DNA, 1260 bp, Pseudomonas aeruginosa
tcggcggcaacatcccggagaaaacccgcgtggtctcggtgcagatattcgatcacgtcgaagccatggaatacgcccaggcccactgcctggccggcggcatggtggcgttctccttcgtcgtcctcctcgccctctattcgggccggcgccgccggccgggctgggcctgagatggacggcctgcgcctgcgcttccgccgcgcctaccccggcttcgaactggacatcgacctggctcttcccggtcgtggcgtgaccgctctgttcggccattcaggctccggcaagagcacctgcctgcgctgtatcgccggcctggaaaaggccgccgagggcgaggtgacgatcaacggcgagacctggcaggacagccgccgcaacctcttcgtcgcgccccaccggcgtgccctcggctacgtgttccaggatgccaacctgttccgccacctgacggtgcggcgcaacctggccttcggtctcaagcgcatcgccgccgccgaacgccgcgtcgagctggaacaggcctgcgccctgctgggcatcgagcacctgctggaacgcatgccggaacgcctctccggcggcgagcagcaacgcgtcggcatcgcccgggccctcctcaccagcccgcgcctgctgctgatggacgagcctctggcatccctcgacctgaagcgcaagggcgagatcctgccctatctcgagcacctgcacgaggaactggacatcccggtgctctatgtcagccactcgccagacgaagtggcgcgcctggccgatcacctggtgctgctggagaacggcaaggtccgcgccagcgggccgatcggcgaaaccctggcgcgagtcgacctgccgctggcgctggacgacgatgccggggtggtgatcgagggcacggtcagcgaccacgacccggcctacggcctgctgaccctggtcctgcccggcagcgcgctgcaaatgcgcgtcgcccacgccccgctggcccccggcaagcgcctgcgcttcaaggtacaggcgcgcgacgtcagcctgaacctgcgcgacgacgcccagagcagcatcctcaaccgcctgccggtacgggtcctggaattggtcgataccgacaccgcggcccacgtcctggtgcgcctggatgccggcggcaatccgctgctggcgcggatcacccgttactcgcgggaccagttgcaactacgacccggccagctgttgtgggcgcagatcaagtcggtggcggtgctcgcctga

SEQ ID NO: 13887 - DNA, 1809 bp, Pseudomonas aeruginosa
actgcaaagcttcgtcagtgtagtcgacagcggttccatcagcgccgccgcggaacagatgggactgaccgcctcggccgtcagccggaccctctcgcgcctcgagcacaagctcggcaccaccctgctcaaccgcaccacccggcgcatggagctgaccgaggaaggccgctacttcctcgaccaggcacggcagatcctgcagcagatggaggcgctcgaggaacgcctggccctgcgccggcagagccccgccgggcgcctgcggatcaacgccgcctcgcccttcatgctgcacgcggtggtgccgcacatcggcgagttccgccggctgtacccggacatccagctcgaactcaacaccaacgacctgatcatcgacctgttggagcaacgcaccgacgtggcgatccgcatcggtgcgctcagcgactccaccctgcacgcgcgcccgctgggcgccagccgcctgcacatcctcgccagcccggagtacctggcccgccacggcacgccggcgagcatcgaggggctgcgagggcacaccctgctcggcttcacccagcccgagcacctcaaccgctggccggtggtgcacgccgacggcgatcgcctggagatccagccggatatctctgcctccagcggcgagacgctccgccaactggtcctgagccaccagggcatcgcctgcctggccagcttcatgaccgaccgcgatatccaggacgggcgcctggtgccgctgttcgccgaacagatgagcgaataccggcaaccgatccacgccgtctactatcgcaactcgcaactggcgctgcgcatccagtgcttcctcgacttcatccagcagcgcctgggcgcctgagaccgaccgtgaacgaatccctcgatttctcgccctacctcgagcgctgggcgttgcaacccgacggcgagcccttcgccacccacagcagccgcctgctgccggtgcgccatcgcggcgcagcggcgatgctgaagatatccagtgccgaagaagagcgtttcggccacgtactgctcaactggtgggacggccagggcgcggccagggtgctggcctacgaccaccaggcgctgctgatggagcgtgccaccggcgggcgctcgctgctggagatggtcaggcgcggcgacgacgacgaggctacgcgtatcctctgccaggccatcgaacgcatccatgccccgcgcccgggtccgttgccagagctgaccccgctggagcgctggttcgactcgctgtatgccgccgagcgccgctacggcgggctctacgtcgactgcgcgaatgccgcccgctacctgctggagaccgctcgcgaacagcgcccgctgcatggcgacatccaccacggcaatgtgctcgacttcggcgagcgcggctggcaagtcatcgaccccaagcggctctacggcgagcgcggctacgactacgccaacctgttcaccaatcccgacgcgaagaccgcccaggcgcccggccgtttcgagcgccagctggagatcgtaatcgccgccagcggcctgcagcgccgccgcctgctgcaatggatcctggcctggaccggactctcggcggcctggttcgacgaggacggcagccgcgaggagaccgaagccgagctggccatcgcccgcctggccctggcaaacctcgctcgaacgcctgcgccaatgaactgtgcggcggctcccgcgctccaacgcgaggcactgttccgccgccgcgatccggtgtcaaatacacaccccgccaagatggcggtgcccaccacccagtaa

SEQ ID NO: 13888 - DNA, 651 bp, Pseudomonas aeruginosa
aatggccaccagtgccatgagccgtttgttccgagccttccagacgaagatccgacctccgcactccatagacccggcaacgggatacccagaaaaataccgataacccaacgaggacccgagggtcgcgcctgctcgccagccggccggaccccggggcccggcgtgccagcgaccatgaacgatacggatagcagaaaagatccggacggctacaactacgacgtcgtccgccagttcaccttgatgaccctggtctggggcatcctcggcatgggcctgggggtgttcatcgccgcccaactggtctggccggcgctcaacctcgacctgccctggaccagcttcggccgcatccgcccgatccacaccagcctggtgatcttcgccttcggcggcagcgcgttgttcgccacctccttctacgtggtgcagcgcaccagcggcgtgcggctgatctccgatgccctggcgcgcttcgtgttctggggctggcaggcggcgatcgtggggatgatcgtcagctacccgtgggctataccacctccaaggaatacgccgagatggaatggccgctggcgctgtggctggcgatcctctgggtggtctatgcatacctgttcttcggcaccttcaccgttcgcaaggtga

SEQ ID NO: 13889 - DNA, 345 bp, Pseudomonas aeruginosa
ccgaacacggtggagccgggaagcgccacccatgttccacacagacatgaacgagagagaccgactcccatgaacgctacgctccgtttcaacgaggctttgctgatcaccgggcgcgccttccagccataccagtgcgttgcctggtccgagctaggcagtgacggcggcctgagcctgtccgtagtcgatcgcactggcacccgcctgctgggccgtgcacgcattccgagctccgcctactccgatccggagcagcttgccggcctgctgcaacaggcacgcgaagaactcagccacaacggctacaacctgcaggactggagtatgcccagccaaggctga

SEQ ID NO: 13890 - DNA, 1230 bp, Pseudomonas aeruginosa
cccgtcaccccgcctccagccgacgcgtcgtcaggcccggcggttgtccggagtgacgccatgctgctacgcaacccgaccctgctcctgctgttctgcggccaggccctgtactggtcctgctcgctgatcggcataaccctgaccgccctggtcggcgtccagctggcgccgttgaacagcctggcaaccctgcccctggccctgctggtgctgggcaacctgctggcggtgcagccgttgtcgcacttcatgcagcgccacggccgacgtcccgggctgatgctcggcgccggcggcggcgtgctcggcggcctggtctgcgccgccggtgtctggactggcgatttcctctggttctgtctcggcgcgctgggcatcggggtctaccaggcctcggccatgtactaccggttcgccgcgctggaggcggtggatgccgggcggaaaggccgcgccagcgcctacgtgctcgccggcggagtactcgccgcgctgctggcgccgagcctggcgctgtggtcgcgcaacgcgctggcccagcccttcgtcggcgcctatctgctgatcgccgtgctggccctcgccggcctgctgctgatggctctgctccgcgaaggccaggcgccacgcccggcacgactcgcctggcgcgacataggcggcctgttgcggcggccggtggtccgcgcggccatcgcctgcaccgcggccggacacgggttgatgatcctgatcatgaacgccacgccgctggccatgagcttctgcggcctgccgctggaacagtcgagtcgggtcatccagtggcacgtgctgggaatgttccttccggcgttcttcgccggaccgctggtcgaccgcatcggcaaccgtcgcgtcgccctgctcggcgcgttcctgctcgccgcaagtgccggcatcgccctggacgggcagtcggtcacgcatttcctgctcagttcgctggccctgggcagcggctggaacctgatgctcatcgccggcaccaccctgctcggcgagggccacgccgaaagcgagcgcggcgccgcgcaaggattgatggagcaaggcaacagcctggtggcggcgctgatgtcgttcggctccggcgccctgatcaccagccttggctggaacgcggtgaacctgctggtctggccggcgctgctggtggcgctgacactgctctggccggtacgacgaacgcggacgctgtcgcgctga

SEQ ID NO: 13891 - DNA, 2997 bp, Pseudomonas aeruginosa
ccgacccgccccttgtggagcgggtcgcgagactcagaggttctcgtagcggttcatgtccagtgcgcccgcctcgaccggctcggtttcgcggatgtacgcctcgagatcgtggaagtagctccagaactgcggattgctgcggcgcacgccccagcgttcgaccaccttgtcgaagtcctcgccgctcttcgccgcctccagggcgccgacgaaggcctcggcatccgtcgccggcagatcgaacatgaagttcgggtagctggacagcacgcccgggtagatcgtcagggtgtccaggcccggctggtagcgcagcgactcgccgagcatgaaggcgacattgctgtgcgcgcggttgcgcagcacggtatagacctcgcgcttgccgctggacgtacgtatccgcagcatggtcgcctcggggaagcgctcgatgaccttgaggccggccgccggccggctcaccaggcgactgaaggcctgctcggcgtcctgcagttcgcggtcgatgcccggtcgatagcagttgccgtccaggcagcggttgatcgggtcgggacgcgcattgaggtcgccgtagcgacgcagcagttcttcggcgaaggccttcttcggctgcttctccggcaatcccagcgcgctcggcgtgtcatcgtcgaaggcctggtagtccatccacatcttcagcttgccgctgttctggtaccagtcgtcgagcaacggctggcgcgcgtcgaccggcatcaggcggaggaagttctgctcggcgccgttgcggatcaggtcgaagtacagccgcgtctgcgcctggtgcgagacgttgccgaagacatcgaagttcaccaccagcccgtagtaggttcgctcgaacagcgggtagtccatcagccacagggtctgcggtacctcgccaagcaggcccttgcgcaccgaggcgctgtcgaactggcggaagatgctcagcagggcgttgtcgttgccgtgccagagcgtgttccaggtcggcggcggcgcgtcggcgtagacgtcctggcgcaggtcttcgtactcgttgcgcttgtcccggtaggcgctccacaggccgagcaggttcttcagctcgtcgatctgccccggcaaggccagcagcggctcgctctgcgcgcggaagttggcgtcggtgacgaacaggtcctgctcggggtcctggaataccacccagaagttgtcgcggatcacgtcggtggcgatctgtccacggcacaccggcccgcggatgaaggtacgggtgaagtattcggcgttatccagcatgaactggtagcgcgcccgtggcgggatcgcggcgaaggtggcgaacgggttggcgcggctctgcacgccgtagccgggaaccttgtcggtgttccactgggtgccgaagaacagctcctggacgcgttccagcttcttcgccgtcagcggataggtgatgtgcgtcttgtgtacgatcacgccctggatcggccagaggcggtaatagaagctgttgcccggatcgtcgttgggacgccgggtcgggatcgggtcgatcggctggccgctgggcgtgcgcgaacgcaccagctggaagaagtggccgggcgcgccctgctccgggaaatacaggtgcgccaggaacaggtgctcgtagagccagcgcgagaccaggctctgcttggccccaggctggttgaggaaacgctcccagctggccacctggcgcgcctcggcggcggtcggccgcaacggctgctggtcgaccggggcgcccgcggccagccacttctgcaaggtggcgtattcgtcgtcgctcagcccggccaccgcgaaaggcatgccggaacctgggttcttgcggatgaacgcatcgatgctggccggcgtcgggcactggttggcgcggttgatcgaaatgtccaggccttcggggatcttcgcattcggctgcaacggctggctgtggccaagctcgagcatccgcgccatcagtgcggcctggccatcctgcgattcgagcaccgaccagaagtccttgcgccgccaggcgtcggcaccgtgcgcatcgaggtacaggcgggtggtttcctgcgccttggtccgcgtgccgtcgtagaccggcagttggttggcgccgcgctgcgcgccctcggcgctgctcaggttgagctggcagggcgaatcgtagcaggcgtggcaggcgacgcacttggcggtaaagatcggctggacgtcacggctataggaaatttcagcagcggaaacagactggataaaagacgacaaaacgaaggccaacccaaccaacggtcttggcaacatgaaccactcctcactcggcgacgggcgattctagcaaacccgcctctctgcgccgcactttcacaacggcgggcgaactcgccccgggcacgagccgccatttcgccagcattccaccggcttcggccgccacgtatgctagccgggctcccaggcccgccctggcgatcaaggacgatgacttcgaggaaacagggatatgtttcgactcgccgcgccccatccgcgcccgttcgcgtgcgccccacgtcccctcttcgccgctttccgcctgctgtcgtcaggcggcgcttccgttcgcgcccggcgcggcctggtccatcctttcgccgccctggcggcccaacggagaacccgccccatgaaactgctcgccggcagcttcgccgctctcttcctgagcctttcggcccaggcggcggactgtactttcacccagctggaaatcgtgccccagttcggctcgccgaacatgttcggcggcgaggacgagcacgtccgcgtgatgttcagcaacgaggatcccaacgacgacaaccccgatgcctttcccgaaccgccggtctacctggccgaccgcgacagcggcaacgattgccgcatagaggacggcggcatctggtcgcgcggcggcgtgttcctgagccaggacggccggcgcgtgctgatgcatga

SEQ ID NO: 13892 - DNA, 468 bp, Pseudomonas aeruginosa
tacatggacagtctcgatcaatgcatcgtcaacgcctgcaagaacagctgggacaagagctacctggccggcaccccgaacaaggacaactgttccggcttcgtccagtcggtggccgccgagctgggcgtaccgatgccccgcggcaacgccaacgccatggtcgacggcctggagcagagctggaccaagctcgcctccggcgccgaggccgcgcagaaggcggcccagggcttcctggtgatcgccggcctgaagggccgcacctacgggcacgtcgcggtggtcatcagcggtccgctgtatcggcagaagtacccgatgtgctggtgcggcagcatcgccggcgcggtcggccagagccagggcctgaagtcggtcggccaggtgtggaatcgcaccgaccgcgaccgcctcaactactacgtctactccctggccagttgcagcctgcccagggccagttga

SEQ ID NO: 13893 - DNA, 2349 bp, Pseudomonas aeruginosa
acatccttcaacttgaatgaaattcatggtccgaccacccccggccggaaagcccctgcctttgttatgcttttcacctttccgcccactgacgccaggtccatccatgtccagcccgctcaccgatcgcagcgcccgcctgcaagccctccagcacgccctcagggaacgtatcctgatcctcgatggcggcatgggcaccatgatccagagctacaagctggaagaggccgactaccgcggcgagcgcttcgccgactggccgagcgacgtgaaaggcaacaacgacctcttgctgctgagccgcccggacgtgatccaggccatcgagaaggcctacctcgacgccggcgccgacatcctcgagaccaacaccttcaacgccacccaggtgtcccaggccgactacggcatgcagtcgctggcctacgaactcaacctcgaaggggcgcgcctggcccgccaggtggcggacgcgaagaccgccgagaccccggacaagccgcgcttcgtcgccggcgtgctcggcccgaccagccgcacctgctcgatttccccggacgtgaacaaccccggctaccgcaacgtcaccttcgacgaactggtggagaactacgtcgaggcgacccgcggcctgatcgaaggcggcgccgacctgatcctgatcgagaccatcttcgacaccctcaacgccaaggcggcgatcttcgccgtccagggcgtgttcgaggaactcggcgtggagctgccgatcatgatctccggaaccatcaccgacgcctccggccgcaccctgtcgggccagaccaccgaggccttctggaactcggtgcggcatgcccggccgatctcggtaggcctgaactgcgccctcggcgccaaggaattgcggccgtacatcgaggaactgtcgaccaaggccgacactcatgtctcggcccaccccaacgccggcctgccgaacgccttcggcgaatacgacgaatcgccggcggaaatggccgtggtggtcgaggaattcgccgccgccggcttcctcaatatcgtcggcggctgctgcggcaccaccccggcgcacatcgaggcgatcgccaaggcagtggccaagtacccgccgcgggccatcccggagattccccgggcctgtcgcctgtccggcctggagccgttcaccatcgaccgcagctcgctgttcgtcaacgtcggcgagcgcaccaacatcaccggttcggccaagttcgcccggctgatccgcgaggaaaactacgcggaagctctcgaggtcgcccagcagcaggtggaagccggcgcccaggtgatcgacatcaacatggacgaaggcatgctggactcgaaggcggccatggtcaccttcctcaacctgatcgcctccgagcccgacatctcgcgcgtgccgatcatgatcgactcctccaagtgggaagtgatcgaggccggcctgaagtgcatccagggcaagggcatcgtcaactcgatctcgatgaaggaaggcgtcgaggccttcaagcaccatgcccgcctgtgcaagcgctacggcgccgcggtggtggtgatggccttcgacgaggacggccaggccgacacccaggcgcgcaaggaagaaatctgcaagcgctcctacgacatcctggtcgacgaagtcggcttcccaccggaagacatcatcttcgatgcgaacatcttcgccatcgccaccggcatcgaggaacacaacaactacgcggtcgatttcatcaacgcctgcgcctacatccgcgaccacctgccctacgccctgagctcgggcggggtgtccaacgtgtccttctcgttccgcggcaacaacccggtgcgcgaggcgatccactcggtgttcctctactacgcgatccgcaacggcctgaccatgggcatcgtcaacgccggccagctggaaatctacgacgagattccgaaagcgctgcgcgaccgggtcgaggacgtggtgctcaaccgcacgcccgaggccaccgaggccctgctggcgatcgccgacgactacaagggcggcggcgcggtcaaggaggccgaggacgaggaatggcgcagctacagtgtcgagaagcgcctcgagcatgcgctggtcaagggcatcaccacctggatcgtcgaggacaccgaggaatgccgccagcagtgtgcgcgtcccatcgaggtcatcgaaggtccgctgatgtccgggatgaacgtggtcggcgacctgttcggcgccggcaagatgttcctcccgcaggtggtcaagtccgcgcgagtgatgaaacaggcggtggcccacctgattcccttcatcgaggcggagaaaggcgataa

SEQ ID NO: 13894 - DNA, 1356 bp, Pseudomonas aeruginosa
cgtggtcgacctcggcgtgatggtgccggcggagaagatcctgcagaccgccatcgccgagaaatgcgacatcatcggcctgtctggcctgatcacgccgtcgctggacgagatggtccacgtcgccaaggaaatgcagcggcagaatttccagttgccgctgatgatcggcggcgccactacctcgaaggcgcataccgcggtgaagatcgatccgcagtacagcaacgacgcggtggtctacgtcaccgacgcctcgcgcgcggtaggcgtggccaccagcctgctgtccaaggagctgaaggccgactacgtggcccgcacccgcgccgactacgcggtggtccgcgaacgcacggccaaccgcagcgcccgcaccgagcggctgagctacgaacaggcgatcgccaacaagccggcgttcgactgggccggctaccaggcgccgacgccttccttcaccggcgtcagggtgctcgacgagatcgacctcgcggtgctcgccgagtacatcgactggacgccgttcttcatttcctgggacctggccggcaagtacccgcgcatcctcaccgacgaagtggtcggcgaggccgccacctcgttgttcaacgacgcccaggcgatgctgaagaagctgatcgacgagaagctgatcaaggcccgcgcggtgttcggcttctggccggccaaccaggtcgagcacgacgacctggaggtctacggcgccgatggcgagaccctcgccaccctgcaccacctgcggcagcagacgatcaagccggacggcaagccgaacctgtcgctggccgatttcgtcgcgccgaaggaaagcggcgtgcgcgactacatcggcggcttcatcaccaccgccgggatcggcgccgaggaagtggccaaggcgtacgaagccaagggcgacgactacaacagcatcatggtcaaggcgctcgccgaccgcctcgccgaagcctgcgccgagtggctgcacgagcgggtgcgcaaggagtactggggctacgcccgcgacgagcacctcgacaacgaggccttgatcaaggagcaatacgtcggcatccgcccggcaccgggctacccggcctgccccgaccataccgagaaaggcaccctgttcgaactgctcgatccgcagggcctgtccggcgtcagcctgaccgagcactacgcgatgttccccgccgcggcggtcagcggttggtatttcgcccacccgcaggcgcagtacttcgcggtcggcaagatcgacaaggaccaggtggaacgctacagccagcgcaagggccaggaagccagcgtcagcgagcgctggctggcgccgaaccttggctacgatga

SEQ ID NO: 13895 - DNA, 381 bp, Pseudomonas aeruginosa
ctgaccaggaaggcgacgatgaaattcctcactcccgagcagatggaaaagccgcgcaagcgccgcctgcgcaagaaactgcgcctgggcgagttccaggagttcggcttcagcttcgaactgacctacgaccgcagcgccctctcccacgacgatgcgctggaccatctgatcgacttcgtcgaggcccagggctgggtgttcggcggcggaggctcgccggaacaggcggagatcagcggctacctgtgcctggcgcgggtcggcagcctggacgaagcggaccgggaaagcgcccgcctgtggctggaagcccaaccctggtgcaagaccttcgaggtcggcccgttgagcgactgctggcacaacttcttcgagtga

SEQ ID NO: 13896 - DNA, 1164 bp, Pseudomonas aeruginosa
ccaagacctccaccagcgcctcgccgatctcggcgccaagcccctgcattgcgggaggatcgtccgcgcctggctgcagggccgcgccctcgatgcctgcaccgcccgccagcgggccgaggacttcctgccgctgggcgtacgccatggtctgccccaggtagcagcggaactggaaggcatcgcccgcctgcacagcgagcatccggcgagcgacggctcgtcgcgcctgctggtggaactggccgaccggcagatggtggaaagcgtgctgctgccgcgcggtgggctgtgcgtctcgacccaggtcggctgcgcggtcggctgcgtgttctgcatgaccggccgcagcggcctgctgcgccaggtcggcagcctggagatggtcgcccaggtggtcctggcgcggcgccggcgagcggtgaagaaagtggtgttcatgggcatgggcgagccggcgcacaacctcgacaacgtcctcgaagccatcgacctgctcggcaccgatggcggcatcggccacaagaacctggtgttctccaccgtcggcgacccccgcgtgttcgagcgcctgccccggcaacgggtgaagcccgccctcgccctgtccctgcacagcacccgcgccgaactgcgccggcaactgttgcccaaggcgccgccgctgagcccggaagaactggtggaagccggcgaggcctacgcccgccgggtcgactatccgatccagtaccaatggaccctgctcgaagggatcaacgacagcctggaggaaatggacggcatcctgcgcctgctcaagggccgcttcgcggtgatgaacctgatcccctacaacagcatggacggcgacgcctaccggcgcccgagcggggagcggatcgtcgagctggtgcgctacctgcacagccgcggcgtgctgaccaaggtgcgcaactcggccggccaggacatcgacggcggctgcgggcaactgcgcgccagggccacgcagggcacggcggaacgacgcatccccgcccgccaggcctgaagccaccctcctcccgccaagggtctagactctcagggcaggtatggaaaagggaggaccaccgatgggtatcgagacggaagaaccgaaccagaagccgccgaccttctggcagatgctgcatagcgtga

SEQ ID NO: 13897 - DNA, 555 bp, Pseudomonas aeruginosa
ggagttccgcccgctgcgcctgcagaacggtctctatatccagcgctatgccccgatgctgcgcatcgccgttccctatggcctgctctcctcgcgccaactgcgcaagctggcgcagatcgcccgcgactacgacaagggctacgcccacatcagcacccggcagaacgtgcagttcaactggccggagctggaagacgtgccggaaatcctcgccgagctggccaccgtgcagatgcacgcgattcagaccagcggcaactgcatccgcaacaccaccaccgaccagttcgccggcgtcgcccgcgacgagctggtggacccgcgcccctggtgcgagatcatccgccaatggtcgaccttccaccccgagttcgcccacctgccgcgcaagttcaagatcgcggtgaacggcgcggtgagcgaccgtgccgccatcgaagtgcacgacatcggcctggaggcggtgaagaacgaggccggcgagctcggcttccgcgtctcggtcggcggcggcctgggccgaacccccatcgtcggcagcttcatcaatga

SEQ ID NO: 13898 - DNA, 471 bp, Pseudomonas aeruginosa
attcctgccctggcagcacctgctcggctacctggatgccatcctgcgcgtctacaaccgctatggccggcgcgacaacaagtacaaggcgcggatcaaaatcctggtcaaggcgctgaccccggaagtcttcgccgagcgcgtcgaggccgaatgggccaacctcaaggacggaccgagcaccctcaccgaggcggaagtccagcgcgtcgccgcgcatttcgtcgatccggcctacaaggccctcgacgacctcgacgagtccctcgcccggctcgacgcggagcaccccggcttcgcccgctggcgcgcacgcaacaccttcgcccacaagaagcccggctacgtcgctgtgacgctctcgctgaagcccaccggcaccgcgccgggagacgtcaccgacaaacagctggaggccatcgccgatctcgccgaccgctacagcttcggcgaggtgcgcaacagccataa

SEQ ID NO: 13899 - DNA, 615 bp, Pseudomonas aeruginosa
tcagaacatcattctcgccgacgtcgagcagggcgaactcttcgccctctggggcgaactccgcgaactgggcttcgccacccccaacgtcggcctgctgaccgacatcatctgctgccccggcggcgacttctgctccctggccaacgccaagtcgatcccgatcgccgaagccatccagcgccgcttcgacaatctcgactatctattcgacatcggcgacatcgacctgaacatctccggttgcatgaacgcctgcggccatcaccatgtcggccacatcggcatcctcggggtcgacaagaaaggcgcggagttctaccaggtctccctcggcggcagctcggcgcgcgacgccagcctcgggcagatcctcggcccgtccttcgcccaggagcagatggccgacgtgatcgacaagatcatccaggtctacgtggaacgccggaccgaggaagaacccttcatcgacaccttccgccgtatcggtatcgacccgttcaaggagcgcgtatatgcagcgaatcattaaggaccgccaggtggtcgacgaccgctggcacttgctgcccaaggacgcgaccctggaaagcgtacccaacagcgacgacgtga

SEQ ID NO: 13900 - DNA, 924 bp, Pseudomonas aeruginosa
acttccccgcctttaccgatggccgcggcttcagcagcgcgcgcctgctgcgcgagcgctacggctacaagggcgagatccgcgcgatcggcgacgtgctgcgcgaccagctgttcttcatgcgccgctgcggcttcgacgcctacgccatccgtgccgaccgcagcccggaagacgccctggccagcctggacgacttcagcgaggtctaccagacctcggtggagcagccgctaccgctgttccgccgccgcggctgacccccgccctgacgaaaaagccccgcagccgcggggctttttcattcccgaggtcacggacgcctcaggccgcccgcacgctgtcccaggccacctgcgccagcagttcgcgacagtcggccaacgccacccgggttcgcccggccagccactggcgggcaagatcgtgggccgggccgatcaccaccgaagcaaagcagtcgtccggcatctcgcggaacaggccctcggcccgatatcccgccagcgccgcatggatccgtgcgaagtgcgcctggttgtcggcccgcaggcgctcgcccagctcccccgcctccacccgcccgcggctgtgcaggatgaagcgtgcccagtcgggattcgccacgacccagtcgatgtagctggtgaccagcaacctgaccgtttcctcggcgctgcgcgccctggcgaagccggcttcgagcaacgccgcgtactggccgatcccggccaggtacagttcgccatggatgcgttccttgttgccgaaatggtggtagaggctaccgatgctcgctccggaacggtcgcggatcatctcgatggtggtggcgtctacgccatgctcgctgaagcaggccagggcggcctggagaatctcgtctttgcgggaagaacggcccatgtcggtccttgtcgataa

SEQ ID NO: 13901 - DNA, 1134 bp, Pseudomonas aeruginosa
ccgtcgagtacctggccaaggccactggcgacgtgcgcgcggtggccgacggcagccagatcgactggcaagccaccggcaacctggtggtgccggtggtcgcctatgtcgacgacaagccggtattccgcgccgagatcaccatgtacgtcagccaggcctgaccgccaaggcgccccggccgtgctttcggccggctggaggcgccctggcggccagctctattctcgaagccatgagcagaccacggagaccggcatgaaccctccgcaaccacgcctcatcgataacggcaacggccatccgctggccagccattggtaccggcctgccggggagccgcgcggctatctcctgatcgtcccggcgatgggagtggaacagcgcttctacgcgcccttcgccgcctggctggcagagcgcggctacctggccatcaccttcgactacctgggcatggggcaatcgcgcaacggctcgctgcgcggtctcgaggtcgatgtgctgggctgggcccgtcatgactgcagcgccatgctcgccgccgcgctcgccgagagcgggagcaagcccctgtactggatcggccatagcctgggcggccagatcctgcccttcgtcgaagggcgcgagcgtatcgatagggtcttcagcatcgccagcggcagtggctactggaaggaaaacagcccgcggttgcgcaacaaggtctggttgttctggtacctcgtcgcgcccctgctgacgccgctgctcggctattttcccgggcgccgcctgggcatggtcggcgacctgccgcgcggggtgatcgaacaatggcgacgctggtgcctgcatccgcagtacgccctcgcggatggcgaggccatccgccgcgccttctccgccgtacgcacgcccatcgtgtcgctgtcgttcaccgacgatgaaatgatgtcccgacgcagcatcgagtcgctgctgggcttctaccgcgaagcgccgaaaaccgcctggcgcatcgctcccgaggaaatcggcgcccgccacatcggccatttcggcttcttccggccgcagttcgccgaatcgctatgggcgggctacctgttgccggagctgggctccggtaacgccctcagccgaggttga

SEQ ID NO: 13902 - DNA, 1164 bp, Pseudomonas aeruginosa
attagccaattatcgccggtcaccatcattgcgcagcctgatgcgcgcaccggctcccgcggctccgccgtggcaccacgagaagggaaccccatgtcgctgaccgaccaatccactcgcatccgcgccggcgaagaactcgacgccgccgtcatcgacccgtacctgaaagcccatatccccggcctcgaaggcaccccgaagatcagccagttccccggtggcgcgtccaacctgacctacctgatcgagtatccgcgccaggagttcgtcctgcgtcgcccgccattcggccacaaggccaagtcggcccacgacatgggccgcgaataccgcatcctgaaccagttgaacgcaggcttcccctactgcccgaaagcctacctctactgcaccgacgagtcggtgatcggcgccgagttctacgtcatggaacgggtcaagggcatcatcctgcgcgccgaactgccgcctgagctgaatctcgacgaacaacagacccgcagcctgtgcaagagcttcatcgacaagttcgtcgaactgcacaacgtcgactacgccgcctgcggactggccgacctgggccgcccggacggctacgtgcagcgccagatcgccggctggaccgaccgctacgagaaggccctgacccccgacgcgccgctctgggaaccggtcaaggcctggctcaaggacaagcagccggccgatcaccacaagccgggcatcgtgcacaacgactaccgcttcgacaacgtgatcctcgacccggaaaacccgatgcagatcatcggcgtgctggactgggaactggccaccctcggcgatccgctgatggacctcggcaataccctcgcctactgggtggaagccggcgacccggctccggtgcagctgacccgccgccagcccagccacctgccgggcatgctgacccgccgagagttcgccgactactacgccgagcgggccgggatcccaccgatcgacaacctggacttctactacacctatggcctgttccgtcttgccggcatcgtccagcagatctactaccgctactaccacgggcagacccaggacaagcgtttcgcccagttcgtgcagatgaacaagctgctggagcagatgagcctgcaggccatcgagcgctcccgcctgtaa

SEQ ID NO: 13903 - DNA, 771 bp, Pseudomonas aeruginosa
cccatgtccaagacccacctgttcgacctcgacggcaagatcgccttcgtttccggcgccagccgcggcatcggcgaggcgatagccaagctgctggcccagcaaggcgcccacgtgatcgtctcgagccgcaagatcgatggctgccaggcggtcgccgacgcgatcaccgcggagggcggcaaggccaccgcgatcgcctgccacatcggcgagatggagcagatccagaacgtcttcgcacagatccgcgagcagttcggccgcctcgacatcctggtcaacaacgccgccaccaacccgcagttctgcaacgtactggaaaccgacctcggcgccttccagaagaccgtcgacgtcaacatccgcggctactacttcatgtccatcgagggcggcaagctgatgaaggaacacggcggcggcagcatcatcaacgtggcctcgatcaatggcgtatcgcccggcgagttccagggcatctactcggtgaccaaggccgccgtgatcagcatgaccaaggtcttcgccaaggaatgcgcgcagttcggcatccgctgcaacgccctcctgccagggttgaccgacaccaagttcgcttcggcgctggtgaagaacgacgcgatccgcaacctcgccctgcagcgcatcccgctcaagcgcgtggccgagccgagcgaaatggcaggcgccgtgctctacctggctagcgaagcgtccagctacaccaccggcgtggcgctgaacgtcgacggcggcttcctttcctga

SEQ ID NO: 13904 - DNA, 1035 bp, Pseudomonas aeruginosa
cgggcttcctctgtaatggatggaacgcctcgtctggccagagcgagcgtacggatggattttcgacggatccgccgcgatatatccaatactgtctttcttaactcaccatatccgggagatatcgcaatggccgacttgcgccagttccgccagttcgtcgcggttgccgaggagctgagcttccgccgcgccgctgagcgcctgcacatggcccagccaccgctgaccactgcgatccggcggctggaagaagaagtcggcgccagcctgctggagcgtgacaaccgtatccaccgcctgacgccggcaggccgcgcgttcctcgacgaagcccggcgcaccctggcccaggccgaacgcaccctggcggccgcgcgcagcgccgccagcggacgcagaacgttgcgcctggcgttcgtcgacagcaccatcaatattctgctaccgcgcatactccaggcgttccgccaccagcatggcgcgctggacttccagctccaggaagacaccaccgcggggcaactggaggcgttgcgcgaagaccgcatcgatgccggcctgatcgttctgccggtcgactgccagcccggcctgtacacacatctactggtggacggcgacatgcgcgtggcattgcccgaagggcatcggctggcacgccatgcgcgcctgcgcctggaacaactggccggagaaccctggctgctgtttccacggcactatgggccgggcatgcacgacctgatcgtcgccgcctgcgcggcagccggcttcgtcccggaggtggtgcaggaggcgcggcagatgcagaccatcgccgggctggtggccggcggcatcggcgtcgcgctagtgccttcgctgctacaaccgttgcgcccgccgggggtcacctttcgtcccctgcaagggcggcgggcgcgaattccctatcggctggcgctggcctaccgcacgccgtcggaactcatcgaacgctttcgcgaaaccgcccaggcgatcgccgccgccccggcttttcgcatggcctag

SEQ ID NO: 13905 - DNA, 858 bp, Pseudomonas aeruginosa
aattgcgggcattatgcgcacccctcctcccgacggccagcgaggccgtttcccgattggaagcaggtccggtttttcatgcccttcgaactcgcgatagaccccagcaccctgatcatcctggccgtggtggcctttctcgccggcttcatcgacgccatcgccggcggcggcggcctgttgaccatccctgcgctgctcaccgccggggtcccgccgcacctggcgctgggtaccaacaagctgagctcgaccttcggtgcggcgaccgccagctacaccttctaccggcgcaagctgttccatcccgggaagtggcgcaacggtttgctcgccaccgcgatcggcgccgccataggcgcctgggcggctcacctgctgcccgccgagtggctgaaccggatgctcccggtggtggtattcacctgcggcctctacatgctcttcggcggcacgccgaaggcgccgctggacgccgatgcgccgctcggacgcaagcgccagtggccgcagggcctcgccctgggcttttacgacggcgtggcgggaccgggcaccggagcgttctggaccgtcagctcgctgctcatgtacccgctggacctggtccgcgccagcggtgtggcgcggagcatgaacttcgtcagcaacatagtggcgctggcggtgttcgtcgcctccggccaggtgatctggttgctcggcctgtgcatgggtgcgtcgctgatggtcggcgcctatttcggcgcgcgcaccgccatcggcggcggggcgaagttcattcgcccggtgttcatcctggtggtcctggcgctgaccgcgcggctagcctggcagcactggttcagcggcgcctga

SEQ ID NO: 13906 - DNA, 849 bp, Pseudomonas aeruginosa
cggcggcaaggcatcgagggagaaccactgggcgtcctcgatctcgtcctcctgcgggacgatctcgccggacacgtactcggcgtggaaaccgagcatcagcgaatgcgggaacggccagttctggctgccgatgtattcgagattggcgacctccaccccgacctcttcgcgcacctcgcggaccacgcactgctccaccgactcgccggcctcgacgaagccggccagggtactgtatacccccggcacgaagcgcggcgaacgcgccagcaacacctcgtcgccccgggtcaccaggacgatcatgctcggcgacaggcgcgggtactggtgcagcccgcactgcggacactgcatcacccgctcgtggtcctgcgtctgcatgcgtgtgccgcaattgccgcagaaccggttgtgacgtgcccagatgccgatctggctggcatagccgagcatgcagaactgatcgaaatcgccgtgcagcatgaactgccgcaacggcgcccaggccatgcccggcagctcgatcggctcgtccagttccagcacgtagaccggctcgccctgccaatggccgaccccatgttcggcgagcagcgggagttcctggcgcttcagccattcgcgggggaacagcaggccgttgtcgtcctggaggaagcgctgctgacagtgcgcgagcacccagccgccgacctgggcggtagccggccgacctgcctgccagcggaactcgccggccatcaggcggccaccggcagtccgagcgccttgacgctggcgctggccaggtcgaggacgtccggctggccctgcggacgcagcacggcaccgccctcgagatag

SEQ ID NO: 13907 - DNA, 1557 bp, Pseudomonas aeruginosa
tccaacgaaagtcctgctggcattttcagtcttttccttgccgtggagtccatcgtgagcagtcccctgagccaggctttcgcacagaacttcctcgggcattcgccgcgctggtacaagctgacggtgctcgccttcctcttgctcaaccccctgctgctatggctggccgggccggtgacaagcgcctgggtgctggtcggcgagttcatcttcaccctggccatggcgctgaaatgctatccgctacagccgggtggcctgttggtgctggaggcgctgctgcttggcctggctacccccgaggcgctctatgcggaattgcagcacaacttcccggtgctcctgctgctgatgttcatggtcgccggcatctacttcatgaaggacctgctgctcctgctgttttcccgcctgctgctcggcgtgcgctcgaagaccctgctatcgctcctgttctgcctgctggccgccctcctctcggccttcctcgacgccctcaccgtgaccgccgtggtgatcagcgtggcggtggcattcttcgccgtgtatcaccgggtcgcttcggggcagcgcgccagcgaggactacgatcccgccaccgaccgccaggtccccgagctgcaccgggcccatctcgaggaattccgcgccttcctccgcagcctgctcatgcacgcggcggtcggcaccgcgctgggcggcgtctgcaccctggtgggagagccgcagaacctgctgatcggccacgaggccggctggcatttcgtcgagttcttccgccaggtcgcgccggtatccatgccggtactggcggccggcctgctgacctgcgtgctgctggagaagagccgccgcttcggctatggcgcccagttgccggcggcggtgcgccaggtgctcgccgagtacgccgccagcgaaagccgcaaacgcggagcgcagcagaaggccgcgctgctggtgcaggccctggcggcgctggtactgatcgtcgggctggccctgcatgtcgccgaggtcggcctgatcggcctgttggtgatcgtgctgatcactgccttcaccggcgtcaccgacgaacaccagatcggccgcgccttccaggaggccctgccgttcactgcgctgctggtggtgttcttcgcggtggtcgcggtgatccaccagcagcacctgttcaccccgatcatccaggcggtgctggcgctgccgacggaacgccagccgggcatgctgttcatcgccaacggcctgctctcggcgatcagcgacaacgtattcgtcgccaccatctacatcaccgaggtgaaacaggcgctggatgccggccacatgagccgcgagcatttcgataccctggcggtggcgatcaataccggcaccaacctgcccagcgtagcgacgcccaacggccaggcggcgttcctcttcctgctgacctcctccatcgccccgctggtgcgcctgtcgtacggccgcatggtctggatggcgctaccctacaccctggtgatgggcggcctgggctggtgggcggtcagtcattggctttga

SEQ ID NO: 13908 - DNA, 2412 bp, Pseudomonas aeruginosa
gcccgccgaacgccgccaggctggagggaagcaggaagactcccgaaccgaccatgttgccgatcaccagcgcgctgcaggtccagaaccccatgccgcgcttgccggccttctctccccccgccatcgacaccccttagcctgtcggcctcattcttttatgcattcaacggtatagcagcgcccggacggtccgtcctgatgctgcaggccgtgcacatcggagtcgaaaccagggaaggcgcgctcgaaggtccgcgcgaactcgagatagtcgaggatcgagcgggtcgcctcggtgaagcgctcacccggcatgatcagcgggatacccggcggatagggtaccagcatgacggccgcgatgcgcccttccaaccgagcgatcggtaccgcctcgacctcgccgcgcaccagcttgtcgtaggcctcggacggccgcatcgcgacctccggcagcaccgtgtacatgcgcttcatggccttcgccgtggcgttgtcgcggtaactggcgtgcatggcgtcgctgaggtcgcgcaggcccactccgttgtagcgcttgccgccggcctgggccacggagggcaagacgtcgagcaccggcaggttggcgtcgtaacagcgcttgaattcgagcagttcggtgaccagggtgctccacttgcccttggtgatgcccatcgagaacagcaccaggaaggagtagagaccggttttctccaccaccagcccgcgctcccagaggaagcggctgacgatggcagccggaatcccctgctcgctgagcttgccgccggcgctcaagcccggggtggtcagggtgaccttgatcggatcgagcagcacgtagtcttcggcgatatcgccgaagccgtgccagtcggcgctcggctccagcacccaatcatgggtgccgacctgatcggtgccctccacctgctccggctgccagacgccgaaccaccagtcgttccggtccaggttctgccgtacgttggccagggcccggcggaagctgagggcctcgtcgaaggtctcctggatcagcgaacgcccggcgggcccttccatcatcgccgaagccacgtccagcgaagcgatgatgccgtactgcggcgaggtcgagatgtgcatcatgaaggcttcgttgaagcgcgccacgtccagcttccgggtcccgccatcctgcacgtggatcatcgaggcctggctgaaggcggcgagcatcttgtgcgtggagtgggtggcgaacaccaggggtccctcctcgctgcgcgaggtgcccatgccatagcgtccgtcgtagaactcgtggaacgcggcataggcgtaccaagcctcgtcgaagtgcaacacctcgacgctgtcgccgagggtctgcttgatcagctcggcgttgtagcacaggccgtcgtaggtggagttggtcaccaccgccagcttcaccttcggctcgcggccgcgcgccagcgggctggcggcgatcttcgcggcgatcgactccttgctgaattcgctcagagggatcggcccgatgatccccagttcgttgcgttccggagtcaggtagagcggtatcgccccggtcatgatgatcgagtggaggatcgacttgtggcagttgcggtccaccagcaccaggtcttcgcgaccgaccatggagtgccagacgatcttgttcgcggtggaagtgccattgatcacgaagaaggtatggtcggcgccgaaattgcgcgcggcacggtcctcggcctcggccagggggccggtatggtcgagcagcgatcccagctcggggaccgagaccgacaggtcggaacgcagcgtgttctccccgaagaactggtggaacgcctgtcccaccggactcttgcgataggcgacaccgccgccgtggcccggcgtatgccaggaatagttggactgcgcggtgtgctcgaccagcgcacggaagaatggcggcagcagcccggccaggtagttgcgcgccgcccgggcgacctggcgggcgaggaacggcacggtgtcttcgaacaggtagaggatgccgcgcaactggtgcaggtcggccatggactcggccggcgcgttctcgatggtcacctgctcgccgagggcgaagatcggcaattgcggcgcccgcacgcgggccacgcggatcagttcgaccacatcctgcagcaggcgctggttttccccggcaccttcggcggcgaccagaatgcaggccaggccgtggtgggtggaagcgacgatgcgcccctcggcggagctggcggtggagagaatgctgaagccgtcctgctccagttcgtgggcgatgccccgcacgcgttcgccggcaacggtgtcggccttgatgtcgcgatggacgatgaggacgggaaatttgaggtctttatacattgttga

SEQ ID NO: 13909 - DNA, 789 bp, Pseudomonas aeruginosa
cgacatcgacccatgatacagatcgacgccctgtccgccttcaacgacaactacatctggctgttgcaagatgcgacaagccgtcgctgcgcggtggtcgaccccggcgacgccaagccggtggaagcctggctggccgcccatcccgactggcggttgagcgatatcctggtgacccaccaccatcacgaccacgtcggcggcgtcgcggccctgaaggaactgaccggcgcgcgggttctcggcccggccaacgagaagatcccggcccgcgacctggcgctggaagacggcgaacgggtcgaggtgctcggcctggtcttcgagatcttccacgtgcccggccataccctcggccatatcgcctactaccacccggcggagacgccgctgctgttctgcggcgacaccctgttcgccgccggctgcggccgtctcttcgaaggcaccccggcgcagatgcatcattccctggcgcgactggccgcgctgccggccaacacccgggtctactgcacccacgagtacacgctgagcaacctgcgcttcgcgctggcggtggagcccgacaacgcagcgctgcgggaacgcttcgaggaagcgacccggctgcgcgaacgggaccgcatcaccctgccgtcggaaatctcgctggaattgtcgaccaatccatttcttcgcgtttcggaaaaatctgttaagaaaaaagccgaccagcggagcggccagcaaaaccgcaccccggaggaggttttcgccgtcctgagggcctggaaggaccagttctga

SEQ ID NO: 13910 - DNA, 546 bp, Pseudomonas aeruginosa
acgccctggctcgcgccgttcgggtgtccatcctgctcatcgccggtgcgctcgccggctgccagggcagcggccagatcaagggggaggcccaggccaaagcagcacgtcccggcgcccgagccgtcgacgtccagttcaacccctcctggctgcatacccagcccggccagaacgccgcctacaacgacatctgggaccgcatgcgcgacggtttccagctccaggatgcgatcagcaccaacccgcgcatcgaacgccagcgcctctggttcctcagcaaccagtcgttcctcgaacaatcgagcgcgcgcggcagcctctacatgcactacgtggtcgagcgcctggaagaacgcaacatgccgctcgaactggcgctgctgccggtcatcgaaagcgcctataaccccttcgccctgtcgcgcagcaacgccgccggcctctggcagttcattcccgccaccggccagcatttcaacctgcgccagaccaatttctacgacggtcgccgcgacatcaccgcctcgaccaatgccgccctga

SEQ ID NO: 13911 - DNA, 2049 bp, Pseudomonas aeruginosa
ccctgtacctggacaccgcgagccgctgacagcccattgcaggccgtcccgaaacgccacgcccgctcctgccggcgtggcgttttcgcaagcgcggccagaaccccggaccctaggccggacaggcccgcgctccctcttttttcctgtgcgggcaaggtgttactgttgcctgacgattcgttgtcaaaaatagccaaggacccggacacacgcctgatgcgtcgcctctccttcctgatcctcggcctggccgtgagcctgcccagcttcgccgcgattacccagagccatggttatgcccaattcggcacgctcaagtatccggccaatttccagcacttcgactggaccaatcccgacgcccccaaaggcggcaccttgcgcctgatggcctcgggcagcttcgacacgctcaacccctacaccctgaaaggcaccagcccgatcggcaccggcgatttcctccagtacggagtcaacgagctgaacgaaccattgatggtgggcaccggcctgtacgacccgtccggcgacgaaccagcctccagctatggcctgatcgcgaagagcgtggaatacgcggaaaaccgcagctgggtggtattcaacctgcggccggaagcgcgcttccacgacggcaggccgatcaccgccagcgacgtggccttttcctatcgcaccctggtcaagcaggggcacccgatgtaccgcacctacctgcaggaggtgaagcgggtcgatatcctcaccccccaccgggtgcgtttcgtcctgcggcgctccggcaacccgctgctgatcctgcgcctgggcgagcttccggtgctgccgcagcattactggaaggatcgcgacttccgcgccaccaccttcaccgcgccgctgggcagcggtccctatcgcatcgtcgaggtcgatcccgggcgccgcctggtgttcgaacgcgtgaagggctggtggggcgaaaaactgccggtgaaccgcggcaaatacaatttcgaccgggtcgtggtggacttctaccgggacaacggcgtcgccttcgaagccttcaaggccggcgagttcgacttctacatcgagcaccaggcgaagaactggctgaacaactatcgcttccccgcggttctgcgcggcgatgtgatccgcacggaaatcccgcaccagatccccagccagacccaggcgttgttcatgaacacccgtcgcgccgtgttcaaggagcgcgcgctacgccaggcgctgggcgagatgttcgacttcgaatggaccaatcgcgccctcttcagcaattcctacctgcgctcgcgcagctactacccgaacagcgaattcgccgccagcggcgtcccggagggccaggaatggctgtacctgtcgccgtaccgcaagcaattgccggcgcagttgttcaaacagccgttcagcctgccgaccaccgaggggcgcggcattccccgtgaaaccctcaggcatgcactcggtctactggccgatgccggctggaagctgtccggcgaccgactgctgaataaaaagggcgaaccgctgcgcttcgaaatcctgctggtcaatccgagcctggagcgtattctccagccctatcgcgaaaacctcgccagcatcggcatcgacgcgcgcctgcgcaccgtcgaccgcgcccaatacaagcagcgcctggaccagttcgactacgacatgatcctcatgaccctgccacagaccctcagtcccggcctggaacagtggcagtacttccactccagccaggtgaaggtcaagggcagcaagaattacgcgggcatcgccaacccggtggtcgacgccatgctcaaccgcctgctcggcgcccacagccgcgacgaacaggtcgccgccgcgcgcgccctggaccggaccttgctctggcagtactacagcattcccaactggtacctcaattcgcaccgtctggcgtaccgcaaccgcttcgccttcgtcgccaccccgccctacaccctgggcctgcgcgcgtggtggcagaaaaacctggagacgtcccgatga

SEQ ID NO: 13912 - DNA, 564 bp, Pseudomonas aeruginosa
tcctcggccagatcgcgatcctgccgaaacactggtgggccgaccgcgacttttccaagaccggcatggaaattccggtgggcagcggcccctaccgcatcgccaaggtcgatccgggacgctccatcagctacgagcgagtcaaggactggtgggccaaggaccttccggtctcccgcggactctataacttcgacaccatcaccatcgactcctatcgcgacatgtcggtcgccctggaagccttcaaggccggccagtacgacgtcaacctcgaatattcggcgaaggactgggccaccggctacgagtcgccggcattgcgcgacgggcgcttcatcaaggccagcatccacaaccacaacccggtggggatgcagggcttcgccttcaatatccgccgcccggtgttccaggaccgccgggtacgccaggcgatcagcctgctgttcgacttcgaatggtcgaacaagcagctgttcttcagctcctacaagcgcaccaacagctatttcgagaactcggagatggccgcccaccagttgcccagcgaagccgagctga

SEQ ID NO: 13913 - DNA, 1083 bp, Pseudomonas aeruginosa
tcagcgatatcgtctacaccctggtcgatccgcgcatcgacttcgagaaccgggagtaatccgatgcgcctgtctcccatcaaccagcgccgctgggcccgcttcaagagcaacaagcgtggctggtggtcgctctggctgttcctcatcctgttcgtcggcagcctcggcgccgaactgatcgccaacgacaaaccgctggtcgtgcattacgacggcggctggtacttcccggtcttcaaacgctacccggaaaccaccttcggcggcgaattccccctggaagccaactacaagagcccctacatcagccaactgatcgccgagaaggacggctgggtgctttggccgccgatcccctacagctacgacaccatcaactacgagctgaaggttcccgcccccgccccgccgtcggcggaaaactggctgggcaccgacgaccaggcccgcgacgtgctcgcccgggtgatctacggcttccgcgtgtcgatcctcttcgccctgaccctgaccgtgctcagttctctgatcggcgtcaccgtcggcgccctgcaaggctactacggcggctgggtcgacctgctcggccagcgtttcctggaagtctggtcggggctgccggtgctctacctgctgatcatcctggccagcttcgtccagccgaacttctggtggctgctgggcatcatgctgctgttttcctggatgagcctggtggacgtggtccgcgccgagttcctccgcgggcgcaacctggaatacgtccgcgccgcccgggccctcggcatgcgcaacagcgccatcatgttccgtcacatcctgccgaacgcgatgatctcgaccctgaccttcatgccgttcatcctcaccggcgccatcggcaccctcacctccctggacttcctcggcttcggcctgccgcccggcgcgccgtcgctgggcgagttggtcgcccagggcaagtccaacctccaggcaccctggctgggcatttccgccttcgtggtgctggcggtcatgctgagcctgctggtgttcatcggcgaagccgcccgcgacgctttcgacccgaggaaatga

SEQ ID NO: 13914 - DNA, 816 bp, Pseudomonas aeruginosa
gatgagcgagaacattctggaaatccgcgacctcgccgtcgaattcctctccggcgagcaacgccagcgggtggtcgaaggcgtcagcttcgacatccgccagggcgagaccctggccctggtcggcgaaagcggctcgggcaagtcggtgaccgcccactcgatcctgcgcctgctgccctactccgtcgccagccacccagcaggcagcatccactaccagggcgaggatctgctcaagctcccggaacggcgcctgcgcgggatccgcggcaaccgcatcgccatggtcttccaggaacccatgacctcgctcaatccgctgcataccatcgagaagcagctcgccgaggtcctcgccctgcacaagggcctgggtggcgccaaggccagcgcgagaattctcgaactgctcgagctggtcggcatccccgagccggccaagcgcctgaaagcctatccacacgaactctccggcggccagcggcagcgggtgatgatcgccatggccctggcctgcgagccgcaactgctgatcgccgacgaaccgaccaccgcgctcgacgtcaccgtccagttgaagatcctcgatctgctcaaggacctgcaggcacgcctgggcatgtccctgctgctgatcacccacgacctcaacctggtccggcgcatcgcccaccgcgtctgcgtcatgcaacaagggcggatcgtcgagcaggcttcctgccaggaactcttcgcagccccgcgacacccctatacccgcgagctgctcaacgccgagcccagcggtgcgccggcgagcaacccgcccggtga

SEQ ID NO: 13915 - DNA, 654 bp, Pseudomonas aeruginosa
gatcggcagcgaggccgaacaggagcaggcgatcatcgacgcgctggtggaggtcgggctcgatccgcagacccgctaccgttacccccacgaattctccggcggccagcgccagcgcatcgccatcgcccgggcactggtgctgaaaccggcactgatcctgctcgacgaaccgacctcggcgctcgaccgcaccgtgcagcgccaggtcgtggaattgctgcggcaactgcagggcaagtacaacctcacctacctgttcatcagccacgacctggcggtggtcaaggcgctcagccaccagttgatggtggttcgacatggcaaggtggtggaacagggcagcgccgaagcggttttcgcctcgccgcaacatccctatacgcagcaattgctggaggctgccttcatggccccggcaagcgcggaaaactgagttgcagacaaggaacggaccatgggatttctcacaggaaaacgcgccctgatcgtcggagtcgccagcaagctctccatcgcttccggcatcgccgccgccatgcaccgggaaggcgccgaactggccttcacctaccagaacgacaagctcaggggccgggtggaggagttcgccagtggctggggctcgcggccggagctgtgcttcccctgtga

SEQ ID NO: 13916 - DNA, 657 bp, Pseudomonas aeruginosa
cgtggccgacgacagccagatcgaagcggtgttcgccgccctgggcaagcactgggacggcctggacatcatcgtccactccgtcggattcgctccaggcgatcagctcgacggcgacttcaccgcggtgaccacccgcgagggcttccgcatcgcccacgacatcagcgcctacagcttcatcgccctggccaaggccggacgggaaatgatgaagggccgcaacggcagcctgctgaccctctcctacctgggcgccgaacggaccatgccgaactacaacgtaatgggcctggccaaggccagcctggaggccggggtccgctacctggccggcagcctgggcgcggaaggcacccgggtcaatgcggtttccgccgggccgatccgaacgctcgccgcctccgggatcaagagcttccgcaagatgctggccgccaacgagcggcagacgccgctgcggcgcaacgtcaccatcgaggaagtcggcaatgccggcgccttcctctgttcggacctggccagcggtatcagcggcgagatcctctacgtcgatggcggcttcaacactaccgccatgggcccgctggacgacgactgatcaccccgcccatgaaaaatggccgcttcgagcggcctttttcatgggcggaataa

SEQ ID NO: 13917 - DNA, 312 bp, Pseudomonas aeruginosa
ttgacagcatccttcagggctttaccggctttgaagcccgggatcttggcagcggcgatcttgatcggcttgccagtttgcgggttgcgaccggtgcgagcagcgcgctctttgacagcgaaggtgccgaaaccaaccagcacgacggagtcaccagccttcagggcgccagtgacggactcgatcactgcgtccagtgcgcgaccggcaacagctttcgggatatcagcagatgcggcaattgcatcgatcagttccgacttgttcactctaagtccccttatttctgttgagtatgtttctatgtgttag

SEQ ID NO: 13918 - DNA, 654 bp, Pseudomonas aeruginosa
tgcgtgctaattcgctccttggaatcaggctcgcgtttttcatcctttgcaaccatctccggagccgcatcgggcaagggctccggggcgtattgcagcgcaatttgcaggacttcgtcaatccatttaaccggtttaataaccagatcactcttaatattgtccggaatttccttcaggtcgcgaacattttcctcgggaatgatcaccgtcttgatcccgccgcggtgcgccgccaaaagtttttctttcagcccgccgatcgccagcacctgcccacgcagggtgatctccccggtcattgccacgtcggcgcgcaccgggatctgcgtgatcgccgaaaccagcgccgtgcacatgccgatgcctgcgctcgggccatccttcggcgtagcgccttccggaacgtggatatggatgtcgcgcttctcgtggaagtccgccgcgattcctaggctctgggcgcggctgcgcaccacggtcaacgccgcggtgatcgattccgccatcacgtcgcccagcgatccggtcttggtcaactggcccttgccgggtaccacggccgcctcgatggtgagcagctcgccgccgacctgggtccaggccagcccggtcacctggccgatctggtcctgctgttcggcgaggccataa

SEQ ID NO: 13919 - DNA, 741 bp, Pseudomonas aeruginosa
tactcgcgctggctgcgctccatctgcttcttgacccggccgcggatgcgcttttccacctgcagcaggtcgatctcggcatccagcagcgccaggacatgctcgacccgcgacgacaggtcggtgatctccaggatgtcctgcttctgctcgatcttcagcgccatgtgcgcggccatggtatcgaccagcctgctcggctcgtcgatgctgttcagcgaggaaagcacctcggcggggactttcttgcccaactggacgtattgctcgaactggctcagcaggctgcgagtgaagacctcggcctcgcgctcgccgacattggcgtcgtcgatggcctggaccgcggcacgaatgtgcccttcttcctcgatgaagcgctcgacctggccgcgctgctcgccttcgaccagcaccttgacggtgccatccggcagcttgagcaactgcagcacggtagcgaccgtacccatgcggtacaggccatcttcgcccggatcatcgtccgcggggtttttctgcgccagcaggaggatttgcttgtcgccggtcatcgctgcctccagggcctcgatggacttttcccgaccgacgaacaacgggatgaccatgtgcgggtacaccaccacgtcacgtagcggcagcaagggcaattcgacgagtgttttcataatgtcggctctacagcggcacttggccacgaaacagataggaagacctttcagcctaagatggggttag

SEQ ID NO: 13920 - DNA, 753 bp, Pseudomonas aeruginosa
cttcaaacacaagatgaaggcaattgtgggcattttcaagcccacgaggcggccgaatgtctcgaccgccagtattgcggagccttagacggccaggtcgcgctgggtcatgaccttgtcgatcaggccatacttgacagcttcgtcaccgctcatgaagcggtcacgatcggtatcgcgggcaatgacgtccaggggctggccggtgtggtgcgccaggatctggttcagacgctccttgatgaagagaatttccttggcatggatctcgatatccgaggcctggccctggaaaccgcccagcggctggtggatcatcatccgcgaatgcggcaggcagtagcgcttgccggcggcaccgcccgcaagcagcagggcacccatgctgcacgcctgaccgatacaggtggtcgagacgttgggcttgatgaactgcatggtgtcgtagatggacatcccggcagtcaccgaaccacccggcgagttgatgtagagatgaatgtccttctcgggattttcagcctccaggaacagcaactgggcaaccaccaggttggccatgtagtcctcgacctggccgaccaggaagatgatccgctccttcagcaggcgcgaatagatgtcgtaggcgcgctcgccgcgggcggactgctccaccaccatgggcaccaggccaccggcggcctggatatcgggaacgtgcggaataaaagagttgcgagacatgtcttgcgatcactccctaacagatag

SEQ ID NO: 13921 - DNA, 1599 bp, Pseudomonas aeruginosa
agcctcaaagacgcacaagccagcactaaggctggcttgtgggattcgaacgagaggaacgaatcaggccgcttgcggagcttcggccggcttgaccgcttcttcgtaggatacctgcttatcggtcacagtggccttttgcaggacagtatctacgacttgttcttccagtacaacagaacggacttcgttcagctggggctcgttcttgaagtaccaggcgacgacctgctcgggctcctggtaggccgaggccatttcctcgatcatttcgcgaacgcgaccttcgtcggccttcagctcgtgctgcttgaccacttcggcgacgatcaggcccagcaccacacggcgcttggcctgctcttcgaacagctcggccggcagttggtcaggcttgatgttgccgccgaactgctggacggcctgcacgcgcagacggttcacttcgttgccgatcagggccttgggcacttcgatcgggttggcctgcagcagaccttccatgacctggttcttgaccttggacttgatcgcctggcgcagctcgcgctccatgttcttctgcacttcggcgcggaagccatcgagaccggtttccttcacgccgaacagagcgaagaactcttcgttcagttccggcagcttgggctcggctacgctattgacggtaacggtgaactcggcagccttgttggccaggtccaggttctggtagtcctcggggaaggtcaggttgagcacacgctcttcaccggccttcgcccccaccagcccttcttcgaagccggcgatcatgcgaccggagcccagtaccagcagggtgcccttggcggaaccgccggcgaaggcttcgccgtcgatcttgccgacgaagtcgatgttcaactggtcatcgttctgggcggcacgctcgaccacttcgaaacgggtgttctgcttgcgcaggacatcgagcatgttgtcgacatcagcatcggaaacttcggcctgcaggcgctcgaccttgatgtcttccaggccggaaacggtaaattccgggaagacttcgaaggttgcgatgtattccaggtccttgcctttctcgaaggacttgggctctaccgacggcgaaccggccggattcagcttctgctcgaccacggcttcgtagaaggtttcctggatcagatcgcccatggcttcctggcgcgcggaagcttcgtagcgctgacgaatgacactcatcggcaccttgccggggcggaaacctggaatcttggcacgacgggcggtctgctgcagacgcttgttgacttcggtctcgatacgctcggcaggcacaccaacggtcatgcggcgctcaagagcggaagtgctttcaacagaaacttgcatggatattcctcgttgcacagacgtaagccggtccttccggctcccagaatcaagggcatgcattctagtagagggaaaagcagaagtcaccccgccagggtgcaggcggatccccggggtgtttccggccgcttccgccgatcgcagcccgatctcgaacgagtcgctggagcttcgccggaagcgggcgcatataatgccagccgattccgctccgaccgatga

SEQ ID NO: 13922 - DNA, 714 bp, Pseudomonas aeruginosa
aaccctatggactgccctaccctcagcaaggtattgctcgtcgaagacgaccagaagctcgcccgcctgatcgccagtttcctttcccagcatggtttcgaagtgcgccaggtgcatcgcggtgatgccgcgttcgccgctttcctcgacttcaaaccgcaagtggtggttctcgacctcatgctccccggacagaatggtctgcaggtgtgccgggagatccgccgggtcgcgaacctgccgatcctcatactcaccgcccaggaggacgatctcgatcacatcctcggcctggagtccggcgccgacgactacgtgatcaagccgatcgagccaccggtgctgctcgcccgcctgcgcgccctgatgcgccggcacgcgccccttcccgcctccccggaaagcctgacattcggcaagctgaacatcgaccgacggcggcgcgaagcggaactcgaaggcctcggcatcgaactgaccacgatggagttcgagctgctctggctgctggccagccaggcaggggaaatactttcccgcgacgagatcctcaaccagatccgcggcatcggcttcgacggcctgaaccgcagcgtcgacgtctgcatcagcaagctgcgcaataaactgaaggacaatccgcgcgagccggtccggatcaagaccgtctggggcaagggctacctgttcaacccgctgggctgggagctctga

SEQ ID NO: 13923 - DNA, 1287 bp, Pseudomonas aeruginosa
atgctgcgcctgttcctgcgcctctacctgctactggccctggggttcgccgccgcgatcttcgtggtcgaccatgtcatcgacgcgttctacgacagcatcgtcgagaactatcaccgcgacgccgttcgcggccaggcctattcgctggtggaaaagctggccccgctggaccaggccggacgccagcgacagctcgaagactggcgtccccactacgggctcgagctgagcctgacggatgccaggcaggcgaagctgacgcaggaagagcaggccctcctcgacaagaacctgctggtggtacgcgaggacttcacggaattcatcagccgcatcgacgcgggcccgcagctgctcgacatcaagctgccgccggaaccctcgctgaccccactattcaccgtgctggcctacatcctgctcggcgtgctggtcggcatcgccctgctggtatgggtccgcccgcactggcgcgacctcgagaccctgcgcctggccgcgcaacgcttcggcgacggcgacctgtcatcgcgcacgcgcattttccgacgctccgacatccgcaccctggcccagcacttcaaccagatggccgaccgcatcgaaagcctgatcagcaaccagcgtgaactgaccaacgcggtatcccacgaattgcgcacgccgatctcccgcctgtccttcgaactcgagcaattgaacaagcaggtcgacgccgaagtacgccacgacctgatagaggacatgcgcgccgatctcggcgaactggaggaaatggtctccgaactgctgacctacgcccgcctggagcacggcaacgtcgggagccaccgggaaatcgtcgacgccgcgagctggctggatagcgtcgtcgccgacgtcgccctggaagccgaagccgccggagtcacctgcgagatcagcgcctgccaggtcgaacagatccgcatcgagcctcgcttcatggcgcgcgcagtgatcaacctgctgcgcaacgccattcgccacgcacactcgcgcgtcgaaatcgccctcctcgatcaaggcgacagctgtcagatacgggtcaacgacgacggccccgggataccggcggacgcccggcagaagatcttcgaacccttttcgcgcctggacgacagccgcgatcgcagcaccggcggcttcggcctgggcctggcgatcgtccgccgggtcgcgcaatggcacggcggctatgcggaagcgctggaaacgccgcaaggaggcgcctccttccgcctgacctgggagcgaccccgttga

SEQ ID NO: 13924 - DNA, 366 bp, Pseudomonas aeruginosa
ctcgttccagcttcgccaggaacgccctgccccaggcgcaacgcgcccaaggctacagcggcggcggtcgccccggctccgccgccgccagcgacctcccggtcaacgacctgtggagcagcccggtcgacctcagccgcttcgtccgcatgctgttcgccaacgggcgccacaaggagcgccagcttctccggaaacactccgtcgaggagatgttccgccagcagaacgccggcaatgccctggacttcgactgccaggtgggcctggcctggttcctcagcccgtgcggctccgcaccgctggaaggaggcatccgtcactatgagtacgccagcgccacccgaggattcagcgcccatctga

SEQ ID NO: 13925 - DNA, 495 bp, Pseudomonas aeruginosa
agcgcaaacgaaaacgccaggcacaaggcctggcgcttcgaaatatggggtggacgatgggaatcgaacccacgacaccaggagccacaatcctgtgctctaccaactgagctacgcccaccatatcgtgaatcgtgccggacgttccggcttcaaccgcagcggccggacaagccgagcctgaaggtggtgcggacggagagactcgaactctcacgccttgcggcgctggaacctaaatccagtgtgtctaccaattccaccacgtccgcgggacactgcttggaaatgaaaacgccaggccccgggcctggcgcttcggaatatggggtggacgatgggaatcgaacccacgacaccaggagccacaatcctgtgctctaccaactgagctacgcccaccatattacgacttgcggtaaaacatcgcctgcttcttgccgattcgccgaatggcgcacccggcaggactcgaacctgcgaccatccgcttag

SEQ ID NO: 13926 - DNA, 1188 bp, Pseudomonas aeruginosa
gcgcaaactttaagctctggcaatcacaaagtcagcaaccgacttgctttacctcttaccctgcgtccggctgtgctcggcaagcggggcgcatgttatacagggggcgaaaggccgtcaacgggttttttaaaaaaattcagctatataaaggagttacggcaaatccacgggtcgcctcctttgccccgggcggcgtccatgcgaaaatgcgcgtcctttttccacccgattcgatggttacccttccgacatgaccgcacaactgatcgacggcaaagcgatcgccgccaaccttcgccagcagatagcccaacgcgtgaccgagcgccgccagcaaggcctgcgcgttcccggcctggcggtgatcctggtcggcaccgatccggcctctcaggtctatgtggcgcacaagcgcaaggactgcgaggaagtcggctttctctcccaggcctacgatcttcccgccgaaaccagccaggacgacctgctggccctgatcgaccgcctgaacgacgaccccgccatcgacggcatcctggtccagctacccctgcccgcccacctggacgcctccctgctgctggagcgcatccacccggacaaggacgtggacggtttccatccctacaacatcggccgcctggcccagcgcatgcccctcctgcgcccctgcaccccgaaaggcatcatgaccctgctcgccagcaccggcgccgacctgtacggcatggatgcggtcgtggtcggcgcctcgaacatcgtcggccggcccatggctctggagttgctgctgggtggctgcaccgtcaccgtgacccaccgcttcacccgcgacctggccgaccatgtgtcgcgcgccgacctggtggtggtcgctgccggcaagccgggactggtcaagggcgagtggatcaaggaaggcgccatcgtcatcgacgtcggcatcaaccgccaggccgacggccgcctggtcggcgacgtggaatacgaagtggcagcgcaacgcgccagctggatcaccccggtgccgggcggcgtcgggccgatgacccgcgcctgcctgctggaaaataccctgcacgccgccgaacacctgcacgactgaggtcgccggtaatgaaaagccccgcgttcgcggggcttttcatttatcgctgcgggttcagtcggccaggcgccaggtag

SEQ ID NO: 13927 - DNA, 462 bp, Pseudomonas aeruginosa
tcatcccgcagtgcagccaggacttggcgtagggcttgccggtcgcggcctcgctctgggcgatctcgttctcgtgatgagggaactccaggtcgttgccaccgccatggatgtcgaaggaatcgcccaggcagcaggtggacatcaccgagcattcgatgtgccagcccgggcgcccctcgccccagggcgacgaccagctcggttcgccaggcttggcgcccttccagagcacgaaatcgagcggatcctccttcgcttcgcccggctcgatccgcgcaccgatgcgcaggtcctcgacccgccgccgcgacaacttgccgtagccagcgaacttgccgacccggtagtacacgtccccgttgcccggcgcgtaggcatagcccttgtcgatcagggtctggatcatcgcgtgcatgccggcgatgtgatcggtggcgcgtggctcctggtccggcttga

SEQ ID NO: 13928 - DNA, 708 bp, Pseudomonas aeruginosa
cgatcttcgcgtgcttgccggcatccaggtcggcttgaacgatctggcgcaggaagttcggggcggcggtggtctctggcttgctcatgggatccttggtcatgctctcgcccgaccagggtaggccgggcaaatcaaagcgcttatcatagccgaagctgtcaaccccctgacaggccttcgattttcacgacaaagcggattacccacatgatcaagctgcataccaaccatggcgtcatcaccctgaagctcgatgaagagaaagccccggaaaccgcggcgaacttcaaggagtacgtgaaaagcggccactacgacaacaccgtcttccaccgcgtgatcaacaacttcatgatccagggcggcggtttcgagccgggcatgaagcagaagcccactcgcgcaccgatcaagaacgaagccaacaacggcctgaccaacaaggtcggcagcatcgccatggctcgtaccatggacccgcattcggccagcgcgcagttcttcatcaacgtcgccgacaacgatttcctcaaccataccgcccccaccacccagggctggggctatgccgtcttcggcgaagtggtcgagggcatggacgtggtcaacaagatcaagggcgtggccaccaccatgcgcagcggccaccaggacgtgccggccgaggacgtgatcatcgagaaggccgaaatcgtcgaagaatga

SEQ ID NO: 13929 - DNA, 330 bp, Pseudomonas aeruginosa
agcagatcgaagcggtcaaggccaagggcttcccggtcgcctacgtcggcgacgtggtcggcaccggttcctcgcgcaaatccgccaccaactcggtgctgtggttcttcggcgacgacattccgttcgtgccgaacaagcgtgccggcggcttctgcttcggcaccaagatcgcaccgatcttctacaacaccatggaagatgccggcgccctgccgatcgagttcgactgcaccaacctggccatgggcgacgtcatcgacgtatacccctatgaaggcaaggtcgctcgccacgacagcggcgaagtggtcaccaccttcgagctga

SEQ ID NO: 13930 - DNA, 750 bp, Pseudomonas aeruginosa
actactgggctcccgagcatcggtctgcatacgctgcacgacgtgcacagtgtggtggttccaccggcgcagatggtcggccatctccaggccgggcgcatcgacgggttctgcgccggcggcccctggggcgccctggccgtggaccagggccagggcttcaccatcgccaccagccaggcgatctggccggaccacccggaaaaggtcctcggcactacccgcgccttcgtcgacgcctacccgaacaccgcccgcgcgctggtcatggcggtcctcgacgccagccgcttcatcgaacagaacgccgagaaccgcctgggcaccgcgcaactgatcagcggccgcgactatgtcgacgctccgctcggcgcgatccagccgcgcttcttcggccgctaccaggacggcctcggcaacgcctggcaggacccacatccgctgcgtttctacgccgacggcgaagtcaaccggccctggctctcggatggcatgtggttcatgacccagttccgccgctggggcctgctgcgcgaagacccggactacctgggcatcgcccgcagggtccagcagaccgcgctgtaccgcgatgccgcgacggcccttgggctacgcctggacggcgccgacatgcgccgctcgacgctgatcgacgggcgcacctgggacggcagcgaccccgccggctacgcccgcagcttcccgatccacgccctggccgaaaccggccagggcatcgccccctga

SEQ ID NO: 13931 - DNA, 792 bp, Pseudomonas aeruginosa
catgaccagggaggcccgcagtggacgcccagggctaggagccgcaggcgtccgcccgaaccgcaccgccgactcagcggtcaggagatgctcagcatgatcgatctcagcacctggaaccttaccattcccaccgaacccaccccgcaggtgatcaccacccagcaactcaacaacggctaccagagccggtacttccagcaaggcaacgatggcggcctggtcttctgggtgcccatcgacggctcgcacaccgaggacagcacctatcctcgcaccgaactgcgcgaaacccaggccgacggcagcctcgacaactggtactactggcaggccgacaacgaattgcgggtgaccatgagcgtcgagaaggtcccctcgaagaacaaggtgatcatcggccagatccacagcaagtcgccacagaccgacgacggcgaacctctggtgaagctgcagtactactacaagcccgaggaaggcctcggccgggtcgaggcgctggtacgcaaccacccggacgattcctatagccgcaacgtgtcgatcctcgagcaggtacgcctgggcgagcgcttcaactacagcctgcgcgtcacctccagcggcgagttggcggtgcgcgcacgcagccaggacggcgaagaggacgcttactaccagaccctcggcagcgcctggaacgaccagttgctctatttcaaggccggcgcctacgtgaacgacaacgccggcgacagcggcgaaggcagccgcgtgaccatctaccacctgaacaccgcccatcgctga

SEQ ID NO: 13932 - DNA, 2730 bp, Pseudomonas aeruginosa
  unsure (1156): Identity of nucleotide at the above locations are unknown.
tggtcgccacgccgatcctcgccggcgccgtactgcgcttcctgctcggcctgctggccgatcgctggtcgccgaagagcgccggcatcctcgcccaggtcatcgtcatcggccgccctcgcggccgcctggctgctgggcgtgaacagctatgagcaggcactgctgctggggttgttcctcggcttcgccggggcatccttcgccgtggccctgccgctcgcatcgcaatggtacccgccgcaacaccagggcaaggccatgggcatcgccggcgcgggcaactccggcaccgtgctcgccgccctcttcgcccccggcctggccgccgcgttcggctggaacaacgtgttcggcttcgccctgctgccgctcgtcctgaccctcctggtgttcgccatggtcgcgcgcaacgccccgcagcggccggcgcccaaggccatgggcgattacctgaaagccctcggcgaccgcgacagctggtggttcatgttcttctacagcgtcaccttcggcggcttcctcggcctggccagcaccctgcccggctatttccacgaccagtacggcctgaacccggtgaccgccggctactacaccgccgcctgcgtcttcgccggcagcctgatgcgcccgctcggtggcgccctcgccgatcgcatcggcggcatccgcagcctgctgatggtgtacaccctggccgccatctgcatcgccgcggtcggtttccacttgtccagcgcgatggccgccctcggcctgttcgtggtcgccatgctcagtctcggtgccggcaatggcgcggtgttccagttggtaccgcagcgcttccacaaggaaatcggcgtgatgaccgggctgatcggcatggccggcggcatcggcggcttctgcctgactgccggcctcggcgcgatcaagcaaagcaccggcgactaccagctcggcctgtggctgttcgccagtctcggcgtgctggcctggttcggcctccacggggtgaagcggcgctggcgcaccacctgggggctcggccgcggtcaccgccgcgcgggtctgagcgtggggctgcgactgagcattggcgaggccagcgcctgcgggcctcgcacggaaaaccaggatgcgctgcgggtggtcaccccggcgccggccntggccgccagcaagggacacctgctggccatcgccgacggtgtcagccagtgcgccgatggcggcctggcggcgcgcagcagcctgcaagcgctggccctggattactatgcgactccggaaacctgggccatcgtgcagtccctggaccgcctgctgctggcgcagaaccgctggctacaggccaacggcggcggccagccgctgctcaccaccctcaccgccctggtgctgcgcggcacccgctacaccctggcccacgtcggcgattgccgggcctacctgtggcgcgacggcgagttgctccggcagaccagcgaccacgtctgggaacagccgcacatgcaacacgtgctgacccgcgccctgggactggaccagcatctggtggtcgactatctggaaggcgatctggagcccggcagccagtggctactggtcagcgacggcgtctgggcgacgctgggcgacagcggcatccgcagcatcctgcgcaacgccgaggagccgcagcgcagcgccgaggccctggttcgcgccgcccacctggcaggcagccaggacaacgccagcgccctgctggtacgcgtggaagccgtgcccgcaggcagcctcggcgacgccctcgcgcaactgggccactggccactgccgccaccgctgaagcccgaccagctcttcgaaggctggcgggtccggcagttgctaggcgaatcccgccagtccctgctctaccgggtcgaagatggccagggccaaccctggctgctgaagacccttcccgccgcacgtgccgacgatccgctggcaacccaggccctgctgctcgaggaatggttcctgcgccgcgtccagggccggcatttccccgagctgtacggattggcgcaacgccagcatctgtattacctgatgcgcgagcaccccggagagactctcgccgagcgcttgcgcaaccatggcccgctgtcgctgccggagtggctggggctggccaaccagctgctgcgcgggcttggccagttgcatcgacgcaacctgctgcaccgcgacctcaagccggaaaatctccacctcggccgtgacggcgagctgcgcctgctggatttcggcctggcctggtgtccgggattgtcgcgcgaagacccccatctgctaccgggtacgcccagctacctggcgccggaatgcttctccggcacctcgccctcggtgcgccaggatctctacgccaccggcgtctgcctctaccaggcgctgaccgggcgctatccctatggcgagatcgaagccttccagcacccgcgcttcggtcgccccgtcccgcccagccgctatcgccccgacctgccggcctggatcgacgacctgctgctgcgcgccgtcgcctgcgaccccgcacagcgcttcgagaccgccgaggaatggctgctctcgctgcaacagggagaagcgttgccggtcgcggcaccccgcccattgctggagcgcgaaccgctgcagacctggcgcgccatcgccctgctgtccctggccgccaacctggcgctactcctggtctggctgaagggctga

SEQ ID NO: 13933 - DNA, 2622 bp, Pseudomonas aeruginosa
cgcaagttggcacggcgcctgcttgggttctcccgacaatcgacaacaaagcgcctgcctcaacgacgaggcggcgtttcccgaccgaacgggacctggacaaaggcgtcctgctggcaacagcgggacgccttttttgtttgcgccaaccttatgcaggagctactccgcatgaagaagatcaagctggtgatggtcggcaacggcatggccggggtccgtaccctggaagaactgctcaagctcaactcggacttctacgacatcacggtgttcggcgccgagccccatcccaactacaaccgcatcctgctgtccccggtgctggccggcgagcagaccttcgaggaaatcgtcctcaacgacctcaactggtatgcggaaaacggcatcaagctcctcctcgaccgcaaggtggtgcagatcgaccgggtccgccgcagggtggtcgccgcggacggcagcgaggccgagtacgaccgcctgctgctggccaccggctcgctccccttcatcctgccgatacccggcaatcgcctgcagggcgtgatcggctaccgcgacatcgccgacacccaggccatgatcgactgcgcccggacccacagccacgcggtggtgatcggcggcggcctgctcggcctggaggcggccaacggcctcaagcaacgcggcatggacgtgaccgtcgtgcacctctccgactggctgctggaacgccaactggaccgcaccgccggcaaactcctgcaaggcgcgctggaagcccgcggcatccgcttccgcctgaacacccagacccaggaactgatggacaacggcagcggccgggtctgtgccgtgcagttcaacgacggcgacgtgattcccgccgacctggtggtaatggccgccggcatccgccccaataccgagctggccgaaagcgcgggcatcccctgcaaccgcggcatcctggtcaacgacaccctgcagacctacgacccacgcatctatgcggtcggcgaatgcgccaaccaccgtggcatcgcctacggcctggttgcgccgctgttcgagcaggccaaggtctgcgccaaccacctggctcatctcggctacgcccgctaccagggctcggtgacctcgaccaagctcaaggtgaccggtatcgacctgttctccgccggcgacttcatcggcggcgaaggcagcgaaaccatcaccctttccgaccccatcggcggcgtctacaagaagctggtgatcaaggacgatgtactggtcggcgcctgtctctacggcgacaccgccgacggcggctggtacttccggcagatccgcgagaaccacaacgtcgcgcagatccgcgaccacctgatgttcggcgagaacgccctcggcgatgtcggccaccagggccagaacagcgccgcgagcatgcccgacacggccgaagtatgcggctgcaacggcgtctgcaagggcaccatcgtcaaggccatacaagaacacggcctgttcagcgtcgacgaagtcaagaaacacaccaaggccgccagctcctgtggctcctgcgcgggattggtggaacagatcctgatcagcaccgtcggcggcgccgccgacgtcaagccgaagagcgagaaggccatctgcggctgcagcgacctcaaccacgggcagatccgcaaggccattcgcgaacaccggctgaccagtctcgacgccgccatgcgcttcatggactggaagaccccgaacggctgtgccacctgccgtccggccctgaactactacctgatctcgacctggccgggagaagccaaggacgatccgcagtcgcgcctgatcaacgaacgcgcccacgccaacatccagaaggacggcacctactcggtggtaccgcggatgtggggtggcgtgaccaacgccgccgagttgcggcgcatcgccgacgtcgccgacaagtaccaggtgccgatggtcaaggtcaccggtggccagcgcatcgacctgctgggggtgaagaaggacgacctgccggccatctggaaagacctcgacatgccctccggacatgcctacggcaaatccatccgcaccgtgaagacctgcgtcggcagcgagttctgccgcttcggcacgcagaactcgacgcagctgggcatcgatctggaacacgacctgttcaacatgtggtcgccgcacaaggtcaagctggcggtctccggctgcccgcgcaactgcgccgaggccgggatcaaggacgtcggcatcatcggcgtggactccggctgggagatgtacatcggcggcaacggcgggatcaagaccgaggtcgcggagttcttcgtcaagctcaagaccgccgaagaggtgcgcgaatacaacggcgccttcctccagctctaccgcgaggaagccttctatctggagcgcacggtgcattacctgcagcgggtcggcatggagcacatccgcaaggcggtggtcgaggacgcggaaaaccgcaaggcgctcaacgaccgcctgcaattcgccctgtccttcgagcaggacccatggaagcagcgcatcgaacagccgcaattgaagaaggagttcgaacggattccgctcaagcaactggaaaacgtctga

SEQ ID NO: 13934 - DNA, 3546 bp, Pseudomonas aeruginosa
caggagccgagcatgtcgacagattccccgctgcgcaccaccgcttcgacctgctgctactgcggcgtgggttgtggcgtcctgatcgaacacgacggcgaacgcatcctcggcgtgcaaggcgatcctcggcacccggccaacttcggcagactctgcagcaaaggcgccagcctgcacctgaccggcgacctccaggcccgcgcgctgtacccccaactgcgcctcggcaagcaactggcgcgggctcgcagcgactgggagagtgccctggaacatgccgccgggcgtttcgccgagaccattcgcgaacatgggccggacagcgtggccttctatatctccggccagttgctgaccgaggactactacgccttcaacaagctggcgcgggccctggtcggcaccaacaacatcgacagcaattcgcgcctgtgcatgtcctcggcggtggtcggctacaagcgcagcctgggcgccgacgcaccgccgtgcagctacgaagacctcgactgcgccgattgcgtgctgatcgccggcagcaacatggccttcgcccacccggtcctgttccgtcgcctggaagccgccaaggccgctcggccggagatgcgcatcgtggtgatcgacccgcggcgcaccgacacctgcgagctggccgacctgcacctggcgctgctgcccggcaccgacgtcgcactgttccacggcatcctgcatatcctgctctgggaggactggatcgaccgttcgttcatcgccgagcataccgagggtttcgccgacctgaaggaactggtgcgcgactacaccccggccgccgtcgccgacatctgcggcatcgaccgcgccgacctgcagcgctgcgccgaatggatcggccgttcgccgcgcttcctttcgctctggtgcatggggctcaaccagtccagcgccggcagcgccaagaacagcgcgctgatcaacctgcacctggctaccggcaagatcggccgcgccggatgcgggccgttttccctcaccggccagccgaacgccatgggcggtcgcgagaccggcagcctggccaacctgctgcccggccaccgcgaagccgccgatcccggccatcgcgccgaggtggcgcactactggggtgtggaacagttgcccacgtcccccggtctcagcgccatcgagctgttcgatgcggtccacgacggccggatcaaggcgctttggatcgcctgtaccaaccccgcgcaatcgctgccggaccagcgcaagatccacgaggcccttgcccgctgtcccttcgtggtggtccaggaagccttcgccggcacggaaacctgccaatacgccgaccttttgcttccagccgcatcctggggagaaaaggaaggctccgtgaccaattcggaacggcggatcagtcatgtccgtcgggccgttccgccccccggtgaagcgcgccaggactggaacatcgtctgcgacttcgcgcgccgcctggaagggcacctgcgtcccgctaaacccggcctgttcgcctttgccgacagccgcagcctgttcgacgaatacaagctgcttaccgccggccgcgacctcgatctttccggcctcagctacgcactgctcgaccgcctggggccgcagcaatggccatttcccactggcgcggagcaaggcaccgcacggctctatgcagacggccgcttccctaccgcctcgggacgcgcgcaactggtcgccgaaccctaccgcgccgcccaggaaaaacgtgacgcgcgctacccgctgaccctcaataccggacgcttgcgcgaccagtggcacggcatgagccggaccggcacctgcgcacgcctgttcggccatgaagaggaggccctggtgcacctgcatcccgaggaactgcgccgccgccaactgcaggacgggcagctcgtgcgcctgaagagccggcgtggcgccctgatcctgccagtgagtgcagacgactcggtgcgccccggccaggccttcctgccgatgcactggggcgatcgcttcctcaagggcctgggctgcaatgtcctgaccctgccggcgttcgaccccctgtcgaaacaacccgaactcaagcacgccggggttcaggtcgaatccgtcgaactgccctggcgcctgttcgcgctggtggaaaccgatatccaggcgcgtttcgaggccctccgtgcgctgtgcgaagtcttcgaccacgccagcttcagtctcgccggacgcgagcgccccgccctgctggtcagcgccgcacaccatgaggcacctggcgcagacctgctggagcggatagatcgccaactcgaattgctcgacgggccgatcctcgcctacgacgacccacggcgcgccatcggcaagcgcgtgcgcctcgaagacgggcgcatcgtcgccgtccggctcgccggcgaaaccctcgcccgagactggttgaaagagctctggcttaccggccgggccgatagcgagctacgccgctggctgctcgccccactcggcgcggcaccgggacgacccagccagggtgcgggcggcaagaccctgtgcagttgccagaacgtcagccagcaaacggtgctcggcggcatcgcccgcggattggacctggacggattgaagcgcgagttcggctgcggcaccggctgcggctcctgcgtaccggaaatcaagagactgctggcggccccccgggcccatggcggcgaatgcctgaggagaacgacgatgagcggtaaggtctggctggtgggtgcgggttcccggcgatccggaactgttgaccctgaaggcagttcgcgccctgcaggacgcggatgtggtgatggtcgacgatctggtcaacccgagcatactggagcactgtccgtccgcccggctggtccgggtcggcaaacgcggcggctgccgctccacaccgcaggacttcatccagcgcctgatgctgcggcatgcccgccagggacgcagcgtggtgcgcctgaaaggcggcgatccatgcatcttcggccgcgccggcgaagaagccgaatggctggcccggcacgggatagacagcgagatagtgaacggcatcaccgccgggctggctggcgccactgcctgcggcataccgctgacctaccgcggcatcagccgcggcgtgaccctggtgaccgcgcatacccaggacgacagcccgctggcctgggaagccctggcacgcagcggtaccacgctggtggtctacatgggcgtcgcccgactcgcggagatccaggccgggctgctggctggaggcatggccgaggatacgccgctggcgatgatcgagaacgccaccttgggcaaccagcgcgaatgccgcagcaacctcggcgagctactgcgggacgccggacgtttcgccttgaaaagcccggcgatcctggtgatcggcgaagtaacccgcgacatcgtgtcgcaaccgatttccctgagcgcctgacgagcggtctttttccaggcaaagaaaaacccggcctgggccgggtttttccttag

SEQ ID NO: 13935 - DNA, 306 bp, Pseudomonas aeruginosa
aaacttttcgcgcaggcggtccagtgcccgcttgtagcgcattttcgtcgcactcagacccatgtgcatgatatccgctatctcctgaaactccagttccgcgacgaagcgaagaaccagaatctcccgatctatcggattgacatggacgagccaacgatccaatccgccccgctcctcaaccttcggcgacttctcctcggaagcctcctccagcgggtcgaggctgagcgcatccatcaatcggcgcttgcggcgctccttgcggtactgcgtgatgcactcgttgtacgtgatgctatatag

SEQ ID NO: 13936 - DNA, 2814 bp, Pseudomonas aeruginosa
tccgagcgcacgcggcgagtaccagaagcggcggttggaaaaactcccgtgcaggaggatcacaggcggtccgcgccgctcgccggcggcctgctgtccaagccgggttacgaccagctcgacgctggcatcggggctgttgccgggcttcaggcgatagatgtcttcggtaaggtcggcgcgcaactcggcgctgaccagggcgacaggaaagaggcgactactgctttgcatgcttgtcttgtacaggaggcacgaaaaagggcggtgttacccgccctttccggatacagcgaggaccgatcaggcctggtcttgcccctcggcaaggaagaaccaggtatccagcaccgagtcggggttcagcgagacgctctcgatgccctgctccatcagccagcgggccaggtccgggtggtccgacggaccctggccgcagatgccgatgtacttgccggccttgttgcaggcagcgatggcgttggccagcagcttcttcaccgccggattgcgctcgtcgaacaggtgggcaacgatgccggaatcgcgatccaggcccagggtcagctgggtcaggtcgttggaaccgatggagaagccatcgaagaactcgaggaactcgtcggccagcagggcgttcgacggcagttcgcacatcatgatgaccttaaggccgttctcgccgcgcttcaggccgttcccggccagcagctcgaccacctggctcgcctcgcccagggtgcgcacgaagggcaccatgatctcgacgttggtcaggcccatttcgttgcggaccttcttcagcgcacggcactccagctcgaagcagtcgcggaacgactcgctgatgtagcgcgaggcaccacggaagccgagcatcggattctcttcttccggctcgtagagcttgccgccgatcaggttggcgtactcattggacttgaagtcggacaggcgcacgatgaccttcttcggccagaacgccgcggccagggtgctgatgccctccaccagtttctcgacgtagaagccgaccggatcgggatagcccgcgatgcgcttctccacgctttccttgatgtccgccggcaggccggcgaagttcagcaatgccttggggtgcacgccgatcatgcggttgatgatgaattcgaggcgggccaggcccacgccttcgttcggcaactgggcgaaatcgaaagcgcgatcgggattgccgacgttcatcatgatcttgaacggaaggtcgggcatggcgtcgaccgagttcttgcgcacatcgaaaccgagttcgccttcgaagatgaagccggtatcgccttcggcacaggaaacggtcaccccctggccatcctgcaggatctgggtggcgttgccgcaaccgaccaccgccgggatgcccagttcgcgagcgatgatcgccgcgtggcaggtacgcccgccgcggttggtgacgatggcgctggcgcgcttcatcaccggctcccagtccgggtcggtcatgtcggagaccaggacgtcacccggttggaccttgtccatttccgacacgtcgttgatcaccttgacaggaccggcaccgatgcgctggccgatggcacgcccttccaccaggacggtccccttctctttcagcaggtagcgctccatgaccgtggcgctggcgcggctcttcacggtttccgggcgtgcctggacgatgtacagcttgccgtcgtcaccgtccttggcccattcgatgtccatcgggcggccatagtgcttctcgatgatcatggcctgcttggccagctcggtgacctcggcgtcgctcagggcgaagcgggcgcgatcggcgcgatcgacgtccactaccttgaccgagcgaccggccttggcttcgtcgccgtagatcatcttgatcgccttgctacccaggttgcggcgcaggatggccggacgcccggcttccagggtcggcttgtggacgtagaactcgtcggggttcaccgcgccctggaccacggtctcgcccaggccgtaggcaccggtgatgaagaccacgtcgcggaagccggattcggtgtccagggtgaacatcaccccggcggtgccggtttccgagcggaccatgcgctgcacgccggcggacaaggcgaccagcttgtgatcgaagccctggtgcacgcggtaggcgatggcgcggtcgttgaacagggaggcgaagacctcttttgctgcgcggatcacattgtccacgccgcggatattgaggaaggtttcctgctggccggcgaacgaggcgtccggaaggtcttcggcggtagcggaggaacgcactgccacggcgaggttgtcgttgccgttggccagggcggcgaaggcctggcggatctcgctgtcgagacgggccgggaactcggcttccatcacccactggcggatctgcgcgccggtcttggccagggcgttgacgtcgtcgacgtccagggcgtccagggccgcgtggatacggtcgttgaggccactctgctcgaggaagtcacggtaggcctgggcggtggtggcaaatccgccgggtacggaaacgccggcaccggccaggttgctgatcatctcgccgagggatgcgttcttgccccccacatgctctacatcatggacgccgagcttatcgagggaaactacgtactctaccaaggtgatctctccactattgaattggaaaagctcaagcggggccaggagcagctccgctggattctggcctggcccttagaaataagtgacaatgctgcgacagaaaggcctctgacaacgcgcggcctatcatag

SEQ ID NO: 13937 - DNA, 855 bp, Pseudomonas aeruginosa
ccaagaatcgttcctaccttaaggctttcggtgcaaatgaaacgaaccgcattcttcatctcggacggcaccggtatcaccgccgaaaccctgggccaaagccttctggcacagttcgagaacatcagcttcgtcaaactgacgagaccgtacatcgataccgaagaaaaagcgcgcgccatggtacagcaaatcaataatgctgccgagtcggacggggcccgcccgatcatcttcgataccatcgtgaaccgcgacatccgggcggtcctggcgcaatccaacggtttcatgatcgatatcttcgccacctttctttcgcctctggaacaggagctttcggccgactcgtcctattcggtcggcaagtcccactccatcggccacaactccaactacatggatcgcatcgaggcggtgaacttcgccctcgacaacgacgacggcgcccgcacccactactacgacaaggccgacctgatcctggtcggcgtctcgcgctgcggcaagacgcccacctgcctgtacatggccttgcagtatggcatccgcgccgccaactacccgttgacggaagaggacatggagcgcctgcaactgccgaacgccctcaagcagtacaagcacaagctgttcggcctgaccatcgaccccgatcgcctcaccgcgattcgcaacgagcgcaagcccaacagtcgctacgccagcttcgcccagtgcgaattcgaggtacgcgaggtcgaaagcctgttccgccgcgaaaacatcgcctacatcaactccacgcatttctcggtggaggagatttccgcaaagatcctcgtcgaaaaaggcgtggaacggcgcttcaaataa

SEQ ID NO: 13938 - DNA, 654 bp, Pseudomonas aeruginosa
cctctggaacatcgatgccaaggtcgacttcgtcgccacgccgaaaaccccggtcaaggtgcagatgttcgttccgccgttgagccaggactacgtcagcctcaacgaaagcttcgtctccaacaattacggcgtcagcatcaatcgcgccgacggcaatcgcaaggtgacctggtccgcccgccgcgccaacggcaagcagaccctgtactaccgcctggtgctgaccaagcgctacaccggcgagaagaccaaggagaaaggcccgatcttccgcgacagcctgcccctggaaggcccggagaagatcgccgcagaagccctgctggcccccattcgccagcactcggccgacgtcgagaccttcgtcagcgaagccatcaagcgcgccaacaacggcaacgacgacaacgtcaagctgctgatggccggcgacaccagcctggaaaagaaagcgcatatcgtcgaaaccctgctgtccatcgctcacgtgccgatggagcgggtccataccatccgcctggtcgccgacctgcaacagagcccggaactgtggctgcgcagcttcaacggcgagaactggctgtatttcaacgtggtcaccggcgaacagggcctgccctccgatcgcctgatctggtggcttggcgatga

SEQ ID NO: 13939 - DNA, 1881 bp, Pseudomonas aeruginosa
gccgctgatgaccatcgacggcggcaagaaggcccaggtcagcttcagcctgaacagcagcgagatgaacgccatccgcctggccaagctgtccgacgagaacaccgaggcggccttcctcgagtactccctgtacggcctgccgctgtccacccagcagaccttccagatcatgatcatgatcccgatcggcgtgctggtgatcctgatcctgcgcaacctgatcggcctgcagaccctcggcaccttcaccccggtgctgatcgccctggccttccgcgagaccggcctgcaatggggtatcgccctgttcaccgtgatcaccgccctgggcctgtcgctgcgctcctatctcgagcacctgaagctgcagatgctgccgcgcctctcggtggtgctgaccttcgtggtggtgatgatcgcggtgatcagcctgttcagccacaagctcggcttcgagagcggcctgtcgatcgccctgttcccgatggtgatcctgaccatgaccatcgaacgcctgtcgatcacctgggaagagcgcggcggcggccatgcgatgaaggtggccatcggcaccctgttcgcggcatcgctggcgcacatcctcatgcgcatcccggaactggtgtacttcatcttcaccttcccggccgtgctgctgatcctggtcgccttcatgctcgccatgggccgctaccgcggctaccgcctgaccgagctgttccgcttcaaggccctgctcaaggactgaaccatgtcgatctggaagacctggaaagacctgaccgcgaaaggcgtgatgggcatcaaccgacgcaatgccgattacgtcctgaagtacaacaagcggcacctgtatccggtggtggacgacaagatcatcaccaaggaacgcgcgctcgaggccggcatccacgtgccggagatgtacggcatcatcgagaccgagaaaggcatcgacaagctcaacgagatcatcggcgagcacaacgatttcgtcatcaagccggcgcagggcgccggcggcgacggcatcatggtgatcgccgaccgcttcgagggccgctacaagaccgtgtcggggaagatcgtcagccacgaggagatcgagcaccacatctcgagcatcctctccggcctctactccctcggcggtcatcgcgaccgcgtactgatcgagtaccgggtgacccccgaccagatcttcaagagcatcagctacgaaggtgtgccggacatccgcatcatcgtgctgatgggctacccggtgatggccatgctgcgcctgccgacccggcagtcgggcggcaaggccaacctgcaccagggcgccatcggcgtgggcgtcgacctggccaccggcgtcaccctgcgcggcacctggctgaacaacaagatcgccaagcacccggacaccaccaacgcggtggacggtgtgcaactgccgaactgggacggcttcatgaagctggcggccggttgctacgagttgtcgggcctcggctacatcggcgtggacatggttctcgaccaggagaaaggcccgctgatcctagaactcaacgcccgcccgggcctgaacatccagatcgccaacgacagcggcctggtgcaccgctgccacgccgtcgaggcgcgactggaagaactcaaggcgaaaggcatcgaagagtccgcggaagagcgcgtacgcttctcccagcaactgttcggccacgtccagcagcaacagggctgacgtgcttccgatatgaagaagcccggctccggccgggctttttcatgtctcggatttcaacgcaccacggccagctcgaagccgccctgccgggcgtgctcatgcacctgcatacccgcctcgttcaccgccaggccctgtag

SEQ ID NO: 13940 - DNA, 1248 bp, Pseudomonas aeruginosa
cggacgcttgaacggcttgttgtcgagggtttgcagcgagcggtcctcgtcggtggtcagcagcagcacgtagcgctcgccgcgattggcccgcaccggcaccgtaccctcgatgaaagcgtagcgataccaggtttccgggttcagcttgtacaccgcgtcgctgaccagccgggtcggccgcttgtgctcgtcgaggaacagcagcgacgggtagaccacctggcggttggcgaaactgcggatgcgcaggccgtagaccccctgggagcgcggcagccggatcgccgcgtagaagctcctgcccatgggaaagtcgaagctcggcgagaagcggttcaactcctcgtagcgcggttcgtcggcatccagttcggtgaagtcgctctcggcgatctgctcgcagcagcgccgttgcaggtcctggtagagatcgtcgatggtcatctcggtgcccttgagcaaagccttcagcgcatcgctctgctggccggcgccatccagcccgggcaacgccgccggacgctgcttgaactcgatctgccggccctcggtgaaggcgatctgcgacgaaggcgcggcctcccgcttgaagcgcgccgcgcgctcctcgagcgggatctgcgagttgtgcatgcggcccttctcgtccacccaggtgtagtagggactgccgttctcgctgcgaacgaaacccttgccctcgaaggcctcggcgtcgatgtattcggcggagtgctcgccgttgggcaggacgtagtcggcgcgctggccggcgacctgggcgccggcatagaagctgttctgcacgttgccgttggcatcgatccaggtgtagtagcgacgcttgctctcccctccgctgctgttccccggccactgcgtggcgttgtccgccttgttcagcacccgcgcctggtcgctctggccgatgcgctgccgcgcctggcgctgctggcggtcgaactggccgtcgacgaaggtgttgtgcaccccgccattgtcgtccacccaggtcaggtagcgcccgccggaggcccagcccggcgaagatgccggcagcgccagggagaagacgcaaagtacgatggatgcgcgcatcatgctccagccctcagaaggtcgtacggtaggtcatggcgaaaatataggctttcaccgtggtgtccacgtccagtcccgcgtaagggttgtacaccaggttgtcgagcccggtgcagttcaggttgcagctggtatcggccttga

SEQ ID NO: 13941 - DNA, 1758 bp, Pseudomonas aeruginosa
ctcttctcggcggcctggaagacctcctccagcgccttggcgctgtcggcatcgtcattcttcttggccagcgcgtcacgggcctggtcgaccgaggcttcctcggcaacggacaaaccgctgatagacagcatcagcgccgccgcgcatgtgtaccccctgattctcatggcgctatccccagagattgttcttgtttttgggtatctgctacttggtgcgcaggtgtatgacgtcgccaccagtgcccagctcacggacctggttttcagtgatcttgttgatctgcggaaactcgcggaacgccagcaggctgacggtgcggtcgtccaccaggcgcatgtcgcgatcgttcagcgccagcgcgttgcggggctcctgcccactcgggaagatcacgaacaggacgttctggtcccagatttcctcgaagcgcgtccgggtgaagctgatgttgcccaaggccggatcggcgacgaagacgtgatcgttgtagacatcgcgcaccaccacgaaatgcttgaagccggcatagtggatggggaccagcgccggatgctcgagagcgtccaggtcgctgaactcggcgcgaaaaccaccgctcttgtagcccagcgcagcggcgtagcgcttcatgtcgagcagcgagaaaccgcggcgctgcacaatcttatcggcctcgccatagcgcagcagtccttccatgacctggcgttcctcgaggttgcgcccgaggtagtagtccagcagcgtggtaagcgccgccgagccgcagctgtagtcataggcctggcggatgacgttgcggaactgcaactggctcatcggctccagttgcaccgattcgcggtagggtccattgggggtcagaggctggctgaggttgaccgtgccctgcggttgcggcttggtatcgaccgtctgggtgaacccgaacagtccgatcagacttcccagcaaaatctcgaacatcgccccgtcgtacctctttcggagaaagaccccgccgatgcctcggcgaggtcttcgcgtctcgactcggttcctggatcagtgaccccagaccttgatggtggaaccggccatgttcagcccggagacggtcagcgagccgatgctggcggcgctggtgtcgcccaccttgatggcgccaacggtcacgtcgccggtgatggccggcaggccgatggccagttgctgggtcgacttgccgccgatatcggtggtgacgacgtcgatggtcagcggcttggtatcgtcgatggtcagcgccggcaggctgatgttctccagccgcagggagccgccgttggtgtcggtatcggtgtaggtcacggccccgacggagccctggaaagtaccggaaatgctgatgcctgcctggccggtcacgtcggacagcgcgccatcgtccatggctttcaggtcggcatgcgccagcaagggagcagccagaacagcagttgcaaggaacaggtgctttttcattgttatttctccagtgttcaggtgtggtttgccccagggcactgccgtttgcatcctgtccccggcagatcgaccggcatctcgccggtctccaggtccggtactgcttccctaggtgtcccggacatggattcggtagagcctcatgctctctcgtcctggattccaagctactgggccaccccttccgccgccagcccatccaagggatggagcggtggcggctgccgctcacgcctcgctcagcagtcccaggcttttaccctttag

SEQ ID NO: 13942 - DNA, 1236 bp, Pseudomonas aeruginosa
ctcggcggcgaacaggtagtcgcgggcgcgaagggcgtacttgatcgcccggtcggccaggtcgcgcccctcgcaccagcgcgccgccgcatgcagcaacggggtcggatcggcatgccgggacagccgcccctggaggaactcggcgaacagatggtggtagcggaaccattcgcgctggtcgtccagggcgatgacgaacaactgctcgttctgcaggcgcatgagcatgtccaggccgtcgcgacgcccggtcagcgcattgcacagttccgcattgaactcgtcgagcaccgaggtctggtcgaggaacagctgcaggtcggcgggcaggctggccagcacgtcttccgccaggtagtcggcgatgttccgttcggtcccggagagcccgcggaggaaaccttcccggtcggtattgcgactgagggccagggccgccaggtgcaacgccgtgatccagccttcggtgcgcttgaacagcagcttcagctcgcgctcgcccagctccagccccttgaggtcgaggagaaacgcatcgctctcctcgcgcgaaagtcgcaggtcttccgcgctcaggcagaaggtccagggcttgagggtcggttcgtcgaccaggaagcgcgggcggaagcgggtcgaggccaccacccgcacgtgatcgggcaggttctcgatcaggtagcgaaccccatgcggcaaggcggcgtggcggatgcggtggaaatcgtcgaggaacaggtacaaggggccttccaggcgacgcaggtcggcgaggaaggcatccaggatgccctccagcggcaccgcgacgtcggtgccgagcagattggcggtattgccgccgaatgccgggaccactcgctggatgctcgccagcaggtactggatcagacgctgcggttcgctgtcggtctcgtcgcaggacaaccatgccaccgccgcgccctgctccagcaggcgcaggcgcaactggcagaggatggtgctcttgccgaagccggccggcgcgctgagcaccatcgcgcgtcgcccgcgggcctcgtacaggcggtcgatcagcgcctggcggggaagcagcggcaaccctccggcgcctggcgggaacagcttggtctgcaacagcgggatggtgctggcgggaaccccgtcgcgatggcccatggtcagagcaggctcagctcgcgggctcgccggatcgcctgggtgcgattgcgcaccttgagcttttcgtag

SEQ ID NO: 13943 - DNA, 816 bp, Pseudomonas aeruginosa
ccagcgcttccaggccgcttgcagcggctcgccgtggccggcctatcgcgccctgcgcgaggcctgcccgacgccgttctccggctacctgcgactggccgacggcgcgatcctcagcctgtcgccggagcgcttcctcaagctcgacaagggcaaggtggaaacccggccgatcaagggcacccgcccgcgcggcaagacccccgaggaggacatggcgctggcggcgtcgctgctggccagccccaaggaccgcgcggaaaacctgatgatcgtcgacctgctgcgcaacgacatcggacgcagttgccaacctggcagcgtacgggtaccggagctgttcgccctggaaagctatcccaacgtgcatcacctggtgagcagcgtcaccggcgaactggcgccgggcaaggacgccctcgacctgctggaaggcagcttccccggcggctcgatcaccggcgcgccgaagattcgcgccatgcagatcatcgacgaactggaaccgagccgacgcggcatctactgcggcagcctgttctacctcgacgtgcgcggcgagatggacagctcgatcgccatccgcaccctgctggtcaggaacggccaggtcagttgctggggcggcggcggcatcgtcgccgactcgcactgggaggacgagtaccaggaaaccctggacaaggtccgggtgctgctggaaaccctggaagggatggccgggacagcgtccccggaatagaaaagagcccgcgttccgcgggctctttcatcggcggcgcggctacagactcagcgaacggctggaagccttga

SEQ ID NO: 13944 - DNA, 810 bp, Pseudomonas aeruginosa
ggccatatgccgccctttgctaccattcccgccacagagcgcaacagcgccgcccagcaccaggaccccagcccgatgagccagcctttcgaccttcccgccctcgcttccagccttgccgacaaatccccccaggacatcctgaaagccgccttcgagcacttcggcgacgagctgtggatctccttcagcggcgccgaggacgtcgtcctagtagacatggcctggaagctcaaccgcaacgtgaaggtgttcagcctcgacaccggtcgcctgcacccggaaacctatcgtttcatcgaccaggtccgcgaacactacggcatcgccatcgacgtgctttcccccgacccgcgcctgctcgaacccctggtgaaggaaaagggcctgttcagcttctaccgggacggccacggtgagtgctgcggcatccgcaagatcgaaccgctcaagcgcaagctcgccggcgtgcgcgcctgggccaccggccaacgccgcgaccagagccccggcacgcgcagccaggtggcggtgctggaaatcgacggtgccttttccacgccggaaaagccgctgtacaaattcaacccactgtcgtccatgaccagcgaggaggtctggggctatatccgcatgctcgaactgccctacaacagcctgcacgaacgcggctatatcagcatcggctgcgaaccctgcacccgtccggtgctgcccaaccagcacgagcgcgagggccgctggtggtgggaggaagccacccacaaggagtgcgggctgcacgccggcaacctgatcagtaaggcctga

SEQ ID NO: 13945 - DNA, 1155 bp, Pseudomonas aeruginosa
tcgcgaagcgctggccaggctggccggtcgcgacaatctcgacatgctctgagggccagccatgaaaaagcccggcaccaggccgggctttttcatgggccgaggcgatcagtagaccggcagttcgatgccgtcgaacaactcgtccagctcggccttgttgtggcattgcacggccttggccagcagctcgcgggtcaggtgcggagcgaatttctcgatgaagtcgcacatgaagccgcgcaggaaggtgccgcggcggaagccgatcttggtcacgctggactcgaacaggtggctggcgtcgaggatcaccaggtcgttgtcgagcttcggatcgaccgccatgtgcgccacgatgccgacccccaggcccaaccgcacgtaggtcttgatcacgtcggcatcggccgcggtgaataccaccttgggcaccaggccgcgctggctgaaggcttcgtcgagcttggagcggccggtgaagccgaacacgtaggtgacgatcggctgctcggccagggcttccagggtcagtttcggcagcttggtcagcggatgcccgtggggcacgatgacgcagcgattccagcggtagcagggcatcatgatcaggtcgccgaacaactccagcgcctcggtggcgatggcgaagtcgacggtgccgtcggcggccatttcggcgatctgcatcggcgtgccctggtgcatgtgcagggagacgtccgggtactgcttgatgaagccgctgatcacgttgggcagcgcatagcgcgcctgggtgtgggtagtggcgatggacagcgtgcccttcttctcgttggagaattcctgggcgatctgcttgatgctctcgaccttgcgcaggatctcgccggcggtatggatgatccgctcccccgccggcgtcacccgggtcaggtgcttgccgctgcgagcgaacacctcgacgcccagttcgtcctccagcaggcggatctgcttgctgatgcccggctgcgaagtatagaggctctgcgccgtggcggagacgttgaggtcgtggtgcgcaacctcccagatatagcgcaattgctgaagcttcatggagattcctcgaaaaggttgtcgcgaccggcgatcaagaaccgaaggtatataaccatattaatggtttga

SEQ ID NO: 13946 - DNA, 1089 bp, Pseudomonas aeruginosa
ttgagtaccacgatggctgatttacagatcgacgaccttaacgttgcctccaacgagaccctgatcacgccggagcagctcaagcgtgaaattcccctgaccgacaaggccctgcagaccgtggcccatggtcgccaggtggtgcgcgacatcctggatggcaaggaccaccgtctgttcgtggtgatcggcccctgctccatccacgacatcaaggccgcccacgaatacgccgaccgcctcaaggcgctcgcggccgaagtggcggatacgctgttcctggtgatgcgcgtgtacttcgagaagccgcgtaccacggtgggctggaaaggcctgatcaacgatccgtacctggacgactcgttcaagatccaggatggcctgcacatcggtcgccaactgctccgcgacctcgccgagaaaggcttgcccaccgccaccgaagcgctcgacccgatttccccgcagtacctgcaggacctgatcagctggtcggcgatcggcgcccgtaccaccgaatcgcagacccaccgcgagatggcctccggcctgtcttccgcggtcggcttcaagaacggcaccgatggcagcctgaccgtggcgatcaatgccctgcagtcggtctccagcccgcatcgcttcctcggcatcaaccagcagggcggcgtatccatcgtcaccaccaagggcaaccgctatggtcacgtggtgttgcgcggcggcaacggcaagccgaactacgattcggtcagcgtcgcgctctgcgagcaggacctgaacaaggcgaaaatcccgctgaacatcatggtcgactgcagccacgccaactccaacaaggacccggccctgcaaccgctggtgatggacaacgtcagcaaccagatcgtcgaaggcaacaactcgatcgtcggcctgatggtggaaagccacctgggctggggcagccagccgattccgaaggatctcgaccaacttcagtacggcgtctccatcaccgatgcatgcatcgactgggcgaccaccgagaagagcatccgcagcatgcacgccaagctcaaggacgtgctgccgaaacgccagcgcggctga

SEQ ID NO: 13947 - DNA, 564 bp, Pseudomonas aeruginosa
cacaggagcgcgggcaagggaaccgtcgccctggcctcgaaaggaatatccggacgattcgccaaaaaacaagcagccggcagaaagattcccgagacgcccagccgtaaagaaatctgcacaggagacggaaggactccccatgcccggaaccgccacgtaaactggcggttttcccgcgaggcacacgccatgttgctcaaggcagtacgtaacggactgggtcaggcgattatcctcgccgacttcgtcagccgcccccgcaagctgcagcgcagcgccgaggcccaggccgaggtcgagcgggcgctgcggaacctgtcgctctaccagttccgcgcctgtccgttctgcgtgaagacacgccgcgccatgcaccggctgaacctgccgatgcaactcaaggacgccatgaacgatccgcaggcccgccaggctttgctggaaggcggcgggaaggtcaaggtgccgtgcctgcgcatcgaggaaaacggccaggtgcgctggatgtacgaatccagcgagatcatcgcctatctggaaggtcgtttcgccaacgcctga

SEQ ID NO: 13948 - DNA, 1515 bp, Pseudomonas aeruginosa
accgttccgtccggcgccaccgcgagatcgttgcccatcccgtcgccgggcagggtcagatatcggcgcacggcaccggtcgcgagatccagggcgaacaccccatgcggccggcgccggccagcgggtaggaagtccggcgaattgccccagagcaggccacgcggctcgtccagccgcagcgcggtggcagcgaagatcgccgggctgccggcgaagaaggattcccactcgcccccgggaggcttgcgcaggatgcgcccgctggtgaccagaccgacgtacagcgttccatcggcggcatgggcgatgccgttgggataccgggcccccgctggcaggacgatgctcgtcgcggcgcaggacggctcgcgctcgcccggcgcacgggcgaaaaccggcaagacggtcgccgataccatggataccagcagcaacacggaagcctgtcgtctcatcatgctttctccgtcgatgtgcgccctaccagcgcggggtccgggcgcgcaccgtgagcggcgcctccagcgtggcgcactcctcttcggcgaggtccagcgtcagcgccgcgagggcatcctcgaggtgatgcggcctggacaggccgacgatcggcgcggcgacaccgttccggccaagcagccaggccagggcgagttgcgccggtggaagcccgcgggcagcggcgagtttctccaacgcgccgagggtcgactcgacttcctccctgccgccgtaccagcgcggggcctgttcgtccgtccgggtccgcagcgtgccggcgcttcgcgctccggccagcagcccacgcgccagcggcgaccagggcgtcaacgcgatcccctcttcccggcacagcggcacgaggtcctcctcgtcctcgcgaacgatcaggttgtactggctctgcatcgagatgaattgcgccaggccgtggtggcgctggaaggcgagcatcttcatgaagcgccaggccggcatcgacgaggcgccgaggtaacggaccttgccggcacgcaccaggctgtcgagggtttcgcaggtttcctcgatcggggtttccggatcgaagcgatggatcacgaagagatccaggtagtccgtacccaaccgccgcagcgaggcatccacgctggcaagcagatgcttgcgcgacaagccgcaggcgttgggcctgtcgctcatgggaaagaacgccttggtggcgattaccaggtcctcgcgctgcgcgaagtccctgagcgcgcgtccgaggatccgctcactctcgccggtggaatagatatcggcactgtcgaagaagtcgatcccggcttccagcgcctcgcgaatgaacggacgcgcccgttcctcgtccagcacccatggacgccacgccggatcgccataggtcatgcaccccaggcagagccgggagactttcaggccgctattgccaagacggacatgctgcatcgtacgacctcgtcggaaggctctgaaaagagcggtttccccggtccaccctgttcatga

SEQ ID NO: 13949 - DNA, 936 bp, Pseudomonas aeruginosa
tcgagttattttaataatccaatgaaaaagcccgatctcgccggtctcgccgccttcgtcgccatcgctcgcgaacgcagtttccgccgcgccgccgccaccctcggcgtgaccccgccgacgctcagccacaccctgcgcgaactggaaacccagctcggcatccgcctgctcaaccgcaccactcgcaacgtctcgccgaccgaggccggcgagcacctgctggcacacctggacccggcgttcgaagacatcgccgccgcgctggacagccttaaccgctttcgcgaaacgcctcacggcctggtacgaatcaacgcaccgcgaaacgccatcggtctcgtcctcgcgccacgtttcggcgaactggcccgcgactatcccggcatcaccctggaagtggtggcggacgagggtttcgccaatatcgtcgaagccggtttcgacgccggcatccgcctcggcgaagacctccagcacggcatgcgcgccgtgcgggtcggcccggacctgcgcttggccatcgtcgccaccccggcctacttccgacggcaaggcaggccgggtagcccggaggaattgttcggccaccgttgcatcggctggcgcaaggtgtcttccggagagctttacaaatggcaattcagcaagggcacgaaagcgctttcggtggccgtgagcggaccgctggtcctcgacgacccgcgcctgatgctacaggcggcgctggccgatgtcgggattgccttcgccatcgaggaggaagtcgccgagcacctcgccgccggccgcctggaacgggtcctggcggattggtgcgccccctttcccggtttccatctctattatccgaaccgccgcaaccacccggcggcgttgagcaccgtgatcgacctgctgcgctaccccggcgaggaacacccaggtcccgcgtag

SEQ ID NO: 13950 - DNA, 2433 bp, Pseudomonas aeruginosa
cgcctgtggcgctattcgccctaccaatggaggctggaggcaagggcctgtaccgccgcgcggcgtagggcggataaccgcatcgcggttatccgccgaacctcggcatatcggcggatagcgcccatggcgctattcgccctacccgtggcggcctggctggcaagaaccaggggataccggggtggcttcatccgccgcggtacgcgaccacgagaaagccggcccgaaggccggctctccatgcgacgccaggactcagaacagctcgcccttcgccgccttctccagcaacagcgccggcggctcgaagcgctcgccgtactgttcgaccaggtattgggcgcgggcgatgaagtccttcaggccgtactggttgatgaactgcaaggcgcccccgctccaggcggcgaaaccgataccgaagatcgagccgatgttcgcgtcggcggtggagtgcaataccccctcctccacgcaacgcacagtctcgatggcctggatgaacagcaggcggtcgcgtacgtcctcggcggatatttgcgcatcgggcttctcgaagcggctcttgagttccgcccagagatgtttcctaccgttcgccgggtagtcgtagaagccggcgccggccgccttgcccgggcgcttgtactcattgaccatcaggtcgatcacggcgaacgcagggtgcgtcggcagagccttgccctcggcctcgaggtcgcgggcggtctggttgcggatgtgggtcatcaggctcagggagacttcgtcggaaatcgccagcggccccaccggcataccggcctggcgcgcctggttgtcgatcatcgcggcgctcacgccttcgccgagcatggcgatgccttcgttggtgaaggtgccgaatacccgcgaggtgaagaagccgcggctgtcgttgaccacgatcggcgttttcttgatctgcagtacgtagtcgaaaccgcgcgccagggtttcgtcgctggtcttttcgccgcggatgatctccaccagcggcatcttgtccaccgggctgaagaagtgcaggccgatgaacttctccggccgcgccaccgcctgggccagaccggtgatcggcagggtcgaggtattggacgccactaccgcatcggccagggcatgcttctcggcctcggcggtgaccttgcctttcagcgcgcggtcctcgaagaccgcctcgatgatcaggtcgcagccttcgaagtcggcttcgctgacgctcggcacgatccgcgcgaggaaggcgtcgcgcttctcggcggacaggtgcccgcgcgcaactttcttgtccagcagcctggccgaataagccttgcccttctccgccgcttccagcgagacgtccttgagcaccacctcgatgccggccgccgccgatacgtaggcgatgcccgcgcccatcatcccggcgccgagcacgccgacctttttcgtcgcccgcaccggatacccctgcggccgcgacttgccggcgttgatctcgttgagctggaaccagaaggtgccgatcatgttcttcgccacctggccggtggtcagctcggtgaaatagcgcgcctcgatcagttgcgcggtgtcgaaatcgacctgggcgccctccactgccgcgcacatgatcttctcgggcgccgggaagcaacccttggtcttgtcgcgcagcaccgacggtgcgatggccagcatctgcgccacgttgggactggcaggcgtaccgccgggaatcttgtagccggcgctgtcccagggctgcttcgccgccgggttggcgaggatccaggcgcgggccttctccagcatttcctcggggctgtcggccagttcgtggatcagcccggccttgagcgcttccgccggacgcaccttcttgccttcggcgaggtacggcagggctttctccaggccaagcaggcgcaccatgcgcacgatcccgccgccgcccggcaacaggccgagagtcacctccggcaggccgagctgcacgccgggattgtccagggcgatgcggtggtggcaggccaggcagatctcccagccgccgcccagcgcagcgccgttgatcgcggcgaccaccggcttgccgagggtctccaggcgccgcagttggcccttgagttcgaggatgccctggtagaaggccggggcgtcggccttggtgaccttgatcagctcgttgagatcgccgccggcgaagaaggtcttcttcgccgaggtcagcaccacgccggcgatcccctctttctccgcctccagccgtgcgatggtcttcgccatcgcctcgcggtagacaccgttcatggtgttggcgctctgcccgggcatgtccatggtcaggacgacgacgttgtcctggcctttttcgtaacggatagcgtcagtcattccggttctcccttcacacgcgctcgatga

SEQ ID NO: 13951 - DNA, 267 bp, Pseudomonas aeruginosa
tcaggtagaacgccaccgccagggtcatccccgcctcgccgaacgcatacaggcacaccggcaggcccatgttgccgacattcgggaagctgtaggccggcaccagcacctgccactcctggcgcccgaggcgcgccgccgcccagcccagcgcagccatgcagacgcagatcagcgcgctggccagggccatccggccgaaactgtgcaggtccacccgggtatgcgccagggtggcgaggatcaggcatggcgaaccgatgttga

SEQ ID NO: 13952 - DNA, 849 bp, Pseudomonas aeruginosa
tcggctacctgcgccacatggccggccgcaaggcgggcgcggccggctgaagcggcgtcagatgttgtacgccgagggcggcgacggcaggcgctccagcaagtcgtgcaggccggcgctccactggcggcggatggcgctgaaataggcgtcgtcctcggtgacccggtagccctccggcaggatcaggctgtcgcggtggtagaccagcaggtccagcggcatgcccaccgagaggttgctgcggatggtcgagtcgaacgacaccagcgcgcagcgcagggcctgctccagcggcgtgtcgaaagtcaggttgcggtcgaggatcggcttgccgtacttgctttcgcccagttgcaggaaaggcgtgtccggcgtggcctggatgaagttgccctggggatagatgctgtacagcgccggcggtccgccggcgatctgcccgccgaccaggaaggaacagctcaggtcggtattgccggccagattgccgccgtcgcgggccagcacctcgcgggtggtctcggcgaccagcgccgtggcgtcgtagaccgagggcacgttgagcaggctggcgccgtcccggcggatgcgctgctgcagcaggttgatcaccgattgcgaggtcgccaggttgccggccgtctgcaccaccagcaggcgctcgccgggcgtgccgaaggtgaacagcttgcggaaggtggcgatatggtcgatcccggcgttggtccgcgaatcggaggcgaacaccaagccgtcggccaggtgcatcgcgacacagtaggtcatctcgaatcttccttattccgtccgtccccgcccctcaagcgtaaaggcaatcgccgataa

SEQ ID NO: 13953 - DNA, 516 bp, Pseudomonas aeruginosa
ccaccagcgagccttcgcgcaacgccacccgggtcagcccgccaggcaccaggcgaacccgatccggcgccgacaggacgaacggccgcaggtcgatatggcgcggcgcgacgccgctctcgacgaaggtcggacaggtcgacagggacagcgtcggttgcgcgatataggcctccgggcgagccttcaggcgctcgcggaacagctcgatttcctcccggctggccgccggtccgaccagcatgccgtagccgccggaaccctgggtctccttcaccaccagctccggcaggtgcgccaggacgtgcgccagttccttcggcttgcgacattgccaggtcggcacgttgtgcagtagcgggtcttcgccgaggtagaagcggatcatgtccggcacgtagggatagatcgacttgtcgtcggccaccccggtaccgatcgcgttggccagcaccaggttgccggcccggtaggcggccagcaggccgggcacgccgagcagcgaatccgggttga

SEQ ID NO: 13954 - DNA, 1371 bp, Pseudomonas aeruginosa
tatcaggttgatatcaaccacttctctcccgctatcccgttcggacgctttcatgcttatcagcagctacaaccaggttcttgtcgccttttccctgattgtggccatcctggcgtcctacaccgctctcgacatggccggccgggtgaccctggcgaaaggccgcgaggcgctctcctggctgatcggcggcgctttcgccatgggcttcggcatctggtcgatgcatttcgtcggcatgctcgccttcagcctgccgatcccgctcggctacgacctgggcctgaccctgctgtcgctgctgctggccgtcggcagttcggccttcgccctctggctggtgtgccaggcggaactcccctggcaacgcctggcgctgggcgccctgctgatgggcagcggcatcgccgccatgcactacaccgggatggccgccctgctgatgatgccggggatcgtctacgacccgctgtggctcggcctctccatcctgatcgcggtgatcgcctccggcgccgcgctgtggatcgccttccgcctgcgccatggcagccggcgcatcgtcctggtccgcgccggcgccgccctggtgatgggctgcgccatcgtcggcatgcactacaccgggatggccgccgcgcagttccccctgggcagcttctgcggcgccgccggccgaggcatcgacaacggctggctggcggtgctggtcatcgtgatcaccctggcggtgatcgccatcgccctgatcgtctcggtgctggactcgcgcctcgaggcacgtacctcggtgctcgccacctccctcgcacgagccaaccgcgagctgatccagttggccctgcacgacaacctgaccaagctgcccaaccgcatgctcctcgacgaccgcctggagcatgcgatccagcaggcgatccgcgacgatcgccggttcgccgtgctgttcatggacctggacggcttcaaggcggtcaacgatgcctacggccatcacctcggcgacctgttgctgatcgaagtcgccgagcgtatccgcgccaacgtccgcgcccaggacaccatcgcccgcctcggcggcgacgagttcgtcctgctgatcgaggcccgagagcccgccgacgccgcgaccctggccgagaagctggtgaagcggatcagccagccgtaccagatatcccgccacgaggtgcggatctcggcgagcatcggcatcgcgctctaccccggcgacgggcagacccgccacgaactgatgatcaatgccgacgcggcgatgtatcacgccaaggaccagggacggaacggctactgcttcttcgagagttcgatgaacgccaacgcccaggaacagttgcaactgctccatga

SEQ ID NO: 13955 - DNA, 3204 bp, Pseudomonas aeruginosa
cctgcgccaggccctggagcgccggcagttggtcttgcactaccaacccaaggtactggcgccgaacggaccgatggtcggcgtggaagcgctgctgcgctgggagcatccgcaacacggactgatcccccccgaccagttcctgccgctggcggaaaaaaccggcctgatcgtgcagatcggcgagtgggtgctcgacgaagcctgccggcagatgcgcctctggctggacggcgggcatgcggagtggaacatcgcggtgaacctttcggccctgcagttcgcccatgccggcctggtcgactcggtgcgcaacgcactcctgcgccacagcctggagcccagccacctgatcctcgaggtgaccgaatcgaccgccatgcgcgatgccgatgccagcctggtgatcctcgagcagttgtcggcgatgggcgtcggcatctccatcgacgacttcggcaccggctactccagcctgctctatctcaagcgcctgccggcgagcgaactgaagatcgaccgtggcttcatcaacgagctggcccacgacagcgacgacgccgcaatcgtctcggcgatcgtcgccctcggccgcacgctgaacctgaagatcgtcgccgagggcgtggaaaccgaggcccagcaggagttcctgacccgcctcggctgcaattcgctgcaaggcttcctgctcggcaggccgatgccggccgagcagttgctcgccagcgtcgcctgagcgccgccagcggcgcgccacgggacctgtcagaaccggcagattcgcccatcgccgtctcgttgacttccgcccgcgctgcgaacaccttatgtcgcgcccgccgggcggcatgccgcgacatgtcacgccgccacgacgagcgtctatccaataacgagaaaacatgcatgaacaggctgtgtgtactggggcttctcatcgggctgagcgggagcccggcactggcggctggccagggcgaatccggcaatccaccggctaccgacaaggagcgtttcatcgccagcctgatggctcgcatgagcaacgcggaaaagatcggccagctacgcctggtcagcgtcggcgccgaccatcccaaggaagcgctgatggcggacatccgcgccggcaaggtcggcgccatcttcaataccgtgacccgcccggacattcgcgccatgcaggatcaggtccgccatagccgcctgaagatcccgctgttccatgcctacgacgtggcccacggccaccgcaccatcttccccatcagcctcggcctggccgccagctgggaccccgaggtggtcgcccgcagcgcgcggatctccgccctcgaagccagcgccgacgggctcgacatgagcttctcgccgatggtcgacatcacccgcgacgcgcgctgggggcgggtctcggaaggcttcggcgaagacacctacctgacctcgctgctgtccggcgtgatggtccgtgcctaccagggctccaacctggccgccccggacagcatcatggcggcggtcaagcacttcgccctgtacggcgcggccgaaggcggccgcgactacaacaccgtggacatgagcctgccgcgcatgttccaggactacctgccgccctacaaggccgcggtggacgccggcgccggcgcggtgatggtctcgctgaacaccatcaacggcgtgcccgccaccgccaaccgctggctgctgaccgacctgttgcgccagcagtggggcttcaaggggctgaccatcagtgaccacggcgcggtgaaggaactgatcaagcacggcctcgccggcaacgagcgggacgccacgcgcctggcgatccaggccggtgtcgacatgaacatgaacgacgatctctactcgacctggctaccgaagctgctggcggccggcgagatcgaccaggccgacatcgatcgcgcctgccgcgacgtgctggcggtgaagtacgacctcggcctgttcgccgatccctaccggcgcctgggcaagccggacgacccgccgttcgacaccaacgccgagagccgcctgcaccgccaggccgcccgcgaggtggctcgcgaaggactggtcctgctgaagaaccgcgacggtctgctgccgctgaagaaacaggggcggatcgccgtgatcggccccctggccaagagccagcgcgacgtcatcggcagttggtcggcagccggcgtgccacgccaggcggtaaccgtctaccagggcctggccaatgccgtcggcgagcgtgccaccctgctctacgccaagggtgccaacgtcagtggcgaccaggcgatcctcgactacctgaacagctacaacccggaagtcgaggtcgatccgcgctccgccgaggcgatgctcgaggaggccttgcgcaccgcgcgcgacgccgacctggtggtcgccgtggtcggcgaatcgcagggcatggcccacgaggcctccagtcgcaccgacctgcgcatcccggccagccagcggcggctgctgaaggcactgaaggccaccggcaagccgctggtgctggtgctgatgaacggccgaccgctgtcgctgggctgggagcaggaaaacgccgatgcgatcctggaaacctggttcagtggcaccgaaggcggcaatgccatcgccgacgtgctgttcggcgagcacaaccccagcggcaagctgaccatgtccttcccgcgctcggtgggccaggtaccggtctactacaaccacctgaacaccggccggccgatggaccacgacaaccccggcaaatacacctcgcgctatttcgacgaagccaacggcccgctctacccgttcggctacggcctcagctacaccgagttcagtctctcgcccctgcgcctgtccagcgaacggctggcccgcggcgctaccctggaagcgcgggtcacgctcagcaacagcggcaagcgcgccggcgccacggtggtccagctttatctgcaggacccggtcgccagcctcagccgtccggtgaaggaactgcgcgggttccgcaaggtgatgctggagcccggcgaatcgcgggagatcgtcttccgcctcggcgaggcagacctgaagttctacgacagccagctcaggcacacggccgagccgggcgagttcaaggtcttcgtcggcctggattcggcgcaaaccgaaagccgcagcttcaccctgctctga

SEQ ID NO: 13956 - DNA, 591 bp, Pseudomonas aeruginosa
cgatcaccgaggcatcgtagttggcgccgaagttggccaacacgtcgcgcaggctttcgccctgcgccacatagtcgtaaggcaggctgggccagtccagcggctgcgcgcgcaagaccgcgccaggcagcagcgccagcagtccgccgatcagcaggcggcgcatcagggacgccacaccggagcctgcggcggcaacccgcggggcagcggttccagctccggcgccagcgcctcgagcagccccacctggggcggccagggcccgttcgagtcgctcgggatcgaggccgtcgaggcccagccgcgcctgcaacagcaggcgcccgtccgcgtccaggacaatggcctggggatagcgccgactccaactggcgacccgcgacaacagcacccgcagcaacccctgctggtcgcgctgcgggtccaggggggcgtgctccagcgggctttccagcagcaggtcgtcgccctggcgcagcaacaggacgctctgtccgtcgatgcgcaggtggtacgaacccgtccgatcggcaacaaagggcccttggcccaggcgagtggccaatccgctcaacagatgatccatga

SEQ ID NO: 13957 - DNA, 840 bp, Pseudomonas aeruginosa
acgacggcatacaggcgcagcctgagttgcgcctggcgcgcctgcagggaaacgccgcccaccgaaccgcccaccgtcaccttcggcgacatcggcgcgggctggctgacgcaaccgccgagcagcaacgccagcggcaacagcatccagcacctcacctgcgccggaccgtgcgcgcctccagcggcgtgccgtcgccgtcggcgaggcgctgcaaggcctgctcgctgcgcggatcgccagccacgttgcgcgccagccagcgcgccagcccggccacgctggaacggtcgtcgccgcgaacggccgcgcgggtcaccgaacgcccctcgaaatgccccaccgtctcggctcctgcgtcttgggacggctgcaccggcgaaatcgattcgattttcatggggccactcaaaccctcatgccgaccgcagcgaccgcctcgcgatcgctgtcgcacggcagcaggcgttgccagaactcggcgtggtcgagcaggttggccagggtcgcctcgaagcattcgagggtcagttgcgctgcgagaatctgcgcatacaactggaccttcccggtcagctcgtcgaagccgaaatgcagatcgaaacggtgccaatggcggttgaagctggcgagctggcgaaagatcccctcgcccagcacatcgatgcccgccacatcggcctccagcaacagacgctcgcgctcggcgagcagcaacagggtgacgcccacctgttcgtcgaacagcaggctcgccatgccctcttcgtcgagggacagggaaggcaaaccgatacggcctgcgaactcggcaagcagtcggttgaccttgctcgttaa

SEQ ID NO: 13958 - DNA, 1809 bp, Pseudomonas aeruginosa
gtccgcgaagcatcgccagggtgccgccgtcgcgcaggaaggcctccagcgcctgttgctggtcggtgtcggaaggggtcgcttgctggttcatggatacctctagatcgcgctgagaatgtcgcgcaggacgctgtcgtatttctggatgaagcggttgagcgcctcgaccgccgagttgtagcgggagctggtgtcgttgagcagggtggtcttctcgttgaccttgtcgttcagcggacgcgagcggtcgctcaccgtggtggcgaaattgccgaccgggttgttgtccttctcgaaggggtactcatccctgaggcccttgagttccccgctctgcttcggcgagccgctgagaaaatccttgatcgacagcttgccgctgaaggtatccagattgctcagcagcgcatactcggggctgtccttccacctgggatcgccgacggcatagccatagagcgtggggtcgaccagatcgataccgccagcgtcgatcctgatgccctgcttggccgacagcgcggcgttgatctgcgactggatcacgctgtagaccttcaactccgcggtcagcgccttgagctcgtcgagcagcgccttgcgcttgccgtcctgggtctgcaggacatccttgtagacaccgatgacatcctcgtcgagacggccgtgcaggctgaaataggccgacaccaggaactcgcgcagatcccactgcgcaccgggctgccgacgtgcctgcaggacttcgcggagtacctcgaggccctgccccggaggcgcggagggattggccgcgagcaaccaggcaagcgccttgagcacttgcgcctcgctcagcggctggccggcgtgggccagcacgatccgctcgctgcgcaacagggccagcagttcctcctgctcggcactggcaggcgccgccgacgcggccaggagctcgtccaggaacagctcgcgagcggcattaaggtttctgacttccatcgtgattcctcagatcaacaagccacgcatcggcgtcggacgccgcggccgggtaccctgctcgccctgcgtcggctgggaactgcgcatgcgccgcagttcggccagcagctcctcttcggcggctcgcgccagctctcgctccggcgcctggaacagcagctcgccggcgtccgcggcaagccccaggccttgccacatttccgccagcaggcggccgcgttcctcgctgtcgcgaatcgccagttcggcggcctggacggtcgcccgcagggtgtcttcggtgtattcgttcatgtcgtccatggtagggatcgacgttgccggagcctgtcaggcacggtcgggtttttgtcgttttcgcaggcttcgctgcgtcaccacccgcccggcctccagctcgaaccagccgtcggcgggctcggcggcgccggtccagcggcgatagaagcgcgccatgcgctcgccaggcagtgggctgccggccagcgccaggaccttgccgtagagacgctggcgcggccccagcgtatcgagcgtggcctccgccagcaggtacagcgcggcgaatggattggccaatccgctgcgcgcctgccgccgacgcaacatcacgatccagacccgctcgccgtcgcagcgccaggccagttcgcagccatgggccaggacctgccagccgagcgcgatcgaggtgtcgcgcaggcaatgcggacgcaccgccaggccgcgggcgagaaaccagggaatcagcggatcggcgctcacaacacgatcctgccaagcggctggatgttgatctgctgggtcagctcctggtag

SEQ ID NO: 13959 - DNA, 495 bp, Pseudomonas aeruginosa
tgcgcctgctccacccagctcgcctcttctcccggcacctgcagctctgccggctcgtgggggaccgcgagcagttccagctgcgcggcgcgttcgcgcaccagcaaccagcccggccgcaggcatccgcgcgcgaccgggacctcctgtagctgcaccaggtattcgccatcgcccatcgcttcgttgaagcgcaagtggatacccgggaacggcacgccgaaatccaggtacaacgcgcgtcgtacccgcaccagctcctcgttcagcgacatcgcctcgagacgttcctggaggctggcatcgacgtcgatcagcaacggcacggtgagggcgaattcttcctgctcggcgagacgcccggccttcggcttgccgccgccagccttgccacgcgccttggccgatggcgctccggcgccctgcgcgagcagcgccggcaggtcgcgggaaccggcgctggcatgggcccgctggcgccagagcatgaagtag

SEQ ID NO: 13960 - DNA, 1467 bp, Pseudomonas aeruginosa
ccgccgccgccaaccagcagcgcgagagccaggaaggtcagggtcgggacaccgggaatcaggccgaacagcaccagcaacaggccgccgatcagcagcgccttgggctgcgccaccacctgttcgccgatgtcgctgccgaggtccgccgattcgtcggaagacacccggggacgagatcccggcggtgatggcgatcagcaacgccggcacctgcgagaccagccatcgccgacggtcagcaccgcgtacagttgcagcgcgtcggcggtgctcaggcccttctgcgtgacgccgatggcgatgccgccgaggatgttgacgacgatgatgatcagcccggcgatggcgtcgcccttgacgaacttcatcgcgccgtccatggagccgaacatctggctttccttttcgatcaccgcgcgccgcgcccgcgcctcgttgacatcgatcacgccggcacgcatgtcgccgtcgatgctcatctgcttgcctggcatggcatccagggaaaagcgcgcgctgacctcggcgacccgctcggcacccttggtgatcaccaggaactgcacgatggtgatgatcaggaagatgatgatgcccaccaccaggttgccgccgaccacgaagctgccgaaggtgttgacgatctgccccgcgtcggcctgcagcaggatcatccgcgtggtgctcaccgacagcgccaggcggaacagcgtggtgatcagcagcaccgccgggaacaccgagaactgcaacggcgagccgatgtacaccgacatcatcagcaggaccacggagatggtgatgttgacggcgatgaggatgtccagcagcagcggtggcagcggcagcaccatcatgaacaccaccgccagcagcaacaccaccagcaggatgtccttgcgctcgccgacccggccgagaagcccgctcaggtcgttcattcccgcgcctccagctccagcgcccgggcgtgcgcggcacgcgccgcgtcgagacgcccggcgagctgttcggcacggctcaggcaaagccacagaccgggctcctcctcgccatcctcctgcaactgccggcacaggcgcacggcgggctcgccgaggccttgctggagcaacgccaggagcaaggcgcggcgcccgtcgcggcgctccggcgcaacgctcagcaaggcctccagcaacacctgggcgcgtcgcggctggccgcattgcaggtgcaaccagcccagcatcagcaacaggcgctgttgcgtctgtttcaacgtcatcgattcataccttgtgcaacaggttcggggccatttgcagcagtcgctggtcttcatcgcgctcgccgagcaggcaggccgcggcctgcagggccggctggcggggcagcgtgagggccaggcggagatcgcgcagcgcctggcggaagtcgccggggcgcagcaggccgtggaactccagctggggccgggcgtag

SEQ ID NO: 13961 - DNA, 474 bp, Pseudomonas aeruginosa
aattcgtcgcgcgaggctttctctatagtgcgcgccgactccagccgaaccgatccgccatgcccgcgcctctctctcctctcatcgtccggatgcgccacgccatcgaaggctgccggccgatccagatccgcgggcgggtcacccaggtcaccggaaccctgctcaaggccgtggtgcccggcgtgcgcatcggcgaactctgccagttgcgcaatcccgaccagagcctggcgctactcgccgaggtcatcggcttccagcagcaccaggcgctgctcaccccgctcggcgagatgctcggggtttcctccaacaccgaagtcagccctaccggcggcatgcatcgcgtggcggttggcgagcacctgctcgggcaggtgctcgacggcctcggccgccccttcgacggcagcccgccggccgagccggcggcctggtatccggtctaccgggatgccccgcaaccgatga

SEQ ID NO: 13962 - DNA, 1716 bp, Pseudomonas aeruginosa
agatcggcgaataccagaaaggccaggacagcgaagccgaccaggccatcgagaagatcgcggcgatccgccagtggctgcgccagggtacccacgaaaccagcgattacgcacaggcctgcgcgcagttgcggagcctctgcgcatgagcctggcgctgctgttgcgcgtccgacgcctgcgcctggaccgggccgagcgcgcccagggccgccaattgctacgggttcgcgccgcggcgcaggaacacaccgagcgccaggcggcgcaacgggactaccgcgactggcgactggccgaagagcaacggctgtttctcgcctgccaggcggccatgctcgaccgccggcgcctggaagcctggcagcagcaggtaggactgctgcgggaaaaggaagccggcctggaacaggactgcgccgagaccgcgcagcgcctcgaaggggagcgcgagcgcctgcggcagtgccggcgagaactgctggaacgccagcggcaactggagaagttcgccgaactggagcgccacgtcgacgccgagcgccaggggctgcgcgaacgcagcgaggaaggcgaactggaagaattcacccgccacgagacctggccatgctcaagctgaacgccgtggatacggctccgctcgtgtcgtccgacacccctgccccccttccgccgctgcgcgcgcagcagatcgccttcgaacaggccctgcccgcgcaccgaccgccggcgcccaggccaccgttcgacaagggcgacgaaacgacagaggccgaagagcccgccgcgacagccgacgcgccgacctcgacgcctctcgccgaccagcccgcggcgcctgccgccgaccggccgccgaccactcggcaagcccccgtgccagttgccgcggacgcaacgccaacgccaacgccaacgccaacgccaacgccaacgccaacgccaacgccaacagtgtcgccgtccggatcggtagcacggcaagcgccggcggtctccgcgcgcgtcgcggcgtccacgcaagcccgggagccggccagcgtttcggcgcctccggtcgacgaaccgccgctggtgccggtgtcctcccacccgcaaatcgcaggtcggacgcatgagcggccacagcccggccccggcttcccggcgaaaaccgcagccgaggtcgcgtccacggcgcaggccagtgtccaggattcgccgcccgcgccgacagcgggcggcgaaggccgcggagaggagcgtcggcaacccggagaaaccgatccatccgcactgccccccgacgaccaagcgcctgtgccactgcctgccatgcaaacccccggcgaccgcctggtggcacgcctgctggcatcgagcgggagccggccactgccgctggccgatctcgcgcgcctgctcgatgccgtgcaggggcgcatccaggtcgccagcgcagccgaaagccatgcggcgcgcctgcaggtgcgactgccccagctcggcgccgtggaggtgcaggtcctgcatggccatggccagttgcaggtcgagatcagtgccagccccggcagcctggcgtttctccagcaagcccgtggcgagttgctcgaacgcctgcaacggctgcatccggaacaaccggtgcaactcaccttcaaccagcagcaggacagcggccagcgctcgcggcaacgtcgctacctgcatgaagagtggcaagccgaatga

SEQ ID NO: 13963 - DNA, 948 bp, Pseudomonas aeruginosa
cccgcctgttcggacacgacgaagcatgatccaattgcccgacgagctcggcctgatcctcggcctggccctgctcgcgctggtcccgttcatcgcggtgatggcgacctccttcatcaagatgaccgtggtcttctcgctgctgcgcaacgccctgggcgtccagcagattccgccgaacatggcgatgtacgggctggcgatcatcctcagcctgtacgtgatggcaccggtcggcttcgccacccgcgactacctgcgcaaccacgacgtcagcctgagcgactcggcatcggtggaacgctttctcgacgagggcatggcgccctaccggaacttcctcaagcggcagatccaggagcgcgaacacaccttcttcatggaaagcacccgccaggtctggcccagcgaatacgccgagcggctcgacccggacagcctgctgatcctgctgccggccttcacagtcagcgaactgacccgtgccttcgagatcggcttcctgatctacctgcccttcatcgccatcgacctgatcatctccaacatcctcctggcgatgggcatgatgatggtgtcgccgatgaccatttccctgccgttcaagctgctcctgttcgtcctcctcgacggctgggcgcggctgacccacggcctggtcatcagctacggaggctgaccatgagcagcgccgacatcctccacttcaccaaccagaccctgtggctggtgctggtcctgtcgctgccgccggtactggtcgcggccctgatcggcaccctggtatcgctggtccaggcgctcacccagatccaggagcagaccctcggcttcgtcgccaagctggtggccgtggtggtggtactgttcgccaccagcggctggctgggcggcgagctgtaccgtttcgccgaaatgaccctgctgaaggtgccgctggtgcgatga

SEQ ID NO: 13964 - DNA, 1377 bp, Pseudomonas aeruginosa
acgtgttcatcctcgccatgccgatcaagagcctggtggccagcctgctgctggtgctctacctgggcatcctcatggagcacgcctacgatgccctgctgctcgccgtcgacccgctgcgcctgctgcgtcccgtgctggagacgccatgagcgccgagaagaccgagcagcccacggcgaagaagctgcgcgacgcccgccggcaaggccaggtggtgaagagcaaggaaattgtctccagcgcgttgatcctgtcgctggtggcgctgctgatgggcttttccgactactacctggagcatctcggcaagctgctcctgctgcccgccgagtacatcgacctgccgtttcgccaggcgctggagaccatcctggagaaccttctccaggagctcctctacctgctggcgccggtcctgctggtcgcggcgctggtggtggtgctcagccatgtcggccagtacggtttcctgctcagcctcgacagcgtcaagccggacctgaagaagatcaacccggtggagggcgcgaagaagatcttctcgatccggagcctggtggagttcctcaagtcgaccctgaaggtcgccctgctctccctgctggtctggctgaccttgcagggcaacctggccagcctcctgcggattcccgcctgcgggctggactgcgtggcaccggtgagcgggctgatgctcaggcagctgatgctggtctgcgcggtcggcttcctggcgattgccgtcgccgactacgccttcgaacgccaccagcactacaagcagttgcgcatgagcaaggacgaggtgaagcgcgagtacaaggagatggagggcagtccggagatcaagagcaagcgccggcaattccatcaggaactgcaatcgagcaacctgcgcgcggatgtccggcgctcctcggtgatcgtcgccaacccgacccacgtcgccatcggcatacgctatcgacgcggcgaaacgcccctgccgctggtcaccctgaagcacaccgacgccctggccctgcgggtccggcgcatcgccgaggaagaaggaatcccggtgctgcaacgaattccgctggcacgggcgctgctgcgcgacggcaatgtcgaccagtacataccggcggacctgatccaggccaccgccgaagtcctgcgctggctggaaagccagcagacggatacgccctgatcgctatcgggcagggcggccgccgcggcaccggcgacgaaagacgctgcgacctggcgccgaaaaaaaggggcccgaaggcccctttcacatgcttgctacgggtcagtccttgtccgggatcccgtgtaccacgcccgcggtattctccagcaggctcttggtcgcggtctggatga

SEQ ID NO: 13965 - DNA, 981 bp, Pseudomonas aeruginosa
actcgcggcgcaccgcggcctcatcggcgtccaccagcttgtcgttgggggtcagcaacatctgccgggtggtctccagggcgacattgtcgtacaggggggcattccagatgttcgcgcggttcttcggagaagcgctccttggccgccttgaccagggtcagggtgccgttcaggcccaactggttggcgaacatggactcggtggtgaaggcatcgcccccagcgcagcggcgggccctggcgcagggtgccgcgggcggagaggacgcagaccagcacgcagaggaacagcaccacgccgcgcacgtaccagggcgcggcagcgctcggccgggcgatcacgctgtcttcgcgcagcttgcgctggctcgggcgggtcgccaggtcgatggccttgaacacccggtacagcacccaggtggcgaaggcccaggccagcaggtagcggaccaccgggaagccgtaccagagcatgctcatgacggtcttcgggtcttccgacatgtactggaagaccaggctgttcaggcgctggtggaactcgcggtagaagtccagttcgagtacgccgaggaacagggtgatgctggcgaacagcgtcaaccatgtacggaacaggccgcgagcggccatcgcgcgtaccgcgaacaacgacagcaccagcggcgccacggcatagacgacgacccgcaggtcgaaacgcacgccgttgccgaacgcctcgaggaaggtgctcgccggggtcgcgccgatcagttcgcggttgtagatcagcaaggccaggcgcagcaggctgaacatgaccagcagcaccagcgcgctgagcgcggtgaacgccaggtggctgcggatggtgggctggaacagccgtgggggcgattgggtggttcggacttccgtttggtccatgtttacaattcgctcttctgtcgttcgatttccagaatgcggtcccgcccctgctcggccagcaggtag

SEQ ID NO: 13966 - DNA, 939 bp, Pseudomonas aeruginosa
caggggatgtcggagcgacgcatgaaaaagggccttgcggcccttcttggtgaagcgtcagtcgttgtcctgcttgccgatggcctgcagcacgtactgcggcagagcaaacgcgcccaggtggatatcggcgttgtagtagcgggtggcgatgccgctgtcgcggaagcgctggcgcagcgtttccagcggaaggcgacgcaggccttcgcgggtcgaaccccaggcgaaggtcatggcgccgccgatataggtcggcaccgccgcctggtagaaatgccagtcggcgaacagcccgtcggtacgtgcggcggtggtgcgcacttcctccagttgcatgaacggcgtgccgttctgggtgaccaggatgccaccctcgttcaggcagcgccggcaggcctggtagaagttctcggagaacagcacctcgccagggccgatcgggtcggtggagtcggagatgatcacgtcgaagcgttcttccgtggtagccacgaagcgcatgccgtcgtcgatcaccaggttcagccgcgggtcgtcgaaggcgccctgggagtggttgggcaggaacgccttgcacatgtcgaccacggtgccgtcgatctcgaccatggtgatccgctcgacgctcttgtgcttggccacctcgcgcagcatgccaccgtcgccgccgccgatgatcagcacgcgccgggccgcgccgtgggcgaggatcggcacgtgggtgagcatctcgtggtagatgaactcgtcggcctcggtggtctggatcactccatcgagcgccatcacccggcccatccgggcgttttcgaaaatcaccaggtgctggtgctcggtgcgcacctcatgcagcatgttgtcgatgctgaagcgctggccgtagccctggtacagagtttcctgataatcgctcatgggccgggatctccctggtaa

SEQ ID NO: 13967 - DNA, 801 bp, Pseudomonas aeruginosa
cgaccactatgcccgcagcttccgggccaacggtcgcccggcctggttcgaggtgcgaccgctggcggaacgccaggtcctggcgctgagcctcagcccgtccgcccatgccctggccgccgaactcgaggcacgggtccgccggatgttcgacctggacagcgacccggccgccatcgcccggcatttcgccggggatcccctgctcggcccgctggtggccgccaatccgggactgcgcctgccggtggccttcgatcccttcgaacaggcggtgcgcgccatcgtcggccagcaggtcacggtgaaggccgcggtgaccatcaccgggcgcctgatccagcgcctcggcgagccgctggaagatctcggttacgacggcatcagccacctgttcccgacgcccgccgcgctggcgcaagccaacctcgacggcatcggcatgcccggcaagcgggtacagacgctgcaacgcttcgccgcggcgatcgcctcgggagagctgagcctggacctggcggacggccccgaggccctggtggagcgcctctgcgcgttgcccggcatcggcccctggaccgccgaatacatagccctgcgtgccatgggcgaagccgacgccttccccgccgccgacctcggcctgctgaaatccacggtctgggggccgcaaggcatcgatgcgcgcagcctgaaggcccgcgccgaggcctggcggccttggcgcgcctacgccgcgatccacctgtggcaccactacgccgcaggcggctaacgccgcggcgggaggctacagcctga

SEQ ID NO: 13968 - DNA, 276 bp, Pseudomonas aeruginosa
gggtggaacccatggcgcgatgctcccgagcaagagtgttccctcaggatagccggcgcgttcactccacgaggatgtcggcgaagctggccaccgtcggatggccgtccaggctgccgccttcgcgggccaggccgagcgtgcgcatgcccgcgtcgcgcgcggcgtccagctcctgcaccacgtcggaaaggaaaaggatttccgcggccggcaggccgatggccccggcgatccgcgcataggaggcgctttcccgcttcggcccgctggtag

SEQ ID NO: 13969 - DNA, 414 bp, Pseudomonas aeruginosa
tgtcgaagtagccggaaaacagcgggcccaggtcgccggcctcggaacagccgaagatcagcttctgcgcctggatcgagccggaggaatagacgtacaggtccagcccacgggccttccactcgcgcagcgcctgcaccgcgtccgggtagacgtggcccttcaattgaccgtcgcggtagccctgggcccagaccatgccttgcagggccttcagcggcgtcgccttgcggtcctcggcgatccattgcaggaggatcgcgatcgcccgctcgacatcggcgtccgcctcaccgctctcggcacgcaccgccgccaactgtgcggctacctcggtctctccggcgtgttcgcggacgaagtccggcaggtgccgggcggcatagggaaacagcacgtcgaaaacgaagctga

SEQ ID NO: 13970 - DNA, 684 bp, Pseudomonas aeruginosa
tggtcatgcggactccggatgaaaccgcccccggcaggaccgggggcgcggatggtgacggatgggacggtgcctcgctcagtcttccagcagggggaagcggctggcgatgtcgtcgccggtgaactgggcgacccagccctccgggttgttgaacaggcgcacggcgacgaaatgcgggtgctcgcccatgtcgaaccagtggcgggtgccggccggcaccgagataaggtcgttgcgctcgcagagcacggcgtagacatgctcctcgatatgcaggacgaacaggccgcgcccggcgacgaagaagcgcacctcgtcttcgccatggcggtgctcgtcgaggaacttggcgcgcaattcggccttctgcgggtggtcgctgttcaagctgaccacgtccacggtgatgtagccgcgctcgcgcttgagccgctcgatctcgtgggcgtaggcggcgatcacctcgtcctggctggcgccggcggcgatcggcgcggcggcttcccagcgttcgaaacggacgccgacctcggccagggtcgaagcgatgtcctcggcatgggtcagcagcttcagcggctgctccggctggttctcgtgatagacggtaaggctgctcatcggctcagactcagtactttcagttcacactcgaacagaaactcgaaagcttccacctga

SEQ ID NO: 13971 - DNA, 531 bp, Pseudomonas aeruginosa
ggacgacagggaaagacatcggagtatacccgtcaaggacgggcctgcgaaccttccccggaggacgcgatcaaagcgctatcatcggcccatgaagacctccatgccgcgcgccctcctcgccctgttctgcctgctcgccagcctggcccacgccgctcccaacagcatcctgcaccgcccctacgacctggacaccgggcacggcgtgctgcgcggctccttgctgctgccgcgcagcgccgtgccgccgccggtggtcctgctggtcgccggctccggtcccaccgaccgcgacggcaacaaccccttcggcggcaacaaccgctacctgctgcgtctcgccgaggccctggccgaacgcggaatcgccagcgtgcgctacgacaagcggggagtcgcccgcagcctggcggcggcgccacgcgaggaagacctcagcgtcggcgcctatgtcgacgacgtggtcgcctggagcgagcggctggcccgcgacccgcgcttctcccggctgatcctggtcggccatag

SEQ ID NO: 13972 - DNA, 276 bp, Pseudomonas aeruginosa
catccaggtcggcgtcgccgacgccgaggcgctccagcgagccaagcccgactcgcaactggtgctcatcgacggcatgaaccacatcctgcggatcgccccgagcaccggtctccagcagctttccgcctacaacgacccgaacctgccgctggcccggcaactggtcgaggcggtcagccgcttcatcctgcgcggcgcagaggcggaaaaaggccgctgagccgctacagaaatcgcttcccgcgccgacaagttctgaaagccggcccgtga

SEQ ID NO: 13973 - DNA, 804 bp, Pseudomonas aeruginosa
aggcggccggccagaggatgtccgatgatcgatagcgatacccaaccggccgcagaagaagccgagaagaaaccgccgcacccctgggccgaactggccccggagcatttccgcctgctccgcctggcgccactgcccaccgaccgcgcgaccggcgcccgccccctgcgcttcgtccagctcggcagggtcgaacggcacagcgcggaccagagcctgctgcgcctgagcatccaggtgccaggcctgatgctgcgcaaggagcagaacctgctggaggtctgggccgatcatcgcaacaaggaagtgcgtttcggttcggacgccgggctcagcctggaacccttgaaccgcgggctgggccgtttcctgctggcccaggcgatcgcctgggcgcaacgacgctgggcccactacaaggtggaaggcggcgcactggcgctgaaggatggcctgaccgaagacgcacgcctgcgccgcgaccatttcatccgcgcccagggcttcgacgtcagctatgaggaccagcggttgctcaaggcccgctacagcgccggccgggtcagtgagctgcacagcgattggcacaaggacaaggtgcagatcgtgccgctgctggacgccgcggcgatgctggaacaggccgagcagaccctgcaggcccaggatgcggagatccgccaactggaacagcgcatcaaccactaccgccgcgacgacaccagcctgcgcttcaccatcgcctgcctgaccgccttcgcggtgttccaggccggcctgctgatctggatcgccactcactga

SEQ ID NO: 13974 - DNA, 1032 bp, Pseudomonas aeruginosa
accggcggcaccagccgcctccgatcacttttccaagcgcgaacggaacagttcccggtgctcgcggcactgcgcggcggacagcatgaacaccccgtggccgccgtgctcgaactccagccaggtgaagtccacttccggatacagcgcctgcacatggacctcgctgttgcccacctcgacgatcagcaggcctttctcgctgaggtggtcggccgcctcggcgagcatccgtcgcaccaggtccaggccgtcgtcgccgcaggccaggccgagttcaggctcatgatggaactccgccggcatgtcggcgaaatcctcggcatccacgtagggcggattggacacgatcaggtcgaagcgctggccgggaagcccggcgaaaccgtcgccctggacggtgtagacccgctcgccgaggtcgtggcgctcgatattgacgttggccacctccagcgcatcgaaggacaggtcggcgagcaccacctccgcctgctcgaacgcataggcgcaggcgatgccgatgcagccggaaccggtgcagaggtcgaggattcgcgccggctcggccggcagccagggcgcgaagcgctgttcgataagttcggcgataggcgagcgcggcaccagcacgcgttcgtcgacgctgaatggaatcccgcagaaccaggcttcgcccagcaggtaggccgccggaatccgttcctcgatgcgccgccggaggatctccgccaactcggcgcgttcatcgtcttccaggcggcaatccaggtagctgtcagaaatttcccagggaaggtgcagggagcccagaaccaggtggcgcgcctcgtcccaggcattgtcggtgccgtgaccgaagaacaggccggcggcgtggaaacggctgacagcccagcggatgtagtcgcgcagggtgagcagacgggactcggacatgacggaattgctcctcgcaacgcacaaaagggcgacattctagccgatcgcgccggagctggcctccagcgcgggaagtccataccactttag

SEQ ID NO: 13975 - DNA, 678 bp, Pseudomonas aeruginosa
gagactggaagtcgccaaacacccaatccactcaggacgcccaaccggatgaacacccataagcatgcccgacttacctttgcccgccgactcgagatggtcaagcagatgacgctggaaggcttggatgccgtgcgagccgcagccgcgcacggcgtcactgcgccaacggccaggaagtggctcggtcgttacctggccggtggccaagccgccttggccgatgcctcttccaggccgctgcgatcgcccagcgccatcgatgccgggcaaggctttggctcatcgtccaacttgcgcaaacgtctaatgctgcaggctcgcatcgcacgcagtgtgggcgtctcggaatccacggtcagccgcgttctggcgccagcggggcttgtccaggttgagcgacctggagcccgccgaagccgttgtgcgctacgaaccaccaggcgccccgggggacctgctggcacatcgaatcccaagaaacctcggggggcatcttgcgggccccagccaccggggttcacaaggcgaaccggtctcgaatccggtccaatggttccgcggcggggaaaaccctgttccttgggccctccaatgaatccccccaaggtgttgggtttcacccccattgcctctccaacaaaaagaaacgggccaggcggtgccctgtttcctgcc

SEQ ID NO: 13976 - DNA, 240 bp, Pseudomonas aeruginosa
acagcaaaccctcttttctttgtcacgagaaagatcatgcaactcgcatcccgcttcgctacccgttccccggtgctgcgttcggaacgtctcttgtccgacgaccaaatccgggccgtggtcccgtccatcttcgtggacgccccgcatgatagccgctccgatcggttcttcttcatcccctccgcttaccgtgctgctagatctgcggggggaatgtctctatcctttcatggctga

SEQ ID NO: 13977 - DNA, 480 bp, Pseudomonas aeruginosa
attcggagcccagcctttcggctgaaaggagcggtcggcacgaggaacccggaaggccctgtagccaccgtctttcatgagatcatcgcccgcgacggtcaggagcgcgcgaacgggagccgtcaaggaggcaagcgcagggaaggagcggcccgcaggcgcagccgaggacacggcccagcgcgccttgacggcacacgggcgcgggcaacagtcgcggagaaggagaagaagtcaggggagacggcaggacaaggcaacggcccctcaacacgccgaccgcacggcaagcgaagcgcgcaggcccggatcaaggaatccgggccggaggcgtcagccgagcggagcgagggaacgaaggaagcccatcaggggcgagacgccgcaggcggctcgaagcgcaacgcgcacgacagcgcgaccggccacgtctattggccgggcgacgcacagcccttaaggattgactcacaccgacaa

SEQ ID NO: 13978 - DNA, 750 bp, Pseudomonas aeruginosa
tcgacatggccgacctcagcctgggcatcggcctggcctgtttcgtggcgctgctgttcacccaggtctggctggaggtcaccatgtcgccgcaccaggtatgggaagcgctgggcggcgaggacgacgatgcgcgcgcttgatgccggaatcctggtgtgcggcgagtgccaccagttgaatcgcgccgacggggacgagcatccgcgttgcagccgctgcggtgcggtgctgcacgcccggcgcccaaacagcctcacgcgcacctgggcgttgctgatcaccgcggcgattctctacatacccgccaacctgttgccgataatgacggtcaacctcttcggcagcggaatgcctgccaccatcatggagggcgtggtcgaactggtgcatgccgacatgttccccatcgccatggtggtgttcgtcgccagtatcctggttcctactttcaagctggtgggcatcgccctgctgctctattcggtacagcggcaccagccgatgtcggcccgccagcgtatcctgatgtatcgcttcatcgaatggatcgggcgctggtcgatgctcgatatcttcgtcatcgccatcctcgtggcgctggtgaatttcggcaacctggcgagcatcgaggccaacctcggcgccgccgccttcgccagcgtggtggtgctcaccatgctcgccgccgtgacgttcgacccccggctgatctgggacaacaccaatctggatgacgagaatgagtga

SEQ ID NO: 13979 - DNA, 570 bp, Pseudomonas aeruginosa
tctgccaagtccgaagaaacacaagacctcgaactggtcggcgatctgggtgctgccgctggtggccctggccatcggtgcctggctggcgtggcgtgccttcgaccaggctggcgtggacatccaggttcgcttcgagagcggcgacgggatccaggccaacaagaccgaggtgctgtacaagggcatctcggtgggcaaggtgaccgacctgcatgtcagcaaggacatcaagggcgtggtcgcgaccatcgagatcaagaaggaagcccaggagtacctgagcaaggacacccgcttctggctggtcaagccgcgggtttccctggctggcgtcaccggcctggaaaccctggtctccggcgtctacatcgcggtcgatccggtgaagggcgagaaggaagaacgctacttcaccgcgttgaaggagccgccacccctttccgacaagctgcccggcctgcacctgaccctcaaggccgatcgcctgggctccctggagcagggcagcccggtgttctaccggcagatccaggtcggccaggtgaagagcttccagttaggcgatga

SEQ ID NO: 13980 - DNA, 828 bp, Pseudomonas aeruginosa
caccaaggtggcggtcagttccttcatggtgtcgaggaacaccagcacgaagccggcgccgatggccggcgagatgatcggcagggtgatccgcaggaaggccatcaagggcgtctggccgagagtgcgggcggcttcctccaactgcggcgaggccttttccagggccacgcggatcggtgcctgggtcagcggcatgaacagcagggcataggcgaccagcagcaagccggtggtctggtaggtggctggcaggtagtgcagcgagaagtacaccagcgagagtgcgatcaccagtcccggcaacgcttgcagcaggtacggcaggcgctgggtccagcgcgccagggcgccggggtagcgcaccaccaggatgcttacgggcagcgccagcaggcaactgagcagggccccgccgaaggccagcgacagggaggaaagcagggtcgaggcgatttccatcagcgggaagctggccgaggagccttcgtacagccaataaccgagcatcaccagggggataccggtaccgaccagcaccagcgtcgccagcagcgcctggagcggccacttgccgaaccccaggcggactcgttcggcccgccgcgcgctgccctggccggtgcgtaccaggcggccgcggccgcgcatgcgcaactccagccagagcagcaggaagcacagtgccaggagtaccgaggagagcatcgccgcggtggcgttgctgaactccagttcgaactcctggtagatggctgtggtgaaggtctggtagcgcaggatcgacagcgcgccgaactccaccagcatgtgcagcgccaccagtag

SEQ ID NO: 13981 - DNA, 861 bp, Pseudomonas aeruginosa
tccggtggcggccagggtcgggcgcagcagcggcagggtgacccgcaggaacacctggcgccgcgacagaccgagcatccgcgccgactcctccagggaaggatcgatgccgcgcagggtcgctgctaccggcaggtagaccagcggatacttggacatggtcatgaccaggatggcgccgccgaggccttcgtacatcgggctcagcgaaacccaggtgaaactgctgacgaaggcggggatggcgaacggcaggcacagcaccacgttccagaagcgccgtgccggcaggtcgctgcgctcgacgcaccaggccagggccaggccgagcagggcgctgagcagggtcacgccgaacatcagccacagggtgttgcccagcaagcggaatacgtaggggcgccagagcagttgccaggcgatgtgccagccggcgtcccaggccttggccgcgacgtagagcagcggcaggctggccagcagggcgaggagcaggaccggcaggaacagccagaatggcgttcgccggcgcgagcccgtgcgcaggcgcacgggcgtggaggcggcgccgatcaattcaggccaacgtcgcgttcgaggctgagggcctcgctggcctcacccaggtcggccggggtcagtttcggtgggtccagttcggcgaacggcttcagcgccggatcggcctgcatccccttgcgcatcgggtactcggcggactggctgaggatcgccttctggccttcctcgctgagcatgaaggcgacgaactgctgggcttccctggggtgcttgctggacttgagcactgcggcgccggagacggtgaccagcgcgcccgggtcctggttgccgaagtag

SEQ ID NO: 13982 - DNA, 693 bp, Pseudomonas aeruginosa
tcgttgagcagcggcagcaggttgtccagcgagtcgtccaccggctccatgaacggcgtgccgaagggcaggtcggccggcagtagctggcggcggcgcagggcatcttccagggtgcgctccttggcctccaggtcgcccagttgccgggccaccagttgcaggcgcgcggagagttgctggacgcgctcggcgaaggcgtcgctggagcgcttgagttcgtcctgggacgcctccagctgggccagttcggcgagcttctcgggctcctcggcggtcagcgtctgggtgcggcggaagtcttccagggccttctgcgcatccagcacgtcctggtacagcttctccgcctgggccttgctcgcggcgcggtcggcagcgacgctctgctgggtcttgagctgcttcagctccttctccaggcgttccttctggtcgcgcagggcggcgcggtcggccagggcctgcaacgccggcggttcgatgtgcgacaggtcgatgctcagtccgggagcctcgaaatgctcgcctttgaagtggtcgaggatggcttcgacgctcttcacccagacgtcgccgtcatctaggttcaccccgttctcgccgagcggcaggctgaacagcgcgccgttgaacagacgcatcaggcgttccacgtcctgctggctgaactcctcgcgcaggcgtgcgtag

SEQ ID NO: 13983 - DNA, 1035 bp, Pseudomonas aeruginosa
acaagggctgctgagatgagtcgcgcctgcctgctcgcggccctgctggccgcccccttcgcccatgccgagatgacagcgctcgacgacgagcaactgtcggacgtgcagggtgccggcatcggcttcgtcctcgacagcgccatggtcgacggcaacaaggccaccatcgcgatcaatggcgtgaccaacaccgccaccgggcagaacgtgccgatcacggtaaaggagctgtacgtcgccgccactggcagcaacaagggcagcaccctggcgccggtgactctcggccgtctcaatttcccgttcaagctgaatctggccaagggttcggtgctgaccacccagctcgacgacgggcgggtggtcagcaccttgccggacaccgcggacgtgatcgagctggctttccccagcctggtgagcggcgccggcggccagccgtgcatcgctggttacgccggtgccggcagcaactgctcgagccgggccagcgaaaaggtcgacgccggcatccgcttcgacttcggcgtcacttccacgcgcaccgatgtgctcaacctggacttctccgaactggcgatggacggttcctacctgcgcttctggggcgccaacgcgcgcagccaactggttggcgagatgcgcctgaacctctacgccaagactttcgagatcatgtcctgcggtgctggctcgcccagttgcgtcagcgccgccgagcaggccgcgcgcaccgtctacctgaccaacgcctatgccagcgtcgcgcttggctacgggaagtcgcagccgttgctgttctcggtcaccgccgacggcaacttcactttcgaactgcccaagctgaccctggccaacgccgctgacttctacgccaatgcgccgcgcaccagcctggtgatcgagaacctcaacatcggcggtacccggccaggctacgggcaggtaccgaccggcggctacaacatgggccgcaacgagatatccgggctcagcttcaactacctgaaggtgacgtcgcacaacctctga

SEQ ID NO: 13984 - DNA, 567 bp, Pseudomonas aeruginosa
ggtggcggcgggaaacgaggtacgcagcacatggccaagcagactcatccactggcaggcggcatcggcatcctcgcggcgctggcgctgctgttcagcgcttcggccggggccgagttgcgctcgctgggcgatagcgatctggacgacgtggtcggccaggccgggatcagcatcagcgcctcgctcaatctccaggaaaatccttcgcagacgcgctgcgccggcggctgcggcgcgcgcctggcgatccagccggccggcagcggcaacaactacctggtgatcgacgatatcagcggcaagttcagcttcgacgaagtcaccctggacgtggtgaccatcaaggacggcttcggcggcgacggcgccgccttcaaccgcccggtgctgcgcgtcggcctgaaggacaccagcttccaggacctgagcttcaccatcgctggcgccaacaaggcgcgcggtaccgatcccgggctggtgcagaccaacctggtcagcgcacgcatcgacggcaccctcaagctgcagggcaacgtcaatatcttcaccgtcgccccgcgttga

SEQ ID NO: 13985 - DNA, 750 bp, Pseudomonas aeruginosa
gggcgaaccgtcgcatggcgggacaaagccgctccgccgaggtcgaagaaccgctatcattgcctgcctgaacgccgggggcgaaaccgtccccgcgcatcgcctaattgccggtgcccgagatttgatcgaagaacagcgtcgccgcgccttcctgggcgcgatgcagataaccagttggctgccccgccagccgttgccgttcgccgcaccctcgcggccggagttgctggagaccccgccccgggaagagccggcggtgcctgtgcgtgcgcgcgccgcgatcgatgcgccgcaggcccgcgtcccgcaagccgaggcgccggccagcgcgccgagcgtggctcccgccgcgcccgtggaaggccgggggatcccgatcagcctgccgaagccgggcgccccggcggcgaagaaagccgagccggtcgcgccggtcgaagaggccccggccgagtcgccggcggtccaggccccgccgccgcgcttcgccttgcaactgctgcaggcgggctcctgcaccctgctggtcgaactgcccaccggcgaacccttcgccagccgcgatccgggttacctgctgctgcgcgacctgctgcgcgccgccggcctgccggacagcccgcggctgatcggcgaaccggtacgctggccgctgctggcgcgcggcaacctcgaccaggggccgcaggcggccctggagttcgtccagagcttcgtcgccgcgcgcatggaggagagcgagcgtag

SEQ ID NO: 13986 - DNA, 660 bp, Pseudomonas aeruginosa
ccgctgcctgtggttggtcggcctgccggcgatccgcttcgccggcgagggcgacgagggcagcctgttccgcgagctgcaggtggacggtctgggcgcaacctgggccgtgccaggcctggaagccctcatggaagaacccgccctcaagggcgagctgtggcgcgccatgcgccgtgtccgtcagcgctggtcgagcgagattcaatgagcgatgcgatttccttccgcccgatgaccgaggcggacctcgatgccgtgctgaaaatcgaatatgccgccttcagccacccctggacccgtggcatcttcagcgaaggcctgaagaactaccattgctggctgatgttcgagggtagccagcaggtcggccatggcgtcatccagatcatcctcgacgaggcgcacctgctgaatatcacggtgaagcccgaaagccaggggcgtggcctcggtctgcgcctgctcgaacacctgatgcgcgaggcggccggccaccaggctcgcgaatgcttcctcgaagtgcgcgcttccaaccaggccgcctaccgcctctacgaacgctacggtttcaacgagatcggccgccgtcgcgactactaccccgccgtcggcgggcgcgaagacgccctgttcatggcctgtaccctgttcgactga

SEQ ID NO: 13987 - DNA, 1407 bp, Pseudomonas aeruginosa
ctatcacttggagtagctggctggccttctggcaccgccgtacccttaccagcattccgattctcgcctgcataccgcaggcaggtcccttcatgcggtaacccttcgcgggagtgcgaagtcaggtcgacagcggccggtggcaggatgcgcagactggagccccccatgtgcgacaccctgatccttcgccaccagggccagacctggttcgccaagaacagtgaccgcgagcccgccgaaccgcagcgtctgctgcgcctgccggcggtgcgcaacgatccggaagcgcgcttgcgcaccacctatctcgacattccccagaccgcccagcgacatgcgctggtgatcagccagccgagctggatctggggcgcggaaatgggcgtcaatgagcacggcgtggccatcggcaacgaagcggtgttcaccaagctgacccgtcagcgcggcaccgcgctgctcggcatggacctgctgcgcctgggactggagcgcggcgccagcgcccgcgaggcgctagaggtgatcaccgggttgttgcagcgttacggccagggcggcccggccggctaccgcgacaagcgcatccgctacgacaacagcttcctcatcgccgaccccggcgaagcctgggtgctggaaaccgccggcaacctgtgggcggcgaagaaggtcgagcgctgggccatctccaacgccctgacccttggccacgaattcgacctgtgcagccgcgacctcgaggaccaggctcgccgccagggctgctgggatggtcgcggcgacttccacttcgcgcgggtcttcgacacccgcctgctaccctgggtcggcggcgcgcaccggcgctgtcggatcaaccagcgcttcctcgacagcctgcctggtgagccggactggcacgcgctgttcgccgcgctgcgccaccatggcccgcgcggggaccacttccgccgccacaacaaccgccaggtatgcatgcacgccggcagcttctggcggccttcgcagaccaccgccagtctggtcgcccgcttgcgcgacgacggcccgttgctggccgccaccggtacttcggcgccgtgcctgggactgttccagccgctgtccttcgatccggcctccggcgccgccgtgctcagccagccgcgcgaggcggtacaggagtccccctggtggcgcttcgaggcggtgcaccgccgcgcgctcaccgaccgcgccttccgccggctcctgcgcagcggccgcgattggctggaacgggaactcttcgccgacctcgaacagcccgactggccgcgcctggcagaggatgccgcagcctggcacgcctgttggcatgatcaggtcgccatgcagccgctggcgcagcagcgctggtggcgtagccacgccgcgctgtga

SEQ ID NO: 13988 - DNA, 978 bp, Pseudomonas aeruginosa
agtcgaccattgtgtatctccaaaaataacaatgcgcccgaacgcttgcgaccagcgttcgggcgatttcaaaggccccgccggagcggggcgttttcgttcaggcgcgttcgtcgaggctgggcctcagcggaacatcgcgctgatcgattcttcgttgctgatccggcgcatggcttccgcaacgaccggagcgatgtccagctggcggatgcggccacaggcctgggcagcggcggacagcgggatggtgttggtcaccaccagctcgtccagtacggatttctcgatgttctcgatggcacggccggacagcaccgggtgggtgcagtaggcgatgaccttggcggcgccgtgctctttcagggccttggcggcgtgaccgagggtgccggcggtatcgaccatgtcgtctaccagtacgcaggtacggccttcgacgtcaccgatgatgtgcatcacttcggactggttggccttgggacgacgcttgtcgatgatcgcaaggtcaacgcccagggacttggccacggcgcgcgcgcgcaccacgccgccgatgtccggggagacgatcatcaggttctcgaagcgctggtcttcgatatcgtccaccagcacgggggaaccgtagatgttgtctaccgggatatcgaagaagccctggatctgatccgcgtgcaggtcgaccgtgaggacacggttgaccccgacgacggtcagcatgtcggccactaccttggcgctgatggccacgcgggcggaacgcggacggcgatcctggcgggcatagccgaagtaggggatgacagcggtgatacgagtggccgaggagcggcggaaggcatcggccatcaccaccagttccatcaggttgtcgttggtcggcgcgcaggtcggctgaatcaggaatacgtccttgccgcggacgttttcgttgatttcgacgctgatttcgccatcggagaatttgccaactga

SEQ ID NO: 13989 - DNA, 414 bp, Pseudomonas aeruginosa
aacatcgccaagaggaatgtgcagctgacgcacgacgcgtcgtgcaagatcggggttagcgttccccgtgaagaccatcatcttggacacgctacaggtacctgtgtcgaccgaagggatccggatgaaatacagaagaggaaaatggcaggggcggctggattcgaaccaacgcatggcaggatcaaaacctgctgccttaccgcttggcgacgcccctgtggtattgctcgaatgccgtttcggcattcctttctcagaccagagtttccagcttccggtgcaacatcgagatgttgcttcctttggcgacgaacctctgaaggtggtctggaagaagggccgagactttatcagcttcagctttgtttgggaagctcccaaacacacaacctccagtgccggttaatctag

SEQ ID NO: 13990 - DNA, 1521 bp, Pseudomonas aeruginosa
ccctggcgctgcagccagaacagggtgccgctgccggagtcgcgcggggcgcggatgccgaccttgccgtcgatctgccaggcatccagctcgctgagctgctgcttgtgggttttccaggtctgcgcatcgccctggccttccagggcttcgtgggaggtcaggccggcgcagccgctgagcagggccagcgcggaggcggcgaggaaaagacgtagacgcatggtttcaaggagtctcggcgccggtcaggcgcttgatggtgcggcgcagcacgtcgctgtcgggctgcttgtcgaggtattcgcgccagatggcccgggcgtcgccctggcgcccctgggcccagaggacttcgcccaggtgcgcggcgacctcgtggtcggggtagcgctgcagcgcctggcgcaggtagcgctcggcgtcggccagcttgccctggcgatagttgatccagcccatgctgtcgaggatcgccgggtcgtccgggttcagcttgtgcgccttgaggatcagctcgcgggcctcggtgtagcgggtagtgcggtcggccagggtgtagccgagggcgttgagggccatggcgttgtccggctcgcgggcgatgacgaagcgcaggtccttttccatctgcgccaggtcgttgcgcttctccgccagcatcgagcgggtgtagagcaggttgaggtcctccgggtactgcttcagaccctcctggatggcctgccaggccttttcctgctggtcgttgttggacagcgcctcggcttcgatcaggtacagctggatgccgtagtcgggttgctcgctgcgcgccttgtccaggcgctgggcggcttcgtcgacgcgaccggccttgagcaggacgtcggtctggcgcagttgcgccgggaggaagtcattgcccgggccgacctgggcgtactcgtcgagggcacgcgcggtgtccttctgttcctcggcgaggcggccgaggttgaagtgggcggcgtcgacgtggctgtcgcgctcgaccagttcttccaggtagatcctggcttcgtcccaggcctgggcttccaggcagaccagcgccagggagaaacgcaggtcgtcgtcgtcggggaattgctggaccagtccggcgaactcggccttggcgtcgtccaggcggttctgctccaccagcaggcgcgcgtaggcgaggcgcacgcgcttgtcgtccgggtgttccttgatcccggccttgagcagcggcagggcatcgtcgctgcgcttcatggttatgcaacaggcgcgagcggagcagcaggggggccacttcgtggcggcttgcggagttgtcctcgagcagggtcagggcttcgtccgggcggccgtcctgttgcagcagcagggccttgccgaacagcaactggccgttgttcgggtatttcttcaacaggtggtcgaagctctgcagcaggccggcgcgggtatccgggtcggtctccgcggcagacagggcgaggaagtcgaagtgcgtgtcgccctggccgttga

SEQ ID NO: 13991 - DNA, 1308 bp, Pseudomonas aeruginosa
gagaattgcgcgtttccccgattagctcagcgatcctgcatggccttcattgccctcggcatcaatcacaagaccgcctcggtggctgtccgcgagcgcgtggctttcactccggaacagatggtcgaggcgctgcagcagctctgccgcctgaccaccagccgcgaggcggccatcctgtcgacctgcaaccggagcgaactctacctggagatcgaccatccgaccgcggacgacgtgctcgcctggctggcggactaccatcgcctgactctcgacgagttgcgcgcctgtgcctatgtgcaccaggacgaagacgcggtgcgccacatgatgcgcgtggcctccggcctcgactcgatggtcctcggcgagccgcagatcctcggccagatgaagtcggcctacgccgtcgcgcgcgaggccggcaccgtcggtccgctgctcggccgcctgttccaggccaccttcagtacggcgaagaccgtccgcaccgataccgccatcggcgagaacccggtgtccgtggcgttcgccgcggtgagcctggccaagcagatcttcagcgacctgcaccgcagccaggcgctgctgatcggcgccggcgagaccatcaccctggtcgcgcgccacctgttcgagcaaggcgtgaagcgcatcgtggtggccaaccgcaccctggagcgcgccagcctgctcgccgagcagttcggcgcccatgcggtgctgctttcggagatacccgaggagttggccaacagcgatatcgtcatcagctccactgccagccagttgccgatcctcggcaagggcgccgtggagcgcgcgctgaagcagcgcaagcacaagccgatgttcatggtcgacatcgccgtgccgcgcgacatcgagccggaagtcggcgaactggacgacgtctacctctatagcgtcgacgacctccacgaagtagtggcggagaatctcaagagccgccagggcgctgcccaggccgccgaggaactggtcggcagcggcgtcgccgagttcatgcagcgcctgcgcgaactggccgcggtggacgtgctgcgcgcctatcggcagcaggccgagcgcctgcgcgatgaggagctgggcaaggcccagcggcaactggccaacggtgccgaccccgccgaggtgatggcccagctggcccgcggcctgaccaacaaactgctgcacgcgcccagcgtgcagatgaagaaaatgtccgccgagggccgcatcgacgcgctggccctggcccaggagctgttcgccctcgacgagggcgcgccgcgccactga

SEQ ID NO: 13992 - DNA, 510 bp, Pseudomonas aeruginosa
ttgcccgggtcgagggcgacaacgtctacgccaagctcaagttcgagtccggcgcgcaccgcgtgcagcgggtgccggaaaccgaatcccagggccggatccacacttccgcctgcaccgtcgcggtgctgccggagccggacgagcaggcagcgatcgagatcaacccggccgacctgcgggtggacacctaccgttcctccggtgccggcggccagcacgtcaacaagaccgactcggcggtgcgcatcacccacattcccagcggcatcgtggttgagtgccaggaagagcgctcgcagcacaagaaccgcgccaaggccatggcctggctggcggccaagctcaacgaccagcagcaggccgcggcgcagcaggcgatcgccagcacgcgcaagctgctggtgggctcgggcgaccgctcggagcgcatccgtacctacaacttcccgcaagggcgggtcaccgaccatcgcatcaacctcaccctgtactccctgggcgaggtga

SEQ ID NO: 13993 - DNA, 888 bp, Pseudomonas aeruginosa
tcgagccgctgctgcaggaataccaggccgatcaactggcggccctgggcgactgacatgaccactatctgtacccttctcaaggattcccaactgcccgattcgcccagcgcccggctcgacaccgagttgctgctggcggcggcgatgggcaagccgcgcagcttcctgcgtacctggccggagcgcatcgtgccgcgcgaggccaacgagcggttcgacgactggatcgcccgtcggcgcaacggcgagccggtggcctacatacttggccaccagggcttctggagcctggacctggaggtcgcgccacacaccctgatcccgcgcccggacaccgaactgctggtggaaaccgcgctggcgaccctcgcggcggataccgctacggtgctcgacctgggcaccggcaccggcgccatcgccctggccctggccagcgaacggccgctgtggacggtgactgcggtggaccgcgtggaagaggccgtggcgctggccgagcgcaatcgccagcggttgctcctggagaacgtcgaggtgcgccgcagccactggttctccgctctcgatggccgacgcttccggatgatcgtcggcaatccgccgtatatccctgccagcgatccgcacctgagcgagggcgacgtgcgtttcgagccgaagagcgcgctggtcgcgggtagcgatggcctcgacgatatccgccagatcgtcgcccaggcgccgcagcatttgctggacgaaggctggttgctgctcgagcacggctatgatcaaggggcggcggtgcgcgaactgctcggcgcccgcggcttcgccggggtacatacgttgcgcgacctcggcggcaacgagcggatcactctcggacaatgggcatgctga

SEQ ID NO: 13994 - DNA, 972 bp, Pseudomonas aeruginosa
tcggtccgctggtggggctggtcggtagcctgcaggcgctggaggcgctcaagctgctggccggtttcggcgaaccgctggtgggccgcctgctgctggtggacgccctcggcacgcgcttccgcgaattgcgggtgcgtcgcgatccttcctgtgccgtctgcgggcaacgccatggcggttgagtcggccgcggtcggcgttttcgattccggggtcggcgggctcagcgtattgcgtgagattcgcgcgcgcctgccatccgaatcgttgctctacgtcgccgacaacgcccatgtgccctacggcgagaagagcgcggagtacatccgcgaacgctgcgagcggatcggtgatttccttctggagcagggcgccaaggctctggtactggcctgcaataccgcgacggctgcggctgcggcggaattgcgcgaacgttatccgcaggtgccgctggtggccatggagcctgcggtgaagccggccgcggcggccacccgcaacggtcgggtcggcgtcctggccaccaccggaactctgaagagcgcgcgtttcgccgccttgctcgaccgcttcgccagcgacgtacaggtcttcacccagccctgcccggggctggtcgagcgcatcgaagccggcgatctctatgggccgcaaacccgggcactgctggaacgcctgctggcgcccatcctcgaacagggctgcgatacgctgatcctcggctgtactcattatcccttcgtcaaacccctgctggccgagctgatcccggcggagatggcggtgatcgatacgggagcggctgtcgcccggcagctggagcgcgtattgtcggcgcgggcgctactggcctctggccaggccgcgacgccgcgtttctggaccagcgcgctgccggaggagatggaaaggatcctgccgatcctctggggaagcccggaaagcgtaggaaaattagtcgtttag

SEQ ID NO: 13995 - DNA, 1638 bp, Pseudomonas aeruginosa
cgcgccctacgcgcgaccatcgcgcggcggcaggttgcggaaagccgccagcgcccgttcgcggctggccttcaggtcgaccatcggccgtggatagtcgaccccggcgaacagccccaggctggacggatcgtggatcgccttgcgctccaggccggccagttccggcagccagtggcggatgaactcgccgcgtggatcgaagcgttcggactgcgagagcggattgaacaggcggaagtaggggaccgcgtcggtgccggtggatgcgctccactgccagccgccgttgttcgccgccaggtcaccgtcgatgaggtggcgcatgaaccatcgttcgccttcgcgccagtcgatcagcaggttcttgctgaggaacatcgctaccaccatccgcaggcgattgtgcatccagccggtggcgagcaactggcgcattgccgcgtcgatgatcggtatgccggtgcgcccctgttgccaggcttcgagttccgccggggcctggcgccagcgcagggcttcggtctcctcgcggaaggggcggtgccgagagacccgggggtagccgaccaggatgtgcttgtagaactcgcgccagagcagctcgttgatccaggtcgcggcgccttgctggccgccgctgaactcgccgcggttggcaaccagcgcggcgtccaggcattgcctgggcgagagtacgccggcggccaggtagggcgacagttggctggtgccgggaagcgccgggaagtcgcgccgttcatggtagtcggccagatgctggtcggcgaagtcgcgcaggcgttcctgcgctacctcttcgcctgccggccagaggcggcgcaagctatcggccggccgcgggaaggcgggcacggcatccggcagcgggtcgctggccagcgcgtgcggtggctggggctgcggacgcgggcggacacccggcagggcctggtacagccgttcgtggcagaccttgcggaactggctgaacacctggaaatagccgccagttcgggtcagcaccgagccgggggcgaagaacagctggtcgaggtggctgtggaaggccacgccctgttcacgcaggcgttggccgacggcctggtcgcggcgttcctcgttcaccccgtattcctggttgacgtgtaccgcgccgactcccagctcccgacagagccggccgatgacttccggggcttgccgccagtggccgcagtcgcgcaccagcagcgggatgttcagcgcggcgagctggcgttgcagctcgcccaggttgcgcagccagaagtcgaccttgcagggcgcatcgtcgtgttcccgccactgcgccgggctgagcaggtagagagccacgcaagggcgcccatcggcggcggcgaggagcgcgctgttatcggtggttcgcaggtcgcagcgaaaccagatcaggttcatcggaagtccgttcatgggttcaacagacctcgttcgccgagcaggcggcgggcttccaggggcgtgctcgccagcagcaggccagttagcgccagggtttcgaaggcttcgcgctggatctccacggccggtccgaccagcaccaccgggcagctcacccctgccagcaggcgcggcaggtgctccggattgaggcgatga

SEQ ID NO: 13996 - DNA, 1134 bp, Pseudomonas aeruginosa
agaatagacggctggcgccgttcactaaggcaccagtgcgatgcaagccctgttccttggctgagtcgaaaacgacgccagggttccccggccggagccgacggatcttccattcacaggataacgccggaatggggggaggatgcacggtcatcgggcagatcgatgtccagggtccagactgaaagggcacgcaggctaaacgaggagacagccatgcacattctcttgaccggcggtaccggcctgatgggtcgccgcctgtgcgcccgctggcgacaggccggacaccggctgaccgtgttcagccggcggccgcagcaggtggaatcgctgtgcggcgtcggcgtgcgcggcatcgatcgtttcgacgagtacggcgaccagccgctcgacgcggtggtcaacctggccggcgagccgatcgcggacaaaccctggagccacaagcgcaaggcgctgctgtgggaaagccgggtacgccttaccgagcgcctggtggaatggctggacgctcgtgagcagcgcccggaccttctgttatcgggttctgcggtgggttggtatggcgacagcggcgagcgcccggtgaccgaggagggggcggcggccggcgaggatttcgctagcgagctatgcctagcctgggagcagatcgcccgcgaggcggagaagctcggcacccgtgtcgtgctgttgcgcaccggcctggtgctggcccccgagggcggcttcctcgggcgcctgttgccgctctaccggctcggcctgggcggaccgctgggtgacggccggcaatggatgccgtggattcatatcgaggatcaaatcgagctgatcgattttcttttgcggcggcccgatgccagcggtccctataatgcgtgcgctcccaacccggtgcgcaaccgcgatttcgccaaggccctgggccgggcgctgcacaagccggcgcggataccgacccccgggttcgtcctgcgcctcgggctgggagaaatgtccggattgctgctcggcggccagcgagccttgccgcaacgcttgcaggacgccggctaccgttttcaattcaccgacctggacgtggcgctggccgatgtcctggacgcccgacgaaaggatcaggcatga

SEQ ID NO: 13997 - DNA, 1059 bp, Pseudomonas aeruginosa
tggcaattcctcaccttccgggtcggcgtcggggtcggcgaggcggcgctgtcgccagcggcctattcgctgatcgccgacagcttcccgcgcgagcgtcgggcgacggcgatcagcgtctactcgatgggcatctacctgggctcggggctggccttcctgctcggcgggctggtgatcaagttcgcctcggcccagggcgacgtgcatctgccgctgttcggcgaggtgcgcccgtggcaactgatcttcctcatcctcggcgccgccggcgtgctcttctgcctgttgctgctggctatccgcgagccggcccggcgcggagtcggcgcaggcgtggcggtgccgctgggcgaggtcggcgcctacctgcgggccaaccgcaagaccgtgctctgccacaacttcggtttcgcctgcctgtccttcgccggctacggcagcggcgcctgggtgccgaccttcttcgtccgcacccacggctgggacgccggtcatgtcggggtggtctacggcagcatcgtcgcggtgttcggctgtctcggcatcgtcttcggcgggcgcctggccgactactgggcgaagcgcgggcgcagcgacgcgaacatgcgcgtcgggctgctcgccgcctgggcggtgattcccttcaccctggtctatccgctgctggacaacgccaattgggcggcggcgctgatggcgccgacggtgttcttcctgagcatgccgttcggcgtggccccggcggcgatccaggagatcatgcccaactcgatgcgcggccaggcctcggcgatctacctgttcgtggtcaccctgttcggtctcggcttgggcccgacggcggtggcgctggtcaccgatttcgtcttcgccgacgacatggcgctgcgctactcgctgctgctggtgaccctggccgcggtgcttggtgcggtggtcctgctggggatcggcctcaagccctatcgcgccagcctggagcacctgaaggactggagcctgcgacgggaaggcgagggcggcgaggattggaaggcgtcccggcagccggcctga

SEQ ID NO: 13998 - DNA, 2208 bp, Pseudomonas aeruginosa
ctggttgtcgctttgcaatccttcgaaatagacctggccgtcccagccgacgctggcgcgctggccgctgccggtttcttcggcctggctgcccagcggcagcggttcgccgcgctcgtccaccaggctgatgctggcggcgactacggcacggatcgggaaatccagcagcaggccgctgccctggcgtaccgccacgcgctgctcgacttcgggcgcgctgacgttggccggaaggtccagcggctcgatctggaacttcgccgggtagtaggccgcgacccagggcaccagcaggtggccgttgtcgtcggtgctgcccatcagttggttctcgtagcggatcggcacctgtggataacccttggtgctgaccaggacgaaggcgtcgttgatccggttgctggcgaacacggcgttgtccatccataccagcgagccgctgagatcggcccagcgcgtgtagttgccggtctcgccataaaggccgccctgcagttgcacgttctgcatgcgccaggtcaggtcggcctgctggtagcggctggcgccgccgccatagccgaggttccagccgaggccgccctggctcggcgtggagcggctccagatcacccgctcgctgtaccgtcggtcgctgtcgcgggtgacgccgatgttcagcaggccgttgatgtcgaagggaatcaccagttgcatcagcgcgctgtagccgtcgccgtcgagatccttgttcagcgccaggtagaagctgctgcggctgccgatcgggcggctgtaggagaggttggccaggcgcgtgcggctgccgtcgcgggcgcggatgtcgaagtagccggtaccgatggtgccctgctcgtcgaaggtcaggctggcggtagcctggtcggtgcgccggctcaactggtactcgccgtccagggtgccgaggtcgccatagccggcgctgcgctcgatgtgttgcaggctgaggccgagccgtcgcgaatagtaggagtagccgagcaggtattgctggccgctgtcgccctggccgtcgctgccgctggccgccaggctgagggtgccgaaggtggccacggcgatgtcgccgccgatgccgagcaggcgcaggtcgctggcggcctcggcgtgggtggagagggtcaggcggtcgctgacgccgtagcggtagatgccgctgacggcgttgtcggcataggagaagttgcgcaggccgtagtcgtcgcgcaggcgcccgacggacaggtcgaaatcgctcaggccgcgcgccagcagggtgttggatacgtagaacggcaggctggtcaccacttgtcgaccctgggcgtcggtggtcaccaccgtggcttcgccggctccgttgatgtacggcacgttgctgatggcgaagggaccgggttgcaggtcggcgctgctggccttgtagccgttgatgaacaggtcgacggtgctgggtacggcggcctggccgtcgaagcgcagcagcggataggtgaccaggtccggacgtacgccgaagttgcgggcgaagcgaaagccgcccatgcgtaccggggtggtccagttcagcgcgccgttgacgtagtcgcccagttggtagctgtgcatgttgcgttcgtcgttgtacagccagtaggtgtcgtagcgcaggtagcggctgtcgaggttgtcggcgtcgccgaaatagcgggtgtagacgccggtgttggagatcaccccgaagccgtcgaacaggcgttgctcgagcagcgcggaaagccagggcgtggcgccgtcggcggggtccgagtagtacaggtcgtagttgaacagcgcgccgaggctgctgcgcgccggggcgcgggcgaccagtccgggatcgtcgaagcgctgctccggcagccagtccggcggcacttgcaggtgcagttgctggctggcgctgtcatagtccgcccggacctcgggcagggcgtccaccgcgacctgtccggcggggttgccaggcaggcgcacgccggcttcgcgcagggccgcggcgtcgagcaggtaatggccatcggcggcgttgaccggcaccacctggccgctgtcgcggccgttgatcaccagttccaggtagtagaggacgttgctgccgccggacggagcgggttgcggcggcggcagtccggccaggtagtccgccgcatggacaggggagagcagcgccaggccgatcagtag

SEQ ID NO: 13999 - DNA, 1233 bp, Pseudomonas aeruginosa
gtccttgtgttgttcgtcgagcgccttgttctgccagccgtcgttgcccggcagcaacaggttgaggacgatggcgacgatggcgcacagggcgatgcccttcaggccgatgtcgtcggggccggtaccgctgccgatcagcacgccgccgatgccgaacaccagggtcaccgagacgatcaccaggttgcgcgcttccgagagatcgaccttgtgccggatcagggtgttcatgccgaccgaggcgatggtgccgaacagcaggcagaggatgccgcccatcaccggtaccgggatgctttgcaggatcgcgccgaacttgccgacgaaggccagggtgatggcgatcaccgccgcccaggtcatgatcttcgggttgtagttcttggtcagcatcactgcgccggtgacttccgcgtaggtggtgttgggcggtccgccgaacaggccggcagccgaggtggccaggccgtcgccgaggagagtgcggtgcaggccgggcttcttcaggtagtcctggccggtgacgccgcccaccgcgatgaccccgccgatatgctcgatggccggggccaggcccaccgggacgatgaacaggatcgcctgccagttgaattccggcgcggtgaatttcggcagttccagccagggtgcggcgacgatcgcggcggtgtcgaccacgccgaagacgaacgacagggcgaagccgaccagcacgccggcgatgattggcaccaggcggaagatacccttgccgaataccgccaccaccagggtggtgagcagcgccggcatcgagatcatcatcgcggtgcggtacggcagcaactcgctgccgtcgccggccttgcccatcgccatgttcgccgcaatcggcgccatcgccaggccgatcgagatgatcaccgggccgatcaccaccggcggcagcagtttatcgatgaagccggtgcccttgatcttcaccgccaggcccatgaaggtgtagacgaagccggcggcgaccaccccgcccatggtcgcggccaggccgaactggcccttggcgaggatgatcggggtgatgaaggcgaagctggaggcgaggaacaccggtacctggcgcccggtcaccaattggaacagcagggtcccgaggccggcggtgaacagcgcgacgttgggatccagaccggtgatcagcggcatcagcaccagcgcgccgaaggcgacgaacagcatctgcgcgcctga

SEQ ID NO: 14000 - DNA, 516 bp, Pseudomonas aeruginosa
agtgccggctcgccctgtccggaggtcccgatgttcgcccgtagcctgtgcggctccctgctcctgtttgtcagtctggccggcctggccgccgagaatcccccgatgcacgcgcgcttcctgccgcccgacgacggccagttgcgccaggaggcgccggagcagcagcaactgatccagatcaccgagtacagcgtggtgctgggcaaccagcggcagtccaaccagcagccgatcccgatcaccacgccgaccctgctgcgcctgaagggcaaaccgctgagcaagggcgcgaccctggcccaggtgctgatccagttcgacagcgaaggcaagagcctgaagaagccggtctacgatgccgggacccgcaccctcacgctcaactacccgttggcgcagtacccggcgttgctcgacctgctgcgcaaccagacggtctattgccagttcctcgcctatcccaacggccatgtctgggcggacctgcacaccggcgcggtacgcgcgcgttga

SEQ ID NO: 14001 - DNA, 1125 bp, Pseudomonas aeruginosa
cgcggctcactcggcgttgaccggggcctgcacgtcgttcttcgcggtcagttccagcacctcgctgcaacggctgctgacgctgcggtacagctcggcgtcgctttccagctctttctcgcgagccgggaagatttccttcagcttggcgctccactccggcgagcgggcctgctccgggaagcagcgctcgatcaggccgagcatgatcgagacggtcaccgaggcgcccggcgaggcgcccagcagggcggcgatggagccgtcgtgggcggccaccagctcggtgccgaactgcaggatgccgcctttcttcggatccttcttgatgatctgcacgcgctggccggcgacttccaggcgccagtcctcggccctggcttcggggtagaacttgcgcagggcttccaggcgctgttccggcgactgcatgacctggccgatcaggtagcgggtcaggtccatgttgtcgcgggccaccgagagcatcggcaggatgttgcccgggcgtaccgacagcggcaggtcgaggaacgagccatggcgcaggaacttggtggagaaaccggcataggggccgaacagcagggatttcttgccgtccaccacacgggtgtccaggtgcggcacggacatcggcggcgagccgacctcggcctggctgtagaccttggcctggtgctgcttgacgatttccgggttgtcgcagcgcagccactggccgctcaccgggaaaccaccgaagcccttgccttccgggatgccggaaagttgcaggagcggcagggcgccgccgccggcgccgaggaagacgaagcgtgcctggatctcgcggtcgccgccgttgcgggtgtccttgacggtgacccgccagccgttatcggcgcggcgcaggtgggtgaccttctggttgtagcggatctgcgcgcccggctgttccgccaggtgttgcaggagctggttggtcagggcgccgaagttgacgtcggtaccgccctcgacgcgggtcgcggcgatcgcttcgtcggccggacgacccggcatcatcagcggcatccactcggcgagggtggccttgtcctcggagtagaccatggtctcgaaagcgtggtgcttcgtcagtga

SEQ ID NO: 14002 - DNA, 408 bp, Pseudomonas aeruginosa
ttcgaagcgcttcttcaggtaggcgatgccttcgctgccgcgcacgaagctcagatgcggtaccgggttgatgaaggtcttcggcgagccgaaggtgcccttggcgaccaggtgcgaccagaactgcttcgacacctcgaacatggtgttgatgcccacggctttcttgatgtcgatgctgccgtcggccgactgcggggtgtagttcagctcgcacaggccggcgtggccggtgcccgcgttgttccacgggttggagctttcgatcgcgccggactcctggagttcgacgacttccatcttcaggttggggtcgagttccttgagcaggaccgccagggtcgcgctcatgatgccggcgcctaccagcagcatgtcgactgtttcgtgatcgttttgcgccattaa

SEQ ID NO: 14003 - DNA, 207 bp, Pseudomonas aeruginosa
acggaactcatagggggtgcagcgatgctcgaaagccaggcctatagctgcccttactgcggggaaccggccgaggcgctgctcgacctgagcgccggcgaccagcagtactacgaggactgcccggtgtgctgccggccgatcctgttcgacctgcgcaccgatgggcaggactggtcactgaacgtccgccgggaggatgactga

SEQ ID NO: 14004 - DNA, 2121 bp, Pseudomonas aeruginosa
aaccgacgggccggagtgcctgaccccggcctgacgctagaccctgaactgattcaccaggcgccgctgctgctcggccaggcgggtcagctcggcgctggcctgcgaggcctcgtcggcgccgccggccacctggttggcgacctggccgatgttggcgacgttgcggttgatgtcctcggccaccgcgctctgctcctcggcggcgctggcgatctggggattcatgtcgttgatcaccgataccgcctgggtgatcgattccagcgcctcggccgcctggcgcgcatggcgcacgctgtcgtcggtgcgctcctggctgtcctgcatgaccttcaccacgtcgcgggtgccctgctgcaactgctggatcatgctctggatttcttcggtggcctgctgggtcttctgcgccaggttgcgtacctcgtcggccaccaccgcgaaaccgcgaccctgctcgccggcgcgggcggcctcgatggcggcgttgagggcgagcaggttggtctgctcggcgataccgcggatcgccaccaggatcgcgttgatgttttcgctgtccttggccaggttctgcaccactccgaccgcgcggccgatctcgctggccagggcctggatcgccgccgagctgctttcgacgatctgcttgccctggtgcgcggcctggtccgcgtggttggctgcctcggcggcgtgggtggcgttgcgcgccacgtcctgggcggtggcggtcatctcgtggaccgcggtggccaccagttcgatctccgccagttgctgctgcacgccctggttggtgcggatggcgatgtcggcggtgtgctccgaggagtcgctgaccttctgcaccgattgcaccacctggccgatcatgttctgcagtttgccaaggaaggtattgaagcccttggcgatggagcccagctcgtcggcgcgctcgctgctcaggcggcgggtgaggtcgccttcgccctgggcgatgtcgtcgagcatgccgaccaattggcgcagcggccgggcgatgccgtagccgaccagccagaccaccagcaggccgagggccgctaccaccaggccggccaggctcatgccgaggatatcctgctggcgctggtcgctcagctcgccctggagttgctgcagttcgccgaataccgccgcctggggaatctgcagcatgagggtccagcgcacgccgctgtcggcgatggtgaaaggcaggaacagctcgatgtggccgtgctcggcgtcgatgtcgtagagcggctggtcgaccgtgaggtttttcaggttgtccacttcgttgccgtcgaggacgctgccggcgggctcgccgagcttgctgtcgtcgcgggtgtaggccaccaggcggccgttgctggcgatcagcgccatttccccggcgccatcgtagagctgctggtcggcgcgcttgagcaggtcctggatgaaggccagcgagaggtcggcaccgactgcgccgcggaactggtcaccgaccatgatcggcacgttgaaggacgacatcatcacggtcttgccgcccatttcgtaaggggccgggtcgatgatgcagggacgcttgttctctttcggacaggcatagaactcgttctcgcgcaccccggtgggcagcagcttttcgctatcgatgctgtcggccatggcctccacgatcggcttgccgtcggcgccgcgataccaccagggcaggtagcggccgtccgggccgtagcccttgccgggttgcccggcgaaggcggcatcggtatcgaaggcattgggttcccaggccatgaaggtgtcgagcagcttggggttgttctgcacggtgctgcgcagcagcgcggagatttcgtcgcggctggcgttcagctgcggcatgccgtcggcgcccggctcgccgagcaggcgggtgctgttggccaggccgtggaccaccgtcagcggatactccagctcgcgctggatctggctgacctgggcgcgggccagggccaccaggcgctcgttgatgaccttctccaacaggccctgggtgcgttgctgcaccagctcctgcgttcgcgcgccggcgaacagggcgtacagcaccagcaccacgacgacgcttag

SEQ ID NO: 14005 - DNA, 948 bp, Pseudomonas aeruginosa
ggagcttatcggcaggaggacggcaaatccttaatcggccgtcggagatttcctcgccaacggctgttgccggcgttcgaggcgcggcctaccatgcgctcggccttcagaggagaacaaaggaccatggctcatcccttccgattcgccaccctcgccggcgcgctgctgctcgccggttgccaggcagtgaacaccaccagtggcggcgccgtcggcgtcgaccgcaagcaatacatgttcagcatgttgtccagccaggaagtcgaccagatgtacgcccagtcgtaccagaagactctcggcgaggcgaaaagcgccggcgtgctcgataccagcagcgccgacgcgcggcgagtcaaggcgatcgcccagcggctgatcccgcagaccgccgccttccgcccggacgccaccggctggaactgggaagtcaatgtggtgaagagcgacgagctcaacgccaactgcggtcccggcggcaagatcattttctacaccgggctgatcgacaagctgaagctcaccgacgacgagatagccgcggtgatgggccacgagatcgcccacgccctgcgcgagcatgggcgcgaggccatgtccaaggcctacggcgtgcaggtggccagccagatcggcgccctggccggcctcggccaggaaagcctgcaactggccaataccggcgtcgactacctgatgaccctgcccaacagtcgtgccaacgagaacgaagccgacctgatcggtctcgagctggccgcccgcgccggctacaacccggaagcggcgatcaccctctggcagaagatgggcagggccagcggcggcgccagccagcccgagttcaccagcacccacccctccgacagttcgcggatggccaatctccaggccgcgattcccaaggtgatgccgctgtaccagcaggccaggcgcggcaagtga

SEQ ID NO: 14006 - DNA, 1278 bp, Pseudomonas aeruginosa
agcatccgggtcgaggcgtacatgccggagttgccggcggagaggatcgccgagaggatcaccgcgttcatcacccccggccgccggggggaagccggcgcgctagaagagcagggagaagggcgatacgctgatgtcgctggcatcgttcttcagcaggttcgggtcggtgtagggaatcagcatgccgatcacgaagatcgccaggatgtagaacatcaggatgcgccagaacacctggcgaatggcgatcgggatgttcttccgcggattttccgattcaccggcggcgatgccgatcagttcggtgccctggaacgagaagccggcgatcatcgccaccccgaccatcgcctggaagccgccgacgaagggcgcgtcgcccatggtgaagttgctgaagccgggcgactccacgccatgcatgatgccgaagatggtcgccaggccgacgccgatgaagatcaccaccgtgactaccttgatcagggcgaaccagaattcgctctcgccgaagccgcgcgcggaaatcacgttgaggccgaacatgatgcccaggaagatcgcgctccagtagatgcccggcacctcggggaaccagaaactcatcaccagttgcgctgccaccagctccgcggcgatggtcaccgcccagttgtaccagtagttccagccgagggcgaaaccgaagccatcttcgacgaaccggctgccataggtgcagaacgagccggaaacgggcatgtaggccgccatctcgccgagactggtcatgaggaagtacaccatcagcccgatcagtgcgtaggaaagcagcgcaccgccgggcccggcggtggccacggtggccccggaggcgacgaacagcccggtgccgatggagccgccgatggcgatcatgttcaggtggcgcggcttgagcacccgccgcaattgctggccctggctggcgttcaggtcagtcatcggcggcctcccggcgggtggccacggaagggtctggctgcgggcgtgcgggcagggagaggaaaagcttcattcacagggttccaggcagaaatcaggagcgacgggcggagtagatgcggaaaccgtcgccttcggcgagtgtccggcaggggccgaggtggcgttcgatcaacggcgggtacttcaggaagctgttggcgaccaggcgcagttcgccgcccggcgccaggtgctcggcggcgcgttgcagcaggcgctcggaggcctggtagtcggtgtgcacgccctggtggaagggcgggttgctga

SEQ ID NO: 14007 - DNA, 1050 bp, Pseudomonas aeruginosa
acacccccggcaggctcaccacctgcagctcgccatcggtcagcggcaggctgtagcgctgggccagggcgtgtaggtcgggctcggccggcgcctgttcgatacgcacctgccagagctggcaatgccgcgcgctatccagtttgcggggcttgccgtaggcggccaactgcttgctcgcgcgctcgatcccgccgcgcttttcgccgaccaggaagagttcgccgccgggcaggcgggcggccaggctggccagcaggtagtcggtcagttcgcgggacttgggcaggaacagaacggccgaagtccaggcgccggtcggcgcgcgcgtgtcgaaacggctacggtcggggaagcgggcgtccaactgcgcctgctcgccggcgtgccagctccagccctgggcctgcggtagctcggcgagcaggtcgtcggcgggcaggccggccagcagcagcggggtcgcgaagaggtggcgctggcgcagcagcacttcactgcgagggtccatgcgggctccggaaaaaatgggaaatcttaacaggcttgggcctggcatacccgcatggattgtcggcgaggatcgccgttcatccgtgcgcggtgcccgcagcgccgtatcagccggcgttgactacccgcagggcgcgcccggccttccatgcctctgcgttttccgccagttggccgacgatgcgctgccgcgcctcgcgactgccccaggcgttatggggggtgacgatcaggcgcgggatgtcgggggccagcagcggattgccgtttctcggcggttcgacgctgagcacgtcggtagcggcgccgcccaggtggccgccgcgcagggcgtcggccagcgcctgttcgtcgaccaggccgccacgggcggtattgaccaggaaggcgccaggcttcatcagcgccagttcggcggcgccgagcatcccgcgggtgtcctcggtcagcgggcagtgcagggtcagggcgtctacccgtggcaggagttcgccaagcggcaggcggtccgcccgggcaggccgtcctggcaactga

SEQ ID NO: 14008 - DNA, 3897 bp, Pseudomonas aeruginosa
accgggtcaccgccaggccaggaaagtgtgatcgccgggcgcatctccgcgcccggccaggtgatcatctacaactccaacggcgtggtattcagcggctcggccaaggtcgacgtgggctccctgatcaccaccacggcgaacatcagcgacgaacacttccgccagggcaagctgatcttcgaccagcccggaaaccccgacgcgcggatcgtcaacgacggcagcatcagcgtcgcggagaaaggcctggcggccttcgtcgcgccgtccgtggccaacaacggcgtgatcaacgcccgtctcggcaccgtggcgatggccgccggcaacgccgcgaccatcgacctctacggcgatggcctggtgtccatcgccgtgaccgacccggttacccgcaagccgcaggatgcccaggcgctggtcagcaacggcggcgcgatccaggccgacggcggtagcgtgctgatcaccgccgagcaggcttcccgggtggtcgacaacgcggtcaacctgtccggcgtgatcctcgcccgcggtaccgaggtgcgcgagggcagcgtggcgctggtaagcaagtccggggacatccaggtcgccggcaagatcgacgtcagcggtccgaagagcggcggcgacgtgctggtcagcgggcagcaggtggccctggcgagcaccgccagcatcgacgcccgcggcgccgcacagggcggcagcgtgcgcatcggcggcgacttccagggccgcggcgagctgccacgagcgaagaacgctacgctggccaagggcgccagcatcgacgtctcggctaccggcaagggcaatggcggcctggcggtggtctggtccgacggcaatacccgcatggacgggcggatcctcgcgcgcggcggcgcccagggcggcaacggcggcctggtggagacctccggcaaggtcaacctgagcatcgccgacagcgcctacgtcagcgtcgccgcaccctacggcaacggtggcacctggctgctcgacccgaccaccctgcgcatcgtcgcatccggcggcacctcaggttcggtggggggcgctaacggcgccagcggcgacgcgacggtgaatgcctcggtggttaccggggcgctggcaggcggcaaggtgaccctcagcgccagcgaccggctgtcggtggaagcgccgctgatcaccagcaacctgggcggcgccagtcgcggcctggagctgatcgccaccggacctgccggtgcggtggatatctctgcgccgatcctgttccgcaacggcagcctggcaatccgcgccggcggcaacatcagcttcctcagcggcggcacgccgcagaccagcggcatcgtcgacctgggcagcggcaccctgtggatgcagaccagcaccgccggcaagatcagccagcaggccggtaccgcattgatcgccgccaacctcgccggccgcgccggtagcatcgacctggcttcctgggacaactacgccggcaacctggcgctgcagaccttcaacggtacgctcaagtaccggcagagcaacgccaccggcgtgaccacgagcggcacggtgttcgatccgttcatcaaccagagcatgaccggcaccgcgcagaacatcgtctccagcgtcggtacgcggattctcgaggccaacagcgtcggcaccaccggcaactacacgctgaccgccgacggcaacagcgagttcgaccgcctggtgttcaccgcgctgccctatcggcgggtcagcggttccgccagcttcccgaccaacgactcgtcggactacctggtgaccaacctgcgctaccaggtcaacggcagcaacgtcaccgccaccccgaacggcggtgcgcccagcgggttcaccgtcgccgccggcaacggcagcgtcaccacctggaccggaaactggggcaccagttggggcgtcaagggcttcggcggcgtgatcggcgtgaccgacgagctgcagtacgacgtcggcaccggcctgaccgaggaactgatcttcggcctcggcggcaagaccagccgcgtcgatacccgcctggacctgttcatgcgcgagggagcgttcaacagcttcgccgagcgcgcccaggtggagatgttcaagaccaccaccactgccggcgacatcctttcccgccagcagaccgccaccctgaccgccaatgacgctacccgcgtctacggtgatgtgaatccgactctgacggccacgatgtccggcatcaacgccatcgacgcctacgtcaacagccagttcaacgacctctaccaggcgaccgccagcaccacggcgacccaggcgtcgaacgtcgggcagtacgcgatcaccggtaacgccaatggcagcgagtatttcagccagcgttaccaactggtgcgccaggacggcaagctgaccgtcacgccggcgcaattgatcgtcagcgccgacgccaagaccaaggtctatggcgacgccgatccgacccttacctaccaggtcagtggcctgaagaacagcgataccgccgctggcgtgctgagcggcaacctcggccgggtggccggggagaacgtcggcaactacgggatactccagggcgggctgggcctcaacacggccaattacaccctcagctacgtcggcaacgacctgcgcatcaccccggcacaactgaacgtgatcgccgatgccaagaccaaggtctacggcgacctggatccggcgctgacctaccaggtctccggtctcaagcgcggcgataccgccggtgccgtgctcaacggtggcagcctgagccgcgtggctggcgagaacgtcggcgtgtacggcatcaaccagggtggactgggcctggtcagcagcaattacaccctgaactaccagggcaataacctgaccatcaccaaggcactgctcaatgtgatcgccgatgccaagaccaaggtctatggcgatgccgatccggcactgacctaccaggtgtccgggctgaagaacggcgataccgccggtgccgtgctcaacggcggtagcctgagccgcgtggctggcgagaatgtcggcgtgtacggcatcaaccagggtggactgggcctggtcagcgcgaactacgacctgagctaccagggcaataacctgaccatcaccaaggcgctgctcaatgtgatcgccgacgccaagaccaaggtctacggcgatgccgatccgagcctgacctaccaggtcagcggcctgaagaatggcgataccgctggcgcggtgctcaacggcggcagcctgagccgcgtggctggcgagaatgtcggcgtgtacggcatcaaccagggcgacctggcattgaacagcggcaactacgatctgagctaccagggcaacaacctgaccatcaccaaggcgctgctgaatgtgatcgccgacgccaagaccaaggtctatggcgatgccgacccgagcctgacctaccaggtcagcggcctgaagaatggcgataccgctggcgcggtgctcaatggcggcggcctggttcgtgtctccggcgaaaacgtaggcaactatgcgattcagcagggtggcctgggtctggtcagcggtaactatgacctggcttaccagggcaacaacctgaccatcaccaaggcactgctgaatgtgatcgccgatgccaagaccaaggtctacggcgatgccgacccgagcctgacctaccaggtcagcggcctgaagaacggcgacagcgccggttcgatcctgaccggcgggttgaaccgcgccgcaggcgagaacgtgggtgtgtatggcatcaaccagggcgacctggcattgaacagcggtaactaccaactgagctaccagggcaacaacctgaccatcaccaagcactgctcaatgtga

SEQ ID NO: 14009 - DNA, 2949 bp, Pseudomonas aeruginosa
cctaccaggtcaggcggcctgaagaacggtgataccgctggcgcggtgttcaacggtggcagcatgagccgcgtggctggcgagaatgtcggcgtgtacggcatcaaccagggcgacctggcattgaacagcggtaactacgacctgagctaccagggcaataacctgaccatcaccaaggcgctgctgaatgtgatcgccgacgccaagaccaaggtttacggcgatgccgacccgagcctgacctaccaggtcagcggcctgaagaatggcgataccgctggcgcggtgctcaatggcggcggcctggttcgtgtctccggcgaaaacgtaggcaactatgcgattcagcagggtggcctgggtctggtcagcggtaactatgacctggcttaccagggcaacaacctgaccatcaccaaggcgctgctcaatgtgatcgccgacggcaagaccaaggtctatggcgacgctgatccgagcctgacctaccaggtcagcggcctgaagaacggcgacagcgccggttcgatcctgaccggcgggctgaaccgcgccgcaggcgagaacgtgggtgtgtatggcatcaaccagggcgacctggcattgaacagcggcaactacgatctgagctaccagggcaacaacctgaccatcaccaaggcactgttgaatgtgatcgccgacggcaagaccaaggtctacggcgatgccgatccgagcctgacctaccaggtcagtggcctgaagaacggcgataccgctggcgcggtgctcaacagtggcagcctgagccgcgtggctggcgagaatgtcggcgtgtacggcatcaaccagggtggactgggcctggtcagcggtaactatgacctggcttaccagggcaacaacctgaccatcaccaaggcgctgctcaatgtgatcgccgacggcaagaccaaggtctatggcgacgctgacccgagcctgacctaccaggtcagcggcctgaggaacggtgacagcgccggctcgatcctgaccggcgggctgaaccgcgacgcaggcgagaacgtgggtgtgtatggcatcaaccagggcgacctggcattgaacagcggtaactacgacctgagctaccagggcaataacctgaccatcaccaaggcactgctcaatgtgatcgccgacgccaagaccaaggtctacggcgatgccgatccgagcctgacctaccaggtcagcggcctgaagaacggtgataccgctggcgcggtgctcaacggtggcagcctgagccgcgtggctggcgagaatgtcggcgtgtacggcatcaaccagggcgacctggcattgaacagcggtaactacgacctgagctaccagggcaataacctgaccatcaccaaggcgctgctgaatgtgatcgccgacgccaagaccaaggtctacggcgatgccgacccgagcctgacctaccaggtcagcggcctgaagaatggcgataccgctggcgcggtgctcaatggcggcggcctggttcgtgtctccggcgaaaacgtaggcaactatgcgattcagcagggtggcctgggtctggtcagcggtaactatgacctggcttaccagggcaataacctgaccatcaccaaggcactgctcaatgtgatcgccgatgccaagaccaaggtctatggcgacgctgacccgagcctgacctatcaggtcagcggcctgaagaacggtgataccgccggttcgatcctgaccggtgggttgaaccgcgccgcaggcgagaacgtgggtgtgtatggcatcaaccagggcgacctggcattgaacagcggtaactacgacctgagctaccagggcaataacctgaccatcaccaaggcactgctcaatgtgatcgccgatgccaagaccaaggtctatggcgatgccgacccgagcctgacctaccaggtcagcggcctgaagaatggcgataccgctggcgcggtgctcaatggcggcggcctggttcgtgtctccggcgaaaacgtaggcaactatgcgattcagcagggtggcctgggtctggtcagcggtaactatgacctggcttaccagggcaacaacctgaccatcaccaaggcgctgctcaatgtgatcgccgacggcaagaccaaggtctatggcgacgctgacccgagcctgacctaccaggtcagcggcctgaagaacggtgacagcgccggctcgatcctgaccggcgggctgaaccgcgacgcaggcgagaacgtgggtgtgtatggcatcaaccagggcggcctggtgctgaccagtggcaactatgacctggcctaccagggtaatgacctgaccatcaccaaggcgctgctcaacgtattcgccgatgccaagagcaagcaggtcggcaccgccgacccggcgctgacctatcaggtttccggcctgaagaatggcgatagcgccggtcaggtgctcgccggcgggctcggtcgggtgggcggcgaagccgtaggccagtacgacatcctccagggtgggcttgccctcaccagcggcaactaccagctcaactaccagggcaacctgctgagcatcctgccgctgccggtcacgccgggcgacctggggcaactggcagcgctctccgacttgcgcgaactgcagaaggggcgcgatccggatacccccggggatgcggtctaccgcaccaccacgctggaaaacccgttcctcgaaaacccgttcctgcgcgcctacgctctgggcatggacgtcagcgatcctaacctgctgccggctaccgccgcgggtccggcggaggacgccagcgccaagcgggtggggcagttcaccgatcgtccgctcagagcagaggccgagagtggggcgggttgctcgaaccagagctacctggccgactactggagctgcttcaacaagcctctgaatttctaa

SEQ ID NO: 14010 - DNA, 489 bp, Pseudomonas aeruginosa
ccgaaaaacgtccgctggatgccgataccctggagcgcggcctgctgctggtcggcgacctgccgggggtcaacgtgcagagcgtgctcagcccgggtcaggcgctgggctcgtcgaacctcgacgtggccttgcagcagcagcgatacgaaggcttcgtcagcctcgacaaccgcggctcgcactacaccgacccgaccaccctggccttcggcgccaccgagttctcccgcctgggcttctacgagcagatcgacgtactcggcgcgatctcgccgttcagcgatgccacccgctacatccagttgcgcggtacgttgccgctgggtggcatgttcgccggcgataccctgcagatcatgggttcctattcgaaggtcaacccggacattccggactcggtattccccttcgacagcgtcagcaagagcaccgaaggcagcatttcctacaaccatcccttcatccgctcgcgctcgcagaacctga

SEQ ID NO: 14011 - DNA, 450 bp, Pseudomonas aeruginosa
agctcgaaccgcgctatggccaggcggtgggctatagctggctgcgcagctaccaggcctacgctttctacgactggggcaagacctacaacctcgacgtggacgatgacgagcagcagaagctcggctcgatcggtgccggggtgcgcttcaacctcaccgaccagttgtcgttcaacccggagattgcccgccaggtcatcggcgagccagccgaccagcgcgatgggaagcgcgagacgcgggtcctgttcaacgtggtggcgcgcttctgaaccctgccggcctccgttccggaggctgctgacggagcccctctccggttctgcggagagggaggttcgtgctcaattccgagtgttcttctcaaactttcgatttcttcgatttttcatatcgatgccgtcaatccgtgtcaaggccggtcggagaggcgtattcttgctgtaa

SEQ ID NO: 14012 - DNA, 639 bp, Pseudomonas aeruginosa
tcccggtggtcggcgccatcgccaacgccgtggcgcacgccaccggcaagcgcgtccgcgacctgcccatcactcccgcccgcatcaaggaggccctccatggctaaccgcaagctccagatgaccctcaacggtcaagccgtcggtccggtggaggtcgccgaagacctgccgatgatcgactacctgcacgaataccagaacctcaccggctcgcgcctgggctgtggccagggcatctgccatgcctgcgtggtgatcgtcgacaatccggacggcaccagcgaggaagtgcgcacctgcatcaccggcgcgcactacttcgacggcaagaaggttcgcaccatcgagggccatgcccagcgcgacgagaatggcgacatccgcgagctgaacccgatccagcagaagttcgtcgaccagttcgccttccagtgcagctattgcgcgccgggcttcgtcaacgccgccaccgtgctggtggaaaaagcccagcgccagccgatcaagcgcagcgagctggagcaggcgatcgaggacagcctcggccatcacatctgccgttgcaccggctacgtgcgctactacagcgccacccgcgacgtgctcgacgaactcggcctggtcaaggaggcttga

SEQ ID NO: 14013 - DNA, 297 bp, Pseudomonas aeruginosa
gcttggcgtggtagcccaggtggcggttgccgacgatccacagttcgccgcccgccgccagggcatcgcgagcctggagaaacatgcgccaggcgaggaagtcgccgaccacctgctgctggtggaacggcgggttgcacaggaccaggtccagcgagcccgccgcctggccggccaggccatcgtcggcgcggaacgtcgccggccgctcgcccagcgccgctcgccagttttcccgcgccgactgcacggccatgtacgactcatccaccagggtcagctcggcctgcgggttga

SEQ ID NO: 14014 - DNA, 423 bp, Pseudomonas aeruginosa
ctcccaacctgttcaccctgcgtaccagccgtgacgcgggattccggttccgcgccgggcaattcgcccggctcggcgtgtacaagcccagcggcagtatcgtctggcgcgcctactcgatggtttcggcgcctcatgacgaattcctcgacttcttttccatcgtcgtcccggacggcgagttcaccagcgaactcagccgcctgcgcgagggcgaccagttgctggtcgatcgccaggccttcggcttcctcaccctcgaccgcttcgtggatggtcgtgacctttggctgctggccaccggtaccggtgtggcgccgttcgtctcgatcctgcaggacttcgaggtctgggagcgcttcgaaagcatcaagctggtctacagcgtgcgtgagagcaaggagctggcctaccgcgagctga

SEQ ID NO: 14015 - DNA, 669 bp, Pseudomonas aeruginosa
ccaagccatgccggcggggaagtggcggaattcgatcggcggtgccgtccgtccccgcctgtgcggctggatcggcggcatgtgtccgagtttgacagttcgtcaagtctcgccaaagctgctaaagcgtttttctccaaaatacaactgcggagcgcagacatggacaagcgacttttgagcaaggggttggttctggggctgctgagcctgggcagcatgacggcacacgccgacgcggcaggcggtaatggctgtggttggggcaacatggtgttcgagggccagcgcggcctgttcccgcacctgctggccaccaccaccaacggtacctcgggcaacgccaccttcggcatgacctccgggaccaacggttgcaacaccaatgcacgcctgggctacggcggccgctcgatcttcgccatgaacgggatgctcgacaacatcgccgaggacatggccaagggccagggcgaagcgctcgacgcctatgccgtgctgctcggcgtggaagccaaggaccgggcgcacttcgcccaggtcacccagcagcatttcggcgagatattcgcgagcaaggatgcgacgggcgaacaggtcctgagcaacaccctggcggtgatgagtcgcgacggcaccctggcgcgctacgccaagcaaccggcctga

SEQ ID NO: 14016 - DNA, 2085 bp, Pseudomonas aeruginosa
cctgctacgtcacctcgcctggctggtggtggcgatcgtgggcgccgcggccctgggcgtcgtcgccctgcgtcgtggcgaagcgatcaacgccttgtggatcgtggtggcggcggtggccatctacctggtcgcctaccgttactacagcctgttcatcgccagcaaggtgatgcaactggaccccaaccgcgccactcccgcggtactcaacaacgatggcctggactacgtcccgaccaacaagcacatcctcttcggccaccacttcgccgccatcgccggcgccggtccgctggtcggtccggtccttgccgcgcagatgggctacctgcccggcaccctctggctgatcgccggcgtagtcctcgccggcgcggtgcaggacttcatggtcctgttcatctccagccgtcgcaacggccgctcgctgggcgagctggtgcgcgaggaaatgggccaggtggccgggaccatcgcgctgttcggcgccttcctgatcatgatcatcatcctcgcggtgctcgcgctgatcgtggtgaaggctctggccgacagcccctggggcatgttcaccgtcctcgcgaccattcccatcgcgctgttcatgggcgtctacatgcgcttcatccgccccggccggatcggcgagatctcgatcatcggggtgttcctcctgctcggttcgatctggctcggcgggcaggtcgcggccagtccggaatgggcgccgcatttcaccttcagtggaatccagatcacctggatgctgatcggctacggcgccgtcgcctcggtactgccggtgtggctgctgctggcgccgcgcgactacctgtcgaccttcctcaagatcggcaccatcatcggcctggcgatcggcatcctgatcgtcatgccggaactgaagatgccggccctgacccagttcaccgacggcaccggcccggtctggaaaggcagcctgttcccgttcctgttcatcaccatcgcctgcggcgcggtgtccggcttccacgcgctgatctcctcggggaccacgccgaagctgctcaaccgcgagcccgacgcccgctacatcggctacggcggcatgctgatggagtccttcgtggcgatcatggcgatggtcgccgcctcggtgatcgagccgggcatctacttcgccatgaacagcccgccggcggtggtcggcgccgacgtcaacgcggtggccgcgaccgtcagcagctggggcttcgccatcacgccggagcaactcacccagaccgcccaggacatcggcgagaccaccatcctggcccgtgccggcggcgcgccgaccctggcggtggggatcgcgcacatcctccaccaggtgctgccgggcgagaacaccatggccttctggtaccacttcgcgatcctcttcgaggccttgttcatcctcaccgcggtggacgccggcacccgtgccgggcgcttcatgctgcaggacctgctgggcaacttcgtgccggcgctgaagaagaccgagtcgtggaccgccaacatcatcggcaccggcggctgcgtggcgctgtggggctggctgctgtaccagggcgtggtcgacccgctgggcgggatcaataccctgtggccgctgttcggcatttccaaccagatgctcgccggcatcgcgctgatgctcgccaccgtggtcctgatcaagatgaagcgccagcagtatgtctgggtcaccatcctgccggcggcctggttgctgatctgcaccaccaccgcgggcctgatcaagatcttcgacagcaacccggcggtcggcttcgtcgctcttggcgagaagtacgccaccgcgctggatgccggccaggtgctggcgccggccaaggatatcggccagatgcagcacgtggtgctgaacgcctacatcaacgccggtctgaccgtgctgttcctgctggtggtgttcagcgtactgttctacgccatcaaggtcggcatcgcggcctggggcaagagcgagcggaccgacaaggaaaccccgttcgagcccatccccgacgcctgaccggccgcgctccccggttcgccggggagccttaa

SEQ ID NO: 14017 - DNA, 1035 bp, Pseudomonas aeruginosa
cgtggcccgcgtcttttctggaagttgcgcatgtccgaagtagccaacgacaaccacgccccgatccccgtcaccgtgctcaccggcttcctcggcgccggcaagaccaccctgctcaagtacctgctgcaggccgagcacggcatgaagatcgcggtgatcgagaacgagtacagtgagacgccgatcgacggccagttgctcggcgtcgagccggtgcaggtgatgacgctgtccaacggctgcgtctgctgctcgatcaacaccgacctggaaaaggccctgttcctcctgctggagcgccgcgacaacggcgagatcgacttcgaccgcctggtgatcgagtgcaccggcctggccgatccggcgccggtggcgcagaccttcttcgccgacgaggaactctgccagcgctacgtgctggacggcatcatcaccctggtggacgccgccaacgccgagcgtcacctgcaggaaaccatcgcccaggcccaggtcggcttcgccgaccgcatcctggtgagcaagaccgacctggtcgacgccgccaccttcgaggccctgggccagcgcctgcaacggatcaaccggagggcgctggtgcatgtggtcgagcacggccgcatcgacctggcgcacctgctcgacgtacgtggcttcaacctcaacgccgacctcggtcctggcatcggcctgcgcccgctgcgagcggtggcagccaaggacagccgcgatcgcatcggcaccctggtactgcgcagcgacacgccgctcgatctcgaaaggctgagcgagttcatggacgacctgttgcagtggcatggcaattccctgctgcgctacaagggcgtgctgaacatcgccgacgagccgcgtcgcctggtgttccagggcgtgctgcgactctacggcttcgactgggatagcgagtggcgggacgacgaggcgcgcgagagcgtgatcgtgttcatcggcgacaacctgccggaggacagtatccgcgagggcttcgaacgcatcgtcgaaggccgctga

SEQ ID NO: 14018 - DNA, 1806 bp, Pseudomonas aeruginosa
ggcgcatcgacgccaaaggagcgtggaaatggacaggaacgcattgatcggcgcctggcgggactgcatccgtggcgcggacaaatcctgggtgctgttcgcccagggcacttgcgtgatcctcacgcagccggagccggacctcgcggcccaggcgcgggcattgctggccgagtggggagcggtacaggtcggcacgccggcgggcgacttcggtgtgatcaccctggacaacggccgcggctgggtggtgaccgggcatcacccggacatccttaccttcgtccctcgcgaggaactggaggaggacgccggcgagctgctcgtcggcatgcacggccgctcccggcggggcgaggatgccgaggccttggcggtgatccatgtcgaggaccggcgataacgctacccggcgcctcctccctcggaggaaatgaaaaagcccggcatttgccgggctctttcgtcttgccttgtcgcttagttgccgtagaccgggaacttggcgcagatcgccttgaccttctcgcgtacgccgtcgaccacggactcgtcgcccatgttctcgaggatgtcgcagatccagccggccagctcgcggcactcggcttccttgaagccgcgggtggtcacggccggggtaccgatgcgcaggccggaggtgacgaacggcgagcgcgggtcgttcgggaccgagttcttgttcacggtgatgaacgcgcggccgagggcggcgtcggcgtctttgccggtgatgtcctgcttgatcagggagagcaggaacaggtggttctgggtgccgccggaaactacgtcgaaaccgcggtcgaggaagacctgggccatggtctgggcgttcttcaggacctgctgctggtaggtcttgaactccggctgcagggcttccttgaagcacaccgccttggccgcgatcacgtgctccagcggaccgccctgggcgccggggaataccgcggagttgagcttcttctcgatctcctcgttggcgcgcgccaggatcaggccaccgcgcggaccgcgcagggtcttgtgggtggtggtggtgaccacgtcggcgaacggcaccgggttcgggtagacgccagcggcgaccaggccggcgacgtgggccatgtcgacgaacaggtaggcgccgaccttgtcggcgatggcgcggaagcgggcgaaatcgaggacctgggaataggcggagaagccggcgacgatcatcttcggcttgtgctccacggccaggcgctcgacttcgtcgtagtcgatcaggccattggcgtcgatgccgtactgcacagcgttgtacagcttgccggaggaggagacgctggcgccgtgggtcaggtggccgccatgggccaggctcatgccgaggatggtgtcgccggccgacagcagggccaggtagaccgcggcgttggcctgggagccggcgtgcggctggacgttggcgtaatcggcgccgaacagttgcttggcgcggtcgatggccagttgctcgacgatatcgacgtactcgcagccgccgtagtagcgcttgtgcggataaccttcggcgtacttgttggtcagcaccgaaccctgggcttccatcaccgccgggctggtgtagttctcggaggcgatcagctcgatgtgctcttcctggcgctgggcttcctgctccatcgcggcaaagagttcggcatcgtagcgggcgagggtcaaatcacggctgaacatggcggtcctcataaggatcggtgctgggaaaaggcgcgcattctaacccatgcggcgggtgctggcacatga

SEQ ID NO: 14019 - DNA, 1233 bp, Pseudomonas aeruginosa
gacaatattgactcaattagctcgaaaaagtaccattcgatccgttttcaatcaacggtcgggtgtgtcatggctgatttgcgtgcaataggaaggatcggggcgttggctatggccatcgcgttggcgggttgtgggccggcggaagagcgacaggaggccgccgaaatggtgttgccggtggaggtcctgacggtgcaggccgagcccctggcgctgagttcggaactgcctgggcggatcgaaccggtgcgtgtcgccgaggtgcgcgcgcgggtggccggcatcgtcgtgcggaagcgcttcgaggagggcgccgacgtcaaggctggcgacctgctgttccagatcgatccggcaccgctgaaggctgcggtgtcgcgcgccgagggtgagctggcgcggaaccgcgcggtgctgttcgaggcgcaggcgcgggtgcgtcgctacgagccgctggtgaagatccaggcggtcagccagcaggacttcgataccgccaccgccgacctgcgcagcgccgaggcggcgacccgctcggcccaggccgacctggagaccgcgcgcctgaacctcggctacgcctcggtcactgcgccgatctccgggcgcatcggccgcgcgctggtgaccgagggcgcgctggtcgggcagggcgaggcgacgctgatggcgcgcatccagcagttcgatccgatctatgcggatttcacccagaccgcggccgaggccctgcgcctgcgcgacgccctgaagaaaggcaccttggccgccggcgacagccaggcgctgaccctgcgcgtcgaagggacgccctacgagcgccagggcgcgttgcagttcgccgacgtggcggtggatcgcggtaccggccagatcgccctgcgcggcaagttcgccaaccccgacggggtcctgctgccgggcatgtacgtgcgcgtacgtacgccccagggcatcgacaaccaggcgatcctggtgccgcaacgggccgtgcaccgctccagcgacggcagcgcccaggtgatggtggtgggcgccgacgagcgcgccgagtcgcgcagcgtcggtaccggcgtcatgcagggttcgcgctggcagatcaccgagggcctggagccgggtgaccgggtcatagtcggcggcctggctgcggtgcagccgggggtgaagatcgtgccgaagccggatggtgcccaggcgcaagcccagtcacctgcgccgcaacagtaa

SEQ ID NO: 14020 - DNA, 3159 bp, Pseudomonas aeruginosa
gggcgggttcgccccgaggattttccgatgtccgaattcttcatcaagcggccgaacttcgcctgggtggtggccctgttcatctccctggccggcctgctggtcatttccaaattgccggtagcgcagtaccccaatgtcgcgccgccacagatcaccatcaccgccacctatcccggcgcctcggcgaaggtgctggtggactccgtcaccagtgtgctcgaggagtcgctgaacggcgccaagggcctgctctacttcgagtcgaccaacaactccaacggcaccgccgagatcgtcgtcaccttcgagccgggcaccgatccggacctggcccaggtggacgtgcagaaccgcctgaagaaagccgaggcgcgcatgccgcaggcggtgctgacccagggcctgcaggtcgagcagaccagcgccggtttcctgctgatctatgcgctcagctacaaggaaggcgctcagcgcagcgacaccaccgccctcggcgactacgccgcgcgcaatatcaacaacgagctgcggcgcctgccgggcgtcggcaagctgcaattcttctcttccgaggcggccatgcgggtctggatcgatccgcaaaagctggtgggcttcggcctctccatcgacgacgtgagcaatgccatccgcgggcagaacgtgcaggtgccggccggcgccttcggcagcgcaccgggcagttccgcgcaggagctgacggcgaccctggcggtgaagggcaccctggacgatccgcaggagttcggccaggtagtgctgcgcgccaaccaggacggctcgctggtccggctcgccgatgtcgcgcgcctggaactcggcaaggagagctacaacatttcctcgcgactgaacggcacgcccaccgtgggcggggcgatccagctgtcgcccggggccaacgcgatccagaccgctaccctggtgaaacagcgtctcgccgaactgtcggcgttcttccccgaggacatgcagtacagcgtgccctacgacacctcgcggtttgtagacgtggccatcgagaaggtgatccacaccctgatcgaagcgatggtcctggtgttcctggggatgttcctgttcctgcagaacgtccgttacaccctgatcccgtccatcgtggtgccggtgtgcctgctgggtacactgatgttgatgtacctgctggggttctcggtgaacatgatgaccatgttcggcatggtcctggcgatcggcatcctggtggacgacgccatcgtggtggtggagaacgtcgagcggatcatggcggaggaggggatttccccggccgaggccacggtcaaggcgatgaagcaggtatccggcgccatcgtcggcatcaccctggtgctctcggcggtgttcctgccgctggctttcatggccggttcggtgggggtgatctaccagcagttttcggtgtcgctggcggtctcgatcctgttctccggcttcctcgccctgaccttcaccccggcgctgtgcgctacgctgctcaagcccattcccgaagggcaccacgagaagcgcggcttcttcggcgccttcaaccgtggcttcgcccgcgtcaccgagcgctattcgctgctcaactcgaagctggtggcgcgcgccggacgcttcatgctggtgtacgccggcctggtggcgatgctcggctacttctacctgcgcctgccggaagccttcgtgccggcggaagacctcggctacatggtggtcgacgtgcaactgccgcctggtgcttcgcgcgtgcgcaccgatgccaccggcgaggagctcgagcgcttcctcaagtcccgcgaggcggtggcttcggtgttcctgatctcgggcttcagcttctccggccagggcgacaatgccgcgctggccttcccgaccttcaaggactggtccgagcgaggcgccgagcagtcggccgccgccgagatcgccgcgctgaacgagcatttcgcgctgcccgacgatggcacggtcatggccgtgtcgccgccaccgatcaacggtctgggtaactccggcggcttcgcattgcgcctgatggaccgtaccggggtcggccgcgaagcgctgctgcaggctcgcgatactcttcttggcgagatccagaccaacccgaaattcctttacgcgatgatggaaggactggccgaagcgccgcaactgcgcctgttaatcgaccgggagaaggcccgcgccctgggggtgagcttcgagaccatcagcggcacgctgtccgctgccttcggctcggaggtgatcaacgacttcaccaatgcggggcgccaacagcgggtggtgatccaggccgaacagggcaaccggatgaccccggaaagcgtgctcgagctatacgtgcctaacgctgctggcaacctggtaccgctcagcgccttcgtcagcgtgaaatgggaagagggaccggtgcaattggtgcgctataacggctacccgtcgatccgcatcgtcggtgacgccgcgcccggcttcagcaccggcgaagccatggcggaaatggagcgcctggccgcgcagctgccggccggcatcggctacgagtggaccggcctgtcctatcaggagaaggtctccgccgggcaggccaccagcctgttcgccctcgccatcctggtggtgttcctgttgctggtggcgctctacgagagctggtcgatcccgctgtcggtgatgctgatcgtgccgatcggcgccatcggcgcggtgctcgcggtgatggtcagcggtatgtccaacgacgtgtatttcaaggtcggcctgatcaccatcatcggtctttcggcgaagaacgcgatcctcatcgtcgagttcgccaaggaactctgggagcaggggcatagcctgcgcgacgccgccatcgaggccgcgcgcctgcgcttccggccgatcatcatgacttccatggcgttcatcctcggcgtgatacccctggccctggccagcggtgccggcgcggcgagccagcgtgccatcggcaccggagtgatcggcgggatgctcagcgccaccttcctcggcgtgctgttcgtacctatctgtttcgtctggctgctgtcgctgctgcgcagcaagccggcacccatcgaacaggccgcttcggccggggagtga

SEQ ID NO: 14021 - DNA, 2337 bp, Pseudomonas aeruginosa
tctgggacaacaccaatctggatgacgagaatgagtgatctgccaagtccgaagaaacacaagacctcgaactggtcggcgatctgggtgctgccgctggtggccctggccatcggtgcctggctggcgtggcgtgccttcgaccaggctggcgtggacatccaggttcgcttcgagagcggcgacgggatccaggccaacaagaccgaggtgctgtacaagggcatctcggtgggcaaggtgaccgacctgcatgtcagcaaggacatcaagggcgtggtcgcgaccatcgagatcaagaaggaagcccaggagtacctgagcaaggacacccgcttctggctggtcaagccgcgggtttccctggctggcgtcaccggcctggaaaccctggtctccggcgtctacatcgcggtcgatccggtgaagggcgagaaggaagaacgctacttcaccgcgttgaaggagccgccacccctttccgacaagctgcccggcctgcacctgaccctcaaggccgatcgcctgggctccctggagcagggcagcccggtgttctaccggcagatccaggtcggccaggtgaagagcttccagttaggcgatgaccagaggaccatcgagatcaaggtgcacatcgagccggcctacgccgacctggtgcgcaagcacacgcgattctggaacgccagcggcatctccatttccggcggcctgtccggcttcaaggtgcacagcgagtcgctgctgaccctggtcgccggcggtatcgccttctccaccccggagaaccgcaccgacagcccgccgaccgatccgagcaagccgttccgcctgtacgacgactacgacgcggcccaggccggtctgcgcgtgaagctgaagatgaacgacgtcagtggtatcgatccgggccgcaccccggtgatgttcaacggcgtgcaggtcggcctggtcaagtcgatcgacatgggcaaggactacagcagcgccactgccgacctggcgatggatccgcgggtcgaggacatgctgctggaaggcaccgaattctggaccgtcaagccaagcatctccctggccggcatcaccggcctcgaggccctggtgaaaggtaactatatcgacgtgcgcttcgccaagagcggcgcgccgagtcgcgagttcaccatccgcccgaaagcgccgccgctgaacaccgacgcgcccggcctgcacctggtgctgaccagcgacaagctcggctcgatcgatatcggcgcgccgatcctctaccgccaggtccgcgtcggcagcgtgcagagctaccagctgtcgcgcgaccgccagcgagtggtggtgggtgtgcacatcgagccggagtacgcgcacctggtgaatacctcgacgcgcttctggaactccagcgggatcaccctgaccggcaacctcagcggcgtgcaggtgaagagcgagtcgctgcagaccctgatcaccggcgggatttccttcgacaccctcgatccgaaggcgccgaccgtgaccaaggtgcgtcgcttcaccctcttcgacagcgaggaggcggcgatggcccgtggcgtggaaatccagctgagcatcgacaatgccgacggcctgcgcgaaggcacgccgatccgcttcaagggcctggacatcggcaagatcgaaagcgtcgagctgaacccggacctctccggggtactgatgaaggcccgcctgacttccgccggcgagcgcgtcgcccgcagcggaacccgcttctgggtggtgcgtccggcgctcggcctgctgcgtaccgagaacctcggaaccctggtcagcggcccctatatcgaggcgctgccgtcgagcacgccgggcgagcgccaggcacgcttccagactctcgccgaagcacccaacctgctgggtcgggaaaacggcctgcggctgaccctcagtgcgccgcgcaagggctcgatcaagccgggcaacctggtgacctaccggcagatcccggtgggcaaggtcgtcgacctggccttgggcgaacaggccgaccgggtgctgatcagcatcctcatcgaaccgcgctacgtaccgctggtgcgtaccggcagccgtttctggaatgccagcggcttcggcgtcgacgccagcctgttcaagggtctgtcgctacgcaccgagtcgatggaggcgctgatggagggcggcattgccttcgccaccccgaacaatgcgcagatgggcgagcccgccaagccggggcagaccttcgccctgttcgattcggccaatgacgaatggttggagtgggcgccgaagattcctctgaaggaaaccgcccgccgctga

SEQ ID NO: 14022 - DNA, 468 bp, Pseudomonas aeruginosa
gaagtcgaacaggcatggattctccccgtgggttacaaatgcgaatgtaaccaattatatcttcgcgggagcttcgggcctatcggaaaagtccacggccctgtcaggcagggccgtggcagacgcttcacgccggttcgccggcttcctccggctcgctggctgcgcgggtttcgccgctggcggcggcatcccggcgacggatgtatttccagtccgcttcgtcgatataaatgccgttcgggccgctaccgccttccaggtcgatcgccacgtgtgcggaaacctgcggcttcacgctcgccaggatcggcacgaagcccagttgcaggctggtctccagcagcgcggcctggttgcgctcgtcgatgtccgccgcctcgtccaggtagtagggcaggcgcacgcgcccggcctgctcgcggtccatcaggtgcagcaacaggtacatgttggtcagcgccttga

SEQ ID NO: 14023 - DNA, 402 bp, Pseudomonas aeruginosa
gcaccgacagctcgccgagccagcgctggatgccggcgatctcgcgctccaggcgcatcagctcctgggtgccgccacgctgttcgttctgcaggccgtcctgctcggcgcggtattgctcgtgctggatcagcagttcctcgcggcgcgccccggcgtagtcgtgccaggtgccgagcaggctgtcgagcagcggtgaaaggcggtgcatcttgccgcgcagtacgtcgcgctgggtcacgccgttggccagggcttccaccagcgggccggcggcgaccagcgcctggtagtcctgctccatccgccgcacgtcgcggaaggcctcctcgcaggcggcgatgtagtcgacattacccgagcgcaggctgtgctcgaaggcgtcgaggaacagctgcttga

SEQ ID NO: 14024 - DNA, 1098 bp, Pseudomonas aeruginosa
gcttcaccatcgctggcgccaacaaggcgcgcggtaccgatcccgggctggtgcagaccaacctggtcagcgcacgcatcgacggcaccctcaagctgcagggcaacgtcaatatcttcaccgtcgccccgcgttgagggcgaaccgtcgcatggcgggacaaagccgctccgccgaggtcgaagaaccgctatcattgcctgcctgaacgccgggggcgaaaccgtccccgcgcatcgcctaattgccggtgcccgagatttgatcgaagaacagcgtcgccgcgccttcctgggcgcgatgcagataaccagttggctgccccgccagccgttgccgttcgccgcaccctcgcggccggagttgctggagaccccgccccgggaagagccggcggtgcctgtgcgtgcgcgcgccgcgatcgatgcgccgcaggcccgcgtcccgcaagccgaggcgccggccagcgcgccgagcgtggctcccgccgcgcccgtggaaggccgggggatcccgatcagcctgccgaagccgggcgccccggcggcgaagaaagccgagccggtcgcgccggtcgaagaggccccggccgagtcgccggcggtccaggccccgccgccgcgcttcgccttgcaactgctgcaggcgggctcctgcaccctgctggtcgaactgcccaccggcgaacccttcgccagccgcgatccgggttacctgctgctgcgcgacctgctgcgcgccgccggcctgccggacagcccgcggctgatcggcgaaccggtacgctggccgctgctggcgcgcggcaacctcgaccaggggccgcaggcggccctggagttcgtccagagcttcgtcgccgcgcgcatggaggagagcgagcgtagccgctgcctgtggttggtcggcctgccggcgatccgcttcgccggcgagggcgacgagggcagcctgttccgcgagctgcaggtggacggtctgggcgcaacctgggccgtgccaggcctggaagccctcatggaagaacccgccctcaagggcgagctgtggcgcgccatgcgccgtgtccgtcagcgctggtcgagcgagattcaatga

SEQ ID NO: 14025 - DNA, 1410 bp, Pseudomonas aeruginosa
cccttggccacgaattcgacctgtgcagccgcgacctcgaggaccaggctcgccgccagggctgctgggatggtcgcggcgacttccacttcgcgcgggtcttcgacacccgcctgctaccctgggtcggcggcgcgcaccggcgctgtcggatcaaccagcgcttcctcgacagcctgcctggtgagccggactggcacgcgctgttcgccgcgctgcgccaccatggcccgcgcggggaccacttccgccgccacaacaaccgccaggtatgcatgcacgccggcagcttctggcggccttcgcagaccaccgccagtctggtcgcccgcttgcgcgacgacggcccgttgctggccgccaccggtacttcggcgccgtgcctgggactgttccagccgctgtccttcgatccggcctccggcgccgccgtgctcagccagccgcgcgaggcggtacaggagtccccctggtggcgcttcgaggcggtgcaccgccgcgcgctcaccgaccgcgccttccgccggctcctgcgcagcggccgcgattggctggaacgggaactcttcgccgacctcgaacagcccgactggccgcgcctggcagaggatgccgcagcctggcacgcctgttggcatgatcaggtcgccatgcagccgctggcgcagcagcgctggtggcgtagccacgccgcgctgtgacgcttgtcaaacgggcatcgccttccgtaaggtgctgcaccggtcaaacgaggggcatgccatgagcgacttgcagcaactgttcgagaacaacgtccgctgggccgaagcgatcaagcaggaagacccggacttcttcgccaagctggcccgccagcagacccccgagtacctctggatcggctgctccgacgcgcgggtgccggccaacgaaatcgtcggcatgctgcccggcgacctgttcgtccatcgcaacgtcgccaacgtcgtgctgcacaccgacctcaactgcctgtcggtgatccagttcgccgtcgacgtgctcaaggtcaagcacatcctggtcaccggccactacggctgcggcggcgtgcgcgcctccctgcacaacgaccagctcggcctgatcgacggctggctgcgcagcattcgcgacctcgcctacgaataccgcgagcacctggagcagttgccgaccgaggaagagcgcgtcgatcgcctctgtgagctcaacgtgatccagcaggtggccaacgtcagccacaccagcatcgtccagaacgcctggcaccgcggccagtcgctgtccgtgcatggctgcatctacgggatcaaggatggcctgtggaagaacctcaacgtcaccgtcagcggcctcgaccagttgccgccgcagtatcgcttgagtccgctgggcggttgctgctga

SEQ ID NO: 14026 - DNA, 1959 bp, Pseudomonas aeruginosa
gagaggcggaagctctttcccacgagttcccctctccctggagggacaggggaactgtcgaggacggcttcagaactccacgctatacgtcaggctgtaggtccgcccccgtcccttgtagtcgaacagtcccgctggtgcgagcccgccgtagtagacctgcgcgcgttgtccccagaccgtggtgtagtccttgtccagcaggttctggatgcccgcggtgagggtgcccaccggcagcgcctgggtgccgagcaggtcgaacagcgcgtagccgtcgatcttgttgcccggctcgtcgttcaggttgaaggtgcgcacgccctgcaggcgcaggctgcgctggtcgtccttccagccgacgaaggcgccggccttggacgggctggccgaggtcacgtcctgcttcagccagcggccgtcgaccttttcctgggagcggatggccaggccgttgacgccgacctgccagtgatcgtccagccagtaggtagcctggccctccaggccgtagttgcgcttcttggtgtcctgctgcagcaccgccagggtcttcgagtcgtacttgatgctcttgtccgaccaggaatagaacgccgccacctgggtatccagggcaccgtcggtgtgccgccagcccagctcgacctgcttggtcttgatcccgtccagcggcgagtcgttcacgctgaccccctgcaacagcgggtagtggccattgccgtcggctgcgccgtagcgtccgaaaccgtagtacttggccggatccggcagctcgaagccttcgctgtagttggcccagacctgttgttgcaggttcagcttgtagatggcgccgacgttgaccaggttgacgtcgtagtccttgctcccgcccggaaccgcgtcggcggtcttgccgaggccgttggcgatgaggatctgctggttcgccgcaacgaagtcgctgacgtcggtgctcatcgactggcgccgcacgccggcgctcagggtcaggtcgtcggtggccttccaactgccctggaggaagaaggcgcggctgtcggtatcgatgtccgggtagcggcccagcttggcctgttcactggctaccagcccgccgctggcggcggcgagcggcaggttgaagagcatctggtcggacgtgaatttttcccggtccaggtccaccccgtaggtcaggctggcgcgctcccaggtcttcaccagggccagtttcatcccgtagtagtcggtgtcctgctgcgaggccgagtagtaggaggtgccgtagttgatcgcgccggtattgctgtagcggatggtagggaagggattgaaggccatcttctcgttgcggtagtaggcctgcaggtagaggtcgtgacccagcacttccggcgcgtggtaggtggcgttgaactgatggcgcttgctctccggctcgcggtcgaggtcgacgccgcccttgatcgaatagggtgcccgtccgcgcagggcgtcgaagttgcgcccaagatcgaggccgcggtcgccgtcgtagccggagtcgtagtactgcaggccgagatcgaggctgtggccattggcgaaagtgaagccaaggctgcccatcaggtccaccgacctgttgtactgcaggtcggtctgggtgatgtccgtcagtacctggtcgccactgccgtcgtaggccgcgccgttcttctggtaggcgatggccaggcggccgttgaacaggtcgttgccgccgctgatcgactgcgccgcgcgcaggtcgtggtcctcatggctctggaagccgctgcgggcgcccagctcggtgttgaagcgagtgtcgccgccgacgcccttcttggtcacgatgttgatgatcccgccggtggcgccgccgccgtacaccgcgctggcgccggacatcacctcgatgcgctcgatgttgaatgggtcgatggagtcgaactgccggctgatgccccgtga

SEQ ID NO: 14027 - DNA, 186 bp, Pseudomonas aeruginosa
ggcatgcctggcatccaaagcaagatgaaatgcctgacacggggcgctgcgcatggcgtggccctacagcggatcctcgggcattcctcgatgatgatgcggtatgcacatctgtcgccggagcacttggaatcggcgatgcgcttttctccgattactcagtctggctacaaattgaccacatga

SEQ ID NO: 14028 - DNA, 327 bp, Pseudomonas aeruginosa
ttaccactgaggaggtggaccatggctaccaatggtatgcgccccatccatcctggggaaatattgcgcgatgagtttctgatggagttggatatctctccagctgctctagcacgcgctttgaaagtctccgctccgacagtgaacgatatcgttcgtgagcagcgtggtatctccgcagatatggcgattcgtctggggcgttactttgatacgtccgctcagttctggatgaatctccagagtgagtattcgttagcaactgcttatgcggcgaatggcaagcagatcgaacatgagattgagccgctgcttgctcacggatag

SEQ ID NO: 14029 - DNA, 1545 bp, Pseudomonas aeruginosa
ccgagtggcgcgcattttccgtatctcgggcggggctgtcaacccctgggcctagataattttctgatctttcaatcgtttagacggaaggggtcggatcgccggagagagggcgatggggaggggcaggaacgaaaagccccggcgcttggccggggctttcctgggacgggaaggggattacacgttgaagcggaaatgcatcacgtcgccgtccttgacgatgtagtccttgccttccaggcgccatttgccggcttccttggcgccctgttcgcccttgaactggatgaagtcgtcgtaggcgaccacttcggcgcggatgaagcctttctcgaagtcggtgtggatcacgccggcggcctgcggggcggtggcgccgacgcggacggtccaggcgcggacttccttcaccccggcggtgaagtaggtctgcaggttgagcaggccgtagccggcacggatcacacggttcaggccgggttcctcgagaccgagggactcgaggaacatgtccttctcttcgccgtcttccagctcggcgatctcggcttcgatcttgttgcacaccggcaccaccaccgcgccttcttcctcggcgatggccttcaccacatccaggtgcgggttgttctcgaagccgtcctcggcgacgttggcgatgtacatcaccggcttgctggtcagcaggtggaagctgcgcaccaggcgcttctcctcgtcaccgaggttcttcagcagcgaacgcgccggcttgccctcggtgaagtgggggatgagcttttccagcagggccttctgggccagggcttccttgtcgccgcccttggcgttgcgggcgactttctgcagttgcttctcgcagctgtcgaggtcggcgaagatcagttcgaggtcgatgatctcgatgtcgcgcttggggtcgacgctgttggacacgtggatcacgttgtcgtcttcgaagcagcgcaccacgtgggcgatggcgtcggtctcgcggatgttggcgaggaacttgttgcccaggccctcacccttggaggcgcccgccaccaggccggcgatgtcgacgaattccatggtggtcggcagtacgcgctcgggcttgacgatctcggccagggcgttcaggcgcgcgtcgggcatcggcacgatgccgctgttcggctcgatggtgcagaacgggaagttttccgccgcgataccggatttggtcagggcgttgaacagggtggacttgccgacgttgggcaggccgacgatgccgcagttgaatcccatgctatgtccctcgcgctcagacaggcgctagaaaagtggttcaggccttctggctgtgcagcttctgcatcgcccgggtccagtccccggcgagcatttccggcagcacgccgagggcgaagtcgatgctggtgtcgagcagttcctgctcgctgcgcggtgcgcggccgagcacgtaaccggaaaccaggctgctgtgccccggatggccgatgccaagccgcaggcgatggaaagaattctgattgccgagctgggcgatga

SEQ ID NO: 14030 - DNA, 579 bp, Pseudomonas aeruginosa
aaaaatttctgctgtgctgacaagtacttgcggaaccacgacgagataccagggctccgggatgtccaccggggtgagcttttcgcccacgccctcggcgaaagccgcgcgtccgcgggtgaagaccggcacgtcggcgcccaggcgcaggcccagggcggcgatgcggtcctcgtcccagccgagttgccagagatggttcaaggccaggagcgtcgtggcggcgtcggagctgccgccgccgatgccgccccccatgggcaagcgcttgtccagccagatgtcgacgccttgcgggctgccggaggcttcctgcagcccgcgcgcggcgcgcacgatcaggttgctgtcgtgcggcaccccggcgatttccgtgtgcaggcgtacctggccgtcctggcgggcttcgaaatgcagctcgtcgccgtggtcgaggaattggaacagtgtctgcaactcgtgatagccatcgtcgcggcggccgaggatatgcaggaacagattgagcttggccggggctggcaggctgaggcgcacgctcatgtcagcggccgagctggcgcggctgccagtccttga

SEQ ID NO: 14031 - DNA, 681 bp, Pseudomonas aeruginosa
ccagacccgcttccgcgcctattcccgcgagtacgccgaggtcgaaccggtgatcctggcgttccgcgactaccgcaaggtgcaggccgatctcgagggcgcccaggcgttgctcaaggacagcgacccggagttgcgcgacctcgccgaggaggaggtcgccgaagcgcgcggccgcctcgccgccctcggcgacagcctgcagcgcatgctgctgccgaaggatcccaacgacagccgcaacgtgttcctggagatccgtgccggcaccggtggcgacgaggcggcgatcttctccggcgacctgttccgcatgtattcgcgctacgccgagcgccagggctggcgggtcgagacgctgtcggagaacgagggcgagcacggtggctacaaggaagtgattgcccgggtcgagggcgacaacgtctacgccaagctcaagttcgagtccggcgcgcaccgcgtgcagcgggtgccggaaaccgaatcccagggccggatccacacttccgcctgcaccgtcgcggtgctgccggagccggacgagcaggcagcgatcgagatcaacccggccgacctgcgggtggacacctaccgttcctccggtgccggcggccagcacgtcaacaagaccgactcggcggtgcgcatcacccacattcccagcggcatcgtggttga

SEQ ID NO: 14032 - DNA, 558 bp, Pseudomonas aeruginosa
gcgagggcgacgtgcgtttcgagccgaagagcgcgctggtcgcgggtagcgatggcctcgacgatatccgccagatcgtcgcccaggcgccgcagcatttgctggacgaaggctggttgctgctcgagcacggctatgatcaaggggcggcggtgcgcgaactgctcggcgcccgcggcttcgccggggtacatacgttgcgcgacctcggcggcaacgagcggatcactctcggacaatgggcatgctgagcgacgaggaactgctgcgctacagtcgccagatcctgctggcgcaggtcgacgtcgagggccagctgcgcctgaagcgcagccgcgcactgatcgtcggtcttggcggcctgggttcgccggtggcgctgtacctggccgcggccggggtcggcgagctgcacctggcggatttcgatacggtcgacctgaccaacctgcaacggcaggtcatccacgatggcaccagcgtcggtgtcggcaaggtggagtcggcgatgcgccggctgggcgcgctgaatccgcagatccgcctggtcagccatag

SEQ ID NO: 14033 - DNA, 588 bp, Pseudomonas aeruginosa
gtgcgctcttataatgcgcagcttgaatgcgggggctttcatgcaactttcgaaaaggacgtttcaatgaagaaactacttccgctggccgttctggccgcactttcctccgtccacgtggcgtccgcccaggcggcggacgtctcggccgccgtcggtgcgaccggccagtcgggcatgacctatcgcctgggcctgagctgggattgggacaagagctggtggcagacctccaccgggcgcctgaccggctactgggatgcgggctacacctattgggaaggtggcgatgaaggcgccggcaagcattcgctgtcgttcgctccggtattcgtctacgagttcgccggcgactcgatcaagccattcatcgaggccggtatcggcgtggcggcgttctccggcacccgtgtcggcgaccagaacctgggttcctccctgaacttcgaagaccgcatcggcgccggcctgaagttcgccaacggccagtcggtcggcgttcgggcgatccactattccaacgccggcctgaaacagccgaacgacggtatcgagtcctacagcctgttctacaagatcccgatctag

SEQ ID NO: 14034 - DNA, 474 bp, Pseudomonas aeruginosa
cttcgcggatcggcaggccgccgcgttcgaggtggggcgagttcatcgggaaatcctagagcgcgttgcgcaggccgagttcggtcgggtgcggttgcaggtaggcctgctgggcgatgtatgcatgcgggtggcgacggaagtggtgctttagcagggtcagcggtaccactagcggcacgctgccatgccggtattgctcgatcagctcgcgcaattcacgcctgtcttcggttgcgaggtcgcgtttcaggtagccgctcaggtgcagcaacacgttgccatggctgccgcgggtcgcgcagcggcgcaagccctgcatcagctcgccgaagtagcgagtgccgagggcttccggctggtagtggccggcttcgccgagcaggcggccgaggctgcggtagtgctccggcgaatgggccagcaactggtacttgtagcggctatggaaggcgacgatggccgaatggctga

SEQ ID NO: 14035 - DNA, 1233 bp, Pseudomonas aeruginosa
atattttcttgtcacatcgggccgccaggcgacggcccgatcccctcagagatgttccagcaggcgccgcgcggcttcctggccgctgagccaggcgccttcgacgcggccgctggagcaccagtcgccgcaggcgtagatgcccaggtcgggatcgccgagggcgccccactggtgggcctccgccgggcgtgcatagagccagcggtgggcgatgctgaaggcggcttccggtacggcgcagccgatcacttcggcgaaggcgcagcgcaggtgctcgaccacgtcctccttggccatgtcgatgtgctgccggctccactggctggtggcgtgcagcacccaggtgtcgagggtggtgtcgcgccccggcttgctgcgattgcaggccagccaggcgatcggactgccgtgcacgaagcagccctgcaccggggtgtcgagtacctcgcggaagcccagcgccaccgcccaggtcggctccatgaccacgctcgcggcggtggccgccagtttcggcacgctggccagcagcggcgtggcctggggagcggggatggcgatcaggacctggttgaacggaccgtggttctgtccctcggagtcctgcaggtgccagtgctgcttgccgcggaagacctcggtgatgcggcaggagaagaccacttgcagatcggtgagcagggcgcgggtgatcgcactcatccgcgggatgccgacccagcgtggctgctcgtccggggaggggctcagctggccgtcgcggtattggtagagagcgggtttccactcgtccacccagccttcctcgcgccagtgttgcaaggcgtcgaggaagcgccggtcgcgggcggtgaagtattgcgcgccgaggtccagcgtgccggcctcgctgcgcttgctggccatgcggccgccgctgccgtggcccttgtcgaacagttgtacggtctggccggcggatctcaatgcgtgggcggcggaaagcccggcgatgccagtaccgatgatggcgatggggacgctcatgacatgcctctctggttgtgtagcgtctggacaggcgaatcaggtttcttgtacaagcttgatttaatgtacagtattgcgcgtgcttcgaggcgcaccttgcatcgcgccgatggcgcgcctgcggcgcacggctcgcttcctggcctgtcgaaccttcagacgttccgttcggaagtatcaaccgagttatctgaagaatag

SEQ ID NO: 14036 - DNA, 1329 bp, Pseudomonas aeruginosa
tcgattttcttttgcggcggcccgatgccagcggtccctataatgcgtgcgctcccaacccggtgcgcaaccgcgatttcgccaaggccctgggccgggcgctgcacaagccggcgcggataccgacccccgggttcgtcctgcgcctcgggctgggagaaatgtccggattgctgctcggcggccagcgagccttgccgcaacgcttgcaggacgccggctaccgttttcaattcaccgacctggacgtggcgctggccgatgtcctggacgcccgacgaaaggatcaggcatgaccgagaatgccctgctgttgctcaacctgggctccccggattcgacccgggtggaggatgtccgccgctatctcgaccagttcctcatggatccctacgtggtcgacctgccctggccgctgcggcgcctgctggtgtcgctgatcctgatcaagcgtccggccgaatcggcgcacgcctacagctcgatctggtgggacgaagggtcgccactgatcgtcctcagtcgtcgcctgcaggaggcgatgaagccgcactggccgcatgggccggtggaactggcgatgcgctacggccagccggccatcgagaaggtcctgctcgacctggcgcgccgcggtatccggcgggtgaccctggcgccgctgtatccgcagttcgccgacagcaccacgaccaccgccgaacaggaggtgcgccgggtgatcgccgcccatcgcctgggcctggaggtcagcacgctgccgccgttctacgaccagccggtatacctcgatgccctggtggaaagcgtgcgtccgtacctgcagcagccccacgaccatctgttgctgagcttccatggcttgcccgagcggcacatccgcaagctggtgaaggatcctgcccacgacctgctggccgagaacagccgcaacgtcagccccgaagccctcgccctctgctaccgcagccagtgcctgcgcaccgccgaggccttcgccgagcgcgccggcctggagcaggggcgctggtcggtgtcgttccagtcgcgcctggggcgcgccaagtggatcgagccctataccgacgccaagctcgacgaactggtgcagcgcggggtgaagcgcctgctggtgatgtgtccggcgttcgttgccgactgcatcgagaccctggaggaaatcggcatgcgcggccgcgagcagttcatcagtgccggcggcgaggacctggtgctgattccctgcctcaacgaccaccccgcctgggtcggcgccctggccgagatgagcgggcgcttggccaggccgctctgagagcctgttcatga

SEQ ID NO: 14037 - DNA, 1167 bp, Pseudomonas aeruginosa
aggactggagcctgcgacgggaaggcgagggcggcgaggattggaaggcgtcccggcagccggcctgactcagtaggtgaggatcacccgcacggtatcgctgtaggtaccggcggggacgttgccctgggccgggttgacgatggcccggtacggcacgttctgcgcggcgccgctaccggtgcctgcctgggtgttgctggtggtccagaccgtcgagtctcccggtttgtagaggttgtactggatcgcgttggcgccgctgagcattcgccgccagccgccgctgaagttgttgccgttgtcgaagccgatggtataggtggcgttcagggtgcagcgcacgccaatgttctggttcaccgcggtgaaggccgagaccagcgcggcgctgccgaagctgaggtccggagcgctgtcgatgaagcagtccttgagcaccgtcagggtaacgttgacgctgctgctggcggtgccgtcgtcgtatacgcagactgggccgatgcccgccgcgcacaggtgccaggcccagttcaggccgatggtatcggtataggtgccggccggcagggtcaccccggtggcggtgcgcaggtacagcggcaggctgccgtcggtggcgttgaacaggccgaggatgccgaggaaggtggtgctgctccagcgtaccgtcgagccgacgttgtagacggtgccgcagccgttgtccttgcagatactgtagggcaggtaggtgccgctggcggcgttgtacagccgcggcgtggtgcccagcggattggcggtgctggcgatggtcgcgtcgatggtgttggtgctgaggatcgacaacaggctgccggtgcacttgaagccggtggtgccggtgatggtctgggcggtgctggccacggtgaacgagctcaggctgccgaaattgccggtgccggagctggtggtgcaggcggcgagcagcaacgggctggcgcagagcgtagcgaagccgagcaggcaggcggacgtggagtggcggctcatggcgtatctccgatcggggccgagcaggtcagcgggccgacctggctgacggtgggtttgcgcgtgtccaggcggaagcgtgcctggcaggcccggccgtcggggcggaccacgcgtagctggttgtcgctttgcaatccttcgaaatag

SEQ ID NO: 14038 - DNA, 804 bp, Pseudomonas aeruginosa
cacgggcgaggcacgggaccgacgtccgcctcagtagccgggaacgctgatcggcgcgtcgttgtccgccagttgcagtttcagggtcatgccggcgtccggcagcagccccggcggcagcggccagcgcatctgctggccgggcagcacgtagccgagcaggccgtccagcagcgccaggctgcggccgttgccctcccagcggacatggctcaggcgggcgtgcacgctaccctcgttgcgcacctgcaggtaacgcttgccctgttcctcgaccagccgccaggccagcttcggccgggtcgcgtcggccgggtcgcgctcgacatcgctgcgcggctgggtccagacgccgtcggcgctgacgaacagcggcaccgaatagcgcatctggaactgcagggcgagaccggggcttcgttgcgtctgccccgcgctgccgtcgggcacttcgtcgatcagcacccgataggcgtcctccggcgtgctgggctggccgccctggcggatcagccggaccagctgccggcggcccggctcgaccttgacgaagggcgggctgggaatcactgcctgctggttgcgatagacgtcctggaaatccgcctgggaccagccgagcacgcgcacctgcagggtcaccggttgcttgccgcgattctccagccacagcgcggtggccggttggtcggcttcgatggccgggttgatcggccagatcagcaccgcactggcggcttgtgccgggccgcccaggaacagcgccagcagcgccgcaagccagcggccggggcggagaggtag

SEQ ID NO: 14039 - DNA, 441 bp, Pseudomonas aeruginosa
cgtggcgggtggaaaatggacggaacagcgaagtgttccgtccgttgttttcagtgtgagtccttgtgttgttcgtcgagcgccttgttctgccagccgtcgttgcccggcagcaacaggttgaggacgatggcgacgatggcgcacagggcgatgcccttcaggccgatgtcgtcggggccggtaccgctgccgatcagcacgccgccgatgccgaacaccagggtcaccgagacgatcaccaggttgcgcgcttccgagagatcgaccttgtgccggatcagggtgttcatgccgaccgaggcgatggtgccgaacagcaggcagaggatgccgcccatcaccggtaccgggatgctttgcaggatcgcgccgaacttgccgacgaaggccagggtgatggcgatcaccgccgcccaggtcatgatcttcgggttgtag

SEQ ID NO: 14040 - DNA, 474 bp, Pseudomonas aeruginosa
tcctggccggtgacgccgcccaccgcgatgaccccgccgatatgctcgatggccggggccaggcccaccgggacgatgaacaggatcgcctgccagttgaattccggcgcggtgaatttcggcagttccagccagggtgcggcgacgatcgcggcggtgtcgaccacgccgaagacgaacgacagggcgaagccgaccagcacgccggcgatgattggcaccaggcggaagatacccttgccgaataccgccaccaccagggtggtgagcagcgccggcatcgagatcatcatcgcggtgcggtacggcagcaactcgctgccgtcgccggccttgcccatcgccatgttcgccgcaatcggcgccatcgccaggccgatcgagatgatcaccgggccgatcaccaccggcggcagcagtttatcgatgaagccggtgcccttgatcttcaccgccaggcccatgaaggtgtag

SEQ ID NO: 14041 - DNA, 645 bp, Pseudomonas aeruginosa
ttcgcactcgaccgccgggggttgcccgatggcgaccggatgagtacctttgccgactttttctcagcccagccagggagaagcaccatgtccgtcgatctcgcgcacatccgccaagtcatggcggaagccgactgcctgttcaacaacgacgaggtcgaggcagccatcggtcgcgtcgccgaggcgatcaaccgcgatctcggcgagaccaacccggtggtcttctgcgtgatgaacggcggcctgatcttctccggcaagctgctcccgctgctcgacttccccctcgaactgtcctacctgcatgcgacccgttaccgcaacgagacctccggcggcgaactgttctggaaggccaagccggaaatctccttcatcgaccgtgatgtgctgatcatcgacgacatcctcgacgaagggcacaccctctcggcgatcatcgacttctgcaagcatgccggcgcacgcgcggtgcacaccgccgtactggtggacaaggaacacgagcgcaaggcccggcctgacctcaaggccagcttcactggcctctactgtgccgaccgctacgtgttcggctacggcatggactacaagggctactggcgcaacgccgcgggcatcttcgcggtcaaggggctctga

SEQ ID NO: 14042 - DNA, 624 bp, Pseudomonas aeruginosa
cgcgccgcgtggtcgccagcatcacaacttccaccgcatggaggagccctgccatcgcatggcggtgggcctccagccgaatacctacatcccgccgcaccggcacctggatgcgggcaaggccgaggcgctgatcgtgctcaagggccgtctcggcctgctggtcttcgccgaggacggggaactcctcgacaagcgcgagttgagcgccgctggggactgccccggtgtcgacctgccgcccggggtgttccatgccctggtggtgctggagccggacagcatcctgttcgaatgcaaggccgggccttaccgcccgctcggcgaaggcgagttcgccagttgggcgcctgccgaaggcagcgccgatgcgccggcctaccgggactggatgcgcgcccagttcgcctgagcgcttcgcttcggcggcgggtcggcagccatgctagagtgccggctcgccctgtccggaggtcccgatgttcgcccgtagcctgtgcggctccctgctcctgtttgtcagtctggccggcctggccgccgagaatcccccgatgcacgcgcgcttcctgccgcccgacgacggccagttgcgccaggaggcgccggagcagcagcaactga

SEQ ID NO: 14043 - DNA, 300 bp, Pseudomonas aeruginosa
gagaaagcgatgcgcaaagacaagaaacagatcattggcgaagagatcagtgacgagtcgatcaagctgttcctcggcgtcgagccggccgacgacacccccccctcgctgcacaagctgatcaaggcctatcgcggtctgcgcatcgacgacttcgagcgcttcctcaccttcttccgcgaggccggctacgatctcgacgcgcgcgacgccaagggcaacgacttcgtcgccctggtcgccgaccagcgccaggccgtgccctacatcgaagcgctgcaggcggccaagggcgcctga

SEQ ID NO: 14044 - DNA, 561 bp, Pseudomonas aeruginosa
cgccttgctggaggacggcgggcgggtcgagctggagttgggcaagaccttctggtcgccctgtttcggtaccctggtggaccgtttcggggtgtcctggatgatcaattgcgaggccggcgcctgactccacaaatgaaaaagccgcccgaaggcggcttgttccgtagcgcggctcactcggcgttgaccggggcctgcacgtcgttcttcgcggtcagttccagcacctcgctgcaacggctgctgacgctgcggtacagctcggcgtcgctttccagctctttctcgcgagccgggaagatttccttcagcttggcgctccactccggcgagcgggcctgctccgggaagcagcgctcgatcaggccgagcatgatcgagacggtcaccgaggcgcccggcgaggcgcccagcagggcggcgatggagccgtcgtgggcggccaccagctcggtgccgaactgcaggatgccgcctttcttcggatccttcttgatgatctgcacgcgctggccggcgacttccaggcgccagtcctcggccctggcttcggggtag

SEQ ID NO: 14045 - DNA, 855 bp, Pseudomonas aeruginosa
tcggggggcgattataacggtgaaaatcaaaaaataccccgctccttagacttttttcccattcccggtcacgaagtgcccgccggcgaaagccccctgggacaatccgccgcgccgtatctgccaaacgccgggcatgcgtgccctgcgccacctgccacaggcgaggaaccgcgccccgtggcgaacgtccaaggcaatgctgcggtgctttcgcggcgccgttatactgccggccattcgtgcccaacccatggagagatgagcatgctgcatcgcctgttgctcagcctgatgaccgcaagcgccctggttctcggcggctgcgccctgagcccgcaacaactggacccgcaaccggtccttaaaggaccgttgaccgcagtcggccatggccagccggtggtggtcaaggtggtcgatggccgtcccggcccgtccctgggcactcgcggcggcctctacgccgataccagcaccctgaccgtccgtagcgaggacgtggtgcccaagctccaggcccaggccgagacggccgtgcgcctgctcggctacacgccttcggccaacgcctacaacgcgccgcaactgatcctgaccctggccgagctgaagtaccagtcgccgaaggacggcgtctacgtcacccaggccgacatcaccgcgaccttccgcgccgacgtgcagaacagcagccggcgctacaccggtcgctatggcgcctcgctgaaccagcgcttcggcatggcgccgaaccaggcgaccaacagcaagctggtcagcgaggtgctcagcgacgccctgacccgcgtgttcaaggacccgaccatcgctcagaccctcggccagcaatga

SEQ ID NO: 14046 - DNA, 663 bp, Pseudomonas aeruginosa
cgcttcgggttacactgtgcggctttccctcaccaggcagtgccaagcatgagtggtcgttacgccctgttccgctggaatccgtcgctggcggccctgccgggctttccggcggattggcgggcgcactggaacatttctccggcgaaccaggtgctgatggttcgcgaggacgccggtgcgcgccgcgccgacctggcgcgctgggggctgaccccggcctggctcaccgacctgtcgcgtacgcccagccacgcgcgggcggaaaccctcgccgagcaaccgatgttccgcgaggcgttccagcagcgccgctgcctgctgccggccaacggcttctatgaatggcgcggggtgcgcaagcgtccgtactgggtttccaccggcgagcgcctgttgttcttcgccggcatctgggaggcctatccggtgcagggacagacctggctcagcgtggcccaggtatcccaggcggccgccgagttccgccggccgctgctgctcgacgaggccgagcaggatacctggctggctccggacacgccgctgccggcgctgataagcctgctcgccaagccccagccgaaactgcgcagcgtggccctggccggcttcgtcaacaagcctgaaaccgacgggccggagtgcctgaccccggcctga

SEQ ID NO: 14047 - DNA, 984 bp, Pseudomonas aeruginosa
ttcaccaggcgccgctgctgctcggccaggcgggtcagctcggcgctggcctgcgaggcctcgtcggcgccgccggccacctggttggcgacctggccgatgttggcgacgttgcggttgatgtcctcggccaccgcgctctgctcctcggcggcgctggcgatctggggattcatgtcgttgatcaccgataccgcctgggtgatcgattccagcgcctcggccgcctggcgcgcatggcgcacgctgtcgtcggtgcgctcctggctgtcctgcatgaccttcaccacgtcgcgggtgccctgctgcaactgctggatcatgctctggatttcttcggtggcctgctgggtcttctgcgccaggttgcgtacctcgtcggccaccaccgcgaaaccgcgaccctgctcgccggcgcgggcggcctcgatggcggcgttgagggcgagcaggttggtctgctcggcgataccgcggatcgccaccaggatcgcgttgatgttttcgctgtccttggccaggttctgcaccactccgaccgcgcggccgatctcgctggccagggcctggatcgccgccgagctgctttcgacgatctgcttgccctggtgcgcggcctggtccgcgtggttggctgcctcggcggcgtgggtggcgttgcgcgccacgtcctgggcggtggcggtcatctcgtggaccgcggtggccaccagttcgatctccgccagttgctgctgcacgccctggttggtgcggatggcgatgtcggcggtgtgctccgaggagtcgctgaccttctgcaccgattgcaccacctggccgatcatgttctgcagtttgccaaggaaggtattgaagcccttggcgatggagcccagctcgtcggcgcgctcgctgctcaggcggcgggtgaggtcgccttcgccctgggcgatgtcgtcgagcatgccgaccaattggcgcagcggccgggcgatgccgtag

SEQ ID NO: 14048 - DNA, 363 bp, Pseudomonas aeruginosa
aacatcaggatgcgccagaacacctggcgaatggcgatcgggatgttcttccgcggattttccgattcaccggcggcgatgccgatcagttcggtgccctggaacgagaagccggcgatcatcgccaccccgaccatcgcctggaagccgccgacgaagggcgcgtcgcccatggtgaagttgctgaagccgggcgactccacgccatgcatgatgccgaagatggtcgccaggccgacgccgatgaagatcaccaccgtgactaccttgatcagggcgaaccagaattcgctctcgccgaagccgcgcgcggaaatcacgttgaggccgaacatgatgcccaggaagatcgcgctccagtag

SEQ ID NO: 14049 - DNA, 816 bp, Pseudomonas aeruginosa
gaaagcagcgcaccgccgggcccggcggtggccacggtggccccggaggcgacgaacagcccggtgccgatggagccgccgatggcgatcatgttcaggtggcgcggcttgagcacccgccgcaattgctggccctggctggcgttcaggtcagtcatcggcggcctcccggcgggtggccacggaagggtctggctgcgggcgtgcgggcagggagaggaaaagcttcattcacagggttccaggcagaaatcaggagcgacgggcggagtagatgcggaaaccgtcgccttcggcgagtgtccggcaggggccgaggtggcgttcgatcaacggcgggtacttcaggaagctgttggcgaccaggcgcagttcgccgcccggcgccaggtgctcggcggcgcgttgcagcaggcgctcggaggcctggtagtcggtgtgcacgccctggtggaagggcgggttgctgacgatcgcggcgagttcgcgcggcgcgccgtcgatgccgtcggcggcgatcacttcgccgtccaggccgttggcggcgagggtcagtcggctgctctcgacagcgaaggcgtcgacgtcgagcaggctcaggcgactggcggggtagcgacgcttgaggaccgccccgagtaccccggcaccgcagccgaagtccagcagatggccgccgggcagggcttgcagttgccccagcagcagcgcgctgccgcgatccaggcggccatggctgaacacccccggcaggctcaccacctgcagctcgccatcggtcagcggcaggctgtagcgctgggccagggcgtgtag

SEQ ID NO: 14050 - DNA, 831 bp, Pseudomonas aeruginosa
caaggcggtgctcgagtcctattaccagcatatgctcggcaagcaggtgtccctggccgaactggtcgacctggccaaccgcctcaccgccaagtaccgccaggacggctacctgttgacccaggtagtggtgccggagcagagcatcgagggcggcaaggtacgcctgcaggtgatcgagggttacctcgaacacgtgcagatcaagggaaccgtcgatgggccgcgggtgcgagtggaggaactgctcgcgccgctgaccgaaaaacgtccgctggatgccgataccctggagcgcggcctgctgctggtcggcgacctgccgggggtcaacgtgcagagcgtgctcagcccgggtcaggcgctgggctcgtcgaacctcgacgtggccttgcagcagcagcgatacgaaggcttcgtcagcctcgacaaccgcggctcgcactacaccgacccgaccaccctggccttcggcgccaccgagttctcccgcctgggcttctacgagcagatcgacgtactcggcgcgatctcgccgttcagcgatgccacccgctacatccagttgcgcggtacgttgccgctgggtggcatgttcgccggcgataccctgcagatcatgggttcctattcgaaggtcaacccggacattccggactcggtattccccttcgacagcgtcagcaagagcaccgaaggcagcatttcctacaaccatcccttcatccgctcgcgctcgcagaacctgagcggcggcctggcgttgcagtggaaggataccgagacccgcctgcgcgacttcgccagcgacgcctcgaaccccggtcgtga

SEQ ID NO: 14051 - DNA, 411 bp, Pseudomonas aeruginosa
cgaatacctggagccactgccatgaaacgcccgctgatcctcgccatcgcccttgctaccctgaccgccaatgccgccttcgctgcaccgcgggtcgaatccatcgccctgcgcggtgcccaacaactgatcgcctccgacggttccgaccgtaccctcgaacgcctgcgcaagacccaggcgccgcgcgtccaggaagaacgccgggtcgccgaaagcggcagcgagcagaccatcgatcgcttgcaccgcgacatgaccagccgcgaggcgcgcctggccgagaacggcagcgaacagaccgtcgaccgtctgcacaaggacatggggcgcgtcgatctgcgcctggccgacaacggtagcgagcgcaccgtcgaccgcctgcatcgggagatgcggcgccccgcctga

SEQ ID NO: 14052 - DNA, 1566 bp, Pseudomonas aeruginosa
caccgcggatcacgccgcaaggtgcgagaaaagcccggctcgatgccgggctttcttattgccgagaaggtgcggtgttccatggggaggacggataacgccccaggcgttatcgccgatacgccgctgtcggggcagcgacgcgcgacggcattggcctcagtgcaggcggtcgcgttgcgccaggctagggaacagcttcatccatgctccggtgaccaccagggtgccgatcccgccgaggaccactgccggtaccgtgccgaaccaatgtgcggtgagcccggactcgaactcgccgagctggttcgaggcgccgatgaacaggccgttcaccgcgctgacccggccgcgcatctcgtcgggggtttcgagctgcacgaaggcgccgcggatgaccatgctgaccatgtccgcggcgccgagtaccaccagcacgccgagggacagccagaacgatttcgacaggccgaaggcgatggttgccaggccgaagatgcccacggagaggaacatgatccgcccgacgttgcgttcgatgctgaagtgcgccagccagaacgacatcgccagggcgcccaccgctggagccgagcgcagcaggccgaggccccagggcccggtgagcaggatgtccttggcgaacaccgggagcagggcggtggcgccgccgaggagcacggcgaacaggtcgagggagattgccccgaagatgtccggtcggctgcggatgaaacggatgccggcgagcagcgagtcgagggtggccttgccctgggtgagcggctggttgcgtaccggcaggctgagcgtcaggacgcacgcgaggacgtagagagtcgcggtcggcacgtagacccaggaggcaccgaacgcatagagcaggccgccgagggccggggcggcaatggtcgccgcctgcatcgccgaagccgaagcggccaccgcgcgcgggaacagcccggccggtaccaggttcggcagcagcgcctgggtggtcggcatttcgaaggcgcgggcggtaccgagggcgaaggcgaggacgaagatcatgttgcgggtgatctctcccgaagccgcgccgagcacctgtgccaccgccaccagggcctggccggcctggcagagggcggcgattctgcgtcggtcgtagcggtcggcaacatgcccggtgtggagcatgaacagtacccgcgggaggaattcgaccaggcctaccaggcccaggtcgaggacattgccggtcagttcgtagatgtgccagccgatggccacggtgagcatctggaagccgctggcggtgcagacgcgggccagccagaaggcgaggaagggacgatggcggagcagggagctgggttggctggacatgctggggtcgggcgtttcgagaggagggcggagagtaacatgtggttacctcttggctgttgccattgccgaaatcgaagattcagagaagcgcacgaaaaggttggagccggcctggcaggcgaccaaagtcgagtgtccatgggtccttccagcggtagacgggacttttcctcgggtgcgacttgtcgctaa

SEQ ID NO: 14053 - DNA, 2676 bp, Pseudomonas aeruginosa
cgacgccttgtccaaggtctgcggcaacaaggtgttcgcccgcgatatccgcgccagggacatgcccggctggccgcagcagcaaggccacgccatgttgctgaagaccgttcgcgccgaccgcatctacgaaggccacgacctttcctggctgggcgccgagttgcagccggaccgtatcgtcaccgccgccgacctggagaaggacggcatcgtcttccccgaggcgcattcgcccgatccgctcctgccgccgggcaaggtgccgatgttcatcggccatccggtggcgatcctgatctggaacgacttcgagcgcttccgccgggccaagctcaagctcaagttcaacgacaaggcgatccgctatggcgcccaggccccgctgtaccagggcgatccctacggcagctatcgcttcgtccgggtcggcggcaagacgccctacgaggacgacgagttctccagcctgaaggactcgatgctgttccccaccatcctcaaccgcaaaccggtatggaccagcgagccgaagctgcacggcgacctcaccgagcaggggctgttccatgccaagcgcatggccgagcaactggaaaacccgccgcaggactggctggtcttcgacgagcgctacaagaccccatcgatcgagccggcggcactggagccggacaacggcaacggctggtacgacgcggcgagcaagaccttgcacttcgtggtcgccacccagtgcccgttcgaagtcgcctacgaaagcgtgcacatgatcaagccgtcgcgcttcgccctggagaagttcaacatccatccgggctataccgtcggctacggctccaaggacaacaacatcttcgtcttctatgccgcgctcgccgcgctgtatggcgagggtgtgccggtgcgcctggccaacgaccgctacgagcagttccagagcggcatcaagcgccacccgttcgacatccgctaccaactggcggtagacaggaacgacctcggcttccgcatcttccgcgccgacatgagcgccgacggcggcgggcgcgccaactacagcgcctcggtggcggcggtgggcgccaccgccgcgcagtcgatctactacatgccgcagaacgacctggcggtcaccgcctatcattcgcgcggcgtggaggccggctcgatgcgcggctacggtaccctgcagaccatggccgcgaccgagatgatggtcgacgagatcgctggccggctgggcgtcgacgccatcgacctgcgtcgtcgcaacgccctgcgctcgggcatgaagaacacccagggcgcggtcccggccggtgccctgcgcctgcacgagatcctcgacaaggccgctgcccacgaggtctggaaggaccgcgacgcacgcaagaagcgcttcgacgcggaagacccggacaactggtatggggtcggcttcgccatttgccagaaggacttcggcaccggcgccgaggcgccgatggcgagcatcgagttcagcgccgacgggcgcatcagcctgcgccacatcggcaccgagatcggtaccgggatgtccacctcgcaggccttcgtggtcggcgacttcctcggccgtccggcggacgaggtgaagaccgccgagaccgaatggcccgagctgcggctcaccaccaagggcaatccctacctgatgagccaggccgagcaggacgccgcgctacgcgatccgcgctgggtcggcaagctggcctcgccgtcgtcggcgaccaactcggcgttctatttcagccacgccacccgcgaagccgcgcgcgtgctgttcaaccacggcctgtggccggcggccctggagctgtggcgcagcggtccgttcggcggccaggccaatccctatgtggtgcgccgcgaaaacgcggtatgggtcgacggccagttgaccggcaacggcctggcgccgattcccttcaccgagctggcgaagaaggcccacgagatgggcctggtcaccggcgtcagcgtccacggcttcaaccgctggagctgggccgaggcggacttcgtcatcgatggcgtgcgcgagcgcctgccgctcgacgccatggcggtgaagtacggcgacggcgcgccgggagtgaagaaggcgatgatgaacagcgccggcttccacctgctcgaccggcagaatccggcttatccggcgacccagctgaacaacgcgatggtcacctactacagtccggtggcgaccctggtcgagctgaaggtgaacaagggcagcggcgaggtgcaggtgctcgaccaccattcctggatcgagtgcggccgggtgctggtgccggagctggtcaagggtcagctggagggcggcatcgccatgggtatcggccatgcgctgctggaggaaatgccgctctacgagggcggccccgcggaaggggactggaacttcaaccgctaccggttgccgcgggcgaaggacgtggcggcgtggagccagacggcggagatcctcccgccgctgtcgccgaccgacccggccaagggcatcgccgaggtggtgatgatcccggtggtcggcgccatcgccaacgccgtggcgcacgccaccggcaagcgcgtccgcgacctgcccatcactcccgcccgcatcaaggaggccctccatggctaaccgcaagctccagatga

SEQ ID NO: 14054 - DNA, 1269 bp, Pseudomonas aeruginosa
acccgatccagcagaagttcgtcgaccagttcgccttccagtgcagctattgcgcgccgggcttcgtcaacgccgccaccgtgctggtggaaaaagcccagcgccagccgatcaagcgcagcgagctggagcaggcgatcgaggacagcctcggccatcacatctgccgttgcaccggctacgtgcgctactacagcgccacccgcgacgtgctcgacgaactcggcctggtcaaggaggcttgaggatgaagcggaccctttccggcctcgccctggcgctggccgcgctgtcgccgttcctggcctccgccgccggcgccgacgcggcgctggtcaagcgcggcgaatacctcgcccgcgccgccgactgcatggcctgccataccgccgagggcggcgcgccgttcgccggcgggctgccgatccagtcgccgttcggcaccatctacggcaccaacatcaccccggacaaggaacacggcatcggcgcctacagcgccgacgagttcttcgccgctcttaccgagggcaagcgcaaggacggcgcctacctctatccggcgatgccctacacctcctatcacctgatcgagcgcgaggatgccgacgccatctacgcctacctgatggcccaggagccgatcgcccggccggcgccgcagaccagcctgagcttcccgttcaacgtgcgcatgggcctggccggctggaacctgctctacggcaagagcgtgcgcttgcagccggaggaagggcgcagcgaggcctggaagcgcgggcagtacatggtcgaggtgctcggccactgcggcgagtgccataccccgcgcaacctggccggcgccctggagcaggacaagcgcctgagcggcggcctgctcaacggctacctggcgcccagcctgctgcccggcgaccttgccgcgcgcggttggacccagccggacctggcgagcttcctcaagcacggcatgagcgcccagggcagcatgttcaacgagatgttcccggtggtgcaccacagcacccagcacctcgacgacagcgacctggcagccatggccacctacctgctcggcgaccagccgccgccggccaaggtggtccaggcgctgcccgaggcgcagctgaacgacagcggcaagcgcggtcgccagcagtacctcaacgtctgcgccggctgccacggcggcgaaggcgagggcaagccgcatatcgcggtggcgatgaacggcaacactaccctgcgcctgcaagacccgcgtaa

SEQ ID NO: 14055 - DNA, 1089 bp, Pseudomonas aeruginosa
acgcgacggcgagtgcgtgcgcttgcgcgtcggcgctgcccagcgcctgctgctggccggctattccagcgtcgcccatgcctgcgccgagttcggcaagggcctgggcttcgaggtgatcctctgcgacccgcgcgaagaagccttgcgcggcgtgctgctggagggcatcgagatccgtcgcgagctgccctcgctgttcatcgccgacggcggttgccacgccgatacggcggtggtggcgttgacccacgatccgaagatcgacgacctggcgatgctcgaggcggtgcgtaccgaagccttctatatcggcgtgatgggatcgcgggcgacctcggagaaacgcttcgagcgcctgcggcgcatcggcggcctgggcgatgccgaactggcgcggatccacgcgccgatcggcctcaacctcggcagcaagacgccggcggaaatcgccctggcggtgctggcggacattcttcgcatccgcaacggcattccccgcgagcggctctgatggtcgccgccgacgaggtgctgtgcctggtcctggcggccgggcaggggcgccgcttcggcagcgacaagcgcctggcgcgcctggctgatggcacgaccctgctggcggccagcgtggcgcgggcgcgcgaggcgttcgccgaggtgcgggtggtggtgcgtgccggagacaccccggcgagcctgggcctgccggcgcagcagcggcttgtccacagcctcgatgcatcgttgggcatgggccacagcctggccgccggcgtcgcggcggcgaggaacagcacggcccgggccatcgccgtcctgctcggcgacatgccctggatcgccgccgataccctcgagcgtctggccgcgatggccactcccgaagccatcgtgtttcccctgtacgacggtcagcgcggccatccggtgctgttcggccgcgctttctgggacgcgcttgcgcaactggacggcgaccagggcgcgcgccgtgtgctgcaggcccatcgtccggcctggtgcgaggtgccgtgcgacgatccgggcgtactccgcgacgtggacaccccggcggcgctcggctga

SEQ ID NO: 14056 - DNA, 429 bp, Pseudomonas aeruginosa
ctattttcccgctttcaggatcacgaacttcggattcgccgcgacctgctcgaccccgcggaacagccgcttgagcttggcgtggtagcccaggtggcggttgccgacgatccacagttcgccgcccgccgccagggcatcgcgagcctggagaaacatgcgccaggcgaggaagtcgccgaccacctgctgctggtggaacggcgggttgcacaggaccaggtccagcgagcccgccgcctggccggccaggccatcgtcggcgcggaacgtcgccggccgctcgcccagcgccgctcgccagttttcccgcgccgactgcacggccatgtacgactcatccaccagggtcagctcggcctgcgggttgagcagcgcgtaggcgatgccgagcaccccgttgccgcagcccaggtcggcggcgcgtag

SEQ ID NO: 14057 - DNA, 1122 bp, Pseudomonas aeruginosa
cccggtagcgcctggacgggcgccttcgccacttcgagcggtgaccgtcacccaacccgtttcccgaacgagacccgtgcgagccgtcgcggggctcgtcgttgccatcgcacaggtacatcgatgttcaagccgtttgtcggtgtggcgctcgccgcactgttcgccgtttccgccgtcgcccatgccgaggacgccggcccgatcgtgatcaagttctcccatgtggtctccgacgacacgcccaagggcaagggggcgctgttgttcaagaagcttgccgaggagcgtctgccgggcaaggtcaaggtcgaggtctaccccaactcgacgctgttcggcgacgccgacgagatcgaggccctgcgcgccaacaaggtgcagatgctggccacctcgctgtccaagttcgagccctataccaagcaactccaggtgttcgacctgccgttcctgttcgatgacctggaggccctgaagcgtttccagaagcgcgacaagagccgcgaactgctgcgctccatggccaagcacggtatctatggcctggcctactggaacaacggcatgaagcagctttccgccactcgcgagctgcaccggccggacgatgccaagggcctggtcttccgtatccagccgtcgtcggtgctggaagcgcagttcgccatgctcggcgccaccgccaagcagttgtcctacgccgagaccctcaaggccatgcaggccggcagcgtgcagggcaccgagaacacctggtcgaacctcgccggacagaagatcgacagcgtgcagccgtacatcaccgagaccaatcacggcgcgctcagctacatgctgatcaccagttcggcgttctggaccggcattccctaccagacccgcaccgaactggagagcatcgtcgacgaggtcaccctggtggtgaacaaggaagccgaagcgctcaaccagaaggagcgcgagcacctgctggcagccggcaagagccgcctggtcagcctcagcgcggaagagcacgaggcctggcgcaacgccatgaagccgctgtggaagaactacgaggcgcagatcggtagtgacgtgttgcgcgcggcccaggtggtcaaccgcaagcgctga

SEQ ID NO: 14058 - DNA, 690 bp, Pseudomonas aeruginosa
cagcgactacggcacgggcctggccaaggtggccggggccgatctgcagcgcgtccggcaactggcggcgaagctccaggattgatcgcaaccggggcggccatccaggccgcccttcctctatcggtttggtgggagatgacgacgatgcgaggttggattctggcaggcttgctgctcgcggcgctggccgcgcaagctggcgaggtgcatggggtcgaggtcgaagcgcggttgcgcgactacttcttcgatgccgcccgacgcggtgaccaggccatgctgaaggagttcgtcgaggccggcttcgacctcgatgtgcaggatgccaagggctataccgggctgatcctggccgcctaccacggccatggcggagcggtggaacaattgctggaggccggtgccgacccctgcgtccaggatgcgcgcggcaacaccgccctgatgggcgccatcttcaagggcgaggtccgcatcgcccggcgcctgatcggcgcgcaatgcagccccgaccagcgcaacggcgcagggcagaccgcggccatgtacgcggcgctgttcgagcgcgaggagctgctccaggcgctgtcggcgcgcggtgccgaccttggcgcccgcgatgcgctgggcaacagcgtggaaagcctgcgacgcggcgaactgaacggcactgcggcggcgaggtga

SEQ ID NO: 14059 - DNA, 1971 bp, Pseudomonas aeruginosa
aaaagggcgcctccggcgccctttttcatgtgggcatgctcagaaggcgccgccgaaacggaaactctgtccgaccgcgacgaaacccaggcccaccagggtgatcgcggcgatgtgccagcccagcttcggcaggctctcggcgtccaggttcgggatcaggcgcaggcgcgcatgcacgcccagggcggcggtcgccgccaggagcagcagcttgagctgcagggcacgggccaccgacgtggcgccgaaccagtggtcgaacggcagccacaggctggccagccacaggccgctgaccacctgcagcagcagggcggggatgccgatccgctcgtagacctgctcgaaggcgcggatcgcctggggatcgcggcggcgcagggcgccggggaggatgccgagggccaggaccaggtggccgccgacccagatcgcggcacccagcaggtgcaggaacagcagtgtgcgcatggaagtctccttgtccggccatcagtgtcgcgcgaagcgcggtcgatcgaggctgatcggaatcaagccagcggctatcatctgcgctttgcccgcgagaggagttcccatggccaaggccaagcgcatgtacggctgcaccgagtgtggcgcgaccttcccgaaatgggctggccagtgcgcggactgcggggcctggaacaccctggtggagaccgtcgtcgaggccgcgccgagcggctccggccgcggcggctgggccggccagcaggccaacctgaagaccctggcggaggtcagcgtcgaggaaatgccgcgcttcacgaccggctccaccgaactggaccgggttctcggcggcggcctggtggacggttcggtggtgctgatcggcggcgatcccggcatcggcaagtcgaccattctcctgcagaccctttgcaacctggccagccgcgtcccggcgctgtacgtcaccggcgaggaatcccagcagcaggtggcgatgcgcgcgcggcgcctgtcgttgccggaagacaagctcaaggtgatgaccgagaccagcatcgaaaccatcatcgccaccgcgcgccaggagcagccgcgggtgatggtgatcgactcgatccagaccatcttcaccgagcagttgcaatcggcgccgggtggcgtcgcccaggtccgcgagagcgccgcgatgctggtgcgctatgccaagcagagcggcacggcgatctttctggtcggccacgtgaccaaggaaggcgccctggccggcccgcgggtgctcgaacacatggtcgacaccgtactgtatttcgagggcgaatcagacggccgcctgcgcctgctgcgggcggtgaagaaccgcttcggcgcggtcaacgaactgggagtgttcggcatgaccgacaaaggcctgaaggaagtgagcaacccttcggcgatcttcctcacgcgggcccaggaagcggtgcccggcagcgtggtgatggccacctgggaaggctcgcggccgatgctggtggaggtccaggcgctggtcgacaccagtcacctggcgaatccgcggcgggtgaccctgggcctcgaccagaaccgcctggcgatgctgctggcggtgctgcaccggcacggcggtatcccgacctacgaccaggacgtgttcctcaacgtggtgggtggggtcaaggtgctggaaaccgcctccgacctggcgttgatggcggcggtgatgtccagcctgcgcaaccgcccgctgccgcacgacctgctggtgttcggcgaggtcgggctgtccggcgaggtgcgtccggtgccgagcggccaggagcgcctgaaggaagccggcaagcatggtttcaagcgtgccatcgtacccctcggcaacgcgccgaaggaggcgccggcgggattgcaggtgatcgccgtgacgcgcctcgagcaggccctggacgccctcttcgagtgacccgcctcagtcgtcgtgggcgctga

SEQ ID NO: 14060 - DNA, 2115 bp, Pseudomonas aeruginosa
aattttcgctgcagaactgcgccctccatctgtcggaagccaaacactatgaacaataacaatagcctgctacgtcacctcgcctggctggtggtggcgatcgtgggcgccgcggccctgggcgtcgtcgccctgcgtcgtggcgaagcgatcaacgccttgtggatcgtggtggcggcggtggccatctacctggtcgcctaccgttactacagcctgttcatcgccagcaaggtgatgcaactggaccccaaccgcgccactcccgcggtactcaacaacgatggcctggactacgtcccgaccaacaagcacatcctcttcggccaccacttcgccgccatcgccggcgccggtccgctggtcggtccggtccttgccgcgcagatgggctacctgcccggcaccctctggctgatcgccggcgtagtcctcgccggcgcggtgcaggacttcatggtcctgttcatctccagccgtcgcaacggccgctcgctgggcgagctggtgcgcgaggaaatgggccaggtggccgggaccatcgcgctgttcggcgccttcctgatcatgatcatcatcctcgcggtgctcgcgctgatcgtggtgaaggctctggccgacagcccctggggcatgttcaccgtcctcgcgaccattcccatcgcgctgttcatgggcgtctacatgcgcttcatccgccccggccggatcggcgagatctcgatcatcggggtgttcctcctgctcggttcgatctggctcggcgggcaggtcgcggccagtccggaatgggcgccgcatttcaccttcagtggaatccagatcacctggatgctgatcggctacggcgccgtcgcctcggtactgccggtgtggctgctgctggcgccgcgcgactacctgtcgaccttcctcaagatcggcaccatcatcggcctggcgatcggcatcctgatcgtcatgccggaactgaagatgccggccctgacccagttcaccgacggcaccggcccggtctggaaaggcagcctgttcccgttcctgttcatcaccatcgcctgcggcgcggtgtccggcttccacgcgctgatctcctcggggaccacgccgaagctgctcaaccgcgagcccgacgcccgctacatcggctacggcggcatgctgatggagtccttcgtggcgatcatggcgatggtcgccgcctcggtgatcgagccgggcatctacttcgccatgaacagcccgccggcggtggtcggcgccgacgtcaacgcggtggccgcgaccgtcagcagctggggcttcgccatcacgccggagcaactcacccagaccgcccaggacatcggcgagaccaccatcctggcccgtgccggcggcgcgccgaccctggcggtggggatcgcgcacatcctccaccaggtgctgccgggcgagaacaccatggccttctggtaccacttcgcgatcctcttcgaggccttgttcatcctcaccgcggtggacgccggcacccgtgccgggcgcttcatgctgcaggacctgctgggcaacttcgtgccggcgctgaagaagaccgagtcgtggaccgccaacatcatcggcaccggcggctgcgtggcgctgtggggctggctgctgtaccagggcgtggtcgacccgctgggcgggatcaataccctgtggccgctgttcggcatttccaaccagatgctcgccggcatcgcgctgatgctcgccaccgtggtcctgatcaagatgaagcgccagcagtatgtctgggtcaccatcctgccggcggcctggttgctgatctgcaccaccaccgcgggcctgatcaagatcttcgacagcaacccggcggtcggcttcgtcgctcttggcgagaagtacgccaccgcgctggatgccggccaggtgctggcgccggccaaggatatcggccagatgcagcacgtggtgctgaacgcctacatcaacgccggtctgaccgtgctgttcctgctggtggtgttcagcgtactgttctacgccatcaaggtcggcatcgcggcctggggcaagagcgagcggaccgacaaggaaaccccgttcgagcccatccccgacgcctga

SEQ ID NO: 14061 - DNA, 252 bp, Pseudomonas aeruginosa
ccggccgcgctccccggttcgccggggagccttaacgaggaactcgccatgttcaacgacctcagccgcatgggcaaatacctgggccaggccgcccggatgctggtcggcatgcccgactacgacacctatgtcgagcacatgcgcaacaagcacccggacaagccggtgatgacctacgaggagttcttccgcgagcgccaggaggcgcgctacggtggcggcaagggtcggccgatccgctgctgctga

SEQ ID NO: 14062 - DNA, 477 bp, Pseudomonas aeruginosa
tcgtgttcatcggcgacaacctgccggaggacagtatccgcgagggcttcgaacgcatcgtcgaaggccgctgaggcgcatcgacgccaaaggagcgtggaaatggacaggaacgcattgatcggcgcctggcgggactgcatccgtggcgcggacaaatcctgggtgctgttcgcccagggcacttgcgtgatcctcacgcagccggagccggacctcgcggcccaggcgcgggcattgctggccgagtggggagcggtacaggtcggcacgccggcgggcgacttcggtgtgatcaccctggacaacggccgcggctgggtggtgaccgggcatcacccggacatccttaccttcgtccctcgcgaggaactggaggaggacgccggcgagctgctcgtcggcatgcacggccgctcccggcggggcgaggatgccgaggccttggcggtgatccatgtcgaggaccggcgataa

SEQ ID NO: 14063 - DNA, 765 bp, Pseudomonas aeruginosa
tcgaaaaacttcgagagctgccgggcggcgtacttccgagggcatgggagacgcgatttgcactgtgcgctcgtctacaatagccgacaaatccagccgagctcattcatgtccgataccgatgtccgtggcctgcaggatcttcccctggaagaactggttgcttgccatgagtgtgatctgttgatgcgccgggaacccctgggaccgggcgagaaagccaattgtccgcgctgcggtttcgagttggccgcgcatcgccatcaatggaaacgccgttgcttcgcgctggttctgacggcgctattcctctatatcccagccaatttcctgccgatcatgaatctcagcctgctcggccagacccgcagcgatacggtctggacgggagtgctcggtctttacgacagtggcatgcagggcgtcgccatcctggtattcctgtgcagcatggtgatcccgttggtcaagttgctctgccagttgctggtgatgatcagcgtgcgtttcggtatcgcccgtcacatcggcatgctgctctaccgcggctatcaccatctgcgcgagtgggggatgctcgaggtctacctcatgggtatcctggtttccatcgtcaagctgatcgacatggccgacctcagcctgggcatcggcctggcctgtttcgtggcgctgctgttcacccaggtctggctggaggtcaccatgtcgccgcaccaggtatgggaagcgctgggcggcgaggacgacgatgcgcgcgcttga

SEQ ID NO: 14064 - DNA, 2388 bp, Pseudomonas aeruginosa
gcagggtcacgccgaacatcagccacagggtgttgcccagcaagcggaatacgtaggggcgccagagcagttgccaggcgatgtgccagccggcgtcccaggccttggccgcgacgtagagcagcggcaggctggccagcagggcgaggagcaggaccggcaggaacagccagaatggcgttcgccggcgcgagcccgtgcgcaggcgcacgggcgtggaggcggcgccgatcaattcaggccaacgtcgcgttcgaggctgagggcctcgctggcctcacccaggtcggccggggtcagtttcggtgggtccagttcggcgaacggcttcagcgccggatcggcctgcatccccttgcgcatcgggtactcggcggactggctgaggatcgccttctggccttcctcgctgagcatgaaggcgacgaactgctgggcttccctggggtgcttgctggacttgagcactgcggcgccggagacggtgaccagcgcgcccgggtcctggttgccgaagtagtgcaggcgcgagttcaactcgcccttttccttcttcagggtgtaccagtagtagttgttgatcagcgccatgtcgacctcgccgttctccacggctttcatggcggtgacgttgttggtgtagatcgagccgaaggcattcaggccggtcagccaatcctcggcttcctcctggcccttgagcttgatcacggcggcgacctgttcgaggaaggcgccactggtgggcacgaagccgaaacggccggaccaggacggatcggaaagatccatcaggctcttcggcagatccttctcgtcgatcttcttcgggttgtaggccagtacccgggtgcgggcggtgatgccgatccagtcgccgttgccgccggcgtgctccggctcgaccagggccagggtctctggctccagcttggccagcaggccggcgctggccaggcggatcaacggtggcgattcctcggtgtagagcacgtcggccggcgagcgcgcgccttcctcggtgatctggctggcgagctggccatcgccgcccttgcggatcttcacctggatgccggtcttgtcctggaaggccttggcgatggcgataccggtggcggcgtgctggccattgtagagggtaagggtgacgggatcggccgccgcattgagggaaagcgaaccgagcaggcacgccagggcggcgtggcggaaacggttgagaagtcgaacaggcatggattctccccgtgggttacaaatgcgaatgtaaccaattatatcttcgcgggagcttcgggcctatcggaaaagtccacggccctgtcaggcagggccgtggcagacgcttcacgccggttcgccggcttcctccggctcgctggctgcgcgggtttcgccgctggcggcggcatcccggcgacggatgtatttccagtccgcttcgtcgatataaatgccgttcgggccgctaccgccttccaggtcgatcgccacgtgtgcggaaacctgcggcttcacgctcgccaggatcggcacgaagcccagttgcaggctggtctccagcagcgcggcctggttgcgctcgtcgatgtccgccgcctcgtccaggtagtagggcaggcgcacgcgcccggcctgctcgcggtccatcaggtgcagcaacaggtacatgttggtcagcgccttgatggtcatggtggtgccgttggaggcggcgccgtcgatgtcggtgtgcatgatcggctggccgttgaccttggtgatctcgaaggccagttcgaacaggtccttcaggcccaactggttgtggttggcggcgaccaggcgggccaggtattccttggcctcctcgttcttcgcgtcctgctcggcgctctgggtcaggtcgaacaccgagaggttctcgccttcctcgtactggccggcgctgtggatgatctggtcgatgtgcttgagcgcatccttgttcggcgcgaggacgatgcggaagctctgcaggttggaaacctggcgcttgttgatctcgcggttgaacagggccaactggtgttccaggttgtcgtagtcgctgcggatgttgcgcagggtccgggcgatgtcggtgaccgccgcgcggcgcgccttggccagcgtcagggcctcgtcctggcgatgcgcgtaggcgttgatcaacagcttcaggcggcgctcggtgtcgtcttcgctatcgaacttggcgacgcccttcaggcgcacctgggcgtacagcgcctcgatctgcccgtcgatgcgctgcagcgcctgccaggtgtcctggtagtcgttgagcagcggcagcaggttgtccagcgagtcgtccaccggctccatgaacggcgtgccgaagggcaggtcggccggcagtag

SEQ ID NO: 14065 - DNA, 1311 bp, Pseudomonas aeruginosa
aaggcggtgcatcttgccgcgcagtacgtcgcgctgggtcacgccgttggccagggcttccaccagcgggccggcggcgaccagcgcctggtagtcctgctccatccgccgcacgtcgcggaaggcctcctcgcaggcggcgatgtagtcgacattacccgagcgcaggctgtgctcgaaggcgtcgaggaacagctgcttgagcttggccgcggtgatctcgcgcatgtgcagcaggttgatgaacagcgagcggaaggtcttcaggctctgctcgctggtggagcgcagcgggatcatggtcaggtcgagcgggatcgacgtgtgcccgccgaccagcaggcggcgcagctcttccggcttcacctcgtaggccttgaagccttcgcgctcaaggttggcgaacagctcgcgctggcgcaggcaggtaccgttcttctggtagtggtccaggctcagctcgccggcgtaggcgaagaactggtggccgaagccgccgcccgggccgcgcccggccacgccgatcacgtgcggaccgtggggcagcatcagttcgaggaggatgtagctggtgtccgaggcgaagtagaagcgccgcgactgctccatgctgtacttgccgaagctcatgtccgacaggcgggcaaggatcgggaactgcagggcgttgatcgaggcgctcttgcccaggttgttggcgccgtagatcgacagcgggttttccagcgggaagatacccaggctgtagccggcggtattgagcagggcgaagcggcggatgccgtagcgggtctggctcatgcgtcagcctcctgttgcgcgtgttcttcggcgatggcgcgggcgagggcgtcttcctcgctctcttcggacaattcttcgtcgctggccatcagcggttcgatctcgccgtcatcgaccagcaccggcgtctgcaacggcaggtcggcgtgcaggctggcggacaggttgcggtcctgctgcaccgacaggcagacgtctaggaaacggtgcatcggcggcatgaagcggtacacgccgctgtcctcggaggcgaagccgagctgggtcaggcggcgcatgaccttctcttccagttcttcctgggtctgcacctcggcctggaggaacaggtcgcggtatttctccagcagcggcggcagctcttcgcggccgatgctgccgccgtccagcacggacagcgggtcgcggccctggtcggcgaggtgttcgacgaggatgaaggtgaacagcgccaggcgttgggcggtcttgttcacctgggcgccgacctgctccgggacgaagtag

SEQ ID NO: 14066 - DNA, 411 bp, Pseudomonas aeruginosa
ccagctggatcatcggctcgacgtactcgtcccaggtcgccaggacctccgcgtagcgctgcgccaggggaatctgccggtcgctggtcttggcccgctcggccacgccgatcagtgcctgctcgtcattgccgagcttcttcagtacatcgcgcacgcgcatgtcgagcagtcgcagctggcgcgccaggtcctggctgtcgcgggtctcgaaggcgtcctggatgtacccggcgaggcgctccagatggcgcaggtaggcctcgatctccaggcacagaccaaggcgatgctcgtggcgcaggtaggcgaggaagtcgtggatctgcgcgttcagctcgaaacggttggggctcttggccaccgggaccaggatatccaggcggatccactggtcgagcagggcggtga

SEQ ID NO: 14067 - DNA, 705 bp, Pseudomonas aeruginosa
ggactttcctgccccgcctggtccggggaatggggcttccaggggctggcacgctttctgctgaagtcccctggcctgtctattccaaatgaatgccgactcttgaacgacgccgcctacgccgaggcccgctgggccgaactgcagaaccagggtgaccttgcctgggacctggatgccatcaccaaccgcagcgaggcgatcgccttcctcaaacgtttcgagaaccgcctgtgcatctactcggcctatgtcgagaagctctacagcaactacagcttcgtgattcccgagagcgaccatggcggcatcaccatcctgcccagcgagcaggcctggcacgacaccttccacgatatcccgctggccgcggtggagcccaccgggatccatatcctgccgggcgagaccatgggctatcgcgggctctacctgaagattcccggcgagcaccgcctggtggcgtcgaaggaattgccgttccaggaagggttgaaactgctgatccagcgttaccaggctcacgacgacgtgttcctgccgatcctggtcaagggcgacctgcgcgagtacgaagcgcgcatgccctcgctacacctgcaccggatcaaccccgcccgcctcagcgcacactccctgctcagcctcaacgccatcaagggcgccatcgccgaccatctgatcggcctgttccgccagcagtga

SEQ ID NO: 14068 - DNA, 1101 bp, Pseudomonas aeruginosa
ctacaggtcgcagtgtctctgccgtcggccacgagaagaacaagaggtgagcccatgtcccgtcgtctgcccttcctgctgcgttgcgcgctgttctgcggcgccggtctgctggctgccaccgcccaggcgaggatggagtcgctggacgacgaccagctttccgacgtggtcggccaggccttcatcaacctcaccaccgacgccgccaacggactgaacttcacccgcatcaacttcggcgccgacatcgagacccaactgaacatgaagaagctgcagttgggccagtacaaccgcagcggcgagcttgccggcagtgccgacatcgccatcgacaacttcgccctgggcacggtcaacgacgccaccggcgcgatcaacccgttcctcatcagcaatccctacatcgagttcgcctacgacggcagcaagatggtcggcatccgtatcggtttcggcgaagccaagggctacctctcgggcgatatcaagaccctcaccggcaacgtgccggtggacctgtacggcaccggcagccaactgggaggcagcatttcctgcggcctgctggccctcgactgcctggcggcgaagaccgccatcactctcaccggcagctctcagtacaccgcccaggcagagctggtgaacagctccggcaaccccgacccgatccgcgctgccatgatcggcctgaagaacggcacggccctggacatgcacgacagcaccatcatcggcagcctggtgaacgtcctgctgcccttcctgacctccaacgactgcaagctgatgggcgcccagacttgcttcaacctggcccagtaccagtcgttcccgatcggcaccgtggatccgaacaacgcgcagaacttcatcgactcgtcgaaaggcttcttcatctcgatgcagagccagaacgtccagtggcgcgaccagcaggatccctccaagctggtcgccgcgctggccggtgccttcctcaacatgtcgcgcaacgccgatggaacggcgccgatcaaggtcgacttcggtcaggccttcaatggcattccacggcaggacacctgcctgggcggcctgaacaagggctgctga

SEQ ID NO: 14069 - DNA, 459 bp, Pseudomonas aeruginosa
ccagttggctgccccgccagccgttgccgttcgccgcaccctcgcggccggagttgctggagaccccgccccgggaagagccggcggtgcctgtgcgtgcgcgcgccgcgatcgatgcgccgcaggcccgcgtcccgcaagccgaggcgccggccagcgcgccgagcgtggctcccgccgcgcccgtggaaggccgggggatcccgatcagcctgccgaagccgggcgccccggcggcgaagaaagccgagccggtcgcgccggtcgaagaggccccggccgagtcgccggcggtccaggccccgccgccgcgcttcgccttgcaactgctgcaggcgggctcctgcaccctgctggtcgaactgcccaccggcgaacccttcgccagccgcgatccgggttacctgctgctgcgcgacctgctgcgcgccgccggcctgccggacagcccgcggctga

SEQ ID NO: 14070 - DNA, 654 bp, Pseudomonas aeruginosa
gcgatggccaggcggccgttgaacaggtcgttgccgccgctgatcgactgcgccgcgcgcaggtcgtggtcctcatggctctggaagccgctgcgggcgcccagctcggtgttgaagcgagtgtcgccgccgacgcccttcttggtcacgatgttgatgatcccgccggtggcgccgccgccgtacaccgcgctggcgccggacatcacctcgatgcgctcgatgttgaatgggtcgatggagtcgaactgccggctgatgccccgtgaactgttcagcgacaccccgtcgatcatcaccagtacgctgcgtccgcgcaggttctggccgttgttggtacgaccctgggagccgatatccaggcccgggatcaattgtcccaacgcctccttcagcggcacgccggcctgggtctgctggtccagttgctcgcgctcgatcacccagaccgtgccgggcaactcgctgatcctggtcggcgcgcgcgagccgatcaccaccatctgctgctccaccggatcggcagccagcgcaggagcggaaaacgaagcgaagagggacagggaaagcgccaggggagccgggcgcaaagggatggagcggggcatgaggagatttccgagttgctgttgttttgatgggcggcaaagctaa

SEQ ID NO: 14071 - DNA, 279 bp, Pseudomonas aeruginosa
atgattctgacctttcgctgcgacgagactcgtcagctttttgagacgggtctttcgaggcggtggggagcgatcctcacagtcgctacgcgtaagctcgcaatgcttcatgcgggtacggagcttcgagacctgcgctctccacctggaaaccggttggagccgttgcagggaaagcgggcgggccaacatagcatcaggatcaatgaccagtggcgtgtctgtttcgtctggacggatgcgggtcccgaagaagtcgaaatagttgattaccactga

SEQ ID NO: 14072 - DNA, 858 bp, Pseudomonas aeruginosa
ccggcacggatcacacggttcaggccgggttcctcgagaccgagggactcgaggaacatgtccttctcttcgccgtcttccagctcggcgatctcggcttcgatcttgttgcacaccggcaccaccaccgcgccttcttcctcggcgatggccttcaccacatccaggtgcgggttgttctcgaagccgtcctcggcgacgttggcgatgtacatcaccggcttgctggtcagcaggtggaagctgcgcaccaggcgcttctcctcgtcaccgaggttcttcagcagcgaacgcgccggcttgccctcggtgaagtgggggatgagcttttccagcagggccttctgggccagggcttccttgtcgccgcccttggcgttgcgggcgactttctgcagttgcttctcgcagctgtcgaggtcggcgaagatcagttcgaggtcgatgatctcgatgtcgcgcttggggtcgacgctgttggacacgtggatcacgttgtcgtcttcgaagcagcgcaccacgtgggcgatggcgtcggtctcgcggatgttggcgaggaacttgttgcccaggccctcacccttggaggcgcccgccaccaggccggcgatgtcgacgaattccatggtggtcggcagtacgcgctcgggcttgacgatctcggccagggcgttcaggcgcgcgtcgggcatcggcacgatgccgctgttcggctcgatggtgcagaacgggaagttttccgccgcgataccggatttggtcagggcgttgaacagggtggacttgccgacgttgggcaggccgacgatgccgcagttgaatcccatgctatgtccctcgcgctcagacaggcgctag

SEQ ID NO: 14073 - DNA, 615 bp, Pseudomonas aeruginosa
aaaagtggttcaggccttctggctgtgcagcttctgcatcgcccgggtccagtccccggcgagcatttccggcagcacgccgagggcgaagtcgatgctggtgtcgagcagttcctgctcgctgcgcggtgcgcggccgagcacgtaaccggaaaccaggctgctgtgccccggatggccgatgccaagccgcaggcgatggaaagaattctgattgccgagctgggcgatgatgtcgcgcaacccgttgtgcccgccgtgtccgccgccggtcttgagcttggcgacgccagggggcatgtcgagttcgtcgtgggccaccaggatggcgtccggggcgatccggaagaatcccgccagcgccgctacggactggccgctgcggttcatgtaggtggtcgggatcaacagacgaacgtccttgccctggtggctgaacttgccgaccaggccgaaatacttgcggtcagccacgaggctgacgccctgggcatgcgccaggcgctcaacgaaaagggcccccgcgttatgccgggtctggtcgtattcaggacccgggtttcccaggccaacgatcagttgtacggccgtcacgacgggagcccctctctataa

SEQ ID NO: 14074 - DNA, 540 bp, Pseudomonas aeruginosa
cagtcgtttcggctgtccccctcgagaacggtgcgcactttaatggcgggagaatcgcgtgtcaacagtggatctgaaaaaatttctgctgtgctgacaagtacttgcggaaccacgacgagataccagggctccgggatgtccaccggggtgagcttttcgcccacgccctcggcgaaagccgcgcgtccgcgggtgaagaccggcacgtcggcgcccaggcgcaggcccagggcggcgatgcggtcctcgtcccagccgagttgccagagatggttcaaggccaggagcgtcgtggcggcgtcggagctgccgccgccgatgccgccccccatgggcaagcgcttgtccagccagatgtcgacgccttgcgggctgccggaggcttcctgcagcccgcgcgcggcgcgcacgatcaggttgctgtcgtgcggcaccccggcgatttccgtgtgcaggcgtacctggccgtcctggcgggcttcgaaatgcagctcgtcgccgtggtcgaggaattggaacagtgtctgcaactcgtga

SEQ ID NO: 14075 - DNA, 1026 bp, Pseudomonas aeruginosa
gccgtccggcaagcccaagggggccgggacgggcgtcgacgaagctgtctatggggtcaatacatcggcaatggttgtcctgcccttggcgaagtaggagaattgcgcgtttccccgattagctcagcgatcctgcatggccttcattgccctcggcatcaatcacaagaccgcctcggtggctgtccgcgagcgcgtggctttcactccggaacagatggtcgaggcgctgcagcagctctgccgcctgaccaccagccgcgaggcggccatcctgtcgacctgcaaccggagcgaactctacctggagatcgaccatccgaccgcggacgacgtgctcgcctggctggcggactaccatcgcctgactctcgacgagttgcgcgcctgtgcctatgtgcaccaggacgaagacgcggtgcgccacatgatgcgcgtggcctccggcctcgactcgatggtcctcggcgagccgcagatcctcggccagatgaagtcggcctacgccgtcgcgcgcgaggccggcaccgtcggtccgctgctcggccgcctgttccaggccaccttcagtacggcgaagaccgtccgcaccgataccgccatcggcgagaacccggtgtccgtggcgttcgccgcggtgagcctggccaagcagatcttcagcgacctgcaccgcagccaggcgctgctgatcggcgccggcgagaccatcaccctggtcgcgcgccacctgttcgagcaaggcgtgaagcgcatcgtggtggccaaccgcaccctggagcgcgccagcctgctcgccgagcagttcggcgcccatgcggtgctgctttcggagatacccgaggagttggccaacagcgatatcgtcatcagctccactgccagccagttgccgatcctcggcaagggcgccgtggagcgcgcgctgaagcagcgcaagcacaagccgatgttcatggtcgacatcgccgtgccgcgcgacatcgagccggaagtcggcgaactggacgacgtctacctctatag

SEQ ID NO: 14076 - DNA, 1302 bp, Pseudomonas aeruginosa
ggagctgggcaaggcccagcggcaactggccaacggtgccgaccccgccgaggtgatggcccagctggcccgcggcctgaccaacaaactgctgcacgcgcccagcgtgcagatgaagaaaatgtccgccgagggccgcatcgacgcgctggccctggcccaggagctgttcgccctcgacgagggcgcgccgcgccactgaccggtacctatgcctgcatgaaagcttctctgctgaaaaagctggatgtcctcagcgatcgctacgaagaactgacggcgctgctcggcgacgccgaggtgatcagtgaccagacccgcttccgcgcctattcccgcgagtacgccgaggtcgaaccggtgatcctggcgttccgcgactaccgcaaggtgcaggccgatctcgagggcgcccaggcgttgctcaaggacagcgacccggagttgcgcgacctcgccgaggaggaggtcgccgaagcgcgcggccgcctcgccgccctcggcgacagcctgcagcgcatgctgctgccgaaggatcccaacgacagccgcaacgtgttcctggagatccgtgccggcaccggtggcgacgaggcggcgatcttctccggcgacctgttccgcatgtattcgcgctacgccgagcgccagggctggcgggtcgagacgctgtcggagaacgagggcgagcacggtggctacaaggaagtgattgcccgggtcgagggcgacaacgtctacgccaagctcaagttcgagtccggcgcgcaccgcgtgcagcgggtgccggaaaccgaatcccagggccggatccacacttccgcctgcaccgtcgcggtgctgccggagccggacgagcaggcagcgatcgagatcaacccggccgacctgcgggtggacacctaccgttcctccggtgccggcggccagcacgtcaacaagaccgactcggcggtgcgcatcacccacattcccagcggcatcgtggttgagtgccaggaagagcgctcgcagcacaagaaccgcgccaaggccatggcctggctggcggccaagctcaacgaccagcagcaggccgcggcgcagcaggcgatcgccagcacgcgcaagctgctggtgggctcgggcgaccgctcggagcgcatccgtacctacaacttcccgcaagggcgggtcaccgaccatcgcatcaacctcaccctgtactccctgggcgaggtgatggagggcgcggtggaacaggtgatcgagccgctgctgcaggaataccaggccgatcaactggcggccctgggcgactga

SEQ ID NO: 14077 - DNA, 630 bp, Pseudomonas aeruginosa
catgaccactatctgtacccttctcaaggattcccaactgcccgattcgcccagcgcccggctcgacaccgagttgctgctggcggcggcgatgggcaagccgcgcagcttcctgcgtacctggccggagcgcatcgtgccgcgcgaggccaacgagcggttcgacgactggatcgcccgtcggcgcaacggcgagccggtggcctacatacttggccaccagggcttctggagcctggacctggaggtcgcgccacacaccctgatcccgcgcccggacaccgaactgctggtggaaaccgcgctggcgaccctcgcggcggataccgctacggtgctcgacctgggcaccggcaccggcgccatcgccctggccctggccagcgaacggccgctgtggacggtgactgcggtggaccgcgtggaagaggccgtggcgctggccgagcgcaatcgccagcggttgctcctggagaacgtcgaggtgcgccgcagccactggttctccgctctcgatggccgacgcttccggatgatcgtcggcaatccgccgtatatccctgccagcgatccgcacctgagcgagggcgacgtgcgtttcgagccgaagagcgcgctggtcgcgggtag

SEQ ID NO: 14078 - DNA, 864 bp, Pseudomonas aeruginosa
tcaaggggcggcggtgcgcgaactgctcggcgcccgcggcttcgccggggtacatacgttgcgcgacctcggcggcaacgagcggatcactctcggacaatgggcatgctgagcgacgaggaactgctgcgctacagtcgccagatcctgctggcgcaggtcgacgtcgagggccagctgcgcctgaagcgcagccgcgcactgatcgtcggtcttggcggcctgggttcgccggtggcgctgtacctggccgcggccggggtcggcgagctgcacctggcggatttcgatacggtcgacctgaccaacctgcaacggcaggtcatccacgatggcaccagcgtcggtgtcggcaaggtggagtcggcgatgcgccggctgggcgcgctgaatccgcagatccgcctggtcagccatagcgccgcgctggacaaggactccctcgatgccgccgtggcggcggtcgacctggtgctcgactgcaccgacaacttcgccacccgcgaggcggtcaacgtcgcctgcgtgcgcgccggcaagcccctggtcagcggcgcggcgatccgtctcgagggccagctttcggtattcgatacccgccgcgacgaaagcccctgctaccactgcctctacgggcacggcagcgaggccgagctgacctgcagcgaggccggcgtgatcggtccgctggtggggctggtcggtagcctgcaggcgctggaggcgctcaagctgctggccggtttcggcgaaccgctggtgggccgcctgctgctggtggacgccctcggcacgcgcttccgcgaattgcgggtgcgtcgcgatccttcctgtgccgtctgcgggcaacgccatggcggttga

SEQ ID NO: 14079 - DNA, 654 bp, Pseudomonas aeruginosa
tttccttctggagcagggcgccaaggctctggtactggcctgcaataccgcgacggctgcggctgcggcggaattgcgcgaacgttatccgcaggtgccgctggtggccatggagcctgcggtgaagccggccgcggcggccacccgcaacggtcgggtcggcgtcctggccaccaccggaactctgaagagcgcgcgtttcgccgccttgctcgaccgcttcgccagcgacgtacaggtcttcacccagccctgcccggggctggtcgagcgcatcgaagccggcgatctctatgggccgcaaacccgggcactgctggaacgcctgctggcgcccatcctcgaacagggctgcgatacgctgatcctcggctgtactcattatcccttcgtcaaacccctgctggccgagctgatcccggcggagatggcggtgatcgatacgggagcggctgtcgcccggcagctggagcgcgtattgtcggcgcgggcgctactggcctctggccaggccgcgacgccgcgtttctggaccagcgcgctgccggaggagatggaaaggatcctgccgatcctctggggaagcccggaaagcgtaggaaaattagtcgtttagtcgttcctggcagacgtgtcagcgattttttgaactaa

SEQ ID NO: 14080 - DNA, 930 bp, Pseudomonas aeruginosa
cgccagggtttcgaaggcttcgcgctggatctccacggccggtccgaccagcaccaccgggcagctcacccctgccagcaggcgcggcaggtgctccggattgaggcgatgactggcgtacagcaacacgccgcgagcttccaggcgttcgcaggccagggccagttcggccggtggcagcggccagtcgaagacctgcagcggcacctcgccgctgccgagcaaccagctgcacagccagaggttcggttccagcgacagctcggactggttgaccagcagcagcggcgcgccctgttgcagccgttgctggtgataaaggcgggcgcccagcttgctgcgcaaccaggagaagaagaaggcccgctccatgcgcgcgccgaactgtccctgccagcgtcgttcgaggtgctgcagcaagggttgcagaagcttttcgcagagggtcgctaccggatagagcgacgcggcctggttgaacagatcgtcgaggcgtcgctcggccagcgcggcgatggcgtccagcagctgttcgtgcaggcgttcccagggggattcgacatccgccgccggggtttcctccggacgctccagcagcgcgcgcacctggctgatggcgacgccacgctcgagccagacgagtatccggcggatgcgctcgacctgctcttcgctgtagagccggtgccccttgccggtgcgttgcggcaccaccaggccatagcggcgctcccaggcgcgcagggtgaccggatggacgccggtcagacgagtgacttcgcggatcggcaggccgccgcgttcgaggtggggcgagttcatcgggaaatcctagagcgcgttgcgcaggccgagttcggtcgggtgcggttgcaggtaggcctgctgggcgatgtatgcatgcgggtggcgacggaagtggtgctttag

SEQ ID NO: 14081 - DNA, 405 bp, Pseudomonas aeruginosa
cggcacgctgccatgccggtattgctcgatcagctcgcgcaattcacgcctgtcttcggttgcgaggtcgcgtttcaggtagccgctcaggtgcagcaacacgttgccatggctgccgcgggtcgcgcagcggcgcaagccctgcatcagctcgccgaagtagcgagtgccgagggcttccggctggtagtggccggcttcgccgagcaggcggccgaggctgcggtagtgctccggcgaatgggccagcaactggtacttgtagcggctatggaaggcgacgatggccgaatggctgaggccgcgctggcgcagggcctgccagtgggcatgggcatacacgcgggtgaggaagttctcccgcaggaccggatcgtgcagccggccttcttcttccaccggtag

SEQ ID NO: 14082 - DNA, 1272 bp, Pseudomonas aeruginosa
tgcgtgcgctcccaacccggtgcgcaaccgcgatttcgccaaggccctgggccgggcgctgcacaagccggcgcggataccgacccccgggttcgtcctgcgcctcgggctgggagaaatgtccggattgctgctcggcggccagcgagccttgccgcaacgcttgcaggacgccggctaccgttttcaattcaccgacctggacgtggcgctggccgatgtcctggacgcccgacgaaaggatcaggcatgaccgagaatgccctgctgttgctcaacctgggctccccggattcgacccgggtggaggatgtccgccgctatctcgaccagttcctcatggatccctacgtggtcgacctgccctggccgctgcggcgcctgctggtgtcgctgatcctgatcaagcgtccggccgaatcggcgcacgcctacagctcgatctggtgggacgaagggtcgccactgatcgtcctcagtcgtcgcctgcaggaggcgatgaagccgcactggccgcatgggccggtggaactggcgatgcgctacggccagccggccatcgagaaggtcctgctcgacctggcgcgccgcggtatccggcgggtgaccctggcgccgctgtatccgcagttcgccgacagcaccacgaccaccgccgaacaggaggtgcgccgggtgatcgccgcccatcgcctgggcctggaggtcagcacgctgccgccgttctacgaccagccggtatacctcgatgccctggtggaaagcgtgcgtccgtacctgcagcagccccacgaccatctgttgctgagcttccatggcttgcccgagcggcacatccgcaagctggtgaaggatcctgcccacgacctgctggccgagaacagccgcaacgtcagccccgaagccctcgccctctgctaccgcagccagtgcctgcgcaccgccgaggccttcgccgagcgcgccggcctggagcaggggcgctggtcggtgtcgttccagtcgcgcctggggcgcgccaagtggatcgagccctataccgacgccaagctcgacgaactggtgcagcgcggggtgaagcgcctgctggtgatgtgtccggcgttcgttgccgactgcatcgagaccctggaggaaatcggcatgcgcggccgcgagcagttcatcagtgccggcggcgaggacctggtgctgattccctgcctcaacgaccaccccgcctgggtcggcgccctggccgagatgagcgggcgcttggccaggccgctctga

SEQ ID NO: 14083 - DNA, 1461 bp, Pseudomonas aeruginosa
gcccggatgttgccggcttatcctgcctgtcgaccctcccttcgcatccgccgcttcggcggcgtccaggacttcggcatgcataacaacaataacggctatccctccaaccttgcggcctggaccacggtggcgatcctcatggtcgcctatgtgctgtccttcatcgaccggcagatcctcaacctgctggtcggcccgatccgccgcgacctggccatcagcgatacggaaatgagcctgctgatgggcttgtccttcgccctgttctacaccctttgcggtatcccgctcggacgcatggccgacaaccgcagccggcgcggcctgatcctgttcggcgtgctggtgtggagcgcgatgaccgcggcctgcggtctggcggcgcagctaatggcaattcctcaccttccgggtcggcgtcggggtcggcgaggcggcgctgtcgccagcggcctattcgctgatcgccgacagcttcccgcgcgagcgtcgggcgacggcgatcagcgtctactcgatgggcatctacctgggctcggggctggccttcctgctcggcgggctggtgatcaagttcgcctcggcccagggcgacgtgcatctgccgctgttcggcgaggtgcgcccgtggcaactgatcttcctcatcctcggcgccgccggcgtgctcttctgcctgttgctgctggctatccgcgagccggcccggcgcggagtcggcgcaggcgtggcggtgccgctgggcgaggtcggcgcctacctgcgggccaaccgcaagaccgtgctctgccacaacttcggtttcgcctgcctgtccttcgccggctacggcagcggcgcctgggtgccgaccttcttcgtccgcacccacggctgggacgccggtcatgtcggggtggtctacggcagcatcgtcgcggtgttcggctgtctcggcatcgtcttcggcgggcgcctggccgactactgggcgaagcgcgggcgcagcgacgcgaacatgcgcgtcgggctgctcgccgcctgggcggtgattcccttcaccctggtctatccgctgctggacaacgccaattgggcggcggcgctgatggcgccgacggtgttcttcctgagcatgccgttcggcgtggccccggcggcgatccaggagatcatgcccaactcgatgcgcggccaggcctcggcgatctacctgttcgtggtcaccctgttcggtctcggcttgggcccgacggcggtggcgctggtcaccgatttcgtcttcgccgacgacatggcgctgcgctactcgctgctgctggtgaccctggccgcggtgcttggtgcggtggtcctgctggggatcggcctcaagccctatcgcgccagcctggagcacctgaaggactggagcctgcgacgggaaggcgagggcggcgaggattggaaggcgtcccggcagccggcctgactcagtag

SEQ ID NO: 14084 - DNA, 786 bp, Pseudomonas aeruginosa
tcagcggcatcagcaccagcgcgccgaaggcgacgaacagcatctgcgcgcctgacagcacctggcgccagagcggctcctggaaggcatcgcccatgttcaggcttccttctgcttggtaccgaagatcttgtcgccggcgtcgcccaggcccggaatgatgtagccgttctcgtcgagcttctcgtcgatcgaggcggtatagatgatcacgtccgggtgggccttgcgtaccgcctcgatgccctcgggggcggcgaccagcaccatggcgcggatttccttgctgccggccttcttcagcaggtcgatggtggcgaccatcgagccaccggtggcgagcatcgggtcgatgatcagcgagcggcgctcggcgatgtccggcgccagtttttccaggtaggtgcgtgcttccagggtctcttcgttgcgggcgacgccgaccgcgctgaccttggcgccgggaatcaggctgagcacgccgtcgagcatgccgatgccggcgcgcaggatcggcaccacggtgatcttcttcccggagatcttctccaccgtcaccgggccggcccatccggggatttcgtactgttccaggggcaggtccttggtcgcctcgtaggtcagcagggcgccgacttcctgggccagttcgcggaagttcttggtgctgatatcggcacggcgcatcaggcccagtttgtggcggatgagggggtggcggatctcatgtacgggcatgggcgactgtctccaacgggggcgggcaaaaaaattgcgctagcgtaa

SEQ ID NO: 14085 - DNA, 723 bp, Pseudomonas aeruginosa
tcatcgacgacatcctcgacgaagggcacaccctctcggcgatcatcgacttctgcaagcatgccggcgcacgcgcggtgcacaccgccgtactggtggacaaggaacacgagcgcaaggcccggcctgacctcaaggccagcttcactggcctctactgtgccgaccgctacgtgttcggctacggcatggactacaagggctactggcgcaacgccgcgggcatcttcgcggtcaaggggctctgagatggccggaccgcgctacctcgaccagcaattgttcgccgaactggcgagcggggcgggtaacgcgccgcgtggtcgccagcatcacaacttccaccgcatggaggagccctgccatcgcatggcggtgggcctccagccgaatacctacatcccgccgcaccggcacctggatgcgggcaaggccgaggcgctgatcgtgctcaagggccgtctcggcctgctggtcttcgccgaggacggggaactcctcgacaagcgcgagttgagcgccgctggggactgccccggtgtcgacctgccgcccggggtgttccatgccctggtggtgctggagccggacagcatcctgttcgaatgcaaggccgggccttaccgcccgctcggcgaaggcgagttcgccagttgggcgcctgccgaaggcagcgccgatgcgccggcctaccgggactggatgcgcgcccagttcgcctga

SEQ ID NO: 14086 - DNA, 495 bp, Pseudomonas aeruginosa
cctgtgcggctccctgctcctgtttgtcagtctggccggcctggccgccgagaatcccccgatgcacgcgcgcttcctgccgcccgacgacggccagttgcgccaggaggcgccggagcagcagcaactgatccagatcaccgagtacagcgtggtgctgggcaaccagcggcagtccaaccagcagccgatcccgatcaccacgccgaccctgctgcgcctgaagggcaaaccgctgagcaagggcgcgaccctggcccaggtgctgatccagttcgacagcgaaggcaagagcctgaagaagccggtctacgatgccgggacccgcaccctcacgctcaactacccgttggcgcagtacccggcgttgctcgacctgctgcgcaaccagacggtctattgccagttcctcgcctatcccaacggccatgtctgggcggacctgcacaccggcgcggtacgcgcgcgttgagcctcgccgcgcgccgggagtaa

SEQ ID NO: 14087 - DNA, 561 bp, Pseudomonas aeruginosa
acgccgcgcgggccccgccgcggtcgcggatcgccagggcggcggggaagggcgaatggccaggactgcgttattcgctctgcgagaggctgcctgtcggctgttgcttttctacactcacaggaaaaacagcctgccgaggttcccatgtacgtccagccctacgtctgcttcaacggccgttgcgaagaggccctgcgtttctatgaacacgccatcggtgccagggtgagtttcctgttccgtttcgacgaggcgcccggtccggtggtggtgcccgaaggctggtgcgacaaggtgatgcacgccaacctgcagatcggcgacagccagatcatggcctcggacgggcacgggccggcgttgcagccgatctccgggatttccctttcactgaatacccgcgacccgcagcaggcgcggcgctgctatgacgccttgctggaggacggcgggcgggtcgagctggagttgggcaagaccttctggtcgccctgtttcggtaccctggtggaccgtttcggggtgtcctggatgatcaattgcgaggccggcgcctga

SEQ ID NO: 14088 - DNA, 312 bp, Pseudomonas aeruginosa
ccccggcgtgtggtcctgttgcggaggttatcgatgtccttgcaagccttgtgggcgctgttcctcgcccatcccgcgcaggccgtgaacggccttgcgctgttcttcggtgtcgccggcgcctggctgctgctggccacccgcgcacgcgagcgtcgcgccctggcgcgctgggccgcggagggcgaggcgggggaggcggcattgccgatggacgaggcgaccctgcggatcaacctgttcttctaccgattcggcaccgcctgcctgggcctggcgctgctggtcagctgggccagcacgcggctctga

SEQ ID NO: 14089 - DNA, 267 bp, Pseudomonas aeruginosa
ctgatgcagcgcgtatatgagccggccgacctgctggaagccgagatgctggtgggaatgctcgccagcgaagggatcgccgcccatgtcagcggccgccacctggtcggcgccatcggcgaactgccgcctggcggactgctggcgttgttggtggcggacgagcagacggagcgggcgcgagaactgatcctcgcctacaacgccgccgccccgctggccgaggagccgccggagccctgcggccccggcagcctgttgtgttga

SEQ ID NO: 14090 - DNA, 1050 bp, Pseudomonas aeruginosa
cccttgttggaattgtctctgaggagcttatcggcaggaggacggcaaatccttaatcggccgtcggagatttcctcgccaacggctgttgccggcgttcgaggcgcggcctaccatgcgctcggccttcagaggagaacaaaggaccatggctcatcccttccgattcgccaccctcgccggcgcgctgctgctcgccggttgccaggcagtgaacaccaccagtggcggcgccgtcggcgtcgaccgcaagcaatacatgttcagcatgttgtccagccaggaagtcgaccagatgtacgcccagtcgtaccagaagactctcggcgaggcgaaaagcgccggcgtgctcgataccagcagcgccgacgcgcggcgagtcaaggcgatcgcccagcggctgatcccgcagaccgccgccttccgcccggacgccaccggctggaactgggaagtcaatgtggtgaagagcgacgagctcaacgccaactgcggtcccggcggcaagatcattttctacaccgggctgatcgacaagctgaagctcaccgacgacgagatagccgcggtgatgggccacgagatcgcccacgccctgcgcgagcatgggcgcgaggccatgtccaaggcctacggcgtgcaggtggccagccagatcggcgccctggccggcctcggccaggaaagcctgcaactggccaataccggcgtcgactacctgatgaccctgcccaacagtcgtgccaacgagaacgaagccgacctgatcggtctcgagctggccgcccgcgccggctacaacccggaagcggcgatcaccctctggcagaagatgggcagggccagcggcggcgccagccagcccgagttcaccagcacccacccctccgacagttcgcggatggccaatctccaggccgcgattcccaaggtgatgccgctgtaccagcaggccaggcgcggcaagtgaggccagggcgcgcggtcgcggggggcggccggcgcgccgacaggcttaccatcggaaacgcctgttgtgtatttccgtaa

SEQ ID NO: 14091 - DNA, 1089 bp, Pseudomonas aeruginosa
cctgctgtttggtatctcgccggtgttcggcctagactgctggccgacccgcttgcgggacccgtggacgaacagccactctcacgccctggagctcatgtgaaatacgccgtactcggagccaccggcctgctgggacatcacgccgcgcgcgccatcagggccgccggtcacgatctggtgctgatccaccgtccttcttcgcagatccagcgtctcgcctatctggagcccgagtgccgggtcgccgagatgctcgaccacgccggcctggaacgcgccctgcgcggcctcgacggggtgatcttcagcgccggctactatccttcgcggccgcgccgctggcaggaggaagtggccagcgcgctgggccagaccaacccgttctatgccgcctgcctgcaggccagggtgccgcgcatcctctatgtcggttcggcatatgccatgccccgccatccccagggactaccgggccacgaggggttgttctacgacagcctgccgagcggcaagagttcctacgtgctgtgcaaatgggcgctcgacgagcaggcccgggagcaggcgcgctacggcctgccggtggtgatcgggattcccggcatggtactcggcgaactggacatcggcccgactaccgggcgcgtgatcaccgccatcggcaatggcgagatgacccactacgtcgccggccagcgtaacgtcatcgatgccgccgaagccgggcgcggactgctgatggcccttgagcgcgggcgtatcggcgagcgctacctgctgaccgggcacaacctggaaatggccgacctgacccggcgcatcgccgagctgctcggccagcctgcgccgcagccgatgtcgatggccatggctcgcgcgctggccaccctgggccgcttgcgctaccgggtcagcggccagttgccgctgctcgacgaaaccgccatcgaggtgatggctggcgggcagttcctcgatggacgcaaggcccgcgaggaactcggcttcttctccaccaccgccctcgacgacaccctgctgcgcgccatcgactggttccgcgacaacggctatttcaatgcctag

SEQ ID NO: 14092 - DNA, 780 bp, Pseudomonas aeruginosa
gacggggcgcattctgcccaagccgggcggcttgggcaagtccgggacggaaactttcgtccgggagggcggcgagggagcctgatcgcaaggaaacgtgccggcatccgcagcgatccgcgaggaatcgctgggcggcagggtgagtcaggtattggtcgggctgacgtccatttcgtggtagcgaacgaagcgtgcgcgcttcttccagcggtatcccagccagatcgccaggaacagcggcaggctgatataggtggcgaggaggccgatccagtcgatgcgttcgcccaccagcgcctggtagttctgcccgagggtgatgaccatgcacagggcgaaggcgaacagcgggccgaaggggaacagcttggcccggtagggcaggtcttccaggcggccgccctgggccaggtaacccttgcggaagcgatagtgggagatggcgatgcccagccaggcgatgaagccgcacatgcccgaagtgttcagcagccatgtgtagacggtgctgtcgccgaaggccgaagtgaggaagcacagggcgccgaccagggtagtggcgtacagcgcgttgcgtggcacgccgctgcgcgagacgcgggagaacaggcgcggtgccttgccctcgagggcgaggttgtagagcatccgggtcgaggcgtacatgccggagttgccggcggagaggatcgccgagaggatcaccgcgttcatcacccccggccgccggggggaagccggcgcgctagaagagcagggagaagggcgatacgctga

SEQ ID NO: 14093 - DNA, 225 bp, Pseudomonas aeruginosa
tgcccaggaagatcgcgctccagtagatgcccggcacctcggggaaccagaaactcatcaccagttgcgctgccaccagctccgcggcgatggtcaccgcccagttgtaccagtagttccagccgagggcgaaaccgaagccatcttcgacgaaccggctgccataggtgcagaacgagccggaaacgggcatgtaggccgccatctcgccgagactggtcatga

SEQ ID NO: 14094 - DNA, 987 bp, Pseudomonas aeruginosa
tcggtcagttcgcgggacttgggcaggaacagaacggccgaagtccaggcgccggtcggcgcgcgcgtgtcgaaacggctacggtcggggaagcgggcgtccaactgcgcctgctcgccggcgtgccagctccagccctgggcctgcggtagctcggcgagcaggtcgtcggcgggcaggccggccagcagcagcggggtcgcgaagaggtggcgctggcgcagcagcacttcactgcgagggtccatgcgggctccggaaaaaatgggaaatcttaacaggcttgggcctggcatacccgcatggattgtcggcgaggatcgccgttcatccgtgcgcggtgcccgcagcgccgtatcagccggcgttgactacccgcagggcgcgcccggccttccatgcctctgcgttttccgccagttggccgacgatgcgctgccgcgcctcgcgactgccccaggcgttatggggggtgacgatcaggcgcgggatgtcgggggccagcagcggattgccgtttctcggcggttcgacgctgagcacgtcggtagcggcgccgcccaggtggccgccgcgcagggcgtcggccagcgcctgttcgtcgaccaggccgccacgggcggtattgaccaggaaggcgccaggcttcatcagcgccagttcggcggcgccgagcatcccgcgggtgtcctcggtcagcgggcagtgcagggtcagggcgtctacccgtggcaggagttcgccaagcggcaggcggtccgcccgggcaggccgtcctggcaactgaccgagcagcacgcgcatgccgaacgcctccgccagccgcgccaccgccccgcccagttcgccatggccgagcaggccgagggtcttgccttccagttcgacgatggggaagtccagcaggcagaactggctggattgctgccagcgaccgctgcgtaccgcctgctggtagtccggcaggcgcgtagccagggccagtag

SEQ ID NO: 14095 - DNA, 876 bp, Pseudomonas aeruginosa
aaggcatttttttggcacacaaggcgcaatgtgaattgcttctcagattttcgtcatttaactgacgaaatgcagtgctggaaaactgacgtgcgccacgcagatagggagattttcatggtccgtccggatagccagcgcggcaagcgcacctcttcgaaagctggtagggaagggcgtttcgtccttgccgccagcagcaccctcatgttcgccatcgccagcatcaacgcggccatggcggcacctaccggtgcccagttcaaccccaacgagatcaagatcagccagcagggcaagaccacgctgatcgaccagagcacccagcgcgcgatcatcaactggaagggcttcgacgtctccgccgacgaagcggtgcgcttcaaccagcccggcgtgacctcgtcgaccctgaaccgggtcaccgccaggccaggaaagtgtgatcgccgggcgcatctccgcgcccggccaggtgatcatctacaactccaacggcgtggtattcagcggctcggccaaggtcgacgtgggctccctgatcaccaccacggcgaacatcagcgacgaacacttccgccagggcaagctgatcttcgaccagcccggaaaccccgacgcgcggatcgtcaacgacggcagcatcagcgtcgcggagaaaggcctggcggccttcgtcgcgccgtccgtggccaacaacggcgtgatcaacgcccgtctcggcaccgtggcgatggccgccggcaacgccgcgaccatcgacctctacggcgatggcctggtgtccatcgccgtgaccgacccggttacccgcaagccgcaggatgcccaggcgctggtcagcaacggcggcgcgatccaggccgacggcggtag

SEQ ID NO: 14096 - DNA, 612 bp, Pseudomonas aeruginosa
cgtgctgatcaccgccgagcaggcttcccgggtggtcgacaacgcggtcaacctgtccggcgtgatcctcgcccgcggtaccgaggtgcgcgagggcagcgtggcgctggtaagcaagtccggggacatccaggtcgccggcaagatcgacgtcagcggtccgaagagcggcggcgacgtgctggtcagcgggcagcaggtggccctggcgagcaccgccagcatcgacgcccgcggcgccgcacagggcggcagcgtgcgcatcggcggcgacttccagggccgcggcgagctgccacgagcgaagaacgctacgctggccaagggcgccagcatcgacgtctcggctaccggcaagggcaatggcggcctggcggtggtctggtccgacggcaatacccgcatggacgggcggatcctcgcgcgcggcggcgcccagggcggcaacggcggcctggtggagacctccggcaaggtcaacctgagcatcgccgacagcgcctacgtcagcgtcgccgcaccctacggcaacggtggcacctggctgctcgacccgaccaccctgcgcatcgtcgcatccggcggcacctcaggttcggtggggggcgctaa

SEQ ID NO: 14097 - DNA, 726 bp, Pseudomonas aeruginosa
catcgacctggcttcctgggacaactacgccggcaacctggcgctgcagaccttcaacggtacgctcaagtaccggcagagcaacgccaccggcgtgaccacgagcggcacggtgttcgatccgttcatcaaccagagcatgaccggcaccgcgcagaacatcgtctccagcgtcggtacgcggattctcgaggccaacagcgtcggcaccaccggcaactacacgctgaccgccgacggcaacagcgagttcgaccgcctggtgttcaccgcgctgccctatcggcgggtcagcggttccgccagcttcccgaccaacgactcgtcggactacctggtgaccaacctgcgctaccaggtcaacggcagcaacgtcaccgccaccccgaacggcggtgcgcccagcgggttcaccgtcgccgccggcaacggcagcgtcaccacctggaccggaaactggggcaccagttggggcgtcaagggcttcggcggcgtgatcggcgtgaccgacgagctgcagtacgacgtcggcaccggcctgaccgaggaactgatcttcggcctcggcggcaagaccagccgcgtcgatacccgcctggacctgttcatgcgcgagggagcgttcaacagcttcgccgagcgcgcccaggtggagatgttcaagaccaccaccactgccggcgacatcctttcccgccagcagaccgccaccctgaccgccaatga

SEQ ID NO: 14098 - DNA, 540 bp, Pseudomonas aeruginosa
cgccaatggcagcgagtatttcagccagcgttaccaactggtgcgccaggacggcaagctgaccgtcacgccggcgcaattgatcgtcagcgccgacgccaagaccaaggtctatggcgacgccgatccgacccttacctaccaggtcagtggcctgaagaacagcgataccgccgctggcgtgctgagcggcaacctcggccgggtggccggggagaacgtcggcaactacgggatactccagggcgggctgggcctcaacacggccaattacaccctcagctacgtcggcaacgacctgcgcatcaccccggcacaactgaacgtgatcgccgatgccaagaccaaggtctacggcgacctggatccggcgctgacctaccaggtctccggtctcaagcgcggcgataccgccggtgccgtgctcaacggtggcagcctgagccgcgtggctggcgagaacgtcggcgtgtacggcatcaaccagggtggactgggcctggtcagcagcaattacaccctgaactaccagggcaataa

SEQ ID NO: 14099 - DNA, 1710 bp, Pseudomonas aeruginosa
atgatgaaacattcgcaatggacgcttccctgggtgacgctctgtggctgcgggatgctggctgcttccgccgccgccgtggagttgccagggactgtacagccatcccagcttgatgaacgcttcaagccccgcagcgagccgcaagccaagcccgaggcgccgctggtggtgcccaagcaggtcgcgccgcaaggcagcgaacagatccgcttcgaactgcgcgagatacgcatcgaaggcaacacccgctatgacaaggcggtgctcgagtcctattaccagcatatgctcggcaagcaggtgtccctggccgaactggtcgacctggccaaccgcctcaccgccaagtaccgccaggacggctacctgttgacccaggtagtggtgccggagcagagcatcgagggcggcaaggtacgcctgcaggtgatcgagggttacctcgaacacgtgcagatcaagggaaccgtcgatgggccgcgggtgcgagtggaggaactgctcgcgccgctgaccgaaaaacgtccgctggatgccgataccctggagcgcggcctgctgctggtcggcgacctgccgggggtcaacgtgcagagcgtgctcagcccgggtcaggcgctgggctcgtcgaacctcgacgtggccttgcagcagcagcgatacgaaggcttcgtcagcctcgacaaccgcggctcgcactacaccgacccgaccaccctggccttcggcgccaccgagttctcccgcctgggcttctacgagcagatcgacgtactcggcgcgatctcgccgttcagcgatgccacccgctacatccagttgcgcggtacgttgccgctgggtggcatgttcgccggcgataccctgcagatcatgggttcctattcgaaggtcaacccggacattccggactcggtattccccttcgacagcgtcagcaagagcaccgaaggcagcatttcctacaaccatcccttcatccgctcgcgctcgcagaacctgagcggcggcctggcgttgcagtggaaggataccgagacccgcctgcgcgacttcgccagcgacgcctcgaaccccggtcgtgaccatgtgcgggtgttccagcaacgcctgacctatgactgggtcgaccgctggatgggcatcaacctggcggaggtgcgcaacaacatcggcctggacatgtggggcgcgaccaagaaggacgatgaacgtcgttcccgcgaagtggccgacggacgtttcgtctatctcaacggcaacatcgggcgtctgcaagggctcggcggaccctggtcggtgtatggcgagttgcaatggcagtacagcttcgacccgttgctgccgagcgagcgcttcggcgtcggcggcagcgggatcggtcgcggcttcgccccgggcaacatcaccggtgaccgtggcttcgccctgaagctcgaaccgcgctatggccaggcggtgggctatagctggctgcgcagctaccaggcctacgctttctacgactggggcaagacctacaacctcgacgtggacgatgacgagcagcagaagctcggctcgatcggtgccggggtgcgcttcaacctcaccgaccagttgtcgttcaacccggagattgcccgccaggtcatcggcgagccagccgaccagcgcgatgggaagcgcgagacgcgggtcctgttcaacgtggtggcgcgcttctga

SEQ ID NO: 14100 - DNA, 987 bp, Pseudomonas aeruginosa
ccagccgcgaggcgcgcctggccgagaacggcagcgaacagaccgtcgaccgtctgcacaaggacatggggcgcgtcgatctgcgcctggccgacaacggtagcgagcgcaccgtcgaccgcctgcatcgggagatgcggcgccccgcctgacaccgcggatcacgccgcaaggtgcgagaaaagcccggctcgatgccgggctttcttattgccgagaaggtgcggtgttccatggggaggacggataacgccccaggcgttatcgccgatacgccgctgtcggggcagcgacgcgcgacggcattggcctcagtgcaggcggtcgcgttgcgccaggctagggaacagcttcatccatgctccggtgaccaccagggtgccgatcccgccgaggaccactgccggtaccgtgccgaaccaatgtgcggtgagcccggactcgaactcgccgagctggttcgaggcgccgatgaacaggccgttcaccgcgctgacccggccgcgcatctcgtcgggggtttcgagctgcacgaaggcgccgcggatgaccatgctgaccatgtccgcggcgccgagtaccaccagcacgccgagggacagccagaacgatttcgacaggccgaaggcgatggttgccaggccgaagatgcccacggagaggaacatgatccgcccgacgttgcgttcgatgctgaagtgcgccagccagaacgacatcgccagggcgcccaccgctggagccgagcgcagcaggccgaggccccagggcccggtgagcaggatgtccttggcgaacaccgggagcagggcggtggcgccgccgaggagcacggcgaacaggtcgagggagattgccccgaagatgtccggtcggctgcggatgaaacggatgccggcgagcagcgagtcgagggtggccttgccctgggtgagcggctggttgcgtaccggcaggctgagcgtcaggacgcacgcgaggacgtag

SEQ ID NO: 14101 - DNA, 2874 bp, Pseudomonas aeruginosa
ataacgacatgggtgggaaccgtaccacccagaggaacttgcatgtccaaccgtgatatatcccggcgcgcctttctccagggcgggttgatcgccggcgtgggtgtcaccctggcgccgctcggcagccaggcgttcgctgccttgttcgagaaccaggtgaccgtttccgcccagcgctggatggcgggcaacggtcaggtccgtttccgtaacgacgccttgtccaaggtctgcggcaacaaggtgttcgcccgcgatatccgcgccagggacatgcccggctggccgcagcagcaaggccacgccatgttgctgaagaccgttcgcgccgaccgcatctacgaaggccacgacctttcctggctgggcgccgagttgcagccggaccgtatcgtcaccgccgccgacctggagaaggacggcatcgtcttccccgaggcgcattcgcccgatccgctcctgccgccgggcaaggtgccgatgttcatcggccatccggtggcgatcctgatctggaacgacttcgagcgcttccgccgggccaagctcaagctcaagttcaacgacaaggcgatccgctatggcgcccaggccccgctgtaccagggcgatccctacggcagctatcgcttcgtccgggtcggcggcaagacgccctacgaggacgacgagttctccagcctgaaggactcgatgctgttccccaccatcctcaaccgcaaaccggtatggaccagcgagccgaagctgcacggcgacctcaccgagcaggggctgttccatgccaagcgcatggccgagcaactggaaaacccgccgcaggactggctggtcttcgacgagcgctacaagaccccatcgatcgagccggcggcactggagccggacaacggcaacggctggtacgacgcggcgagcaagaccttgcacttcgtggtcgccacccagtgcccgttcgaagtcgcctacgaaagcgtgcacatgatcaagccgtcgcgcttcgccctggagaagttcaacatccatccgggctataccgtcggctacggctccaaggacaacaacatcttcgtcttctatgccgcgctcgccgcgctgtatggcgagggtgtgccggtgcgcctggccaacgaccgctacgagcagttccagagcggcatcaagcgccacccgttcgacatccgctaccaactggcggtagacaggaacgacctcggcttccgcatcttccgcgccgacatgagcgccgacggcggcgggcgcgccaactacagcgcctcggtggcggcggtgggcgccaccgccgcgcagtcgatctactacatgccgcagaacgacctggcggtcaccgcctatcattcgcgcggcgtggaggccggctcgatgcgcggctacggtaccctgcagaccatggccgcgaccgagatgatggtcgacgagatcgctggccggctgggcgtcgacgccatcgacctgcgtcgtcgcaacgccctgcgctcgggcatgaagaacacccagggcgcggtcccggccggtgccctgcgcctgcacgagatcctcgacaaggccgctgcccacgaggtctggaaggaccgcgacgcacgcaagaagcgcttcgacgcggaagacccggacaactggtatggggtcggcttcgccatttgccagaaggacttcggcaccggcgccgaggcgccgatggcgagcatcgagttcagcgccgacgggcgcatcagcctgcgccacatcggcaccgagatcggtaccgggatgtccacctcgcaggccttcgtggtcggcgacttcctcggccgtccggcggacgaggtgaagaccgccgagaccgaatggcccgagctgcggctcaccaccaagggcaatccctacctgatgagccaggccgagcaggacgccgcgctacgcgatccgcgctgggtcggcaagctggcctcgccgtcgtcggcgaccaactcggcgttctatttcagccacgccacccgcgaagccgcgcgcgtgctgttcaaccacggcctgtggccggcggccctggagctgtggcgcagcggtccgttcggcggccaggccaatccctatgtggtgcgccgcgaaaacgcggtatgggtcgacggccagttgaccggcaacggcctggcgccgattcccttcaccgagctggcgaagaaggcccacgagatgggcctggtcaccggcgtcagcgtccacggcttcaaccgctggagctgggccgaggcggacttcgtcatcgatggcgtgcgcgagcgcctgccgctcgacgccatggcggtgaagtacggcgacggcgcgccgggagtgaagaaggcgatgatgaacagcgccggcttccacctgctcgaccggcagaatccggcttatccggcgacccagctgaacaacgcgatggtcacctactacagtccggtggcgaccctggtcgagctgaaggtgaacaagggcagcggcgaggtgcaggtgctcgaccaccattcctggatcgagtgcggccgggtgctggtgccggagctggtcaagggtcagctggagggcggcatcgccatgggtatcggccatgcgctgctggaggaaatgccgctctacgagggcggccccgcggaaggggactggaacttcaaccgctaccggttgccgcgggcgaaggacgtggcggcgtggagccagacggcggagatcctcccgccgctgtcgccgaccgacccggccaagggcatcgccgaggtggtgatgatcccggtggtcggcgccatcgccaacgccgtggcgcacgccaccggcaagcgcgtccgcgacctgcccatcactcccgcccgcatcaaggaggccctccatggctaa

SEQ ID NO: 14102 - DNA, 1782 bp, Pseudomonas aeruginosa
ccgcaagctccagatgaccctcaacggtcaagccgtcggtccggtggaggtcgccgaagacctgccgatgatcgactacctgcacgaataccagaacctcaccggctcgcgcctgggctgtggccagggcatctgccatgcctgcgtggtgatcgtcgacaatccggacggcaccagcgaggaagtgcgcacctgcatcaccggcgcgcactacttcgacggcaagaaggttcgcaccatcgagggccatgcccagcgcgacgagaatggcgacatccgcgagctgaacccgatccagcagaagttcgtcgaccagttcgccttccagtgcagctattgcgcgccgggcttcgtcaacgccgccaccgtgctggtggaaaaagcccagcgccagccgatcaagcgcagcgagctggagcaggcgatcgaggacagcctcggccatcacatctgccgttgcaccggctacgtgcgctactacagcgccacccgcgacgtgctcgacgaactcggcctggtcaaggaggcttgaggatgaagcggaccctttccggcctcgccctggcgctggccgcgctgtcgccgttcctggcctccgccgccggcgccgacgcggcgctggtcaagcgcggcgaatacctcgcccgcgccgccgactgcatggcctgccataccgccgagggcggcgcgccgttcgccggcgggctgccgatccagtcgccgttcggcaccatctacggcaccaacatcaccccggacaaggaacacggcatcggcgcctacagcgccgacgagttcttcgccgctcttaccgagggcaagcgcaaggacggcgcctacctctatccggcgatgccctacacctcctatcacctgatcgagcgcgaggatgccgacgccatctacgcctacctgatggcccaggagccgatcgcccggccggcgccgcagaccagcctgagcttcccgttcaacgtgcgcatgggcctggccggctggaacctgctctacggcaagagcgtgcgcttgcagccggaggaagggcgcagcgaggcctggaagcgcgggcagtacatggtcgaggtgctcggccactgcggcgagtgccataccccgcgcaacctggccggcgccctggagcaggacaagcgcctgagcggcggcctgctcaacggctacctggcgcccagcctgctgcccggcgaccttgccgcgcgcggttggacccagccggacctggcgagcttcctcaagcacggcatgagcgcccagggcagcatgttcaacgagatgttcccggtggtgcaccacagcacccagcacctcgacgacagcgacctggcagccatggccacctacctgctcggcgaccagccgccgccggccaaggtggtccaggcgctgcccgaggcgcagctgaacgacagcggcaagcgcggtcgccagcagtacctcaacgtctgcgccggctgccacggcggcgaaggcgagggcaagccgcatatcgcggtggcgatgaacggcaacactaccctgcgcctgcaagacccgcgtaatctgttgcgagtgatcgaagacggcatcgtcgaacagcagttcaccggcttcgaacgcatgcaaccgatgcccggtttcgccgggaaactcgacgacgagcaactcacggacctgctcaactacctgcgccagacctggggcggattgcccggtgacctcggtccccaacaggtcgcgcaattgaagatggagagcgcttcggcgcataccgtcaaggtgaagtga

SEQ ID NO: 14103 - DNA, 975 bp, Pseudomonas aeruginosa
atcgtgcaacacctcgatctacaggtggtccgcaaggcgctgaagtggtccgtgggcggcgaacgggtgtggttctgtaccgtgctcacgacctatggctcggcgccccgcgcgccgggatcgctgctggcggtgaacgccagcggtgaatggatcggctcgctgtccggcggctgcgtcgaggatgatttcctcgagcgggtcgccgccggcggtttccccgatcccgcggtgatcgtgcgctacggcgagggcgacgacccgaactcgaacatccgcctgccctgcggcggcatcctcgacgtactggtggaaaacctggcgccggactgcgatgtccaggcccatctgcgcgagctggagtcggcgttgcttggtcagcgccgcctgctgcgcgaggtcgaactgggcagcggcgcgcgcagcctgcgcgacgattccagccacggccctcgggctgaacgcgacggcgagtgcgtgcgcttgcgcgtcggcgctgcccagcgcctgctgctggccggctattccagcgtcgcccatgcctgcgccgagttcggcaagggcctgggcttcgaggtgatcctctgcgacccgcgcgaagaagccttgcgcggcgtgctgctggagggcatcgagatccgtcgcgagctgccctcgctgttcatcgccgacggcggttgccacgccgatacggcggtggtggcgttgacccacgatccgaagatcgacgacctggcgatgctcgaggcggtgcgtaccgaagccttctatatcggcgtgatgggatcgcgggcgacctcggagaaacgcttcgagcgcctgcggcgcatcggcggcctgggcgatgccgaactggcgcggatccacgcgccgatcggcctcaacctcggcagcaagacgccggcggaaatcgccctggcggtgctggcggacattcttcgcatccgcaacggcattccccgcgagcggctctga

SEQ ID NO: 14104 - DNA, 270 bp, Pseudomonas aeruginosa
agcagctttccgccactcgcgagctgcaccggccggacgatgccaagggcctggtcttccgtatccagccgtcgtcggtgctggaagcgcagttcgccatgctcggcgccaccgccaagcagttgtcctacgccgagaccctcaaggccatgcaggccggcagcgtgcagggcaccgagaacacctggtcgaacctcgccggacagaagatcgacagcgtgcagccgtacatcaccgagaccaatcacggcgcgctcagctacatgctga

SEQ ID NO: 14105 - DNA, 963 bp, Pseudomonas aeruginosa
agccgctgtggaagaactacgaggcgcagatcggtagtgacgtgttgcgcgcggcccaggtggtcaaccgcaagcgctgatcggccgctggctattcccgtcagcggggatagccacaagccttgcgggtgtttctgccgggtgctttgcgggacactaggggagtatcggtatccggagcggaccatgaccgccagcgaagagaaattcacccgccagacgctgctcgacgtgcagcctctgactcccaacctgttcaccctgcgtaccagccgtgacgcgggattccggttccgcgccgggcaattcgcccggctcggcgtgtacaagcccagcggcagtatcgtctggcgcgcctactcgatggtttcggcgcctcatgacgaattcctcgacttcttttccatcgtcgtcccggacggcgagttcaccagcgaactcagccgcctgcgcgagggcgaccagttgctggtcgatcgccaggccttcggcttcctcaccctcgaccgcttcgtggatggtcgtgacctttggctgctggccaccggtaccggtgtggcgccgttcgtctcgatcctgcaggacttcgaggtctgggagcgcttcgaaagcatcaagctggtctacagcgtgcgtgagagcaaggagctggcctaccgcgagctgatcgccggcctcgccgagcgcgaatacctggccgagcatgcccacaagctgcagttcattccggtggtgacccgcgagcaggtacccggttgcctgaacggacgtatcaccacgctgatcgagaacggcgatctggagcgtgccgccgacctggaactgaccccggagcattcgcgggtgatgctctgcggcaacccgcagatgatcgaggacacccgcgccgtgctgaaggctcgcggcatgaacctcagtctgacgcggcgcccggggcaggtggcggtggagaactactggtag

SEQ ID NO: 14106 - DNA, 1563 bp, Pseudomonas aeruginosa
caagccattaggagctcttccatgaacccttccctgaacgccttccgtcccggccgcctgctggtggcggcaagcctgaccgccagcctcctgtcgctgtccgtgcaggccgcgaccctgacccgtgacaacggtgcgccagtgggcgacaaccagaactcgcagaccgccgggcccaacggttcggtgctgctgcaggacgtgcaactgctgcagaagctgcaacgtttcgaccgcgagcgtattcccgaacgcgtggtgcatgcccgcggcaccggcgcccatggcgagttcgtcgccagtgccgatatcagcgacctgagcatggccaaggtcttccgcaagggcgagaagaccccggtattcgtgcgcttctccgcggtggtgcacggcaaccactccccggaaaccctgcgcgatccgcgcggtttcgccaccaagttctataccgcagacggcaattgggacctggtgggcaacaacttcccgaccttcttcatccgcgatgcgatcaagttcccggacatggtccatgccttcaagccggacccgcgcagcaacctcgacgacgactcgcgacgcttcgatttcttctcccacgtgccggaggcgacccgcaccctgaccctgctgtattccaacgagggcaccccggccagctaccgggaaatggacggcaacagcgtgcatgcctacaagctggtcaacgccaggggcgaagtgcactacgtgaagttccactggaagagcctgcagggccagaagaacctcgatccgaaacaggtggcggaagtccaggggcgcgactacagccacatgaccaatgacctggtgagcgcgatccggaagggcgacttcccgaaatgggacctgtacatccaggtgctcaagcccgaggacctggcgaaattcgacttcgacccgctggacgcgaccaagatctggccgggcattcccgagcgcaagatcggccagatggtgctgaaccgcaacgtcgacaacttcttccaggaaaccgaacaggtcgccatggcgccgtcgaacctggtgccgggcatcgagccctccgaggatcgcctgctccagggacggctgttcgcctacgccgatacccagatgtaccgggtcggcgccaacggcctgggcctgccggtcaaccgcccgcgcagcgaggtcaataccgtcaaccaggacggcgcgctgaacgccggacacagtaccagcggggtgaactaccagccgagccggctcgatccgcgcgaggagcaggccagcgcccgctacgtgcggaccccgctgagcggcaccacccagcaggcgaagatccagcgcgagcagaacttcaagcagaccggcgagctgttccgctcctacggcaagaaggaccaggccgacctgatcgccagtctcggcggggcgttggcgatcaccgacgacgagagcaagtacatcatgctttcctacttctacaaggctgacagcgactacggcacgggcctggccaaggtggccggggccgatctgcagcgcgtccggcaactggcggcgaagctccaggattga

SEQ ID NO: 14107 - DNA, 1605 bp, Pseudomonas aeruginosa
acctgctcgaaggcgcggatcgcctggggatcgcggcggcgcagggcgccggggaggatgccgagggccaggaccaggtggccgccgacccagatcgcggcacccagcaggtgcaggaacagcagtgtgcgcatggaagtctccttgtccggccatcagtgtcgcgcgaagcgcggtcgatcgaggctgatcggaatcaagccagcggctatcatctgcgctttgcccgcgagaggagttcccatggccaaggccaagcgcatgtacggctgcaccgagtgtggcgcgaccttcccgaaatgggctggccagtgcgcggactgcggggcctggaacaccctggtggagaccgtcgtcgaggccgcgccgagcggctccggccgcggcggctgggccggccagcaggccaacctgaagaccctggcggaggtcagcgtcgaggaaatgccgcgcttcacgaccggctccaccgaactggaccgggttctcggcggcggcctggtggacggttcggtggtgctgatcggcggcgatcccggcatcggcaagtcgaccattctcctgcagaccctttgcaacctggccagccgcgtcccggcgctgtacgtcaccggcgaggaatcccagcagcaggtggcgatgcgcgcgcggcgcctgtcgttgccggaagacaagctcaaggtgatgaccgagaccagcatcgaaaccatcatcgccaccgcgcgccaggagcagccgcgggtgatggtgatcgactcgatccagaccatcttcaccgagcagttgcaatcggcgccgggtggcgtcgcccaggtccgcgagagcgccgcgatgctggtgcgctatgccaagcagagcggcacggcgatctttctggtcggccacgtgaccaaggaaggcgccctggccggcccgcgggtgctcgaacacatggtcgacaccgtactgtatttcgagggcgaatcagacggccgcctgcgcctgctgcgggcggtgaagaaccgcttcggcgcggtcaacgaactgggagtgttcggcatgaccgacaaaggcctgaaggaagtgagcaacccttcggcgatcttcctcacgcgggcccaggaagcggtgcccggcagcgtggtgatggccacctgggaaggctcgcggccgatgctggtggaggtccaggcgctggtcgacaccagtcacctggcgaatccgcggcgggtgaccctgggcctcgaccagaaccgcctggcgatgctgctggcggtgctgcaccggcacggcggtatcccgacctacgaccaggacgtgttcctcaacgtggtgggtggggtcaaggtgctggaaaccgcctccgacctggcgttgatggcggcggtgatgtccagcctgcgcaaccgcccgctgccgcacgacctgctggtgttcggcgaggtcgggctgtccggcgaggtgcgtccggtgccgagcggccaggagcgcctgaaggaagccggcaagcatggtttcaagcgtgccatcgtacccctcggcaacgcgccgaaggaggcgccggcgggattgcaggtgatcgccgtgacgcgcctcgagcaggccctggacgccctcttcgagtga

SEQ ID NO: 14108 - DNA, 747 bp, Pseudomonas aeruginosa
gacgccgatcgacggccagttgctcggcgtcgagccggtgcaggtgatgacgctgtccaacggctgcgtctgctgctcgatcaacaccgacctggaaaaggccctgttcctcctgctggagcgccgcgacaacggcgagatcgacttcgaccgcctggtgatcgagtgcaccggcctggccgatccggcgccggtggcgcagaccttcttcgccgacgaggaactctgccagcgctacgtgctggacggcatcatcaccctggtggacgccgccaacgccgagcgtcacctgcaggaaaccatcgcccaggcccaggtcggcttcgccgaccgcatcctggtgagcaagaccgacctggtcgacgccgccaccttcgaggccctgggccagcgcctgcaacggatcaaccggagggcgctggtgcatgtggtcgagcacggccgcatcgacctggcgcacctgctcgacgtacgtggcttcaacctcaacgccgacctcggtcctggcatcggcctgcgcccgctgcgagcggtggcagccaaggacagccgcgatcgcatcggcaccctggtactgcgcagcgacacgccgctcgatctcgaaaggctgagcgagttcatggacgacctgttgcagtggcatggcaattccctgctgcgctacaagggcgtgctgaacatcgccgacgagccgcgtcgcctggtgttccagggcgtgctgcgactctacggcttcgactgggatag

SEQ ID NO: 14109 - DNA, 663 bp, Pseudomonas aeruginosa
ccacgtcggcgaacggcaccgggttcgggtagacgccagcggcgaccaggccggcgacgtgggccatgtcgacgaacaggtaggcgccgaccttgtcggcgatggcgcggaagcgggcgaaatcgaggacctgggaataggcggagaagccggcgacgatcatcttcggcttgtgctccacggccaggcgctcgacttcgtcgtagtcgatcaggccattggcgtcgatgccgtactgcacagcgttgtacagcttgccggaggaggagacgctggcgccgtgggtcaggtggccgccatgggccaggctcatgccgaggatggtgtcgccggccgacagcagggccaggtagaccgcggcgttggcctgggagccggcgtgcggctggacgttggcgtaatcggcgccgaacagttgcttggcgcggtcgatggccagttgctcgacgatatcgacgtactcgcagccgccgtagtagcgcttgtgcggataaccttcggcgtacttgttggtcagcaccgaaccctgggcttccatcaccgccgggctggtgtagttctcggaggcgatcagctcgatgtgctcttcctggcgctgggcttcctgctccatcgcggcaaagagttcggcatcgtagcgggcgagggtcaaatcacggctga

SEQ ID NO: 14110 - DNA, 2829 bp, Pseudomonas aeruginosa
ggatcggtgctgggaaaaggcgcgcattctaacccatgcggcgggtgctggcacatgaaaggccatcatgtcgcggacaagcggcgctcaagcgcgccgcacggcggctcagccctcgttgaacatgaacagcacgtcgctggcgtagagcatgccgaactgctcggcgggcatcggccggccgaacaggtagccttgcacctcgtcgcagccgtgctcgcgaaggaagtccagctgggcctggctctccacgccctcggcgatcaccatcaggttcaggctgtgggccatggcaatgatcgcccgggcgatctgtgcgtcctgttcgccgtggggcaggccgtcgacgaagctgcggtcgatcttcagcacgtcgatggggaactgcttgaggtagttcagcgaggagtagccggtgccgaagtcgtccaccgcgatggccaggccgaggcgcttgagcccggagaggatctgcatggcctcggcgacgtcgctcatcaggatgctttcggtcagttccagctccaggcatgccggcgggatgcctgtctcgtagaggatcgcggcgatccgctcgcccaactggccatcggcgaactgccgtgccgagaggttcaccgagacctttggcacccgcaccttggccttgtgccagctgcgcaactgcttgcaggcttccgccagcagccagtcgccgacctgggccaccaggccgatctcctccagcaccggaatgaactcgctcggcggaaccagtccgcggcgcggatgctgccagcgcagcagggcctcggcgccggtcaggcggcggccgtcgccggtgaactgcggctggtagtggaggacgaactcgcccagttcaagggcgcggcgcaggtcgctttccagttccaggcgctccagggcgcgagcgttcatctcggcctggtagaactggaagttgttcttgcccatctccttggcgtggtacatcgccgtgtcggcgttcttcatcagcaggctcagttcggcgccgtcctggggcgacaaggccacgccgatgctggcggtgacgaagaattcacggccttccagggtgaacggccgggccagacggccgaggatcagctcggcgacctggatcgcccgtttcagggcgatctcgcggtcgccctgggaaggcagcagcagggtgaattcgtcgccgcccatgcgcgccacggtatcgtcctggctgacgcaggcgctcaggcgggtcgccacttcctgcagcatgcggtcgccggcggcgtggccgagggagtcgttgatcggcttgaagcggtcgaggtcgaggaacatcagcaccacccactggccgttgcgctcggcctgctgcagggcggtatgcagacggtcctggaacagcgtgcggttgggcaggtgggtgagggcgtcgtagtaggccaggcggtggatgcgccgctcgctggccttgcgctcgctgatgtcgctgaagaagcagacgaagctgaccaggtcgccttcctcgtcacgcaccgcggtgatgccgacccaggacggatagagttcgccggtcttgcgcttctgcaggatctcgccttcccagctgccgctgtgctgcaggctggcgagcacgtgcttgagctggttggcttcctggcggtcggcggtgagcaggcgcggctgctggtcgagcacgtcggccgggctgtagccggtcaggcgcgagaaggaatcgttgacctggacgatgtagccggccgggtcggtgaccatgatcgccgccgtggagtgttcgaataccgtcgccgccatccgcagctcgcgttcggcgcggcgctgctggctgatgtcgcgggcgatgccgagcaggccttcgaagcggtcgtgctcgtcccacatcaggacgatccgcagttcgatgggaatcttgcgtccgtcggcgcgcaggcagtcgagggcgaacagatgctggccagggttttcccgcagctcggcgagcttctggcggtcgccgatggcgtgccgcacgcggcgcagcaggccgttcaggcggccgagctggcgcgggttggtggcggtctgatggaggccgttgagcagcgcccattccgggctgtagccgaacacgtgctgtaccgaggggctgacgtagctggcgttgagttcggcgtcggtggagaagatcacgtcgctgatgttttccgccagcatgcggtagcgtcggccgttctcgcgcagcgcgttgttcgcctcgacggtgaaggtgatgtccttggccacgccgatcaggcgcgccacgcgaccgctgcggtcgcggctgaaggcctgctcgcggatgtcgaaccagtgccagcggccgtcgcggtggcgccagcgcagttggctgtcgagcagcaggccgtcgccgaccacgtgctgcaggttgcggatgcgccagtagtattcctggtcgtcggggtgcagcagggtttcccagaagttctcgcccatccgcgccagttcttcctggttgtagcccaactgctggcccaggtgatggttgctgaagatcacccggcgcgcgtgcaggtcgtggatgtagagggtatcgggcaccgcctggaccgcgtccgaccagaacttctcgcgctcgatcagcgacagttcgacttccttgcgactggtgacgtcggacaggctgaggggcaccgcatgccattcgccggggttttccggcaggcgcagttgcaaccacaggtgccgcggcgtgctcttgccgcagcgcagcgtggcttccagttcgagtaccggccggcgttcgatgagcgcctcgatcacctgcaggcgcaggctgtccggttgtag

SEQ ID NO: 14111 - DNA, 1512 bp, Pseudomonas aeruginosa
cgggccgtggtcgagcaagcgctgccaggcctgttcggtggactcgatctgcagcaggcggcgactgacatcgttgatctcggtgatgcggatccgctccagcagcgcctgctgccgcccgggttcgccggcgagccaggcgcgcagtgcggcgcagctgtccaggccttgttccaccagagcctggcgcagggcggagaggtcgagcacgcagagggccacgccgaccccttcgaagatgtcctggtagcgccgccgggtttcctccaggacgccgagggcgtgctgttcctcggtgacgtcgcgcaacacccagacctgcccgccctggagtatctgctcgcggagggtccaggcctggtcggcgagcgccggatagctggccagcggatggcggctgagggtgaacgtccgcggctcgccgcgcacccgcagcggcagcagctcgctacgggtctcgccgtcgccaccggcgtccgtcagccagcctggctcgaggtccggcagcaggcccagcagatgatgctggcgggcctgggccgaactgatgccgaagaggcgttcggcctggggattgaggtagctgaggcggccgtcggcgcgggtcaccagcacccgctcgtcgatcgccgccagtgccgtggccgcctggcgcaggctgcgctgcgaggccagggtcatggcgcgcaggccctgttgctcgcggtgcaggcgcagcagcatgtacacggtgacgccgaccagcaggaggaagatcgccagctcgccgccgattcccggcagcaggccgagccgcactcgcgtgctgtcgtagagcccgcgaagctgccagtcgctgttgcgcagcggttccacgccgagggtctgcatgtcgtcgagcagcgccgtgctccccggggtatgccagagcacccgcccggcgtattggtcttccaggcgccagagcaggttgccggtgggcaggtcgggactccactgggcgaggctgtcgctggccaggtgcaacagccagaagccactgtcgcggcggctgccgggttcgcgcagggtcaggtagagggattcgccgtcgcgcgggtcgaggcaatagtggtagaggccggagccggcgtgctggcgcaactgctcgggcagcgtcgtttccggcgacgggctgtccgtctgcagggcgctgtccacccattgcaactggcgcacctgcggcagcgcatcgctgatgcgcggcaacagcctgccctgtatctcgccacgctcgctggggggcacgcccgggagcagggcgagggcggtgcgcgccttgagttcgagggtcagggacaggcggtcgttgagacgatcgagctgggccgcggctcgctcgtgttcgaagcgttcctgctggcgcagctcctggctcatctgccagagcagcaggccgagcatcaacaggaccagcaacagcaggccagccttggctgccggtcggtcgggtacggtcagtgggtcgccggcgggaggcggcgacggggttag

SEQ ID NO: 14112 - DNA, 2151 bp, Pseudomonas aeruginosa
ccgggtcatagtcggcggcctggctgcggtgcagccgggggtgaagatcgtgccgaagccggatggtgcccaggcgcaagcccagtcacctgcgccgcaacagtaagggcgggttcgccccgaggattttccgatgtccgaattcttcatcaagcggccgaacttcgcctgggtggtggccctgttcatctccctggccggcctgctggtcatttccaaattgccggtagcgcagtaccccaatgtcgcgccgccacagatcaccatcaccgccacctatcccggcgcctcggcgaaggtgctggtggactccgtcaccagtgtgctcgaggagtcgctgaacggcgccaagggcctgctctacttcgagtcgaccaacaactccaacggcaccgccgagatcgtcgtcaccttcgagccgggcaccgatccggacctggcccaggtggacgtgcagaaccgcctgaagaaagccgaggcgcgcatgccgcaggcggtgctgacccagggcctgcaggtcgagcagaccagcgccggtttcctgctgatctatgcgctcagctacaaggaaggcgctcagcgcagcgacaccaccgccctcggcgactacgccgcgcgcaatatcaacaacgagctgcggcgcctgccgggcgtcggcaagctgcaattcttctcttccgaggcggccatgcgggtctggatcgatccgcaaaagctggtgggcttcggcctctccatcgacgacgtgagcaatgccatccgcgggcagaacgtgcaggtgccggccggcgccttcggcagcgcaccgggcagttccgcgcaggagctgacggcgaccctggcggtgaagggcaccctggacgatccgcaggagttcggccaggtagtgctgcgcgccaaccaggacggctcgctggtccggctcgccgatgtcgcgcgcctggaactcggcaaggagagctacaacatttcctcgcgactgaacggcacgcccaccgtgggcggggcgatccagctgtcgcccggggccaacgcgatccagaccgctaccctggtgaaacagcgtctcgccgaactgtcggcgttcttccccgaggacatgcagtacagcgtgccctacgacacctcgcggtttgtagacgtggccatcgagaaggtgatccacaccctgatcgaagcgatggtcctggtgttcctggggatgttcctgttcctgcagaacgtccgttacaccctgatcccgtccatcgtggtgccggtgtgcctgctgggtacactgatgttgatgtacctgctggggttctcggtgaacatgatgaccatgttcggcatggtcctggcgatcggcatcctggtggacgacgccatcgtggtggtggagaacgtcgagcggatcatggcggaggaggggatttccccggccgaggccacggtcaaggcgatgaagcaggtatccggcgccatcgtcggcatcaccctggtgctctcggcggtgttcctgccgctggctttcatggccggttcggtgggggtgatctaccagcagttttcggtgtcgctggcggtctcgatcctgttctccggcttcctcgccctgaccttcaccccggcgctgtgcgctacgctgctcaagcccattcccgaagggcaccacgagaagcgcggcttcttcggcgccttcaaccgtggcttcgcccgcgtcaccgagcgctattcgctgctcaactcgaagctggtggcgcgcgccggacgcttcatgctggtgtacgccggcctggtggcgatgctcggctacttctacctgcgcctgccggaagccttcgtgccggcggaagacctcggctacatggtggtcgacgtgcaactgccgcctggtgcttcgcgcgtgcgcaccgatgccaccggcgaggagctcgagcgcttcctcaagtcccgcgaggcggtggcttcggtgttcctgatctcgggcttcagcttctccggccagggcgacaatgccgcgctggccttcccgaccttcaaggactggtccgagcgaggcgccgagcagtcggccgccgccgagatcgccgcgctgaacgagcatttcgcgctgcccgacgatggcacggtcatggccgtgtcgccgccaccgatcaacggtctgggtaa

SEQ ID NO: 14113 - DNA, 957 bp, Pseudomonas aeruginosa
cctgcgcgacgccgccatcgaggccgcgcgcctgcgcttccggccgatcatcatgacttccatggcgttcatcctcggcgtgatacccctggccctggccagcggtgccggcgcggcgagccagcgtgccatcggcaccggagtgatcggcgggatgctcagcgccaccttcctcggcgtgctgttcgtacctatctgtttcgtctggctgctgtcgctgctgcgcagcaagccggcacccatcgaacaggccgcttcggccggggagtgaacgagatgcgcaaacctgcattcggcgtatcggcgctgctgatcgccctgaccctcggcgcctgctccatggcgccgacctacaaacgtcccgccgcgccggtggcccacagctggatcggcgccgccgcccagcgccagggcacggcgatcgacacgctggattggaagactttcatcgtcgatgccgaactacgccgcctggtggacctggccctgaataacaaccgctcgttgcgccaaaccctcctgtatatcgaggcggcccgctcgcagtatcgaatccaccgcgccgaccgggttccgggcctgaacgccgctgccaccggcaaccgccatcggcagccggtctacctgtccgccggcaatcgctcggaagtggctcacaactaccaggtcgggctggccctgccggagtacgaactggacctcttcggtcgggtcaagagcctgaccgacgcaaccctgcaacagtacctggccaacgaggaggcatcgcgcgcggcacggatcgccctggtcgccgaggtcagccaggcctacctgatctatgacggcgccctgcggggcctggggctgaaccgtcagaccctggtcattcaacaagttatcccttcgccctggatcgaacatcccccccccgggccggcgcccgccaccgcgctgggattaccacgaaaccccttg

SEQ ID NO: 14114 - DNA, 267 bp, Pseudomonas aeruginosa
cccgaccgaagaggtccagttcgtactccggcagggccagcccgacctggtagttgtgagccacttccgagcgattgccggcggacaggtagaccggctgccgatggcggttgccggtggcagcggcgttcaggcccggaacccggtcggcgcggtggattcgatactgcgagcgggccgcctcgatatacaggagggtttggcgcaacgagcggttgttattcagggccaggtccaccaggcggcgtagttcggcatcgacgatga

SEQ ID NO: 14115 - DNA, 954 bp, Pseudomonas aeruginosa
aagtcttccaatccagcgtgtcgatcgccgtgccctggcgctgggcggcggcgccgatccagctgtgggccaccggcgcggcgggacgtttgtaggtcggcgccatggagcaggcgccgagggtcagggcgatcagcagcgccgatacgccgaatgcaggtttgcgcatctcgttcactccccggccgaagcggcctgttcgatgggtgccggcttgctgcgcagcagcgacagcagccagacgaaacagataggtacgaacagcacgccgaggaaggtggcgctgagcatcccgccgatcactccggtgccgatggcacgctggctcgccgcgccggcaccgctggccagggccaggggtatcacgccgaggatgaacgccatggaagtcatgatgatcggccggaagcgcaggcgcgcggcctcgatggcggcgtcgcgcaggctatgcccctgctcccagagttccttggcgaactcgacgatgaggatcgcgttcttcgccgaaagaccgatgatggtgatcaggccgaccttgaaatacacgtcgttggacataccgctgaccatcaccgcgagcaccgcgccgatggcgccgatcggcacgatcagcatcaccgacagcgggatcgaccagctctcgtagagcgccaccagcaacaggaacaccaccaggatggcgagggcgaacaggctggtggcctgcccggcggagaccttctcctgataggacaggccggtccactcgtagccgatgccggccggcagctgcgcggccaggcgctccatttccgccatggcttcgccggtgctgaagccgggcgcggcgtcaccgacgatgcggatcgacgggtagccgttatagcgcaccaattgcaccggtccctcttcccatttcacgctgacgaaggcgctgagcggtaccaggttgccagcagcgttaggcacgtatag

SEQ ID NO: 14116 - DNA, 2223 bp, Pseudomonas aeruginosa
caggcgcagttgcggcgcttcggccagtccttccatcatcgcgtaaaggaatttcgggttggtctggatctcgccaagaagagtatcgcgagcctgcagcagcgcttcgcggccgaccccggtacggtccatcaggcgcaatgcgaagccgccggagttacccagaccgttgatcggtggcggcgacacggccatgaccgtgccatcgtcgggcagcgcgaaatgctcgttcagcgcggcgatctcggcggcggccgactgctcggcgcctcgctcggaccagtccttgaaggtcgggaaggccagcgcggcattgtcgccctggccggagaagctgaagcccgagatcaggaacaccgaagccaccgcctcgcgggacttgaggaagcgctcgagctcctcgccggtggcatcggtgcgcacgcgcgaagcaccaggcggcagttgcacgtcgaccaccatgtagccgaggtcttccgccggcacgaaggcttccggcaggcgcaggtagaagtagccgagcatcgccaccaggccggcgtacaccagcatgaagcgtccggcgcgcgccaccagcttcgagttgagcagcgaatagcgctcggtgacgcgggcgaagccacggttgaaggcgccgaagaagccgcgcttctcgtggtgcccttcgggaatgggcttgagcagcgtagcgcacagcgccggggtgaaggtcagggcgaggaagccggagaacaggatcgagaccgccagcgacaccgaaaactgctggtagatcacccccaccgaaccggccatgaaagccagcggcaggaacaccgccgagagcaccagggtgatgccgacgatggcgccggatacctgcttcatcgccttgaccgtggcctcggccggggaaatcccctcctccgccatgatccgctcgacgttctccaccaccacgatggcgtcgtccaccaggatgccgatcgccaggaccatgccgaacatggtcatcatgttcaccgagaaccccagcaggtacatcaacatcagtgtacccagcaggcacaccggcaccacgatggacgggatcagggtgtaacggacgttctgcaggaacaggaacatccccaggaacaccaggaccatcgcttcgatcagggtgtggatcaccttctcgatggccacgtctacaaaccgcgaggtgtcgtagggcacgctgtactgcatgtcctcggggaagaacgccgacagttcggcgagacgctgtttcaccagggtagcggtctggatcgcgttggccccgggcgacagctggatcgccccgcccacggtgggcgtgccgttcagtcgcgaggaaatgttgtagctctccttgccgagttccaggcgcgcgacatcggcgagccggaccagcgagccgtcctggttggcgcgcagcactacctggccgaactcctgcggatcgtccagggtgcccttcaccgccagggtcgccgtcagctcctgcgcggaactgcccggtgcgctgccgaaggcgccggccggcacctgcacgttctgcccgcggatggcattgctcacgtcgtcgatggagaggccgaagcccaccagcttttgcggatcgatccagacccgcatggccgcctcggaagagaagaattgcagcttgccgacgcccggcaggcgccgcagctcgttgttgatattgcgcgcggcgtagtcgccgagggcggtggtgtcgctgcgctgagcgccttccttgtagctgagcgcatagatcagcaggaaaccggcgctggtctgctcgacctgcaggccctgggtcagcaccgcctgcggcatgcgcgcctcggctttcttcaggcggttctgcacgtccacctgggccaggtccggatcggtgcccggctcgaaggtgacgacgatctcggcggtgccgttggagttgttggtcgactcgaagtagagcaggcccttggcgccgttcagcgactcctcgagcacactggtgacggagtccaccagcaccttcgccgaggcgccgggataggtggcggtgatggtgatctgtggcggcgcgacattggggtactgcgctaccggcaatttggaaatgaccagcaggccggccagggagatgaacagggccaccacccaggcgaagttcggccgcttgatgaagaattcggacatcggaaaatcctcggggcgaacccgcccttactgttgcggcgcaggtga

SEQ ID NO: 14117 - DNA, 1161 bp, Pseudomonas aeruginosa
ctgggcttgcgcctgggcaccatccggcttcggcacgatcttcacccccggctgcaccgcagccaggccgccgactatgacccggtcacccggctccaggccctcggtgatctgccagcgcgaaccctgcatgacgccggtaccgacgctgcgcgactcggcgcgctcgtcggcgcccaccaccatcacctgggcgctgccgtcgctggagcggtgcacggcccgttgcggcaccaggatcgcctggttgtcgatgccctggggcgtacgtacgcgcacgtacatgcccggcagcaggaccccgtcggggttggcgaacttgccgcgcagggcgatctggccggtaccgcgatccaccgccacgtcggcgaactgcaacgcgccctggcgctcgtagggcgtcccttcgacgcgcagggtcagcgcctggctgtcgccggcggccaaggtgcctttcttcagggcgtcgcgcaggcgcagggcctcggccgcggtctgggtgaaatccgcatagatcggatcgaactgctggatgcgcgccatcagcgtcgcctcgccctgcccgaccagcgcgccctcggtcaccagcgcgcggccgatgcgcccggagatcggcgcagtgaccgaggcgtagccgaggttcaggcgcgcggtctccaggtcggcctgggccgagcgggtcgccgcctcggcgctgcgcaggtcggcggtggcggtatcgaagtcctgctggctgaccgcctggatcttcaccagcggctcgtagcgacgcacccgcgcctgcgcctcgaacagcaccgcgcggttccgcgccagctcaccctcggcgcgcgacaccgcagccttcagcggtgccggatcgatctggaacagcaggtcgccagccttgacgtcggcgccctcctcgaagcgcttccgcacgacgatgccggccacccgcgcgcgcacctcggcgacacgcaccggttcgatccgcccaggcagttccgaactcagcgccaggggctcggcctgcaccgtcaggacctccaccggcaacaccatttcggcggcctcctgtcgctcttccgccggcccacaacccgccaacgcgatggccatagccaacgccccgatccttcctattgcacgcaaatcagccatgacacacccgaccgttga

SEQ ID NO: 14118 - DNA, 1866 bp, Pseudomonas aeruginosa
cgagcgactcatcaaggcgctggcagtcgctatcgtcgaccgcccgcgagcgacgctgaaggaactggccgaggcggccggcgtaagcaaggccaccctgcaccgcttctgcggcacgcgggacaacctggtgcaaatgctcgaggaccacggagagaccgtactgaaccagatcatccagacctgcgacctggagcatgccgagcctctggaggcgttgcagcgcctgatcaaggaacacctcacccaccgcgagctgctggtattcctggtattccagtaccgcccggacttcctcgacccgcacggggaaggcgcacgctggcagtcctacctggaagcgctggacgccttcttcctgcgcggacagcagaaaggcgtgtttcgcatcgacatcacggcggccgtgttcaccgaactgttcatcaccctggtctacggcatggtcgatgcggaacgtcgcggacgggcggccagctccaattccgcgcataccctggagcagatgttcctccatggcgcctccaatccggcgcgctcctgaccctcgcgcccgcggcggcgcccctctcgtcgccgcatggcacggaccgatccgcgtgccgtcgacttcggccgcccggaggcctgctcgacactcgggaagatcagtcgtcaccggtcctgcgacaaagtgcctcgacagccggaaaggaccgtgacgctcgtcggcgatactggcacttggccttgcttccgggcatcctaactgtctaccgaatcacacctcccccaggaattccggtcagtgtcgaccccctcgctaaccccgtcgccgcctcccgccggcgacccactgaccgtacccgaccgaccggcagccaaggctggcctgctgttgctggtcctgttgatgctcggcctgctgctctggcagatgagccaggagctgcgccagcaggaacgcttcgaacacgagcgagccgcggcccagctcgatcgtctcaacgaccgcctgtccctgaccctcgaactcaaggcgcgcaccgccctcgccctgctcccgggcgtgccccccagcgagcgtggcgagatacagggcaggctgttgccgcgcatcagcgatgcgctgccgcaggtgcgccagttgcaatgggtggacagcgccctgcagacggacagcccgtcgccggaaacgacgctgcccgagcagttgcgccagcacgccggctccggcctctaccactattgcctcgacccgcgcgacggcgaatccctctacctgaccctgcgcgaacccggcagccgccgcgacagtggcttctggctgttgcacctggccagcgacagcctcgcccagtggagtcccgacctgcccaccggcaacctgctctggcgcctggaagaccaatacgccgggcgggtgctctggcataccccggggagcacggcgctgctcgacgacatgcagaccctcggcgtggaaccgctgcgcaacagcgactggcagcttcgcgggctctacgacagcacgcgagtgcggctcggcctgctgccgggaatcggcggcgagctggcgatcttcctcctgctggtcggcgtcaccgtgtacatgctgctgcgcctgcaccgcgagcaacagggcctgcgcgccatgaccctggcctcgcagcgcagcctgcgccaggcggccacggcactggcggcgatcgacgagcgggtgctggtgacccgcgccgacggccgcctcagctacctcaatccccaggccgaacgcctcttcggcatcagttcggcccaggcccgccagcatcatctgctgggcctgctgccggacctcgagccaggctggctgacggacgccggtggcgacggcgagacccgtag

SEQ ID NO: 14119 - DNA, 1767 bp, Pseudomonas aeruginosa
cgagctgctgccgctgcgggtgcgcggcgagccgcggacgttcaccctcagccgccatccgctggccagctatccggcgctcgccgaccaggcctggaccctccgcgagcagatactccagggcgggcaggtctgggtgttgcgcgacgtcaccgaggaacagcacgccctcggcgtcctggaggaaacccggcggcgctaccaggacatcttcgaaggggtcggcgtggccctctgcgtgctcgacctctccgccctgcgccaggctctggtggaacaaggcctggacagctgcgccgcactgcgcgcctggctcgccggcgaacccgggcggcagcaggcgctgctggagcggatccgcatcaccgagatcaacgatgtcagtcgccgcctgctgcagatcgagtccaccgaacaggcctggcagcgcttgctcgaccacggcccgctacaaccggacagcctgcgcctgcaggtgatcgaggcgctcatcgaacgccggccggtactcgaactggaagccacgctgcgctgcggcaagagcacgccgcggcacctgtggttgcaactgcgcctgccggaaaaccccggcgaatggcatgcggtgcccctcagcctgtccgacgtcaccagtcgcaaggaagtcgaactgtcgctgatcgagcgcgagaagttctggtcggacgcggtccaggcggtgcccgataccctctacatccacgacctgcacgcgcgccgggtgatcttcagcaaccatcacctgggccagcagttgggctacaaccaggaagaactggcgcggatgggcgagaacttctgggaaaccctgctgcaccccgacgaccaggaatactactggcgcatccgcaacctgcagcacgtggtcggcgacggcctgctgctcgacagccaactgcgctggcgccaccgcgacggccgctggcactggttcgacatccgcgagcaggccttcagccgcgaccgcagcggtcgcgtggcgcgcctgatcggcgtggccaaggacatcaccttcaccgtcgaggcgaacaacgcgctgcgcgagaacggccgacgctaccgcatgctggcggaaaacatcagcgacgtgatcttctccaccgacgccgaactcaacgccagctacgtcagcccctcggtacagcacgtgttcggctacagcccggaatgggcgctgctcaacggcctccatcagaccgccaccaacccgcgccagctcggccgcctgaacggcctgctgcgccgcgtgcggcacgccatcggcgaccgccagaagctcgccgagctgcgggaaaaccctggccagcatctgttcgccctcgactgcctgcgcgccgacggacgcaagattcccatcgaactgcggatcgtcctgatgtgggacgagcacgaccgcttcgaaggcctgctcggcatcgcccgcgacatcagccagcagcgccgcgccgaacgcgagctgcggatggcggcgacggtattcgaacactccacggcggcgatcatggtcaccgacccggccggctacatcgtccaggtcaacgattccttctcgcgcctgaccggctacagcccggccgacgtgctcgaccagcagccgcgcctgctcaccgccgaccgccaggaagccaaccagctcaagcacgtgctcgccagcctgcagcacagcggcagctgggaaggcgagatcctgcagaagcgcaagaccggcgaactctatccgtcctgggtcggcatcaccgcggtgcgtga

SEQ ID NO: 14120 - DNA, 831 bp, Pseudomonas aeruginosa
actgggcgagttcgtcctccactaccagccgcagttcaccggcgacggccgccgcctgaccggcgccgaggccctgctgcgctggcagcatccgcgccgcggactggttccgccgagcgagttcattccggtgctggaggagatcggcctggtggcccaggtcggcgactggctgctggcggaagcctgcaagcagttgcgcagctggcacaaggccaaggtgcgggtgccaaaggtctcggtgaacctctcggcacggcagttcgccgatggccagttgggcgagcggatcgccgcgatcctctacgagacaggcatcccgccggcatgcctggagctggaactgaccgaaagcatcctgatgagcgacgtcgccgaggccatgcagatcctctccgggctcaagcgcctcggcctggccatcgcggtggacgacttcggcaccggctactcctcgctgaactacctcaagcagttccccatcgacgtgctgaagatcgaccgcagcttcgtcgacggcctgccccacggcgaacaggacgcacagatcgcccgggcgatcattgccatggcccacagcctgaacctgatggtgatcgccgagggcgtggagagccaggcccagctggacttccttcgcgagcacggctgcgacgaggtgcaaggctacctgttcggccggccgatgcccgccgagcagttcggcatgctctacgccagcgacgtgctgttcatgttcaacgagggctgagccgccgtgcggcgcgcttgagcgccgcttgtccgcgacatgatggcctttcatgtgccagcacccgccgcatgggttag

SEQ ID NO: 14121 - DNA, 1296 bp, Pseudomonas aeruginosa
aatgcgcgccttttcccagcaccgatccttatgaggaccgccatgttcagccgtgatttgaccctcgcccgctacgatgccgaactctttgccgcgatggagcaggaagcccagcgccaggaagagcacatcgagctgatcgcctccgagaactacaccagcccggcggtgatggaagcccagggttcggtgctgaccaacaagtacgccgaaggttatccgcacaagcgctactacggcggctgcgagtacgtcgatatcgtcgagcaactggccatcgaccgcgccaagcaactgttcggcgccgattacgccaacgtccagccgcacgccggctcccaggccaacgccgcggtctacctggccctgctgtcggccggcgacaccatcctcggcatgagcctggcccatggcggccacctgacccacggcgccagcgtctcctcctccggcaagctgtacaacgctgtgcagtacggcatcgacgccaatggcctgatcgactacgacgaagtcgagcgcctggccgtggagcacaagccgaagatgatcgtcgccggcttctccgcctattcccaggtcctcgatttcgcccgcttccgcgccatcgccgacaaggtcggcgcctacctgttcgtcgacatggcccacgtcgccggcctggtcgccgctggcgtctacccgaacccggtgccgttcgccgacgtggtcaccaccaccacccacaagaccctgcgcggtccgcgcggtggcctgatcctggcgcgcgccaacgaggagatcgagaagaagctcaactccgcggtattccccggcgcccagggcggtccgctggagcacgtgatcgcggccaaggcggtgtgcttcaaggaagccctgcagccggagttcaagacctaccagcagcaggtcctgaagaacgcccagaccatggcccaggtcttcctcgaccgcggtttcgacgtagtttccggcggcacccagaaccacctgttcctgctctccctgatcaagcaggacatcaccggcaaagacgccgacgccgccctcggccgcgcgttcatcaccgtgaacaagaactcggtcccgaacgacccgcgctcgccgttcgtcacctccggcctgcgcatcggtaccccggccgtgaccacccgcggcttcaaggaagccgagtgccgcgagctggccggctggatctgcgacatcctcgagaacatgggcgacgagtccgtggtcgacggcgtacgcgagaaggtcaaggcgatctgcgccaagttcccggtctacggcaactaa

SEQ ID NO: 14122 - DNA, 1365 bp, Pseudomonas aeruginosa
tgcccggtcaccacccagccgcggccgttgtccagggtgatcacaccgaagtcgcccgccggcgtgccgacctgtaccgctccccactcggccagcaatgcccgcgcctgggccgcgaggtccggctccggctgcgtgaggatcacgcaagtgccctgggcgaacagcacccaggatttgtccgcgccacggatgcagtcccgccaggcgccgatcaatgcgttcctgtccatttccacgctcctttggcgtcgatgcgcctcagcggccttcgacgatgcgttcgaagccctcgcggatactgtcctccggcaggttgtcgccgatgaacacgatcacgctctcgcgcgcctcgtcgtcccgccactcgctatcccagtcgaagccgtagagtcgcagcacgccctggaacaccaggcgacgcggctcgtcggcgatgttcagcacgcccttgtagcgcagcagggaattgccatgccactgcaacaggtcgtccatgaactcgctcagcctttcgagatcgagcggcgtgtcgctgcgcagtaccagggtgccgatgcgatcgcggctgtccttggctgccaccgctcgcagcgggcgcaggccgatgccaggaccgaggtcggcgttgaggttgaagccacgtacgtcgagcaggtgcgccaggtcgatgcggccgtgctcgaccacatgcaccagcgccctccggttgatccgttgcaggcgctggcccagggcctcgaaggtggcggcgtcgaccaggtcggtcttgctcaccaggatgcggtcggcgaagccgacctgggcctgggcgatggtttcctgcaggtgacgctcggcgttggcggcgtccaccagggtgatgatgccgtccagcacgtagcgctggcagagttcctcgtcggcgaagaaggtctgcgccaccggcgccggatcggccaggccggtgcactcgatcaccaggcggtcgaagtcgatctcgccgttgtcgcggcgctccagcaggaggaacagggccttttccaggtcggtgttgatcgagcagcagacgcagccgttggacagcgtcatcacctgcaccggctcgacgccgagcaactggccgtcgatcggcgtctcactgtactcgttctcgatcaccgcgatcttcatgccgtgctcggcctgcagcaggtacttgagcagggtggtcttgccggcgccgaggaagccggtgagcacggtgacggggatcggggcgtggttgtcgttggctacttcggacatgcgcaacttccagaaaagacgcgggccacgtcagacgtggcccgcggaaggatggggattcagcagcagcggatcggccgacccttgccgccaccgtag

SEQ ID NO: 14123 - DNA, 747 bp, Pseudomonas aeruginosa
gcgttcagcaccacgtgctgcatctggccgatatccttggccggcgccagcacctggccggcatccagcgcggtggcgtacttctcgccaagagcgacgaagccgaccgccgggttgctgtcgaagatcttgatcaggcccgcggtggtggtgcagatcagcaaccaggccgccggcaggatggtgacccagacatactgctggcgcttcatcttgatcaggaccacggtggcgagcatcagcgcgatgccggcgagcatctggttggaaatgccgaacagcggccacagggtattgatcccgcccagcgggtcgaccacgccctggtacagcagccagccccacagcgccacgcagccgccggtgccgatgatgttggcggtccacgactcggtcttcttcagcgccggcacgaagttgcccagcaggtcctgcagcatgaagcgcccggcacgggtgccggcgtccaccgcggtgaggatgaacaaggcctcgaagaggatcgcgaagtggtaccagaaggccatggtgttctcgcccggcagcacctggtggaggatgtgcgcgatccccaccgccagggtcggcgcgccgccggcacgggccaggatggtggtctcgccgatgtcctgggcggtctgggtgagttgctccggcgtgatggcgaagccccagctgctgacggtcgcggccaccgcgttgacgtcggcgccgaccaccgccggcgggctgttcatggcgaagtag

SEQ ID NO: 14124 - DNA, 486 bp, Pseudomonas aeruginosa
ccagcacgacgaacgtcgacgtttccaccggatcgccttcgacgccgacagcgagatcctccagggcgaacggcgctgggaggtcttgctccacgacgtctccctgcacggcatcctggtcggccagccgcaggactggaacggcgacccgcaacggcccttcgaggcccgcctgtacctgggcctggatgtactgatccgcatggagatcagcctggcctgggctcgcgacggcctgctcggcttcgaatgccagcacatcgacctcgactccatcagccacctgcgccgcctggtggaactgaacctgggcgacgaggaactcctcgagcgcgagctggccctgctggtcagcgcccacgacgactgaggcgggtcactcgaagagggcgtccagggcctgctcgaggcgcgtcacggcgatcacctgcaatcccgccggcgcctccttcggcgcgttgccgaggggtacgatggcacgcttga

SEQ ID NO: 14125 - DNA, 480 bp, Pseudomonas aeruginosa
cgctcagcctgccggtacgcaaccagccgctcacccagggcaaggccaccctcgactcgctgctcgccggcatccgtttcatccgcagccgaccggacatcttcggggcaatctccctcgacctgttcgccgtgctcctcggcggcgccaccgccctgctcccggtgttcgccaaggacatcctgctcaccgggccctggggcctcggcctgctgcgctcggctccagcggtgggcgccctggcgatgtcgttctggctggcgcacttcagcatcgaacgcaacgtcgggcggatcatgttcctctccgtgggcatcttcggcctggcaaccatcgccttcggcctgtcgaaatcgttctggctgtccctcggcgtgctggtggtactcggcgccgcggacatggtcagcatggtcatccgcggcgccttcgtgcagctcgaaacccccgacgagatgcgcggccgggtcagcgcggtga

SEQ ID NO: 14126 - DNA, 669 bp, Pseudomonas aeruginosa
agctgttccctagcctggcgcaacgcgaccgcctgcactgaggccaatgccgtcgcgcgtcgctgccccgacagcggcgtatcggcgataacgcctggggcgttatccgtcctccccatggaacaccgcaccttctcggcaataagaaagcccggcatcgagccgggcttttctcgcaccttgcggcgtgatccgcggtgtcaggcggggcgccgcatctcccgatgcaggcggtcgacggtgcgctcgctaccgttgtcggccaggcgcagatcgacgcgccccatgtccttgtgcagacggtcgacggtctgttcgctgccgttctcggccaggcgcgcctcgcggctggtcatgtcgcggtgcaagcgatcgatggtctgctcgctgccgctttcggcgacccggcgttcttcctggacgcgcggcgcctgggtcttgcgcaggcgttcgagggtacggtcggaaccgtcggaggcgatcagttgttgggcaccgcgcagggcgatggattcgacccgcggtgcagcgaaggcggcattggcggtcagggtagcaagggcgatggcgaggatcagcgggcgtttcatggcagtggctccaggtattcgttacgtggggccattctctgttcgggaaactcgattggaaaacgaagcgcgccaatag

SEQ ID NO: 14127 - DNA, 2958 bp, Pseudomonas aeruginosa
tgcgcattgcgaaaagggttagaaattcagaggcttgttgaagcagctccagtagtcggccaggtagctctggttcgagcaacccgccccactctcggcctctgctctgagcggacgatcggtgaactgccccacccgcttggcgctggcgtcctccgccggacccgcggcggtagccggcagcaggttaggatcgctgacgtccatgcccagagcgtaggcgcgcaggaacgggttttcgaggaacgggttttccagcgtggtggtgcggtagaccgcatccccgggggtatccggatcgcgccccttctgcagttcgcgcaagtcggagagcgctgccagttgccccaggtcgcccggcgtgaccggcagcggcaggatgctcagcaggttgccctggtagttgagctggtagttgccgctggtgagggcaagcccaccctggaggatgtcgtactggcctacggcttcgccgcccacccgaccgagcccgccggcgagcacctgaccggcgctatcgccattcttcaggccggaaacctgataggtcagcgccgggtcggcggtgccgacctgcttgctcttggcatcggcgaatacgttgagcagcgccttggtgatggtcaggtcattaccctggtaggccaggtcatagttgccactggtcagcaccaggccgccctggttgatgccatacacacccacgttctcgcctgcgtcgcggttcagcccgccggtcaggatcgagccggcgctgtcaccgttcttcaggccgctgacctggtaggtcaggctcgggtcagcgtcgccatagaccttggtcttgccgtcggcgatcacattgagcagcgccttggtgatggtcaggttgttgccctggtaagccaggtcatagttaccgctgaccagacccaggccaccctgctgaatcgcatagttgcctacgttttcgccggagacacgaaccaggccgccgccattgagcaccgcgccagcggtatcgccattcttcaggccgctgacctggtaggtcaggctcgggtcggcatcgccatagaccttggtcttggcatcggcgatcacattgagcagtgccttggtgatggtcaggttattgccctggtagctcaggtcgtagttaccgctgttcaatgccaggtcgccctggttgatgccatacacacccacgttctcgcctgcggcgcggttcaacccaccggtcaggatcgaaccggcggtatcaccgttcttcaggccgctgacctgataggtcaggctcgggtcagcgtcgccatagaccttggtcttggcatcggcgatcacattgagcagtgccttggtgatggtcaggttattgccctggtaagccaggtcatagttaccgctgaccagacccaggccaccctgctgaatcgcatagttgcctacgttttcgccggagacacgaaccaggccgccgccattgagcaccgcgccagcggtatcgccattcttcaggccgctgacctggtaggtcaggctcgggtcggcatcgccgtagaccttggtcttggcgtcggcgatcacattcagcagcgccttggtgatggtcaggttattgccctggtagctcaggtcgtagttaccgctgttcaatgccaggtcgccctggttgatgccgtacacgccgacattctcgccagccacgcggctcaggctgccaccgttgagcaccgcgccagcggtatcaccgttcttcaggccgctgacctggtaggtcaggctcggatcggcatcgccgtagaccttggtcttggcgtcggcgatcacattgagcagtgccttggtgatggtcaggttattgccctggtagctcaggtcgtagttaccgctgttcaatgccaggtcgccctggttgatgccatacacacccacgttctcgcctgcgtcgcggttcagcccgccggtcaggatcgagccggcgctgtcaccgttcctcaggccgctgacctggtaggtcaggctcgggtcagcgtcgccatagaccttggtcttgccgtcggcgatcacattgagcagcgccttggtgatggtcaggttgttgccctggtaagccaggtcatagttaccgctgaccaggcccagtccaccctggttgatgccgtacacgccgacattctcgccagccacgcggctcaggctgccactgttgagcaccgcgccagcggtatcgccgttcttcaggccactgacctggtaggtcaggctcggatcggcatcgccgtagaccttggtcttgccgtcggcgatcacattcaacagtgccttggtgatggtcaggttgttgccctggtagctcagatcgtagttgccgctgttcaatgccaggtcgccctggttgatgccatacacacccacgttctcgcctgcggcgcggttcagcccgccggtcaggatcgaaccggcgctgtcgccgttcttcaggccgctgacctggtaggtcaggctcggatcagcgtcgccatagaccttggtcttgccgtcggcgatcacattgagcagcgccttggtgatggtcaggttgttgccctggtaagccaggtcatagttaccgctgaccagacccaggccaccctgctgaatcgcatagttgcctacgttttcgccggagacacgaaccaggccgccgccattgagcaccgcgccagcggtatcgccattcttcaggccgctgacctggtaggtcaggctcgggtcggcatcgccgtaaaccttggtcttggcgtcggcgatcacattcagcagcgccttggtgatggtcaggttattgccctggtagctcaggtcgtagttaccgctgttcaatgccaggtcgccctggttgatgccgtacacgccgacattctcgccagccacgcggctcatgctgccaccgttgaacaccgcgccagcggtatcaccgttcttcaggccgcctga

SEQ ID NO: 14128 - DNA, 2838 bp, Pseudomonas aeruginosa
gcagtgcttggtgatggtcaggttgttgccctggtagctcagttggtagttaccgctgttcaatgccaggtcgccctggttgatgccatacacacccacgttctcgcctgcggcgcggttcaacccgccggtcaggatcgaaccggcgctgtcgccgttcttcaggccgctgacctggtaggtcaggctcgggtcggcatcgccgtagaccttggtcttggcatcggcgatcacattcagcagtgccttggtgatggtcaggttgttgccctggtaagccaggtcatagttaccgctgaccagacccaggccaccctgctgaatcgcatagttgcctacgttttcgccggagacacgaaccaggccgccgccattgagcaccgcgccagcggtatcgccattcttcaggccgctgacctggtaggtcaggctcgggtcggcatcgccatagaccttggtcttggcgtcggcgatcacattcagcagcgccttggtgatggtcaggttgttgccctggtagctcagatcgtagttgccgctgttcaatgccaggtcgccctggttgatgccgtacacgccgacattctcgccagccacgcggctcaggctgccgccgttgagcaccgcgccagcggtatcgccattcttcaggccgctgacctggtaggtcaggctcggatcggcatcgccgtagaccttggtcttggcgtcggcgatcacattgagcagcgccttggtgatggtcaggttattgccctggtagctcaggtcgtagttcgcgctgaccaggcccagtccaccctggttgatgccgtacacgccgacattctcgccagccacgcggctcaggctaccgccgttgagcacggcaccggcggtatcgccgttcttcagcccggacacctggtaggtcagtgccggatcggcatcgccatagaccttggtcttggcatcggcgatcacattgagcagtgccttggtgatggtcaggttattgccctggtagttcagggtgtaattgctgctgaccaggcccagtccaccctggttgatgccgtacacgccgacgttctcgccagccacgcggctcaggctgccaccgttgagcacggcaccggcggtatcgccgcgcttgagaccggagacctggtaggtcagcgccggatccaggtcgccgtagaccttggtcttggcatcggcgatcacgttcagttgtgccggggtgatgcgcaggtcgttgccgacgtagctgagggtgtaattggccgtgttgaggcccagcccgccctggagtatcccgtagttgccgacgttctccccggccacccggccgaggttgccgctcagcacgccagcggcggtatcgctgttcttcaggccactgacctggtaggtaagggtcggatcggcgtcgccatagaccttggtcttggcgtcggcgctgacgatcaattgcgccggcgtgacggtcagcttgccgtcctggcgcaccagttggtaacgctggctgaaatactcgctgccattggcgttaccggtgatcgcgtactgcccgacgttcgacgcctgggtcgccgtggtgctggcggtcgcctggtagaggtcgttgaactggctgttgacgtaggcgtcgatggcgttgatgccggacatcgtggccgtcagagtcggattcacatcaccgtagacgcgggtagcgtcattggcggtcagggtggcggtctgctggcgggaaaggatgtcgccggcagtggtggtggtcttgaacatctccacctgggcgcgctcggcgaagctgttgaacgctccctcgcgcatgaacaggtccaggcgggtatcgacgcggctggtcttgccgccgaggccgaagatcagttcctcggtcaggccggtgccgacgtcgtactgcagctcgtcggtcacgccgatcacgccgccgaagcccttgacgccccaactggtgccccagtttccggtccaggtggtgacgctgccgttgccggcggcgacggtgaacccgctgggcgcaccgccgttcggggtggcggtgacgttgctgccgttgacctggtagcgcaggttggtcaccaggtagtccgacgagtcgttggtcgggaagctggcggaaccgctgacccgccgatagggcagcgcggtgaacaccaggcggtcgaactcgctgttgccgtcggcggtcagcgtgtagttgccggtggtgccgacgctgttggcctcgagaatccgcgtaccgacgctggagacgatgttctgcgcggtgccggtcatgctctggttgatgaacggatcgaacaccgtgccgctcgtggtcacgccggtggcgttgctctgccggtacttgagcgtaccgttgaaggtctgcagcgccaggttgccggcgtagttgtcccaggaagccaggtcgatgctaccggcgcggccggcgaggttggcggcgatcaatgcggtaccggcctgctggctgatcttgccggcggtgctggtctgcatccacagggtgccgctgcccaggtcgacgatgccgctggtctgcggcgtgccgccgctgaggaagctgatgttgccgccggcgcggattgccaggctgccgttgcggaacaggatcggcgcagagatatccaccgcaccggcaggtccggtggcgatcagctccaggccgcgactggcgccgcccaggttgctggtgatcagcggcgcttccaccgacagccggtcgctggcgctgagggtcaccttgccgcctgccagcgccccggtaaccaccgaggcattcaccgtcgcgtcgccgctggcgccgttagcgccccccaccgaacctga

SEQ ID NO: 14129 - DNA, 906 bp, Pseudomonas aeruginosa
gctaggcagccccccgtccgctgccgccaaggaaccgtccatgagccatgccctgcgcgccgttttcctcgaccatgcctccctcgacctcggcgacctggacatgcgccccctgcgcgccgccttcgacgagctgcaactgcatgccgccagccaaccgcaggaagtcgccgcgcggctgcacgatgcgcgggtcgcgatcagcaacaaggtgccgatcgacgcgcaatgcatcgccgcctgcccagagctggaactgatcctggtcagcgctaccggcaccaacaacatcgatctcgctgccgctcgcgagcgcggtatcgtcgtcgccaactgccatggctacggcacgccctcggtagcccagcacaccctcgcgctgctactggccctggctacgcgcctgccggactaccagcaggcggtacgcagcggtcgctggcagcaatccagccagttctgcctgctggacttccccatcgtcgaactggaaggcaagaccctcggcctgctcggccatggcgaactgggcggggcggtggcgcggctggcggaggcgttcggcatgcgcgtgctgctcggtcagttgccaggacggcctgcccgggcggaccgcctgccgcttggcgaactcctgccacgggtagacgccctgaccctgcactgcccgctgaccgaggacacccgcgggatgctcggcgccgccgaactggcgctgatgaagcctggcgccttcctggtcaataccgcccgtggcggcctggtcgacgaacaggcgctggccgacgccctgcgcggcggccacctgggcggcgccgctaccgacgtgctcagcgtcgaaccgccgagaaacggcaatccgctgctggcccccgacatcccgcgcctgatcgtcaccccccataa

SEQ ID NO: 14130 - DNA, 933 bp, Pseudomonas aeruginosa
agcttttcctctccctgcccgcacgcccgcagccagacccttccgtggccacccgccgggaggccgccgatgactgacctgaacgccagccagggccagcaattgcggcgggtgctcaagccgcgccacctgaacatgatcgccatcggcggctccatcggcaccgggctgttcgtcgcctccggggccaccgtggccaccgccgggcccggcggtgcgctgctttcctacgcactgatcgggctgatggtgtacttcctcatgaccagtctcggcgagatggcggcctacatgcccgtttccggctcgttctgcacctatggcagccggttcgtcgaagatggcttcggtttcgccctcggctggaactactggtacaactgggcggtgaccatcgccgcggagctggtggcagcgcaactggtgatgagtttctggttccccgaggtgccgggcatctactggagcgcgatcttcctgggcatcatgttcggcctcaacgtgatttccgcgcgcggcttcggcgagagcgaattctggttcgccctgatcaaggtagtcacggtggtgatcttcatcggcgtcggcctggcgaccatcttcggcatcatgcatggcgtggagtcgcccggcttcagcaacttcaccatgggcgacgcgcccttcgtcggcggcttccaggcgatggtcggggtggcgatgatcgccggcttctcgttccagggcaccgaactgatcggcatcgccgccggtgaatcggaaaatccgcggaagaacatcccgatcgccattcgccaggtgttctggcgcatcctgatgttctacatcctggcgatcttcgtgatcggcatgctgattccctacaccgacccgaacctgctgaagaacgatgccagcgacatcagcgtatcgcccttctccctgctcttctag

SEQ ID NO: 14131 - DNA, 945 bp, Pseudomonas aeruginosa
cgcgccggcttccccccggcggccgggggtgatgaacgcggtgatcctctcggcgatcctctccgccggcaactccggcatgtacgcctcgacccggatgctctacaacctcgccctcgagggcaaggcaccgcgcctgttctcccgcgtctcgcgcagcggcgtgccacgcaacgcgctgtacgccactaccctggtcggcgccctgtgcttcctcacttcggccttcggcgacagcaccgtctacacatggctgctgaacacttcgggcatgtgcggcttcatcgcctggctgggcatcgccatctcccactatcgcttccgcaagggttacctggcccagggcggccgcctggaagacctgccctaccgggccaagctgttccccttcggcccgctgttcgccttcgccctgtgcatggtcatcaccctcgggcagaactaccaggcgctggtgggcgaacgcatcgactggatcggcctcctcgccacctatatcagcctgccgctgttcctggcgatctggctgggataccgctggaagaagcgcgcacgcttcgttcgctaccacgaaatggacgtcagcccgaccaatacctgactcaccctgccgcccagcgattcctcgcggatcgctgcggatgccggcacgtttccttgcgatcaggctccctcgccgccctcccggacgaaagtttccgtcccggacttgcccaagccgcccggcttgggcagaatgcgccccgtcctaggggagtagtctcccgcgagcgccgcaccggcctcgcccggcacgcgtcaacacacttggtccgcagaccatggcgcgcgcgacccaagcctgcccagacaggccaagggtttgacaagacctatgacacgcacgatctgacccggggcgggcagatggcgcgtgtcatggtgattggtcgacccgccccttag

SEQ ID NO: 14132 - DNA, 2205 bp, Pseudomonas aeruginosa
ggatttgccgtcctcctgccgataagctcctcagagacaattccaacaagggtcagaagtcccatcatgaagctcaagtcgatccagttttctgtcgccgccctcgccggcgccagcgttctaagcgtcgtcgtggtgctggtgctgtacgccctgttcgccggcgcgcgaacgcaggagctggtgcagcaacgcacccagggcctgttggagaaggtcatcaacgagcgcctggtggccctggcccgcgcccaggtcagccagatccagcgcgagctggagtatccgctgacggtggtccacggcctggccaacagcacccgcctgctcggcgagccgggcgccgacggcatgccgcagctgaacgccagccgcgacgaaatctccgcgctgctgcgcagcaccgtgcagaacaaccccaagctgctcgacaccttcatggcctgggaacccaatgccttcgataccgatgccgccttcgccgggcaacccggcaagggctacggcccggacggccgctacctgccctggtggtatcgcggcgccgacggcaagccgatcgtggaggccatggccgacagcatcgatagcgaaaagctgctgcccaccggggtgcgcgagaacgagttctatgcctgtccgaaagagaacaagcgtccctgcatcatcgacccggccccttacgaaatgggcggcaagaccgtgatgatgtcgtccttcaacgtgccgatcatggtcggtgaccagttccgcggcgcagtcggtgccgacctctcgctggccttcatccaggacctgctcaagcgcgccgaccagcagctctacgatggcgccggggaaatggcgctgatcgccagcaacggccgcctggtggcctacacccgcgacgacagcaagctcggcgagcccgccggcagcgtcctcgacggcaacgaagtggacaacctgaaaaacctcacggtcgaccagccgctctacgacatcgacgccgagcacggccacatcgagctgttcctgcctttcaccatcgccgacagcggcgtgcgctggaccctcatgctgcagattccccaggcggcggtattcggcgaactgcagcaactccagggcgagctgagcgaccagcgccagcaggatatcctcggcatgagcctggccggcctggtggtagcggccctcggcctgctggtggtctggctggtcggctacggcatcgcccggccgctgcgccaattggtcggcatgctcgacgacatcgcccagggcgaaggcgacctcacccgccgcctgagcagcgagcgcgccgacgagctgggctccatcgccaagggcttcaataccttccttggcaaactgcagaacatgatcggccaggtggtgcaatcggtgcagaaggtcagcgactcctcggagcacaccgccgacatcgccatccgcaccaaccagggcgtgcagcagcaactggcggagatcgaactggtggccaccgcggtccacgagatgaccgccaccgcccaggacgtggcgcgcaacgccacccacgccgccgaggcagccaaccacgcggaccaggccgcgcaccagggcaagcagatcgtcgaaagcagctcggcggcgatccaggccctggccagcgagatcggccgcgcggtcggagtggtgcagaacctggccaaggacagcgaaaacatcaacgcgatcctggtggcgatccgcggtatcgccgagcagaccaacctgctcgccctcaacgccgccatcgaggccgcccgcgccggcgagcagggtcgcggtttcgcggtggtggccgacgaggtacgcaacctggcgcagaagacccagcaggccaccgaagaaatccagagcatgatccagcagttgcagcagggcacccgcgacgtggtgaaggtcatgcaggacagccaggagcgcaccgacgacagcgtgcgccatgcgcgccaggcggccgaggcgctggaatcgatcacccaggcggtatcggtgatcaacgacatgaatccccagatcgccagcgccgccgaggagcagagcgcggtggccgaggacatcaaccgcaacgtcgccaacatcggccaggtcgccaaccaggtggccggcggcgccgacgaggcctcgcaggccagcgccgagctgacccgcctggccgagcagcagcggcgcctggtgaatcagttcagggtctag

SEQ ID NO: 14133 - DNA, 900 bp, Pseudomonas aeruginosa
aacatggattggaaagtatttctcctgcgcgtcgcggtcgcgctggtcctgggcgccctgatcggcgccgaacgccagctgcgccaacgcctcaccggcctgcgcaccaatgcgctggtcagcactggcgcctgcctgttcgtgctgatgacccagggcgtgcccggcctgggccggcgacgcttcgcggatcgccgcctacgtggtctccgggatcggcttcctcggcggcggcgtgatcatgcgcgacggcctcaacgtgcgcggcatgaacaccgcagccaccctctggtgcaccgccgccatcggcgtcctgtgcagcatgggcctgctgctggaggccacgctcggcagcctggtggtgctctgcgccaacatcctgttgcgcgacatcgcccaacgcctgaaccgccaggacgtgttgccggccagcgaggccgagcaacgctacgaagtgcagatcgtctgccgcgccgaggacgagatccaggttcgcagcctgatgctgcacagcctcggcagcagcgacctgcgcctgcaatcgctgcacagcgaggatctggacaacccggccaagctggaagtccgcgccgaactgctcggcacccccgaagctccggcgcagctggaacgcctggtcagccgggtcagcctggagaagggcgtcagctcggtgcgctggcaggtcttcgaactggcggccgactgagcggcggccgcctcaacacaacaggctgccggggccgcagggctccggcggctcctcggccagcggggcggcggcgttgtaggcgaggatcagttctcgcgcccgctccgtctgctcgtccgccaccaacaacgccagcagtccgccaggcggcagttcgccgatggcgccgaccaggtggcggccgctga

SEQ ID NO: 14134 - DNA, 1263 bp, Pseudomonas aeruginosa
cgccgaagtccccgcggtattgcaacgcctcctgagcgacgacgccttcctcggcgccctggtccgctaccgcttcccgcgcctggccggtcccctcggttggctgctcaaacctcttatagcccatcgcctggcccgcgaggtcaccggcatccgcagcgtcgccacgctgcaggacaagttcgagccctacgtcgaccacaccatcgagaaggccaccgatggcgtcacctactccggggtcaatcgcctcaagccagggctgcgccctacctgttcatcgccaaccaccgcgatatcgtgatggacccggccttcgtcaactacgccgtgtaccacgccggcctgccgaccccgcgcatcgccatcggcgacaacctgctgcagaaatccttcgtcagcgacctgatgcgcctgaacaagagcttcatcgtgcaccgttcgctgagcggccggcgcgagaagctcgccgcctaccagacgctctccgcctacatcaaccactcgatccgcgaggaccgccagtcggtgtggatcgcccaggccgaagggcgggccaaggacggcgacgaccgtaccgactcggcgatactcaagatgttccacatgagccgcaaggacgaacccttcgccgaaatggtgcgcgccctgcatttcatcccggtgtcgatcagctacgaatacgacccctgcgacctggccaaggcccgcgagttgcacacccgcgccagcaccggcgagtaccgcaaggcaccgggcgaggacgatgccagcatcgcgtgggcatcaccggtacaagggccgctgcacatcaacttcggcccgaggtggggggagttcagcagccaagcagctggccgccgaactggaccggcagatcctcggcaactaccgtctgttcccggtgcactacctggcctacgagatgagcgagaaccgcgacccgggcctcgccgtccccacggccgagagcctgttcggcagcgaggagctggagaaggcgcgcaaggaatggaaccgccgcctggagcaatgcccggccgagcagcgcccctggctggtgctgcaatacgccaacccggtgctcaaccaataccggatcaagcagcaatcctgaagacgaaagcccggcgccgccgggcttctccatcgggcaacggcttcgaacccgcaggcgatggacggataaccgcgatacgcttatccgcgtgcggttcggctcgccgaggtagggctctcagagccgcgtgctggcccagctga

SEQ ID NO: 14135 - DNA, 1617 bp, Pseudomonas aeruginosa
cggctccctccgccgctgcctgccggcccgtaccggcctcggccccgccccgtctgtcgtcaatttggtgctgaagattttggagaagcgttaatggcgcaaaacgatcacgaaacagtcgacatgctgctggtaggcgccggcatcatgagcgcgaccctggcggtcctgctcaaggaactcgaccccaacctgaagatggaagtcgtcgaactccaggagtccggcgcgatcgaaagctccaacccgtggaacaacgcgggcaccggccacgccggcctgtgcgagctgaactacaccccgcagtcggccgacggcagcatcgacatcaagaaagccgtgggcatcaacaccatgttcgaggtgtcgaagcagttctggtcgcacctggtcgccaagggcaccttcggctcgccgaagaccttcatcaacccggtaccgcatctgagcttcgtgcgcggcagcgaaggcatcgcctacctgaagaagcgcttcgaatcactgacgaagcaccacgctttcgagaccatggtctactccgaggacaaggccaccctcgccgagtggatgccgctgatgatgccgggtcgtccggccgacgaagcgatcgccgcgacccgcgtcgagggcggtaccgacgtcaacttcggcgccctgaccaaccagctcctgcaacacctggcggaacagccgggcgcgcagatccgctacaaccagaaggtcacccacctgcgccgcgccgataacggctggcgggtcaccgtcaaggacacccgcaacggcggcgaccgcgagatccaggcacgcttcgtcttcctcggcgccggcggcggcgccctgccgctcctgcaactttccggcatcccggaaggcaagggcttcggtggtttcccggtgagcggccagtggctgcgctgcgacaacccggaaatcgtcaagcagcaccaggccaaggtctacagccaggccgaggtcggctcgccgccgatgtccgtgccgcacctggacacccgtgtggtggacggcaagaaatccctgctgttcggcccctatgccggtttctccaccaagttcctgcgccatggctcgttcctcgacctgccgctgtcggtacgcccgggcaacatcctgccgatgctctcggtggcccgcgacaacatggacctgacccgctacctgatcggccaggtcatgcagtcgccggaacagcgcctggaagccctgcgcaagttctaccccgaagccagggccgaggactggcgcctggaagtcgccggccagcgcgtgcagatcatcaagaaggatccgaagaaaggcggcatcctgcagttcggcaccgagctggtggccgcccacgacggctccatcgccgccctgctgggcgcctcgccgggcgcctcggtgaccgtctcgatcatgctcggcctgatcgagcgctgcttcccggagcaggcccgctcgccggagtggagcgccaagctgaaggaaatcttcccggctcgcgagaaagagctggaaagcgacgccgagctgtaccgcagcgtcagcagccgttgcagcgaggtgctggaactgaccgcgaagaacgacgtgcaggccccggtcaacgccgagtga

SEQ ID NO: 14136 - DNA, 1911 bp, Pseudomonas aeruginosa
gatccgccaccccctcatccgccacaaactgggcctgatgcgccgtgccgatatcagcaccaagaacttccgcgaactggcccaggaagtcggcgccctgctgacctacgaggcgaccaaggacctgcccctggaacagtacgaaatccccggatgggccggcccggtgacggtggagaagatctccgggaagaagatcaccgtggtgccgatcctgcgcgccggcatcggcatgctcgacggcgtgctcagcctgattcccggcgccaaggtcagcgcggtcggcgtcgcccgcaacgaagagaccctggaagcacgcacctacctggaaaaactggcgccggacatcgccgagcgccgctcgctgatcatcgacccgatgctcgccaccggtggctcgatggtcgccaccatcgacctgctgaagaaggccggcagcaaggaaatccgcgccatggtgctggtcgccgcccccgagggcatcgaggcggtacgcaaggcccacccggacgtgatcatctataccgcctcgatcgacgagaagctcgacgagaacggctacatcattccgggcctgggcgacgccggcgacaagatcttcggtaccaagcagaaggaagcctgaacatgggcgatgccttccaggagccgctctggcgccaggtgctgtcaggcgcgcagatgctgttcgtcgccttcggcgcgctggtgctgatgccgctgatcaccggtctggatcccaacgtcgcgctgttcaccgccggcctcgggaccctgctgttccaattggtgaccgggcgccaggtaccggtgttcctcgcctccagcttcgccttcatcaccccgatcatcctcgccaagggccagttcggcctggccgcgaccatgggcggggtggtcgccgccggcttcgtctacaccttcatgggcctggcggtgaagatcaagggcaccggcttcatcgataaactgctgccgccggtggtgatcggcccggtgatcatctcgatcggcctggcgatggcgccgattgcggcgaacatggcgatgggcaaggccggcgacggcagcgagttgctgccgtaccgcaccgcgatgatgatctcgatgccggcgctgctcaccaccctggtggtggcggtattcggcaagggtatcttccgcctggtgccaatcatcgccggcgtgctggtcggcttcgccctgtcgttcgtcttcggcgtggtcgacaccgccgcgatcgtcgccgcaccctggctggaactgccgaaattcaccgcgccggaattcaactggcaggcgatcctgttcatcgtcccggtgggcctggccccggccatcgagcatatcggcggggtcatcgcggtgggcggcgtcaccggccaggactacctgaagaagcccggcctgcaccgcactctcctcggcgacggcctggccacctcggctgccggcctgttcggcggaccgcccaacaccacctacgcggaagtcaccggcgcagtgatgctgaccaagaactacaacccgaagatcatgacctgggcggcggtgatcgccatcaccctggccttcgtcggcaagttcggcgcgatcctgcaaagcatcccggtaccggtgatgggcggcatcctctgcctgctgttcggcaccatcgcctcggtcggcatgaacaccctgatccggcacaaggtcgatctctcggaagcgcgcaacctggtgatcgtctcggtgaccctggtgttcggcatcggcggcgtgctgatcggcagcggtaccggccccgacgacatcggcctgaagggcatcgccctgtgcgccatcgtcgccatcgtcctcaacctgttgctgccgggcaacgacggctggcagaacaaggcgctcgacgaacaacacaaggactcacactga

SEQ ID NO: 14137 - DNA, 696 bp, Pseudomonas aeruginosa
ggccgatcatttaaagtcgtgggaactttatttatccgccaacatcgtcctgcgtcaccgacattcgttatcgacaggaagttagagatgaataaacgcactccggcagtcttgttgttctgtgcctgcgccagcctgctgggcaccgcccaggccgccggtacgctgatcggccaggtcggcgtgcagatggtcatcggtgccggctgcaccatcatcaacggcagcgtcagcggcggtatcaaccagtggggaaccctggacttcggcagccattccgaccttaccaacgtggtcgacgcgcagaccgtcggcaccagcggcaatatccagatccagtgcagcaccggcctgaccccgagcctgacggtgcaacgcaggcttgcacgccagcggcgggccacgctacatgcagaacaccaccaccaccagcagcaccatcgcctacaacatctattcggaagccgcgcgcaagcgcggctgatccaggccaacacaccgggtggacatttcctccggtctccaccgggcaccgcagtcaaaatcccccctatacggcggggtggtgcccaccgggcaaagcacgcccacgcggacggcggggacgtacacggacaccctgcttggtcaccatcgcctggtaagacgcgccgccaggcgcggcgccgggcagcatggtcctggggggaccgatga

SEQ ID NO: 14138 - DNA, 507 bp, Pseudomonas aeruginosa
accgcttccctcgccggaggactgctctgcctgctcggctgcaacccggcaaacgcgcagaccgccaccatcgtcctgagcgccacgctgctcccggcctgcgaagcgggtagcgtcggcagcggtggcgcgatcaccttcggcaccctcgacttcggccagtacgcctccctgaacaacgccatcagcgccaccagccagcaaggcgcaggctccatccgggtcaagtgcgtcagcggccagacctatgcgatcacgctcgacggcgggctctacggcagcgtcgccacgcggcgcatggcgaacatcgccaacaccgccctcaccctgacctacaacctgtacagcgaccgccccggcggcatcgtctgggacaacaccaccggcgttgccgccaccggcaacggcaacgaccagtggtatcccatctacggcctggtgccggcacagaccacgccggtcgccgggacctaccgcgacaccgtcaacgtgaccatcagttggtga

SEQ ID NO: 14139 - DNA, 2439 bp, Pseudomonas aeruginosa
aactgcaactggcggacaacgacgcgccgatcagcgttcccggctactgaggcggacgtcggtcccgtgcctcgcccgtgtcagcggcgctctcgccaccaccgctcgctactgatcggcctggcgctgctctcccctgtccatgcggcggactacctggccggactgccgccgccgcaacccgctccgtccggcggcagcaacgtcctctactacctggaactggtgatcaacggccgcgacagcggccaggtggtgccggtcaacgccgccgatggccattacctgctcgacgccgcggccctgcgcgaagccggcgtgcgcctgcctggcaaccccgccggacaggtcgcggtggacgccctgcccgaggtccgggcggactatgacagcgccagccagcaactgcacctgcaagtgccgccggactggctgccggagcagcgcttcgacgatcccggactggtcgcccgcgccccggcgcgcagcagcctcggcgcgctgttcaactacgacctgtactactcggaccccgccgacggcgccacgccctggctttccgcgctgctcgagcaacgcctgttcgacggcttcggggtgatctccaacaccggcgtctacacccgctatttcggcgacgccgacaacctcgacagccgctacctgcgctacgacacctactggctgtacaacgacgaacgcaacatgcacagctaccaactgggcgactacgtcaacggcgcgctgaactggaccaccccggtacgcatgggcggctttcgcttcgcccgcaacttcggcgtacgtccggacctggtcacctatccgctgctgcgcttcgacggccaggccgccgtacccagcaccgtcgacctgttcatcaacggctacaaggccagcagcgccgacctgcaacccggtcccttcgccatcagcaacgtgccgtacatcaacggagccggcgaagccacggtggtgaccaccgacgcccagggtcgacaagtggtgaccagcctgccgttctacgtatccaacaccctgctggcgcgcggcctgagcgatttcgacctgtccgtcgggcgcctgcgcgacgactacggcctgcgcaacttctcctatgccgacaacgccgtcagcggcatctaccgctacggcgtcagcgaccgcctgaccctctccacccacgccgaggccgccagcgacctgcgcctgctcggcatcggcggcgacatcgccgtggccaccttcggcaccctcagcctggcggccagcggcagcgacggccagggcgacagcggccagcaatacctgctcggctactcctactattcgcgacggctcggcctcagcctgcaacacatcgagcgcagcgccggctatggcgacctcggcaccctggacggcgagtaccagttgagccggcgcaccgaccaggctaccgccagcctgaccttcgacgagcagggcaccatcggtaccggctacttcgacatccgcgcccgcgacggcagccgcacgcgcctggccaacctctcctacagccgcccgatcggcagccgcagcagcttctacctggcgctgaacaaggatctcgacggcgacggctacagcgcgctgatgcaactggtgattcccttcgacatcaacggcctgctgaacatcggcgtcacccgcgacagcgaccgacggtacagcgagcgggtgatctggagccgctccacgccgagccagggcggcctcggctggaacctcggctatggcggcggcgccagccgctaccagcaggccgacctgacctggcgcatgcagaacgtgcaactgcagggcggcctttatggcgagaccggcaactacacgcgctgggccgatctcagcggctcgctggtatggatggacaacgccgtgttcgccagcaaccggatcaacgacgccttcgtcctggtcagcaccaagggttatccacaggtgccgatccgctacgagaaccaactgatgggcagcaccgacgacaacggccacctgctggtgccctgggtcgcggcctactacccggcgaagttccagatcgagccgctggaccttccggccaacgtcagcgcgcccgaagtcgagcagcgcgtggcggtacgccagggcagcggcctgctgctggatttcccgatccgtgccgtagtcgccgccagcatcagcctggtggacgagcgcggcgaaccgctgccgctgggcagccaggccgaagaaaccggcagcggccagcgcgccagcgtcggctgggacggccaggtctatttcgaaggattgcaaagcgacaaccagctacgcgtggtccgccccgacggccgggcctgccaggcacgcttccgcctggacacgcgcaaacccaccgtcagccaggtcggcccgctgacctgctcggccccgatcggagatacgccatga

SEQ ID NO: 14140 - DNA, 1248 bp, Pseudomonas aeruginosa
tcctcacctactgagtcaggccggctgccgggacgccttccaatcctcgccgccctcgccttcccgtcgcaggctccagtccttcaggtgctccaggctggcgcgatagggcttgaggccgatccccagcaggaccaccgcaccaagcaccgcggccagggtcaccagcagcagcgagtagcgcagcgccatgtcgtcggcgaagacgaaatcggtgaccagcgccaccgccgtcgggcccaagccgagaccgaacagggtgaccacgaacaggtagatcgccgaggcctggccgcgcatcgagttgggcatgatctcctggatcgccgccggggccacgccgaacggcatgctcaggaagaacaccgtcggcgccatcagcgccgccgcccaattggcgttgtccagcagcggatagaccagggtgaagggaatcaccgcccaggcggcgagcagcccgacgcgcatgttcgcgtcgctgcgcccgcgcttcgcccagtagtcggccaggcgcccgccgaagacgatgccgagacagccgaacaccgcgacgatgctgccgtagaccaccccgacatgaccggcgtcccagccgtgggtgcggacgaagaaggtcggcacccaggcgccgctgccgtagccggcgaaggacaggcaggcgaaaccgaagttgtggcagagcacggtcttgcggttggcccgcaggtaggcgccgacctcgcccagcggcaccgccacgcctgcgccgactccgcgccgggccggctcgcggatagccagcagcaacaggcagaagagcacgccggcggcgccgaggatgaggaagatcagttgccacgggcgcacctcgccgaacagcggcagatgcacgtcgccctgggccgaggcgaacttgatcaccagcccgccgagcaggaaggccagccccgagcccaggtagatgcccatcgagtagacgctgatcgccgtcgcccgacgctcgcgcgggaagctgtcggcgatcagcgaataggccgctggcgacagcgccgcctcgccgaccccgacgccgacccggaaggtgaggaattgccattagctgcgccgccagaccgcaggccgcggtcatcgcgctccacaccagcacgccgaacaggatcaggccgcgccggctgcggttgtcggccatgcgtccgagcgggataccgcaaagggtgtagaacagggcgaaggacaagcccatcagcaggctcatttccgtatcgctga

SEQ ID NO: 14141 - DNA, 516 bp, Pseudomonas aeruginosa
gcaacagcagggcattctcggtcatgcctgatcctttcgtcgggcgtccaggacatcggccagcgccacgtccaggtcggtgaattgaaaacggtagccggcgtcctgcaagcgttgcggcaaggctcgctggccgccgagcagcaatccggacatttctcccagcccgaggcgcaggacgaacccgggggtcggtatccgcgccggcttgtgcagcgcccggcccagggccttggcgaaatcgcggttgcgcaccgggttgggagcgcacgcattatagggaccgctggcatcgggccgccgcaaaagaaaatcgatcagctcgatttgatcctcgatatgaatccacggcatccattgccggccgtcacccagcggtccgcccaggccgagccggtagagcggcaacaggcgcccgaggaagccgccctcgggggccagcaccaggccggtgcgcaacagcacgacacgggtgccgagcttctccgcctcgcgggcgatctgctcccaggctag

SEQ ID NO: 14142 - DNA, 2514 bp, Pseudomonas aeruginosa
attgcgcgagctgatcgagcaataccggcatggcagcgtgccgctagtggtaccgctgaccctgctaaagcaccacttccgtcgccacccgcatgcatacatcgcccagcaggcctacctgcaaccgcacccgaccgaactcggcctgcgcaacgcgctctaggatttcccgatgaactcgccccacctcgaacgcggcggcctgccgatccgcgaagtcactcgtctgaccggcgtccatccggtcaccctgcgcgcctgggagcgccgctatggcctggtggtgccgcaacgcaccggcaaggggcaccggctctacagcgaagagcaggtcgagcgcatccgccggatactcgtctggctcgagcgtggcgtcgccatcagccaggtgcgcgcgctgctggagcgtccggaggaaaccccggcggcggatgtcgaatccccctgggaacgcctgcacgaacagctgctggacgccatcgccgcgctggccgagcgacgcctcgacgatctgttcaaccaggccgcgtcgctctatccggtagcgaccctctgcgaaaagcttctgcaacccttgctgcagcacctcgaacgacgctggcagggacagttcggcgcgcgcatggagcgggccttcttcttctcctggttgcgcagcaagctgggcgcccgcctttatcaccagcaacggctgcaacagggcgcgccgctgctgctggtcaaccagtccgagctgtcgctggaaccgaacctctggctgtgcagctggttgctcggcagcggcgaggtgccgctgcaggtcttcgactggccgctgccaccggccgaactggccctggcctgcgaacgcctggaagctcgcggcgtgttgctgtacgccagtcatcgcctcaatccggagcacctgccgcgcctgctggcaggggtgagctgcccggtggtgctggtcggaccggccgtggagatccagcgcgaagccttcgaaaccctggcgctaactggcctgctgctggcgagcacgcccctggaagcccgccgcctgctcggcgaacgaggtctgttgaacccatgaacggacttccgatgaacctgatctggtttcgctgcgacctgcgaaccaccgataacagcgcgctcctcgccgccgccgatgggcgcccttgcgtggctctctacctgctcagcccggcgcagtggcgggaacacgacgatgcgccctgcaaggtcgacttctggctgcgcaacctgggcgagctgcaacgccagctcgccgcgctgaacatcccgctgctggtgcgcgactgcggccactggcggcaagccccggaagtcatcggccggctctgtcgggagctgggagtcggcgcggtacacgtcaaccaggaatacggggtgaacgaggaacgccgcgaccaggccgtcggccaacgcctgcgtgaacagggcgtggccttccacagccacctcgaccagctgttcttcgcccccggctcggtgctgacccgaactggcggctatttccaggtgttcagccagttccgcaaggtctgccacgaacggctgtaccaggccctgccgggtgtccgcccgcgtccgcagccccagccaccgcacgcgctggccagcgacccgctgccggatgccgtgcccgccttcccgcggccggccgatagcttgcgccgcctctggccggcaggcgaagaggtagcgcaggaacgcctgcgcgacttcgccgaccagcatctggccgactaccatgaacggcgcgacttcccggcgcttcccggcaccagccaactgtcgccctacctggccgccggcgtactctcgcccaggcaatgcctggacgccgcgctggttgccaaccgcggcgagttcagcggcggccagcaaggcgccgcgacctggatcaacgagctgctctggcgcgagttctacaagcacatcctggtcggctacccccgggtctctcggcaccgccccttccgcgaggagaccgaagccctgcgctggcgccaggccccggcggaactcgaagcctggcaacaggggcgcaccggcataccgatcatcgacgcggcaatgcgccagttgctcgccaccggctggatgcacaatcgcctgcggatggtggtagcgatgttcctcagcaagaacctgctgatcgactggcgcgaaggcgaacgatggttcatgcgccacctcatcgacggtgacctggcggcgaacaacggcggctggcagtggagcgcatccaccggcaccgacgcggtcccctacttccgcctgttcaatccgctctcgcagtccgaacgcttcgatccacgcggcgagttcatccgccactggctgccggaactggccggcctggagcgcaaggcgatccacgatccgtccagcctggggctgttcgccggggtcgactatccacggccgatggtcgacctgaaggccagccgcgaacgggcgctggcggctttccgcaacctgccgccgcgcgatggtcgcgcgtag

SEQ ID NO: 14143 - DNA, 1149 bp, Pseudomonas aeruginosa
cctgccgttgcaggttggtcaggtcgaccgtatcgaaatccgccaggtgcagctcgccgaccccggccgcggccaggtacagcgccaccggcgaacccaggccgccaagaccgacgatcagtgcgcggctgcgcttcaggcgcagctggccctcgacgtcgacctgcgccagcaggatctggcgactgtagcgcagcagttcctcgtcgctcagcatgcccattgtccgagagtgatccgctcgttgccgccgaggtcgcgcaacgtatgtaccccggcgaagccgcgggcgccgagcagttcgcgcaccgccgccccttgatcatagccgtgctcgagcagcaaccagccttcgtccagcaaatgctgcggcgcctgggcgacgatctggcggatatcgtcgaggccatcgctacccgcgaccagcgcgctcttcggctcgaaacgcacgtcgccctcgctcaggtgcggatcgctggcagggatatacggcggattgccgacgatcatccggaagcgtcggccatcgagagcggagaaccagtggctgcggcgcacctcgacgttctccaggagcaaccgctggcgattgcgctcggccagcgccacggcctcttccacgcggtccaccgcagtcaccgtccacagcggccgttcgctggccagggccagggcgatggcgccggtgccggtgcccaggtcgagcaccgtagcggtatccgccgcgagggtcgccagcgcggtttccaccagcagttcggtgtccgggcgcgggatcagggtgtgtggcgcgacctccaggtccaggctccagaagccctggtggccaagtatgtaggccaccggctcgccgttgcgccgacgggcgatccagtcgtcgaaccgctcgttggcctcgcgcggcacgatgcgctccggccaggtacgcaggaagctgcgcggcttgcccatcgccgccgccagcagcaactcggtgtcgagccgggcgctgggcgaatcgggcagttgggaatccttgagaagggtacagatagtggtcatgtcagtcgcccagggccgccagttgatcggcctggtattcctgcagcagcggctcgatcacctgttccaccgcgccctccatcacctcgcccagggagtacagggtga

SEQ ID NO: 14144 - DNA, 1338 bp, Pseudomonas aeruginosa
ggacatccagctttttcagcagagaagctttcatgcaggcataggtaccggtcagtggcgcggcgcgccctcgtcgagggcgaacagctcctgggccagggccagcgcgtcgatgcggccctcggcggacattttcttcatctgcacgctgggcgcgtgcagcagtttgttggtcaggccgcgggccagctgggccatcacctcggcggggtcggcaccgttggccagttgccgctgggccttgcccagctcctcatcgcgcaggcgctcggcctgctgccgataggcgcgcagcacgtccaccgcggccagttcgcgcaggcgctgcatgaactcggcgacgccgctgccgaccagttcctcggcggcctgggcagcgccctggcggctcttgagattctccgccactacttcgtggaggtcgtcgacgctatagaggtagacgtcgtccagttcgccgacttccggctcgatgtcgcgcggcacggcgatgtcgaccatgaacatcggcttgtgcttgcgctgcttcagcgcgcgctccacggcgcccttgccgaggatcggcaactggctggcagtggagctgatgacgatatcgctgttggccaactcctcgggtatctccgaaagcagcaccgcatgggcgccgaactgctcggcgagcaggctggcgcgctccagggtgcggttggccaccacgatgcgcttcacgccttgctcgaacaggtggcgcgcgaccagggtgatggtctcgccggcgccgatcagcagcgcctggctgcggtgcaggtcgctgaagatctgcttggccaggctcaccgcggcgaacgccacggacaccgggttctcgccgatggcggtatcggtgcggacggtcttcgccgtactgaaggtggcctggaacaggcggccgagcagcggaccgacggtgccggcctcgcgcgcgacggcgtaggccgacttcatctggccgaggatctgcggctcgccgaggaccatcgagtcgaggccggaggccacgcgcatcatgtggcgcaccgcgtcttcgtcctggtgcacataggcacaggcgcgcaactcgtcgagagtcaggcgatggtagtccgccagccaggcgagcacgtcgtccgcggtcggatggtcgatctccaggtagagttcgctccggttgcaggtcgacaggatggccgcctcgcggctggtggtcaggcggcagagctgctgcagcgcctcgaccatctgttccggagtgaaagccacgcgctcgcggacagccaccgaggcggtcttgtgattgatgccgagggcaatgaaggccatgcaggatcgctgagctaa

SEQ ID NO: 14145 - DNA, 324 bp, Pseudomonas aeruginosa
gcaactatgtggtgcaggcgcagaaaacccgcgaccccggggtttccgagcgcgccttccgcatcgccgaatacctcggcgccgaccaggaagccctcgacacctccctgctctgggcgcgcagcgcgccggacaacctcgatgcccaacgcgccgccgcgatccagttggcccgcgccgggcgctacgaggagtccatggtgtacatggagaaggtcctcaacggccagggcgacacgcacttcgacttcctcgccctgtctgccgcggagaccgacccggatacccgcgccggcctgctgcagagcttcgaccacctgttga

SEQ ID NO: 14146 - DNA, 1107 bp, Pseudomonas aeruginosa
ccctgctcgaggacaactccgcaagccgccacgaagtggcccccctgctgctccgctcgcgcctgttgcataaccatgaagcgcagcgacgatgccctgccgctgctcaaggccgggatcaaggaacacccggacgacaagcgcgtgcgcctcgcctacgcgcgcctgctggtggagcagaaccgcctggacgacgccaaggccgagttcgccggactggtccagcaattccccgacgacgacgacctgcgtttctccctggcgctggtctgcctggaagcccaggcctgggacgaagccaggatctacctggaagaactggtcgagcgcgacagccacgtcgacgccgcccacttcaacctcggccgcctcgccgaggaacagaaggacaccgcgcgtgccctcgacgagtacgcccaggtcggcccgggcaatgacttcctcccggcgcaactgcgccagaccgacgtcctgctcaaggccggtcgcgtcgacgaagccgcccagcgcctggacaaggcgcgcagcgagcaacccgactacggcatccagctgtacctgatcgaagccgaggcgctgtccaacaacgaccagcaggaaaaggcctggcaggccatccaggagggtctgaagcagtacccggaggacctcaacctgctctacacccgctcgatgctggcggagaagcgcaacgacctggcgcagatggaaaaggacctgcgcttcgtcatcgcccgcgagccggacaacgccatggccctcaacgccctcggctacaccctggccgaccgcactacccgctacaccgaggcccgcgagctgatcctcaaggcgcacaagctgaacccggacgacccggcgatcctcgacagcatgggctggatcaactatcgccagggcaagctggccgacgccgagcgctacctgcgccaggcgctgcagcgctaccccgaccacgaggtcgccgcgcacctgggcgaagtcctctgggcccaggggcgccagggcgacgcccgggccatctggcgcgaatacctcgacaagcagcccgacagcgacgtgctgcgccgcaccatcaagcgcctgaccggcgccgagactccttga

SEQ ID NO: 14147 - DNA, 1257 bp, Pseudomonas aeruginosa
ccggcactggaggttgtgtgtttgggagcttcccaaacaaagctgaagctgataaagtctcggcccttcttccagaccaccttcagaggttcgtcgccaaaggaagcaacatctcgatgttgcaccggaagctggaaactctggtctgagaaaggaatgccgaaacggcattcgagcaataccacaggggcgtcgccaagcggtaaggcagcaggttttgatcctgccatgcgttggttcgaatccagccgcccctgccattttcctcttctgtatttcatccggatcccttcggtcgacacaggtacctgtagcgtgtccaagatgatggtcttcacggggaacgctaaccccgatcttgcacgacgcgtcgtgcgtcagctgcacattcctcttggcgatgtttcagttggcaaattctccgatggcgaaatcagcgtcgaaatcaacgaaaacgtccgcggcaaggacgtattcctgattcagccgacctgcgcgccgaccaacgacaacctgatggaactggtggtgatggccgatgccttccgccgctcctcggccactcgtatcaccgctgtcatcccctacttcggctatgcccgccaggatcgccgtccgcgttccgcccgcgtggccatcagcgccaaggtagtggccgacatgctgaccgtcgtcggggtcaaccgtgtcctcacggtcgacctgcacgcggatcagatccagggcttcttcgatatcccggtagacaacatctacggttcccccgtgctggtggacgatatcgaagaccagcgcttcgagaacctgatgatcgtctccccggacatcggcggcgtggtgcgcgcgcgcgccgtggccaagtccctgggcgttgaccttgcgatcatcgacaagcgtcgtcccaaggccaaccagtccgaagtgatgcacatcatcggtgacgtcgaaggccgtacctgcgtactggtagacgacatggtcgataccgccggcaccctcggtcacgccgccaaggccctgaaagagcacggcgccgccaaggtcatcgcctactgcacccacccggtgctgtccggccgtgccatcgagaacatcgagaaatccgtactggacgagctggtggtgaccaacaccatcccgctgtccgccgctgcccaggcctgtggccgcatccgccagctggacatcgctccggtcgttgcggaagccatgcgccggatcagcaacgaagaatcgatcagcgcgatgttccgctga

SEQ ID NO: 14148 - DNA, 564 bp, Pseudomonas aeruginosa
ccgcaagtatttcggcctggtcggcaagttcagccaccagggcaaggacgttcgtctgttgatcccgaccacctacatgaaccgcagcggccagtccgtagcggcgctggcgggattcttccggatcgccccggacgccatcctggtggcccacgacgaactcgacatgccccctggcgtcgccaagctcaagaccggcggcggacacggcgggcacaacgggttgcgcgacatcatcgcccagctcggcaatcagaattctttccatcgcctgcggcttggcatcggccatccggggcacagcagcctggtttccggttacgtgctcggccgcgcaccgcgcagcgagcaggaactgctcgacaccagcatcgacttcgccctcggcgtgctgccggaaatgctcgccggggactggacccgggcgatgcagaagctgcacagccagaaggcctgaaccacttttctagcgcctgtctgagcgcgagggacatagcatgggattcaactgcggcatcgtcggcctgcccaacgtcggcaagtccaccctgttcaacgccctga

SEQ ID NO: 14149 - DNA, 360 bp, Pseudomonas aeruginosa
cggacacggcgcatggcgcgccacagctcgcccttgagggcgggttcttccatgagggcttccaggcctggcacggcccaggttgcgcccagaccgtccacctgcagctcgcggaacaggctgccctcgtcgccctcgccggcgaagcggatcgccggcaggccgaccaaccacaggcagcggctacgctcgctctcctccatgcgcgcggcgacgaagctctggacgaactccagggccgcctgcggcccctggtcgaggttgccgcgcgccagcagcggccagcgtaccggttcgccgatcagccgcgggctgtccggcaggccggcggcgcgcagcaggtcgcgcagcagcaggtaa

SEQ ID NO: 14150 - DNA, 2217 bp, Pseudomonas aeruginosa
cccggatcgcggctggcgaagggttcgccggtgggcagttcgaccagcagggtgcaggagcccgcctgcagcagttgcaaggcgaagcgcggcggcggggcctggaccgccggcgactcggccggggcctcttcgaccggcgcgaccggctcggctttcttcgccgccggggcgcccggcttcggcaggctgatcgggatcccccggccttccacgggcgcggcgggagccacgctcggcgcgctggccggcgcctcggcttgcgggacgcgggcctgcggcgcatcgatcgcggcgcgcgcacgcacaggcaccgccggctcttcccggggcggggtctccagcaactccggccgcgagggtgcggcgaacggcaacggctggcggggcagccaactggttatctgcatcgcgcccaggaaggcgcggcgacgctgttcttcgatcaaatctcgggcaccggcaattaggcgatgcgcggggacggtttcgcccccggcgttcaggcaggcaatgatagcggttcttcgacctcggcggagcggctttgtcccgccatgcgacggttcgccctcaacgcggggcgacggtgaagatattgacgttgccctgcagcttgagggtgccgtcgatgcgtgcgctgaccaggttggtctgcaccagcccgggatcggtaccgcgcgccttgttggcgccagcgatggtgaagctcaggtcctggaagctggtgtccttcaggccgacgcgcagcaccgggcggttgaaggcggcgccgtcgccgccgaagccgtccttgatggtcaccacgtccagggtgacttcgtcgaagctgaacttgccgctgatatcgtcgatcaccaggtagttgttgccgctgccggccggctggatcgccaggcgcgcgccgcagccgccggcgcagcgcgtctgcgaaggattttcctggagattgagcgaggcgctgatgctgatcccggcctggccgaccacgtcgtccagatcgctatcgcccagcgagcgcaactcggccccggccgaagcgctgaacagcagcgccagcgccgcgaggatgccgatgccgcctgccagtggatgagtctgcttggccatgtgctgcgtacctcgtttcccgccgccacctcagaggttgtgcgacgtcaccttcaggtagttgaagctgagcccggatatctcgttgcggcccatgttgtagccgccggtcggtacctgcccgtagcctggccgggtaccgccgatgttgaggttctcgatcaccaggctggtgcgcggcgcattggcgtagaagtcagcggcgttggccagggtcagcttgggcagttcgaaagtgaagttgccgtcggcggtgaccgagaacagcaacggctgcgacttcccgtagccaagcgcgacgctggcataggcgttggtcaggtagacggtgcgcgcggcctgctcggcggcgctgacgcaactgggcgagccagcaccgcaggacatgatctcgaaagtcttggcgtagaggttcaggcgcatctcgccaaccagttggctgcgcgcgttggcgccccagaagcgcaggtaggaaccgtccatcgccagttcggagaagtccaggttgagcacatcggtgcgcgtggaagtgacgccgaagtcgaagcggatgccggcgtcgaccttttcgctggcccggctcgagcagttgctgccggcaccggcgtaaccagcgatgcacggctggccgccggcgccgctcaccaggctggggaaagccagctcgatcacgtccgcggtgtccggcaaggtgctgaccacccgcccgtcgtcgagctgggtggtcagcaccgaacccttggccagattcagcttgaacgggaaattgagacggccgagagtcaccggcgccagggtgctgcccttgttgctgccagtggcggcgacgtacagctcctttaccgtgatcggcacgttctgcccggtggcggtgttggtcacgccattgatcgcgatggtggccttgttgccgtcgaccatggcgctgtcgaggacgaagccgatgccggcaccctgcacgtccgacagttgctcgtcgtcgagcgctgtcatctcggcatgggcgaagggggcggccagcagggccgcgagcaggcaggcgcgactcatctcagcagcccttgttcaggccgcccaggcaggtgtcctgccgtggaatgccattga

SEQ ID NO: 14151 - DNA, 1482 bp, Pseudomonas aeruginosa
actgccgcttttcgacacctcgatgatagccagatgccatccgccgataccgggcccgtacctgcgccgcagacgtgtcgacggcctgcatcgcactcatcggcggcgtctgcgtcgcccgtgcctttgcagtacaatcggcgctttttccacggaccggccctcccgatgatcgacccccgacgcgtactgcgtgcgcttgccgaacactgggccctgctcgagcctctctgcgagcgcttcgatgccggcaccctgagcctggcggaactgcgcagccagttgaacacccagttaccggaaagcaacccggcggaaatcaccgccctgctcgaccagtggatccgcctggatatcctggtcccggtggccaagagccccaaccgtttcgagctgaacgcgcagatccacgacttcctcgcctacctgcgccacgagcatcgccttggtctgtgcctggagatcgaggcctacctgcgccatctggagcgcctcgccgggtacatccaggacgccttcgagacccgcgacagccaggacctggcgcgccagctgcgactgctcgacatgcgcgtgcgcgatgtactgaagaagctcggcaatgacgagcaggcactgatcggcgtggccgagcgggccaagaccagcgaccggcagattcccctggcgcagcgctacgcggaggtcctggcgacctgggacgagtacgtcgagccgatgatccagctggtcagcgccgacggcgccttcgagcagggcgtgcggcgggtcgaacaggtcctgctgcgcctgctaggcgaacagcagcgcctcggccacctggtcgacgacgacctggtgctgcgcacccacgcgcgcatcctcgagatgcagaccaacgcccagctgaccctgcgccgcgcccgcgaattattgctgccgctgcgcgaggaagcgcgccggcacaacgcggtgacccgtggcgccgccctggcgctggcggcgatccggcgcaagggcctggatgccgtgccgcaggcggcgatgccgctgttcacccggccgcagagcaccttcctcggcaccgcctcgcaggtcgagagctacgtcttcgccctcgcccgcttcgagccgaagccggcgcagttccccaagtccagcggcacgcgcaagagccaacgggccggcgcgaccaccacggaccgcgcgggaaatgatcgagcgctgccaggcggcgctgccgctgccggacctcatgcaatggctgctggcccaggaaccggacggcgccaccgacgagttgctctactggttctcccggctgtcgcgcgacgcgcgcttccagcgcgaacgcctgcaacgccgcgagtacgaaaccaccgaacattgcgtcagcctctgctccttcgccctgacccccgccgccaaggacaagggccaggccagggacgcagacaccctttccgcgagcgaaacccatgcatcttgatctctccgaactga

SEQ ID NO: 14152 - DNA, 675 bp, Pseudomonas aeruginosa
cggcgacgtctgggtgaagagcgtcgaagccatcctcgaccacttcaaaggcgagcatttcgaggctcccggactgagcatcgacctgtcgcacatcgaaccgccggcgttgcaggccctggccgaccgcgccgccctgcgcgaccagaaggaacgcctggagaaggagctgaagcagctcaagacccagcagagcgtcgctgccgaccgcgccgcgagcaaggcccaggcggagaagctgtaccaggacgtgctggatgcgcagaaggccctggaagacttccgccgcacccagacgctgaccgccgaggagcccgagaagctcgccgaactggcccagctggaggcgtcccaggacgaactcaagcgctccagcgacgccttcgccgagcgcgtccagcaactctccgcgcgcctgcaactggtggcccggcaactgggcgacctggaggccaaggagcgcaccctggaagatgccctgcgccgccgccagctactgccggccgacctgcccttcggcacgccgttcatggagccggtggacgactcgctggacaacctgctgccgctgctcaacgactaccaggacacctggcaggcgctgcagcgcatcgacgggcagatcgaggcgctgtacgcccaggtgcgcctgaagggcgtcgccaagttcgatag

SEQ ID NO: 14153 - DNA, 735 bp, Pseudomonas aeruginosa
cgaagacgacaccgagcgccgcctgaagctgttgatcaacgcctacgcgcatcgccaggacgaggccctgacgctggccaaggcgcgccgcgcggcggtcaccgacatcgcccggaccctgcgcaacatccgcagcgactacgacaacctggaacaccagttggccctgttcaaccgcgagatcaacaagcgccaggtttccaacctgcagagcttccgcatcgtcctcgcgccgaacaaggatgcgctcaagcacatcgaccagatcatccacagcgccggccagtacgaggaaggcgagaacctctcggtgttcgacctgacccagagcgccgagcaggacgcgaagaacgaggaggccaaggaatacctggcccgcctggtcgccgccaaccacaaccagttgggcctgaaggacctgttcgaactggccttcgagatcaccaaggtcaacggccagccgatcatgcacaccgacatcgacggcgccgcctccaacggcaccaccatgaccatcaaggcgctgaccaacatgtacctgttgctgcacctgatggaccgcgagcaggccgggcgcgtgcgcctgccctactacctggacgaggcggcggacatcgacgagcgcaaccaggccgcgctgctggagaccagcctgcaactgggcttcgtgccgatcctggcgagcgtgaagccgcaggtttccgcacacgtggcgatcgacctggaaggcggtag

SEQ ID NO: 14154 - DNA, 1605 bp, Pseudomonas aeruginosa
ggccagcgaggccctcagcctcgaacgcgacgttggcctgaattgatcggcgccgcctccacgcccgtgcgcctgcgcacgggctcgcgccggcgaacgccattctggctgttcctgccggtcctgctcctcgccctgctggccagcctgccgctgctctacgtcgcggccaaggcctgggacgccggctggcacatcgcctggcaactgctctggcgcccctacgtattccgcttgctgggcaacaccctgtggctgatgttcggcgtgaccctgctcagcgccctgctcggcctggccctggcctggtgcgtcgagcgcagcgacctgccggcacggcgcttctggaacgtggtgctgtgcctgccgttcgccatccccgccttcgtcagcagtttcacctgggtttcgctgagcccgatgtacgaaggcctcggcggcgccatcctggtcatgaccatgtccaagtatccgctggtctacctgccggtagcagcgaccctgcgcggcatcgatccttccctggaggagtcggcgcggatgctcggtctgtcgcggcgccaggtgttcctgcgggtcaccctgccgctgctgcgcccgaccctggccgccaccggactactggtggcgctgcacatgctggtggagttcggcgcgctgtcgatcctgcgctaccagaccttcaccacagccatctaccaggagttcgaactggagttcagcaacgccaccgcggcgatgctctcctcggtactcctggcactgtgcttcctgctgctctggctggagttgcgcatgcgcggccgcggccgcctggtacgcaccggccagggcagcgcgcggcgggccgaacgagtccgcctggggttcggcaagtggccgctccaggcgctgctggcgacgctggtgctggtcggtaccggtatccccctggtgatgctcggttattggctgtacgaaggctcctcggccagcttcccgctgatggaaatcgcctcgaccctgctttcctccctgtcgctggccttcggcggggccctgctcagttgcctgctggcgctgcccgtaagcatcctggtggtgcgctaccccggcgccctggcgcgctggacccagcgcctgccgtacctgctgcaagcgttgccgggactggtgatcgcactctcgctggtgtacttctcgctgcactacctgccagccacctaccagaccaccggcttgctgctggtcgcctatgccctgctgttcatgccgctgacccaggcaccgatccgcgtggccctggaaaaggcctcgccgcagttggaggaagccgcccgcactctcggccagacgcccttgatggccttcctgcggatcaccctgccgatcatctcgccggccatcggcgccggcttcgtgctggtgttcctcgacaccatgaaggaactgaccgccaccttggtgctaggtcccaccgggctgtcgaccctggccacctcggtctgggtgcacaccgccaacctggagtacgctgccgccgcaccctacgccgcgctgctgatcctgatctccggcttgccggtgtacctgctgaccacccgggcgcatctcagcactcactga

SEQ ID NO: 14155 - DNA, 1038 bp, Pseudomonas aeruginosa
acgccggagaccagggtttccaggccggtgacgccagccagggaaacccgcggcttgaccagccagaagcgggtgtccttgctcaggtactcctgggcttccttcttgatctcgatggtcgcgaccacgcccttgatgtccttgctgacatgcaggtcggtcaccttgcccaccgagatgcccttgtacagcacctcggtcttgttggcctggatcccgtcgccgctctcgaagcgaacctggatgtccacgccagcctggtcgaaggcacgccacgccagccaggcaccgatggccagggccaccagcggcagcacccagatcgccgaccagttcgaggtcttgtgtttcttcggacttggcagatcactcattctcgtcatccagattggtgttgtcccagatcagccgggggtcgaacgtcacggcggcgagcatggtgagcaccaccacgctggcgaaggcggcggcgccgaggttggcctcgatgctcgccaggttgccgaaattcaccagcgccacgaggatggcgatgacgaagatatcgagcatcgaccagcgcccgatccattcgatgaagcgatacatcaggatacgctggcgggccgacatcggctggtgccgctgtaccgaatagagcagcagggcgatgcccaccagcttgaaagtaggaaccaggatactggcgacgaacaccaccatggcgatggggaacatgtcggcatgcaccagttcgaccacgccctccatgatggtggcaggcattccgctgccgaagaggttgaccgtcattatcggcaacaggttggcgggtatgtagagaatcgccgcggtgatcagcaacgcccaggtgcgcgtgaggctgtttgggcgccgggcgtgcagcaccgcaccgcagcggctgcaacgcggatgctcgtccccgtcggcgcgattcaactggtggcactcgccgcacaccaggattccggcatcaagcgcgcgcatcgtcgtcctcgccgcccagcgcttcccatacctggtgcggcgacatggtga

SEQ ID NO: 14156 - DNA, 663 bp, Pseudomonas aeruginosa
ttcggcatcgacgatgaaagtcttccaatccagcgtgtcgatcgccgtgccctggcgctgggcggcggcgccgatccagctgtgggccaccggcgcggcgggacgtttgtaggtcggcgccatggagcaggcgccgagggtcagggcgatcagcagcgccgatacgccgaatgcaggtttgcgcatctcgttcactccccggccgaagcggcctgttcgatgggtgccggcttgctgcgcagcagcgacagcagccagacgaaacagataggtacgaacagcacgccgaggaaggtggcgctgagcatcccgccgatcactccggtgccgatggcacgctggctcgccgcgccggcaccgctggccagggccaggggtatcacgccgaggatgaacgccatggaagtcatgatgatcggccggaagcgcaggcgcgcggcctcgatggcggcgtcgcgcaggctatgcccctgctcccagagttccttggcgaactcgacgatgaggatcgcgttcttcgccgaaagaccgatgatggtgatcaggccgaccttgaaatacacgtcgttggacataccgctgaccatcaccgcgagcaccgcgccgatggcgccgatcggcacgatcagcatcaccgacagcgggatcgaccagctctcgtag

SEQ ID NO: 14157 - DNA, 588 bp, Pseudomonas aeruginosa
gtggcggtgatggtgatctgtggcggcgcgacattggggtactgcgctaccggcaatttggaaatgaccagcaggccggccagggagatgaacagggccaccacccaggcgaagttcggccgcttgatgaagaattcggacatcggaaaatcctcggggcgaacccgcccttactgttgcggcgcaggtgactgggcttgcgcctgggcaccatccggcttcggcacgatcttcacccccggctgcaccgcagccaggccgccgactatgacccggtcacccggctccaggccctcggtgatctgccagcgcgaaccctgcatgacgccggtaccgacgctgcgcgactcggcgcgctcgtcggcgcccaccaccatcacctgggcgctgccgtcgctggagcggtgcacggcccgttgcggcaccaggatcgcctggttgtcgatgccctggggcgtacgtacgcgcacgtacatgcccggcagcaggaccccgtcggggttggcgaacttgccgcgcagggcgatctggccggtaccgcgatccaccgccacgtcggcgaactgcaacgcgccctggcgctcgtag

SEQ ID NO: 14158 - DNA, 399 bp, Pseudomonas aeruginosa
cgacgcacccgcgcctgcgcctcgaacagcaccgcgcggttccgcgccagctcaccctcggcgcgcgacaccgcagccttcagcggtgccggatcgatctggaacagcaggtcgccagccttgacgtcggcgccctcctcgaagcgcttccgcacgacgatgccggccacccgcgcgcgcacctcggcgacacgcaccggttcgatccgcccaggcagttccgaactcagcgccaggggctcggcctgcaccgtcaggacctccaccggcaacaccatttcggcggcctcctgtcgctcttccgccggcccacaacccgccaacgcgatggccatagccaacgccccgatccttcctattgcacgcaaatcagccatgacacacccgaccgttgattga

SEQ ID NO: 14159 - DNA, 639 bp, Pseudomonas aeruginosa
cagctaattcctttggacgcgaggccagttttctgcacaatgcgcacaatcagaaaaaccaaccgggacccatcgatgaccctgatttcccatgacgagcgactcatcaaggcgctggcagtcgctatcgtcgaccgcccgcgagcgacgctgaaggaactggccgaggcggccggcgtaagcaaggccaccctgcaccgcttctgcggcacgcgggacaacctggtgcaaatgctcgaggaccacggagagaccgtactgaaccagatcatccagacctgcgacctggagcatgccgagcctctggaggcgttgcagcgcctgatcaaggaacacctcacccaccgcgagctgctggtattcctggtattccagtaccgcccggacttcctcgacccgcacggggaaggcgcacgctggcagtcctacctggaagcgctggacgccttcttcctgcgcggacagcagaaaggcgtgtttcgcatcgacatcacggcggccgtgttcaccgaactgttcatcaccctggtctacggcatggtcgatgcggaacgtcgcggacgggcggccagctccaattccgcgcataccctggagcagatgttcctccatggcgcctccaatccggcgcgctcctga

SEQ ID NO: 14160 - DNA, 4287 bp, Pseudomonas aeruginosa
ctgtctaccgaatcacacctcccccaggaattccggtcagtgtcgaccccctcgctaaccccgtcgccgcctcccgccggcgacccactgaccgtacccgaccgaccggcagccaaggctggcctgctgttgctggtcctgttgatgctcggcctgctgctctggcagatgagccaggagctgcgccagcaggaacgcttcgaacacgagcgagccgcggcccagctcgatcgtctcaacgaccgcctgtccctgaccctcgaactcaaggcgcgcaccgccctcgccctgctcccgggcgtgccccccagcgagcgtggcgagatacagggcaggctgttgccgcgcatcagcgatgcgctgccgcaggtgcgccagttgcaatgggtggacagcgccctgcagacggacagcccgtcgccggaaacgacgctgcccgagcagttgcgccagcacgccggctccggcctctaccactattgcctcgacccgcgcgacggcgaatccctctacctgaccctgcgcgaacccggcagccgccgcgacagtggcttctggctgttgcacctggccagcgacagcctcgcccagtggagtcccgacctgcccaccggcaacctgctctggcgcctggaagaccaatacgccgggcgggtgctctggcataccccggggagcacggcgctgctcgacgacatgcagaccctcggcgtggaaccgctgcgcaacagcgactggcagcttcgcgggctctacgacagcacgcgagtgcggctcggcctgctgccgggaatcggcggcgagctggcgatcttcctcctgctggtcggcgtcaccgtgtacatgctgctgcgcctgcaccgcgagcaacagggcctgcgcgccatgaccctggcctcgcagcgcagcctgcgccaggcggccacggcactggcggcgatcgacgagcgggtgctggtgacccgcgccgacggccgcctcagctacctcaatccccaggccgaacgcctcttcggcatcagttcggcccaggcccgccagcatcatctgctgggcctgctgccggacctcgagccaggctggctgacggacgccggtggcgacggcgagacccgtagcgagctgctgccgctgcgggtgcgcggcgagccgcggacgttcaccctcagccgccatccgctggccagctatccggcgctcgccgaccaggcctggaccctccgcgagcagatactccagggcgggcaggtctgggtgttgcgcgacgtcaccgaggaacagcacgccctcggcgtcctggaggaaacccggcggcgctaccaggacatcttcgaaggggtcggcgtggccctctgcgtgctcgacctctccgccctgcgccaggctctggtggaacaaggcctggacagctgcgccgcactgcgcgcctggctcgccggcgaacccgggcggcagcaggcgctgctggagcggatccgcatcaccgagatcaacgatgtcagtcgccgcctgctgcagatcgagtccaccgaacaggcctggcagcgcttgctcgaccacggcccgctacaaccggacagcctgcgcctgcaggtgatcgaggcgctcatcgaacgccggccggtactcgaactggaagccacgctgcgctgcggcaagagcacgccgcggcacctgtggttgcaactgcgcctgccggaaaaccccggcgaatggcatgcggtgcccctcagcctgtccgacgtcaccagtcgcaaggaagtcgaactgtcgctgatcgagcgcgagaagttctggtcggacgcggtccaggcggtgcccgataccctctacatccacgacctgcacgcgcgccgggtgatcttcagcaaccatcacctgggccagcagttgggctacaaccaggaagaactggcgcggatgggcgagaacttctgggaaaccctgctgcaccccgacgaccaggaatactactggcgcatccgcaacctgcagcacgtggtcggcgacggcctgctgctcgacagccaactgcgctggcgccaccgcgacggccgctggcactggttcgacatccgcgagcaggccttcagccgcgaccgcagcggtcgcgtggcgcgcctgatcggcgtggccaaggacatcaccttcaccgtcgaggcgaacaacgcgctgcgcgagaacggccgacgctaccgcatgctggcggaaaacatcagcgacgtgatcttctccaccgacgccgaactcaacgccagctacgtcagcccctcggtacagcacgtgttcggctacagcccggaatgggcgctgctcaacggcctccatcagaccgccaccaacccgcgccagctcggccgcctgaacggcctgctgcgccgcgtgcggcacgccatcggcgaccgccagaagctcgccgagctgcgggaaaaccctggccagcatctgttcgccctcgactgcctgcgcgccgacggacgcaagattcccatcgaactgcggatcgtcctgatgtgggacgagcacgaccgcttcgaaggcctgctcggcatcgcccgcgacatcagccagcagcgccgcgccgaacgcgagctgcggatggcggcgacggtattcgaacactccacggcggcgatcatggtcaccgacccggccggctacatcgtccaggtcaacgattccttctcgcgcctgaccggctacagcccggccgacgtgctcgaccagcagccgcgcctgctcaccgccgaccgccaggaagccaaccagctcaagcacgtgctcgccagcctgcagcacagcggcagctgggaaggcgagatcctgcagaagcgcaagaccggcgaactctatccgtcctgggtcggcatcaccgcggtgcgtgacgaggaaggcgacctggtcagcttcgtctgcttcttcagcgacatcagcgagcgcaaggccagcgagcggcgcatccaccgcctggcctactacgacgccctcacccacctgcccaaccgcacgctgttccaggaccgtctgcataccgccctgcagcaggccgagcgcaacggccagtgggtggtgctgatgttcctcgacctcgaccgcttcaagccgatcaacgactccctcggccacgccgccggcgaccgcatgctgcaggaagtggcgacccgcctgagcgcctgcgtcagccaggacgataccgtggcgcgcatgggcggcgacgaattcaccctgctgctgccttcccagggcgaccgcgagatcgccctgaaacgggcgatccaggtcgccgagctgatcctcggccgtctggcccggccgttcaccctggaaggccgtgaattcttcgtcaccgccagcatcggcgtggccttgtcgccccaggacggcgccgaactgagcctgctgatgaagaacgccgacacggcgatgtaccacgccaaggagatgggcaagaacaacttccagttctaccaggccgagatgaacgctcgcgccctggagcgcctggaactggaaagcgacctgcgccgcgcccttgaactgggcgagttcgtcctccactaccagccgcagttcaccggcgacggccgccgcctgaccggcgccgaggccctgctgcgctggcagcatccgcgccgcggactggttccgccgagcgagttcattccggtgctggaggagatcggcctggtggcccaggtcggcgactggctgctggcggaagcctgcaagcagttgcgcagctggcacaaggccaaggtgcgggtgccaaaggtctcggtgaacctctcggcacggcagttcgccgatggccagttgggcgagcggatcgccgcgatcctctacgagacaggcatcccgccggcatgcctggagctggaactgaccgaaagcatcctgatgagcgacgtcgccgaggccatgcagatcctctccgggctcaagcgcctcggcctggccatcgcggtggacgacttcggcaccggctactcctcgctgaactacctcaagcagttccccatcgacgtgctgaagatcgaccgcagcttcgtcgacggcctgccccacggcgaacaggacgcacagatcgcccgggcgatcattgccatggcccacagcctgaacctgatggtgatcgccgagggcgtggagagccaggcccagctggacttccttcgcgagcacggctgcgacgaggtgcaaggctacctgttcggccggccgatgcccgccgagcagttcggcatgctctacgccagcgacgtgctgttcatgttcaacgagggctga

SEQ ID NO: 14161 - DNA, 633 bp, Pseudomonas aeruginosa
cgctggcagagttcctcgtcggcgaagaaggtctgcgccaccggcgccggatcggccaggccggtgcactcgatcaccaggcggtcgaagtcgatctcgccgttgtcgcggcgctccagcaggaggaacagggccttttccaggtcggtgttgatcgagcagcagacgcagccgttggacagcgtcatcacctgcaccggctcgacgccgagcaactggccgtcgatcggcgtctcactgtactcgttctcgatcaccgcgatcttcatgccgtgctcggcctgcagcaggtacttgagcagggtggtcttgccggcgccgaggaagccggtgagcacggtgacggggatcggggcgtggttgtcgttggctacttcggacatgcgcaacttccagaaaagacgcgggccacgtcagacgtggcccgcggaaggatggggattcagcagcagcggatcggccgacccttgccgccaccgtagcgcgcctcctggcgctcgcggaagaactcctcgtaggtcatcaccggcttgtccgggtgcttgttgcgcatgtgctcgacataggtgtcgtagtcgggcatgccgaccagcatccgggcggcctggcccaggtatttgcccatgcggctga

SEQ ID NO: 14162 - DNA, 816 bp, Pseudomonas aeruginosa
cccaggcgtgcattggtgttgcaaccgttggtcccggaggtcatgccgaaggtggcgttgcccgaggtaccgttggtggtggtggccagcaggtgcgggaacaggccgcgctggccctcgaacaccatgttgccccaaccacagccattaccgcctgccgcgtcggcgtgtgccgtcatgctgcccaggctcagcagccccagaaccaaccccttgctcaaaagtcgcttgtccatgtctgcgctccgcagttgtattttggagaaaaacgctttagcagctttggcgagacttgacgaactgtcaaactcggacacatgccgccgatccagccgcacaggcggggacggacggcaccgccgatcgaattccgccacttccccgccggcatggcttggctatagtggtatccagcagcgcgcaccgagggatcgcgacatgagtgaccagcacgacgaacgtcgacgtttccaccggatcgccttcgacgccgacagcgagatcctccagggcgaacggcgctgggaggtcttgctccacgacgtctccctgcacggcatcctggtcggccagccgcaggactggaacggcgacccgcaacggcccttcgaggcccgcctgtacctgggcctggatgtactgatccgcatggagatcagcctggcctgggctcgcgacggcctgctcggcttcgaatgccagcacatcgacctcgactccatcagccacctgcgccgcctggtggaactgaacctgggcgacgaggaactcctcgagcgcgagctggccctgctggtcagcgcccacgacgactga

SEQ ID NO: 14163 - DNA, 648 bp, Pseudomonas aeruginosa
ggcgggtcactcgaagagggcgtccagggcctgctcgaggcgcgtcacggcgatcacctgcaatcccgccggcgcctccttcggcgcgttgccgaggggtacgatggcacgcttgaaaccatgcttgccggcttccttcaggcgctcctggccgctcggcaccggacgcacctcgccggacagcccgacctcgccgaacaccagcaggtcgtgcggcagcgggcggttgcgcaggctggacatcaccgccgccatcaacgccaggtcggaggcggtttccagcaccttgaccccacccaccacgttgaggaacacgtcctggtcgtaggtcgggataccgccgtgccggtgcagcaccgccagcagcatcgccaggcggttctggtcgaggcccagggtcacccgccgcggattcgccaggtgactggtgtcgaccagcgcctggacctccaccagcatcggccgcgagccttcccaggtggccatcaccacgctgccgggcaccgcttcctgggcccgcgtgaggaagatcgccgaagggttgctcacttccttcaggcctttgtcggtcatgccgaacactcccagttcgttgaccgcgccgaagcggttcttcaccgcccgcagcaggcgcaggcggccgtctga

SEQ ID NO: 14164 - DNA, 1278 bp, Pseudomonas aeruginosa
ttcgccctcgaaatacagtacggtgtcgaccatgtgttcgagcacccgcgggccggccagggcgccttccttggtcacgtggccgaccagaaagatcgccgtgccgctctgcttggcatagcgcaccagcatcgcggcgctctcgcggacctgggcgacgccacccggcgccgattgcaactgctcggtgaagatggtctggatcgagtcgatcaccatcacccgcggctgctcctggcgcgcggtggcgatgatggtttcgatgctggtctcggtcatcaccttgagcttgtcttccggcaacgacaggcgccgcgcgcgcatcgccacctgctgctgggattcctcgccggtgacgtacagcgccgggacgcggctggccaggttgcaaagggtctgcaggagaatggtcgacttgccgatgccgggatcgccgccgatcagcaccaccgaaccgtccaccaggccgccgccgagaacccggtccagttcggtggagccggtcgtgaagcgcggcatttcctcgacgctgacctccgccagggtcttcaggttggcctgctggccggcccagccgccgcggccggagccgctcggcgcggcctcgacgacggtctccaccagggtgttccaggccccgcagtccgcgcactggccagcccatttcgggaaggtcgcgccacactcggtgcagccgtacatgcgcttggccttggccatgggaactcctctcgcgggcaaagcgcagatgatagccgctggcttgattccgatcagcctcgatcgaccgcgcttcgcgcgacactgatggccggacaaggagacttccatgcgcacactgctgttcctgcacctgctgggtgccgcgatctgggtcggcggccacctggtcctggccctcggcatcctccccggcgccctgcgccgccgcgatccccaggcgatccgcgccttcgagcaggtctacgagcggatcggcatccccgccctgctgctgcaggtggtcagcggcctgtggctggccagcctgtggctgccgttcgaccactggttcggcgccacgtcggtggcccgtgccctgcagctcaagctgctgctcctggcggcgaccgccgccctgggcgtgcatgcgcgcctgcgcctgatcccgaacctggacgccgagagcctgccgaagctgggctggcacatcgccgcgatcaccctggtgggcctgggtttcgtcgcggtcggacagagtttccgtttcggcggcgccttctgagcatgcccacatga

SEQ ID NO: 14165 - DNA, 2055 bp, Pseudomonas aeruginosa
agatggcgcccatcagggcggtgttgccgcgcgcatcctggacgcaggggtcggcaccggcctccagcaattgttccaccgctccgccatggccgtggtaggcggccaggatcagcccggtatagcccttggcatcctgcacatcgaggtcgaagccggcctcgacgaactccttcagcatggcctggtcaccgcgtcgggcggcatcgaagaagtagtcgcgcaaccgcgcttcgacctcgaccccatgcacctcgccagcttgcgcggccagcgccgcgagcagcaagcctgccagaatccaacctcgcatcgtcgtcatctcccaccaaaccgatagaggaagggcggcctggatggccgccccggttgcgatcaatcctggagcttcgccgccagttgccggacgcgctgcagatcggccccggccaccttggccaggcccgtgccgtagtcgctgtcagccttgtagaagtaggaaagcatgatgtacttgctctcgtcgtcggtgatcgccaacgccccgccgagactggcgatcaggtcggcctggtccttcttgccgtaggagcggaacagctcgccggtctgcttgaagttctgctcgcgctggatcttcgcctgctgggtggtgccgctcagcggggtccgcacgtagcgggcgctggcctgctcctcgcgcggatcgagccggctcggctggtagttcaccccgctggtactgtgtccggcgttcagcgcgccgtcctggttgacggtattgacctcgctgcgcgggcggttgaccggcaggcccaggccgttggcgccgacccggtacatctgggtatcggcgtaggcgaacagccgtccctggagcaggcgatcctcggagggctcgatgcccggcaccaggttcgacggcgccatggcgacctgttcggtttcctggaagaagttgtcgacgttgcggttcagcaccatctggccgatcttgcgctcgggaatgcccggccagatcttggtcgcgtccagcgggtcgaagtcgaatttcgccaggtcctcgggcttgagcacctggatgtacaggtcccatttcgggaagtcgcccttccggatcgcgctcaccaggtcattggtcatgtggctgtagtcgcgcccctggacttccgccacctgtttcggatcgaggttcttctggccctgcaggctcttccagtggaacttcacgtagtgcacttcgcccctggcgttgaccagcttgtaggcatgcacgctgttgccgtccatttcccggtagctggccggggtgccctcgttggaatacagcagggtcagggtgcgggtcgcctccggcacgtgggagaagaaatcgaagcgtcgcgagtcgtcgtcgaggttgctgcgcgggtccggcttgaaggcatggaccatgtccgggaacttgatcgcatcgcggatgaagaaggtcgggaagttgttgcccaccaggtcccaattgccgtctgcggtatagaacttggtggcgaaaccgcgcggatcgcgcagggtttccggggagtggttgccgtgcaccaccgcggagaagcgcacgaataccggggtcttctcgcccttgcggaagaccttggccatgctcaggtcgctgatatcggcactggcgacgaactcgccatgggcgccggtgccgcgggcatgcaccacgcgttcgggaatacgctcgcggtcgaaacgttgcagcttctgcagcagttgcacgtcctgcagcagcaccgaaccgttgggcccggcggtctgcgagttctggttgtcgcccactggcgcaccgttgtcacgggtcagggtcgcggcctgcacggacagcgacaggaggctggcggtcaggcttgccgccaccagcaggcggccgggacggaaggcgttcagggaagggttcatggaagagctcctaatggcttgtcaggcgtcttgttgcgcccgaccaaggtaaggagcgccgccggcgacgctaaattgaaaaacctcaccgcgccgattaggaatatcaatgcgcccatgaatcgcaaaaagaaataa

SEQ ID NO: 14166 - DNA, 891 bp, Pseudomonas aeruginosa
aaaagggcccgaacgggccctttttcattgccggacaacacgccgggcggcagcgttatccgccgctactgcgcgggcacgcacctaccagtagttctccaccgccacctgccccgggcgccgcgtcagactgaggttcatgccgcgagccttcagcacggcgcgggtgtcctcgatcatctgcgggttgccgcagagcatcacccgcgaatgctccggggtcagttccaggtcggcggcacgctccagatcgccgttctcgatcagcgtggtgatacgtccgttcaggcaaccgggtacctgctcgcgggtcaccaccggaatgaactgcagcttgtgggcatgctcggccaggtattcgcgctcggcgaggccggcgatcagctcgcggtaggccagctccttgctctcacgcacgctgtagaccagcttgatgctttcgaagcgctcccagacctcgaagtcctgcaggatcgagacgaacggcgccacaccggtaccggtggccagcagccaaaggtcacgaccatccacgaagcggtcgagggtgaggaagccgaaggcctggcgatcgaccagcaactggtcgccctcgcgcaggcggctgagttcgctggtgaactcgccgtccgggacgacgatggaaaagaagtcgaggaattcgtcatgaggcgccgaaaccatcgagtaggcgcgccagacgatactgccgctgggcttgtacacgccgagccgggcgaattgcccggcgcggaaccggaatcccgcgtcacggctggtacgcagggtgaacaggttgggagtcagaggctgcacgtcgagcagcgtctggcgggtgaatttctcttcgctggcggtcatggtccgctccggataccgatactcccctag

SEQ ID NO: 14167 - DNA, 933 bp, Pseudomonas aeruginosa
ctcgtcggtaaggaaacgactaaccagagccgggtaaagaatttttcggcatatccgtgtgccgcacaagctggagaactccaaccagctctcagtttcgacagattgttaattgacgagcgggattcgccccgccgggaacccgatgcctctattcgccacccccttcgcccagctcgacctggtccgccagcccgagcaggacggcgagcccctccaggcgttcgacgccgccgacgaatacctgctcaaccagttgcacgaacggggcgtgacggcgcaatgccgggtgctggtcctcaacgacgccttcggcgccctcgccgcgagcctggcgccgcacgtccaggtcaccagcagcggcgattcgcacctgggcttcctcgccctgcgcaagaacctcgcgcgcaacggcctcgacctgggctcggtgcgcttcgtcccggccagcgaaaccgccgtggggcccttcgatcacgtactggtcaaggtgccgaagaccctcgcgttgctggaggagcaactgatccgcctgcacggccaactggcaccgggcgcgcaggtcgtcgccgcggggatggtcaagcacttgccgcgcgccgccggcgacctgctggaacgctacatcggcccgatgcacgcttcgctggcggtgaagcaggcccgcctgctgatcgccgaggcagcggagcgcccgcaaccgcgctcgccctatccgacccgctatcgcctggagcagccgccgctgacgctgctcaaccacgccaacgtattctgccgggagggtctcgacatcggcacccgcgccttcctcccgcacctgccacgcagcctcggcgcgctacgcgccgccgacctgggctgcggcaacggggtgctcggcatcgcctacgcgctgctcaacccgcaggccgagctgaccctggtggatga

SEQ ID NO: 14168 - DNA, 1869 bp, Pseudomonas aeruginosa
gtcgtacatggccgtgcagtcggcgcgggaaaactggcgagcggcgctgggcgagcggccggcgacgttccgcgccgacgatggcctggccggccaggcggcgggctcgctggacctggtcctgtgcaacccgccgttccaccagcagcaggtggtcggcgacttcctcgcctggcgcatgtttctccaggctcgcgatgccctggcggcgggcggcgaactgtggatcgtcggcaaccgccacctgggctaccacgccaagctcaagcggctgttccgcggggtcgagcaggtcgcggcgaatccgaagttcgtgatcctgaaagcgggaaaatagtcagccgagcgccgccggggtgtccacgtcgcggagtacgcccggatcgtcgcacggcacctcgcaccaggccggacgatgggcctgcagcacacggcgcgcgccctggtcgccgtccagttgcgcaagcgcgtcccagaaagcgcggccgaacagcaccggatggccgcgctgaccgtcgtacaggggaaacacgatggcttcgggagtggccatcgcggccagacgctcgagggtatcggcggcgatccagggcatgtcgccgagcaggacggcgatggcccgggccgtgctgttcctcgccgccgcgacgccggcggccaggctgtggcccatgcccaacgatgcatcgaggctgtggacaagccgctgctgcgccggcaggcccaggctcgccggggtgtctccggcacgcaccaccacccgcacctcggcgaacgcctcgcgcgcccgcgccacgctggccgccagcagggtcgtgccatcagccaggcgcgccaggcgcttgtcgctgccgaagcggcgcccctgcccggccgccaggaccaggcacagcacctcgtcggcggcgaccatcagagccgctcgcggggaatgccgttgcggatgcgaagaatgtccgccagcaccgccagggcgatttccgccggcgtcttgctgccgaggttgaggccgatcggcgcgtggatccgcgccagttcggcatcgcccaggccgccgatgcgccgcaggcgctcgaagcgtttctccgaggtcgcccgcgatcccatcacgccgatatagaaggcttcggtacgcaccgcctcgagcatcgccaggtcgtcgatcttcggatcgtgggtcaacgccaccaccgccgtatcggcgtggcaaccgccgtcggcgatgaacagcgagggcagctcgcgacggatctcgatgccctccagcagcacgccgcgcaaggcttcttcgcgcgggtcgcagaggatcacctcgaagcccaggcccttgccgaactcggcgcaggcatgggcgacgctggaatagccggccagcagcaggcgctgggcagcgccgacgcgcaagcgcacgcactcgccgtcgcgttcagcccgagggccgtggctggaatcgtcgcgcaggctgcgcgcgccgctgcccagttcgacctcgcgcagcaggcggcgctgaccaagcaacgccgactccagctcgcgcagatgggcctggacatcgcagtccggcgccaggttttccaccagtacgtcgaggatgccgccgcagggcaggcggatgttcgagttcgggtcgtcgccctcgccgtagcgcacgatcaccgcgggatcggggaaaccgccggcggcgacccgctcgaggaaatcatcctcgacgcagccgccggacagcgagccgatccattcaccgctggcgttcaccgccagcagcgatcccggcgcgcggggcgccgagccataggtcgtgagcacggtacagaaccacacccgttcgccgcccacggaccacttcagcgccttgcggaccacctgtag

SEQ ID NO: 14169 - DNA, 1323 bp, Pseudomonas aeruginosa
atcgaggtgttgcacgattcacttcaccttgacggtatgcgccgaagcgctctccatcttcaattgcgcgacctgttggggaccgaggtcaccgggcaatccgccccaggtctggcgcaggtagttgagcaggtccgtgagttgctcgtcgtcgagtttcccggcgaaaccgggcatcggttgcatgcgttcgaagccggtgaactgctgttcgacgatgccgtcttcgatcactcgcaacagattacgcgggtcttgcaggcgcagggtagtgttgccgttcatcgccaccgcgatatgcggcttgccctcgccttcgccgccgtggcagccggcgcagacgttgaggtactgctggcgaccgcgcttgccgctgtcgttcagctgcgcctcgggcagcgcctggaccaccttggccggcggcggctggtcgccgagcaggtaggtggccatggctgccaggtcgctgtcgtcgaggtgctgggtgctgtggtgcaccaccgggaacatctcgttgaacatgctgccctgggcgctcatgccgtgcttgaggaagctcgccaggtccggctgggtccaaccgcgcgcggcaaggtcgccgggcagcaggctgggcgccaggtagccgttgagcaggccgccgctcaggcgcttgtcctgctccagggcgccggccaggttgcgcggggtatggcactcgccgcagtggccgagcacctcgaccatgtactgcccgcgcttccaggcctcgctgcgcccttcctccggctgcaagcgcacgctcttgccgtagagcaggttccagccggccaggcccatgcgcacgttgaacgggaagctcaggctggtctgcggcgccggccgggcgatcggctcctgggccatcaggtaggcgtagatggcgtcggcatcctcgcgctcgatcaggtgataggaggtgtagggcatcgccggatagaggtaggcgccgtccttgcgcttgccctcggtaagagcggcgaagaactcgtcggcgctgtaggcgccgatgccgtgttccttgtccggggtgatgttggtgccgtagatggtgccgaacggcgactggatcggcagcccgccggcgaacggcgcgccgccctcggcggtatggcaggccatgcagtcggcggcgcgggcgaggtattcgccgcgcttgaccagcgccgcgtcggcgccggcggcggaggccaggaacggcgacagcgcggccagcgccagggcgaggccggaaagggtccgcttcatcctcaagcctccttgaccaggccgagttcgtcgagcacgtcgcgggtggcgctgtag

SEQ ID NO: 14170 - DNA, 2106 bp, Pseudomonas aeruginosa
cgcggcgtcctgctcggcctggctcatcaggtagggattgcccttggtggtgagccgcagctcgggccattcggtctcggcggtcttcacctcgtccgccggacggccgaggaagtcgccgaccacgaaggcctgcgaggtggacatcccggtaccgatctcggtgccgatgtggcgcaggctgatgcgcccgtcggcgctgaactcgatgctcgccatcggcgcctcggcgccggtgccgaagtccttctggcaaatggcgaagccgaccccataccagttgtccgggtcttccgcgtcgaagcgcttcttgcgtgcgtcgcggtccttccagacctcgtgggcagcggccttgtcgaggatctcgtgcaggcgcagggcaccggccgggaccgcgccctgggtgttcttcatgcccgagcgcagggcgttgcgacgacgcaggtcgatggcgtcgacgcccagccggccagcgatctcgtcgaccatcatctcggtcgcggccatggtctgcagggtaccgtagccgcgcatcgagccggcctccacgccgcgcgaatgataggcggtgaccgccaggtcgttctgcggcatgtagtagatcgactgcgcggcggtggcgcccaccgccgccaccgaggcgctgtagttggcgcgcccgccgccgtcggcgctcatgtcggcgcggaagatgcggaagccgaggtcgttcctgtctaccgccagttggtagcggatgtcgaacgggtggcgcttgatgccgctctggaactgctcgtagcggtcgttggccaggcgcaccggcacaccctcgccatacagcgcggcgagcgcggcatagaagacgaagatgttgttgtccttggagccgtagccgacggtatagcccggatggatgttgaacttctccagggcgaagcgcgacggcttgatcatgtgcacgctttcgtaggcgacttcgaacgggcactgggtggcgaccacgaagtgcaaggtcttgctcgccgcgtcgtaccagccgttgccgttgtccggctccagtgccgccggctcgatcgatggggtcttgtagcgctcgtcgaagaccagccagtcctgcggcgggttttccagttgctcggccatgcgcttggcatggaacagcccctgctcggtgaggtcgccgtgcagcttcggctcgctggtccataccggtttgcggttgaggatggtggggaacagcatcgagtccttcaggctggagaactcgtcgtcctcgtagggcgtcttgccgccgacccggacgaagcgatagctgccgtagggatcgccctggtacagcggggcctgggcgccatagcggatcgccttgtcgttgaacttgagcttgagcttggcccggcggaagcgctcgaagtcgttccagatcaggatcgccaccggatggccgatgaacatcggcaccttgcccggcggcaggagcggatcgggcgaatgcgcctcggggaagacgatgccgtccttctccaggtcggcggcggtgacgatacggtccggctgcaactcggcgcccagccaggaaaggtcgtggccttcgtagatgcggtcggcgcgaacggtcttcagcaacatggcgtggccttgctgctgcggccagccgggcatgtccctggcgcggatatcgcgggcgaacaccttgttgccgcagaccttggacaaggcgtcgttacggaaacggacctgaccgttgcccgccatccagcgctgggcggaaacggtcacctggttctcgaacaaggcagcgaacgcctggctgccgagcggcgccagggtgacacccacgccggcgatcaacccgccctggagaaaggcgcgccgggatatatcacggttggacatgcaagttcctctgggtggtacggttcccacccatgtcgttattcaggcttgaacagctcgtccggacggacgaggtggagcacgcaggcggaaaaacctgactcaggagttaattttagcgacaagtcgcacccgaggaaaagtcccgtctaccgctggaaggacccatggacactcgactttggtcgcctgccaggccggctccaaccttttcgtgcgcttctctga

SEQ ID NO: 14171 - DNA, 1266 bp, Pseudomonas aeruginosa
atcttcgatttcggcaatggcaacagccaagaggtaaccacatgttactctccgccctcctctcgaaacgcccgaccccagcatgtccagccaacccagctccctgctccgccatcgtcccttcctcgccttctggctggcccgcgtctgcaccgccagcggcttccagatgctcaccgtggccatcggctggcacatctacgaactgaccggcaatgtcctcgacctgggcctggtaggcctggtcgaattcctcccgcgggtactgttcatgctccacaccgggcatgttgccgaccgctacgaccgacgcagaatcgccgccctctgccaggccggccaggccctggtggcggtggcacaggtgctcggcgcggcttcgggagagatcacccgcaacatgatcttcgtcctcgccttcgccctcggtaccgcccgcgccttcgaaatgccgaccacccaggcgctgctgccgaacctggtaccggccgggctgttcccgcgcgcggtggccgcttcggcttcggcgatgcaggcggcgaccattgccgccccggccctcggcggcctgctctatgcgttcggtgcctcctgggtctacgtgccgaccgcgactctctacgtcctcgcgtgcgtcctgacgctcagcctgccggtacgcaaccagccgctcacccagggcaaggccaccctcgactcgctgctcgccggcatccgtttcatccgcagccgaccggacatcttcggggcaatctccctcgacctgttcgccgtgctcctcggcggcgccaccgccctgctcccggtgttcgccaaggacatcctgctcaccgggccctggggcctcggcctgctgcgctcggctccagcggtgggcgccctggcgatgtcgttctggctggcgcacttcagcatcgaacgcaacgtcgggcggatcatgttcctctccgtgggcatcttcggcctggcaaccatcgccttcggcctgtcgaaatcgttctggctgtccctcggcgtgctggtggtactcggcgccgcggacatggtcagcatggtcatccgcggcgccttcgtgcagctcgaaacccccgacgagatgcgcggccgggtcagcgcggtgaacggcctgttcatcggcgcctcgaaccagctcggcgagttcgagtccgggctcaccgcacattggttcggcacggtaccggcagtggtcctcggcgggatcggcaccctggtggtcaccggagcatggatgaagctgttccctag

SEQ ID NO: 14172 - DNA, 1845 bp, Pseudomonas aeruginosa
gcacgaacctccctctccgcagaaccggagaggggctccgtcagcagcctccggaacggaggccggcagggttcagaagcgcgccaccacgttgaacaggacccgcgtctcgcgcttcccatcgcgctggtcggctggctcgccgatgacctggcgggcaatctccgggttgaacgacaactggtcggtgaggttgaagcgcaccccggcaccgatcgagccgagcttctgctgctcgtcatcgtccacgtcgaggttgtaggtcttgccccagtcgtagaaagcgtaggcctggtagctgcgcagccagctatagcccaccgcctggccatagcgcggttcgagcttcagggcgaagccacggtcaccggtgatgttgcccggggcgaagccgcgaccgatcccgctgccgccgacgccgaagcgctcgctcggcagcaacgggtcgaagctgtactgccattgcaactcgccatacaccgaccagggtccgccgagcccttgcagacgcccgatgttgccgttgagatagacgaaacgtccgtcggccacttcgcgggaacgacgttcatcgtccttcttggtcgcgccccacatgtccaggccgatgttgttgcgcacctccgccaggttgatgcccatccagcggtcgacccagtcataggtcaggcgttgctggaacacccgcacatggtcacgaccggggttcgaggcgtcgctggcgaagtcgcgcaggcgggtctcggtatccttccactgcaacgccaggccgccgctcaggttctgcgagcgcgagcggatgaagggatggttgtaggaaatgctgccttcggtgctcttgctgacgctgtcgaaggggaataccgagtccggaatgtccgggttgaccttcgaataggaacccatgatctgcagggtatcgccggcgaacatgccacccagcggcaacgtaccgcgcaactggatgtagcgggtggcatcgctgaacggcgagatcgcgccgagtacgtcgatctgctcgtagaagcccaggcgggagaactcggtggcgccgaaggccagggtggtcgggtcggtgtagtgcgagccgcggttgtcgaggctgacgaagccttcgtatcgctgctgctgcaaggccacgtcgaggttcgacgagcccagcgcctgacccgggctgagcacgctctgcacgttgacccccggcaggtcgccgaccagcagcaggccgcgctccagggtatcggcatccagcggacgtttttcggtcagcggcgcgagcagttcctccactcgcacccgcggcccatcgacggttcccttgatctgcacgtgttcgaggtaaccctcgatcacctgcaggcgtaccttgccgccctcgatgctctgctccggcaccactacctgggtcaacaggtagccgtcctggcggtacttggcggtgaggcggttggccaggtcgaccagttcggccagggacacctgcttgccgagcatatgctggtaataggactcgagcaccgccttgtcatagcgggtgttgccttcgatgcgtatctcgcgcagttcgaagcggatctgttcgctgccttgcggcgcgacctgcttgggcaccaccagcggcgcctcgggcttggcttgcggctcgctgcggggcttgaagcgttcatcaagctgggatggctgtacagtccctggcaactccacggcggcggcggaagcagccagcatcccgcagccacagagcgtcacccagggaagcgtccattgcgaatgtttcatcattcacctcgggcagatgacgcactaccgcccggagacgatagtgcgcattgcgaaaagggttag

SEQ ID NO: 14173 - DNA, 612 bp, Pseudomonas aeruginosa
gcgctgtcggcgatgctcaggttgaccttgccggaggtctccaccaggccgccgttgccgccctgggcgccgccgcgcgcgaggatccgcccgtccatgcgggtattgccgtcggaccagaccaccgccaggccgccattgcccttgccggtagccgagacgtcgatgctggcgcccttggccagcgtagcgttcttcgctcgtggcagctcgccgcggccctggaagtcgccgccgatgcgcacgctgccgccctgtgcggcgccgcgggcgtcgatgctggcggtgctcgccagggccacctgctgcccgctgaccagcacgtcgccgccgctcttcggaccgctgacgtcgatcttgccggcgacctggatgtccccggacttgcttaccagcgccacgctgccctcgcgcacctcggtaccgcgggcgaggatcacgccggacaggttgaccgcgttgtcgaccacccgggaagcctgctcggcggtgatcagcacgctaccgccgtcggcctggatcgcgccgccgttgctgaccagcgcctgggcatcctgcggcttgcgggtaaccgggtcggtcacggcgatggacaccaggccatcgccgtag

SEQ ID NO: 14174 - DNA, 1128 bp, Pseudomonas aeruginosa
ctcaaaaatgacactacagaggttaaatatgtaataccgtcaaaaaaccgactatactttctggataatcactgtcaagaaaaccggaagacctccctggcacgcgggtttgctaggctaggcagccccccgtccgctgccgccaaggaaccgtccatgagccatgccctgcgcgccgttttcctcgaccatgcctccctcgacctcggcgacctggacatgcgccccctgcgcgccgccttcgacgagctgcaactgcatgccgccagccaaccgcaggaagtcgccgcgcggctgcacgatgcgcgggtcgcgatcagcaacaaggtgccgatcgacgcgcaatgcatcgccgcctgcccagagctggaactgatcctggtcagcgctaccggcaccaacaacatcgatctcgctgccgctcgcgagcgcggtatcgtcgtcgccaactgccatggctacggcacgccctcggtagcccagcacaccctcgcgctgctactggccctggctacgcgcctgccggactaccagcaggcggtacgcagcggtcgctggcagcaatccagccagttctgcctgctggacttccccatcgtcgaactggaaggcaagaccctcggcctgctcggccatggcgaactgggcggggcggtggcgcggctggcggaggcgttcggcatgcgcgtgctgctcggtcagttgccaggacggcctgcccgggcggaccgcctgccgcttggcgaactcctgccacgggtagacgccctgaccctgcactgcccgctgaccgaggacacccgcgggatgctcggcgccgccgaactggcgctgatgaagcctggcgccttcctggtcaataccgcccgtggcggcctggtcgacgaacaggcgctggccgacgccctgcgcggcggccacctgggcggcgccgctaccgacgtgctcagcgtcgaaccgccgagaaacggcaatccgctgctggcccccgacatcccgcgcctgatcgtcaccccccataacgcctggggcagtcgcgaggcgcggcagcgcatcgtcggccaactggcggaaaacgcagaggcatggaaggccgggcgcgccctgcgggtagtcaacgccggctga

SEQ ID NO: 14175 - DNA, 720 bp, Pseudomonas aeruginosa
cgcgcggcattgccagctctggcaggtgcgtatcgaacaggcgccggccgagcccgacctacacgccctggcccagcgctacagcctgccgctgaccgatggcgagctgcaggtggtgagcctgccgggggtgttcagccatggccgcctggatcgcggcagcgcgctgctgctggggcaactgcaagccctgcccggcggccatctgctggacttcggctgcggtgccggggtactcggggcggtcctcaagcgtcgctaccccgccagtcgcctgagcctgctcgacgtcgacgccttcgctgtcgagagcagccgactgaccctcgccgccaacggcctggacggcgaagtgatcgccgccgacggcatcgacggcgcgccgcgcgaactcgccgcgatcgtcagcaacccgcccttccaccagggcgtgcacaccgactaccaggcctccgagcgcctgctgcaacgcgccgccgagcacctggcgccgggcggcgaactgcgcctggtcgccaacagcttcctgaagtacccgccgttgatcgaacgccacctcggcccctgccggacactcgccgaaggcgacggtttccgcatctactccgcccgtcgctcctgatttctgcctggaaccctgtgaatgaagcttttcctctccctgcccgcacgcccgcagccagacccttccgtggccacccgccgggaggccgccgatga

SEQ ID NO: 14176 - DNA, 651 bp, Pseudomonas aeruginosa
agaacgatgccagcgacatcagcgtatcgcccttctccctgctcttctagcgcgccggcttccccccggcggccgggggtgatgaacgcggtgatcctctcggcgatcctctccgccggcaactccggcatgtacgcctcgacccggatgctctacaacctcgccctcgagggcaaggcaccgcgcctgttctcccgcgtctcgcgcagcggcgtgccacgcaacgcgctgtacgccactaccctggtcggcgccctgtgcttcctcacttcggccttcggcgacagcaccgtctacacatggctgctgaacacttcgggcatgtgcggcttcatcgcctggctgggcatcgccatctcccactatcgcttccgcaagggttacctggcccagggcggccgcctggaagacctgccctaccgggccaagctgttccccttcggcccgctgttcgccttcgccctgtgcatggtcatcaccctcgggcagaactaccaggcgctggtgggcgaacgcatcgactggatcggcctcctcgccacctatatcagcctgccgctgttcctggcgatctggctgggataccgctggaagaagcgcgcacgcttcgttcgctaccacgaaatggacgtcagcccgaccaatacctga

SEQ ID NO: 14177 - DNA, 1167 bp, Pseudomonas aeruginosa
ttggtcgacccgccccttaggaagcctgatggaatcgctgttcgtccctaccctcatcgttgccctcgcggaaatcggcgacaagacccagttgctggcactcctgctcgcggcgcgtttccgcaagccgtggccgatcatcgccggcatcgtcgccgccaccctggccaaccatttcgctgccggcgcggtgggcgcctgggtcgccagcttcttctcggaagccaccctcagttggatcctcgccgcctccttcatcgccgtcgccctgtggacgctggtaccggacaagctcgacgacgaagagtccggactgaagaaatacggccccttcctcaccaccctgatcgcgttcttcctcgccgagatgggcgacaagacccaggtcgccacggtcatgctggccgcccagtatccgcatttctggctggtggtgatcggcaccaccctgggcatgctgatcgcccacgtaccggtggtactgatcggcaacctggccgccgacaagctgccgctgaccctgatccgccgcctggccgcggccgccttcgccgcacttggcctgtacgccgcctggcacgccgcgcaattgaccggctggctctgaaggactgcgccgccgggcccgggatggctgggcggccaatgcaaaatgcatgggaacggctacagttcaggcaggcaccggatgcctgccccaccactcgccctcgagagccggagatgccctcacacgacctgaaacgactcgcccgccatcacatcgagctgtcctggaacaagggccgcatggcgttggtggagcagttgcacagcaaggatttcctctacaaaagctcgttcatcggccgtcccctggataccgccggctatatccgcctgctgcaggacatccgcacggcgatgccggacctggaggtcgtggtcgaagactgcatcggcgaggaacgcaaggtgttcacctggagcacgctgatcggcaccatcgtccggccgaccctgggctatccggccagcgacaaggtgctgagcatttccgcgatgggcttctgggtgttcaacccgcagggccagttgcaggagctgtgcaccatgttcgacatggagagctttcgcgcccagctgggactgcagacccgacccttcgcggaaaaaacgctgccctag

SEQ ID NO: 14178 - DNA, 342 bp, Pseudomonas aeruginosa
acgccagccgcgacgaaatctccgcgctgctgcgcagcaccgtgcagaacaaccccaagctgctcgacaccttcatggcctgggaacccaatgccttcgataccgatgccgccttcgccgggcaacccggcaagggctacggcccggacggccgctacctgccctggtggtatcgcggcgccgacggcaagccgatcgtggaggccatggccgacagcatcgatagcgaaaagctgctgcccaccggggtgcgcgagaacgagttctatgcctgtccgaaagagaacaagcgtccctgcatcatcgacccggccccttacgaaatgggcggcaagaccgtga

SEQ ID NO: 14179 - DNA, 558 bp, Pseudomonas aeruginosa
cccagggcgtgcccggcctgggccggcgacgcttcgcggatcgccgcctacgtggtctccgggatcggcttcctcggcggcggcgtgatcatgcgcgacggcctcaacgtgcgcggcatgaacaccgcagccaccctctggtgcaccgccgccatcggcgtcctgtgcagcatgggcctgctgctggaggccacgctcggcagcctggtggtgctctgcgccaacatcctgttgcgcgacatcgcccaacgcctgaaccgccaggacgtgttgccggccagcgaggccgagcaacgctacgaagtgcagatcgtctgccgcgccgaggacgagatccaggttcgcagcctgatgctgcacagcctcggcagcagcgacctgcgcctgcaatcgctgcacagcgaggatctggacaacccggccaagctggaagtccgcgccgaactgctcggcacccccgaagctccggcgcagctggaacgcctggtcagccgggtcagcctggagaagggcgtcagctcggtgcgctggcaggtcttcgaactggcggccgactga

SEQ ID NO: 14180 - DNA, 456 bp, Pseudomonas aeruginosa
gcctggctttcgagcatcgctgcaccccctatgagttccgtttataatcgcgcggttcaattttcggccacccccttgggcggccttcgcagcatccatatggaaccagaaagcatgatgggcgagttcgaagccatccgaccctacagtgacgccgaagtccccgcggtattgcaacgcctcctgagcgacgacgccttcctcggcgccctggtccgctaccgcttcccgcgcctggccggtcccctcggttggctgctcaaacctcttatagcccatcgcctggcccgcgaggtcaccggcatccgcagcgtcgccacgctgcaggacaagttcgagccctacgtcgaccacaccatcgagaaggccaccgatggcgtcacctactccggggtcaatcgcctcaagccagggctgcgccctacctgttcatcgccaaccaccgcgatatcgtga

SEQ ID NO: 14181 - DNA, 507 bp, Pseudomonas aeruginosa
gccgcaaggacgaacccttcgccgaaatggtgcgcgccctgcatttcatcccggtgtcgatcagctacgaatacgacccctgcgacctggccaaggcccgcgagttgcacacccgcgccagcaccggcgagtaccgcaaggcaccgggcgaggacgatgccagcatcgcgtgggcatcaccggtacaagggccgctgcacatcaacttcggcccgaggtggggggagttcagcagccaagcagctggccgccgaactggaccggcagatcctcggcaactaccgtctgttcccggtgcactacctggcctacgagatgagcgagaaccgcgacccgggcctcgccgtccccacggccgagagcctgttcggcagcgaggagctggagaaggcgcgcaaggaatggaaccgccgcctggagcaatgcccggccgagcagcgcccctggctggtgctgcaatacgccaacccggtgctcaaccaataccggatcaagcagcaatcctga

SEQ ID NO: 14182 - DNA, 678 bp, Pseudomonas aeruginosa
cgcaatttttttgcccgcccccgttggagacagtcgcccatgcccgtacatgagatccgccaccccctcatccgccacaaactgggcctgatgcgccgtgccgatatcagcaccaagaacttccgcgaactggcccaggaagtcggcgccctgctgacctacgaggcgaccaaggacctgcccctggaacagtacgaaatccccggatgggccggcccggtgacggtggagaagatctccgggaagaagatcaccgtggtgccgatcctgcgcgccggcatcggcatgctcgacggcgtgctcagcctgattcccggcgccaaggtcagcgcggtcggcgtcgcccgcaacgaagagaccctggaagcacgcacctacctggaaaaactggcgccggacatcgccgagcgccgctcgctgatcatcgacccgatgctcgccaccggtggctcgatggtcgccaccatcgacctgctgaagaaggccggcagcaaggaaatccgcgccatggtgctggtcgccgcccccgagggcatcgaggcggtacgcaaggcccacccggacgtgatcatctataccgcctcgatcgacgagaagctcgacgagaacggctacatcattccgggcctgggcgacgccggcgacaagatcttcggtaccaagcagaaggaagcctga

SEQ ID NO: 14183 - DNA, 936 bp, Pseudomonas aeruginosa
cgtcgccagcagctccggggccggctccatcgtcctgacctgcactccgggaatgaccgtctccgtcgccctcgactacggggtcaatggcggcagcagcagccagcgctacctgaagcgggtgagcggcaacgagaccctcgcctaccagctctaccaggatgccgcctactcccaggtctggggcaacggggcactcgcgcggaccatcgccaactttcccgccagcacccagacctacacggtatacgcgcgcctgttcgcggtcggcagcctgccgtccgccggcaactaccgcgataccgtcaccgtcaccctttcgttctgagccgtcatggaggatcacatgcccagtccacacctacctctccgccccggccgctggcttgcggcgctgctggcgctgttcctgggcggcccggcacaagccgccagtgcggtgctgatctggccgatcaacccggccatcgaagccgaccaaccggccaccgcgctgtggctggagaatcgcggcaagcaaccggtgaccctgcaggtgcgcgtgctcggctggtcccaggcggatttccaggacgtctatcgcaaccagcaggcagtgattcccagcccgcccttcgtcaaggtcgagccgggccgccggcagctggtccggctgatccgccagggcggccagcccagcacgccggaggacgcctatcgggtgctgatcgacgaagtgcccgacggcagcgcggggcagacgcaacgaagccccggtctcgccctgcagttccagatgcgctattcggtgccgctgttcgtcagcgccgacggcgtctggacccagccgcgcagcgatgtcgagcgcgacccggccgacgcgacccggccgaagctggcctggcggctggtcgaggaacagggcaagcgttacctgcaggtgcgcaacgagggtag

SEQ ID NO: 14184 - DNA, 372 bp, Pseudomonas aeruginosa
tcaacggccgcgacagcggccaggtggtgccggtcaacgccgccgatggccattacctgctcgacgccgcggccctgcgcgaagccggcgtgcgcctgcctggcaaccccgccggacaggtcgcggtggacgccctgcccgaggtccgggcggactatgacagcgccagccagcaactgcacctgcaagtgccgccggactggctgccggagcagcgcttcgacgatcccggactggtcgcccgcgccccggcgcgcagcagcctcggcgcgctgttcaactacgacctgtactactcggaccccgccgacggcgccacgccctggctttccgcgctgctcgagcaacgcctgttcgacggcttcggggtga

SEQ ID NO: 14185 - DNA, 870 bp, Pseudomonas aeruginosa
cctgctcggccccgatcggagatacgccatgagccgccactccacgtccgcctgcctgctcggcttcgctacgctctgcgccagcccgttgctgctcgccgcctgcaccaccagctccggcaccggcaatttcggcagcctgagctcgttcaccgtggccagcaccgcccagaccatcaccggcaccaccggcttcaagtgcaccggcagcctgttgtcgatcctcagcaccaacaccatcgacgcgaccatcgccagcaccgccaatccgctgggcaccacgccgcggctgtacaacgccgccagcggcacctacctgccctacagtatctgcaaggacaacggctgcggcaccgtctacaacgtcggctcgacggtacgctggagcagcaccaccttcctcggcatcctcggcctgttcaacgccaccgacggcagcctgccgctgtacctgcgcaccgccaccggggtgaccctgccggccggcacctataccgataccatcggcctgaactgggcctggcacctgtgcgcggcgggcatcggcccagtctgcgtatacgacgacggcaccgccagcagcagcgtcaacgttaccctgacggtgctcaaggactgcttcatcgacagcgctccggacctcagcttcggcagcgccgcgctggtctcggccttcaccgcggtgaaccagaacattggcgtgcgctgcaccctgaacgccacctataccatcggcttcgacaacggcaacaacttcagcggcggctggcggcgaatgctcagcggcgccaacgcgatccagtacaacctctacaaaccgggagactcgacggtctggaccaccagcaacacccaggcaggcaccggtag

SEQ ID NO: 14186 - DNA, 1620 bp, Pseudomonas aeruginosa
ctgcgccgccagaccgcaggccgcggtcatcgcgctccacaccagcacgccgaacaggatcaggccgcgccggctgcggttgtcggccatgcgtccgagcgggataccgcaaagggtgtagaacagggcgaaggacaagcccatcagcaggctcatttccgtatcgctgatggccaggtcgcggcggatcgggccgaccagcaggttgaggatctgccggtcgatgaaggacagcacataggcgaccatgaggatcgccaccgtggtccaggccgcaaggttggagggatagccgttattgttgttatgcatgccgaagtcctggacgccgccgaagcggcggatgcgaagggagggtcgacaggcaggataagccggcaacatccgggcttatacccagggcaagggactatagaactgctgaatgcgggaagcgggttccggcgaatgaccgccaggtcattcgccgccgcatgcgctcagagcctgtccagcatctcgcgagctgggcggggaagcggagctgacgagcggcaaatgagcacttcaaagccgtcataccgcgccgcgcagcggatcatgaacaggctctcagagcggcctggccaagcgcccgctcatctcggccagggcgccgacccaggcggggtggtcgttgaggcagggaatcagcaccaggtcctcgccgccggcactgatgaactgctcgcggccgcgcatgccgatttcctccagggtctcgatgcagtcggcaacgaacgccggacacatcaccagcaggcgcttcaccccgcgctgcaccagttcgtcgagcttggcgtcggtatagggctcgatccacttggcgcgccccaggcgcgactggaacgacaccgaccagcgcccctgctccaggccggcgcgctcggcgaaggcctcggcggtgcgcaggcactggctgcggtagcagagggcgagggcttcggggctgacgttgcggctgttctcggccagcaggtcgtgggcaggatccttcaccagcttgcggatgtgccgctcgggcaagccatggaagctcagcaacagatggtcgtggggctgctgcaggtacggacgcacgctttccaccagggcatcgaggtataccggctggtcgtagaacggcggcagcgtgctgacctccaggcccaggcgatgggcggcgatcacccggcgcacctcctgttcggcggtggtcgtggtgctgtcggcgaactgcggatacagcggcgccagggtcacccgccggataccgcggcgcgccaggtcgagcaggaccttctcgatggccggctggccgtagcgcatcgccagttccaccggcccatgcggccagtgcggcttcatcgcctcctgcaggcgacgactgaggacgatcagtggcgacccttcgtcccaccagatcgagctgtaggcgtgcgccgattcggccggacgcttgatcaggatcagcgacaccagcaggcgccgcagcggccagggcaggtcgaccacgtagggatccatgaggaactggtcgagatagcggcggacatcctccacccgggtcgaatccggggagcccaggttgagcaacagcagggcattctcggtcatgcctga

SEQ ID NO: 14187 - DNA, 642 bp, Pseudomonas aeruginosa
agcggcaacaggcgcccgaggaagccgccctcgggggccagcaccaggccggtgcgcaacagcacgacacgggtgccgagcttctccgcctcgcgggcgatctgctcccaggctaggcatagctcgctagcgaaatcctcgccggccgccgccccctcctcggtcaccgggcgctcgccgctgtcgccataccaacccaccgcagaacccgataacagaaggtccgggcgctgctcacgagcgtccagccattccaccaggcgctcggtaaggcgtacccggctttcccacagcagcgccttgcgcttgtggctccagggtttgtccgcgatcggctcgccggccaggttgaccaccgcgtcgagcggctggtcgccgtactcgtcgaaacgatcgatgccgcgcacgccgacgccgcacagcgattccacctgctgcggccgccggctgaacacggtcagccggtgtccggcctgtcgccagcgggcgcacaggcggcgacccatcaggccggtaccgccggtcaagagaatgtgcatggctgtctcctcgtttagcctgcgtgccctttcagtctggaccctggacatcgatctgcccgatgaccgtgcatcctccccccattccggcgttatcctgtga

SEQ ID NO: 14188 - DNA, 1356 bp, Pseudomonas aeruginosa
atggaagatccgtcggctccggccggggaaccctggcgtcgttttcgactcagccaaggaacagggcttgcatcgcactggtgccttagtgaacggcgccagccgtctattcttcagataactcggttgatacttccgaacggaacgtctgaaggttcgacaggccaggaagcgagccgtgcgccgcaggcgcgccatcggcgcgatgcaaggtgcgcctcgaagcacgcgcaatactgtacattaaatcaagcttgtacaagaaacctgattcgcctgtccagacgctacacaaccagagaggcatgtcatgagcgtccccatcgccatcatcggtactggcatcgccgggctttccgccgcccacgcattgagatccgccggccagaccgtacaactgttcgacaagggccacggcagcggcggccgcatggccagcaagcgcagcgaggccggcacgctggacctcggcgcgcaatacttcaccgcccgcgaccggcgcttcctcgacgccttgcaacactggcgcgaggaaggctgggtggacgagtggaaacccgctctctaccaataccgcgacggccagctgagcccctccccggacgagcagccacgctgggtcggcatcccgcggatgagtgcgatcacccgcgccctgctcaccgatctgcaagtggtcttctcctgccgcatcaccgaggtcttccgcggcaagcagcactggcacctgcaggactccgagggacagaaccacggtccgttcaaccaggtcctgatcgccatccccgctccccaggccacgccgctgctggccagcgtgccgaaactggcggccaccgccgcgagcgtggtcatggagccgacctgggcggtggcgctgggcttccgcgaggtactcgacaccccggtgcagggctgcttcgtgcacggcagtccgatcgcctggctggcctgcaatcgcagcaagccggggcgcgacaccaccctcgacacctgggtgctgcacgccaccagccagtggagccggcagcacatcgacatggccaaggaggacgtggtcgagcacctgcgctgcgccttcgccgaagtgatcggctgcgccgtaccggaagccgccttcagcatcgcccaccgctggctctatgcacgcccggcggaggcccaccagtggggcgccctcggcgatcccgacctgggcatctacgcctgcggcgactggtgctccagcggccgcgtcgaaggcgcctggctcagcggccaggaagccgcgcggcgcctgctggaacatctctgaggggatcgggccgtcgcctggcggcccgatgtgacaagaaaatatctatacaaatacattga

SEQ ID NO: 14189 - DNA, 1026 bp, Pseudomonas aeruginosa
gatgtgtcgtatgaccgcctggctgtcgagctgcgcgcgaacctcctttcccctcgggagacgacaccgatgcacgaatctcacccttccctgacgccccgactcggcatcagcgcctgcctgctcggcgaaccggtgcgcttcaacggcggccacaagcgatccgcgctttgcgaggaactggcgcgacacgtcgagttcgtctccttctgcccggaacaggccatcggcctgggcacgccgcgcccggcgattcgcctggaaggcactccggaagccgccgaggcgcggagccgcgacggcctggcggtcggcggagcgctcgccgaatatgcgcggcgggtggcgcaacgggcggatacgctggacggtttcatcttcatgcaacgctcgccgtcctgcgggctgcaacgggtcaaggtctatccagaaggcggcggcgcgccgcgcgccgaaggccgtggacgcttcgccgcagccctttgcgaagccttgccggagctaccggtggaagaagaaggccggctgcacgatccggtcctgcgggagaacttcctcacccgcgtgtatgcccatgcccactggcaggccctgcgccagcgcggcctcagccattcggccatcgtcgccttccatagccgctacaagtaccagttgctggcccattcgccggagcactaccgcagcctcggccgcctgctcggcgaagccggccactaccagccggaagccctcggcactcgctacttcggcgagctgatgcagggcttgcgccgctgcgcgacccgcggcagccatggcaacgtgttgctgcacctgagcggctacctgaaacgcgacctcgcaaccgaagacaggcgtgaattgcgcgagctgatcgagcaataccggcatggcagcgtgccgctagtggtaccgctgaccctgctaaagcaccacttccgtcgccacccgcatgcatacatcgcccagcaggcctacctgcaaccgcacccgaccgaactcggcctgcgcaacgcgctctag

SEQ ID NO: 14190 - DNA, 909 bp, Pseudomonas aeruginosa
gatttcccgatgaactcgccccacctcgaacgcggcggcctgccgatccgcgaagtcactcgtctgaccggcgtccatccggtcaccctgcgcgcctgggagcgccgctatggcctggtggtgccgcaacgcaccggcaaggggcaccggctctacagcgaagagcaggtcgagcgcatccgccggatactcgtctggctcgagcgtggcgtcgccatcagccaggtgcgcgcgctgctggagcgtccggaggaaaccccggcggcggatgtcgaatccccctgggaacgcctgcacgaacagctgctggacgccatcgccgcgctggccgagcgacgcctcgacgatctgttcaaccaggccgcgtcgctctatccggtagcgaccctctgcgaaaagcttctgcaacccttgctgcagcacctcgaacgacgctggcagggacagttcggcgcgcgcatggagcgggccttcttcttctcctggttgcgcagcaagctgggcgcccgcctttatcaccagcaacggctgcaacagggcgcgccgctgctgctggtcaaccagtccgagctgtcgctggaaccgaacctctggctgtgcagctggttgctcggcagcggcgaggtgccgctgcaggtcttcgactggccgctgccaccggccgaactggccctggcctgcgaacgcctggaagctcgcggcgtgttgctgtacgccagtcatcgcctcaatccggagcacctgccgcgcctgctggcaggggtgagctgcccggtggtgctggtcggaccggccgtggagatccagcgcgaagccttcgaaaccctggcgctaactggcctgctgctggcgagcacgcccctggaagcccgccgcctgctcggcgaacgaggtctgttgaacccatga

SEQ ID NO: 14191 - DNA, 954 bp, Pseudomonas aeruginosa
agcaacgattcggatggcaggcgcgcgcgaatctcacgcaatacgctgagcccgccgaccccggaatcgaaaacgccgaccgcggccgactcaaccgccatggcgttgcccgcagacggcacaggaaggatcgcgacgcacccgcaattcgcggaagcgcgtgccgagggcgtccaccagcagcaggcggcccaccagcggttcgccgaaaccggccagcagcttgagcgcctccagcgcctgcaggctaccgaccagccccaccagcggaccgatcacgccggcctcgctgcaggtcagctcggcctcgctgccgtgcccgtagaggcagtggtagcaggggctttcgtcgcggcgggtatcgaataccgaaagctggccctcgagacggatcgccgcgccgctgaccaggggcttgccggcgcgcacgcaggcgacgttgaccgcctcgcgggtggcgaagttgtcggtgcagtcgagcaccaggtcgaccgccgccacggcggcatcgagggagtccttgtccagcgcggcgctatggctgaccaggcggatctgcggattcagcgcgcccagccggcgcatcgccgactccaccttgccgacaccgacgctggtgccatcgtggatgacctgccgttgcaggttggtcaggtcgaccgtatcgaaatccgccaggtgcagctcgccgaccccggccgcggccaggtacagcgccaccggcgaacccaggccgccaagaccgacgatcagtgcgcggctgcgcttcaggcgcagctggccctcgacgtcgacctgcgccagcaggatctggcgactgtagcgcagcagttcctcgtcgctcagcatgcccattgtccgagagtgatccgctcgttgccgccgaggtcgcgcaacgtatgtaccccggcgaagccgcgggcgccgagcagttcgcgcaccgccgccccttga

SEQ ID NO: 14192 - DNA, 1539 bp, Pseudomonas aeruginosa
gccaccggctcgccgttgcgccgacgggcgatccagtcgtcgaaccgctcgttggcctcgcgcggcacgatgcgctccggccaggtacgcaggaagctgcgcggcttgcccatcgccgccgccagcagcaactcggtgtcgagccgggcgctgggcgaatcgggcagttgggaatccttgagaagggtacagatagtggtcatgtcagtcgcccagggccgccagttgatcggcctggtattcctgcagcagcggctcgatcacctgttccaccgcgccctccatcacctcgcccagggagtacagggtgaggttgatgcgatggtcggtgacccgcccttgcgggaagttgtaggtacggatgcgctccgagcggtcgcccgagcccaccagcagcttgcgcgtgctggcgatcgcctgctgcgccgcggcctgctgctggtcgttgagcttggccgccagccaggccatggccttggcgcggttcttgtgctgcgagcgctcttcctggcactcaaccacgatgccgctgggaatgtgggtgatgcgcaccgccgagtcggtcttgttgacgtgctggccgccggcaccggaggaacggtaggtgtccacccgcaggtcggccgggttgatctcgatcgctgcctgctcgtccggctccggcagcaccgcgacggtgcaggcggaagtgtggatccggccctgggattcggtttccggcacccgctgcacgcggtgcgcgccggactcgaacttgagcttggcgtagacgttgtcgccctcgacccgggcaatcacttccttgtagccaccgtgctcgccctcgttctccgacagcgtctcgacccgccagccctggcgctcggcgtagcgcgaatacatgcggaacaggtcgccggagaagatcgccgcctcgtcgccaccggtgccggcacggatctccaggaacacgttgcggctgtcgttgggatccttcggcagcagcatgcgctgcaggctgtcgccgagggcggcgaggcggccgcgcgcttcggcgacctcctcctcggcgaggtcgcgcaactccgggtcgctgtccttgagcaacgcctgggcgccctcgagatcggcctgcaccttgcggtagtcgcggaacgccaggatcaccggttcgacctcggcgtactcgcgggaataggcgcggaagcgggtctggtcactgatcacctcggcgtcgccgagcagcgccgtcagttcttcgtagcgatcgctgaggacatccagctttttcagcagagaagctttcatgcaggcataggtaccggtcagtggcgcggcgcgccctcgtcgagggcgaacagctcctgggccagggccagcgcgtcgatgcggccctcggcggacattttcttcatctgcacgctgggcgcgtgcagcagtttgttggtcaggccgcgggccagctgggccatcacctcggcggggtcggcaccgttggccagttgccgctgggccttgcccagctcctcatcgcgcaggcgctcggcctgctgccgatag

SEQ ID NO: 14193 - DNA, 513 bp, Pseudomonas aeruginosa
acgtcgtccagttcgccgacttccggctcgatgtcgcgcggcacggcgatgtcgaccatgaacatcggcttgtgcttgcgctgcttcagcgcgcgctccacggcgcccttgccgaggatcggcaactggctggcagtggagctgatgacgatatcgctgttggccaactcctcgggtatctccgaaagcagcaccgcatgggcgccgaactgctcggcgagcaggctggcgcgctccagggtgcggttggccaccacgatgcgcttcacgccttgctcgaacaggtggcgcgcgaccagggtgatggtctcgccggcgccgatcagcagcgcctggctgcggtgcaggtcgctgaagatctgcttggccaggctcaccgcggcgaacgccacggacaccgggttctcgccgatggcggtatcggtgcggacggtcttcgccgtactgaaggtggcctggaacaggcggccgagcagcggaccgacggtgccggcctcgcgcgcgacggcgtag

SEQ ID NO: 14194 - DNA, 483 bp, Pseudomonas aeruginosa
agcgcagcgacgatgccctgccgctgctcaaggccgggatcaaggaacacccggacgacaagcgcgtgcgcctcgcctacgcgcgcctgctggtggagcagaaccgcctggacgacgccaaggccgagttcgccggactggtccagcaattccccgacgacgacgacctgcgtttctccctggcgctggtctgcctggaagcccaggcctgggacgaagccaggatctacctggaagaactggtcgagcgcgacagccacgtcgacgccgcccacttcaacctcggccgcctcgccgaggaacagaaggacaccgcgcgtgccctcgacgagtacgcccaggtcggcccgggcaatgacttcctcccggcgcaactgcgccagaccgacgtcctgctcaaggccggtcgcgtcgacgaagccgcccagcgcctggacaaggcgcgcagcgagcaacccgactacggcatccagctgtacctga

SEQ ID NO: 14195 - DNA, 642 bp, Pseudomonas aeruginosa
ccggcgccgagactccttgaaaccatgcgtctacgtcttttcctcgccgcctccgcgctggccctgctcagcggctgcgccggcctgacctcccacgaagccctggaaggccagggcgatgcgcagacctggaaaacccacaagcagcagctcagcgagctggatgcctggcagatcgacggcaaggtcggcatccgcgccccgcgcgactccggcagcggcaccctgttctggctgcagcgccagggctactacgacatccgcctgtccggcccgctcggccgcggcgcagcacgcctgaccgggcgtgaaggcgcggtgagcctggaggtcgccgggcagggccgctaccaggcggagtccccggaagcactgctggaagaacaactaggctggcgcctgccggtctcgcacctgctctggtgggtacgcggcctcccggcgccggacagcaagagccgcctgaccctcgacgccgacagccgcctggcgcgcctggaacaggacggctggcagatcgaatacacccgctacgccgaacagaacggctactggctacccgagcgcctgaaactgcacggccaggacctcgacgtcaccctggtgatcaaggactggcagccgcgccagctcggccgctga

SEQ ID NO: 14196 - DNA, 600 bp, Pseudomonas aeruginosa
agaggggctcccgtcgtgacggccgtacaactgatcgttggcctgggaaacccgggtcctgaatacgaccagacccggcataacgcgggggcccttttcgttgagcgcctggcgcatgcccagggcgtcagcctcgtggctgaccgcaagtatttcggcctggtcggcaagttcagccaccagggcaaggacgttcgtctgttgatcccgaccacctacatgaaccgcagcggccagtccgtagcggcgctggcgggattcttccggatcgccccggacgccatcctggtggcccacgacgaactcgacatgccccctggcgtcgccaagctcaagaccggcggcggacacggcgggcacaacgggttgcgcgacatcatcgcccagctcggcaatcagaattctttccatcgcctgcggcttggcatcggccatccggggcacagcagcctggtttccggttacgtgctcggccgcgcaccgcgcagcgagcaggaactgctcgacaccagcatcgacttcgccctcggcgtgctgccggaaatgctcgccggggactggacccgggcgatgcagaagctgcacagccagaaggcctga

SEQ ID NO: 14197 - DNA, 642 bp, Pseudomonas aeruginosa
cgaggagaagcgcctggtgcgcagcttccacctgctgaccagcaagccggtgatgtacatcgccaacgtcgccgaggacggcttcgagaacaacccgcacctggatgtggtgaaggccatcgccgaggaagaaggcgcggtggtggtgccggtgtgcaacaagatcgaagccgagatcgccgagctggaagacggcgaagagaaggacatgttcctcgagtccctcggtctcgaggaacccggcctgaaccgtgtgatccgtgccggctacggcctgctcaacctgcagacctacttcaccgccggggtgaaggaagtccgcgcctggaccgtccgcgtcggcgccaccgccccgcaggccgccggcgtgatccacaccgacttcgagaaaggcttcatccgcgccgaagtggtcgcctacgacgacttcatccagttcaagggcgaacagggcgccaaggaagccggcaaatggcgcctggaaggcaaggactacatcgtcaaggacggcgacgtgatgcatttccgcttcaacgtgtaatccccttcccgtcccaggaaagccccggccaagcgccggggcttttcgttcctgcccctccccatcgccctctctccggcgatccgaccccttccgtctaa

SEQ ID NO: 14198 - DNA, 321 bp, Pseudomonas aeruginosa
ccatggtccacctcctcagtggtaatcaactatttcgacttcttcgggacccgcatccgtccagacgaaacagacacgccactggtcattgatcctgatgctatgttggcccgcccgctttccctgcaacggctccaaccggtttccaggtggagagcgcaggtctcgaagctccgtacccgcatgaagcattgcgagcttacgcgtagcgactgtgaggatcgctccccaccgcctcgaaagacccgtctcaaaaagctgacgagtctcgtcgcagcgaaaggtcagaatcattcattaacccttaacgttaagcgttaa

SEQ ID NO: 14199 - DNA, 999 bp, Pseudomonas aeruginosa
acaggccaagctgggccgctacccggacatcgataccgacagccgcgccttcttcctccagggcagttggaaggccaccgacgacctgaccctgagcgccggcgtgcggcgccagtcgatgagcaccgacgtcagcgacttcgttgcggcgaaccagcagatcctcatcgccaacggcctcggcaagaccgccgacgcggttccgggcgggagcaaggactacgacgtcaacctggtcaacgtcggcgccatctacaagctgaacctgcaacaacaggtctgggccaactacagcgaaggcttcgagctgccggatccggccaagtactacggtttcggacgctacggcgcagccgacggcaatggccactacccgctgttgcagggggtcagcgtgaacgactcgccgctggacgggatcaagaccaagcaggtcgagctgggctggcggcacaccgacggtgccctggatacccaggtggcggcgttctattcctggtcggacaagagcatcaagtacgactcgaagaccctggcggtgctgcagcaggacaccaagaagcgcaactacggcctggagggccaggctacctactggctggacgatcactggcaggtcggcgtcaacggcctggccatccgctcccaggaaaaggtcgacggccgctggctgaagcaggacgtgacctcggccagcccgtccaaggccggcgccttcgtcggctggaaggacgaccagcgcagcctgcgcctgcagggcgtgcgcaccttcaacctgaacgacgagccgggcaacaagatcgacggctacgcgctgttcgacctgctcggcacccaggcgctgccggtgggcaccctcaccgcgggcatccagaacctgctggacaaggactacaccacggtctggggacaacgcgcgcaggtctactacggcgggctcgcaccagcgggactgttcgactacaagggacgggggcggacctacagcctgacgtatag

SEQ ID NO: 14200 - DNA, 753 bp, Pseudomonas aeruginosa
tcatgccaacaggcgtgccaggctgcggcatcctctgccaggcgcggccagtcgggctgttcgaggtcggcgaagagttcccgttccagccaatcgcggccgctgcgcaggagccggcggaaggcgcggtcggtgagcgcgcggcggtgcaccgcctcgaagcgccaccagggggactcctgtaccgcctcgcgcggctggctgagcacggcggcgccggaggccggatcgaaggacagcggctggaacagtcccaggcacggcgccgaagtaccggtggcggccagcaacgggccgtcgtcgcgcaagcgggcgaccagactggcggtggtctgcgaaggccgccagaagctgccggcgtgcatgcatacctggcggttgttgtggcggcggaagtggtccccgcgcgggccatggtggcgcagcgcggcgaacagcgcgtgccagtccggctcaccaggcaggctgtcgaggaagcgctggttgatccgacagcgccggtgcgcgccgccgacccagggtagcaggcgggtgtcgaagacccgcgcgaagtggaagtcgccgcgaccatcccagcagccctggcggcgagcctggtcctcgaggtcgcggctgcacaggtcgaattcgtggccaagggtcagggcgttggagatggcccagcgctcgaccttcttcgccgcccacaggttgccggcggtttccagcacccaggcttcgccggggtcggcgatgaggaagctgttgtcgtag

SEQ ID NO: 14201 - DNA, 498 bp, Pseudomonas aeruginosa
gggcttccaggcctggcacggcccaggttgcgcccagaccgtccacctgcagctcgcggaacaggctgccctcgtcgccctcgccggcgaagcggatcgccggcaggccgaccaaccacaggcagcggctacgctcgctctcctccatgcgcgcggcgacgaagctctggacgaactccagggccgcctgcggcccctggtcgaggttgccgcgcgccagcagcggccagcgtaccggttcgccgatcagccgcgggctgtccggcaggccggcggcgcgcagcaggtcgcgcagcagcaggtaacccggatcgcggctggcgaagggttcgccggtgggcagttcgaccagcagggtgcaggagcccgcctgcagcagttgcaaggcgaagcgcggcggcggggcctggaccgccggcgactcggccggggcctcttcgaccggcgcgaccggctcggctttcttcgccgccggggcgcccggcttcggcaggctga

SEQ ID NO: 14202 - DNA, 1542 bp, Pseudomonas aeruginosa
ccagcgatgcacggctggccgccggcgccgctcaccaggctggggaaagccagctcgatcacgtccgcggtgtccggcaaggtgctgaccacccgcccgtcgtcgagctgggtggtcagcaccgaacccttggccagattcagcttgaacgggaaattgagacggccgagagtcaccggcgccagggtgctgcccttgttgctgccagtggcggcgacgtacagctcctttaccgtgatcggcacgttctgcccggtggcggtgttggtcacgccattgatcgcgatggtggccttgttgccgtcgaccatggcgctgtcgaggacgaagccgatgccggcaccctgcacgtccgacagttgctcgtcgtcgagcgctgtcatctcggcatgggcgaagggggcggccagcagggccgcgagcaggcaggcgcgactcatctcagcagcccttgttcaggccgcccaggcaggtgtcctgccgtggaatgccattgaaggcctgaccgaagtcgaccttgatcggcgccgttccatcggcgttgcgcgacatgttgaggaaggcaccggccagcgcggcgaccagcttggagggatcctgctggtcgcgccactggacgttctggctctgcatcgagatgaagaagcctttcgacgagtcgatgaagttctgcgcgttgttcggatccacggtgccgatcgggaacgactggtactgggccaggttgaagcaagtctgggcgcccatcagcttgcagtcgttggaggtcaggaagggcagcaggacgttcaccaggctgccgatgatggtgctgtcgtgcatgtccagggccgtgccgttcttcaggccgatcatggcagcgcggatcgggtcggggttgccggagctgttcaccagctctgcctgggcggtgtactgagagctgccggtgagagtgatggcggtcttcgccgccaggcagtcgagggccagcaggccgcaggaaatgctgcctcccagttggctgccggtgccgtacaggtccaccggcacgttgccggtgagggtcttgatatcgcccgagaggtagcccttggcttcgccgaaaccgatacggatgccgaccatcttgctgccgtcgtaggcgaactcgatgtagggattgctgatgaggaacgggttgatcgcgccggtggcgtcgttgaccgtgcccagggcgaagttgtcgatggcgatgtcggcactgccggcaagctcgccgctgcggttgtactggcccaactgcagcttcttcatgttcagttgggtctcgatgtcggcgccgaagttgatgcgggtgaagttcagtccgttggcggcgtcggtggtgaggttgatgaaggcctggccgaccacgtcggaaagctggtcgtcgtccagcgactccatcctcgcctgggcggtggcagccagcagaccggcgccgcagaacagcgcgcaacgcagcaggaagggcagacgacgggacatgggctcacctcttgttcttctcgtggccgacggcagagacactgcgacctgtag

SEQ ID NO: 14203 - DNA, 513 bp, Pseudomonas aeruginosa
cccgtggcgccgccctggcgctggcggcgatccggcgcaagggcctggatgccgtgccgcaggcggcgatgccgctgttcacccggccgcagagcaccttcctcggcaccgcctcgcaggtcgagagctacgtcttcgccctcgcccgcttcgagccgaagccggcgcagttccccaagtccagcggcacgcgcaagagccaacgggccggcgcgaccaccacggaccgcgcgggaaatgatcgagcgctgccaggcggcgctgccgctgccggacctcatgcaatggctgctggcccaggaaccggacggcgccaccgacgagttgctctactggttctcccggctgtcgcgcgacgcgcgcttccagcgcgaacgcctgcaacgccgcgagtacgaaaccaccgaacattgcgtcagcctctgctccttcgccctgacccccgccgccaaggacaagggccaggccagggacgcagacaccctttccgcgagcgaaacccatgcatcttga

SEQ ID NO: 14204 - DNA, 570 bp, Pseudomonas aeruginosa
tctctccgaactgacccagctcgcgccgatcttccgcgagctgttcaagggctaccacatcagccaccgcgaccccgagctgtacacccagctgtcctcgcaccaggaccagtaccgcggcctgttccgcgccatgggcttcgagctggtctgcgacacccgcggcttctactacttcgtcccggagcaggtcggcgcccaggtgaacaagaccgcccaacgcctggcgctgttcaccttcatcctcgtcgaacacctcgccgaccagggccgcgacccgctgtccgtgctggacggcggcagcatcggccgcgaagagctgccgccgctgctggagaaataccgcgacctgttcctccaggccgaggtgcagacccaggaagaactggaagagaaggtcatgcgccgcctgacccagctcggcttcgcctccgaggacagcggcgtgtaccgcttcatgccgccgatgcaccgtttcctagacgtctgcctgtcggtgcagcaggaccgcaacctgtccgccagcctgcacgccgacctgccgttgcagacgccggtgctggtcgatga

SEQ ID NO: 14205 - DNA, 2850 bp, Pseudomonas aeruginosa
cgcatgagccagacccgctacggcatccgccgcttcgccctgctcaataccgccggctacagcctgggtatcttcccgctggaaaacccgctgtcgatctacggcgccaacaacctgggcaagagcgcctcgatcaacgccctgcagttcccgatccttgcccgcctgtcggacatgagcttcggcaagtacagcatggagcagtcgcggcgcttctacttcgcctcggacaccagctacatcctcctcgaactgatgctgccccacggtccgcacgtgatcggcgtggccgggcgcggcccgggcggcggcttcggccaccagttcttcgcctacgccggcgagctgagcctggaccactaccagaagaacggtacctgcctgcgccagcgcgagctgttcgccaaccttgagcgcgaaggcttcaaggcctacgaggtgaagccggaagagctgcgccgcctgctggtcggcgggcacacgtcgatcccgctcgacctgaccatgatcccgctgcgctccaccagcgagcagagcctgaagaccttccgctcgctgttcatcaacctgctgcacatgcgcgagatcaccgcggccaagctcaagcagctgttcctcgacgccttcgagcacagcctgcgctcgggtaatgtcgactacatcgccgcctgcgaggaggccttccgcgacgtgcggcggatggagcaggactaccaggcgctggtcgccgccggcccgctggtggaagccctggccaacggcgtgacccagcgcgacgtactgcgcggcaagatgcaccgcctttcaccgctgctcgacagcctgctcggcacctggcacgactacgccggggcgcgccgcgaggaactgctgatccagcacgagcaataccgcgccgagcaggacggcctgcagaacgaacagcgtggcggcacccaggagctgatgcgcctggagcgcgagatcgccggcatccagcgctggctcggcgagctgtcggtgctcaagacccgcttcgccctggtcgacgacgccaaggtcctcgaacaacagctgctcgccgccaaggatgctcacgacgaactggccggcgccctggcccattcgcggcagttctccagcgaagacctggaagagcgcctgcgcgacctggaaaaacgcctgaagaacgtccgccagcagctcgaacacgccgacaacaacagctacgcacgcctgcgcgaggagttcagccagcaggacgtggaacgcctgatgcgtctgttcaacggcgcgctgttcagcctgccgctcggcgagaacggggtgaacctagatgacggcgacgtctgggtgaagagcgtcgaagccatcctcgaccacttcaaaggcgagcatttcgaggctcccggactgagcatcgacctgtcgcacatcgaaccgccggcgttgcaggccctggccgaccgcgccgccctgcgcgaccagaaggaacgcctggagaaggagctgaagcagctcaagacccagcagagcgtcgctgccgaccgcgccgcgagcaaggcccaggcggagaagctgtaccaggacgtgctggatgcgcagaaggccctggaagacttccgccgcacccagacgctgaccgccgaggagcccgagaagctcgccgaactggcccagctggaggcgtcccaggacgaactcaagcgctccagcgacgccttcgccgagcgcgtccagcaactctccgcgcgcctgcaactggtggcccggcaactgggcgacctggaggccaaggagcgcaccctggaagatgccctgcgccgccgccagctactgccggccgacctgcccttcggcacgccgttcatggagccggtggacgactcgctggacaacctgctgccgctgctcaacgactaccaggacacctggcaggcgctgcagcgcatcgacgggcagatcgaggcgctgtacgcccaggtgcgcctgaagggcgtcgccaagttcgatagcgaagacgacaccgagcgccgcctgaagctgttgatcaacgcctacgcgcatcgccaggacgaggccctgacgctggccaaggcgcgccgcgcggcggtcaccgacatcgcccggaccctgcgcaacatccgcagcgactacgacaacctggaacaccagttggccctgttcaaccgcgagatcaacaagcgccaggtttccaacctgcagagcttccgcatcgtcctcgcgccgaacaaggatgcgctcaagcacatcgaccagatcatccacagcgccggccagtacgaggaaggcgagaacctctcggtgttcgacctgacccagagcgccgagcaggacgcgaagaacgaggaggccaaggaatacctggcccgcctggtcgccgccaaccacaaccagttgggcctgaaggacctgttcgaactggccttcgagatcaccaaggtcaacggccagccgatcatgcacaccgacatcgacggcgccgcctccaacggcaccaccatgaccatcaaggcgctgaccaacatgtacctgttgctgcacctgatggaccgcgagcaggccgggcgcgtgcgcctgccctactacctggacgaggcggcggacatcgacgagcgcaaccaggccgcgctgctggagaccagcctgcaactgggcttcgtgccgatcctggcgagcgtgaagccgcaggtttccgcacacgtggcgatcgacctggaaggcggtagcggcccgaacggcatttatatcgacgaagcggactggaaatacatccgtcgccgggatgccgccgccagcggcgaaacccgcgcagccagcgagccggaggaagccggcgaaccggcgtga

SEQ ID NO: 14206 - DNA, 1071 bp, Pseudomonas aeruginosa
gcccgaagctcccgcgaagatataattggttacattcgcatttgtaacccacggggagaatccatgcctgttcgacttctcaaccgtttccgccacgccgccctggcgtgcctgctcggttcgctttccctcaatgcggcggccgatcccgtcacccttaccctctacaatggccagcacgccgccaccggtatcgccatcgccaaggccttccaggacaagaccggcatccaggtgaagatccgcaagggcggcgatggccagctcgccagccagatcaccgaggaaggcgcgcgctcgccggccgacgtgctctacaccgaggaatcgccaccgttgatccgcctggccagcgccggcctgctggccaagctggagccagagaccctggccctggtcgagccggagcacgccggcggcaacggcgactggatcggcatcaccgcccgcacccgggtactggcctacaacccgaagaagatcgacgagaaggatctgccgaagagcctgatggatctttccgatccgtcctggtccggccgtttcggcttcgtgcccaccagtggcgccttcctcgaacaggtcgccgccgtgatcaagctcaagggccaggaggaagccgaggattggctgaccggcctgaatgccttcggctcgatctacaccaacaacgtcaccgccatgaaagccgtggagaacggcgaggtcgacatggcgctgatcaacaactactactggtacaccctgaagaaggaaaagggcgagttgaactcgcgcctgcactacttcggcaaccaggacccgggcgcgctggtcaccgtctccggcgccgcagtgctcaagtccagcaagcaccccagggaagcccagcagttcgtcgccttcatgctcagcgaggaaggccagaaggcgatcctcagccagtccgccgagtacccgatgcgcaaggggatgcaggccgatccggcgctgaagccgttcgccgaactggacccaccgaaactgaccccggccgacctgggtgaggccagcgaggccctcagcctcgaacgcgacgttggcctgaattga

SEQ ID NO: 14207 - DNA, 423 bp, Pseudomonas aeruginosa
cggtctggatcgcgttggccccgggcgacagctggatcgccccgcccacggtgggcgtgccgttcagtcgcgaggaaatgttgtagctctccttgccgagttccaggcgcgcgacatcggcgagccggaccagcgagccgtcctggttggcgcgcagcactacctggccgaactcctgcggatcgtccagggtgcccttcaccgccagggtcgccgtcagctcctgcgcggaactgcccggtgcgctgccgaaggcgccggccggcacctgcacgttctgcccgcggatggcattgctcacgtcgtcgatggagaggccgaagcccaccagcttttgcggatcgatccagacccgcatggccgcctcggaagagaagaattgcagcttgccgacgcccggcaggcgccgcagctcgttgttga

SEQ ID NO: 14208 - DNA, 372 bp, Pseudomonas aeruginosa
ccctgcgcgaacccggcagccgccgcgacagtggcttctggctgttgcacctggccagcgacagcctcgcccagtggagtcccgacctgcccaccggcaacctgctctggcgcctggaagaccaatacgccgggcgggtgctctggcataccccggggagcacggcgctgctcgacgacatgcagaccctcggcgtggaaccgctgcgcaacagcgactggcagcttcgcgggctctacgacagcacgcgagtgcggctcggcctgctgccgggaatcggcggcgagctggcgatcttcctcctgctggtcggcgtcaccgtgtacatgctgctgcgcctgcaccgcgagcaacagggcctgcgcgccatga

SEQ ID NO: 14209 - DNA, 1788 bp, Pseudomonas aeruginosa
tttgaccctcgcccgctacgatgccgaactctttgccgcgatggagcaggaagcccagcgccaggaagagcacatcgagctgatcgcctccgagaactacaccagcccggcggtgatggaagcccagggttcggtgctgaccaacaagtacgccgaaggttatccgcacaagcgctactacggcggctgcgagtacgtcgatatcgtcgagcaactggccatcgaccgcgccaagcaactgttcggcgccgattacgccaacgtccagccgcacgccggctcccaggccaacgccgcggtctacctggccctgctgtcggccggcgacaccatcctcggcatgagcctggcccatggcggccacctgacccacggcgccagcgtctcctcctccggcaagctgtacaacgctgtgcagtacggcatcgacgccaatggcctgatcgactacgacgaagtcgagcgcctggccgtggagcacaagccgaagatgatcgtcgccggcttctccgcctattcccaggtcctcgatttcgcccgcttccgcgccatcgccgacaaggtcggcgcctacctgttcgtcgacatggcccacgtcgccggcctggtcgccgctggcgtctacccgaacccggtgccgttcgccgacgtggtcaccaccaccacccacaagaccctgcgcggtccgcgcggtggcctgatcctggcgcgcgccaacgaggagatcgagaagaagctcaactccgcggtattccccggcgcccagggcggtccgctggagcacgtgatcgcggccaaggcggtgtgcttcaaggaagccctgcagccggagttcaagacctaccagcagcaggtcctgaagaacgcccagaccatggcccaggtcttcctcgaccgcggtttcgacgtagtttccggcggcacccagaaccacctgttcctgctctccctgatcaagcaggacatcaccggcaaagacgccgacgccgccctcggccgcgcgttcatcaccgtgaacaagaactcggtcccgaacgacccgcgctcgccgttcgtcacctccggcctgcgcatcggtaccccggccgtgaccacccgcggcttcaaggaagccgagtgccgcgagctggccggctggatctgcgacatcctcgagaacatgggcgacgagtccgtggtcgacggcgtacgcgagaaggtcaaggcgatctgcgccaagttcccggtctacggcaactaagcgacaaggcaagacgaaagagcccggcaaatgccgggctttttcatttcctccgagggaggaggcgccgggtagcgttatcgccggtcctcgacatggatcaccgccaaggcctcggcatcctcgccccgccgggagcggccgtgcatgccgacgagcagctcgccggcgtcctcctccagttcctcgcgagggacgaaggtaaggatgtccgggtgatgcccggtcaccacccagccgcggccgttgtccagggtgatcacaccgaagtcgcccgccggcgtgccgacctgtaccgctccccactcggccagcaatgcccgcgcctgggccgcgaggtccggctccggctgcgtgaggatcacgcaagtgccctgggcgaacagcacccaggatttgtccgcgccacggatgcagtcccgccaggcgccgatcaatgcgttcctgtccatttccacgctcctttggcgtcgatgcgcctcagcggccttcgacgatgcgttcgaagccctcgcggatactgtcctccggcaggttgtcgccgatga

SEQ ID NO: 14210 - DNA, 2397 bp, Pseudomonas aeruginosa
cggggatcggggcgtggttgtcgttggctacttcggacatgcgcaacttccagaaaagacgcgggccacgtcagacgtggcccgcggaaggatggggattcagcagcagcggatcggccgacccttgccgccaccgtagcgcgcctcctggcgctcgcggaagaactcctcgtaggtcatcaccggcttgtccgggtgcttgttgcgcatgtgctcgacataggtgtcgtagtcgggcatgccgaccagcatccgggcggcctggcccaggtatttgcccatgcggctgaggtcgttgaacatggcgagttcctcgttaaggctccccggcgaaccggggagcgcggccggtcaggcgtcggggatgggctcgaacggggtttccttgtcggtccgctcgctcttgccccaggccgcgatgccgaccttgatggcgtagaacagtacgctgaacaccaccagcaggaacagcacggtcagaccggcgttgatgtaggcgttcagcaccacgtgctgcatctggccgatatccttggccggcgccagcacctggccggcatccagcgcggtggcgtacttctcgccaagagcgacgaagccgaccgccgggttgctgtcgaagatcttgatcaggcccgcggtggtggtgcagatcagcaaccaggccgccggcaggatggtgacccagacatactgctggcgcttcatcttgatcaggaccacggtggcgagcatcagcgcgatgccggcgagcatctggttggaaatgccgaacagcggccacagggtattgatcccgcccagcgggtcgaccacgccctggtacagcagccagccccacagcgccacgcagccgccggtgccgatgatgttggcggtccacgactcggtcttcttcagcgccggcacgaagttgcccagcaggtcctgcagcatgaagcgcccggcacgggtgccggcgtccaccgcggtgaggatgaacaaggcctcgaagaggatcgcgaagtggtaccagaaggccatggtgttctcgcccggcagcacctggtggaggatgtgcgcgatccccaccgccagggtcggcgcgccgccggcacgggccaggatggtggtctcgccgatgtcctgggcggtctgggtgagttgctccggcgtgatggcgaagccccagctgctgacggtcgcggccaccgcgttgacgtcggcgccgaccaccgccggcgggctgttcatggcgaagtagatgcccggctcgatcaccgaggcggcgaccatcgccatgatcgccacgaaggactccatcagcatgccgccgtagccgatgtagcgggcgtcgggctcgcggttgagcagcttcggcgtggtccccgaggagatcagcgcgtggaagccggacaccgcgccgcaggcgatggtgatgaacaggaacgggaacaggctgcctttccagaccgggccggtgccgtcggtgaactgggtcagggccggcatcttcagttccggcatgacgatcaggatgccgatcgccaggccgatgatggtgccgatcttgaggaaggtcgacaggtagtcgcgcggcgccagcagcagccacaccggcagtaccgaggcgacggcgccgtagccgatcagcatccaggtgatctggattccactgaaggtgaaatgcggcgcccattccggactggccgcgacctgcccgccgagccagatcgaaccgagcaggaggaacaccccgatgatcgagatctcgccgatccggccggggcggatgaagcgcatgtagacgcccatgaacagcgcgatgggaatggtcgcgaggacggtgaacatgccccaggggctgtcggccagagccttcaccacgatcagcgcgagcaccgcgaggatgatgatcatgatcaggaaggcgccgaacagcgcgatggtcccggccacctggcccatttcctcgcgcaccagctcgcccagcgagcggccgttgcgacggctggagatgaacaggaccatgaagtcctgcaccgcgccggcgaggactacgccggcgatcagccagagggtgccgggcaggtagcccatctgcgcggcaaggaccggaccgaccagcggaccggcgccggcgatggcggcgaagtggtggccgaagaggatgtgcttgttggtcgggacgtagtccaggccatcgttgttgagtaccgcgggagtggcgcggttggggtccagttgcatcaccttgctggcgatgaacaggctgtagtaacggtaggcgaccaggtagatggccaccgccgccaccacgatccacaaggcgttgatcgcttcgccacgacgcagggcgacgacgcccagggccgcggcgcccacgatcgccaccaccagccaggcgaggtgacgtag

SEQ ID NO: 14211 - DNA, 456 bp, Pseudomonas aeruginosa
tggccggacaaggagacttccatgcgcacactgctgttcctgcacctgctgggtgccgcgatctgggtcggcggccacctggtcctggccctcggcatcctccccggcgccctgcgccgccgcgatccccaggcgatccgcgccttcgagcaggtctacgagcggatcggcatccccgccctgctgctgcaggtggtcagcggcctgtggctggccagcctgtggctgccgttcgaccactggttcggcgccacgtcggtggcccgtgccctgcagctcaagctgctgctcctggcggcgaccgccgccctgggcgtgcatgcgcgcctgcgcctgatcccgaacctggacgccgagagcctgccgaagctgggctggcacatcgccgcgatcaccctggtgggcctgggtttcgtcgcggtcggacagagtttccgtttcggcggcgccttctga

SEQ ID NO: 14212 - DNA, 435 bp, Pseudomonas aeruginosa
cgaaatacagggagtgaacccatgggtcttctgagtgaattcaaagcctttgccgtcaagggcaatgtcgtggatatggctgtcggtatcatcatcggcgcggccttcggcaagatcgtctcgtccttcgtgggcgatgtgatcatgccgccgatcggactgctgatcggcggagtcgacttctccgacctggcgataacgttgaaggccgccgaaggcgacgtgccggcggtggtgctggcctatggcaagttcattcagaccgtactcgacttcgtcatcgtggccttcgccatcttcatgggggtcaaggcgatcaaccgcctcaagcgcgaagaagccgtcgcgccgtccgaaccgccagtgccgagtgccgaggaaaccctgctgaccgagatccgcgatctgctgaaagcccagcagaacaagtcgtga

SEQ ID NO: 14213 - DNA, 1404 bp, Pseudomonas aeruginosa
gcgcgccagacgatactgccgctgggcttgtacacgccgagccgggcgaattgcccggcgcggaaccggaatcccgcgtcacggctggtacgcagggtgaacaggttgggagtcagaggctgcacgtcgagcagcgtctggcgggtgaatttctcttcgctggcggtcatggtccgctccggataccgatactcccctagtgtcccgcaaagcacccggcagaaacacccgcaaggcttgtggctatccccgctgacgggaatagccagcggccgatcagcgcttgcggttgaccacctgggccgcgcgcaacacgtcactaccgatctgcgcctcgtagttcttccacagcggcttcatggcgttgcgccaggcctcgtgctcttccgcgctgaggctgaccaggcggctcttgccggctgccagcaggtgctcgcgctccttctggttgagcgcttcggcttccttgttcaccaccagggtgacctcgtcgacgatgctctccagttcggtgcgggtctggtagggaatgccggtccagaacgccgaactggtgatcagcatgtagctgagcgcgccgtgattggtctcggtgatgtacggctgcacgctgtcgatcttctgtccggcgaggttcgaccaggtgttctcggtgccctgcacgctgccggcctgcatggccttgagggtctcggcgtaggacaactgcttggcggtggcgccgagcatggcgaactgcgcttccagcaccgacgacggctggatacggaagaccaggcccttggcatcgtccggccggtgcagctcgcgagtggcggaaagctgcttcatgccgttgttccagtaggccaggccatagataccgtgcttggccatggagcgcagcagttcgcggctcttgtcgcgcttctggaaacgcttcagggcctccaggtcatcgaacaggaacggcaggtcgaacacctggagttgcttggtatagggctcgaacttggacagcgaggtggccagcatctgcaccttgttggcgcgcagggcctcgatctcgtcggcgtcgccgaacagcgtcgagttggggtagacctcgaccttgaccttgcccggcagacgctcctcggcaagcttcttgaacaacagcgcccccttgcccttgggcgtgtcgtcggagaccacatgggagaacttgatcacgatcgggccggcgtcctcggcatgggcgacggcggaaacggcgaacagtgcggcgagcgccacaccgacaaacggcttgaacatcgatgtacctgtgcgatggcaacgacgagccccgcgacggctcgcacgggtctcgttcgggaaacgggttgggtgacggtcaccgctcgaagtggcgaaggcgcccgtccaggcgctaccgggtcatga

SEQ ID NO: 14214 - DNA, 1158 bp, Pseudomonas aeruginosa
ttgacgagcgggattcgccccgccgggaacccgatgcctctattcgccacccccttcgcccagctcgacctggtccgccagcccgagcaggacggcgagcccctccaggcgttcgacgccgccgacgaatacctgctcaaccagttgcacgaacggggcgtgacggcgcaatgccgggtgctggtcctcaacgacgccttcggcgccctcgccgcgagcctggcgccgcacgtccaggtcaccagcagcggcgattcgcacctgggcttcctcgccctgcgcaagaacctcgcgcgcaacggcctcgacctgggctcggtgcgcttcgtcccggccagcgaaaccgccgtggggcccttcgatcacgtactggtcaaggtgccgaagaccctcgcgttgctggaggagcaactgatccgcctgcacggccaactggcaccgggcgcgcaggtcgtcgccgcggggatggtcaagcacttgccgcgcgccgccggcgacctgctggaacgctacatcggcccgatgcacgcttcgctggcggtgaagcaggcccgcctgctgatcgccgaggcagcggagcgcccgcaaccgcgctcgccctatccgacccgctatcgcctggagcagccgccgctgacgctgctcaaccacgccaacgtattctgccgggagggtctcgacatcggcacccgcgccttcctcccgcacctgccacgcagcctcggcgcgctacgcgccgccgacctgggctgcggcaacggggtgctcggcatcgcctacgcgctgctcaacccgcaggccgagctgaccctggtggatgagtcgtacatggccgtgcagtcggcgcgggaaaactggcgagcggcgctgggcgagcggccggcgacgttccgcgccgacgatggcctggccggccaggcggcgggctcgctggacctggtcctgtgcaacccgccgttccaccagcagcaggtggtcggcgacttcctcgcctggcgcatgtttctccaggctcgcgatgccctggcggcgggcggcgaactgtggatcgtcggcaaccgccacctgggctaccacgccaagctcaagcggctgttccgcggggtcgagcaggtcgcggcgaatccgaagttcgtgatcctgaaagcgggaaaatag

SEQ ID NO: 14215 - DNA, 1257 bp, Pseudomonas aeruginosa
ccacatgttactctccgccctcctctcgaaacgcccgaccccagcatgtccagccaacccagctccctgctccgccatcgtcccttcctcgccttctggctggcccgcgtctgcaccgccagcggcttccagatgctcaccgtggccatcggctggcacatctacgaactgaccggcaatgtcctcgacctgggcctggtaggcctggtcgaattcctcccgcgggtactgttcatgctccacaccgggcatgttgccgaccgctacgaccgacgcagaatcgccgccctctgccaggccggccaggccctggtggcggtggcacaggtgctcggcgcggcttcgggagagatcacccgcaacatgatcttcgtcctcgccttcgccctcggtaccgcccgcgccttcgaaatgccgaccacccaggcgctgctgccgaacctggtaccggccgggctgttcccgcgcgcggtggccgcttcggcttcggcgatgcaggcggcgaccattgccgccccggccctcggcggcctgctctatgcgttcggtgcctcctgggtctacgtgccgaccgcgactctctacgtcctcgcgtgcgtcctgacgctcagcctgccggtacgcaaccagccgctcacccagggcaaggccaccctcgactcgctgctcgccggcatccgtttcatccgcagccgaccggacatcttcggggcaatctccctcgacctgttcgccgtgctcctcggcggcgccaccgccctgctcccggtgttcgccaaggacatcctgctcaccgggccctggggcctcggcctgctgcgctcggctccagcggtgggcgccctggcgatgtcgttctggctggcgcacttcagcatcgaacgcaacgtcgggcggatcatgttcctctccgtgggcatcttcggcctggcaaccatcgccttcggcctgtcgaaatcgttctggctgtccctcggcgtgctggtggtactcggcgccgcggacatggtcagcatggtcatccgcggcgccttcgtgcagctcgaaacccccgacgagatgcgcggccgggtcagcgcggtgaacggcctgttcatcggcgcctcgaaccagctcggcgagttcgagtccgggctcaccgcacattggttcggcacggtaccggcagtggtcctcggcgggatcggcaccctggtggtcaccggagcatggatgaagctgttccctagcctggcgcaacgcgaccgcctgcactga

SEQ ID NO: 14216 - DNA, 1122 bp, Pseudomonas aeruginosa
tcaacgccggctgatacggcgctgcgggcaccgcgcacggatgaacggcgatcctcgccgacaatccatgcgggtatgccaggcccaagcctgttaagatttcccattttttccggagcccgcatggaccctcgcagtgaagtgctgctgcgccagcgccacctcttcgcgaccccgctgctgctggccggcctgcccgccgacgacctgctcgccgagctaccgcaggcccagggctggagctggcacgccggcgagcaggcgcagttggacgcccgcttccccgaccgtagccgtttcgacacgcgcgcgccgaccggcgcctggacttcggccgttctgttcctgcccaagtcccgcgaactgaccgactacctgctggccagcctggccgcccgcctgcccggcggcgaactcttcctggtcggcgaaaagcgcggcgggatcgagcgcgcgagcaagcagttggccgcctacggcaagccccgcaaactggatagcgcgcggcattgccagctctggcaggtgcgtatcgaacaggcgccggccgagcccgacctacacgccctggcccagcgctacagcctgccgctgaccgatggcgagctgcaggtggtgagcctgccgggggtgttcagccatggccgcctggatcgcggcagcgcgctgctgctggggcaactgcaagccctgcccggcggccatctgctggacttcggctgcggtgccggggtactcggggcggtcctcaagcgtcgctaccccgccagtcgcctgagcctgctcgacgtcgacgccttcgctgtcgagagcagccgactgaccctcgccgccaacggcctggacggcgaagtgatcgccgccgacggcatcgacggcgcgccgcgcgaactcgccgcgatcgtcagcaacccgcccttccaccagggcgtgcacaccgactaccaggcctccgagcgcctgctgcaacgcgccgccgagcacctggcgccgggcggcgaactgcgcctggtcgccaacagcttcctgaagtacccgccgttgatcgaacgccacctcggcccctgccggacactcgccgaaggcgacggtttccgcatctactccgcccgtcgctcctga

SEQ ID NO: 14217 - DNA, 678 bp, Pseudomonas aeruginosa
cctgaacgccagccagggccagcaattgcggcgggtgctcaagccgcgccacctgaacatgatcgccatcggcggctccatcggcaccgggctgttcgtcgcctccggggccaccgtggccaccgccgggcccggcggtgcgctgctttcctacgcactgatcgggctgatggtgtacttcctcatgaccagtctcggcgagatggcggcctacatgcccgtttccggctcgttctgcacctatggcagccggttcgtcgaagatggcttcggtttcgccctcggctggaactactggtacaactgggcggtgaccatcgccgcggagctggtggcagcgcaactggtgatgagtttctggttccccgaggtgccgggcatctactggagcgcgatcttcctgggcatcatgttcggcctcaacgtgatttccgcgcgcggcttcggcgagagcgaattctggttcgccctgatcaaggtagtcacggtggtgatcttcatcggcgtcggcctggcgaccatcttcggcatcatgcatggcgtggagtcgcccggcttcagcaacttcaccatgggcgacgcgcccttcgtcggcggcttccaggcgatggtcggggtggcgatgatcgccggcttctcgttccagggcaccgaactgatcggcatcgccgccggtga

SEQ ID NO: 14218 - DNA, 210 bp, Pseudomonas aeruginosa
atcggaaaatccgcggaagaacatcccgatcgccattcgccaggtgttctggcgcatcctgatgttctacatcctggcgatcttcgtgatcggcatgctgattccctacaccgacccgaacctgctgaagaacgatgccagcgacatcagcgtatcgcccttctccctgctcttctagcgcgccggcttccccccggcggccgggggtga

SEQ ID NO: 14219 - DNA, 216 bp, Pseudomonas aeruginosa
tcctctcggcgatcctctccgccggcaactccggcatgtacgcctcgacccggatgctctacaacctcgccctcgagggcaaggcaccgcgcctgttctcccgcgtctcgcgcagcggcgtgccacgcaacgcgctgtacgccactaccctggtcggcgccctgtgcttcctcacttcggccttcggcgacagcaccgtctacacatggctgctga

SEQ ID NO: 14220 - DNA, 654 bp, Pseudomonas aeruginosa
cacgcacgatctgacccggggcgggcagatggcgcgtgtcatggtgattggtcgacccgccccttaggaagcctgatggaatcgctgttcgtccctaccctcatcgttgccctcgcggaaatcggcgacaagacccagttgctggcactcctgctcgcggcgcgtttccgcaagccgtggccgatcatcgccggcatcgtcgccgccaccctggccaaccatttcgctgccggcgcggtgggcgcctgggtcgccagcttcttctcggaagccaccctcagttggatcctcgccgcctccttcatcgccgtcgccctgtggacgctggtaccggacaagctcgacgacgaagagtccggactgaagaaatacggccccttcctcaccaccctgatcgcgttcttcctcgccgagatgggcgacaagacccaggtcgccacggtcatgctggccgcccagtatccgcatttctggctggtggtgatcggcaccaccctgggcatgctgatcgcccacgtaccggtggtactgatcggcaacctggccgccgacaagctgccgctgaccctgatccgccgcctggccgcggccgccttcgccgcacttggcctgtacgccgcctggcacgccgcgcaattgaccggctggctctga

SEQ ID NO: 14221 - DNA, 2118 bp, Pseudomonas aeruginosa
ccagttccgcggcgcagtcggtgccgacctctcgctggccttcatccaggacctgctcaagcgcgccgaccagcagctctacgatggcgccggggaaatggcgctgatcgccagcaacggccgcctggtggcctacacccgcgacgacagcaagctcggcgagcccgccggcagcgtcctcgacggcaacgaagtggacaacctgaaaaacctcacggtcgaccagccgctctacgacatcgacgccgagcacggccacatcgagctgttcctgcctttcaccatcgccgacagcggcgtgcgctggaccctcatgctgcagattccccaggcggcggtattcggcgaactgcagcaactccagggcgagctgagcgaccagcgccagcaggatatcctcggcatgagcctggccggcctggtggtagcggccctcggcctgctggtggtctggctggtcggctacggcatcgcccggccgctgcgccaattggtcggcatgctcgacgacatcgcccagggcgaaggcgacctcacccgccgcctgagcagcgagcgcgccgacgagctgggctccatcgccaagggcttcaataccttccttggcaaactgcagaacatgatcggccaggtggtgcaatcggtgcagaaggtcagcgactcctcggagcacaccgccgacatcgccatccgcaccaaccagggcgtgcagcagcaactggcggagatcgaactggtggccaccgcggtccacgagatgaccgccaccgcccaggacgtggcgcgcaacgccacccacgccgccgaggcagccaaccacgcggaccaggccgcgcaccagggcaagcagatcgtcgaaagcagctcggcggcgatccaggccctggccagcgagatcggccgcgcggtcggagtggtgcagaacctggccaaggacagcgaaaacatcaacgcgatcctggtggcgatccgcggtatcgccgagcagaccaacctgctcgccctcaacgccgccatcgaggccgcccgcgccggcgagcagggtcgcggtttcgcggtggtggccgacgaggtacgcaacctggcgcagaagacccagcaggccaccgaagaaatccagagcatgatccagcagttgcagcagggcacccgcgacgtggtgaaggtcatgcaggacagccaggagcgcaccgacgacagcgtgcgccatgcgcgccaggcggccgaggcgctggaatcgatcacccaggcggtatcggtgatcaacgacatgaatccccagatcgccagcgccgccgaggagcagagcgcggtggccgaggacatcaaccgcaacgtcgccaacatcggccaggtcgccaaccaggtggccggcggcgccgacgaggcctcgcaggccagcgccgagctgacccgcctggccgagcagcagcggcgcctggtgaatcagttcagggtctagcgtcaggccggggtcaggcactccggcccgtcggtttcaggcttgttgacgaagccggccagggccacgctgcgcagtttcggctggggcttggcgagcaggcttatcagcgccggcagcggcgtgtccggagccagccaggtatcctgctcggcctcgtcgagcagcagcggccggcggaactcggcggccgcctgggatacctgggccacgctgagccaggtctgtccctgcaccggataggcctcccagatgccggcgaagaacaacaggcgctcgccggtggaaacccagtacggacgcttgcgcaccccgcgccattcatagaagccgttggccggcagcaggcagcggcgctgctggaacgcctcgcggaacatcggttgctcggcgagggtttccgcccgcgcgtggctgggcgtacgcgacaggtcggtgagccaggccggggtcagcccccagcgcgccaggtcggcgcggcgcgcaccggcgtcctcgcgaaccatcagcacctggttcgccggagaaatgttccagtgcgcccgccaatccgccggaaagcccggcagggccgccagcgacggattccagcggaacagggcgtaacgaccactcatgcttggcactgcctggtgagggaaagccgcacagtgtaa

SEQ ID NO: 14222 - DNA, 270 bp, Pseudomonas aeruginosa
tctgaaagtgcttttccggtcacagaaccccacccaggcaaacgacaacacaggagagtcgtcatgctggaaaccgcaccccacgaacataactatctgatcgaccacctggacgagatcgaggccgtgatcgtcgatctttccttcaatgtccaggacgaccgctggctggtgtactgcaccgcctgcggccatgaacacctcgacctgcctgagaccgacgaacgcatcagcatcggcgagccggacccgttccaccaggccgcctga

SEQ ID NO: 14223 - DNA, 1053 bp, Pseudomonas aeruginosa
cggctggcgggtcaccgtcaaggacacccgcaacggcggcgaccgcgagatccaggcacgcttcgtcttcctcggcgccggcggcggcgccctgccgctcctgcaactttccggcatcccggaaggcaagggcttcggtggtttcccggtgagcggccagtggctgcgctgcgacaacccggaaatcgtcaagcagcaccaggccaaggtctacagccaggccgaggtcggctcgccgccgatgtccgtgccgcacctggacacccgtgtggtggacggcaagaaatccctgctgttcggcccctatgccggtttctccaccaagttcctgcgccatggctcgttcctcgacctgccgctgtcggtacgcccgggcaacatcctgccgatgctctcggtggcccgcgacaacatggacctgacccgctacctgatcggccaggtcatgcagtcgccggaacagcgcctggaagccctgcgcaagttctaccccgaagccagggccgaggactggcgcctggaagtcgccggccagcgcgtgcagatcatcaagaaggatccgaagaaaggcggcatcctgcagttcggcaccgagctggtggccgcccacgacggctccatcgccgccctgctgggcgcctcgccgggcgcctcggtgaccgtctcgatcatgctcggcctgatcgagcgctgcttcccggagcaggcccgctcgccggagtggagcgccaagctgaaggaaatcttcccggctcgcgagaaagagctggaaagcgacgccgagctgtaccgcagcgtcagcagccgttgcagcgaggtgctggaactgaccgcgaagaacgacgtgcaggccccggtcaacgccgagtgagccgcgctacggaacaagccgccttcgggcggctttttcatttgtggagtcaggcgccggcctcgcaattgatcatccaggacaccccgaaacggtccaccagggtaccgaaacagggcgaccagaaggtcttgcccaactccagctcgacccgcccgccgtcctccagcaaggcgtcatag

SEQ ID NO: 14224 - DNA, 1035 bp, Pseudomonas aeruginosa
actgctgccgccggtggtgatcggcccggtgatcatctcgatcggcctggcgatggcgccgattgcggcgaacatggcgatgggcaaggccggcgacggcagcgagttgctgccgtaccgcaccgcgatgatgatctcgatgccggcgctgctcaccaccctggtggtggcggtattcggcaagggtatcttccgcctggtgccaatcatcgccggcgtgctggtcggcttcgccctgtcgttcgtcttcggcgtggtcgacaccgccgcgatcgtcgccgcaccctggctggaactgccgaaattcaccgcgccggaattcaactggcaggcgatcctgttcatcgtcccggtgggcctggccccggccatcgagcatatcggcggggtcatcgcggtgggcggcgtcaccggccaggactacctgaagaagcccggcctgcaccgcactctcctcggcgacggcctggccacctcggctgccggcctgttcggcggaccgcccaacaccacctacgcggaagtcaccggcgcagtgatgctgaccaagaactacaacccgaagatcatgacctgggcggcggtgatcgccatcaccctggccttcgtcggcaagttcggcgcgatcctgcaaagcatcccggtaccggtgatgggcggcatcctctgcctgctgttcggcaccatcgcctcggtcggcatgaacaccctgatccggcacaaggtcgatctctcggaagcgcgcaacctggtgatcgtctcggtgaccctggtgttcggcatcggcggcgtgctgatcggcagcggtaccggccccgacgacatcggcctgaagggcatcgccctgtgcgccatcgtcgccatcgtcctcaacctgttgctgccgggcaacgacggctggcagaacaaggcgctcgacgaacaacacaaggactcacactgaaaacaacggacggaacacttcgctgttccgtccattttccacccgccacgttattttcaaaagcatgtagccaatcgcttactactttgtaa

SEQ ID NO: 14225 - DNA, 549 bp, Pseudomonas aeruginosa
acgcactccggcagtcttgttgttctgtgcctgcgccagcctgctgggcaccgcccaggccgccggtacgctgatcggccaggtcggcgtgcagatggtcatcggtgccggctgcaccatcatcaacggcagcgtcagcggcggtatcaaccagtggggaaccctggacttcggcagccattccgaccttaccaacgtggtcgacgcgcagaccgtcggcaccagcggcaatatccagatccagtgcagcaccggcctgaccccgagcctgacggtgcaacgcaggcttgcacgccagcggcgggccacgctacatgcagaacaccaccaccaccagcagcaccatcgcctacaacatctattcggaagccgcgcgcaagcgcggctgatccaggccaacacaccgggtggacatttcctccggtctccaccgggcaccgcagtcaaaatcccccctatacggcggggtggtgcccaccgggcaaagcacgcccacgcggacggcggggacgtacacggacaccctgcttggtcaccatcgcctggtaa

SEQ ID NO: 14226 - DNA, 936 bp, Pseudomonas aeruginosa
cgtcggcagcggtggcgcgatcaccttcggcaccctcgacttcggccagtacgcctccctgaacaacgccatcagcgccaccagccagcaaggcgcaggctccatccgggtcaagtgcgtcagcggccagacctatgcgatcacgctcgacggcgggctctacggcagcgtcgccacgcggcgcatggcgaacatcgccaacaccgccctcaccctgacctacaacctgtacagcgaccgccccggcggcatcgtctgggacaacaccaccggcgttgccgccaccggcaacggcaacgaccagtggtatcccatctacggcctggtgccggcacagaccacgccggtcgccgggacctaccgcgacaccgtcaacgtgaccatcagttggtgatgccgatgtccagccggcgtctattcctgtcgcttctcctgctcccgctgccgaacctggtcgcgcatgccgatccatcgccgatcagccgcgccttccaggtccaggcggtggtcgccaacggctgcgccttcggcaccgccatcagcaacaacgcctatgacctcggcaccctgagcttcggcaccctcggcaacctggccagtccggttaacgtcgccagcagctccggggccggctccatcgtcctgacctgcactccgggaatgaccgtctccgtcgccctcgactacggggtcaatggcggcagcagcagccagcgctacctgaagcgggtgagcggcaacgagaccctcgcctaccagctctaccaggatgccgcctactcccaggtctggggcaacggggcactcgcgcggaccatcgccaactttcccgccagcacccagacctacacggtatacgcgcgcctgttcgcggtcggcagcctgccgtccgccggcaactaccgcgataccgtcaccgtcaccctttcgttctga

SEQ ID NO: 14227 - DNA, 807 bp, Pseudomonas aeruginosa
gccgtcatggaggatcacatgcccagtccacacctacctctccgccccggccgctggcttgcggcgctgctggcgctgttcctgggcggcccggcacaagccgccagtgcggtgctgatctggccgatcaacccggccatcgaagccgaccaaccggccaccgcgctgtggctggagaatcgcggcaagcaaccggtgaccctgcaggtgcgcgtgctcggctggtcccaggcggatttccaggacgtctatcgcaaccagcaggcagtgattcccagcccgcccttcgtcaaggtcgagccgggccgccggcagctggtccggctgatccgccagggcggccagcccagcacgccggaggacgcctatcgggtgctgatcgacgaagtgcccgacggcagcgcggggcagacgcaacgaagccccggtctcgccctgcagttccagatgcgctattcggtgccgctgttcgtcagcgccgacggcgtctggacccagccgcgcagcgatgtcgagcgcgacccggccgacgcgacccggccgaagctggcctggcggctggtcgaggaacagggcaagcgttacctgcaggtgcgcaacgagggtagcgtgcacgcccgcctgagccatgtccgctgggagggcaacggccgcagcctggcgctgctggacggcctgctcggctacgtgctgcccggccagcagatgcgctggccgctgccgccggggctgctgccggacgccggcatgaccctgaaactgcaactggcggacaacgacgcgccgatcagcgttcccggctactga

SEQ ID NO: 14228 - DNA, 2994 bp, Pseudomonas aeruginosa
cagcgccagccagcaactgcacctgcaagtgccgccggactggctgccggagcagcgcttcgacgatcccggactggtcgcccgcgccccggcgcgcagcagcctcggcgcgctgttcaactacgacctgtactactcggaccccgccgacggcgccacgccctggctttccgcgctgctcgagcaacgcctgttcgacggcttcggggtgatctccaacaccggcgtctacacccgctatttcggcgacgccgacaacctcgacagccgctacctgcgctacgacacctactggctgtacaacgacgaacgcaacatgcacagctaccaactgggcgactacgtcaacggcgcgctgaactggaccaccccggtacgcatgggcggctttcgcttcgcccgcaacttcggcgtacgtccggacctggtcacctatccgctgctgcgcttcgacggccaggccgccgtacccagcaccgtcgacctgttcatcaacggctacaaggccagcagcgccgacctgcaacccggtcccttcgccatcagcaacgtgccgtacatcaacggagccggcgaagccacggtggtgaccaccgacgcccagggtcgacaagtggtgaccagcctgccgttctacgtatccaacaccctgctggcgcgcggcctgagcgatttcgacctgtccgtcgggcgcctgcgcgacgactacggcctgcgcaacttctcctatgccgacaacgccgtcagcggcatctaccgctacggcgtcagcgaccgcctgaccctctccacccacgccgaggccgccagcgacctgcgcctgctcggcatcggcggcgacatcgccgtggccaccttcggcaccctcagcctggcggccagcggcagcgacggccagggcgacagcggccagcaatacctgctcggctactcctactattcgcgacggctcggcctcagcctgcaacacatcgagcgcagcgccggctatggcgacctcggcaccctggacggcgagtaccagttgagccggcgcaccgaccaggctaccgccagcctgaccttcgacgagcagggcaccatcggtaccggctacttcgacatccgcgcccgcgacggcagccgcacgcgcctggccaacctctcctacagccgcccgatcggcagccgcagcagcttctacctggcgctgaacaaggatctcgacggcgacggctacagcgcgctgatgcaactggtgattcccttcgacatcaacggcctgctgaacatcggcgtcacccgcgacagcgaccgacggtacagcgagcgggtgatctggagccgctccacgccgagccagggcggcctcggctggaacctcggctatggcggcggcgccagccgctaccagcaggccgacctgacctggcgcatgcagaacgtgcaactgcagggcggcctttatggcgagaccggcaactacacgcgctgggccgatctcagcggctcgctggtatggatggacaacgccgtgttcgccagcaaccggatcaacgacgccttcgtcctggtcagcaccaagggttatccacaggtgccgatccgctacgagaaccaactgatgggcagcaccgacgacaacggccacctgctggtgccctgggtcgcggcctactacccggcgaagttccagatcgagccgctggaccttccggccaacgtcagcgcgcccgaagtcgagcagcgcgtggcggtacgccagggcagcggcctgctgctggatttcccgatccgtgccgtagtcgccgccagcatcagcctggtggacgagcgcggcgaaccgctgccgctgggcagccaggccgaagaaaccggcagcggccagcgcgccagcgtcggctgggacggccaggtctatttcgaaggattgcaaagcgacaaccagctacgcgtggtccgccccgacggccgggcctgccaggcacgcttccgcctggacacgcgcaaacccaccgtcagccaggtcggcccgctgacctgctcggccccgatcggagatacgccatgagccgccactccacgtccgcctgcctgctcggcttcgctacgctctgcgccagcccgttgctgctcgccgcctgcaccaccagctccggcaccggcaatttcggcagcctgagctcgttcaccgtggccagcaccgcccagaccatcaccggcaccaccggcttcaagtgcaccggcagcctgttgtcgatcctcagcaccaacaccatcgacgcgaccatcgccagcaccgccaatccgctgggcaccacgccgcggctgtacaacgccgccagcggcacctacctgccctacagtatctgcaaggacaacggctgcggcaccgtctacaacgtcggctcgacggtacgctggagcagcaccaccttcctcggcatcctcggcctgttcaacgccaccgacggcagcctgccgctgtacctgcgcaccgccaccggggtgaccctgccggccggcacctataccgataccatcggcctgaactgggcctggcacctgtgcgcggcgggcatcggcccagtctgcgtatacgacgacggcaccgccagcagcagcgtcaacgttaccctgacggtgctcaaggactgcttcatcgacagcgctccggacctcagcttcggcagcgccgcgctggtctcggccttcaccgcggtgaaccagaacattggcgtgcgctgcaccctgaacgccacctataccatcggcttcgacaacggcaacaacttcagcggcggctggcggcgaatgctcagcggcgccaacgcgatccagtacaacctctacaaaccgggagactcgacggtctggaccaccagcaacacccaggcaggcaccggtagcggcgccgcgcagaacgtgccgtaccgggccatcgtcaacccggcccagggcaacgtccccgccggtacctacagcgataccgtgcgggtgatcctcacctactga

SEQ ID NO: 14229 - DNA, 1023 bp, Pseudomonas aeruginosa
ttcgcctgtccagacgctacacaaccagagaggcatgtcatgagcgtccccatcgccatcatcggtactggcatcgccgggctttccgccgcccacgcattgagatccgccggccagaccgtacaactgttcgacaagggccacggcagcggcggccgcatggccagcaagcgcagcgaggccggcacgctggacctcggcgcgcaatacttcaccgcccgcgaccggcgcttcctcgacgccttgcaacactggcgcgaggaaggctgggtggacgagtggaaacccgctctctaccaataccgcgacggccagctgagcccctccccggacgagcagccacgctgggtcggcatcccgcggatgagtgcgatcacccgcgccctgctcaccgatctgcaagtggtcttctcctgccgcatcaccgaggtcttccgcggcaagcagcactggcacctgcaggactccgagggacagaaccacggtccgttcaaccaggtcctgatcgccatccccgctccccaggccacgccgctgctggccagcgtgccgaaactggcggccaccgccgcgagcgtggtcatggagccgacctgggcggtggcgctgggcttccgcgaggtactcgacaccccggtgcagggctgcttcgtgcacggcagtccgatcgcctggctggcctgcaatcgcagcaagccggggcgcgacaccaccctcgacacctgggtgctgcacgccaccagccagtggagccggcagcacatcgacatggccaaggaggacgtggtcgagcacctgcgctgcgccttcgccgaagtgatcggctgcgccgtaccggaagccgccttcagcatcgcccaccgctggctctatgcacgcccggcggaggcccaccagtggggcgccctcggcgatcccgacctgggcatctacgcctgcggcgactggtgctccagcggccgcgtcgaaggcgcctggctcagcggccaggaagccgcgcggcgcctgctggaacatctctga

SEQ ID NO: 14230 - DNA, 666 bp, Pseudomonas aeruginosa
cgccccgactcggcatcagcgcctgcctgctcggcgaaccggtgcgcttcaacggcggccacaagcgatccgcgctttgcgaggaactggcgcgacacgtcgagttcgtctccttctgcccggaacaggccatcggcctgggcacgccgcgcccggcgattcgcctggaaggcactccggaagccgccgaggcgcggagccgcgacggcctggcggtcggcggagcgctcgccgaatatgcgcggcgggtggcgcaacgggcggatacgctggacggtttcatcttcatgcaacgctcgccgtcctgcgggctgcaacgggtcaaggtctatccagaaggcggcggcgcgccgcgcgccgaaggccgtggacgcttcgccgcagccctttgcgaagccttgccggagctaccggtggaagaagaaggccggctgcacgatccggtcctgcgggagaacttcctcacccgcgtgtatgcccatgcccactggcaggccctgcgccagcgcggcctcagccattcggccatcgtcgccttccatagccgctacaagtaccagttgctggcccattcgccggagcactaccgcagcctcggccgcctgctcggcgaagccggccactaccagccggaagccctcggcactcgctacttcggcgagctga

SEQ ID NO: 14231 - DNA, 372 bp, Pseudomonas aeruginosa
agacctgtacgtcgctggcgaagcggtcgagcaaggcggcgaaacgcgcgctcttcagagttccggtggtggccaggacgccgacccgaccgttgcgggtggccgccgcggccggcttcaccgcaggctccatggccaccagcggcacctgcggataacgttcgcgcaattccgccgcagccgcagccgtcgcggtattgcaggccagtaccagagccttggcgccctgctccagaaggaaatcaccgatccgctcgcagcgttcgcggatgtactccgcgctcttctcgccgtagggcacatgggcgttgtcggcgacgtagagcaacgattcggatggcaggcgcgcgcgaatctcacgcaatacgctga

SEQ ID NO: 14232 - DNA, 486 bp, Pseudomonas aeruginosa
caggggctttcgtcgcggcgggtatcgaataccgaaagctggccctcgagacggatcgccgcgccgctgaccaggggcttgccggcgcgcacgcaggcgacgttgaccgcctcgcgggtggcgaagttgtcggtgcagtcgagcaccaggtcgaccgccgccacggcggcatcgagggagtccttgtccagcgcggcgctatggctgaccaggcggatctgcggattcagcgcgcccagccggcgcatcgccgactccaccttgccgacaccgacgctggtgccatcgtggatgacctgccgttgcaggttggtcaggtcgaccgtatcgaaatccgccaggtgcagctcgccgaccccggccgcggccaggtacagcgccaccggcgaacccaggccgccaagaccgacgatcagtgcgcggctgcgcttcaggcgcagctggccctcgacgtcgacctgcgccagcaggatctggcgactgtag

SEQ ID NO: 14233 - DNA, 1167 bp, Pseudomonas aeruginosa
ccccatagacagcttcgtcgacgcccgtcccggcccccttgggcttgccggacggcttatgtcatgatggcgccaccctcgcaggttcaaggccggctttcttcctctatgaacaaatcccttgcgctgctgaccgtcacgctgctgctcggcggctgccagtcacttatccacaagactcccgatggcaccccgccggtggaagacaccgcggtcgagaccaaggccaagccggaaaagtacggctccttcagcgaggacagcctgtattcgctgctggtggccgaactggccgggcagcgcaaccgcttcgacatcgccctgagcaactatgtggtgcaggcgcagaaaacccgcgaccccggggtttccgagcgcgccttccgcatcgccgaatacctcggcgccgaccaggaagccctcgacacctccctgctctgggcgcgcagcgcgccggacaacctcgatgcccaacgcgccgccgcgatccagttggcccgcgccgggcgctacgaggagtccatggtgtacatggagaaggtcctcaacggccagggcgacacgcacttcgacttcctcgccctgtctgccgcggagaccgacccggatacccgcgccggcctgctgcagagcttcgaccacctgttgaagaaatacccgaacaacggccagttgctgttcggcaaggccctgctgctgcaacaggacggccgcccggacgaagccctgaccctgctcgaggacaactccgcaagccgccacgaagtggcccccctgctgctccgctcgcgcctgttgcataaccatgaagcgcagcgacgatgccctgccgctgctcaaggccgggatcaaggaacacccggacgacaagcgcgtgcgcctcgcctacgcgcgcctgctggtggagcagaaccgcctggacgacgccaaggccgagttcgccggactggtccagcaattccccgacgacgacgacctgcgtttctccctggcgctggtctgcctggaagcccaggcctgggacgaagccaggatctacctggaagaactggtcgagcgcgacagccacgtcgacgccgcccacttcaacctcggccgcctcgccgaggaacagaaggacaccgcgcgtgccctcgacgagtacgcccaggtcggcccgggcaatga

SEQ ID NO: 14234 - DNA, 738 bp, Pseudomonas aeruginosa
cttcctcccggcgcaactgcgccagaccgacgtcctgctcaaggccggtcgcgtcgacgaagccgcccagcgcctggacaaggcgcgcagcgagcaacccgactacggcatccagctgtacctgatcgaagccgaggcgctgtccaacaacgaccagcaggaaaaggcctggcaggccatccaggagggtctgaagcagtacccggaggacctcaacctgctctacacccgctcgatgctggcggagaagcgcaacgacctggcgcagatggaaaaggacctgcgcttcgtcatcgcccgcgagccggacaacgccatggccctcaacgccctcggctacaccctggccgaccgcactacccgctacaccgaggcccgcgagctgatcctcaaggcgcacaagctgaacccggacgacccggcgatcctcgacagcatgggctggatcaactatcgccagggcaagctggccgacgccgagcgctacctgcgccaggcgctgcagcgctaccccgaccacgaggtcgccgcgcacctgggcgaagtcctctgggcccaggggcgccagggcgacgcccgggccatctggcgcgaatacctcgacaagcagcccgacagcgacgtgctgcgccgcaccatcaagcgcctgaccggcgccgagactccttgaaaccatgcgtctacgtcttttcctcgccgcctccgcgctggccctgctcagcggctgcgccggcctga

SEQ ID NO: 14235 - DNA, 885 bp, Pseudomonas aeruginosa
tcaaggactggcagccgcgccagctcggccgctgacatgagcgtgcgcctcagcctgccagccccggccaagctcaatctgttcctgcatatcctcggccgccgcgacgatggctatcacgagttgcagacactgttccaattcctcgaccacggcgacgagctgcatttcgaagcccgccaggacggccaggtacgcctgcacacggaaatcgccggggtgccgcacgacagcaacctgatcgtgcgcgccgcgcgcgggctgcaggaagcctccggcagcccgcaaggcgtcgacatctggctggacaagcgcttgcccatggggggcggcatcggcggcggcagctccgacgccgccacgacgctcctggccttgaaccatctctggcaactcggctgggacgaggaccgcatcgccgccctgggcctgcgcctgggcgccgacgtgccggtcttcacccgcggacgcgcggctttcgccgagggcgtgggcgaaaagctcaccccggtggacatcccggagccctggtatctcgtcgtggttccgcaagtacttgtcagcacagcagaaattttttcagatccactgttgacacgcgattctcccgccattaaagtgcgcaccgttctcgagggggacagccgaaacgactgtcagccggtagtcgagaggcgttacccagaagttcgtaacgctttgatcttgctaaacaaatttgtttcagctagattaaccggcactggaggttgtgtgtttgggagcttcccaaacaaagctgaagctgataaagtctcggcccttcttccagaccaccttcagaggttcgtcgccaaaggaagcaacatctcgatgttgcaccggaagctggaaactctggtctga

SEQ ID NO: 14236 - DNA, 705 bp, Pseudomonas aeruginosa
acgaaaacgccccgctccggcggggcctttgaaatcgcccgaacgctggtcgcaagcgttcgggcgcattgttatttttggagatacacaatggtcgactttattctgaatgcccaagtgcgttccgatctggggaaaggtgcgagccgccgcctgcgtcgtaacgccggtctggttcctgctgtcgtttacggcggcgacaaagagccccagtccgtaaccctggaactgcgcgaaatcgccaagctcctggaaaacgaggctgccttcagccacgtgatcgccctgaacgttggcggcgccaaggaaaccgtactgatcaaggccctgcagcgccatccggcgaaaggcttcgtgatgcacgccgacttcctgcgcgtggtcgccgaccacaagctgaccgcccacgtaccgctgcacttcatcaacgaagaagtagccgttggcgtcaagcaagccggtggcgagatctcccacaccatctccgaagtcgaagtttcctgcctgccgaaagacctgccggaattcatcgaagtcgacatggccaaggtcgagctgggccagatcgttcacctgtcggacctcaaggctccgaaaggcgtcgagctggtacaactggcccacggcaacgacctggccgttgccaacatccacgcttcccgcgtggtgaaggaagaaggtagcgaagaaggcgccgccgagtaa

SEQ ID NO: 14237 - DNA, 1128 bp, Pseudomonas aeruginosa
cgcctgtctgagcgcgagggacatagcatgggattcaactgcggcatcgtcggcctgcccaacgtcggcaagtccaccctgttcaacgccctgaccaaatccggtatcgcggcggaaaacttcccgttctgcaccatcgagccgaacagcggcatcgtgccgatgcccgacgcgcgcctgaacgccctggccgagatcgtcaagcccgagcgcgtactgccgaccaccatggaattcgtcgacatcgccggcctggtggcgggcgcctccaagggtgagggcctgggcaacaagttcctcgccaacatccgcgagaccgacgccatcgcccacgtggtgcgctgcttcgaagacgacaacgtgatccacgtgtccaacagcgtcgaccccaagcgcgacatcgagatcatcgacctcgaactgatcttcgccgacctcgacagctgcgagaagcaactgcagaaagtcgcccgcaacgccaagggcggcgacaaggaagccctggcccagaaggccctgctggaaaagctcatcccccacttcaccgagggcaagccggcgcgttcgctgctgaagaacctcggtgacgaggagaagcgcctggtgcgcagcttccacctgctgaccagcaagccggtgatgtacatcgccaacgtcgccgaggacggcttcgagaacaacccgcacctggatgtggtgaaggccatcgccgaggaagaaggcgcggtggtggtgccggtgtgcaacaagatcgaagccgagatcgccgagctggaagacggcgaagagaaggacatgttcctcgagtccctcggtctcgaggaacccggcctgaaccgtgtgatccgtgccggctacggcctgctcaacctgcagacctacttcaccgccggggtgaaggaagtccgcgcctggaccgtccgcgtcggcgccaccgccccgcaggccgccggcgtgatccacaccgacttcgagaaaggcttcatccgcgccgaagtggtcgcctacgacgacttcatccagttcaagggcgaacagggcgccaaggaagccggcaaatggcgcctggaaggcaaggactacatcgtcaaggacggcgacgtgatgcatttccgcttcaacgtgtaa

SEQ ID NO: 14238 - DNA, 2271 bp, Pseudomonas aeruginosa
ctttgccgcccatcaaaacaacagcaactcggaaatctcctcatgccccgctccatccctttgcgcccggctcccctggcgctttccctgtccctcttcgcttcgttttccgctcctgcgctggctgccgatccggtggagcagcagatggtggtgatcggctcgcgcgcgccgaccaggatcagcgagttgcccggcacggtctgggtgatcgagcgcgagcaactggaccagcagacccaggccggcgtgccgctgaaggaggcgttgggacaattgatcccgggcctggatatcggctcccagggtcgtaccaacaacggccagaacctgcgcggacgcagcgtactggtgatgatcgacggggtgtcgctgaacagttcacggggcatcagccggcagttcgactccatcgacccattcaacatcgagcgcatcgaggtgatgtccggcgccagcgcggtgtacggcggcggcgccaccggcgggatcatcaacatcgtgaccaagaagggcgtcggcggcgacactcgcttcaacaccgagctgggcgcccgcagcggcttccagagccatgaggaccacgacctgcgcgcggcgcagtcgatcagcggcggcaacgacctgttcaacggccgcctggccatcgcctaccagaagaacggcgcggcctacgacggcagtggcgaccaggtactgacggacatcacccagaccgacctgcagtacaacaggtcggtggacctgatgggcagccttggcttcactttcgccaatggccacagcctcgatctcggcctgcagtactacgactccggctacgacggcgaccgcggcctcgatcttgggcgcaacttcgacgccctgcgcggacgggcaccctattcgatcaagggcggcgtcgacctcgaccgcgagccggagagcaagcgccatcagttcaacgccacctaccacgcgccggaagtgctgggtcacgacctctacctgcaggcctactaccgcaacgagaagatggccttcaatcccttccctaccatccgctacagcaataccggcgcgatcaactacggcacctcctactactcggcctcgcagcaggacaccgactactacgggatgaaactggccctggtgaagacctgggagcgcgccagcctgacctacggggtggacctggaccgggaaaaattcacgtccgaccagatgctcttcaacctgccgctcgccgccgccagcggcgggctggtagccagtgaacaggccaagctgggccgctacccggacatcgataccgacagccgcgccttcttcctccagggcagttggaaggccaccgacgacctgaccctgagcgccggcgtgcggcgccagtcgatgagcaccgacgtcagcgacttcgttgcggcgaaccagcagatcctcatcgccaacggcctcggcaagaccgccgacgcggttccgggcgggagcaaggactacgacgtcaacctggtcaacgtcggcgccatctacaagctgaacctgcaacaacaggtctgggccaactacagcgaaggcttcgagctgccggatccggccaagtactacggtttcggacgctacggcgcagccgacggcaatggccactacccgctgttgcagggggtcagcgtgaacgactcgccgctggacgggatcaagaccaagcaggtcgagctgggctggcggcacaccgacggtgccctggatacccaggtggcggcgttctattcctggtcggacaagagcatcaagtacgactcgaagaccctggcggtgctgcagcaggacaccaagaagcgcaactacggcctggagggccaggctacctactggctggacgatcactggcaggtcggcgtcaacggcctggccatccgctcccaggaaaaggtcgacggccgctggctgaagcaggacgtgacctcggccagcccgtccaaggccggcgccttcgtcggctggaaggacgaccagcgcagcctgcgcctgcagggcgtgcgcaccttcaacctgaacgacgagccgggcaacaagatcgacggctacgcgctgttcgacctgctcggcacccaggcgctgccggtgggcaccctcaccgcgggcatccagaacctgctggacaaggactacaccacggtctggggacaacgcgcgcaggtctactacggcgggctcgcaccagcgggactgttcgactacaagggacgggggcggacctacagcctgacgtatagcgtggagttctga

SEQ ID NO: 14239 - DNA, 735 bp, Pseudomonas aeruginosa
agccgtcctcgacagttcccctgtccctccagggagaggggaactcgtgggaaagagcttccgcctctctcagcagcaaccgcccagcggactcaagcgatactgcggcggcaactggtcgaggccgctgacggtgacgttgaggttcttccacaggccatccttgatcccgtagatgcagccatgcacggacagcgactggccgcggtgccaggcgttctggacgatgctggtgtggctgacgttggccacctgctggatcacgttgagctcacagaggcgatcgacgcgctcttcctcggtcggcaactgctccaggtgctcgcggtattcgtaggcgaggtcgcgaatgctgcgcagccagccgtcgatcaggccgagctggtcgttgtgcagggaggcgcgcacgccgccgcagccgtagtggccggtgaccaggatgtgcttgaccttgagcacgtcgacggcgaactggatcaccgacaggcagttgaggtcggtgtgcagcacgacgttggcgacgttgcgatggacgaacaggtcgccgggcagcatgccgacgatttcgttggccggcacccgcgcgtcggagcagccgatccagaggtactcgggggtctgctggcgggccagcttggcgaagaagtccgggtcttcctgcttgatcgcttcggcccagcggacgttgttctcgaacagttgctgcaagtcgctcatggcatgcccctcgtttga

SEQ ID NO: 14240 - DNA, 576 bp, Pseudomonas aeruginosa
ccagatgccatccgccgataccgggcccgtacctgcgccgcagacgtgtcgacggcctgcatcgcactcatcggcggcgtctgcgtcgcccgtgcctttgcagtacaatcggcgctttttccacggaccggccctcccgatgatcgacccccgacgcgtactgcgtgcgcttgccgaacactgggccctgctcgagcctctctgcgagcgcttcgatgccggcaccctgagcctggcggaactgcgcagccagttgaacacccagttaccggaaagcaacccggcggaaatcaccgccctgctcgaccagtggatccgcctggatatcctggtcccggtggccaagagccccaaccgtttcgagctgaacgcgcagatccacgacttcctcgcctacctgcgccacgagcatcgccttggtctgtgcctggagatcgaggcctacctgcgccatctggagcgcctcgccgggtacatccaggacgccttcgagacccgcgacagccaggacctggcgcgccagctgcgactgctcgacatgcgcgtgcgcgatgtactgaagaagctcggcaatga

SEQ ID NO: 14241 - DNA, 591 bp, Pseudomonas aeruginosa
cgagcaggcactgatcggcgtggccgagcgggccaagaccagcgaccggcagattcccctggcgcagcgctacgcggaggtcctggcgacctgggacgagtacgtcgagccgatgatccagctggtcagcgccgacggcgccttcgagcagggcgtgcggcgggtcgaacaggtcctgctgcgcctgctaggcgaacagcagcgcctcggccacctggtcgacgacgacctggtgctgcgcacccacgcgcgcatcctcgagatgcagaccaacgcccagctgaccctgcgccgcgcccgcgaattattgctgccgctgcgcgaggaagcgcgccggcacaacgcggtgacccgtggcgccgccctggcgctggcggcgatccggcgcaagggcctggatgccgtgccgcaggcggcgatgccgctgttcacccggccgcagagcaccttcctcggcaccgcctcgcaggtcgagagctacgtcttcgccctcgcccgcttcgagccgaagccggcgcagttccccaagtccagcggcacgcgcaagagccaacgggccggcgcgaccaccacggaccgcgcgggaaatga

SEQ ID NO: 14242 - DNA, 759 bp, Pseudomonas aeruginosa
cccccgccgccaaggacaagggccaggccagggacgcagacaccctttccgcgagcgaaacccatgcatcttgatctctccgaactgacccagctcgcgccgatcttccgcgagctgttcaagggctaccacatcagccaccgcgaccccgagctgtacacccagctgtcctcgcaccaggaccagtaccgcggcctgttccgcgccatgggcttcgagctggtctgcgacacccgcggcttctactacttcgtcccggagcaggtcggcgcccaggtgaacaagaccgcccaacgcctggcgctgttcaccttcatcctcgtcgaacacctcgccgaccagggccgcgacccgctgtccgtgctggacggcggcagcatcggccgcgaagagctgccgccgctgctggagaaataccgcgacctgttcctccaggccgaggtgcagacccaggaagaactggaagagaaggtcatgcgccgcctgacccagctcggcttcgcctccgaggacagcggcgtgtaccgcttcatgccgccgatgcaccgtttcctagacgtctgcctgtcggtgcagcaggaccgcaacctgtccgccagcctgcacgccgacctgccgttgcagacgccggtgctggtcgatgacggcgagatcgaaccgctgatggccagcgacgaagaattgtccgaagagagcgaggaagacgccctcgcccgcgccatcgccgaagaacacgcgcaacaggaggctgacgcatga

SEQ ID NO: 14243 - DNA, 1824 bp, Pseudomonas aeruginosa
attgatcggcgccgcctccacgcccgtgcgcctgcgcacgggctcgcgccggcgaacgccattctggctgttcctgccggtcctgctcctcgccctgctggccagcctgccgctgctctacgtcgcggccaaggcctgggacgccggctggcacatcgcctggcaactgctctggcgcccctacgtattccgcttgctgggcaacaccctgtggctgatgttcggcgtgaccctgctcagcgccctgctcggcctggccctggcctggtgcgtcgagcgcagcgacctgccggcacggcgcttctggaacgtggtgctgtgcctgccgttcgccatccccgccttcgtcagcagtttcacctgggtttcgctgagcccgatgtacgaaggcctcggcggcgccatcctggtcatgaccatgtccaagtatccgctggtctacctgccggtagcagcgaccctgcgcggcatcgatccttccctggaggagtcggcgcggatgctcggtctgtcgcggcgccaggtgttcctgcgggtcaccctgccgctgctgcgcccgaccctggccgccaccggactactggtggcgctgcacatgctggtggagttcggcgcgctgtcgatcctgcgctaccagaccttcaccacagccatctaccaggagttcgaactggagttcagcaacgccaccgcggcgatgctctcctcggtactcctggcactgtgcttcctgctgctctggctggagttgcgcatgcgcggccgcggccgcctggtacgcaccggccagggcagcgcgcggcgggccgaacgagtccgcctggggttcggcaagtggccgctccaggcgctgctggcgacgctggtgctggtcggtaccggtatccccctggtgatgctcggttattggctgtacgaaggctcctcggccagcttcccgctgatggaaatcgcctcgaccctgctttcctccctgtcgctggccttcggcggggccctgctcagttgcctgctggcgctgcccgtaagcatcctggtggtgcgctaccccggcgccctggcgcgctggacccagcgcctgccgtacctgctgcaagcgttgccgggactggtgatcgcactctcgctggtgtacttctcgctgcactacctgccagccacctaccagaccaccggcttgctgctggtcgcctatgccctgctgttcatgccgctgacccaggcaccgatccgcgtggccctggaaaaggcctcgccgcagttggaggaagccgcccgcactctcggccagacgcccttgatggccttcctgcggatcaccctgccgatcatctcgccggccatcggcgccggcttcgtgctggtgttcctcgacaccatgaaggaactgaccgccaccttggtgctaggtcccaccgggctgtcgaccctggccacctcggtctgggtgcacaccgccaacctggagtacgctgccgccgcaccctacgccgcgctgctgatcctgatctccggcttgccggtgtacctgctgaccacccgggcgcatctcagcactcactgacacccacttcccagcaggcaggcatgaacgaaaacgccgcttacccaggtaagcggcgtttctttttgccggtccgacaatcagcggcgggcggtttccttcagaggaatcttcggcgcccactccaaccattcgtcattggccgaatcgaacagggcgaaggtctgccccggcttggcgggctcgcccatctgcgcattgttcggggtggcgaaggcaatgccgccctccatcagcgcctccatcgactcggtgcgtag

SEQ ID NO: 14244 - DNA, 1560 bp, Pseudomonas aeruginosa
cgacagacccttgaacaggctggcgtcgacgccgaagccgctggcattccagaaacggctgccggtacgcaccagcggtacgtagcgcggttcgatgaggatgctgatcagcacccggtcggcctgttcgcccaaggccaggtcgacgaccttgcccaccgggatctgccggtaggtcaccaggttgcccggcttgatcgagcccttgcgcggcgcactgagggtcagccgcaggccgttttcccgacccagcaggttgggtgcttcggcgagagtctggaagcgtgcctggcgctcgcccggcgtgctcgacggcagcgcctcgatataggggccgctgaccagggttccgaggttctcggtacgcagcaggccgagcgccggacgcaccacccagaagcgggttccgctgcgggcgacgcgctcgccggcggaagtcaggcgggccttcatcagtaccccggagaggtccgggttcagctcgacgctttcgatcttgccgatgtccaggcccttgaagcggatcggcgtgccttcgcgcaggccgtcggcattgtcgatgctcagctggatttccacgccacgggccatcgccgcctcctcgctgtcgaagagggtgaagcgacgcaccttggtcacggtcggcgccttcggatcgagggtgtcgaaggaaatcccgccggtgatcagggtctgcagcgactcgctcttcacctgcacgccgctgaggttgccggtcagggtgatcccgctggagttccagaagcgcgtcgaggtattcaccaggtgcgcgtactccggctcgatgtgcacacccaccaccactcgctggcggtcgcgcgacagctggtagctctgcacgctgccgacgcggacctggcggtagaggatcggcgcgccgatatcgatcgagccgagcttgtcgctggtcagcaccaggtgcaggccgggcgcgtcggtgttcagcggcggcgctttcgggcggatggtgaactcgcgactcggcgcgccgctcttggcgaagcgcacgtcgatatagttacctttcaccagggcctcgaggccggtgatgccggccagggagatgcttggcttgacggtccagaattcggtgccttccagcagcatgtcctcgacccgcggatccatcgccaggtcggcagtggcgctgctgtagtccttgcccatgtcgatcgacttgaccaggccgacctgcacgccgttgaacatcaccggggtgcggcccggatcgataccactgacgtcgttcatcttcagcttcacgcgcagaccggcctgggccgcgtcgtagtcgtcgtacaggcggaacggcttgctcggatcggtcggcgggctgtcggtgcggttctccggggtggagaaggcgataccgccggcgaccagggtcagcagcgactcgctgtgcaccttgaagccggacaggccgccggaaatggagatgccgctggcgttccagaatcgcgtgtgcttgcgcaccaggtcggcgtaggccggctcgatgtgcaccttgatctcgatggtcctctggtcatcgcctaa

SEQ ID NO: 14245 - DNA, 636 bp, Pseudomonas aeruginosa
ctggaagctcttcacctggccgacctggatctgccggtagaacaccgggctgccctgctccagggagcccaggcgatcggccttgagggtcaggtgcaggccgggcagcttgtcggaaaggggtggcggctccttcaacgcggtgaagtagcgttcttccttctcgcccttcaccggatcgaccgcgatgtagacgccggagaccagggtttccaggccggtgacgccagccagggaaacccgcggcttgaccagccagaagcgggtgtccttgctcaggtactcctgggcttccttcttgatctcgatggtcgcgaccacgcccttgatgtccttgctgacatgcaggtcggtcaccttgcccaccgagatgcccttgtacagcacctcggtcttgttggcctggatcccgtcgccgctctcgaagcgaacctggatgtccacgccagcctggtcgaaggcacgccacgccagccaggcaccgatggccagggccaccagcggcagcacccagatcgccgaccagttcgaggtcttgtgtttcttcggacttggcagatcactcattctcgtcatccagattggtgttgtcccagatcagccgggggtcgaacgtcacggcggcgagcatggtga

SEQ ID NO: 14246 - DNA, 234 bp, Pseudomonas aeruginosa
acgagcgcacagtgcaaatcgcgtctcccatgccctcggaagtacgccgcccggcagctctcgaagtttttcgattaccgtccgcagcgctgctggcttgccacttttccgcgcgcaaaagcaaaacccccggtcatcgctgaccaggggttttgggataggagcttgacgatgacctactctcacatggggagaccccacactaccatcggcgatgcgtcgtttcacttctga

SEQ ID NO: 14247 - DNA, 312 bp, Pseudomonas aeruginosa; identical to SEQ ID NO: 4717

SEQ ID NO: 14248 - DNA, 270 bp, Pseudomonas aeruginosa
gccgttgacgggcgctgtcgctgcctttataaaaccgcctcacgcagccggcaggcagccctcgaccgcgtactgtcgtggggctactacgtggttcctaactactacgtcgatacctggcgggtcgcctactggaaccgtttcggccggccgaaggtgacgccactctacgactggggcctgatgacctggtggcagaccagcgacaaggcgctgccgagcaaggcgcaagccgaagccacgcaagacgccgagccggaacgggagtaa

SEQ ID NO: 14249 - DNA, 861 bp, Pseudomonas aeruginosa
  unsure (762): Identity of nucleotide at the above locations are unknown.
cgccgcatgctctcctatatcctgcggcgcctgctgctgatcgtccctaccctgttcggcatcctgctgatcaacttcatcatcatccaggccgctcccggcggtccggtggagcagatgatcgccttgctggaaggcttcgacgccgcttccggcggcgcctccgggcgcatctccggcggcggcggcgaagtcgccgtggccggctcgcaataccgcggcgcgcaaggcctggacccggagctggtgaaagagatcgagcgcatgtacggcttcgacaagtcggcccccgagcgcttcatgatcatgctgaagaactacctgcacctggacttcgggcagagcttcttccgcgacgccaaggtcaccgacctgatcatcgagaaattgccggtgtcgatctcgctcgggctctggagcacgctgatcatgtacctggtgtcgatcccgctggggatcgccaaggcggtccgccatggcagcgtcttcgacatctggaccagctcggcgatcatcgtcggctacgccattcccgccttcctcttcgccatcctgctggtggtgctgttcgccggcggcagctactgggactggttccccctgcgcggcctgacctcgaggaacttcgacaagctcagcctcggcggcaatgtgctcgactatttctggcacctggccttgccggtaaccgccctggtgatcggcgacttcgccaccatcacgctgctgaccaacaacagcttcctcgacgagatcggcaancaatacgtggtcaccgccccgccccaaaggcctgacactaacgccgcgtgctctaccggcccgtattcccgcaacgccgtgctgctgggtgattgccgg

SEQ ID NO: 14250 - DNA, 1092 bp, Pseudomonas aeruginosa
  unsure (100): Identity of nucleotide at the above locations are unknown.
ccggcaatcacccagcagcacggcgttgcgggaatacgggccggtagagcacgcggcgttagtgtcaggcctttggggcggggcggtgaccacgtattgnttgccgatctcgtcgaggaagctgttgttggtcagcagcgtgatggtggcgaagtcgccgatcaccagggcggttaccggcaaggccaggtgccagaaatagtcgagcacattgccgccgaggctgagcttgtcgaagttcctcgaggtcaggccgcgcagggggaaccagtcccagtagctgccgccggcgaacagcaccaccagcaggatggcgaagaggaaggcgggaatggcgtagccgacgatgatcgccgagctggtccagatgtcgaagacgctgccatggcggaccgccttggcgatccccagcgggatcgacaccaggtacatgatcagcgtgctccagagcccgagcgagatcgacaccggcaatttctcgatgatcaggtcggtgaccttggcgtcgcggaagaagctctgcccgaagtccaggtgcaggtagttcttcagcatgatcatgaagcgctcgggggccgacttgtcgaagccgtacatgcgctcgatctctttcaccagctccgggtccaggccttgcgcgccgcggtattgcgagccggccacggcgacttcgccgccgccgccggagatgcgcccggaggcgccgccggaagcggcgtcgaagccttccagcaaggcgatcatctgctccaccggaccgccgggagcggcctggatgatgatgaagttgatcagcaggatgccgaacagggtagggacgatcagcagcaggcgccgcaggatataggagagcatgcggcgttactcccgttccggctcggcgtcttgcgtggcttcggcttgcgccttgctcggcagcgccttgtcgctggtctgccaccaggtcatcaggccccagtcgtagagtggcgtcaccttcggccggccgaaacggttccagtaggcgacccgccaggtatcgacgtagtagttaggaaccacgtagtagccccacgacagtacgcggtcgagggctgcctgccggctgcgtga

SEQ ID NO: 14251 - DNA, 765 bp, Pseudomonas aeruginosa
  unsure (82),(87),(147),(160),(163),(183),(328),(351),(438): Identity of nucleotide at the above locations are unknown.
accggaagcgggggagcgttttcctcccaagaggtcgggcggcagcctggagggcatcccagaccgctttggccaacgtttnccagngtgggcaaccaaccccagcggcaagttgaaggtcagcatggggtggctttcggccgcgantacatcctgccgntgntcggcgagttcctcgaacgntatcccgacatcgtgcccgactggcatttcgacaatcgccaggtcgacctcatcggcgaaggcttcgacgccgccatcggcggtggtttcgaactgccgcccggggtggtggcgcgcaacctgacgccgggccacctgatcctcntcgcctcgcccgcatacctccgngacaagccgccaatccgccatccaggcgacctgggcggcttcgacgggatccgcatccgctcgccgcagaccggccgcgtgcgctcntggccgctgcgccggcgcaacggcgaggaggcgccgatcgagctgcgcgaacgcatgaccatgagcgacccggaagccacctgcgaggtcgccgccatgggcctgggcatcaccctggtatgcatgcagcacgcctatgcgtacctggagtccggcgccctggtgcgggtcctgcgggactggtacgtagacgccggcaacaccagcctttactacgcggcgaacaagctgctaccggccaagacccgggtcttcgtcgacttcgtcgtcgactacttccgccgccaggacctggcccggcgattctccgccttcccaaccggctag

SEQ ID NO: 14252 - DNA, 1248 bp, Pseudomonas aeruginosa
acccttttctgctcgttgtcgttcagttcagatctcgaggacttccagttcgcgcagcgcctcgccgatggcggcgaccgcctgccgcatctccgcggcgtcgacgtggccgatgcagccgacgcggaaggtttccacctgggtcaacttgcccggatagaggatgaagcccttctcccgcacgcgttggtagaagtcggcgaagcggtagcgcggatcgcgcggcgcgtggaaggtaacgatgatcggcgcctggatttccgccggcaggaagctgcggaaaccgagccgggccatctcgccgagcagcgtttcgcaattgctcgcgtagcgccgctggcgcgccggcaggccgccctcctcttcgtactggctgagcgcttcgtgcagggcggcgaccacatgggtcggcggggtgaagcgccactgcccggtcttgcgcatataggcgtgctggtcctgcaggtccatggccagggagtggcagttgccggcgctggcttccagggcggcgctgcgggcgaagacgaagcccatcccggggacgccctccaggcacttgccggaggcggcgatcaaggcatcgaacggaactttccgggcatcgatcccgatcgccccgaaggagctcatggcatcgacgatcaggcgcttgccgtgacgctcgacgaccttggcgatggcctcgagcggattgaggataccggtgctggtctcgcagtggatcagcgccacatggctgatcgccggatcggcggccagcagacgctcgacgtcagcggcggtggtcggcacgttctcttcggtctcgaaggtgctgaagggccgttgcagaacctcgcagatcttcgccaggcgcttgccgtaggcaccgttgatcaacaccaggaccttgccgtcgcgcggcaccagggtgccgatcgccgcttccacggcgaaggtgccgctgccctgcaacggtacgcaggtgtggctgccttcgccgcctacgatcttcagcaggcgctggcagacgctggcggtgagttcgttgaaatcgctgtcccaggagccccagtcgaccatcatcgcccgacgggtacggtaggaggtggtcagcggaccgggggtcagcaggatgggtgcgcgttcggcagtgctcatgctcatttcctctgcgggaatcggccaaagaaaccggatcgggcttcgcggtccgggcggtcgttccgcgccggcgttccagggaagcctggagacataaggtga

SEQ ID NO: 14253 - DNA, 387 bp, Pseudomonas aeruginosa
attcgcgcatctgcgcccctgttgcctcgccagcatccctggtgcgaacgcaacgaaggcgtaccgctggaagagctcgaccagcagatcatggtgctgcgcgaacccggttcgatcacccgccgcaccttcgaccgcgcctgtgccgagcagggcgtgcagccgcgggtactgctggagctggacagccgggaagcggtgaccgaagcggtggccgccgaactgggcgtcggcgtggtgtcttccctggaggtcggcaacgatccgcgggttcgcgcggtgccgctggtcggtcccgagctgaccaaccgccacctgatcggctgcctggagaagcgccgcggcctacgggtgatcagggcattcctggaactggcggcggcctga

SEQ ID NO: 14254 - DNA, 378 bp, Pseudomonas aeruginosa
agacgatcagccgcaggggttcgcgcagccagcgccacatccagccggtcatcagccagaacaccagcatcaggccgagtccggcgatggcgtaggcgccccaggcgatcagatagtcttgttcattcatgcggcgtgcgtggcgatagcggtgatggggggcttatgatagccgcttttgcatgccgacgcgcctacccaccgatggcgggcgccgcgccgccagttttattcagatttcccggcctcgcgcatggccggatcgacgaggattcccgatgccccatccgcagccccccatcgcccgccgcgacgccggaagcgacccctacgcctggctggaggagcgcgacgccccggaggtgctcgactacctga

SEQ ID NO: 14255 - DNA, 423 bp, Pseudomonas aeruginosa
aggccgagaacgcctacctggatagcgaactggccgaccaggccgggttgcgcgagaccctgttcgaggagatcaggggacgcatccgcgagaccgacctgtcgttgcccaatccgtggggtccgtggctgtactaccagcgcaccaccgccggcgacgaatacccgcgccactaccgctgcccgcgtccggcggacggcagcctggaggtcgacgaaggcgccgagcaactgttgctcgatcccaaccagttggccgacggcggcttcctctccctcggcgccttcagcatcagccccgaccagagcctgctggcctacagcctggacaccagcggcgacgagatctaccgcctgttcgtcaaggacctcgccagcggcgcggtgcaggccctgcccttcgacgactgcgacggcagcctga

SEQ ID NO: 14256 - DNA, 669 bp, Pseudomonas aeruginosa
aggacgtggcgctggaatacgccttcctgctcaaggtcctcggcctggtatgaccaccgcgggggccggcgacgccggccttccgccacgaaaaagggaaccttcgtgaaacgacgcttctggcccgccatgggcctgctcgccgcgatcatgctggccgtctacctggcgaatccgttcggcaccgccagtctcgacccgcgcgcacggctcctcggcgtggcgctgtacaatatcccttcgcgctcgatggaaccgaccttgcaacagggcgacttcatcctcgccaacgccgcgcgctacgccttcgccgacccgcaggtcggcgacctggtggtgttccgcttcccgccgcagcgcagcatcgcctatgtgaagcgcatcgccgggatacccggcgatcgcgtgcggatcgatggcggccggctctacgtcaatgagcgcccggtgacggagccctacctggcgcaacaggcgctgcgccagccggactccctgcgcatggcccagcggaccgtccccgccggccactacttcatgctcggcgacaaccgcgacaactccaacgacagccgctactggggctacgtaccgcgcgccgacctggtcggccgggtgttcgccgtctggtatgccgaggacacccggcgcatcggttcggtgcgctga

SEQ ID NO: 14257 - DNA, 1182 bp, Pseudomonas aeruginosa
cgcccctcagaagaactgggtgacgctgatcttggcgttgcgtccctggctgtagaccaggtcgccgcccagcggctggcgataggagcggttgaacaggttgtccacggtgaagtcgatgcgggtgtccttcaggcccagcttggccgggacccactcggcgaacagccgatgagtgtcgtagctgtcgttggccgcgtgatcccagtagatatcgccggaaccggtacccatcccgccgctgtagcgatcgctgggcaggcggtcggtcttgcgcacgaactcgccctgccagccgagcttggcatcccattccggaaccttcaggccgagcatggccacccacttcggcggcgggatgtcgcgcgcccacacgttcggtccccagggattgctgtaggccccatcgtgcttgccggtcatccacgagtaggacaggctgccgaacagccgctggctgtcgtagaagctctcgatctcgaagcccttgatggtcaggcccggcaggttgcggtagttgctcagcggcagcatgtcgccgcagctaccgccgatactgccgttgtcgatcgactgctggcggcagccgacgctgcgggtgcggaatatctcgtccttgatgcggttctggaacaacgtggtgcggatctgcaggctgtcgccggcgaccagcaggtccggcaggttgatcacgctgccgccacggatcgcatggatgcgctcggcgtccaggtcgcggctgctgccaccgatggtcgaactgttctgcacttcgtactgctcgtcgatcaccggcgctcgccaggtctcggtgtagtcggcgaagaacgccaggttcggcgtcgcggtccagaacaccgacagccgcggcgaccagccggagtaggtctgggcgcgatagtcatggccgagcttgggattgtcgtagatcggcgccaggttggcctggccgtcgttgcgcacgctgtcgaagcgcatcgatggggtgacggtcaggctgccgtaggtgatcgcgtcctggatgtagaagctctgcgtgtcctgcttgccggccggcatgaatgccggttgcagccagccgtagttgtagcgcggggtctcgtaggtcttgcccggcatgtgcatgaggatgtcgcgcttgtgcttgtgcagcgccgcgcccagggtcagctcgtgctgtag

SEQ ID NO: 14258 - DNA, 1401 bp, Pseudomonas aeruginosa
cgctccggtatcgaaacggctggtgttgcgcagctccaggaccttgtcctggtactcggtacgcatccgtttgccaccggtggcgagctggtagaaggcggtgtcctcgcgacggtcgagttgctcggtgcgggcgtcggaatagctcagttgcaggtcgatccaggggttgtccagcggatggtagttgtacttgccggtccaggtggtgtcggtggtatcgcggtgggccagcaggcgggtcaggcccagctcgtagccgtagcggtcgatggtccactggctcggcggggtcgggtagctgctggcggagaacggcgtccagcgcgagcttttcgagcgcaggtaggtgaaacccaggtcgtgctcctcggtggggtgcaggttgagcttgaacaggccggtcttctcgtcctgggcgctgttgggcaggcgcttggggttgatcgggtagtcggtgggcgacagcggcaggttgtcggccagcttcatgtcgcggccgtcgcgaccgttgagatagagcagggcatcgacgcggcggtcttcgctgcgaccgaacacggcgccggagtagatcttctgctggtcgttggagtgatagccgtacttgagcatggcgccgacgtcgcggccttcgcgcagcaggtccggcgcgtccttggtctccatgtgcacggtgccgccgaagccgccattgccggtgaacaccgagtgcggtcccttctccacctcgatgcgcttgatcatttccggttcgatgaacacggtgccctgctggtagcgctcgaagccgctcttctgcgcgccgtccagggtatagggcacgtcctcggcgtcgcccaggccccagatgttggtggtctgtccgcccggcttgggcgagccgcccatggtcactccgggcagggtctgcagcaggctggggatgttgtccgcctgctggcgttcgatatcccgccgggtcagggtcgaacggccgacgttgctggcgtccacttcgcgaccgttgccgacgatggtctgcgcgtccagttgcagcgcgttgtcgctgtaggcatcgacctggcgccggcgcaccacgtagccgtcgcccgcctccaccagctccagctcggaaccgaccagcaaccgctccagcgcctcgcgcaccccgtagctgccgctcagcgccggagcgcgcaggccccgcaggagcgactcgtcgaacagcacctggacctgcgcctgctgcgccaggcgcgacagcgaggcggccagcggctgcgccggcaggtcgaagcgtcgttcggcagcgctggcgccggcggcccacaacgcggcgccgagcacggcggcggaacacagcgggcgccaggcggcgcgggtgaaaggcaaggtcatgctggaactctccccaagtga

SEQ ID NO: 14259 - DNA, 495 bp, Pseudomonas aeruginosa
tcccccgccccctccaggccaagcaccggccggcacatggctacttcaggtaggaacgcagcgcggtcaccaccagttccaggtcttcgcgacgctgctccgcgctcgcctgctcggcgccgaggtgttcgcggatgtgcccctccagcacttcgttcatcaggccgttcaccgcaccgcggatcgccgcgatctgttgcagcaccgccgcgcattcgctgccctcttccagcgcctgctccagcgcccgggtctgcccggcgatgcggcgcacccgcgccaggagcttcttcttcccatggatggtatgggccaccgctctctcctcaaggtaatatactggggtatagtatattttcgacgtctcgacaggacagtagcaaatgcccggcaccccgactacccagcccctgcgccattcccatcggttcgaccagggcaacccgctggccgagcgcaacacgcgctgggcggtattgctcaccgcctgcatga

SEQ ID NO: 14260 - DNA, 699 bp, Pseudomonas aeruginosa
aagctgccaaactgcccggccccgccgatccaccttgcgcgaggccgtcatgggtatttccgccaacgatctttgccagcacgtgatacgcccgaccctggactacctgtcctgccacagccccgccgccgaagcgctgctgctgggcgctgcggcctgccagtcggcgctggggagcgccctcgacgaccgccgtggccacggcctgtaccggatcgccagcgaacgccaccagcagctctgggaccagtacctggcgctggacccggagcgcgccagccgggtccgcggcctggccagccagcatgccttcctcgccgcgccgcacctggaactgacggtgaacctgcgctacagcacggccatcgcctggtcgctggtggaagccgcgcgactgccactgcccgaccagcacgaccacctcgcccaggctcgcgtgtggcgccaggtattccagccgcacggtcgcctgcacgagttcatcgacgcctggcaacgctgcatcggcagcctcagccaggtcgcctgacggcgaatggaaaaatcccgcgtccgaaacagaccaaccggtcagaaaattttttacatacagacacgaacggttgcgctaccttcgcttcactggcaccggagccaaccgctctgttccgcaccctgcggaacttcggaacactggcgccggtctgggaatcttggtag

SEQ ID NO: 14261 - DNA, 918 bp, Pseudomonas aeruginosa
ccgcccaggtcacctatcgtttctgatcacacgcgccaacgaagaagccgggcaatgcccggctttttcatgcctggccgaccctcagggctggctggcgatggccttctcgatggcggcctggagctgcggatcgtccggggtggtcttgctggagaactgcgcgaccaccctgccctggcgatccaccacgtacttgtagaaattccagcgcggcgcctggccgctctgctcggccaactggcggaacagcgggatcgcctcgtcgccgcgaacgtgctgcggctgggtcatggcgaaggtcacgccgtagttgccatagcagatcttcgcggtctcggcggtatccgcggcttcctgcttgaagtcgtcggaaggtaccccgagcacttccaggccctgccccttgtaacgctggtagagcgcctcgagccccttgaactgcggggtgaagccacagtggctggcagtgttgaccaccaccagcggcttgccggcgtaacgctggcaaagatcgatgttttccttggaacgcagcttggtcaactggccctgcaacagttccgggcaatcggcggcccagccgctcagcggcagcccggcgagcgccaggacggacaacagcacgcgaggtttcatggaatggctccttggcgacgaatgtcccagcttacccttccccgcgcctatcgccacctatcagcatgcgcccatgcccagttccagcagcgccagtccgccacgctgccagccccaccaggcgagtcccagcagcgccccggcggcgagcagccaggccagcttcacgccgcgcctccggccacttgcaggcgcgccaccggacgctcgcgcaccggccagttgagcagcgccgcgagcaggcttagcaggatcgacaactgccagaccaggtcgtag

SEQ ID NO: 14262 - DNA, 3594 bp, Pseudomonas aeruginosa
  unsure (3084): Identity of nucleotide at the above locations are unknown.
cgtgcggcgcatgctgctgacccagaaagccatcgccgaaggcggccgggcgctggtctacctggccacccagtacgccgaccggatgatccagggcatcctcagcaacgacgacgccgaatacgaacgctgggacgacaagctcggcttcctcacgccgatcctcaagggctgcctgaccgaactcggcctggaaagcgccaacctcggcatgcaggtgttcggcggccacggctatatccgcgaacacggcatggagcagatcgtccgcgacgcgcggatcgccaccctctacgaaggcaccaccggcatccaggccctcgacctgctcggccgcaaggtcctgctgatgacccagggcaaggccgtgcgcgacttcaccaggggcgtggcccggttcgccgtcgacctgctgaagaacgagccgcgcatgcgcggccgcgccctggtgctgctcaagctctgcgcccaatggaacctgctgaccctgcgcattgccctcaccgcgcgcaagcaacgcgatctggtgagcaccgccagccacgactacctgatgttctccggctacgccacgctggcctattcctgggccctacaggaagccgctgcgcgccggcgactgcgccagggcggcagcgagtcggcggacttctacaaggccaagatcgccaccagcgagttctacttcgcccgcctgcttccgcgcgccaagggccacgcggcggcaatggcgaagccgacgggttcgatcatggacctgaagagcgagcacttcgccttcgactgaggcgaccacccgcagcgcgcgccagcggagcctcagtctccgctggcgccagccggggtcagcaacaacgcacgaacgtcgtcgagcatcgagtcccactcctcctggccaatgtccatcaggcggaagtagcgcaacatgaaagcgccctccaccgccaggaacgccaggcgcgcacggcgcccctcaggtgcggacaggtccaggccttccaaccggctgcgataccactggttgctgccctccagatgctcgggcgtctggatcagcgccgccatcagcgccgccgccttgctgctggacagctcgtccgaacgctgggtcgcctcggcatgtgcgcgaacccgcgtcagtggcgtcggctgcttccctgccaccgcttcgaacaggctgtcgtaggccttgccccagcgctcgaagatcgcgtcgatcagcgcatccttggtaccgaagcagtactgcacgccgcccttggtaatgcccatttccttcgccaccgcatcgatggtcaggccggccgcgccttcgcggccgatcaccgcctcggcggcatcgagcaactggtcacggtcgatcgttcgtcggcgtcccatggctacctcttgagtttaaatccatacgtatgtatttatattttcacgcgcccgcccgtggcgcgcaattcccgttatccacggcgagcgatgaaccgttcgccacagaggttatcccatgttccggcagaaccgctggctggtcctggccatcgtctccagcgccctgttcctcatcatcatcgacatgaccgtgctctacacggccctgccgcgcctgacccacgacctcggcgcgacggccgcggagaaactctggatcgtcaacgcctatccgctggtggtcgccggcctgctgcccggcgccggcttgctcagcgaccgccttggccacaagcggctgttcctcgccggcctgccgctgttcggcctggcctcgctgtgcgccgccttcgcccccagcgccgcggcgctgatcgccgcccgcgccgggttggcggtgggcgcggcactgatgatgccggcgaccctgtcgatcgtccgccatgtcttccaggacgaacgcgaacgcgccctggccatcggcatctgggcctccgtcgcctctgccggcgcggcgctggggccggtggtcggcggcgtgctgctggagttcttctggtggggctcggtgttcctcatcaacgtcccggtggtggtcgtcgctttgttgctggcgctgccggccatcccggcctgcggcggccagtcgcggcgcccatgggacgccctcggctcactgcaggtgatgttcggcctggtcggggtggtgtatgcgatcaaggaactcagcacacgcgccccggacttcgggctggtcgtcctcgccgcgctcggcggcatgctctgcctgtacctgttcgtccgccgccagcgccgcgcccgcgaaccgatgatcgacttcgcgctgttccgcaaccggcgcttcgcccgcggcgtcgcggtggccctggtggcgaccatggcgctggtcggcatggaactggtgttcagccagcacctgcaactggtgcaggacctgacgccgctgaaggccggcctgttcgtcctgccgatcccgctggcctcgctggtggtcgggccgctggccggctggctggtgccgcgctggggcgagaaccgggtgatgtgcgcctccctgctgctcggcagcgccggattgctcggcctggccctgtcctaccagtccgtcaccggagcgcaactggccagcctggtgctgctcggcgtcggcttcggcggcgcgatgaccgccgcctccaccgcggtgatgctcaacgtggacgaacagagttccggaatggcggccgccatcgaagacgtgtcctacgaattgggcggggtgatcggcgtgaccctgctcggcagcctgatgagtttcgtctacgggatgtcgctgaggctgccctcggccgagctgccggcgcgggtccgcgacagcctcgacgacgccctgttggtcgccgagggcctggcgccggaggtcgcgtcgcggctcgtcgagcttgcccggcaggctttcgaccaggccttcgtcgccgtgctactggccgccgccgcgctgctcttcctcagcgccatggcggtcctgcgccagccgcgtccggctacagagccagcgccaccagcaccgcacactcggtaagttcgaccagcgcgccggcggtgtccccggtggtgccgccgaggcgcgcgaggaaacggctgcgcagccaggcgaagagnatcagcgtcaccagcaacgccagcaggccggccaggccgaacgccagggccaggccgaaactcacccccagcacccacggcaggctgcgcgccggcaggtgctcggcgatggcctggccgaggccgccggggcgcgcgtatggcgtggtcaggaacagcagcggcaggctgctgcgcgccagccacggggccagcggcaacaacccggcctcgccctggccgagcagcgccgccagggaggagaacttcaacaacaggaccagtaccaggaccaccaccgccaccgggccgctgcgcgggtccttcatgatcgccagggtccgctcgcggtcgcccagcccgccgacccaggcgtccgccatgtcggccaggccgtccaggtgcagcgcgccgctcagcgccacccacaggctcagcagcaaggctgcctgcaacagctgcggcgtaccatcgagcgacagagccgcggcgtacagcacgacgccgatcagcaccccgaccagtggatag

SEQ ID NO: 14263 - DNA, 1299 bp, Pseudomonas aeruginosa
ccagcaggtcccagcgtccgccttccaccgccgtgcgcatctgcgcccagccacgcgcggtcaaggcgtcgtcgaggctgccgcggaaaccgccgccggactcggtttcgccatgccgcaggaggtccaggcgcaggctcatgccgggcggtccgagaccgccgcttcggcgaaggtcgccatccccgcgtgcagcgcgcaggcctggcgcagcagcggcaccgccagcgccgcgccgctaccctcgcccaggcgcaggccgaggtcgagcagcggttgcgccgccagggcttcgagcacatggcgatggcccggctcggcaccgctgtgggcgaacagcagccagtcgcggcaggccgggttcaggcgcaccgcgcagagcgccgcgacgctgcagatgtagccgtcgaccagggcgaccatgcctttctgcgcgcaggccaggtaggcgccggccagcgcggcgatctccaggccaccgagacggcggagggtttcgaaggggtcggcgcgatgggcgccgtgcagggccagggcacgctcgatcaccgcggccttgtgcgccacgccgctggcgtccagcccggttcccggcccgaccagcgcgctcgccggcgcatccagcagcgcgcaggccatggccgccgccgcggtggtattgccgatgcccatctcgccgccgatgaacagctggctgccggcctgctcggcgcggcgcacgctttcgcgcccggcctcgagcgccagcaggcactgttcggcgcccatcgccggggcctcgacgaagttcgcggtgcccgccgccaggcgcaggtgacgcacgccgggcaaggcttccagggggaacgcggtgcccaggtcgaccacctccaggccggcgccgagttcgcgcgccagcacgctgatcgccgcgccgccgcggacgaagttgcgcagcatctcgccggtgaccgcctgcggataggccgagatgccctcggcgactaccccgtggtcgccggcgaagaccgtcacccagatcctctccaggctcggtcgttcgcgcccctgcaacgccgccaggtcgatcgccacttgctccaggcggcccagcgagccgcgcggcttggtcaaccggtcctggcgttcggccgcgcgccggcgcatctgcgggtccgcctcgcggcaggtgtcgcgccaccattgcagactcatagcggttctcctttcaacggcatgggcaggccggcgacggtgaaggtcacccgttcgcagcgttcggcgatggcctggtgcagccagccggcctcgtcgacgtag

SEQ ID NO: 14264 - DNA, 1566 bp, Pseudomonas aeruginosa
ctcaccgccagcccgctctcggcggccaggcgctcggccaggcggctcttgccggaacgggcgccgccaaggatcaggtcacgcatggggttctccgcagagggcgagcaatcgcccggtatccaggtggcgctcgaccaggtcggcgagccgctcgatgtcgcgttcgcgcaaggcctggtagtccaccgcctggacctcgcgcaggccggcccagcgcagcagcgccgaacaggccgcggtggattcgaacaggccgtgcaggtaggtgcccatgacgttcccgtcgacgctacgggcaccatccgcgcgaccatcgtcgagcaccaccgccggccgcgccagggcctcgccacgggtgaccccggcatggatctcgtagcccgacagcggcgcatcctccaggctcaggcggccctgtacgttgcgcaattgcttgtccgcctcaagggtcgtttccaacgccagcaggccgaggccagcgctgctgccggccgcgccttccaggccgagcggatcgtgcaggcgctcgccgagcatctgcaggccgccgcagatccccagcaggcgaccgccgtagcgcaggtgacggaggatcgcctcgtcccagccgcgctcgcgcagcgccgcgaggtcggcgcgcacgctcttcgagccgggcaggacgatcaggtccgccgacggcagcgcctggccggggccgacgaagctcaactcgacctgggggtgcaggcgcagcggatcgaaatcggtgtggttgctgatcctcggcagcaccggcaccaccaccttcaggcgcggcccgaccttggccgcctggcgcgtgtcgatggcgtcctccgcctccaggtgcaggtcgctgacatagggcagcacgccgagcaccggcttgccggtgcgtgcctccagccagtcgaggccgggttgcagcagggcgatgtcgccgcggaagcgattgatgacgaagcccttgacccgctcccgctccgagtcggagagcagttccagggtgccgaccaggtgggcgaagaccccgccgcggtcgatatcggcgaccaggatcaccggacagtccaccgcttcggcgaagcccatgttggcgatgtcgttggcgcgcaggttgatctccgccggcgagccggcgccctccaccatcaccacccggtaggcggcggcgagccgcccatgggaagccagcaccgcttccatcgccacgcgcttgtagtcgtggtaggcggcggcgtccatgctggtcaccgcgcggccatggatgatcacctgggcgccgatgtcggtgttcggcttgagcagcaccgggttcatgtcggtgtgcggcgccagccggcaggcctgggcctggaccgcctgggcgcggccgatctcgccgccgtcggcggtgaccgcgctgttcagcgccatgttctgcggcttgaacggcaccaccgcgacgccgcgccgggccagccagcggcacagcgcggtcaccagggtgctcttgccggcgtccgaggtggtgccctggaccatcagggtccgcccgcgatcactcatgagcaggctccttga

SEQ ID NO: 14265 - DNA, 474 bp, Pseudomonas aeruginosa
ccaccagcagcacgtcgaggctgtcgagatagggctcgacctcggcctcgccgatctcccgcaccaggtgcccggcctggcgccaggcgtgggcgtgctcggcatagcacggcgacaggacgccgacccgcccgccccgccgcaaccttggcagggcctggatcgccgcctggctgccggccagcggcaatacccgttcggcgccgtagtagaggcaggcagcggcttccaggccgtcgtcgctctccggcaggcgggtccaggcctgctcggggatcgccggcagcggaaacggccagggcgcgatgccggtggacaggtccagccagtccgccagcggaatgtcgtagcggcgcgccgcctcgcgcaaccgccctccgtgttcaagcatgcagccaccccatggcccagagtccggccagcaccagcagccagaacagcacgccctggcgtaccagcgccagggcccgatag

SEQ ID NO: 14266 - DNA, 603 bp, Pseudomonas aeruginosa
ggaagttcagcgagcgcccaggccagcagggtcagcggcagtaccgcgaggacccaggcggtcaccccgtggctgcgccagccgaccccgggatcggcctcgccggccaggcgcgagcggttgaaacggcgctccaggcgatcggccaggcggccgaaggcgaccagcgggtgccagccctgcggctcgccgaagcgcgcatccagcgccacgccgaggatacccagcagtgcgctcatgctcgctcgccccaacggttctggtagaccagctcggccagcggacgcggttcgctccaaccctccagcgccagcatcggcgccgggtagaactccgccaccgggcccaggcagagcaccgccaccgcttcgctgccgggcggcaggccgagcagctcgcccagcgcggccggatcgaacagcgatacccagcccatccccaggccctcggcgcgactggccagccagaggttgtggatcgcgcaggcgagcgacgccaggtccatctgcggcagggtccggcgaccgaacacatggcgctcgcggtcgtccatcagagcggcgaccagcagttcggcgcaatccagcacgccctctaccttga

SEQ ID NO: 14267 - DNA, 2943 bp, Pseudomonas aeruginosa
acaggcgcgccggaggcgcgggcgaggatcatcgggtcgaggaagtccggcccgcacttgaacacccgcacccgccgcccctggcgcgcatgcaggcgggccagggcggcggtgacggtggtcttgccctggccggaggccggggcggcgatcagcagggccggacagcgtgcctgggtcatgggcgaagcgtctccgcgcatggcgccggcatcagaattccactcctttctgcgccttgatcccggccttgaacgcgtgcttgaccagactcatctcggtcaccgtgtcggcggcctcgaccatccccggctgcgcgccgcggccggtcaccaccacatgctgcatggccgggcgcgcctggatgtcggcgaggaccctgtccagttccaggtagccgtgcttgagggcgatgttcaattcgtccagcaccaccaggcccacgtccgggtcggccagcaattgcgcggcgaccttccaggctgcctcggccttggcgatgtcgcgctggcggtcctgggtctcccaggtgaagccctcgcccatcacgtggtagctgacttcctcggggaagcgccggaagaaggcttcctcgccggtgctggcggcgcccttgatgaactgcacaacgccgaccttcatgccatggcccagggcccgcgcgaccatgccgaaggccgagctgctcttgcccttgccgttgccgctatgcaccaggagcacgccgcgttcgtcgcgggcctgggcgatcttctcgtcaatcacggccttcttgcgctccatccgctcgcggtggcgctggtccttctcaggggattcgttcatcgtcgatcactccttgcggcgacgcggcctcgccgtcgcctcgttcattcgaaatacccggcctcacagggcctggtagcgcacgctgaggtagaccgcctggccaggctggttgtagccatacgcggtttcgtagtcggcaccgaacaggttggcgatccggccctgcaggcgccattcgtcgttcagccggtactcgctgcgcaggtcgagggtggcgtagccgcccaggcgcaccttgttggccggatcatcatagcgtcggccttcggcgtgcacgctggcgcccagcgaaagacgctcgaagcgccggtccagttccaggttgaacatccgccgcgcccggcgcggcagctcgttgccgtcgttgacgccgccggaacggttttgcgggtcgaggaaggtcgcgttggcgttccagtcccaacccagccactggctgccgaggaccagttcgacgccgcggatgcgcgcttcgtcgatgttgttcggctgcccccaggggcgccccggagccggacgcggatcgttgccgatcaggtcgtcgacgttggtacggaaggcattcaccgcccagtgcccccagccatgcgtaccgctcagcccgacctccaggctgcgcgaagtctcggcgtccaggtcgggattgccgtagtcggggtagtagagttcgttgaaggtcggcgccttgaatgccgtgccgtagttgacggtgaagcgcagcgcgtcgctcagcgcgtagccccaggcggcgctgccggtgtcgtgcacgccgaactgctggttgtcgtcacggcgcaggctcagttgccaatcctggcgaccgtactggccgaggtactgggcgaaccagcctttgttcagccgcgagtcgacgctgaaggcttcgctgctgctgatctcgtccttctgccagtcgtagccgagggtcagtacatggccttcggccagggtcaggtcgttctgccaggacaggctgtcgcgacgggtatcgaagcgcgagtagaaacggccatcctgataggcatcggccttgtcctcgctgcgcccggcctggagggtcaccagccagggatcgaacggagtgaagcgggcacggccgccgaccaggttctgctcgccgtcggcgttggcattgaaaccggagttgccgaaaacctggtcatagtcgttgtgcgacttggccctgagcagcgtgccgtcgagttccaggccattgtcgaagcgatagccgccgcgcaggttgccggacaggttgcggtagccgtctcggtctggctcatagcccgcagtaccggcgcgcttggtattgatccccgccgtatcgaagctgctcaccccgaggctgtaccagccgttgccggcgccgccgctgaccccggcgctgccctccagggtctgatgggtgccgtaaccggcggagaagaacggcttggcgccctggccgtcgccgcgccgggtgaagatctggatcaccccgccgatggcctccgagccgtacaggctggaacgcggcccgcggaccacctcgatgcgctcgatcagctccaccggcaagtcctggaacgcggtgaggccagcgctggccgagccgaccttgatgccgtcgatcagcaccagcacatggtcggactcggtgccgcgcaggaacagcgtggtgttcttgccgaaaccgccgttgttcgccagcgacacgccgggtacctggcgcaacagctccggcacgctgcgcgcctggctgcgctcgatatcctcgcggtcgatgacgctcaccgccgccaggctctgggaagcggtctgggcggtacgggtggcggtcaccacctggtcggcaaggctgaccggttcggccaggctcagggaagaagcgccgcacagcgctacggctgccggggtcaggaaaactctgttcatgctctacgctgctccgtcgctctcacccgcgcgacctgggttaaggcagacggaggacgaagcgacggcaggagacgtccgacagcgccctccgcgatgccgtgggtgcgtcaggccggtctccgggctcgcgagcgaagcgctggacgcttccagccgcgccttcccatgccggagcacagtggtcatcgagcggctgtctga

SEQ ID NO: 14268 - DNA, 720 bp, Pseudomonas aeruginosa
accagcgcctcgacgctgcgcccggccgccctcgcctcgccgagcaggcgttcgaggcagaccaggcacaggtgcaactgtccgtgcgccgcgtccagcgccaggcgcaagcgctgccggcaggcctcgaactcggcctggcggccctcgcgcaacagtgcctcgagttcttccagccagggctgcaaggcgtgcgcgctggccggatcgagcagcctccgctcgcgagccaccttgcgcgccgcgcgcagcaggccgagcaggtcgaggcctagcacgcgcaaggcctgggaacgggcgcggccgagcgcaccctcgaaccaagcgtggtcgcgctgggcgtccgccgcggagatccgccccagcgccgcgagcagctcgccgcgttcgtcggcgccgcgcagctccgccgcggccgcctgcaagccggcctcccgggccgccttgccctggttcgccaactggcgttccaggcgccgcggccagagcagcacactcaccagcgccgcgcagaggatgcccaggccgatctccgagcagcgggccaccgcctggtcgaacaccgtcgccggatcggcgctggccggcagggcgacgatcgccgcggtgtatccggccaggacgaaaccgtacgacgcatggttgtgcatcaacgacgcgccggcggtgcagaacgccagccagagcgccatcagaaggaggaagggcagcgacgcctga

SEQ ID NO: 14269 - DNA, 786 bp, Pseudomonas aeruginosa
agccgaccaacacgcctgcgcagaaggcgccaaccggcagcggcagccgccgagcgttcgtatacaatatcccgcacgttcccaacgccacgcaggttgccccgcttgcctctctccatgctcaacgcccctaacctgggcatcgctccttcggcctccgagatcatcgccaagcacctgcgcgaagcgatcatcgccgggcatttcgccgaggacgaaccgatccgccaggacgacatcgcgcaactcttcaatgtcagcaagattcccgtccgcgaggccctcaagcgcctggaagcggaaggcctggtgctgttccagcgcaacaagggcgcggtggtgacgcgtatttccgaaccggaactggcgcagatgttcgaagtgcgggtgctgctcgaggcgcaggcgatccgcctggcggtgccgaacatggacgagaccaccttcgcccgcgccgaggcgatctgcgccgacttcgtcggcgaagacaacgtcggccgctgggccgaactcaactggcaactgcacgcctgcctctacgaaccggcgcagcggccgttcctggtcaacctgatccgctccatccacgacaagctggaacgttacctgcgcatgcagatgagcctgtccgaaggcaagcagcgcgccgaccaggaacaccgcgagatcgtcgccgcctgtcgcgccggcgatgccgaacgggccgcggcactgatcgaggcacatatcgtcggggtctgccggaccctctacgaacacgtgccgaaccgcccggccagcacctga

SEQ ID NO: 14270 - DNA, 486 bp, Pseudomonas aeruginosa
ggcggatcggtcccggcgtgcaccgcatcgagacaccggtcggcgaggtcgaggcgaccctccacgaggacggctcggtcagcgtgcgcaacgtgccggcctaccgctaccgtcgccaggtcagcgtcgaagtgcccggcatcggccgggtcagcggcgacatcgcctggggcggcaactggttcttcctggtcgccggacacggccagcgcatcgccggcgacaacctcgacgccctcaccgcctacaccgtcgccgtccagcaggcgctggaagaccagggcatccgcggcgaggacggcggcgccatcgatcacatcgaactgttcgccgacgatccccacgccgacagccgcaacttcgtgctctgtcccggcaaggcctacgaccgctcgccctgcggcaccggcaccagcgccaagctggcctgcctggccgccgacggcaagctgctgcccggccagccctggcgccaggcgagcgtga

SEQ ID NO: 14271 - DNA, 987 bp, Pseudomonas aeruginosa
cttggaaccggtcttgcggccaggcctcgccggcgccctgaaggtgccgggcgacggcatcctctacgcgcccaacgcggcgcgctggctgctcgaacgagccggcccgcgcctgcgtcgattgcacgccgaagtcagcgaagtggacggcagccgcctgcgcctggccgacggccgctggctgagcgccgaggcgctggtgctggccaacggcatccatgccggcgagctgtgcgcggagctgccgatccgcccgaagaaaggccacctgctgatcaccgaccgctatcccggcaccctccgccatcaactggtggaactcggctatgtcagcagcgcccacgccagcagcggtacctcggtagccttcaacgcccagccgcgccccaccgggcaggtcttcctcggctcctcgcggcagttcgacacgctcgacccgcaggtggaaggcccggtgctggcgcgcatgctgcggcgtgccctggactacctgccggggctcgccggcctcaatgcgatccgtgcctggaccggcttccgcgctgccactccggacggcctgccgctgcttggcgagcacccggcgcagccgggcctgtggctggcggtcggccacgagggcctgggcgtgaccaccgcgccgggcagcgcgcgcctgctcgccgcccagttgttcggcgaaacgccgccgctggatgccacgccttatctgccgcaacgcttcctctccagctccgggagtgcccggccatgatcgaactgttcatcgaccggcgtccgctgcgggtcgccgtcggcaccagcgtggcggccgccctcgccctcggcggcgacggctgctcccgcagcgcggtcggcggcgggcggcgcgcgccgttctgcggcatgggcgcgtgccaggaatgccgggtattgatcgacggtcggcgacgcctggcctgccagaccgtctgccaatccggcatgcgcgtggagacccaggcatga

SEQ ID NO: 14272 - DNA, 1992 bp, Pseudomonas aeruginosa
tcgtcggtgccggccccgccggcctggccgcagcgctggccgccgcgccgagcggcgcgcgcatcgccctggtcgacgacaacccggcccccggcggacagatctggcgcgacggcccgcgtgccagcctgccgccgcgtgcccatcagatgcgccaacgcctggccgggcaggccaatgtcgagcacttcccggcgacccgggtggtcgcctgcggtcccggcaggcgcctgttgctggaagacccgcaacgtggctggcaggtcggctaccgacgcctggtcctctgcaccggcgcccgcgaactgctgctgccttttcccggctggaccctccccggcgtcaccggcgccggcggcctgcaggcgttggccaagggcggcctgccactggccggccagcgcctggtggtggctggctccggcccgctgctgctggccagcgccgccagcgccagccagtgcggggcgcgcctgctgcgcgtcgccgaacaggcgccggcgagaaccctggccgccttcgccgtacgcctcccgcgctggcccggcaagctgtggcaggccgccggcctgttcgcccgtagctaccgcgccgacagctacgtgctcgccgccctcggcgaggagcgcctggaagccgtgcgcctgcgcgaaggcggtcgggtccgcgagatcgcctgcgaacgcctggcctgcggcttcggcctggtgcccaacgtgcaactcggccaggccctcggctatcgcctcgacggcccggcgctcgccgtcgacgaatggcaggccggcagcctgcccgaccactacgccgccggcgaatgcaccggcttcggcggcagcgaactggccctggtggaaggcgccatcgccggccatgccgccgtcgacgagcgcgacgcggctcgccgcatgtggccacgacggcgacgctggcagggcttcgcagacaccctggcgcgacacttcgccctgcgtgccgaactgcgtcaactggcggaggcggataccctggtctgccgttgcgaagacgtccccttggccgcgctggccgggcatgccggctggaccgaggccaagctgcacagccgttgcggcatgggcgcctgccaggggcggatatgcggcagcgccgcgcaattcctgttcggctggacgcctccggcgccgcgtccgccgttcagcccggcgcgcctggagaccctggcccgctggcagggcgacgccggctagcgacgctcggcgcgattcagccagccgaggccggccagcgacagcagcagaccacccagcagcatgggtgtcagcggctcggcgaacatccagtgcgcccatagcagggtcagcgccgggctcaggtacagcgccgcgctgccaccctgtgcggaaagatggcgcaggcccagccagtacaggccgtagccgccgaaggtgggcagcagcaccagccaggcgagcccgaacaggaatccgccggacagcggcggccgcatgctaccctccgccagcgccaggccggcgaacgccggcagcgcggcgccgatctgcacgaacagcaccacggccagcgatcccggcgcatcgtcccagcgcttctgcaacagggtggccagggccagcgctagcatgcccagcagcggcaggccgtaggcccagcccggcgcccgccccagcgccagcgccgcatgcccggcccagagcaccccggcgacgcccagggcgatccccggccactgccccggccgcgttcgctgccccggcaggaccaacgccagcaaggccaccagcagcggcaacaggtcggccatcagcgccgccacgcccggcgagacgccgagttcgatggccttggcgatcggcgcgatgtagcccgcgtaggccaacgccccgatcagcgcctggcgccgccactggcgcgccgacaaccggcgcagcccggcccaggcgaagggcagcagcagcgccaggcaaacggcgaagcgccagaagctggtga

SEQ ID NO: 14273 - DNA, 1125 bp, Pseudomonas aeruginosa
ggaacaccggcgcctgttccatggcatagcggtagccgacgaagccggaactccaggccagtaccatgcccagttgcacggccagcaggcgggtcgccccgggcatcgctcgcggggtgcaggtggtcgcgcgcatcgctcgcctccgtcggtcaggttcgagtcgaggctaggcggcctccgccgctactatcaaacgaaactatctgcaccagtcatgcaggaaatcggaaccatgagcgccaacctggatatcgagctgctgcgtaccttccatgccatcctgcgcttcggccgctttctcgccgcggccagccacctcaaccgcagcccctcggcggtgagcacccacgtccggcgcctggaggaactggccggcggccggctgttcgagcgcgacaaccagtcggtgcggctgaccccgctggggcagcggttccagcgccagaccgccgagctgctggagacccacgaccgcgtgctcgccgggttgcgcagacgggaagagccgctgcgcgtgcgcttcggcatttccgaggaatacgccggcaagctgctcggccgcctcctgccacgcctcggcgcggaactgccggcgctggagctggaggtgctcaccgacgccagcggcaggctggccggacgcctgcggcgcggccagctggacctcgccctgctggtgcaagcgcaagacgaaaccccgtacgacgggcactcccgcgagatcggcggcacccagccggtgtgggtcgccggccacggcctgcggatcgatccgcaacgcccgctgccgctggccctgcacggccagggttgtccctatcgacaggcgctgctggaagccctcggcgcgacgggccggcgctggcgcacggtggtcagcagtcccggcgcggcggcgctggaagcggccatcgaaggcggcctggcgatcggcgtgatcgaccgtgcgcgggtcggcccgacgatgcgcgtgctggggccggcggagggcttcgccgaactgcccgcccaccgcattcgcctggccttcgccccgggagagcggccgccggcgctggagcgcctcggcgaactgatcgccgaggagttccggctctgagccgctacagcgccgggcgctag

SEQ ID NO: 14274 - DNA, 1167 bp, Pseudomonas aeruginosa
acccgcaggcggtggccgtctgtcagtttccggcagcagtcgctcactgcgcggcgatgctttcccgttcacgccactcgcgcagcaacgcctggcgccggcgccgccctcgatgtgcgcgccctgctgtcgcaggatggcgatatcgcggtagagggtgcgcaggctgatccccagttcgccggcgagcacatgcccagccaccgggtaacggtgccggcgcagaatctgcagcaggtcgagcaggcgctggctacgggacagggcgccgactcacagttgctccaggcagtcgcgggcgtggtcgtcgagggggacgaagaccagcaggcgatcgccgttcttcggcgccgaccaccagttggtctgctgcagttcgaattcgccgcagcgcgcatgacggaagcgcttgagctggttttcgatacccatcacctcgttgcgccgccagatctcgcggaactccgccgaagcctccaggcagcgctgcaactgccgctcccacagcggatcgcccatgcgctcgaccattgccgcgcggaagaagccgaccatccgcggcaacgcctcctcgcggttggccatgcagtagcgccagcgctcgtgggtcagcgccaggtagatgcagttgcggtcttcctcggggatctccgccaggtcgatgcccaccagccggcaataggcgcggttgtagccgcggatgtcgaaacgggcgttctgcaccatggccggcaacgggtcgagggcatcgaggatggcctgggtggcggccgagggcttctcgcagaccgcccgccgcgccgaggtcggcgcggccagcccggcgaggttgaacaggtggtgggtttccgtctcgttgcacagcagggcccgggcgatggctccgatcacctgctccgaagcgcgtaccgcgcggccctgctccagccaggtgtaccaggtcacgccgaccccggcgagctgcgccacctcctcgcgacgcaggcccggcgtgcgtcggcggccgaggcgggaaatgccgacccgctgcggctcgatgctttcccgccggcggcgcaggaaggcccccagctgttcggcgcgggacggctgcgcggggctttccgcagcgtggctggcaggggcgtcgaggggcatggcgaagtcctccgaagggcagacgggtag

SEQ ID NO: 14275 - DNA, 1287 bp, Pseudomonas aeruginosa
tcgtcgccgtctacggcgtggccttcgcgcgtgtgcctggcgatgggcggccggcttggcgacaattacggccgtcgccgcctgttcgatctcggcgtcgctctgttcgccgtcgcattgttgctttgcgggctggccggttcggtctggctgctgttggtggcgcgcgccatacagggcgtcggcgcggcgctggtcgtgccgcagattctcgccaccctgcatgtcagcctcagcggccacgcgcattcccgcgcgctggccgcctacggcgccatcggcggcctggccttcgtcgtcggccaggtgctcggcggcttcctggtctccgccgacatcggcggcctcggctggcgcagcgtgttcctgatcaacctgccgatctgcctcggcattctcctttgcagccgccgctgggtaccggaaacccgcgccgagcatgccgcccgcatcgacgcgccgggcaccctgctgctcgccgcgctgatcctctgcctgctgctgccgttggctctcggcccatcgctgcactggtcctggccctgcgccctgctgctggcggcggcggtgccgctgctggcctggctgtggcgcaccgagctgcgccaggaacgccgccaggcctggccgttgctgccgccgtcgctgctgcgcctgccgagcatccgcttcggcctgttgctggcgatcctgttcttcgcctgctggagcggcttcttgttcgccctcgccctggccctgcaggccggcgccggtctctcgccggtacaggccggcaatgccttcatcgccctcggcgcctcctacttcgtctcggcgctgctcaccgccagggtggcggcgcggctcggcccggtacgcctgctgctgctcggctgcgtcatccagatgtgcggcctgctcggcctgatgctgaccctgcaacgggtctggccgcagccgggcatcctcaacctggcgccggcgaccctggtgatcggcttcggccaggcgttcatcgtcagcagcttcttccgcatcggcctctcggaggtgccggccgcccaggccggcgccggcagcgccatgctcgccaccgtccagcaggcctccctcggcctcggctcggcgctgctcggcgcggtgttcgcgcacaggctggagcgccatggcgactacctggaagcgacgcagacgaccctggccgtcgagttcgtcctgatgacgctgctgctcggcgccacctgcctcttctacctgcgccgcgtgcgcacggtgccattgcgctgcgattcgccgggcaactga

SEQ ID NO: 14276 - DNA, 588 bp, Pseudomonas aeruginosa
tcgagacgccctattcccgaccgcatcccggcgctggtgtcgggtcgcgccgacgtgatcgtcgcatccacctcggacaccctggagcgggccaagaccatcggcatgagcatcccctacttcgccttcgtcaaggtggtactgacccgcgaggacaccggcatcgccagctacgaggacctcaagggccgcccggtcggcggcaccgccggcaccttcgaagcgctggccctggagaaggacagcagggcctggggcgacgccaaaggcagcttccgcgcctaccattccgaggccgacaccgccctggcgatcagccaggggcatatcgacgccacggtcgtctcttccaccgtcgccgcctcgtggatcaagtcgggcaagtacaagggcctgaagatcgccggcgacgcgccctatgacatcgactacgtggccctcggcgccaagcgcaacgaatacggcctgctcaactacctgaacctgttcatcaaccagcaggtgcgcaccggccgctacgccgagctggcgcagaaatgggtcggcggcacggcgccggagctgaccaccagcgcggtctaccgctga

SEQ ID NO: 14277 - DNA, 1299 bp, Pseudomonas aeruginosa
agccgagggcgcggtccgccgccgggccgcgccgtttccccccgtcctggatgcgccgatgaagcacgcacacctcatcgttccccgtaccctggtcgccggcagcgcgtccggcgaactgctgtacgcaccgaccggcctgagcttctggggcggcgtcgacccgcgcagcgcggaagtgatcgaccgtcaccacccgctcagcggccgccatctacacggcaggctgctggcgattcccggtgggcgcggctcctgtaccggcagcagcgtactgctggaactgatcctcggcggacgtgcgccggcggcgatcctcctgcgcgaaccggacgaaatcctcgccctcggcgcgatcgtcgccgaggaactgttcggccgctcgctacccatcgcctgtctcggcgagcgcttcgacgaactcgccgcctatccctgggcgcgcctggccgacggacgcctggaactccaccgcgatgccccgccgccgctggagacccgacccgccgaagcgctggcgaccgatgccggcccacgactggacgccttcgaccaggccctgctcgccggcgaacacggcgaagccgcacgcctggcgatgcgcatcgtcctgcgcatggcggcgttgcagggcgcgcaacggctgatcgacatccagcgcgcgcacatcgacgcttgcatctacaccggcccggccggcctgcgcttcgccgaaaccctgcgcgacctcggtgcccgggtacgggtaccgaccaccctcaacaccatctccgtggaccagcgccgttggcgcgaacagggcgtacccgccgccctcggcgagccagccgcggccctggcccaggcctatctcgacatgggcgcgcagcccagcttcacctgcgcgccctacctgctcgacaacagcgcgcgggccggcgaacagatcgtctgggccgagtccaacgcggtgctcttcgccaacagcgtgctcggcgcacgcaccaacaagtacgccgacttcatggatatctgctgcgccctcaccggtcgcgcgccgctggccggctgccacctcgacgagcagcgccaggcgcgggtactgatcgaagtggaagacctcggcagcgtcgacgatgccttctacccgaccctcggctacctctgcggcctgctctgcgacgggcagatcccggcgatcgacggcctgcggcagcggcagccggaccacgacgcgctcaaggccttcggcgcggcgctgggcaccagttcctcggtgccgatgttccacgtcatcggcgtcaccccggaagcccctga

SEQ ID NO: 14278 - DNA, 1167 bp, Pseudomonas aeruginosa
cctggccagcgccttcggcggccgcgcgccgcggcggaccctgcgggtcggacgcgagcgcctgcgcgacgcctggcgcgagctggacagcgccggcgagacgcggatcgacctggtggcgctgggcaacccgcacttctccgccagcgaattcgcccagctcgccgcgctctgccacggccgccgcagacacccggaggtagcgctggtgatcaccagcagccggcaggtcgtcgcccaggccgaagcggccgggcacctggcgacgctgcaggcgttcggcgcgcggctggtcaccgacacctgctggtgcatgctcgacgaaccgctggtgccgccgggcgcgcgcaccctgatgaccaactccgccaagtatgcccactacgcccccggactggtcggccgccaggtgcgcttcgccggcctcgccggctgcgtcgaggccgccgtcggcgggcgggcccccgccgggctgcccgcctggttgagcgaggactgctgatgttcgactacaccttccactggcgctcggcgttcaacgccctgccggagatgctcgccggcagcctggtgacgctccaggtcaccgcgctgtcgatgctcttcggcatcctcatcgccctgctcctggccttcgcccggctcggcggtaaccgcccgctgcgcgccgccgccggagcctggatctccatcgcgcggaataccccggcgctgttccagatctacatcctctacttcggcctgggctccttcggcctgcacgtcagttcctggttcgccctgctcgccggggtcaccttcaacaacgccggctacctcgccgagaccttccgcggcggcctccaggcggtgcccgagacccagttgcgggcggcccgctcgctgggcatgagcgcgccgcaggcctatcgcctggtggtgatcccgcagctgctgcgggtggtgttctacccgctgaccaaccagttggtctgggccatgctgatgacctccctcggcgtggtggtgggcctgaccgacgacctcaccggcgtcacccaagcactcaacgtcaagaccttccgcaccttcgaatacttcgccctggccgccgtcctctacttcgccatggccaagctgctggtgctggccgcccgcctgctgggctggcgcctgttccgttactga

SEQ ID NO: 14279 - DNA, 1374 bp, Pseudomonas aeruginosa
ggggaatgccgtgttcaccaccagcctcaccgccaacgacctgctgttcctcctgcaaggcgcctggaccaccctcgccatcaccgccatggcgatgctgatcggcaccctgctgggtgtcgtcttcggcctgctccgcgccctgctgccacgcgccagcctgccgctggcggcgctgctcgacgtattccgcagcgtgccgctgctgatccagttcgtcctgctcaattccttcaagagcatcctcggcctcgactggagcgccttcgccgtggcctgcctggtgctcggcgtgtacgccgccgcctactgcgccgaggtggtccgcggcggcgtcctctcggtaccgccgagcgtgcgccgggccgcgcgttcgctgggcctgagctatcgccaggacctgttccacatcgtcctgccgatggccgcccgggtggccttccccggttgggtcaacctgaccctgtcggtgatgaaggacacctcgctggtgctctggatcggcatcgtcgaactgctgcgcgcctcgcagaccatcgtcacgcgcatccaggaaccactcttcgtgctctgcatcgcggggctcgtctattacctcatgagctgggtggtcgcgcgactcggcgcccggctggaacggagatggcagcaatgatcgagatcagcggcgtgcacaaggcctacggccagttcgaggtggtcaagggcgtcgacctgagggtggacaagggcgaggtgctgtcgatcatcggcggctccggttccggcaagtcgaccctgctgatgtgcatcaacggcctggagccgatccagcgcggcagcatccgcgtcgacggcatcgacgtgcatgcccgcggtaccgacctcaaccgcctgcggcggaagatcggcatcgtcttccagcagtggaacgccttcccccacctgaccgtgctggaaaacgtcatgctcgcgccgcgcaaggtgctcggcaagagccgcgccgaagccgaggcgatggcgctgaagcaactcacccacgtcggtctcggcgacaagctcaaggtcttcccccagcgcctttccggcggccagcaacagcgcatggcgatcgcccgggcgctggcgatgtcgccggaatacatgctgttcgacgaagccacctcggcgctcgacccgcagttggtcggcgaggtggtggacaccatgcgcatgctcgccgaggaaggcatgaccatggtcctggtcacccacgagatccgcttcgcccgcgacgtgtccgaccgggtggcgttcttccgcaatggcctggtccacgagatcggcacccccgaccaggtgatcggcaacccgcagcggccggagacggtggaattcctccgctcggtgctctga

SEQ ID NO: 14280 - DNA, 3801 bp, Pseudomonas aeruginosa
gcccgcccccgcacaggagatagccatgcgttcgcagcggatcgtccacatcgtcagttgccatgccgaaggcgaggtcggcgacgtgatcgtcggcggcgtcgccgcgccgcccggcgccaccctctgggaacagtcgcgctggatcgccagagaccaggacctgcgcaacttcgtcctcaacgaaccgcgcggcggagtgttccgccacgccaatctgctggtgccggccaaggacccgcgcgcgcagatgggctggatcatcatggagccggccgacaccccgccgatgtccggttccaattcgctgtgcgtggccaccgtactgctcgacagcggcatcctgccgatgcgcgaaccgctgacccggctgctgctggaagcgccgggcgggctgatcgaggcccgcgcggaatgccgcgacggcaaggccgagcgggtggaaatccgcaacgtgccgtcgttcgccgaccgcctcgacgcctggatcgaagtcgagggcctcggctcgctacaggtcgacaccgcctacggcggcgacagcttcgtcatcgccgacgcccggcgcctgggcttcgccctgcgcgccgacgaggccgccgagctggtcgccaccggcttgaagatcacccacgcggccaacgaacaactgggcttccgccacccgaccaacccggactgggaccatctatccttctgccagctggccgcgccgccggagcgccgcgacggtgtcctcggcgcgagcaacgcggtggtcatccgccccggcaagatcgaccgctcgccctgcggcaccggctgctcggcgcggatggcggtgctccaggcgaaaggccagctgcgggtcggcgaacgcttcgtcgggcgctccatcatcggttcggaattccactgccacatcgagtcgctgaccgaactcggcggccgttcggcgatcctcccgtgcctgtccgggcgggcctggatcaccggcatccaccagtacctgctcgccccggacgatccctggccgcaaggctatcggctgtccgacacctggcccggcggccactgctgaccaccccgcccgaccgcaggcagcggccgggcggaaaccgatccggcgcgtaccggatcgcccacgacggcgaacgctgccgtcgccctgtgactcggaccgcagcggtccgattgaattcgtatacgaaatacgaaaaaaggagaaaccatgagcaagcacgtcaactggagcggcgtattccccgcggtcaccacccaattcaacgccgatttctcggtgaacctggaggaaacccacacggtcatctccaacctggtgcgcgacggcgtgtccgggctggtggtatgcggcagcgtcggcgagaacacctcgctgaccatcgaggagaagatggccgtcacggaggtcgccaaggatgcctccggcggccgcgtgccggtgatctgcgggatcgccgagttcaccagcgccggcgcggcgaaggtggccaaggcggtggagcgggtcggcgtcgacggcatcatggtgatgccggcgctggtctattcctccaagccgcacgagaccgccgagcatttccgcagcgtggccagcggcaccgacctgccggtgatggtctacaacaacccgccgatctaccggaacgacgtcaccccggacatcctggtttccctggccgactgcgagaacatcgtctgcttcaaggacagctccggcgacacccgccgcttcatcgacgtacgcaaccaggtgggcgagcgcttcatcctcttcgccgggctcgacgacgtggtcctggaaagcgtggcggtgggtgcccagggctggatctcgggaatgtccaacgtgttcccgaaggaaggcgagaccatcttccgcctggccagggccgggcgcttcgccgaggcgatgccgatctacgagtggctgatgccgatcctccatctcgacgcccgtcccgacctggtgcagtgcatcaagctctgcgagcaactcgccggtcgcggcagcgccctcacccgtccaccgcgcctggccctgcgcggcgccgatcgcgagcacgtcgagcggatcatggccaaggccctggccagccggccggcgctgccggacatcggcttgtagccgacgccccgccctcgccgcctcgctccccggggagcggccggcgagggccagcggcagagcattccgtccaccgtccccagggaggccccatgcccagcatcctcggtcacaactacgtcggcggcgctcgcagcgccgccggcaacctcatcctgcgcagcctcgacgccgacagcggcgaagcgctgccctacgccttcgtccaggccaccgaggcggaggtcgacgccgccgcccgcgccgccgaacgcgcctatccacactaccggcaactgtccgcaacgcgccgcgccggattcctcgaggcgatcgcctcgcgcctcgacgccctgggcgacgacttcgtcgccctggtccgtcgcgagaccgcgctgcccgccgcacgcatccagggcgaacgaacacgtaccgccaaccagttgcggctgttcgccgaagtcctgcggcgtggcgacttccacggcgcgcgcatcgatcgaggacaacccgggcgtaccccgccgcgccccgacctgcgccagtggcgaatcggtctcggcccggtggcggtgttcggtgccagcaacttcccgctggccttttccaccgccggcggcgacagcgccgccgccctggccgccggctgtccggtggtggtcaaggcccacggcggacacatggccacagccgaatgcgtggccgacgcgatcctccaggcggcggccgacagcggcatgccggccggggtattcaacatggtctacggcagcggcgtcggcgaggcgctggtgcgccatccggccatccgcgcggtcggcttcaccggttcgctcaagggcgggcgcgcactgtgcgacctggcagcggcgcggccgcagccgatcccggtgttcgccgagatgagcagcatcaatccgctggtggtgctccccgaagccctgcgccggcgcggccggcaggtggcggaggagctggccgcctcggtgacgctcggctgcggccagttctgcaccaagccgggcctggtgcttggcctgcgctcccccggcttcgacgccttcgtcgcggccctgggcgaggcactggccgccaggccggcacagagcatgctcaacgccggcaccttgcgcagctatgtcgaaggactgcaacgcctggagcgccaccccggcatccggcgcctggccggcgcgccacaggaagggcggcaggcccatccgcagttgttcaaggccgacgtgggcctgttgctggaaggcgacgaactgctccaggaagaggtgtttggcccggccaccgtggtcgtcgaggcggccgacgaggaacagcttgcccgcgcgctggacaacctgcacggccagttgtcggcgaccctgatcggcgaagcggacgacctcgcggcgttcgccgggctggtcccgctgctcgaacgcaaggccgggcgcctgctattcaacggctatccgaccggcgtcgaggtgtgcgacgccatggtccacggcggcccctacccggccacctccgacgctcgcggcacctcggtgggaaccctggccatcgagcgtttcctgcgcccgctgtgctaccaggactaccccgacagcctgctcccggacgccctgaagaacgccaacccgctgggcctgctgcgcctggtcgatggccggagcacgcgcgaggcgctggattga

SEQ ID NO: 14281 - DNA, 1179 bp, Pseudomonas aeruginosa
  unsure (151),(152),(154),(157),(162): Identity of nucleotide at the above locations are unknown.
ccacacctcggttgccggcgatgcgaccagcgccgttgtcgacttagtcggcgtcgagggccagcgcgccccgagtcgtcagctctcccccgttccgcaccagcgccccgagtgtggcacgcagatcatccttggcgacgatactcccctnngnctngttcncggcctcggcacagacgtggctcagttaccctgcggcatctcgccgcgcgccaggcgtgcattgatgtcgcggaccaccgccggcagctcggcgatggtctcgatcaggtagtgcggacgcgaaccttcgaacatctgttcgatacgcgtccgctcgcgctccagttcggccgccggcagcgccttgtactgctcgtaggtgaggcccagggcattgcccgagcaggtcagcgccaccgtccacatcccggcgcggcgcccttcgaggatacccggccaggtgtcgtcgaccttcacgcaggccgccacatcgtcgatccccagggcgatcacgttggccagcgcctgggccggccatggccggccgttgggcacttcgtcggtggccaccacgtggtcggcgacgtaaccgttggtctcggccagggctaccaccttctccatcaccaccgccggataaccggaacaggaaccgatcttcaggcccatcccgcggagttcggcgatcgcctgcagggcgccggggatcagcgccgaatgttcggcgatcttttcgatctgcagcggcatgaagcgctcgtagatggcggtgacatcgtcgtcgctgggcaggcggccgaagacggcgcggtagcgctcggcgatcgccgggatgtcgcagagggtgcggatgtggtcccacttgcccattcccatcggaccgcgcgcttcctccaggctgacctggacgccgaattcggcgaaagcctcgacgaagatctgggtcggcgcgaaggagccgaaatcgaccacggttcccgcccagtcgaggatggcggcctggagggtggctggctggttgtaattcattgtcgtgaacccttttctgctcgttgtcgttcagttcagatctcgaggacttccagttcgcgcagcgcctcgccgatggcggcgaccgcctgccgcatctccgcggcgtcgacgtggccgatgcagccgacgcggaaggtttccacctgggtcaacttgcccggatag

SEQ ID NO: 14282 - DNA, 1260 bp, Pseudomonas aeruginosa
cgaactggccgaccaggccgggttgcgcgagaccctgttcgaggagatcaggggacgcatccgcgagaccgacctgtcgttgcccaatccgtggggtccgtggctgtactaccagcgcaccaccgccggcgacgaatacccgcgccactaccgctgcccgcgtccggcggacggcagcctggaggtcgacgaaggcgccgagcaactgttgctcgatcccaaccagttggccgacggcggcttcctctccctcggcgccttcagcatcagccccgaccagagcctgctggcctacagcctggacaccagcggcgacgagatctaccgcctgttcgtcaaggacctcgccagcggcgcggtgcaggccctgcccttcgacgactgcgacggcagcctgacctgggccaacgacaaccgcacgctgttcttcggcgaactggacgacacccaccgcccgcacaagctctatcgccaccgcctgggcgaggccggcgccgagctggtgttcgaggaaggcgacgggcgcttcttcctgcactgctaccgctccagctcggaacgccagctgatcctcctgctcaacagcaagaccaccagcgaggcctgggtgctcgacgccgaccagccgcagggaacgttccgttgcctggcgccgcgcgaggaaggccacgagtactaccccgaccacggtcgcctcgacggccggggcctgtggctgatccgcagcaaccaggcggggatcaacttcgccctctaccaggccgaggagtcgcggccgactcgcgagcactggcaactgcgcgtggcccacgacccgcagcggaccctggaagatgtcagcctgaacgccgaggcggtgatcctcggcctgcgcgacggcggcctgccggtgatcgaggtgcaaccgcagggcctgccggcctaccgcgtgcagttgccggacgccgcctacagcctctacgtgcaggacagcctggaattcgacagcccctgcgtgcgactgcgctacgaggccctgaatcgtccggcgcaggtacgccagctgaacctcgccgatggcacgcagaccgtcctcaagcagaccccggtggaaggccccttcgacgccgacgcctacgccagccggcgcatctgggccagcagcggcgacggcacgcaggtgccggtcagcctggtggcgcgcaaggaagtcctcgacggcatcgccgccgggcgccccgcgccgctctatctctatggctacggcgcctacgggcatag

SEQ ID NO: 14283 - DNA, 396 bp, Pseudomonas aeruginosa
ccacgaagaacacctcgcctttcttcaacagcacgtcgcgggtgcgctcggcgtaacgcacctgcacctgggtatcgacgtcgaggaacagcttcgatccgtccgccaggaccacctcgcgctgctcgccaggtgccgtgccgtaggcgaggttcggtccgagcgactggtcgcgccagaacagggtggcgacgagcagcgcgcagaacacgaagaacgccgccgccagcgcccggggcaggcgccaggccggcaccggctcgggaatatcgtccagcgccgggcgcggcaggccgtcgaattcgcgccagagccgctccatgccctcgagcgcttcgcgatggcgcggatcggcgcgtagccaatcctccagctcggcccggcaggcagcgctga

SEQ ID NO: 14284 - DNA, 1305 bp, Pseudomonas aeruginosa
tctagtcccccgccccctccaggccaagcaccggccggcacatggctacttcaggtaggaacgcagcgcggtcaccaccagttccaggtcttcgcgacgctgctccgcgctcgcctgctcggcgccgaggtgttcgcggatgtgcccctccagcacttcgttcatcaggccgttcaccgcaccgcggatcgccgcgatctgttgcagcaccgccgcgcattcgctgccctcttccagcgcctgctccagcgcccgggtctgcccggcgatgcggcgcacccgcgccaggagcttcttcttcccatggatggtatgggccaccgctctctcctcaaggtaatatactggggtatagtatattttcgacgtctcgacaggacagtagcaaatgcccggcaccccgactacccagcccctgcgccattcccatcggttcgaccagggcaacccgctggccgagcgcaacacgcgctgggcggtattgctcaccgcctgcatgatggtcgcggaaatcgccggcggctggctgttcaactccatggccctgctcgccgacggctggcacatgagctcccatgccctggccctgggtcttgcggtactcgcctacggcgccgcgcggcgctatgccaacgacccgcgcttcagcttcggtacgtggaagatcgaggtgctcggcagctacaccagcgccctgctgcttctgctggtggccgggctgatgctctaccaatcggtcgaacgcctgctcgaccccagcccgatccactaccagcaggcgatgctggtcgccgcgctcggcctgctggtcaatctcgcctgcgcctggctgctgcgcgacggcatgcccaccacgggcacggccactcgcaccaccaccaccaccaccaccaccacgaccatcatgccgcaccggcacgatctgaatcttgcgcgccgcctaactgcacgtgctggcggatgccccccaccctggctgctgggcgatcttctcgctggccggcggcctgcctgttgaacgcggccctggctggacccgctgatgggtatcgtcggggcggtactggtcagtgtttgggcatgcggcctgatccggcagagcagccgggtattgctggatgcgcagatggacgcgccggtggctgcggaaatccgcgcggggatcgccagcagcccgctgccggcggaactgctcgacctgcacctgtggcaggtcggccagggcaagtacgcctgcctgctgagtctgctgaccaccgaggaaggcagcgccgactatttcaagcgccgcctggccgagcatga

SEQ ID NO: 14285 - DNA, 1494 bp, Pseudomonas aeruginosa
ggaactggtgcacatcaccgtcgaggtgaacccgctgctcccgctcgccgcctgagggaacgcggctcagtagccgcgagcgaagtccacctcgccgcgcatggcggtacccgcccagaagcgcgcgaggttgtcgcggaacagttcgaccatcgcccccggcagggtcggcgcggcggtgtgcccggtcagcaagaggcgcggggtatgccagaacaggtggttggccggcagcggctcttcgcggcagacgtcgatcaccgcgccggccagttggttgttctccagtgccgccaccaggtcggcgtccaccaccgcgacaccacgcccggcattgataaacagcgccgtgggcttgagccgggcgaacagcgcacggtcgtagatgtcgtgggtatcgggggtgtcgggcagcaggttgatcaggtagtcggccgtctccaccaggcgaccgaggtcgtcgagcgaccccatgcggttgaacggcaccagcgaacgcggattcttcgccaccccggtcaggtccatgccgaagccggacagggtatgcgccaccgcctggccgatctccccggtgcccacgatcaccacctgccggccacgcaacccgccaggcgtgcggctatcccattgcgaaccgacctggctggccaggcgaccgaggaactggcgctcgtgggcgagcatataggtcagcaggtattcgctcatcacctggccgaagatgcctaccgcgcgtgtcaggctgtagtccttcggcaggtcggcggccagcagcggcgtgatgcccgcccaggtcgactgcacccagaccggatgcacgccctggcgcagcatctgcgccaccaggtcgggctggccgagccagatcgagcactcgctggcggcgtcgatgagttgcaggggatcgtcccccgccaccaccttcaggctggggtcggccgccatcagcagcgcggcatagagagcgtggtcacgttcgagaatcagcaagcgcatgggtcacactgccaagccggacaagggctggcgatcaggccggagaatattgttctttcatgcatcacggctcctggagggaagccctcgagagcagcaggtttggcgctggtagaccacggtcgctgccaggggttccgctatcgtgcgacatcttgcggacatcatgcaccgaaggcgcaaccttgcacagagcgggtttcacgtcgtgaaagtggcgccgggaagccggcgccagcggggtacggctcgcgtcagagcgggtcgttcatgcgcagcaactcttccgggagatgctcgatgtactcttcttcgcccggcggcatctgcaagtggaagccctgcttctcgatgttctccaggaccttggcgacatcctcgcgggccagttggcgctcgggggtgagcagcaggtcgaagacatgttgcggcgcgccgaacggcaccagcagggcctcgggcacgcggctcaacgcctcgcgcttgtcgacatag

SEQ ID NO: 14286 - DNA, 1479 bp, Pseudomonas aeruginosa
aaggtatcgacgcgcatgaactcggtatcgagcgcgaggtacggctgtgtgcgccattcccggcattgctgcgccaggctggcatcatcgcggatccactggatttcgggcgcggtcacgaacatctccttggtcaagtgcggcgcattatatagagcctggcgccatgcgagcattccgctcggcaccgcgcttgccgatgagcgtagcgaatgtccatactccgccctttgtccgacaatccgaacaagggaactgcatgaagaagctcagcggaataatcgtcctcctgctggctggcgcggctctttacctggccctgaagaccagcccgatcgacccgctcgcctgggatgctccggccgctccgcagatgaccggggtcctcgaacccaacgacaccctgatgaaggccgagctgcttggccagggccagttgcacggccccgaggacaccgccgtggacagccagggccgcgtctatgccggtctcgccgacggccgcgtggtacgcctggacgccagcggcaaggtcgagaccttcgtcgacaccggcggccgcccgctgggcatggacttcgatgccgccggcaacctgatcctcgccgacgcctggaaaggcctgctgcgcatcgatccgcagggcaaggtggaaatcctcgccaccgaggccgacggtgtccccttcgccttcaccgacgacctcgacatcgccagcgacggccgcatctacttcagcgacgcttccagcaagttccaccagcccgactacatcctcgacctgctcgaggcccgaccgcacggccgcctgctgcgctacgacccgtccaccggcaagaccgaggtgctgctcaaggacctgtacttcgccaatggcgtggcactctcggcaaacgaggacttcgtactggtcaacgagacctaccgctatcgcatcacccgctactggctgaaaggcgagaaggctggccagcacgaggtgttcatcgacaacctgccgggcttgccggacaacctccagggcgaccgcaagggtaccttctgggtggccctgccgaccccgcgcaaggccgacgccgacttcctccaccggcatccctggctgaaggcgcagctggccaagctgccgcgcatgttcctgcccaagccgaccgcctacgggctggtcatcgccatcgacgaacagggcaggatcgtccgcagcctgcacgacaccagcggccaccacctgcgcatgatcacctcggcgaagccggtgggcgaccagctctacttcggcagcctggaaaacgatcggatcggccgtctggcgattccctgaaaaagccgaggcgaaaaaaagcccggcgcaagcgtcgggccaagccaatcggacaagcgtcccgagggatagaacacaggagcgggtatctcggaacgagccgattctgcatgtctggacaaatcccccgctgccgggcgaggctgatgaccgagtag

SEQ ID NO: 14287 - DNA, 411 bp, Pseudomonas aeruginosa
gaatcttcctcgcctggagccagccctttcctttcgccatttctccgcctcgccgcgcgacgccgggatgacgcgacgcggtccaaggggcatgatccacccatccgccaccggctttgcttcccgacccaaggagtccgcgatgtcgtccgcccaactgctgaccgcgcaacaactggcagcccgcctcagcgaacccgacctgctggtcctcgactgccgtttcgccctcgaagacccgtcctacggtgcccgcgtctatcaggagaaccacattcccggcgcgcatttcgccgacctcgaacgggatctttccgctcccgtgcgcaagggcgtgaccggtcgccatccgctgccggatcccgccgagctagcgctcaagctacaagcctggggcctgcgccaggatag

SEQ ID NO: 14288 - DNA, 636 bp, Pseudomonas aeruginosa
ccaggtggtgctctacgacgacggccccggcgcattcgccgcccgcgcctggtggctgttgcattggctgggcaagcgcgatggggtctacctcctcgatggcggcctggcggcctggaaggctgcggggctggcactgaccaatggcgaaagcagtcttcgacccggcgatttccagggccagcccgatgcctcgctgttgatcgacgccgccaccctccaggcccaactgggccaacccgaactggcgctgctcgatgctcgcgcgcagccgcgcttccgtggcgaagtcgagcccatagatccggtcgccggacacattcccggtgcccagtgcgccgccttcaccgacaaccttggcagcgacggccgcttccttccgccggaacaattgcaccagcggttctccgccctgttgcgcggtcgcccggtggacgagctggtcgcctactgcggctccggcgtcaccgcctgccacaacctgttcgccctgagcctcgccggcttcccgcttccgcgcctctacgccggctcgtggagcgagtggatcaccgacccgcgccgcccggtcgccaccggcgactgacgacgccatacgctcggacgcggcttacgccgcgtcgggcagcttcctga

SEQ ID NO: 14289 - DNA, 558 bp, Pseudomonas aeruginosa
gtccgctatcggcggggccatcggaatagaagctgccaaactgcccggccccgccgatccaccttgcgcgaggccgtcatgggtatttccgccaacgatctttgccagcacgtgatacgcccgaccctggactacctgtcctgccacagccccgccgccgaagcgctgctgctgggcgctgcggcctgccagtcggcgctggggagcgccctcgacgaccgccgtggccacggcctgtaccggatcgccagcgaacgccaccagcagctctgggaccagtacctggcgctggacccggagcgcgccagccgggtccgcggcctggccagccagcatgccttcctcgccgcgccgcacctggaactgacggtgaacctgcgctacagcacggccatcgcctggtcgctggtggaagccgcgcgactgccactgcccgaccagcacgaccacctcgcccaggctcgcgtgtggcgccaggtattccagccgcacggtcgcctgcacgagttcatcgacgcctggcaacgctgcatcggcagcctcagccaggtcgcctga

SEQ ID NO: 14290 - DNA, 495 bp, Pseudomonas aeruginosa
acaccacctggaagccgcagacgaagaagcccagcgccagcagccagaacccggaatgcgcgcaggcctcgcgcagcgcttcgccgaggctctgttcatggccctgcggcggcaacgggcgatccttcatcagcccggccagcggcacgatcagcgccaccagcaggcccagggcgagcagggccgaggaccagcccagccagccgatcagggcgagggtaccgggcagcatggcgaactggccgaaggagccggccgcgctggagatacccatcgccatgctgcgctgctccgccggcactgcgcggccgacggcgccgaggatcaccgagaacgaggtgccggaaaggcccaggccgatcagcaggccggcgctcagcgacagcccactggccgactgcgagagtcccatcaggaccaggccgagggcgtacagcaggccccccaccagcaccgcccgcgccgcgccgtagcggtcggcgagcgccccggtga

SEQ ID NO: 14291 - DNA, 606 bp, Pseudomonas aeruginosa
acggctgggccaggccccagaccaggttctgcaaggcgatggcgaaggcgaagacttcgcggccccagccgaagtcggcgctcatcggcgcgaggaacaggccgaagccatgtcgcacgccgagggacagggcgaggatcagggctccggacagcaggatccagaaggcggcacgcggcatgggtcgctccatctacgggtatatacccgctttatcgtgaacgaagcgcctcggcgagaggcttcgtcggttgtcagtccagtcgctccagttccaccagcaacgccgccaaggcgccgctgcgctcctcgccaaggcgcccggcgagacgccgctgcgcgtcttcccaggccggcgttccgcgctccagggcatccagcccggcaggcgtcagctcgaccaggcggttgcgctggtcctcgccaccggtcaggcgcagcaggccgtcgccttccagcacccgcaggttgcgaccgagggtgctgcggtcgagtcccatggcttcggcgagttcggaaatgctcggccggtccaggcgccgcaggtgccgcagcagggaaaactgcgccaccttgaggccggtatcggccagcgcctcgtcgtag

SEQ ID NO: 14292 - DNA, 1881 bp, Pseudomonas aeruginosa
ctcgcgctgtcagcggcgaccgggagcacccggcgccctccatccatcgccgaggtagccatgcccgtttacaaagccccgctgcgcgacacgcgcttcctgctcaacgaagtcttcgatttccccgagcattaccgcaacctggtcaacggagccgaagccacgccggacatggtcgatgcgatcctcggcgaatgcgcgaagctctgcgaggaagtgatcgccccgctctaccacagcggcgacgaggaaggctgccacctggagaacggcgaagtacggacgccgaagggctacaaggaagcctacgaggcctatgtcgccggcggctggcagggcctctcgcacccggtggagtacggtggccagggcctgccgatgagcctcggcgcgctcaagcaggagatgatgggcaccgccaactggccgttctccatgtatcccggcctctccctcggcgcgatgaacaccctgatgcagcacggcaccgaggaacagaagcagacctacctggttccgctcaccgagggccgctggggcggcaccatgtgcctcaccgagccgcagtgcggcaccgatctcggccaggtgaagacccgcgccgaggccaaccccgacggtagctacgccatcagcgggacgaagatattcatctcttccggcgaacacgacctgaccgagaacatcgtccacatcgtcctcgcccgcctgccggacgcaccgaagggcacccgcggcatttccctgttcatcgtgcccaagttccttcccggcgaaggcggcgcgctcggcccgcgcaacggcgtgagttgcggcgcgctggagaagaagatggggatcaaggcctcggccacctgcgtgatgaacttcgacggcgccaccggcttcctcatcggaccgccgaacaagggcctggaatgcatgttcaccttcatgaacagcgcccgcatcggcaccgccatccagggcgtggccaccgccgagctggcctaccagggcgccctcgcctacgcccgcgaacgccgctccatgcgcgcgctctccgggaccaaggaacccgaccaggtcgccgacagcctgatgcaccacggtgacgtgcggcgcatgctgctgacccagaaagccatcgccgaaggcggccgggcgctggtctacctggccacccagtacgccgaccggatgatccagggcatcctcagcaacgacgacgccgaatacgaacgctgggacgacaagctcggcttcctcacgccgatcctcaagggctgcctgaccgaactcggcctggaaagcgccaacctcggcatgcaggtgttcggcggccacggctatatccgcgaacacggcatggagcagatcgtccgcgacgcgcggatcgccaccctctacgaaggcaccaccggcatccaggccctcgacctgctcggccgcaaggtcctgctgatgacccagggcaaggccgtgcgcgacttcaccaggggcgtggcccggttcgccgtcgacctgctgaagaacgagccgcgcatgcgcggccgcgccctggtgctgctcaagctctgcgcccaatggaacctgctgaccctgcgcattgccctcaccgcgcgcaagcaacgcgatctggtgagcaccgccagccacgactacctgatgttctccggctacgccacgctggcctattcctgggccctacaggaagccgctgcgcgccggcgactgcgccagggcggcagcgagtcggcggacttctacaaggccaagatcgccaccagcgagttctacttcgcccgcctgcttccgcgcgccaagggccacgcggcggcaatggcgaagccgacgggttcgatcatggacctgaagagcgagcacttcgccttcgactga

SEQ ID NO: 14293 - DNA, 1530 bp, Pseudomonas aeruginosa
accgttcgccacagaggttatcccatgttccggcagaaccgctggctggtcctggccatcgtctccagcgccctgttcctcatcatcatcgacatgaccgtgctctacacggccctgccgcgcctgacccacgacctcggcgcgacggccgcggagaaactctggatcgtcaacgcctatccgctggtggtcgccggcctgctgcccggcgccggcttgctcagcgaccgccttggccacaagcggctgttcctcgccggcctgccgctgttcggcctggcctcgctgtgcgccgccttcgcccccagcgccgcggcgctgatcgccgcccgcgccgggttggcggtgggcgcggcactgatgatgccggcgaccctgtcgatcgtccgccatgtcttccaggacgaacgcgaacgcgccctggccatcggcatctgggcctccgtcgcctctgccggcgcggcgctggggccggtggtcggcggcgtgctgctggagttcttctggtggggctcggtgttcctcatcaacgtcccggtggtggtcgtcgctttgttgctggcgctgccggccatcccggcctgcggcggccagtcgcggcgcccatgggacgccctcggctcactgcaggtgatgttcggcctggtcggggtggtgtatgcgatcaaggaactcagcacacgcgccccggacttcgggctggtcgtcctcgccgcgctcggcggcatgctctgcctgtacctgttcgtccgccgccagcgccgcgcccgcgaaccgatgatcgacttcgcgctgttccgcaaccggcgcttcgcccgcggcgtcgcggtggccctggtggcgaccatggcgctggtcggcatggaactggtgttcagccagcacctgcaactggtgcaggacctgacgccgctgaaggccggcctgttcgtcctgccgatcccgctggcctcgctggtggtcgggccgctggccggctggctggtgccgcgctggggcgagaaccgggtgatgtgcgcctccctgctgctcggcagcgccggattgctcggcctggccctgtcctaccagtccgtcaccggagcgcaactggccagcctggtgctgctcggcgtcggcttcggcggcgcgatgaccgccgcctccaccgcggtgatgctcaacgtggacgaacagagttccggaatggcggccgccatcgaagacgtgtcctacgaattgggcggggtgatcggcgtgaccctgctcggcagcctgatgagtttcgtctacgggatgtcgctgaggctgccctcggccgagctgccggcgcgggtccgcgacagcctcgacgacgccctgttggtcgccgagggcctggcgccggaggtcgcgtcgcggctcgtcgagcttgcccggcaggctttcgaccaggccttcgtcgccgtgctactggccgccgccgcgctgctcttcctcagcgccatggcggtcctgcgccagccgcgtccggctacagagccagcgccaccagcaccgcacactcggtaa

SEQ ID NO: 14294 - DNA, 369 bp, Pseudomonas aeruginosa
gcgccggccagcgcggcgatctccaggccaccgagacggcggagggtttcgaaggggtcggcgcgatgggcgccgtgcagggccagggcacgctcgatcaccgcggccttgtgcgccacgccgctggcgtccagcccggttcccggcccgaccagcgcgctcgccggcgcatccagcagcgcgcaggccatggccgccgccgcggtggtattgccgatgcccatctcgccgccgatgaacagctggctgccggcctgctcggcgcggcgcacgctttcgcgcccggcctcgagcgccagcaggcactgttcggcgcccatcgccggggcctcgacgaagttcgcggtgcccgccgccaggcgcaggtga

SEQ ID NO: 14295 - DNA, 450 bp, Pseudomonas aeruginosa
tccgtcccggcagctcgccgagacattccagcagcgcctcgcgctcgccgtcgagacgctggggatcgtcgcagagcagcaggttggtcagccacagggtcaggcagtcgaccagcaggcagcgtccggcctcggcctcgctgcgcagcgtcgccgccagcgccagaggctcctccagggttcgccagtgggccgggcggcgcgcgcggtgctcggcgatgcgccggcccatttcgccgtcgccggcctgggcggtggcgatgtagctcaccgccagcccgctctcggcggccaggcgctcggccaggcggctcttgccggaacgggcgccgccaaggatcaggtcacgcatggggttctccgcagagggcgagcaatcgcccggtatccaggtggcgctcgaccaggtcggcgagccgctcgatgtcgcgttcgcgcaaggcctggtag

SEQ ID NO: 14296 - DNA, 1626 bp, Pseudomonas aeruginosa
gcggcggcgtccatgctggtcaccgcgcggccatggatgatcacctgggcgccgatgtcggtgttcggcttgagcagcaccgggttcatgtcggtgtgcggcgccagccggcaggcctgggcctggaccgcctgggcgcggccgatctcgccgccgtcggcggtgaccgcgctgttcagcgccatgttctgcggcttgaacggcaccaccgcgacgccgcgccgggccagccagcggcacagcgcggtcaccagggtgctcttgccggcgtccgaggtggtgccctggaccatcagggtccgcccgcgatcactcatgagcaggctccttgaagccgagcagcgcggcatccagccgggcccaggcggcctcgtcggcgggcaggccgaggcgcaggctggccggctgctcgaactggcgggtgaggatgccgcgccgcgccaggtagtcgtgcaacgccgcgcagcgtggatcgaccaggcgctggaacagcgcgctgccgcccgccggcggccagccgtggcggcgcagcagttcctccaggcgctggctggcggccagcaggcgctcgcgctgctggcgctgttgctggcggtcgcgcaaggcattctgggccacatggcgcaccgggccattgaccgtccacgggccgagctgctcggccagcgcctgcaacagcggccgttcgccgagggcgaagccgagccgcgcaccggccaggccgaagaacttgccgaacgagcgcagcacgatcaatccgggtcggttgatacaggccgccaggctcgactgcggggtgcagtccatgaacgcctcgtcgaccagcagccagccgccgcgacgttgcaggcgggcatgccaggccagcagctcggcgggctcgaagacccgcccggtggggttgttcgggttgaccaccagcagcacgtcgaggctgtcgagatagggctcgacctcggcctcgccgatctcccgcaccaggtgcccggcctggcgccaggcgtgggcgtgctcggcatagcacggcgacaggacgccgacccgcccgccccgccgcaaccttggcagggcctggatcgccgcctggctgccggccagcggcaatacccgttcggcgccgtagtagaggcaggcagcggcttccaggccgtcgtcgctctccggcaggcgggtccaggcctgctcggggatcgccggcagcggaaacggccagggcgcgatgccggtggacaggtccagccagtccgccagcggaatgtcgtagcggcgcgccgcctcgcgcaaccgccctccgtgttcaagcatgcagccaccccatggcccagagtccggccagcaccagcagccagaacagcacgccctggcgtaccagcgccagggcccgatagatgtcgcggccctgcggctgcgggccgctgccgaggagcggccgctggtgcagctcgccgtggtagatcgccgcgccgcccagggacacgcccagcgcaccggcgccggcggccatcaccgggccggcgttggggctgtcccattgcggcgcctgctctcgccagcagcgcagggcctggcgggtgccgccgagcagcgcgtaggtcagcgccaccagccgcgccggcaggtagttga

SEQ ID NO: 14297 - DNA, 1725 bp, Pseudomonas aeruginosa
aacggcgctccaggcgatcggccaggcggccgaaggcgaccagcgggtgccagccctgcggctcgccgaagcgcgcatccagcgccacgccgaggatacccagcagtgcgctcatgctcgctcgccccaacggttctggtagaccagctcggccagcggacgcggttcgctccaaccctccagcgccagcatcggcgccgggtagaactccgccaccgggcccaggcagagcaccgccaccgcttcgctgccgggcggcaggccgagcagctcgcccagcgcggccggatcgaacagcgatacccagcccatccccaggccctcggcgcgactggccagccagaggttgtggatcgcgcaggcgagcgacgccaggtccatctgcggcagggtccggcgaccgaacacatggcgctcgcggtcgtccatcagagcggcgaccagcagttcggcgcaatccagcacgccctctaccttgagccgcatgaactcgtcggagcgctcgccgagggcttcggcggtgcgtccgcgttcctcctcgaccagcccgtggatggcccggcgcaacgccgactcggtgatacggatgaagcgccagggttgcatcaggccgacgctgggcgcctggtgcgcggcctccagcagccgcgcgagcagctccggcgccacgctgccgccgctgaagtggcgcatgtcgcggcgctcggcgatggcccggtagacggcggcgcgttccgtggcgctgaaggcgtgggaagaatcggacatgtcagtcggcgtctcgcgcgggcgccagcaacgcggcggcggcctgcgggttggaaggcaggtagaaatggatataggaagccgtcagccggccaagacggaacaccgcctccgccgtgttccggccgttcgggcagacgccacgggccagaggctcgacggcgcagtcgagggtcgagtgatggaaggtatgcccgcgcagccgcccttccggcagctcgacctcctgcaaggccagggcggtcaggcgcttctgcaggcgcgcccggcccggcagcaggccgagcagttcgccgcgctcgccgtcggcgtcttccaggcagtcgagcaggtagagcatgccgccgcactcggccagcagcggcttgccggcggcatggtgggctcggatcgcctcggccatggcgcgattgccctgcaggcgccccaggtgcagttcgggatagccgcccggcaggtacaggctgtccacggcgggcaacgcctggtcctgcagcggcgagaagaacgccagttcggcgccgagttcgcgcagcaggtcgagattggcctggtagaggaaggcgaacgaggcgtcgcgggccacgccgatgcgcacgccttccaggctacgttgcagcggcgccggagcgggcacctcgaaggtcaccggctccggcaggtcggtctcggcgctggcccgcaaggcgtcggcggcggcgtccaggcgcacatcgagatcggccagttcctcggcctggaccaggcccaggtggcggctcggcaattcgaattcggccgagcgcggcagaccgccgaaccagcgcataccgggcggcaggcaatcacgcaggatgtcgctgtggcgctggctgccgacgcggttgccgagcactccggaaaacggcaggtccggctggaaatgcgccagtccgtaggccagcgcgccgaaggtctgggccatcgccgcgccgttga

SEQ ID NO: 14298 - DNA, 216 bp, Pseudomonas aeruginosa
cggtcgcggggcctgcgccagggacgccgggacctcctccaggcactgccgcaggtagagcagcttcgtcgccgaagtcgagtcccatcaggccgtccgaccagggctggcggcgcccctccggcaaacggtcgtagcgctgcgccaggcggatcaggcgatccgcggtgcgcccgccgaaccaggcctcggcttgcgccggcgagcgcagggtga

SEQ ID NO: 14299 - DNA, 981 bp, Pseudomonas aeruginosa
tcgacaccgcgcccaacccgctcggccaggcgctggccagccagaacgcggctacgcagaggaacgccagggcgctgcgcaggccgaacagcacgccgcgctcgatgtcccggtgccaggcgatggcgcccggcgcctggcgggtgggcgcgccatagaccagcgcctcgacgctgcgcccggccgccctcgcctcgccgagcaggcgttcgaggcagaccaggcacaggtgcaactgtccgtgcgccgcgtccagcgccaggcgcaagcgctgccggcaggcctcgaactcggcctggcggccctcgcgcaacagtgcctcgagttcttccagccagggctgcaaggcgtgcgcgctggccggatcgagcagcctccgctcgcgagccaccttgcgcgccgcgcgcagcaggccgagcaggtcgaggcctagcacgcgcaaggcctgggaacgggcgcggccgagcgcaccctcgaaccaagcgtggtcgcgctgggcgtccgccgcggagatccgccccagcgccgcgagcagctcgccgcgttcgtcggcgccgcgcagctccgccgcggccgcctgcaagccggcctcccgggccgccttgccctggttcgccaactggcgttccaggcgccgcggccagagcagcacactcaccagcgccgcgcagaggatgcccaggccgatctccgagcagcgggccaccgcctggtcgaacaccgtcgccggatcggcgctggccggcagggcgacgatcgccgcggtgtatccggccaggacgaaaccgtacgacgcatggttgtgcatcaacgacgcgccggcggtgcagaacgccagccagagcgccatcagaaggaggaagggcagcgacgcctgaccatacagcgcgaccatgccgatggacaccagcgcaccggcgcaggtgccgatcaggcggaacatgcccttggccaggaccatgccgctatagggctggctga

SEQ ID NO: 14300 - DNA, 423 bp, Pseudomonas aeruginosa
ttttctattgtccagcctctccgcgaactttccggaagagcgtttcgccctgcgaaacatgcgccacggaggcccactgaagccgaccaacacgcctgcgcagaaggcgccaaccggcagcggcagccgccgagcgttcgtatacaatatcccgcacgttcccaacgccacgcaggttgccccgcttgcctctctccatgctcaacgcccctaacctgggcatcgctccttcggcctccgagatcatcgccaagcacctgcgcgaagcgatcatcgccgggcatttcgccgaggacgaaccgatccgccaggacgacatcgcgcaactcttcaatgtcagcaagattcccgtccgcgaggccctcaagcgcctggaagcggaaggcctggtgctgttccagcgcaacaagggcgcggtggtga

SEQ ID NO: 14301 - DNA, 1959 bp, Pseudomonas aeruginosa
gcgccggcgcctgctcggcgagcgccacgacgcctggcgcgccgcctgcatcctcgagccgcgcggcagcgacgtactggtcggcgccctgctctgcgcgccggtcgatcccgaagcctgtgccggagtgatcttcttcaacaacagtggctacctcggcatgtgcggccacggcaccatcggcctggtcgcctcgctggcacacctagggcggatcggtcccggcgtgcaccgcatcgagacaccggtcggcgaggtcgaggcgaccctccacgaggacggctcggtcagcgtgcgcaacgtgccggcctaccgctaccgtcgccaggtcagcgtcgaagtgcccggcatcggccgggtcagcggcgacatcgcctggggcggcaactggttcttcctggtcgccggacacggccagcgcatcgccggcgacaacctcgacgccctcaccgcctacaccgtcgccgtccagcaggcgctggaagaccagggcatccgcggcgaggacggcggcgccatcgatcacatcgaactgttcgccgacgatccccacgccgacagccgcaacttcgtgctctgtcccggcaaggcctacgaccgctcgccctgcggcaccggcaccagcgccaagctggcctgcctggccgccgacggcaagctgctgcccggccagccctggcgccaggcgagcgtgatcggcagccagttcgaggggcgttacgaatggctcgacggccagcccggcgggcgtatcgtgccgaccatccgcggccgcgcccacgtcagcgcggaagccaccctgctgctggcggacgacgatccgttcgcctggggcatccgccggtgaacgccgaggtcatcgtggtcggcgccggcatcgtcggcagcgcctgcgcccatgaactggcgcgtcgcggcctcgacgtactggtgctggacagccgccgcggcggtgccaccgcggtgggcatggggcacctggtggcgatggacgacaacccggccgaactggccctcagcgactactcgatccaggcctggcgcacctgggcggcggatctgccggaagactgcgcgtaccgcaattgcggcaccctctggctggccgccgacgccgccgaactcgccgaagccgagcgcaagcgccaggccctgctggccgccggcgtcgcctgcgagatgctcgacgccgcgcgcctgcgtgacttggaaccggtcttgcggccaggcctcgccggcgccctgaaggtgccgggcgacggcatcctctacgcgcccaacgcggcgcgctggctgctcgaacgagccggcccgcgcctgcgtcgattgcacgccgaagtcagcgaagtggacggcagccgcctgcgcctggccgacggccgctggctgagcgccgaggcgctggtgctggccaacggcatccatgccggcgagctgtgcgcggagctgccgatccgcccgaagaaaggccacctgctgatcaccgaccgctatcccggcaccctccgccatcaactggtggaactcggctatgtcagcagcgcccacgccagcagcggtacctcggtagccttcaacgcccagccgcgccccaccgggcaggtcttcctcggctcctcgcggcagttcgacacgctcgacccgcaggtggaaggcccggtgctggcgcgcatgctgcggcgtgccctggactacctgccggggctcgccggcctcaatgcgatccgtgcctggaccggcttccgcgctgccactccggacggcctgccgctgcttggcgagcacccggcgcagccgggcctgtggctggcggtcggccacgagggcctgggcgtgaccaccgcgccgggcagcgcgcgcctgctcgccgcccagttgttcggcgaaacgccgccgctggatgccacgccttatctgccgcaacgcttcctctccagctccgggagtgcccggccatga

SEQ ID NO: 14302 - DNA, 750 bp, Pseudomonas aeruginosa
ctaccgcgccgacagctacgtgctcgccgccctcggcgaggagcgcctggaagccgtgcgcctgcgcgaaggcggtcgggtccgcgagatcgcctgcgaacgcctggcctgcggcttcggcctggtgcccaacgtgcaactcggccaggccctcggctatcgcctcgacggcccggcgctcgccgtcgacgaatggcaggccggcagcctgcccgaccactacgccgccggcgaatgcaccggcttcggcggcagcgaactggccctggtggaaggcgccatcgccggccatgccgccgtcgacgagcgcgacgcggctcgccgcatgtggccacgacggcgacgctggcagggcttcgcagacaccctggcgcgacacttcgccctgcgtgccgaactgcgtcaactggcggaggcggataccctggtctgccgttgcgaagacgtccccttggccgcgctggccgggcatgccggctggaccgaggccaagctgcacagccgttgcggcatgggcgcctgccaggggcggatatgcggcagcgccgcgcaattcctgttcggctggacgcctccggcgccgcgtccgccgttcagcccggcgcgcctggagaccctggcccgctggcagggcgacgccggctagcgacgctcggcgcgattcagccagccgaggccggccagcgacagcagcagaccacccagcagcatgggtgtcagcggctcggcgaacatccagtgcgcccatag

SEQ ID NO: 14303 - DNA, 1473 bp, Pseudomonas aeruginosa
catgcccagcagcggcaggccgtaggcccagcccggcgcccgccccagcgccagcgccgcatgcccggcccagagcaccccggcgacgcccagggcgatccccggccactgccccggccgcgttcgctgccccggcaggaccaacgccagcaaggccaccagcagcggcaacaggtcggccatcagcgccgccacgcccggcgagacgccgagttcgatggccttggcgatcggcgcgatgtagcccgcgtaggccaacgccccgatcagcgcctggcgccgccactggcgcgccgacaaccggcgcagcccggcccaggcgaagggcagcagcagcgccaggcaaacggcgaagcgccagaagctggtgaggaacaccggcgcctgttccatggcatagcggtagccgacgaagccggaactccaggccagtaccatgcccagttgcacggccagcaggcgggtcgccccgggcatcgctcgcggggtgcaggtggtcgcgcgcatcgctcgcctccgtcggtcaggttcgagtcgaggctaggcggcctccgccgctactatcaaacgaaactatctgcaccagtcatgcaggaaatcggaaccatgagcgccaacctggatatcgagctgctgcgtaccttccatgccatcctgcgcttcggccgctttctcgccgcggccagccacctcaaccgcagcccctcggcggtgagcacccacgtccggcgcctggaggaactggccggcggccggctgttcgagcgcgacaaccagtcggtgcggctgaccccgctggggcagcggttccagcgccagaccgccgagctgctggagacccacgaccgcgtgctcgccgggttgcgcagacgggaagagccgctgcgcgtgcgcttcggcatttccgaggaatacgccggcaagctgctcggccgcctcctgccacgcctcggcgcggaactgccggcgctggagctggaggtgctcaccgacgccagcggcaggctggccggacgcctgcggcgcggccagctggacctcgccctgctggtgcaagcgcaagacgaaaccccgtacgacgggcactcccgcgagatcggcggcacccagccggtgtgggtcgccggccacggcctgcggatcgatccgcaacgcccgctgccgctggccctgcacggccagggttgtccctatcgacaggcgctgctggaagccctcggcgcgacgggccggcgctggcgcacggtggtcagcagtcccggcgcggcggcgctggaagcggccatcgaaggcggcctggcgatcggcgtgatcgaccgtgcgcgggtcggcccgacgatgcgcgtgctggggccggcggagggcttcgccgaactgcccgcccaccgcattcgcctggccttcgccccgggagagcggccgccggcgctggagcgcctcggcgaactgatcgccgaggagttccggctctga

SEQ ID NO: 14304 - DNA, 1089 bp, Pseudomonas aeruginosa
ccgcggatgtcgaaacgggcgttctgcaccatggccggcaacgggtcgagggcatcgaggatggcctgggtggcggccgagggcttctcgcagaccgcccgccgcgccgaggtcggcgcggccagcccggcgaggttgaacaggtggtgggtttccgtctcgttgcacagcagggcccgggcgatggctccgatcacctgctccgaagcgcgtaccgcgcggccctgctccagccaggtgtaccaggtcacgccgaccccggcgagctgcgccacctcctcgcgacgcaggcccggcgtgcgtcggcggccgaggcgggaaatgccgacccgctgcggctcgatgctttcccgccggcggcgcaggaaggcccccagctgttcggcgcgggacggctgcgcggggctttccgcagcgtggctggcaggggcgtcgaggggcatggcgaagtcctccgaagggcagacgggtagcgccaataccaggataagcaagaactggtaccgggttagccagaagcgcatgctgccagcccactcccttccgcacaaggactccgcccatgcccagcaccgtctcgtcgtcgcggctcggcctcgccgggctctgcatcctgctggcggggcaactgttgccgatgatcgatttctccatcgtcaacgtcgccctcgacgccctcgcccattccctcggcgccagcgaaaccgaactggaactgatcgtcgccgtctacggcgtggccttcgcgcgtgtgcctggcgatgggcggccggcttggcgacaattacggccgtcgccgcctgttcgatctcggcgtcgctctgttcgccgtcgcattgttgctttgcgggctggccggttcggtctggctgctgttggtggcgcgcgccatacagggcgtcggcgcggcgctggtcgtgccgcagattctcgccaccctgcatgtcagcctcagcggccacgcgcattcccgcgcgctggccgcctacggcgccatcggcggcctggccttcgtcgtcggccaggtgctcggcggcttcctggtctccgccgacatcggcggcctcggctggcgcagcgtgttcctga

SEQ ID NO: 14305 - DNA, 423 bp, Pseudomonas aeruginosa
tcctctgcctgctgctgccgttggctctcggcccatcgctgcactggtcctggccctgcgccctgctgctggcggcggcggtgccgctgctggcctggctgtggcgcaccgagctgcgccaggaacgccgccaggcctggccgttgctgccgccgtcgctgctgcgcctgccgagcatccgcttcggcctgttgctggcgatcctgttcttcgcctgctggagcggcttcttgttcgccctcgccctggccctgcaggccggcgccggtctctcgccggtacaggccggcaatgccttcatcgccctcggcgcctcctacttcgtctcggcgctgctcaccgccagggtggcggcgcggctcggcccggtacgcctgctgctgctcggctgcgtcatccagatgtgcggcctgctcggcctga

SEQ ID NO: 14306 - DNA, 951 bp, Pseudomonas aeruginosa
cgctgctgctcggcgccacctgcctcttctacctgcgccgcgtgcgcacggtgccattgcgctgcgattcgccgggcaactgaggcgcgcggccgggccctattcccggccgccggcgccccgtatgctggcgcggccccccagccaggccttcgccccgatgcacgacctgctcgccgccccgccccccgccgacttcgccagcctgctggccagcctgcgccaggtcgaggcgctgctcgacgccatgcccggcgtggtgtttttcgtcaaggacgagcgcgcccgctacgtcctggtcaaccgcaccctggcacgccgctgcggcgtgaaggacaaggccgaactgctcggccgcagcgccgacgaggtcttcccttccagcctcggtccgctctatgccgagcaggatcggcgcgtgctgcgcggcggcgcgacgctggagaaccagtaggagctgcacgtctatcccggtcgccagccgggctggtgcctgacccacaagcaggcgctgcgcgatgccaacggggcgatcatcggcatggccggcatctcccacgacctgccggcggcgcagtcggcgcacccggcctacggccggctggcggcggtggatgcgcatatccgcgagcactacgaccagccgctcagcctcgccaatctcactgccatcgccgggctctcggtggcgcaactggaacgtcactgcaagcgcatcttccagctcaccccacggcagatgatccacaaggcgcggctcggcgccgcctcgcaactgctcgccggcgacgcgccgatcaccgagatcgccctgcgctgcggctacaccgaccacagcgccttcagccgccagttcaaggcgctcaccggactctcgccgagccagtaccgcgagacccatcgccagccccgaaaagcgtaacgcctcgccccgccacggggcggcggtag

SEQ ID NO: 14307 - DNA, 1824 bp, Pseudomonas aeruginosa
ccaccagcgcggtctaccgctgaagccgagggcgcggtccgccgccgggccgcgccgtttccccccgtcctggatgcgccgatgaagcacgcacacctcatcgttccccgtaccctggtcgccggcagcgcgtccggcgaactgctgtacgcaccgaccggcctgagcttctggggcggcgtcgacccgcgcagcgcggaagtgatcgaccgtcaccacccgctcagcggccgccatctacacggcaggctgctggcgattcccggtgggcgcggctcctgtaccggcagcagcgtactgctggaactgatcctcggcggacgtgcgccggcggcgatcctcctgcgcgaaccggacgaaatcctcgccctcggcgcgatcgtcgccgaggaactgttcggccgctcgctacccatcgcctgtctcggcgagcgcttcgacgaactcgccgcctatccctgggcgcgcctggccgacggacgcctggaactccaccgcgatgccccgccgccgctggagacccgacccgccgaagcgctggcgaccgatgccggcccacgactggacgccttcgaccaggccctgctcgccggcgaacacggcgaagccgcacgcctggcgatgcgcatcgtcctgcgcatggcggcgttgcagggcgcgcaacggctgatcgacatccagcgcgcgcacatcgacgcttgcatctacaccggcccggccggcctgcgcttcgccgaaaccctgcgcgacctcggtgcccgggtacgggtaccgaccaccctcaacaccatctccgtggaccagcgccgttggcgcgaacagggcgtacccgccgccctcggcgagccagccgcggccctggcccaggcctatctcgacatgggcgcgcagcccagcttcacctgcgcgccctacctgctcgacaacagcgcgcgggccggcgaacagatcgtctgggccgagtccaacgcggtgctcttcgccaacagcgtgctcggcgcacgcaccaacaagtacgccgacttcatggatatctgctgcgccctcaccggtcgcgcgccgctggccggctgccacctcgacgagcagcgccaggcgcgggtactgatcgaagtggaagacctcggcagcgtcgacgatgccttctacccgaccctcggctacctctgcggcctgctctgcgacgggcagatcccggcgatcgacggcctgcggcagcggcagccggaccacgacgcgctcaaggccttcggcgcggcgctgggcaccagttcctcggtgccgatgttccacgtcatcggcgtcaccccggaagcccctgacctggccagcgccttcggcggccgcgcgccgcggcggaccctgcgggtcggacgcgagcgcctgcgcgacgcctggcgcgagctggacagcgccggcgagacgcggatcgacctggtggcgctgggcaacccgcacttctccgccagcgaattcgcccagctcgccgcgctctgccacggccgccgcagacacccggaggtagcgctggtgatcaccagcagccggcaggtcgtcgcccaggccgaagcggccgggcacctggcgacgctgcaggcgttcggcgcgcggctggtcaccgacacctgctggtgcatgctcgacgaaccgctggtgccgccgggcgcgcgcaccctgatgaccaactccgccaagtatgcccactacgcccccggactggtcggccgccaggtgcgcttcgccggcctcgccggctgcgtcgaggccgccgtcggcgggcgggcccccgccgggctgcccgcctggttgagcgaggactgctga

SEQ ID NO: 14308 - DNA, 807 bp, Pseudomonas aeruginosa
ccgacgacctcaccggcgtcacccaagcactcaacgtcaagaccttccgcaccttcgaatacttcgccctggccgccgtcctctacttcgccatggccaagctgctggtgctggccgcccgcctgctgggctggcgcctgttccgttactgaggggaatgccgtgttcaccaccagcctcaccgccaacgacctgctgttcctcctgcaaggcgcctggaccaccctcgccatcaccgccatggcgatgctgatcggcaccctgctgggtgtcgtcttcggcctgctccgcgccctgctgccacgcgccagcctgccgctggcggcgctgctcgacgtattccgcagcgtgccgctgctgatccagttcgtcctgctcaattccttcaagagcatcctcggcctcgactggagcgccttcgccgtggcctgcctggtgctcggcgtgtacgccgccgcctactgcgccgaggtggtccgcggcggcgtcctctcggtaccgccgagcgtgcgccgggccgcgcgttcgctgggcctgagctatcgccaggacctgttccacatcgtcctgccgatggccgcccgggtggccttccccggttgggtcaacctgaccctgtcggtgatgaaggacacctcgctggtgctctggatcggcatcgtcgaactgctgcgcgcctcgcagaccatcgtcacgcgcatccaggaaccactcttcgtgctctgcatcgcggggctcgtctattacctcatgagctgggtggtcgcgcgactcggcgcccggctggaacggagatggcagcaatga

SEQ ID NO: 14309 - DNA, 1113 bp, Pseudomonas aeruginosa
tcggcaacccgcagcggccggagacggtggaattcctccgctcggtgctctgagcccgcccccgcacaggagatagccatgcgttcgcagcggatcgtccacatcgtcagttgccatgccgaaggcgaggtcggcgacgtgatcgtcggcggcgtcgccgcgccgcccggcgccaccctctgggaacagtcgcgctggatcgccagagaccaggacctgcgcaacttcgtcctcaacgaaccgcgcggcggagtgttccgccacgccaatctgctggtgccggccaaggacccgcgcgcgcagatgggctggatcatcatggagccggccgacaccccgccgatgtccggttccaattcgctgtgcgtggccaccgtactgctcgacagcggcatcctgccgatgcgcgaaccgctgacccggctgctgctggaagcgccgggcgggctgatcgaggcccgcgcggaatgccgcgacggcaaggccgagcgggtggaaatccgcaacgtgccgtcgttcgccgaccgcctcgacgcctggatcgaagtcgagggcctcggctcgctacaggtcgacaccgcctacggcggcgacagcttcgtcatcgccgacgcccggcgcctgggcttcgccctgcgcgccgacgaggccgccgagctggtcgccaccggcttgaagatcacccacgcggccaacgaacaactgggcttccgccacccgaccaacccggactgggaccatctatccttctgccagctggccgcgccgccggagcgccgcgacggtgtcctcggcgcgagcaacgcggtggtcatccgccccggcaagatcgaccgctcgccctgcggcaccggctgctcggcgcggatggcggtgctccaggcgaaaggccagctgcgggtcggcgaacgcttcgtcgggcgctccatcatcggttcggaattccactgccacatcgagtcgctgaccgaactcggcggccgttcggcgatcctcccgtgcctgtccgggcgggcctggatcaccggcatccaccagtacctgctcgccccggacgatccctggccgcaaggctatcggctgtccgacacctggcccggcggccactgctga

SEQ ID NO: 14310 - DNA, 951 bp, Pseudomonas aeruginosa
attcgtatacgaaatacgaaaaaaggagaaaccatgagcaagcacgtcaactggagcggcgtattccccgcggtcaccacccaattcaacgccgatttctcggtgaacctggaggaaacccacacggtcatctccaacctggtgcgcgacggcgtgtccgggctggtggtatgcggcagcgtcggcgagaacacctcgctgaccatcgaggagaagatggccgtcacggaggtcgccaaggatgcctccggcggccgcgtgccggtgatctgcgggatcgccgagttcaccagcgccggcgcggcgaaggtggccaaggcggtggagcgggtcggcgtcgacggcatcatggtgatgccggcgctggtctattcctccaagccgcacgagaccgccgagcatttccgcagcgtggccagcggcaccgacctgccggtgatggtctacaacaacccgccgatctaccggaacgacgtcaccccggacatcctggtttccctggccgactgcgagaacatcgtctgcttcaaggacagctccggcgacacccgccgcttcatcgacgtacgcaaccaggtgggcgagcgcttcatcctcttcgccgggctcgacgacgtggtcctggaaagcgtggcggtgggtgcccagggctggatctcgggaatgtccaacgtgttcccgaaggaaggcgagaccatcttccgcctggccagggccgggcgcttcgccgaggcgatgccgatctacgagtggctgatgccgatcctccatctcgacgcccgtcccgacctggtgcagtgcatcaagctctgcgagcaactcgccggtcgcggcagcgccctcacccgtccaccgcgcctggccctgcgcggcgccgatcgcgagcacgtcgagcggatcatggccaaggccctggccagccggccggcgctgccggacatcggcttgtag

SEQ ID NO: 14311 - DNA, 885 bp, Pseudomonas aeruginosa
ccgacgccccgccctcgccgcctcgctccccggggagcggccggcgagggccagcggcagagcattccgtccaccgtccccagggaggccccatgcccagcatcctcggtcacaactacgtcggcggcgctcgcagcgccgccggcaacctcatcctgcgcagcctcgacgccgacagcggcgaagcgctgccctacgccttcgtccaggccaccgaggcggaggtcgacgccgccgcccgcgccgccgaacgcgcctatccacactaccggcaactgtccgcaacgcgccgcgccggattcctcgaggcgatcgcctcgcgcctcgacgccctgggcgacgacttcgtcgccctggtccgtcgcgagaccgcgctgcccgccgcacgcatccagggcgaacgaacacgtaccgccaaccagttgcggctgttcgccgaagtcctgcggcgtggcgacttccacggcgcgcgcatcgatcgaggacaacccgggcgtaccccgccgcgccccgacctgcgccagtggcgaatcggtctcggcccggtggcggtgttcggtgccagcaacttcccgctggccttttccaccgccggcggcgacagcgccgccgccctggccgccggctgtccggtggtggtcaaggcccacggcggacacatggccacagccgaatgcgtggccgacgcgatcctccaggcggcggccgacagcggcatgccggccggggtattcaacatggtctacggcagcggcgtcggcgaggcgctggtgcgccatccggccatccgcgcggtcggcttcaccggttcgctcaagggcgggcgcgcactgtgcgacctggcagcggcgcggccgcagccgatcccggtgttcgccgagatga

SEQ ID NO: 14312 - DNA, 1905 bp, Pseudomonas aeruginosa
aatcgctgtcccaggagccccagtcgaccatcatcgcccgacgggtacggtaggaggtggtcagcggaccgggggtcagcaggatgggtgcgcgttcggcagtgctcatgctcatttcctctgcgggaatcggccaaagaaaccggatcgggcttcgcggtccgggcggtcgttccgcgccggcgttccagggaagcctggagacataaggtgagcgccgcgctactatcgttcaaattgtttgttccgatgccagccataagccaggccgataccatgaatctcttccagctccgcgccttcgacgccgtcgcccgcgaaggcagtttcacccgcgccgccgagcgcctgtgcatcagccagccggcggtgaccggacacgtcaaggcactcgaggagcactaccaggtcaccctgttccggcgcaccgcccggcgcatcgaactgaccgaggagggctcgcgcctggtggcgatcacgcgcaccctgttcgccctggaggaagaagccgaggccctgctcgacgccaatcgacaattggtctccggccgcctcgaagtcgccgccgacggcccgcacctggtgatgccgatgctcgcccggctgcgcgcgagctatccgggaatcaccgtcaacctgcgtctgggcaacgcccaggagaacctcgcggggctgctcagcgcacacgtcgacgtccccgtgctgaccgaggtcgaggcgcgtcccgggctgttcctggaggagttggtgaattcgcgcatctgcgcccctgttgcctcgccagcatccctggtgcgaacgcaacgaaggcgtaccgctggaagagctcgaccagcagatcatggtgctgcgcgaacccggttcgatcacccgccgcaccttcgaccgcgcctgtgccgagcagggcgtgcagccgcgggtactgctggagctggacagccgggaagcggtgaccgaagcggtggccgccgaactgggcgtcggcgtggtgtcttccctggaggtcggcaacgatccgcgggttcgcgcggtgccgctggtcggtcccgagctgaccaaccgccacctgatcggctgcctggagaagcgccgcggcctacgggtgatcagggcattcctggaactggcggcggcctgagtcgcgcctcagctccagtgacgctcgcgggtgcggcggtcttcgccgaagccgaacagcgaggccagcgaatacacgatcagctcggcgatccaggcgaccagcaaggcgcagcccaggccccaggcgatcacctcgggcttgagcaggacctggtagctgtagctggcataggtttccatcagcaactcatggttcggtgcgcgcagcatgtgccaggcgcgggcgtaccagggaccctgcatggcctgccactcagcgtcgagcatgcgcgcgcgacgcatcaggcggtcgaggttctcgccgtcgcgctggaacaccggatcgctgttgctgcggtaatgcctgaccagttcctccaggctaccgttgaagaactgcccggcggtctgctggaagccctggatgttctgcgcggcctccaggcgatgggcgtcgacgcgcttggcgtagtcgtcgatgaaaccgggcacctgcaccccgagcagcaggcccagggtgaacagcagcagtctcaggtaactgcggaacatgcgctctcctcgttcacggcggcgattcagacccgccccttggccaacacctcgccgccccaccagaggacccactcgccgctctgctgcaaggtccagttctcgttgtcggtgagcggctcggtggcgatcaccgtgaccacatcgtccggcgtggtttccgcctggaagtccacggtcaggtcggcatccttcaaccgcgccgggccgaatggcgcacggcgggtaatgtag

SEQ ID NO: 14313 - DNA, 2175 bp, Pseudomonas aeruginosa
tggggggcttatgatagccgcttttgcatgccgacgcgcctacccaccgatggcgggcgccgcgccgccagttttattcagatttcccggcctcgcgcatggccggatcgacgaggattcccgatgccccatccgcagccccccatcgcccgccgcgacgccggaagcgacccctacgcctggctggaggagcgcgacgccccggaggtgctcgactacctgaaggccgagaacgcctacctggatagcgaactggccgaccaggccgggttgcgcgagaccctgttcgaggagatcaggggacgcatccgcgagaccgacctgtcgttgcccaatccgtggggtccgtggctgtactaccagcgcaccaccgccggcgacgaatacccgcgccactaccgctgcccgcgtccggcggacggcagcctggaggtcgacgaaggcgccgagcaactgttgctcgatcccaaccagttggccgacggcggcttcctctccctcggcgccttcagcatcagccccgaccagagcctgctggcctacagcctggacaccagcggcgacgagatctaccgcctgttcgtcaaggacctcgccagcggcgcggtgcaggccctgcccttcgacgactgcgacggcagcctgacctgggccaacgacaaccgcacgctgttcttcggcgaactggacgacacccaccgcccgcacaagctctatcgccaccgcctgggcgaggccggcgccgagctggtgttcgaggaaggcgacgggcgcttcttcctgcactgctaccgctccagctcggaacgccagctgatcctcctgctcaacagcaagaccaccagcgaggcctgggtgctcgacgccgaccagccgcagggaacgttccgttgcctggcgccgcgcgaggaaggccacgagtactaccccgaccacggtcgcctcgacggccggggcctgtggctgatccgcagcaaccaggcggggatcaacttcgccctctaccaggccgaggagtcgcggccgactcgcgagcactggcaactgcgcgtggcccacgacccgcagcggaccctggaagatgtcagcctgaacgccgaggcggtgatcctcggcctgcgcgacggcggcctgccggtgatcgaggtgcaaccgcagggcctgccggcctaccgcgtgcagttgccggacgccgcctacagcctctacgtgcaggacagcctggaattcgacagcccctgcgtgcgactgcgctacgaggccctgaatcgtccggcgcaggtacgccagctgaacctcgccgatggcacgcagaccgtcctcaagcagaccccggtggaaggccccttcgacgccgacgcctacgccagccggcgcatctgggccagcagcggcgacggcacgcaggtgccggtcagcctggtggcgcgcaaggaagtcctcgacggcatcgccgccgggcgccccgcgccgctctatctctatggctacggcgcctacgggcatagcctcgatccctggttctcccacgcccgcctgagcctgctcgaacgcggcttcgtcttcgccatcgcccatgtccgtggcggcggcgaactgggcgaagcctggtaccgggccggcaagctggaacacaagcagaacagcttcgacgacttcatcgcctgcgccgagcacctgctcgccgagggctactgccgtcccgagggcctcgccatcagcggcggcagcgccggcgggctgttgatcggcgcggtgctcaaccagcgcccgcaactgttcggcgcggccatcgccgaggtgccgttcgtcgacgtgctgaacagcatgctcaatccggacctgccgctgaccgtcaccgaatacgatgagtggggcaacccgcaggagcccgaggtgcatgcgcggatcgccgcctacgcgccctacgagaacgtcagggcccaggactacccgcacctgctggtggtcgccggctacaacgacagccgcgtgcagtactgggaagccgccaagtgggtggcgaaactgcgggcgaccaggaccgacgccaacctgctgctgctcaagaccgacctcggcgccggccacggcggcatgagcggccgctaccaggggctgaaggacgtggcgctggaatacgccttcctgctcaaggtcctcggcctggtatga

SEQ ID NO: 14314 - DNA, 606 bp, Pseudomonas aeruginosa
acacggtgccctgctggtagcgctcgaagccgctcttctgcgcgccgtccagggtatagggcacgtcctcggcgtcgcccaggccccagatgttggtggtctgtccgcccggcttgggcgagccgcccatggtcactccgggcagggtctgcagcaggctggggatgttgtccgcctgctggcgttcgatatcccgccgggtcagggtcgaacggccgacgttgctggcgtccacttcgcgaccgttgccgacgatggtctgcgcgtccagttgcagcgcgttgtcgctgtaggcatcgacctggcgccggcgcaccacgtagccgtcgcccgcctccaccagctccagctcggaaccgaccagcaaccgctccagcgcctcgcgcaccccgtagctgccgctcagcgccggagcgcgcaggccccgcaggagcgactcgtcgaacagcacctggacctgcgcctgctgcgccaggcgcgacagcgaggcggccagcggctgcgccggcaggtcgaagcgtcgttcggcagcgctggcgccggcggcccacaacgcggcgccgagcacggcggcggaacacagcgggcgccaggcggcgcgggtga

SEQ ID NO: 14315 - DNA, 633 bp, Pseudomonas aeruginosa
caaatgcccggcaccccgactacccagcccctgcgccattcccatcggttcgaccagggcaacccgctggccgagcgcaacacgcgctgggcggtattgctcaccgcctgcatgatggtcgcggaaatcgccggcggctggctgttcaactccatggccctgctcgccgacggctggcacatgagctcccatgccctggccctgggtcttgcggtactcgcctacggcgccgcgcggcgctatgccaacgacccgcgcttcagcttcggtacgtggaagatcgaggtgctcggcagctacaccagcgccctgctgcttctgctggtggccgggctgatgctctaccaatcggtcgaacgcctgctcgaccccagcccgatccactaccagcaggcgatgctggtcgccgcgctcggcctgctggtcaatctcgcctgcgcctggctgctgcgcgacggcatgcccaccacgggcacggccactcgcaccaccaccaccaccaccaccaccacgaccatcatgccgcaccggcacgatctgaatcttgcgcgccgcctaactgcacgtgctggcggatgccccccaccctggctgctgggcgatcttctcgctggccggcggcctgcctgttga

SEQ ID NO: 14316 - DNA, 342 bp, Pseudomonas aeruginosa
acgcggccctggctggacccgctgatgggtatcgtcggggcggtactggtcagtgtttgggcatgcggcctgatccggcagagcagccgggtattgctggatgcgcagatggacgcgccggtggctgcggaaatccgcgcggggatcgccagcagcccgctgccggcggaactgctcgacctgcacctgtggcaggtcggccagggcaagtacgcctgcctgctgagtctgctgaccaccgaggaaggcagcgccgactatttcaagcgccgcctggccgagcatgaggaactggtgcacatcaccgtcgaggtgaacccgctgctcccgctcgccgcctga

SEQ ID NO: 14317 - DNA, 1302 bp, Pseudomonas aeruginosa
actcggtatcgagcgcgaggtacggctgtgtgcgccattcccggcattgctgcgccaggctggcatcatcgcggatccactggatttcgggcgcggtcacgaacatctccttggtcaagtgcggcgcattatatagagcctggcgccatgcgagcattccgctcggcaccgcgcttgccgatgagcgtagcgaatgtccatactccgccctttgtccgacaatccgaacaagggaactgcatgaagaagctcagcggaataatcgtcctcctgctggctggcgcggctctttacctggccctgaagaccagcccgatcgacccgctcgcctgggatgctccggccgctccgcagatgaccggggtcctcgaacccaacgacaccctgatgaaggccgagctgcttggccagggccagttgcacggccccgaggacaccgccgtggacagccagggccgcgtctatgccggtctcgccgacggccgcgtggtacgcctggacgccagcggcaaggtcgagaccttcgtcgacaccggcggccgcccgctgggcatggacttcgatgccgccggcaacctgatcctcgccgacgcctggaaaggcctgctgcgcatcgatccgcagggcaaggtggaaatcctcgccaccgaggccgacggtgtccccttcgccttcaccgacgacctcgacatcgccagcgacggccgcatctacttcagcgacgcttccagcaagttccaccagcccgactacatcctcgacctgctcgaggcccgaccgcacggccgcctgctgcgctacgacccgtccaccggcaagaccgaggtgctgctcaaggacctgtacttcgccaatggcgtggcactctcggcaaacgaggacttcgtactggtcaacgagacctaccgctatcgcatcacccgctactggctgaaaggcgagaaggctggccagcacgaggtgttcatcgacaacctgccgggcttgccggacaacctccagggcgaccgcaagggtaccttctgggtggccctgccgaccccgcgcaaggccgacgccgacttcctccaccggcatccctggctgaaggcgcagctggccaagctgccgcgcatgttcctgcccaagccgaccgcctacgggctggtcatcgccatcgacgaacagggcaggatcgtccgcagcctgcacgacaccagcggccaccacctgcgcatgatcacctcggcgaagccggtgggcgaccagctctacttcggcagcctggaaaacgatcggatcggccgtctggcgattccctga

SEQ ID NO: 14318 - DNA, 1005 bp, Pseudomonas aeruginosa
ccgagtaggaatcttcctcgcctggagccagccctttcctttcgccatttctccgcctcgccgcgcgacgccgggatgacgcgacgcggtccaaggggcatgatccacccatccgccaccggctttgcttcccgacccaaggagtccgcgatgtcgtccgcccaactgctgaccgcgcaacaactggcagcccgcctcagcgaacccgacctgctggtcctcgactgccgtttcgccctcgaagacccgtcctacggtgcccgcgtctatcaggagaaccacattcccggcgcgcatttcgccgacctcgaacgggatctttccgctcccgtgcgcaagggcgtgaccggtcgccatccgctgccggatcccgccgagctagcgctcaagctacaagcctggggcctgcgccaggatagccaggtggtgctctacgacgacggccccggcgcattcgccgcccgcgcctggtggctgttgcattggctgggcaagcgcgatggggtctacctcctcgatggcggcctggcggcctggaaggctgcggggctggcactgaccaatggcgaaagcagtcttcgacccggcgatttccagggccagcccgatgcctcgctgttgatcgacgccgccaccctccaggcccaactgggccaacccgaactggcgctgctcgatgctcgcgcgcagccgcgcttccgtggcgaagtcgagcccatagatccggtcgccggacacattcccggtgcccagtgcgccgccttcaccgacaaccttggcagcgacggccgcttccttccgccggaacaattgcaccagcggttctccgccctgttgcgcggtcgcccggtggacgagctggtcgcctactgcggctccggcgtcaccgcctgccacaacctgttcgccctgagcctcgccggcttcccgcttccgcgcctctacgccggctcgtggagcgagtggatcaccgacccgcgccgcccggtcgccaccggcgactga

SEQ ID NO: 14319 - DNA, 606 bp, Pseudomonas aeruginosa
gaaggcagcagtatgaatgtcaagagcaggcagcaggaaaatgccgaggcgacccgcgaggcgctgctggaaagcgccctctccgccttcatcgaacatggctatggcggagtctccatcgacgccatcgcccgcgaggcgcgcgtgaccaagggcgcgttctaccaccacttcggcagcaagcaggaactgctcgccgaatgctacgaacgccaggtacggacgatcgccgaggacctggacagggtgccggcgcatgtcgacaagtgggcggaggccgccgcactggccgaggccttcatcgacagcgtgatggcgcgcggcaagcggcaactgtcgctgcaggaggtgatcacggtcgtcggctgggagcgatggaaacgcatcgactcgcgccacacgctgcgctacgtcgggcgcctggtggacgaactggcggccagtggcgaactcaaggactaccgccgggaaaccctggtcggccagctctacggcttccttacccaggccgcgatgagtcttcgcgatgcacgcaacaagcggcaagcggccaatgaagtgaaagccatcatccgcgacttcctctacagcctgcgcaggggctga

SEQ ID NO: 14320 - DNA, 1665 bp, Pseudomonas aeruginosa
acctgcgctacagcacggccatcgcctggtcgctggtggaagccgcgcgactgccactgcccgaccagcacgaccacctcgcccaggctcgcgtgtggcgccaggtattccagccgcacggtcgcctgcacgagttcatcgacgcctggcaacgctgcatcggcagcctcagccaggtcgcctgacggcgaatggaaaaatcccgcgtccgaaacagaccaaccggtcagaaaattttttacatacagacacgaacggttgcgctaccttcgcttcactggcaccggagccaaccgctctgttccgcaccctgcggaacttcggaacactggcgccggtctgggaatcttggtagtttgcgcgccgttatacacaggagttgctccaacaatgaaaacaatatggtttaaaacctctctcgcactgaccattagcgctgtctccacctacaccctcgccaacggcatcgccatcaacgaacagagcgccagcggcgccggcaccgcctacgccggccgcgcctcgtccgcgctcgatgccagcaccatctacggcaacccggccggcctgtccaagctgaaacgcaccgaagtcagcggcggtctggccatcgtcaaggccaaggacgacatcagccaggcccacagcaccgcccagggcagcaacaagggcgactcggtaccgctggccgccgtaccgttcggctacttctccacgccgatcaacgaagatttcactttcggcctgggcatctacgtgccctacggcatcatcaacgattacgaaaacggcttcatgggcagctcccacggctcctatagcaaggtgcaggtgatcaccgtgcagccgaccatcgcctggaagatcaacgacaaggtttccgtcggcttcggtccgaccttcaaccgcatcgacggccagttgaagaacaccctggccaccaatggcctgctcggcagcaacggcgataccaagatcaacatcaagggcgacgacaccgccatcggctacaacgtcggcgtgatggtcgacctgaccgacgacaccacctggggcctgacctaccactccaaggtcaagtaccacctgggcggcaacaccgaagtgaagaacgctccgggtgccctgggcctgaacggcaagtacgatgccaagctggacatcaccctgccggaatcggtggatacctccatcacccacaagttcgacgacaagtggacgggctacctgggcgccgtctggacccgctggagccgcctggagaagatcgaggtgcgcaacagcggcgtaccggcgctcggccaggccctgggcttcaacaccatcggcgaagacctgaactggcgcgacacctggtccttctcggtaggtacctcataccaggccaccccggagtgggtgctgcgcaccggctttgcctacgagccgtcgccgacctccaacgaggaccgcaacgtacgcatcccggtgggcgaccgcaaggtcttcaccgtcggtgccggctggtcgccgaaccaggacctgaccgtcgacgtggcctacgcctacctgtgggaaaccaccgccggcgtcaaccaggaaggcagcgccctgcagccggcctacagcgccaagtacgacaacagcgcgcatggcctgaccgcccaggtcacctatcgtttctga

SEQ ID NO: 14321 - DNA, 1512 bp, Pseudomonas aeruginosa
caggatcgacaactgccagaccaggtcgtagctgccggtgcggtcgtagaccaccccgcccagccagccgccgaggaaggcgcccaactggtggaagaggaacacgatgccgccgagcatcgacaggttgcgcacgccgaacagggtcgccacggtgccgttggtcaggggcaccgtggacagccacagcagccccatggccacgccgaaggcgtaggcgctgtagacgctcagaggcagccagaggaacagcacgatcactaccccgcgcaccaggtacagcgcggtcagcaggcgcggcttcgaccagcgcccgccgagccagccggcgatgtaggtgccgaacacgttgaacagcccgaccagcgccagcaccgtggtgccgacatgcgccggcaggtgctggtcgaccaggtaggccggcaggtgtacgccgatgaacaccacctggaagccgcagacgaagaagcccagcgccagcagccagaacccggaatgcgcgcaggcctcgcgcagcgcttcgccgaggctctgttcatggccctgcggcggcaacgggcgatccttcatcagcccggccagcggcacgatcagcgccaccagcaggcccagggcgagcagggccgaggaccagcccagccagccgatcagggcgagggtaccgggcagcatggcgaactggccgaaggagccggccgcgctggagatacccatcgccatgctgcgctgctccgccggcactgcgcggccgacggcgccgaggatcaccgagaacgaggtgccggaaaggcccaggccgatcagcaggccggcgctcagcgacagcccactggccgactgcgagagtcccatcaggaccaggccgagggcgtacagcaggccccccaccagcaccgcccgcgccgcgccgtagcggtcggcgagcgccccggtgaacggctgggccaggccccagaccaggttctgcaaggcgatggcgaaggcgaagacttcgcggccccagccgaagtcggcgctcatcggcgcgaggaacaggccgaagccatgtcgcacgccgagggacagggcgaggatcagggctccggacagcaggatccagaaggcggcacgcggcatgggtcgctccatctacgggtatatacccgctttatcgtgaacgaagcgcctcggcgagaggcttcgtcggttgtcagtccagtcgctccagttccaccagcaacgccgccaaggcgccgctgcgctcctcgccaaggcgcccggcgagacgccgctgcgcgtcttcccaggccggcgttccgcgctccagggcatccagcccggcaggcgtcagctcgaccaggcggttgcgctggtcctcgccaccggtcaggcgcagcaggccgtcgccttccagcacccgcaggttgcgaccgagggtgctgcggtcgagtcccatggcttcggcgagttcggaaatgctcggccggtccaggcgccgcaggtgccgcagcagggaaaactgcgccaccttga

SEQ ID NO: 14322 - DNA, 927 bp, Pseudomonas aeruginosa
  unsure (325): Identity of nucleotide at the above locations are unknown.
ggctgccctcggccgagctgccggcgcgggtccgcgacagcctcgacgacgccctgttggtcgccgagggcctggcgccggaggtcgcgtcgcggctcgtcgagcttgcccggcaggctttcgaccaggccttcgtcgccgtgctactggccgccgccgcgctgctcttcctcagcgccatggcggtcctgcgccagccgcgtccggctacagagccagcgccaccagcaccgcacactcggtaagttcgaccagcgcgccggcggtgtccccggtggtgccgccgaggcgcgcgaggaaacggctgcgcagccaggcgaagagnatcagcgtcaccagcaacgccagcaggccggccaggccgaacgccagggccaggccgaaactcacccccagcacccacggcaggctgcgcgccggcaggtgctcggcgatggcctggccgaggccgccggggcgcgcgtatggcgtggtcaggaacagcagcggcaggctgctgcgcgccagccacggggccagcggcaacaacccggcctcgccctggccgagcagcgccgccagggaggagaacttcaacaacaggaccagtaccaggaccaccaccgccaccgggccgctgcgcgggtccttcatgatcgccagggtccgctcgcggtcgcccagcccgccgacccaggcgtccgccatgtcggccaggccgtccaggtgcagcgcgccgctcagcgccacccacaggctcagcagcaaggctgcctgcaacagctgcggcgtaccatcgagcgacagagccgcggcgtacagcacgacgccgatcagcaccccgaccagtggatagcagagcaccgcgcggccgaactgttccggcgtcggcatcgccgacaggcgcaccggcaggcgggtgaggaactgcaaggcgaccagcagtga

SEQ ID NO: 14323 - DNA, 864 bp, Pseudomonas aeruginosa
ggatcggcccagaagcggccgagcgcctcgctgtggccgtccatcagggcggccgccgagcgcccctcccaagcgccgaaatgcagttcgcgcagatcgttttccagttccagctcgatcccctggcgctgcgccagttcctcggcgaaggcgcggcaacgttgcaatggcgagctgaccagcaggtcccagcgtccgccttccaccgccgtgcgcatctgcgcccagccacgcgcggtcaaggcgtcgtcgaggctgccgcggaaaccgccgccggactcggtttcgccatgccgcaggaggtccaggcgcaggctcatgccgggcggtccgagaccgccgcttcggcgaaggtcgccatccccgcgtgcagcgcgcaggcctggcgcagcagcggcaccgccagcgccgcgccgctaccctcgcccaggcgcaggccgaggtcgagcagcggttgcgccgccagggcttcgagcacatggcgatggcccggctcggcaccgctgtgggcgaacagcagccagtcgcggcaggccgggttcaggcgcaccgcgcagagcgccgcgacgctgcagatgtagccgtcgaccagggcgaccatgcctttctgcgcgcaggccaggtaggcgccggccagcgcggcgatctccaggccaccgagacggcggagggtttcgaaggggtcggcgcgatgggcgccgtgcagggccagggcacgctcgatcaccgcggccttgtgcgccacgccgctggcgtccagcccggttcccggcccgaccagcgcgctcgccggcgcatccagcagcgcgcaggccatggccgccgccgcggtggtattgccgatgcccatctcgccgccgatga

SEQ ID NO: 14324 - DNA, 246 bp, Pseudomonas aeruginosa
ccgcctgcggataggccgagatgccctcggcgactaccccgtggtcgccggcgaagaccgtcacccagatcctctccaggctcggtcgttcgcgcccctgcaacgccgccaggtcgatcgccacttgctccaggcggcccagcgagccgcgcggcttggtcaaccggtcctggcgttcggccgcgcgccggcgcatctgcgggtccgcctcgcggcaggtgtcgcgccaccattgcagactcatag

SEQ ID NO: 14325 - DNA, 402 bp, Pseudomonas aeruginosa
ccccggcatggatctcgtagcccgacagcggcgcatcctccaggctcaggcggccctgtacgttgcgcaattgcttgtccgcctcaagggtcgtttccaacgccagcaggccgaggccagcgctgctgccggccgcgccttccaggccgagcggatcgtgcaggcgctcgccgagcatctgcaggccgccgcagatccccagcaggcgaccgccgtagcgcaggtgacggaggatcgcctcgtcccagccgcgctcgcgcagcgccgcgaggtcggcgcgcacgctcttcgagccgggcaggacgatcaggtccgccgacggcagcgcctggccggggccgacgaagctcaactcgacctgggggtgcaggcgcagcggatcgaaatcggtgtggttgctga

SEQ ID NO: 14326 - DNA, 999 bp, Pseudomonas aeruginosa
cggcgcgccgcctcgcgcaaccgccctccgtgttcaagcatgcagccaccccatggcccagagtccggccagcaccagcagccagaacagcacgccctggcgtaccagcgccagggcccgatagatgtcgcggccctgcggctgcgggccgctgccgaggagcggccgctggtgcagctcgccgtggtagatcgccgcgccgcccagggacacgcccagcgcaccggcgccggcggccatcaccgggccggcgttggggctgtcccattgcggcgcctgctctcgccagcagcgcagggcctggcgggtgccgccgagcagcgcgtaggtcagcgccaccagccgcgccggcaggtagttgaggatgtcgtcgatcttcgccgcagcccagccgaagcgctcgaagcgcgcgttgcggtagccccacatcgcgtccagggtattgctcaggcgatacagcaccacccccggcgcgccggccacggcgaaccagaacagggcggcgtaaaccgcgtcgctgccgttctccagtaccgactcggtggctgcgcgggcgaccccggcctggtccagttcgcgggtatcgcggctgaccaggtagccgacacgtcgccgcgcctcgtccaggtcgccggcgcgcaaggccagcgccaccggttcggcgtgctcgccgaggctgcgcaggccgagcgcggcgtacagcgccagggcctggaccaaccagccgaggtagggaagttcagcgagcgcccaggccagcagggtcagcggcagtaccgcgaggacccaggcggtcaccccgtggctgcgccagccgaccccgggatcggcctcgccggccaggcgcgagcggttgaaacggcgctccaggcgatcggccaggcggccgaaggcgaccagcgggtgccagccctgcggctcgccgaagcgcgcatccagcgccacgccgaggatacccagcagtgcgctcatgctcgctcgccccaacggttctggtag

SEQ ID NO: 14327 - DNA, 516 bp, Pseudomonas aeruginosa
aactccgccaccgggcccaggcagagcaccgccaccgcttcgctgccgggcggcaggccgagcagctcgcccagcgcggccggatcgaacagcgatacccagcccatccccaggccctcggcgcgactggccagccagaggttgtggatcgcgcaggcgagcgacgccaggtccatctgcggcagggtccggcgaccgaacacatggcgctcgcggtcgtccatcagagcggcgaccagcagttcggcgcaatccagcacgccctctaccttgagccgcatgaactcgtcggagcgctcgccgagggcttcggcggtgcgtccgcgttcctcctcgaccagcccgtggatggcccggcgcaacgccgactcggtgatacggatgaagcgccagggttgcatcaggccgacgctgggcgcctggtgcgcggcctccagcagccgcgcgagcagctccggcgccacgctgccgccgctgaagtggcgcatgtcgcggcgctcggcgatggcccggtag

SEQ ID NO: 14328 - DNA, 1416 bp, Pseudomonas aeruginosa
acggcggcgcgttccgtggcgctgaaggcgtgggaagaatcggacatgtcagtcggcgtctcgcgcgggcgccagcaacgcggcggcggcctgcgggttggaaggcaggtagaaatggatataggaagccgtcagccggccaagacggaacaccgcctccgccgtgttccggccgttcgggcagacgccacgggccagaggctcgacggcgcagtcgagggtcgagtgatggaaggtatgcccgcgcagccgcccttccggcagctcgacctcctgcaaggccagggcggtcaggcgcttctgcaggcgcgcccggcccggcagcaggccgagcagttcgccgcgctcgccgtcggcgtcttccaggcagtcgagcaggtagagcatgccgccgcactcggccagcagcggcttgccggcggcatggtgggctcggatcgcctcggccatggcgcgattgccctgcaggcgccccaggtgcagttcgggatagccgcccggcaggtacaggctgtccacggcgggcaacgcctggtcctgcagcggcgagaagaacgccagttcggcgccgagttcgcgcagcaggtcgagattggcctggtagaggaaggcgaacgaggcgtcgcgggccacgccgatgcgcacgccttccaggctacgttgcagcggcgccggagcgggcacctcgaaggtcaccggctccggcaggtcggtctcggcgctggcccgcaaggcgtcggcggcggcgtccaggcgcacatcgagatcggccagttcctcggcctggaccaggcccaggtggcggctcggcaattcgaattcggccgagcgcggcagaccgccgaaccagcgcataccgggcggcaggcaatcacgcaggatgtcgctgtggcgctggctgccgacgcggttgccgagcactccggaaaacggcaggtccggctggaaatgcgccagtccgtaggccagcgcgccgaaggtctgggccatcgccgcgccgttgatcacccccagcaccggcacgccgaaacgccgcgccaggtctgccgccgaggggttgccatcgaacaggcccatcaccccttcgatgaggatcaggtcggcctcgccggcggcccgcgccagcaggcgtcgcgcttcggcctcgccgaccatccacaggtcgagctggtaaacaggcgcgccggaggcgcgggcgaggatcatcgggtcgaggaagtccggcccgcacttgaacacccgcacccgccgcccctggcgcgcatgcaggcgggccagggcggcggtgacggtggtcttgccctggccggaggccggggcggcgatcagcagggccggacagcgtgcctgggtcatgggcgaagcgtctccgcgcatggcgccggcatcagaattccactcctttctgcgccttga

SEQ ID NO: 14329 - DNA, 759 bp, Pseudomonas aeruginosa
cacgcgcaaggcctgggaacgggcgcggccgagcgcaccctcgaaccaagcgtggtcgcgctgggcgtccgccgcggagatccgccccagcgccgcgagcagctcgccgcgttcgtcggcgccgcgcagctccgccgcggccgcctgcaagccggcctcccgggccgccttgccctggttcgccaactggcgttccaggcgccgcggccagagcagcacactcaccagcgccgcgcagaggatgcccaggccgatctccgagcagcgggccaccgcctggtcgaacaccgtcgccggatcggcgctggccggcagggcgacgatcgccgcggtgtatccggccaggacgaaaccgtacgacgcatggttgtgcatcaacgacgcgccggcggtgcagaacgccagccagagcgccatcagaaggaggaagggcagcgacgcctgaccatacagcgcgaccatgccgatggacaccagcgcaccggcgcaggtgccgatcaggcggaacatgcccttggccaggaccatgccgctatagggctggctgaccacgaacaccgtcatcaatgcccattgcggctgctccagctccaggccgaaggccaggtacagggccaacccgccggccagcagggccttcaccgcgaactgcagttcgtgcagacgcgggcacagcagcacctgcaccaggtcggaggaaaagaaggaaggcttggccatcgcggacgccccgaaatacatgagcgagcgaattattag

SEQ ID NO: 14330 - DNA, 1020 bp, Pseudomonas aeruginosa
gcgaaaaccctcaagcgccccgccccgccgaaacgccaccctgtggcgcataccccggcacaggcgagggccaccatgcaacgcatccgcatcatcgattcgcataccggcggcgagcccacccgcctggtcatcggcggctttcccgatctcggccagggcgacatgactgagcgccggcgcctgctcggcgagcgccacgacgcctggcgcgccgcctgcatcctcgagccgcgcggcagcgacgtactggtcggcgccctgctctgcgcgccggtcgatcccgaagcctgtgccggagtgatcttcttcaacaacagtggctacctcggcatgtgcggccacggcaccatcggcctggtcgcctcgctggcacacctagggcggatcggtcccggcgtgcaccgcatcgagacaccggtcggcgaggtcgaggcgaccctccacgaggacggctcggtcagcgtgcgcaacgtgccggcctaccgctaccgtcgccaggtcagcgtcgaagtgcccggcatcggccgggtcagcggcgacatcgcctggggcggcaactggttcttcctggtcgccggacacggccagcgcatcgccggcgacaacctcgacgccctcaccgcctacaccgtcgccgtccagcaggcgctggaagaccagggcatccgcggcgaggacggcggcgccatcgatcacatcgaactgttcgccgacgatccccacgccgacagccgcaacttcgtgctctgtcccggcaaggcctacgaccgctcgccctgcggcaccggcaccagcgccaagctggcctgcctggccgccgacggcaagctgctgcccggccagccctggcgccaggcgagcgtgatcggcagccagttcgaggggcgttacgaatggctcgacggccagcccggcgggcgtatcgtgccgaccatccgcggccgcgcccacgtcagcgcggaagccaccctgctgctggcggacgacgatccgttcgcctggggcatccgccggtga

SEQ ID NO: 14331 - DNA, 1605 bp, Pseudomonas aeruginosa
ccaccgcgccgggcagcgcgcgcctgctcgccgcccagttgttcggcgaaacgccgccgctggatgccacgccttatctgccgcaacgcttcctctccagctccgggagtgcccggccatgatcgaactgttcatcgaccggcgtccgctgcgggtcgccgtcggcaccagcgtggcggccgccctcgccctcggcggcgacggctgctcccgcagcgcggtcggcggcgggcggcgcgcgccgttctgcggcatgggcgcgtgccaggaatgccgggtattgatcgacggtcggcgacgcctggcctgccagaccgtctgccaatccggcatgcgcgtggagacccaggcatgagcgccgactacgacctgctgatcgtcggtgccggccccgccggcctggccgcagcgctggccgccgcgccgagcggcgcgcgcatcgccctggtcgacgacaacccggcccccggcggacagatctggcgcgacggcccgcgtgccagcctgccgccgcgtgcccatcagatgcgccaacgcctggccgggcaggccaatgtcgagcacttcccggcgacccgggtggtcgcctgcggtcccggcaggcgcctgttgctggaagacccgcaacgtggctggcaggtcggctaccgacgcctggtcctctgcaccggcgcccgcgaactgctgctgccttttcccggctggaccctccccggcgtcaccggcgccggcggcctgcaggcgttggccaagggcggcctgccactggccggccagcgcctggtggtggctggctccggcccgctgctgctggccagcgccgccagcgccagccagtgcggggcgcgcctgctgcgcgtcgccgaacaggcgccggcgagaaccctggccgccttcgccgtacgcctcccgcgctggcccggcaagctgtggcaggccgccggcctgttcgcccgtagctaccgcgccgacagctacgtgctcgccgccctcggcgaggagcgcctggaagccgtgcgcctgcgcgaaggcggtcgggtccgcgagatcgcctgcgaacgcctggcctgcggcttcggcctggtgcccaacgtgcaactcggccaggccctcggctatcgcctcgacggcccggcgctcgccgtcgacgaatggcaggccggcagcctgcccgaccactacgccgccggcgaatgcaccggcttcggcggcagcgaactggccctggtggaaggcgccatcgccggccatgccgccgtcgacgagcgcgacgcggctcgccgcatgtggccacgacggcgacgctggcagggcttcgcagacaccctggcgcgacacttcgccctgcgtgccgaactgcgtcaactggcggaggcggataccctggtctgccgttgcgaagacgtccccttggccgcgctggccgggcatgccggctggaccgaggccaagctgcacagccgttgcggcatgggcgcctgccaggggcggatatgcggcagcgccgcgcaattcctgttcggctggacgcctccggcgccgcgtccgccgttcagcccggcgcgcctggagaccctggcccgctggcagggcgacgccggctag

SEQ ID NO: 14332 - DNA, 522 bp, Pseudomonas aeruginosa
ccccgctggggcagcggttccagcgccagaccgccgagctgctggagacccacgaccgcgtgctcgccgggttgcgcagacgggaagagccgctgcgcgtgcgcttcggcatttccgaggaatacgccggcaagctgctcggccgcctcctgccacgcctcggcgcggaactgccggcgctggagctggaggtgctcaccgacgccagcggcaggctggccggacgcctgcggcgcggccagctggacctcgccctgctggtgcaagcgcaagacgaaaccccgtacgacgggcactcccgcgagatcggcggcacccagccggtgtgggtcgccggccacggcctgcggatcgatccgcaacgcccgctgccgctggccctgcacggccagggttgtccctatcgacaggcgctgctggaagccctcggcgcgacgggccggcgctggcgcacggtggtcagcagtcccggcgcggcggcgctggaagcggccatcgaaggcggcctggcgatcggcgtga

SEQ ID NO: 14333 - DNA, 1887 bp, Pseudomonas aeruginosa
gcaagaactggtaccgggttagccagaagcgcatgctgccagcccactcccttccgcacaaggactccgcccatgcccagcaccgtctcgtcgtcgcggctcggcctcgccgggctctgcatcctgctggcggggcaactgttgccgatgatcgatttctccatcgtcaacgtcgccctcgacgccctcgcccattccctcggcgccagcgaaaccgaactggaactgatcgtcgccgtctacggcgtggccttcgcgcgtgtgcctggcgatgggcggccggcttggcgacaattacggccgtcgccgcctgttcgatctcggcgtcgctctgttcgccgtcgcattgttgctttgcgggctggccggttcggtctggctgctgttggtggcgcgcgccatacagggcgtcggcgcggcgctggtcgtgccgcagattctcgccaccctgcatgtcagcctcagcggccacgcgcattcccgcgcgctggccgcctacggcgccatcggcggcctggccttcgtcgtcggccaggtgctcggcggcttcctggtctccgccgacatcggcggcctcggctggcgcagcgtgttcctgatcaacctgccgatctgcctcggcattctcctttgcagccgccgctgggtaccggaaacccgcgccgagcatgccgcccgcatcgacgcgccgggcaccctgctgctcgccgcgctgatcctctgcctgctgctgccgttggctctcggcccatcgctgcactggtcctggccctgcgccctgctgctggcggcggcggtgccgctgctggcctggctgtggcgcaccgagctgcgccaggaacgccgccaggcctggccgttgctgccgccgtcgctgctgcgcctgccgagcatccgcttcggcctgttgctggcgatcctgttcttcgcctgctggagcggcttcttgttcgccctcgccctggccctgcaggccggcgccggtctctcgccggtacaggccggcaatgccttcatcgccctcggcgcctcctacttcgtctcggcgctgctcaccgccagggtggcggcgcggctcggcccggtacgcctgctgctgctcggctgcgtcatccagatgtgcggcctgctcggcctgatgctgaccctgcaacgggtctggccgcagccgggcatcctcaacctggcgccggcgaccctggtgatcggcttcggccaggcgttcatcgtcagcagcttcttccgcatcggcctctcggaggtgccggccgcccaggccggcgccggcagcgccatgctcgccaccgtccagcaggcctccctcggcctcggctcggcgctgctcggcgcggtgttcgcgcacaggctggagcgccatggcgactacctggaagcgacgcagacgaccctggccgtcgagttcgtcctgatgacgctgctgctcggcgccacctgcctcttctacctgcgccgcgtgcgcacggtgccattgcgctgcgattcgccgggcaactgaggcgcgcggccgggccctattcccggccgccggcgccccgtatgctggcgcggccccccagccaggccttcgccccgatgcacgacctgctcgccgccccgccccccgccgacttcgccagcctgctggccagcctgcgccaggtcgaggcgctgctcgacgccatgcccggcgtggtgtttttcgtcaaggacgagcgcgcccgctacgtcctggtcaaccgcaccctggcacgccgctgcggcgtgaaggacaaggccgaactgctcggccgcagcgccgacgaggtcttcccttccagcctcggtccgctctatgccgagcaggatcggcgcgtgctgcgcggcggcgcgacgctggagaaccagtag

SEQ ID NO: 14334 - DNA, 468 bp, Pseudomonas aeruginosa
gagctgcacgtctatcccggtcgccagccgggctggtgcctgacccacaagcaggcgctgcgcgatgccaacggggcgatcatcggcatggccggcatctcccacgacctgccggcggcgcagtcggcgcacccggcctacggccggctggcggcggtggatgcgcatatccgcgagcactacgaccagccgctcagcctcgccaatctcactgccatcgccgggctctcggtggcgcaactggaacgtcactgcaagcgcatcttccagctcaccccacggcagatgatccacaaggcgcggctcggcgccgcctcgcaactgctcgccggcgacgcgccgatcaccgagatcgccctgcgctgcggctacaccgaccacagcgccttcagccgccagttcaaggcgctcaccggactctcgccgagccagtaccgcgagacccatcgccagccccgaaaagcgtaa

SEQ ID NO: 14335 - DNA, 438 bp, Pseudomonas aeruginosa
tcgacatccagcgcgcgcacatcgacgcttgcatctacaccggcccggccggcctgcgcttcgccgaaaccctgcgcgacctcggtgcccgggtacgggtaccgaccaccctcaacaccatctccgtggaccagcgccgttggcgcgaacagggcgtacccgccgccctcggcgagccagccgcggccctggcccaggcctatctcgacatgggcgcgcagcccagcttcacctgcgcgccctacctgctcgacaacagcgcgcgggccggcgaacagatcgtctgggccgagtccaacgcggtgctcttcgccaacagcgtgctcggcgcacgcaccaacaagtacgccgacttcatggatatctgctgcgccctcaccggtcgcgcgccgctggccggctgccacctcgacgagcagcgccaggcgcgggtactga

SEQ ID NO: 14336 - DNA, 417 bp, Pseudomonas aeruginosa
tcgaagtggaagacctcggcagcgtcgacgatgccttctacccgaccctcggctacctctgcggcctgctctgcgacgggcagatcccggcgatcgacggcctgcggcagcggcagccggaccacgacgcgctcaaggccttcggcgcggcgctgggcaccagttcctcggtgccgatgttccacgtcatcggcgtcaccccggaagcccctgacctggccagcgccttcggcggccgcgcgccgcggcggaccctgcgggtcggacgcgagcgcctgcgcgacgcctggcgcgagctggacagcgccggcgagacgcggatcgacctggtggcgctgggcaacccgcacttctccgccagcgaattcgcccagctcgccgcgctctgccacggccgccgcagacacccggaggtag

SEQ ID NO: 14337 - DNA, 795 bp, Pseudomonas aeruginosa
gctgggtggtcgcgcgactcggcgcccggctggaacggagatggcagcaatgatcgagatcagcggcgtgcacaaggcctacggccagttcgaggtggtcaagggcgtcgacctgagggtggacaagggcgaggtgctgtcgatcatcggcggctccggttccggcaagtcgaccctgctgatgtgcatcaacggcctggagccgatccagcgcggcagcatccgcgtcgacggcatcgacgtgcatgcccgcggtaccgacctcaaccgcctgcggcggaagatcggcatcgtcttccagcagtggaacgccttcccccacctgaccgtgctggaaaacgtcatgctcgcgccgcgcaaggtgctcggcaagagccgcgccgaagccgaggcgatggcgctgaagcaactcacccacgtcggtctcggcgacaagctcaaggtcttcccccagcgcctttccggcggccagcaacagcgcatggcgatcgcccgggcgctggcgatgtcgccggaatacatgctgttcgacgaagccacctcggcgctcgacccgcagttggtcggcgaggtggtggacaccatgcgcatgctcgccgaggaaggcatgaccatggtcctggtcacccacgagatccgcttcgcccgcgacgtgtccgaccgggtggcgttcttccgcaatggcctggtccacgagatcggcacccccgaccaggtgatcggcaacccgcagcggccggagacggtggaattcctccgctcggtgctctgagcccgcccccgcacaggagatag

SEQ ID NO: 14338 - DNA, 1896 bp, Pseudomonas aeruginosa
tgccgatcctccatctcgacgcccgtcccgacctggtgcagtgcatcaagctctgcgagcaactcgccggtcgcggcagcgccctcacccgtccaccgcgcctggccctgcgcggcgccgatcgcgagcacgtcgagcggatcatggccaaggccctggccagccggccggcgctgccggacatcggcttgtagccgacgccccgccctcgccgcctcgctccccggggagcggccggcgagggccagcggcagagcattccgtccaccgtccccagggaggccccatgcccagcatcctcggtcacaactacgtcggcggcgctcgcagcgccgccggcaacctcatcctgcgcagcctcgacgccgacagcggcgaagcgctgccctacgccttcgtccaggccaccgaggcggaggtcgacgccgccgcccgcgccgccgaacgcgcctatccacactaccggcaactgtccgcaacgcgccgcgccggattcctcgaggcgatcgcctcgcgcctcgacgccctgggcgacgacttcgtcgccctggtccgtcgcgagaccgcgctgcccgccgcacgcatccagggcgaacgaacacgtaccgccaaccagttgcggctgttcgccgaagtcctgcggcgtggcgacttccacggcgcgcgcatcgatcgaggacaacccgggcgtaccccgccgcgccccgacctgcgccagtggcgaatcggtctcggcccggtggcggtgttcggtgccagcaacttcccgctggccttttccaccgccggcggcgacagcgccgccgccctggccgccggctgtccggtggtggtcaaggcccacggcggacacatggccacagccgaatgcgtggccgacgcgatcctccaggcggcggccgacagcggcatgccggccggggtattcaacatggtctacggcagcggcgtcggcgaggcgctggtgcgccatccggccatccgcgcggtcggcttcaccggttcgctcaagggcgggcgcgcactgtgcgacctggcagcggcgcggccgcagccgatcccggtgttcgccgagatgagcagcatcaatccgctggtggtgctccccgaagccctgcgccggcgcggccggcaggtggcggaggagctggccgcctcggtgacgctcggctgcggccagttctgcaccaagccgggcctggtgcttggcctgcgctcccccggcttcgacgccttcgtcgcggccctgggcgaggcactggccgccaggccggcacagagcatgctcaacgccggcaccttgcgcagctatgtcgaaggactgcaacgcctggagcgccaccccggcatccggcgcctggccggcgcgccacaggaagggcggcaggcccatccgcagttgttcaaggccgacgtgggcctgttgctggaaggcgacgaactgctccaggaagaggtgtttggcccggccaccgtggtcgtcgaggcggccgacgaggaacagcttgcccgcgcgctggacaacctgcacggccagttgtcggcgaccctgatcggcgaagcggacgacctcgcggcgttcgccgggctggtcccgctgctcgaacgcaaggccgggcgcctgctattcaacggctatccgaccggcgtcgaggtgtgcgacgccatggtccacggcggcccctacccggccacctccgacgctcgcggcacctcggtgggaaccctggccatcgagcgtttcctgcgcccgctgtgctaccaggactaccccgacagcctgctcccggacgccctgaagaacgccaacccgctgggcctgctgcgcctggtcgatggccggagcacgcgcgaggcgctggattgagcacgcctggaagcctggatggcggatag

SEQ ID NO: 14339 - DNA, 1638 bp, Pseudomonas aeruginosa
caggcgcccggccttgcgttcgagcagcgggaccagcccggcgaacgccgcgaggtcgtccgcttcgccgatcagggtcgccgacaactggccgtgcaggttgtccagcgcgcgggcaagctgttcctcgtcggccgcctcgacgaccacggtggccgggccaaacacctcttcctggagcagttcgtcgccttccagcaacaggcccacgtcggccttgaacaactgcggatgggcctgccgcccttcctgtggcgcgccggccaggcgccggatgccggggtggcgctccaggcgttgcagtccttcgacatagctgcgcaaggtgccggcgttgagcatgctctgtgccggcctggcggccagtgcctcgcccagggccgcgacgaaggcgtcgaagccgggggagcgcaggccaagcaccaggcccggcttggtgcagaactggccgcagccgagcgtcaccgaggcggccagctcctccgccacctgccggccgcgccggcgcagggcttcggggagcaccaccagcggattgatgctgctcatctcggcgaacaccgggatcggctgcggccgcgccgctgccaggtcgcacagtgcgcgcccgcccttgagcgaaccggtgaagccgaccgcgcggatggccggatggcgcaccagcgcctcgccgacgccgctgccgtagaccatgttgaataccccggccggcatgccgctgtcggccgccgcctggaggatcgcgtcggccacgcattcggctgtggccatgtgtccgccgtgggccttgaccaccaccggacagccggcggccagggcggcggcgctgtcgccgccggcggtggaaaaggccagcgggaagttgctggcaccgaacaccgccaccgggccgagaccgattcgccactggcgcaggtcggggcgcggcggggtacgcccgggttgtcctcgatcgatgcgcgcgccgtggaagtcgccacgccgcaggacttcggcgaacagccgcaactggttggcggtacgtgttcgttcgccctggatgcgtgcggcgggcagcgcggtctcgcgacggaccagggcgacgaagtcgtcgcccagggcgtcgaggcgcgaggcgatcgcctcgaggaatccggcgcggcgcgttgcggacagttgccggtagtgtggataggcgcgttcggcggcgcgggcggcggcgtcgacctccgcctcggtggcctggacgaaggcgtagggcagcgcttcgccgctgtcggcgtcgaggctgcgcaggatgaggttgccggcggcgctgcgagcgccgccgacgtagttgtgaccgaggatgctgggcatggggcctccctggggacggtggacggaatgctctgccgctggccctcgccggccgctccccggggagcgaggcggcgagggcggggcgtcggctacaagccgatgtccggcagcgccggccggctggccagggccttggccatgatccgctcgacgtgctcgcgatcggcgccgcgcagggccaggcgcggtggacgggtgagggcgctgccgcgaccggcgagttgctcgcagagcttgatgcactgcaccaggtcgggacgggcgtcgagatggaggatcggcatcagccactcgtag

SEQ ID NO: 14340 - DNA, 1311 bp, Pseudomonas aeruginosa
gcggtgtcgacctgtagcgagccgaggccctcgacttcgatccaggcgtcgaggcggtcggcgaacgacggcacgttgcggatttccacccgctcggccttgccgtcgcggcattccgcgcgggcctcgatcagcccgcccggcgcttccagcagcagccgggtcagcggttcgcgcatcggcaggatgccgctgtcgagcagtacggtggccacgcacagcgaattggaaccggacatcggcggggtgtcggccggctccatgatgatccagcccatctgcgcgcgcgggtccttggccggcaccagcagattggcgtggcggaacactccgccgcgcggttcgttgaggacgaagttgcgcaggtcctggtctctggcgatccagcgcgactgttcccagagggtggcgccgggcggcgcggcgacgccgccgacgatcacgtcgccgacctcgccttcggcatggcaactgacgatgtggacgatccgctgcgaacgcatggctatctcctgtgcgggggcgggctcagagcaccgagcggaggaattccaccgtctccggccgctgcgggttgccgatcacctggtcgggggtgccgatctcgtggaccaggccattgcggaagaacgccacccggtcggacacgtcgcgggcgaagcggatctcgtgggtgaccaggaccatggtcatgccttcctcggcgagcatgcgcatggtgtccaccacctcgccgaccaactgcgggtcgagcgccgaggtggcttcgtcgaacagcatgtattccggcgacatcgccagcgcccgggcgatcgccatgcgctgttgctggccgccggaaaggcgctgggggaagaccttgagcttgtcgccgagaccgacgtgggtgagttgcttcagcgccatcgcctcggcttcggcgcggctcttgccgagcaccttgcgcggcgcgagcatgacgttttccagcacggtcaggtgggggaaggcgttccactgctggaagacgatgccgatcttccgccgcaggcggttgaggtcggtaccgcgggcatgcacgtcgatgccgtcgacgcggatgctgccgcgctggatcggctccaggccgttgatgcacatcagcagggtcgacttgccggaaccggagccgccgatgatcgacagcacctcgcccttgtccaccctcaggtcgacgcccttgaccacctcgaactggccgtaggccttgtgcacgccgctgatctcgatcattgctgccatctccgttccagccgggcgccgagtcgcgcgaccacccagctcatgaggtaa

SEQ ID NO: 14341 - DNA, 1092 bp, Pseudomonas aeruginosa
gcggcggcgtacacgccgagcaccaggcaggccacggcgaaggcgctccagtcgaggccgaggatgctcttgaaggaattgagcaggacgaactggatcagcagcggcacgctgcggaatacgtcgagcagcgccgccagcggcaggctggcgcgtggcagcagggcgcggagcaggccgaagacgacacccagcagggtgccgatcagcatcgccatggcggtgatggcgagggtggtccaggcgccttgcaggaggaacagcaggtcgttggcggtgaggctggtggtgaacacggcattcccctcagtaacggaacaggcgccagcccagcaggcgggcggccagcaccagcagcttggccatggcgaagtagaggacggcggccagggcgaagtattcgaaggtgcggaaggtcttgacgttgagtgcttgggtgacgccggtgaggtcgtcggtcaggcccaccaccacgccgagggaggtcatcagcatggcccagaccaactggttggtcagcgggtagaacaccacccgcagcagctgcgggatcaccaccaggcgataggcctgcggcgcgctcatgcccagcgagcgggccgcccgcaactgggtctcgggcaccgcctggaggccgccgcggaaggtctcggcgaggtagccggcgttgttgaaggtgaccccggcgagcagggcgaaccaggaactgacgtgcaggccgaaggagcccaggccgaagtagaggatgtagatctggaacagcgccggggtattccgcgcgatggagatccaggctccggcggcggcgcgcagcgggcggttaccgccgagccgggcgaaggccaggagcagggcgatgaggatgccgaagagcatcgacagcgcggtgacctggagcgtcaccaggctgccggcgagcatctccggcagggcgttgaacgccgagcgccagtggaaggtgtagtcgaacatcagcagtcctcgctcaaccaggcgggcagcccggcgggggcccgcccgccgacggcggcctcgacgcagccggcgaggccggcgaagcgcacctggcggccgaccagtccgggggcgtag

SEQ ID NO: 14342 - DNA, 1536 bp, Pseudomonas aeruginosa
cgaaaaacaccacgccgggcatggcgtcgagcagcgcctcgacctggcgcaggctggccagcaggctggcgaagtcggcggggggcggggcggcgagcaggtcgtgcatcggggcgaaggcctggctggggggccgcgccagcatacggggcgccggcggccgggaatagggcccggccgcgcgcctcagttgcccggcgaatcgcagcgcaatggcaccgtgcgcacgcggcgcaggtagaagaggcaggtggcgccgagcagcagcgtcatcaggacgaactcgacggccagggtcgtctgcgtcgcttccaggtagtcgccatggcgctccagcctgtgcgcgaacaccgcgccgagcagcgccgagccgaggccgagggaggcctgctggacggtggcgagcatggcgctgccggcgccggcctgggcggccggcacctccgagaggccgatgcggaagaagctgctgacgatgaacgcctggccgaagccgatcaccagggtcgccggcgccaggttgaggatgcccggctgcggccagacccgttgcagggtcagcatcaggccgagcaggccgcacatctggatgacgcagccgagcagcagcaggcgtaccgggccgagccgcgccgccaccctggcggtgagcagcgccgagacgaagtaggaggcgccgagggcgatgaaggcattgccggcctgtaccggcgagagaccggcgccggcctgcagggccagggcgagggcgaacaagaagccgctccagcaggcgaagaacaggatcgccagcaacaggccgaagcggatgctcggcaggcgcagcagcgacggcggcagcaacggccaggcctggcggcgttcctggcgcagctcggtgcgccacagccaggccagcagcggcaccgccgccgccagcagcagggcgcagggccaggaccagtgcagcgatgggccgagagccaacggcagcagcaggcagaggatcagcgcggcgagcagcagggtgcccggcgcgtcgatgcgggcggcatgctcggcgcgggtttccggtacccagcggcggctgcaaaggagaatgccgaggcagatcggcaggttgatcaggaacacgctgcgccagccgaggccgccgatgtcggcggagaccaggaagccgccgagcacctggccgacgacgaaggccaggccgccgatggcgccgtaggcggccagcgcgcgggaatgcgcgtggccgctgaggctgacatgcagggtggcgagaatctgcggcacgaccagcgccgcgccgacgccctgtatggcgcgcgccaccaacagcagccagaccgaaccggccagcccgcaaagcaacaatgcgacggcgaacagagcgacgccgagatcgaacaggcggcgacggccgtaattgtcgccaagccggccgcccatcgccaggcacacgcgcgaaggccacgccgtagacggcgacgatcagttccagttcggtttcgctggcgccgagggaatgggcgagggcgtcgagggcgacgttga

SEQ ID NO: 14343 - DNA, 1077 bp, Pseudomonas aeruginosa
cgatggagaaatcgatcatcggcaacagttgccccgccagcaggatgcagagcccggcgaggccgagccgcgacgacgagacggtgctgggcatgggcggagtccttgtgcggaagggagtgggctggcagcatgcgcttctggctaacccggtaccagttcttgcttatcctggtattggcgctacccgtctgcccttcggaggacttcgccatgcccctcgacgcccctgccagccacgctgcggaaagccccgcgcagccgtcccgcgccgaacagctgggggccttcctgcgccgccggcgggaaagcatcgagccgcagcgggtcggcatttcccgcctcggccgccgacgcacgccgggcctgcgtcgcgaggaggtggcgcagctcgccggggtcggcgtgacctggtacacctggctggagcagggccgcgcggtacgcgcttcggagcaggtgatcggagccatcgcccgggccctgctgtgcaacgagacggaaacccaccacctgttcaacctcgccgggctggccgcgccgacctcggcgcggcgggcggtctgcgagaagccctcggccgccacccaggccatcctcgatgccctcgacccgttgccggccatggtgcagaacgcccgtttcgacatccgcggctacaaccgcgcctattgccggctggtgggcatcgacctggcggagatccccgaggaagaccgcaactgcatctacctggcgctgacccacgagcgctggcgctactgcatggccaaccgcgaggaggcgttgccgcggatggtcggcttcttccgcgcggcaatggtcgagcgcatgggcgatccgctgtgggagcggcagttgcagcgctgcctggaggcttcggcggagttccgcgagatctggcggcgcaacgaggtgatgggtatcgaaaaccagctcaagcgcttccgtcatgcgcgctgcggcgaattcgaactgcagcagaccaactggtggtcggcgccgaagaacggcgatcgcctgctggtcttcgtccccctcgacgaccacgcccgcgactgcctggagcaactgtga

SEQ ID NO: 14344 - DNA, 579 bp, Pseudomonas aeruginosa
gtcggcgccctgtcccgtagccagcgcctgctcgacctgctgcagattctgcgccggcaccgttacccggtggctgggcatgtgctcgccggcgaactggggatcagcctgcgcaccctctaccgcgatatcgccatcctgcgacagcagggcgcgcacatcgagggcggcgccggcgccaggcgttgctgcgcgagtggcgtgaacgggaaagcatcgccgcgcagtgagcgactgctgccggaaactgacagacggccaccgcctgcgggtctagcgcccggcgctgtagcggctcagagccggaactcctcggcgatcagttcgccgaggcgctccagcgccggcggccgctctcccggggcgaaggccaggcgaatgcggtgggcgggcagttcggcgaagccctccgccggccccagcacgcgcatcgtcgggccgacccgcgcacggtcgatcacgccgatcgccaggccgccttcgatggccgcttccagcgccgccgcgccgggactgctgaccaccgtgcgccagcgccggcccgtcgcgccgagggcttccagcagcgcctgtcgatag

SEQ ID NO: 14345 - DNA, 627 bp, Pseudomonas aeruginosa
ggacaaccctggccgtgcagggccagcggcagcgggcgttgcggatcgatccgcaggccgtggccggcgacccacaccggctgggtgccgccgatctcgcgggagtgcccgtcgtacggggtttcgtcttgcgcttgcaccagcagggcgaggtccagctggccgcgccgcaggcgtccggccagcctgccgctggcgtcggtgagcacctccagctccagcgccggcagttccgcgccgaggcgtggcaggaggcggccgagcagcttgccggcgtattcctcggaaatgccgaagcgcacgcgcagcggctcttcccgtctgcgcaacccggcgagcacgcggtcgtgggtctccagcagctcggcggtctggcgctggaaccgctgccccagcggggtcagccgcaccgactggttgtcgcgctcgaacagccggccgccggccagttcctccaggcgccggacgtgggtgctcaccgccgaggggctgcggttgaggtggctggccgcggcgagaaagcggccgaagcgcaggatggcatggaaggtacgcagcagctcgatatccaggttggcgctcatggttccgatttcctgcatgactggtgcagatagtttcgtttga

SEQ ID NO: 14346 - DNA, 834 bp, Pseudomonas aeruginosa
acggcggacgcggcgccggaggcgtccagccgaacaggaattgcgcggcgctgccgcatatccgcccctggcaggcgcccatgccgcaacggctgtgcagcttggcctcggtccagccggcatgcccggccagcgcggccaaggggacgtcttcgcaacggcagaccagggtatccgcctccgccagttgacgcagttcggcacgcagggcgaagtgtcgcgccagggtgtctgcgaagccctgccagcgtcgccgtcgtggccacatgcggcgagccgcgtcgcgctcgtcgacggcggcatggccggcgatggcgccttccaccagggccagttcgctgccgccgaagccggtgcattcgccggcggcgtagtggtcgggcaggctgccggcctgccattcgtcgacggcgagcgccgggccgtcgaggcgatagccgagggcctggccgagttgcacgttgggcaccaggccgaagccgcaggccaggcgttcgcaggcgatctcgcggacccgaccgccttcgcgcaggcgcacggcttccaggcgctcctcgccgagggcggcgagcacgtagctgtcggcgcggtagctacgggcgaacaggccggcggcctgccacagcttgccgggccagcgcgggaggcgtacggcgaaggcggccagggttctcgccggcgcctgttcggcgacgcgcagcaggcgcgccccgcactggctggcgctggcggcgctggccagcagcagcgggccggagccagccaccaccaggcgctggccggccagtggcaggccgcccttggccaacgcctgcaggccgccggcgccggtga

SEQ ID NO: 14347 - DNA, 645 bp, Pseudomonas aeruginosa
cgccggggagggtccagccgggaaaaggcagcagcagttcgcgggcgccggtgcagaggaccaggcgtcggtagccgacctgccagccacgttgcgggtcttccagcaacaggcgcctgccgggaccgcaggcgaccacccgggtcgccgggaagtgctcgacattggcctgcccggccaggcgttggcgcatctgatgggcacgcggcggcaggctggcacgcgggccgtcgcgccagatctgtccgccgggggccgggttgtcgtcgaccagggcgatgcgcgcgccgctcggcgcggcggccagcgctgcggccaggccggcggggccggcaccgacgatcagcaggtcgtagtcggcgctcatgcctgggtctccacgcgcatgccggattggcagacggtctggcaggccaggcgtcgccgaccgtcgatcaatacccggcattcctggcacgcgcccatgccgcagaacggcgcgcgccgcccgccgccgaccgcgctgcgggagcagccgtcgccgccgagggcgagggcggccgccacgctggtgccgacggcgacccgcagcggacgccggtcgatgaacagttcgatcatggccgggcactcccggagctggagaggaagcgttgcggcagataa

SEQ ID NO: 14348 - DNA, 219 bp, Pseudomonas aeruginosa
ggcgtggcatccagcggcggcgtttcgccgaacaactgggcggcgagcaggcgcgcgctgcccggcgcggtggtcacgcccaggccctcgtggccgaccgccagccacaggcccggctgcgccgggtgctcgccaagcagcggcaggccgtccggagtggcagcgcggaagccggtccaggcacggatcgcattgaggccggcgagccccggcaggtag

SEQ ID NO: 14349 - DNA, 1263 bp, Pseudomonas aeruginosa
cggcatggtcctggccaagggcatgttccgcctgatcggcacctgcgccggtgcgctggtgtccatcggcatggtcgcgctgtatggtcaggcgtcgctgcccttcctccttctgatggcgctctggctggcgttctgcaccgccggcgcgtcgttgatgcacaaccatgcgtcgtacggtttcgtcctggccggatacaccgcggcgatcgtcgccctgccggccagcgccgatccggcgacggtgttcgaccaggcggtggcccgctgctcggagatcggcctgggcatcctctgcgcggcgctggtgagtgtgctgctctggccgcggcgcctggaacgccagttggcgaaccagggcaaggcggcccgggaggccggcttgcaggcggccgcggcggagctgcgcggcgccgacgaacgcggcgagctgctcgcggcgctggggcggatctccgcggcggacgcccagcgcgaccacgcttggttcgagggtgcgctcggccgcgcccgttcccaggccttgcgcgtgctaggcctcgacctgctcggcctgctgcgcgcggcgcgcaaggtggctcgcgagcggaggctgctcgatccggccagcgcgcacgccttgcagccctggctggaagaactcgaggcactgttgcgcgagggccgccaggccgagttcgaggcctgccggcagcgcttgcgcctggcgctggacgcggcgcacggacagttgcacctgtgcctggtctgcctcgaacgcctgctcggcgaggcgagggcggccgggcgcagcgtcgaggcgctggtctatggcgcgcccacccgccaggcgccgggcgccatcgcctggcaccgggacatcgagcgcggcgtgctgttcggcctgcgcagcgccctggcgttcctctgcgtagccgcgttctggctggccagcgcctggccgagcgggttgggcgcggtgtcgatcaccggcgtggtgctgagtctcttcgccagccgcgacaacccggcccaggccggcctgaacttccttcgcgggattctcctgtcgatcccgctggccggcttcgtcgcactgttctacctgcccggcgtggacggcttcccgctgctttgcctgggcctgggcgtaccgctgttcttcgccgcgctgtgcgtgaaccgggcgagcctggccgggatcgcctcgccgttctgcatcttcttcgtgaaaaacgtcgcgccgagcaacagcatgagctacgacctcgcgcacttccttaa

SEQ ID NO: 14350 - DNA, 1854 bp, Pseudomonas aeruginosa
agcatgaacagagttttcctgaccccggcagccgtagcgctgtgcggcgcttcttccctgagcctggccgaaccggtcagccttgccgaccaggtggtgaccgccacccgtaccgcccagaccgcttcccagagcctggcggcggtgagcgtcatcgaccgcgaggatatcgagcgcagccaggcgcgcagcgtgccggagctgttgcgccaggtacccggcgtgtcgctggcgaacaacggcggtttcggcaagaacaccacgctgttcctgcgcggcaccgagtccgaccatgtgctggtgctgatcgacggcatcaaggtcggctcggccagcgctggcctcaccgcgttccaggacttgccggtggagctgatcgagcgcatcgaggtggtccgcgggccgcgttccagcctgtacggctcggaggccatcggcggggtgatccagatcttcacccggcgcggcgacggccagggcgccaagccgttcttctccgccggttacggcacccatcagaccctggagggcagcgccggggtcagcggcggcgccggcaacggctggtacagcctcggggtgagcagcttcgatacggcggggatcaataccaagcgcgccggtactgcgggctatgagccagaccgagacggctaccgcaacctgtccggcaacctgcgcggcggctatcgcttcgacaatggcctggaactcgacggcacgctgctcagggccaagtcgcacaacgactatgaccaggttttcggcaactccggtttcaatgccaacgccgacggcgagcagaacctggtcggcggccgtgcccgcttcactccgttcgatccctggctggtgaccctccaggccgggcgcagcgaggacaaggccgatgcctatcaggatggccgtttctactcgcgcttcgatacccgtcgcgacagcctgtcctggcagaacgacctgaccctggccgaaggccatgtactgaccctcggctacgactggcagaaggacgagatcagcagcagcgaagccttcagcgtcgactcgcggctgaacaaaggctggttcgcccagtacctcggccagtacggtcgccaggattggcaactgagcctgcgccgtgacgacaaccagcagttcggcgtgcacgacaccggcagcgccgcctggggctacgcgctgagcgacgcgctgcgcttcaccgtcaactacggcacggcattcaaggcgccgaccttcaacgaactctactaccccgactacggcaatcccgacctggacgccgagacttcgcgcagcctggaggtcgggctgagcggtacgcatggctgggggcactgggcggtgaatgccttccgtaccaacgtcgacgacctgatcggcaacgatccgcgtccggctccggggcgcccctgggggcagccgaacaacatcgacgaagcgcgcatccgcggcgtcgaactggtcctcggcagccagtggctgggttgggactggaacgccaacgcgaccttcctcgacccgcaaaaccgttccggcggcgtcaacgacggcaacgagctgccgcgccgggcgcggcggatgttcaacctggaactggaccggcgcttcgagcgtctttcgctgggcgccagcgtgcacgccgaaggccgacgctatgatgatccggccaacaaggtgcgcctgggcggctacgccaccctcgacctgcgcagcgagtaccggctgaacgacgaatggcgcctgcagggccggatcgccaacctgttcggtgccgactacgaaaccgcgtatggctacaaccagcctggccaggcggtctacctcagcgtgcgctaccaggccctgtga

SEQ ID NO: 14351 - DNA, 618 bp, Pseudomonas aeruginosa
tcgacgatgaacgaatcccctgagaaggaccagcgccaccgcgagcggatggagcgcaagaaggccgtgattgacgagaagatcgcccaggcccgcgacgaacgcggcgtgctcctggtgcatagcggcaacggcaagggcaagagcagctcggccttcggcatggtcgcgcgggccctgggccatggcatgaaggtcggcgttgtgcagttcatcaagggcgccgccagcaccggcgaggaagccttcttccggcgcttccccgaggaagtcagctaccacgtgatgggcgagggcttcacctgggagacccaggaccgccagcgcgacatcgccaaggccgaggcagcctggaaggtcgccgcgcaattgctggccgacccggacgtgggcctggtggtgctggacgaattgaacatcgccctcaagcacggctacctggaactggacagggtcctcgccgacatccaggcgcgcccggccatgcagcatgtggtggtgaccggccgcggcgcgcagccggggatggtcgaggccgccgacacggtgaccgagatgagtctggtcaagcacgcgttcaaggccgggatcaaggcgcagaaaggagtggaattctga

SEQ ID NO: 14352 - DNA, 1251 bp, Pseudomonas aeruginosa
acttccctacctcggctggttggtccaggccctggcgctgtacgccgcgctcggcctgcgcagcctcggcgagcacgccgaaccggtggcgctggccttgcgcgccggcgacctggacgaggcgcggcgacgtgtcggctacctggtcagccgcgatacccgcgaactggaccaggccggggtcgcccgcgcagccaccgagtcggtactggagaacggcagcgacgcggtttacgccgccctgttctggttcgccgtggccggcgcgccgggggtggtgctgtatcgcctgagcaataccctggacgcgatgtggggctaccgcaacgcgcgcttcgagcgcttcggctgggctgcggcgaagatcgacgacatcctcaactacctgccggcgcggctggtggcgctgacctacgcgctgctcggcggcacccgccaggccctgcgctgctggcgagagcaggcgccgcaatgggacagccccaacgccggcccggtgatggccgccggcgccggtgcgctgggcgtgtccctgggcggcgcggcgatctaccacggcgagctgcaccagcggccgctcctcggcagcggcccgcagccgcagggccgcgacatctatcgggccctggcgctggtacgccagggcgtgctgttctggctgctggtgctggccggactctgggccatggggtggctgcatgcttgaacacggagggcggttgcgcgaggcggcgcgccgctacgacattccgctggcggactggctggacctgtccaccggcatcgcgccctggccgtttccgctgccggcgatccccgagcaggcctggacccgcctgccggagagcgacgacggcctggaagccgctgcctgcctctactacggcgccgaacgggtattgccgctggccggcagccaggcggcgatccaggccctgccaaggttgcggcggggcgggcgggtcggcgtcctgtcgccgtgctatgccgagcacgcccacgcctggcgccaggccgggcacctggtgcgggagatcggcgaggccgaggtcgagccctatctcgacagcctcgacgtgctgctggtggtcaacccgaacaaccccaccgggcgggtcttcgagcccgccgagctgctggcctggcatgcccgcctgcaacgtcgcggcggctggctgctggtcgacgaggcgttcatggactgcaccccgcagtcgagcctggcggcctgtatcaaccgacccggattga

SEQ ID NO: 14353 - DNA, 1908 bp, Pseudomonas aeruginosa
tcgtgctgcgctcgttcggcaagttcttcggcctggccggtgcgcggctcggcttcgccctcggcgaacggccgctgttgcaggcgctggccgagcagctcggcccgtggacggtcaatggcccggtgcgccatgtggcccagaatgccttgcgcgaccgccagcaacagcgccagcagcgcgagcgcctgctggccgccagccagcgcctggaggaactgctgcgccgccacggctggccgccggcgggcggcagcgcgctgttccagcgcctggtcgatccacgctgcgcggcgttgcacgactacctggcgcggcgcggcatcctcacccgccagttcgagcagccggccagcctgcgcctcggcctgcccgccgacgaggccgcctgggcccggctggatgccgcgctgctcggcttcaaggagcctgctcatgagtgatcgcgggcggaccctgatggtccagggcaccacctcggacgccggcaagagcaccctggtgaccgcgctgtgccgctggctggcccggcgcggcgtcgcggtggtgccgttcaagccgcagaacatggcgctgaacagcgcggtcaccgccgacggcggcgagatcggccgcgcccaggcggtccaggcccaggcctgccggctggcgccgcacaccgacatgaacccggtgctgctcaagccgaacaccgacatcggcgcccaggtgatcatccatggccgcgcggtgaccagcatggacgccgccgcctaccacgactacaagcgcgtggcgatggaagcggtgctggcttcccatgggcggctcgccgccgcctaccgggtggtgatggtggagggcgccggctcgccggcggagatcaacctgcgcgccaacgacatcgccaacatgggcttcgccgaagcggtggactgtccggtgatcctggtcgccgatatcgaccgcggcggggtcttcgcccacctggtcggcaccctggaactgctctccgactcggagcgggagcgggtcaagggcttcgtcatcaatcgcttccgcggcgacatcgccctgctgcaacccggcctcgactggctggaggcacgcaccggcaagccggtgctcggcgtgctgccctatgtcagcgacctgcacctggaggcggaggacgccatcgacacgcgccaggcggccaaggtcgggccgcgcctgaaggtggtggtgccggtgctgccgaggatcagcaaccacaccgatttcgatccgctgcgcctgcacccccaggtcgagttgagcttcgtcggccccggccaggcgctgccgtcggcggacctgatcgtcctgcccggctcgaagagcgtgcgcgccgacctcgcggcgctgcgcgagcgcggctgggacgaggcgatcctccgtcacctgcgctacggcggtcgcctgctggggatctgcggcggcctgcagatgctcggcgagcgcctgcacgatccgctcggcctggaaggcgcggccggcagcagcgctggcctcggcctgctggcgttggaaacgacccttgaggcggacaagcaattgcgcaacgtacagggccgcctgagcctggaggatgcgccgctgtcgggctacgagatccatgccggggtcacccgtggcgaggccctggcgcggccggcggtggtgctcgacgatggtcgcgcggatggtgcccgtagcgtcgacgggaacgtcatgggcacctacctgcacggcctgttcgaatccaccgcggcctgttcggcgctgctgcgctgggccggcctgcgcgaggtccaggcggtggactaccaggccttgcgcgaacgcgacatcgagcggctcgccgacctggtcgagcgccacctggataccgggcgattgctcgccctctgcggagaaccccatgcgtga

SEQ ID NO: 14354 - DNA, 1566 bp, Pseudomonas aeruginosa
cctgatccttggcggcgcccgttccggcaagagccgcctggccgagcgcctggccgccgagagcgggctggcggtgagctacatcgccaccgcccaggccggcgacggcgaaatgggccggcgcatcgccgagcaccgcgcgcgccgcccggcccactggcgaaccctggaggagcctctggcgctggcggcgacgctgcgcagcgaggccgaggccggacgctgcctgctggtcgactgcctgaccctgtggctgaccaacctgctgctctgcgacgatccccagcgtctcgacggcgagcgcgaggcgctgctggaatgtctcggcgagctgccgggacggatcatcctggtcagcaacgaaaccgggctcggcgtggtgccgctgggcgaactcagccggcgctacgtcgacgaggccggctggctgcaccaggccatcgccgaacgctgcgaacgggtgaccttcaccgtcgccggcctgcccatgccgttgaaaggagaaccgctatgagtctgcaatggtggcgcgacacctgccgcgaggcggacccgcagatgcgccggcgcgcggccgaacgccaggaccggttgaccaagccgcgcggctcgctgggccgcctggagcaagtggcgatcgacctggcggcgttgcaggggcgcgaacgaccgagcctggagaggatctgggtgacggtcttcgccggcgaccacggggtagtcgccgagggcatctcggcctatccgcaggcggtcaccggcgagatgctgcgcaacttcgtccgcggcggcgcggcgatcagcgtgctggcgcgcgaactcggcgccggcctggaggtggtcgacctgggcaccgcgttccccctggaagccttgcccggcgtgcgtcacctgcgcctggcggcgggcaccgcgaacttcgtcgaggccccggcgatgggcgccgaacagtgcctgctggcgctcgaggccgggcgcgaaagcgtgcgccgcgccgagcaggccggcagccagctgttcatcggcggcgagatgggcatcggcaataccaccgcggcggcggccatggcctgcgcgctgctggatgcgccggcgagcgcgctggtcgggccgggaaccgggctggacgccagcggcgtggcgcacaaggccgcggtgatcgagcgtgccctggccctgcacggcgcccatcgcgccgaccccttcgaaaccctccgccgtctcggtggcctggagatcgccgcgctggccggcgcctacctggcctgcgcgcagaaaggcatggtcgccctggtcgacggctacatctgcagcgtcgcggcgctctgcgcggtgcgcctgaacccggcctgccgcgactggctgctgttcgcccacagcggtgccgagccgggccatcgccatgtgctcgaagccctggcggcgcaaccgctgctcgacctcggcctgcgcctgggcgagggtagcggcgcggcgctggcggtgccgctgctgcgccaggcctgcgcgctgcacgcggggatggcgaccttcgccgaagcggcggtctcggaccgcccggcatga

SEQ ID NO: 14355 - DNA, 1116 bp, Pseudomonas aeruginosa
  unsure (775): Identity of nucleotide at the above locations are unknown.
cccatggcggcgtcatacgcctgttgctcgcttgcgcccgtggcttgccgcgcgagcgcttgctgcaggtggacgtcggtcatggcgcactgttcggcctgcgcgccggagagggcgacgatcgctggcacgaatgccgggaaggggaatagccatgcgcgaagccttgcgctcactgctggtcgccttgcagttcctcacccgcctgccggtgcgcctgtcggcgatgccgacgccggaacagttcggccgcgcggtgctctgctatccactggtcggggtgctgatcggcgtcgtgctgtacgccgcggctctgtcgctcgatggtacgccgcagctgttgcaggcagccttgctgctgagcctgtgggtggcgctgagcggcgcgctgcacctggacggcctggccgacatggcggacgcctgggtcggcgggctgggcgaccgcgagcggaccctggcgatcatgaaggacccgcgcagcggcccggtggcggtggtggtcctggtactggtcctgttgttgaagttctcctccctggcggcgctgctcggccagggcgaggccgggttgttgccgctggccccgtggctggcgcgcagcagcctgccgctgctgttcctgaccacgccatacgcgcgccccggcggcctcggccaggccatcgccgagcacctgccggcgcgcagcctgccgtgggtgctgggggtgagtttcggcctggccctggcgttcggcctggccggcctgctggcgttgctggtgacgctgatnctcttcgcctggctgcgcagccgtttcctcgcgcgcctcggcggcaccaccggggacaccgccggcgcgctggtcgaacttaccgagtgtgcggtgctggtggcgctggctctgtagccggacgcggctggcgcaggaccgccatggcgctgaggaagagcagcgcggcggcggccagtagcacggcgacgaaggcctggtcgaaagcctgccgggcaagctcgacgagccgcgacgcgacctccggcgccaggccctcggcgaccaacagggcgtcgtcgaggctgtcgcggacccgcgccggcagctcggccgagggcagcctcagcgacatcccgtag

SEQ ID NO: 14356 - DNA, 888 bp, Pseudomonas aeruginosa
gacagggccaggccgagcaatccggcgctgccgagcagcagggaggcgcacatcacccggttctcgccccagcgcggcaccagccagccggccagcggcccgaccaccagcgaggccagcgggatcggcaggacgaacaggccggccttcagcggcgtcaggtcctgcaccagttgcaggtgctggctgaacaccagttccatgccgaccagcgccatggtcgccaccagggccaccgcgacgccgcgggcgaagcgccggttgcggaacagcgcgaagtcgatcatcggttcgcgggcgcggcgctggcggcggacgaacaggtacaggcagagcatgccgccgagcgcggcgaggacgaccagcccgaagtccggggcgcgtgtgctgagttccttgatcgcatacaccaccccgaccaggccgaacatcacctgcagtgagccgagggcgtcccatgggcgccgcgactggccgccgcaggccgggatggccggcagcgccagcaacaaagcgacgaccaccaccgggacgttgatgaggaacaccgagccccaccagaagaactccagcagcacgccgccgaccaccggccccagcgccgcgccggcagaggcgacggaggcccagatgccgatggccagggcgcgttcgcgttcgtcctggaagacatggcggacgatcgacagggtcgccggcatcatcagtgccgcgcccaccgccaacccggcgcgggcggcgatcagcgccgcggcgctgggggcgaaggcggcgcacagcgaggccaggccgaacagcggcaggccggcgaggaacagccgcttgtggccaaggcggtcgctgagcaagccggcgccgggcagcaggccggcgaccaccagcggatag

SEQ ID NO: 14357 - DNA, 576 bp, Pseudomonas aeruginosa
actcaagaggtagccatgggacgccgacgaacgatcgaccgtgaccagttgctcgatgccgccgaggcggtgatcggccgcgaaggcgcggccggcctgaccatcgatgcggtggcgaaggaaatgggcattaccaagggcggcgtgcagtactgcttcggtaccaaggatgcgctgatcgacgcgatcttcgagcgctggggcaaggcctacgacagcctgttcgaagcggtggcagggaagcagccgacgccactgacgcgggttcgcgcacatgccgaggcgacccagcgttcggacgagctgtccagcagcaaggcggcggcgctgatggcggcgctgatccagacgcccgagcatctggagggcagcaaccagtggtatcgcagccggttggaaggcctggacctgtccgcacctgaggggcgccgtgcgcgcctggcgttcctggcggtggagggcgctttcatgttgcgctacttccgcctgatggacattggccaggaggagtgggactcgatgctcgacgacgttcgtgcgttgttgctgaccccggctggcgccagcggagactga

SEQ ID NO: 14358 - DNA, 588 bp, Pseudomonas aeruginosa
acgggcatggctacctcggcgatggatggagggcgccgggtgctcccggtcgccgctgacagcgcgagttataggccagcgcccggcgtccggccttggcaggggcaacagacggcgttggcagttcggacaatccgcttgaccgacgagaggtacgggtatatacacgcatccatgctaccgacccaatgcctctgtaccaaactgcgtcgcgccgcccgcagcgtttcccgcttctacgacgaggcgctggccgataccggcctcaaggtggcgcagttttccctgctgcggcacctgcggcgcctggaccggccgagcatttccgaactcgccgaagccatgggactcgaccgcagcaccctcggtcgcaacctgcgggtgctggaaggcgacggcctgctgcgcctgaccggtggcgaggaccagcgcaaccgcctggtcgagctgacgcctgccgggctggatgccctggagcgcggaacgccggcctgggaagacgcgcagcggcgtctcgccgggcgccttggcgaggagcgcagcggcgccttggcggcgttgctggtggaactggagcgactggactga

SEQ ID NO: 14359 - DNA, 612 bp, Pseudomonas aeruginosa
gtggcgataggcgcggggaagggtaagctgggacattcgtcgccaaggagccattccatgaaacctcgcgtgctgttgtccgtcctggcgctcgccgggctgccgctgagcggctgggccgccgattgcccggaactgttgcagggccagttgaccaagctgcgttccaaggaaaacatcgatctttgccagcgttacgccggcaagccgctggtggtggtcaacactgccagccactgtggcttcaccccgcagttcaaggggctcgaggcgctctaccagcgttacaaggggcagggcctggaagtgctcggggtaccttccgacgacttcaagcaggaagccgcggataccgccgagaccgcgaagatctgctatggcaactacggcgtgaccttcgccatgacccagccgcagcacgttcgcggcgacgaggcgatcccgctgttccgccagttggccgagcagagcggccaggcgccgcgctggaatttctacaagtacgtggtggatcgccagggcagggtggtcgcgcagttctccagcaagaccaccccggacgatccgcagctccaggccgccatcgagaaggccatcgccagccagccctga

SEQ ID NO: 14360 - DNA, 423 bp, Pseudomonas aeruginosa
aggcgaaggggacaccgtcggcctcggtggcgaggatttccaccttgccctgcggatcgatgcgcagcaggcctttccaggcgtcggcgaggatcaggttgccggcggcatcgaagtccatgcccagcgggcggccgccggtgtcgacgaaggtctcgaccttgccgctggcgtccaggcgtaccacgcggccgtcggcgagaccggcatagacgcggccctggctgtccacggcggtgtcctcggggccgtgcaactggccctggccaagcagctcggccttcatcagggtgtcgttgggttcgaggaccccggtcatctgcggagcggccggagcatcccaggcgagcgggtcgatcgggctggtcttcagggccaggtaaagagccgcgccagccagcaggaggacgattattccgctga

SEQ ID NO: 14361 - DNA, 1566 bp, Pseudomonas aeruginosa
gcttcttcatgcagttcccttgttcggattgtcggacaaagggcggagtatggacattcgctacgctcatcggcaagcgcggtgccgagcggaatgctcgcatggcgccaggctctatataatgcgccgcacttgaccaaggagatgttcgtgaccgcgcccgaaatccagtggatccgcgatgatgccagcctggcgcagcaatgccgggaatggcgcacacagccgtacctcgcgctcgataccgagttcatgcgcgtcgataccttctatcccgcggccggtctggtgcaggtgggcgatggccggcaggagtggctgatcgatccgctgctgatccaggactggagccccttcgccgagctgctcgaagacgagcgggtggtgaaggtgctgcatgcctgcagcgaagacctcgaggtgttcctgcgcctcaccggcagcctgccggtgccgctgttcgatacgcagttggccgccgcctatctcggcatggcccattcgatgggctactcgaagctggtgaaggaggtgctggacatcgacctgcccaaggacgagacccgttccgactggttgcaacggccgctcaccgagatgcagatgcgctacgccgccgacgacgtccagcacctcgcccaggtctacctggccctggatgcgcggctgagcgaggagaaacgcgcctggctgctggaggacggcgccgaactggtcgccaacctctgccgcgagagcgatccgcgcgaggcctaccgcgaggtcaagctgggttggcggctgcgtccgcagcaactggcggtgctccgcgaactctgcgcctggcgcgaggagcaggcacgcctgcgcaaccggccgcgcaaccacgtgctgcgcgaacgcaccctgtggccgctggcgcgcctgctgccgaagaacaagaccgacctggcggcgatcgaggacatgcatccgcgcaccgtgcgccaggacggcgacttcctcatcgaactgatcgcccaggctgcgcgcctgccgcaggagcgaatggcccgaggcgctgcccgagccgctgccgccggaggtcaccccgctgctcaagagcctgcgcgccatcggccagcgcgaagcggagaccctgggcatggcgcccgaactgatgctgcgcaagaaagtcctcgaggcactgctcaagagcggctatcccgacggtccctacgaactgcccgattccctccgcggctggcgccgcgaacgcatgggccaggccctgctggacgccctggagagcgcatgaaacgaatctgttccgtctacaagagcccgcgcaagagcgagatgtacctctatgtcgacaagcgcgaggcgttgagccgcgtgcccgaggccctgctggtgccgttcggcgcgccgcaacatgtcttcgacctgctgctcacccccgagcgccaactggcccgcgaggatgtcgccaaggtcctggagaacatcgagaagcagggcttccacttgcagatgccgccgggcgaagaagagtacatcgagcatctcccggaagagttgctgcgcatgaacgacccgctctga

SEQ ID NO: 14362 - DNA, 531 bp, Pseudomonas aeruginosa
agtagccatgtgccggccggtgcttggcctggagggggcgggggactagactatcgcgccttttcaccagcccccgatgccatggccgccaaagtcgaacccttctggaaacgcaagaccctcgcccaactcgaccaggacgagtgggagtcgctgtgcgacggttgcggcctgtgctgcctgcagaagctcgaggacgaggacgacggcagcgtctactacacgcgtatcgcctgcaagctgctcgacctgcaaagctgccgctgcaccaactacgccgagcgcatccgtttcgtccccgactgtatccagctcaccccggcgcaggccgacgagttccagtggttgccgccgacctgcggctatcgcctggttgccgaaggcaaggacctgccgctctggcaccacctggtctgcggcgacccggagcgggtccacaaggaacgcatttcccagtccgggcgcatgctcagcgagacccaggtggccgaggacgactgggaggactacctgatcttccgcgccggctga

SEQ ID NO: 14363 - DNA, 447 bp, Pseudomonas aeruginosa
gcgcttccgtggttccgtctcgcatgcctatcaggcgttccatggcgagttgctgcgcttcctgcgcaagcacctgggcagttcggcggacgccgccgacctcgcccaggatactttcgcccagtggctgaaatggccgggccggcaatcggtcgagcagccgcgcgcatttcttttccagatcgcccgcaacctgttgcgcgaccattggcgccggcagcagagccgcggccaggatctcgaccggccggcggcgaacgacgaacccgccgcgctggaaggcgaggcggccgggccgggcgagcgtttcgaacagcagcagcgtctcagccacctggcggccgcgctggccgagctgccgccgcggcggcgcgaagcgttcgtcctgcacaagttcgacggcctgtcccaggtcgaagtggccgagcgcatgggaatctcccctga

SEQ ID NO: 14364 - DNA, 3738 bp, Pseudomonas aeruginosa
gcatggtggaaaagcacatcgccagcgccttgctgcactgcaagcggcggcttggccagggaggcgaaggatgaagccgctggaacgactggaaccgctgttcgcagacgaaaccgaagaggacatcgatcaccgcgccgcctactggttcagccggcgtcgttccgggcatttcagcgctgcctgccgggccgagctggaggattggctacgcgccgatccgcgccatcgcgaagcgctcgagggcatggagcggctctggcgcgaattcgacggcctgccgcgcccggcgctggacgatattcccgagccggtgccggcctggcgcctgccccgggcgctggcggcggcgttcttcgtgttctgcgcgctgctcgtcgccaccctgttctggcgcgaccagtcgctcggaccgaacctcgcctacggcacggcacctggcgagcagcgcgaggtggtcctggcggacggatcgaagctgttcctcgacgtcgatacccaggtgcaggtgcgttacgccgagcgcacccgcgacgtgctgttgaagaaaggcgaggtgttcttcgtggtcagccacgatccggcccggcctttccgggtcggcagcggcgacagccgggtcaccgtactcggtacccagttcagcgtccggcgcaacgcgcaggccctcgccgtggcggtgaaacaggggcgcgtggcgttgcagccgtccctggagaaggatgccgaacatgtgctgctggctggcgacagcgcgcgcctggacctcgccgagcagcgcctggaactcggccatgtggcgccggagcaggtcgccagttggcgcgatgggcaactggtgttccgcgacaagccgctgggcgaactggtggaggaactgtcgcgctatcgcgccgcgccgatccgcctgggagatccccggcttgccggcaagcgggtctccggtacggtgcggatcgcccgccccgacgattttctcctcgccctgccggcgctattgccggtgcgggtgcagccgcaggctggtggcgaggtgctgatcctggcgcgctgaggcgcgtcgtcagcattaatgaaaatatttttcattcgcatatgtgggtttttctccctgctgcgtcttctctgctgtccgtcgccgctgccggcgacatccagcagtcacttggggagagttccagcatgaccttgcctttcacccgcgccgcctggcgcccgctgtgttccgccgccgtgctcggcgccgcgttgtgggccgccggcgccagcgctgccgaacgacgcttcgacctgccggcgcagccgctggccgcctcgctgtcgcgcctggcgcagcaggcgcaggtccaggtgctgttcgacgagtcgctcctgcggggcctgcgcgctccggcgctgagcggcagctacggggtgcgcgaggcgctggagcggttgctggtcggttccgagctggagctggtggaggcgggcgacggctacgtggtgcgccggcgccaggtcgatgcctacagcgacaacgcgctgcaactggacgcgcagaccatcgtcggcaacggtcgcgaagtggacgccagcaacgtcggccgttcgaccctgacccggcgggatatcgaacgccagcaggcggacaacatccccagcctgctgcagaccctgcccggagtgaccatgggcggctcgcccaagccgggcggacagaccaccaacatctggggcctgggcgacgccgaggacgtgccctataccctggacggcgcgcagaagagcggcttcgagcgctaccagcagggcaccgtgttcatcgaaccggaaatgatcaagcgcatcgaggtggagaagggaccgcactcggtgttcaccggcaatggcggcttcggcggcaccgtgcacatggagaccaaggacgcgccggacctgctgcgcgaaggccgcgacgtcggcgccatgctcaagtacggctatcactccaacgaccagcagaagatctactccggcgccgtgttcggtcgcagcgaagaccgccgcgtcgatgccctgctctatctcaacggtcgcgacggccgcgacatgaagctggccgacaacctgccgctgtcgcccaccgactacccgatcaaccccaagcgcctgcccaacagcgcccaggacgagaagaccggcctgttcaagctcaacctgcaccccaccgaggagcacgacctgggtttcacctacctgcgctcgaaaagctcgcgctggacgccgttctccgccagcagctacccgaccccgccgagccagtggaccatcgaccgctacggctacgagctgggcctgacccgcctgctggcccaccgcgataccaccgacaccacctggaccggcaagtacaactaccatccgctggacaacccctggatcgacctgcaactgagctattccgacgcccgcaccgagcaactcgaccgtcgcgaggacaccgccttctaccagctcgccaccggtggcaaacggatgcgtaccgagtaccaggacaaggtcctggagctgcgcaacaccagccgtttcgataccggagcgctacagcacgagctgaccctgggcgcggcgctgcacaagcacaagcgcgacatcctcatgcacatgccgggcaagacctacgagaccccgcgctacaactacggctggctgcaaccggcattcatgccggccggcaagcaggacacgcagagcttctacatccaggacgcgatcacctacggcagcctgaccgtcaccccatcgatgcgcttcgacagcgtgcgcaacgacggccaggccaacctggcgccgatctacgacaatcccaagctcggccatgactatcgcgcccagacctactccggctggtcgccgcggctgtcggtgttctggaccgcgacgccgaacctggcgttcttcgccgactacaccgagacctggcgagcgccggtgatcgacgagcagtacgaagtgcagaacagttcgaccatcggtggcagcagccgcgacctggacgccgagcgcatccatgcgatccgtggcggcagcgtgatcaacctgccggacctgctggtcgccggcgacagcctgcagatccgcaccacgttgttccagaaccgcatcaaggacgagatattccgcacccgcagcgtcggctgccgccagcagtcgatcgacaacggcagtatcggcggtagctgcggcgacatgctgccgctgagcaactaccgcaacctgccgggcctgaccatcaagggcttcgagatcgagagcttctacgacagccagcggctgttcggcagcctgtcctactcgtggatgaccggcaagcacgatggggcctacagcaatccctggggaccgaacgtgtgggcgcgcgacatcccgccgccgaagtgggtggccatgctcggcctgaaggttccggaatgggatgccaagctcggctggcagggcgagttcgtgcgcaagaccgaccgcctgcccagcgatcgctacagcggcgggatgggtaccggttccggcgatatctactgggatcacgcggccaacgacagctacgacactcatcggctgttcgccgagtgggtcccggccaagctgggcctgaaggacacccgcatcgacttcaccgtggacaacctgttcaaccgctcctatcgccagccgctgggcggcgacctggtctacagccagggacgcaacgccaagatcagcgtcacccagttcttctga

SEQ ID NO: 14365 - DNA, 645 bp, Pseudomonas aeruginosa
ggggcgtcagcgcaccgaaccgatgcgccgggtgtcctcggcataccagacggcgaacacccggccgaccaggtcggcgcgcggtacgtagccccagtagcggctgtcgttggagttgtcgcggttgtcgccgagcatgaagtagtggccggcggggacggtccgctgggccatgcgcagggagtccggctggcgcagcgcctgttgcgccaggtagggctccgtcaccgggcgctcattgacgtagagccggccgccatcgatccgcacgcgatcgccgggtatcccggcgatgcgcttcacataggcgatgctgcgctgcggcgggaagcggaacaccaccaggtcgccgacctgcgggtcggcgaaggcgtagcgcgcggcgttggcgaggatgaagtcgccctgttgcaaggtcggttccatcgagcgcgaagggatattgtacagcgccacgccgaggagccgtgcgcgcgggtcgagactggcggtgccgaacggattcgccaggtagacggccagcatgatcgcggcgagcaggcccatggcgggccagaagcgtcgtttcacgaaggttccctttttcgtggcggaaggccggcgtcgccggcccccgcggtggtcataccaggccgaggaccttga

SEQ ID NO: 14366 - DNA, 1239 bp, Pseudomonas aeruginosa
acgatagtagcgcggcgctcaccttatgtctccaggcttccctggaacgccggcgcggaacgaccgcccggaccgcgaagcccgatccggtttctttggccgattcccgcagaggaaatgagcatgagcactgccgaacgcgcacccatcctgctgacccccggtccgctgaccacctcctaccgtacccgtcgggcgatgatggtcgactggggctcctgggacagcgatttcaacgaactcaccgccagcgtctgccagcgcctgctgaagatcgtaggcggcgaaggcagccacacctgcgtaccgttgcagggcagcggcaccttcgccgtggaagcggcgatcggcaccctggtgccgcgcgacggcaaggtcctggtgttgatcaacggtgcctacggcaagcgcctggcgaagatctgcgaggttctgcaacggcccttcagcaccttcgagaccgaagagaacgtgccgaccaccgccgctgacgtcgagcgtctgctggccgccgatccggcgatcagccatgtggcgctgatccactgcgagaccagcaccggtatcctcaatccgctcgaggccatcgccaaggtcgtcgagcgtcacggcaagcgcctgatcgtcgatgccatgagctccttcggggcgatcgggatcgatgcccggaaagttccgttcgatgccttgatcgccgcctccggcaagtgcctggagggcgtccccgggatgggcttcgtcttcgcccgcagcgccgccctggaagccagcgccggcaactgccactccctggccatggacctgcaggaccagcacgcctatatgcgcaagaccgggcagtggcgcttcaccccgccgacccatgtggtcgccgccctgcacgaagcgctcagccagtacgaagaggagggcggcctgccggcgcgccagcggcgctacgcgagcaattgcgaaacgctgctcggcgagatggcccggctcggtttccgcagcttcctgccggcggaaatccaggcgccgatcatcgttaccttccacgcgccgcgcgatccgcgctaccgcttcgccgacttctaccaacgcgtgcgggagaagggcttcatcctctatccgggcaagttgacccaggtggaaaccttccgcgtcggctgcatcggccacgtcgacgccgcggagatgcggcaggcggtcgccgccatcggcgaggcgctgcgcgaactggaagtcctcgagatctga

SEQ ID NO: 14367 - DNA, 477 bp, Pseudomonas aeruginosa
accatgttgaataccccggccggcatgccgctgtcggccgccgcctggaggatcgcgtcggccacgcattcggctgtggccatgtgtccgccgtgggccttgaccaccaccggacagccggcggccagggcggcggcgctgtcgccgccggcggtggaaaaggccagcgggaagttgctggcaccgaacaccgccaccgggccgagaccgattcgccactggcgcaggtcggggcgcggcggggtacgcccgggttgtcctcgatcgatgcgcgcgccgtggaagtcgccacgccgcaggacttcggcgaacagccgcaactggttggcggtacgtgttcgttcgccctggatgcgtgcggcgggcagcgcggtctcgcgacggaccagggcgacgaagtcgtcgcccagggcgtcgaggcgcgaggcgatcgcctcgaggaatccggcgcggcgcgttgcggacagttgccggtag

SEQ ID NO: 14368 - DNA, 747 bp, Pseudomonas aeruginosa
cgatgtggacgatccgctgcgaacgcatggctatctcctgtgcgggggcgggctcagagcaccgagcggaggaattccaccgtctccggccgctgcgggttgccgatcacctggtcgggggtgccgatctcgtggaccaggccattgcggaagaacgccacccggtcggacacgtcgcgggcgaagcggatctcgtgggtgaccaggaccatggtcatgccttcctcggcgagcatgcgcatggtgtccaccacctcgccgaccaactgcgggtcgagcgccgaggtggcttcgtcgaacagcatgtattccggcgacatcgccagcgcccgggcgatcgccatgcgctgttgctggccgccggaaaggcgctgggggaagaccttgagcttgtcgccgagaccgacgtgggtgagttgcttcagcgccatcgcctcggcttcggcgcggctcttgccgagcaccttgcgcggcgcgagcatgacgttttccagcacggtcaggtgggggaaggcgttccactgctggaagacgatgccgatcttccgccgcaggcggttgaggtcggtaccgcgggcatgcacgtcgatgccgtcgacgcggatgctgccgcgctggatcggctccaggccgttgatgcacatcagcagggtcgacttgccggaaccggagccgccgatgatcgacagcacctcgcccttgtccaccctcaggtcgacgcccttgaccacctcgaactggccgtag

SEQ ID NO: 14369 - DNA, 558 bp, Pseudomonas aeruginosa
gggtggtcggtacccgtacccgggcaccgaggtcgcgcagggtttcggcgaagcgcaggccggccgggccggtgtagatgcaagcgtcgatgtgcgcgcgctggatgtcgatcagccgttgcgcgccctgcaacgccgccatgcgcaggacgatgcgcatcgccaggcgtgcggcttcgccgtgttcgccggcgagcagggcctggtcgaaggcgtccagtcgtgggccggcatcggtcgccagcgcttcggcgggtcgggtctccagcggcggcggggcatcgcggtggagttccaggcgtccgtcggccaggcgcgcccagggataggcggcgagttcgtcgaagcgctcgccgagacaggcgatgggtagcgagcggccgaacagttcctcggcgacgatcgcgccgagggcgaggatttcgtccggttcgcgcaggaggatcgccgccggcgcacgtccgccgaggatcagttccagcagtacgctgctgccggtacaggagccgcgcccaccgggaatcgccagcagcctgccgtgtagatggcggccgctga

SEQ ID NO: 14370 - DNA, 537 bp, Pseudomonas aeruginosa
gaggcgccgagggcgatgaaggcattgccggcctgtaccggcgagagaccggcgccggcctgcagggccagggcgagggcgaacaagaagccgctccagcaggcgaagaacaggatcgccagcaacaggccgaagcggatgctcggcaggcgcagcagcgacggcggcagcaacggccaggcctggcggcgttcctggcgcagctcggtgcgccacagccaggccagcagcggcaccgccgccgccagcagcagggcgcagggccaggaccagtgcagcgatgggccgagagccaacggcagcagcaggcagaggatcagcgcggcgagcagcagggtgcccggcgcgtcgatgcgggcggcatgctcggcgcgggtttccggtacccagcggcggctgcaaaggagaatgccgaggcagatcggcaggttgatcaggaacacgctgcgccagccgaggccgccgatgtcggcggagaccaggaagccgccgagcacctggccgacgacgaaggccaggccgccgatggcgccgtag

SEQ ID NO: 14371 - DNA, 654 bp, Pseudomonas aeruginosa
ccgacggaggcgagcgatgcgcgcgaccacctgcaccccgcgagcgatgcccggggcgacccgcctgctggccgtgcaactgggcatggtactggcctggagttccggcttcgtcggctaccgctatgccatggaacaggcgccggtgttcctcaccagcttctggcgcttcgccgtttgcctggcgctgctgctgcccttcgcctgggccgggctgcgccggttgtcggcgcgccagtggcggcgccaggcgctgatcggggcgttggcctacgcgggctacatcgcgccgatcgccaaggccatcgaactcggcgtctcgccgggcgtggcggcgctgatggccgacctgttgccgctgctggtggccttgctggcgttggtcctgccggggcagcgaacgcggccggggcagtggccggggatcgccctgggcgtcgccggggtgctctgggccgggcatgcggcgctggcgctggggcgggcgccgggctgggcctacggcctgccgctgctgggcatgctagcgctggccctggccaccctgttgcagaagcgctgggacgatgcgccgggatcgctggccgtggtgctgttcgtgcagatcggcgccgcgctgccggcgttcgccggcctggcgctggcggagggtag

SEQ ID NO: 14372 - DNA, 1989 bp, Pseudomonas aeruginosa
catgcggccgccgctgtccggcggattcctgttcgggctcgcctggctggtgctgctgcccaccttcggcggctacggcctgtactggctgggcctgcgccatctttccgcacagggtggcagcgcggcgctgtacctgagcccggcgctgaccctgctatgggcgcactggatgttcgccgagccgctgacacccatgctgctgggtggtctgctgctgtcgctggccggcctcggctggctgaatcgcgccgagcgtcgctagccggcgtcgccctgccagcgggccagggtctccaggcgcgccgggctgaacggcggacgcggcgccggaggcgtccagccgaacaggaattgcgcggcgctgccgcatatccgcccctggcaggcgcccatgccgcaacggctgtgcagcttggcctcggtccagccggcatgcccggccagcgcggccaaggggacgtcttcgcaacggcagaccagggtatccgcctccgccagttgacgcagttcggcacgcagggcgaagtgtcgcgccagggtgtctgcgaagccctgccagcgtcgccgtcgtggccacatgcggcgagccgcgtcgcgctcgtcgacggcggcatggccggcgatggcgccttccaccagggccagttcgctgccgccgaagccggtgcattcgccggcggcgtagtggtcgggcaggctgccggcctgccattcgtcgacggcgagcgccgggccgtcgaggcgatagccgagggcctggccgagttgcacgttgggcaccaggccgaagccgcaggccaggcgttcgcaggcgatctcgcggacccgaccgccttcgcgcaggcgcacggcttccaggcgctcctcgccgagggcggcgagcacgtagctgtcggcgcggtagctacgggcgaacaggccggcggcctgccacagcttgccgggccagcgcgggaggcgtacggcgaaggcggccagggttctcgccggcgcctgttcggcgacgcgcagcaggcgcgccccgcactggctggcgctggcggcgctggccagcagcagcgggccggagccagccaccaccaggcgctggccggccagtggcaggccgcccttggccaacgcctgcaggccgccggcgccggtgacgccggggagggtccagccgggaaaaggcagcagcagttcgcgggcgccggtgcagaggaccaggcgtcggtagccgacctgccagccacgttgcgggtcttccagcaacaggcgcctgccgggaccgcaggcgaccacccgggtcgccgggaagtgctcgacattggcctgcccggccaggcgttggcgcatctgatgggcacgcggcggcaggctggcacgcgggccgtcgcgccagatctgtccgccgggggccgggttgtcgtcgaccagggcgatgcgcgcgccgctcggcgcggcggccagcgctgcggccaggccggcggggccggcaccgacgatcagcaggtcgtagtcggcgctcatgcctgggtctccacgcgcatgccggattggcagacggtctggcaggccaggcgtcgccgaccgtcgatcaatacccggcattcctggcacgcgcccatgccgcagaacggcgcgcgccgcccgccgccgaccgcgctgcgggagcagccgtcgccgccgagggcgagggcggccgccacgctggtgccgacggcgacccgcagcggacgccggtcgatgaacagttcgatcatggccgggcactcccggagctggagaggaagcgttgcggcagataaggcgtggcatccagcggcggcgtttcgccgaacaactgggcggcgagcaggcgcgcgctgcccggcgcggtggtcacgcccaggccctcgtggccgaccgccagccacaggcccggctgcgccgggtgctcgccaagcagcggcaggccgtccggagtggcagcgcggaagccggtccaggcacggatcgcattga

SEQ ID NO: 14373 - DNA, 324 bp, Pseudomonas aeruginosa
cttcggcgtgcaatcgacgcaggcgcgggccggctcgttcgagcagccagcgcgccgcgttgggcgcgtagaggatgccgtcgcccggcaccttcagggcgccggcgaggcctggccgcaagaccggttccaagtcacgcaggcgcgcggcgtcgagcatctcgcaggcgacgccggcggccagcagggcctggcgcttgcgctcggcttcggcgagttcggcggcgtcggcggccagccagagggtgccgcaattgcggtacgcgcagtcttccggcagatccgccgcccaggtgcgccaggcctggatcgagtagtcgctga

SEQ ID NO: 14374 - DNA, 2235 bp, Pseudomonas aeruginosa
aaaattagcttgctaataattcgctcgctcatgtatttcggggcgtccgcgatggccaagccttccttcttttcctccgacctggtgcaggtgctgctgtgcccgcgtctgcacgaactgcagttcgcggtgaaggccctgctggccggcgggttggccctgtacctggccttcggcctggagctggagcagccgcaatgggcattgatgacggtgttcgtggtcagccagccctatagcggcatggtcctggccaagggcatgttccgcctgatcggcacctgcgccggtgcgctggtgtccatcggcatggtcgcgctgtatggtcaggcgtcgctgcccttcctccttctgatggcgctctggctggcgttctgcaccgccggcgcgtcgttgatgcacaaccatgcgtcgtacggtttcgtcctggccggatacaccgcggcgatcgtcgccctgccggccagcgccgatccggcgacggtgttcgaccaggcggtggcccgctgctcggagatcggcctgggcatcctctgcgcggcgctggtgagtgtgctgctctggccgcggcgcctggaacgccagttggcgaaccagggcaaggcggcccgggaggccggcttgcaggcggccgcggcggagctgcgcggcgccgacgaacgcggcgagctgctcgcggcgctggggcggatctccgcggcggacgcccagcgcgaccacgcttggttcgagggtgcgctcggccgcgcccgttcccaggccttgcgcgtgctaggcctcgacctgctcggcctgctgcgcgcggcgcgcaaggtggctcgcgagcggaggctgctcgatccggccagcgcgcacgccttgcagccctggctggaagaactcgaggcactgttgcgcgagggccgccaggccgagttcgaggcctgccggcagcgcttgcgcctggcgctggacgcggcgcacggacagttgcacctgtgcctggtctgcctcgaacgcctgctcggcgaggcgagggcggccgggcgcagcgtcgaggcgctggtctatggcgcgcccacccgccaggcgccgggcgccatcgcctggcaccgggacatcgagcgcggcgtgctgttcggcctgcgcagcgccctggcgttcctctgcgtagccgcgttctggctggccagcgcctggccgagcgggttgggcgcggtgtcgatcaccggcgtggtgctgagtctcttcgccagccgcgacaacccggcccaggccggcctgaacttccttcgcgggattctcctgtcgatcccgctggccggcttcgtcgcactgttctacctgcccggcgtggacggcttcccgctgctttgcctgggcctgggcgtaccgctgttcttcgccgcgctgtgcgtgaaccgggcgagcctggccgggatcgcctcgccgttctgcatcttcttcgtgaaaaacgtcgcgccgagcaacagcatgagctacgacctcgcgcacttccttaacaacgccctgtcgacggtgctcggggtggccttcgccgtgctggtgttcaacctggtcagcctgctgccgggcgaacgccattaccggcgcatgctgcatgccaccctcggcgacctggcgcggctcaccctgcgctcgccggcgcaagccgaggcctggttcggcgggcgcaccgcggatcgcctgatccgcctggcgcagcgctacgaccgtttgccggaggggcgccgccagccctggtcggacggcctgatgggactcgacttcggcgacgaagctgctctacctgcggcagtgcctggaggaggtcccggcgtccctggcgcaggccccgcgaccgttacctgcggcgcctgcgcctggcgctgctgggcgatggcccgcgggccgagcgtgaacacgccctcgacccgccgaccgcgcgcctgctcaaggccctggccgccagcccgctggccggcagcgaacgcggcgagctggccggcgccgcgctggtgcagttgcaggccacctggcggcagtggtgccgcagccatgctccggccgggacggcgctgcgcgcggacccgctccccggagccgggcgctagttctgcggtggccggccacattgaccgcgcaagccccgaaccactaagctgcgcgccttgcgacaggtgccccgcaaggggtgaaacagggaagctggtgcgttccgtcggaaccaggccagcgctgcccccgcaacggtag

SEQ ID NO: 14375 - DNA, 1398 bp, Pseudomonas aeruginosa
gtctggtcaagcacgcgttcaaggccgggatcaaggcgcagaaaggagtggaattctgatgccggcgccatgcgcggagacgcttcgcccatgacccaggcacgctgtccggccctgctgatcgccgccccggcctccggccagggcaagaccaccgtcaccgccgccctggcccgcctgcatgcgcgccaggggcggcgggtgcgggtgttcaagtgcgggccggacttcctcgacccgatgatcctcgcccgcgcctccggcgcgcctgtttaccagctcgacctgtggatggtcggcgaggccgaagcgcgacgcctgctggcgcgggccgccggcgaggccgacctgatcctcatcgaaggggtgatgggcctgttcgatggcaacccctcggcggcagacctggcgcggcgtttcggcgtgccggtgctgggggtgatcaacggcgcggcgatggcccagaccttcggcgcgctggcctacggactggcgcatttccagccggacctgccgttttccggagtgctcggcaaccgcgtcggcagccagcgccacagcgacatcctgcgtgattgcctgccgcccggtatgcgctggttcggcggtctgccgcgctcggccgaattcgaattgccgagccgccacctgggcctggtccaggccgaggaactggccgatctcgatgtgcgcctggacgccgccgccgacgccttgcgggccagcgccgagaccgacctgccggagccggtgaccttcgaggtgcccgctccggcgccgctgcaacgtagcctggaaggcgtgcgcatcggcgtggcccgcgacgcctcgttcgccttcctctaccaggccaatctcgacctgctgcgcgaactcggcgccgaactggcgttcttctcgccgctgcaggaccaggcgttgcccgccgtggacagcctgtacctgccgggcggctatcccgaactgcacctggggcgcctgcagggcaatcgcgccatggccgaggcgatccgagcccaccatgccgccggcaagccgctgctggccgagtgcggcggcatgctctacctgctcgactgcctggaagacgccgacggcgagcgcggcgaactgctcggcctgctgccgggccgggcgcgcctgcagaagcgcctgaccgccctggccttgcaggaggtcgagctgccggaagggcggctgcgcgggcataccttccatcactcgaccctcgactgcgccgtcgagcctctggcccgtggcgtctgcccgaacggccggaacacggcggaggcggtgttccgtcttggccggctgacggcttcctatatccatttctacctgccttccaacccgcaggccgccgccgcgttgctggcgcccgcgcgagacgccgactga

SEQ ID NO: 14376 - DNA, 1593 bp, Pseudomonas aeruginosa
catgtccgattcttcccacgccttcagcgccacggaacgcgccgccgtctaccgggccatcgccgagcgccgcgacatgcgccacttcagcggcggcagcgtggcgccggagctgctcgcgcggctgctggaggccgcgcaccaggcgcccagcgtcggcctgatgcaaccctggcgcttcatccgtatcaccgagtcggcgttgcgccgggccatccacgggctggtcgaggaggaacgcggacgcaccgccgaagccctcggcgagcgctccgacgagttcatgcggctcaaggtagagggcgtgctggattgcgccgaactgctggtcgccgctctgatggacgaccgcgagcgccatgtgttcggtcgccggaccctgccgcagatggacctggcgtcgctcgcctgcgcgatccacaacctctggctggccagtcgcgccgagggcctggggatgggctgggtatcgctgttcgatccggccgcgctgggcgagctgctcggcctgccgcccggcagcgaagcggtggcggtgctctgcctgggcccggtggcggagttctacccggcgccgatgctggcgctggagggttggagcgaaccgcgtccgctggccgagctggtctaccagaaccgttggggcgagcgagcatgagcgcactgctgggtatcctcggcgtggcgctggatgcgcgcttcggcgagccgcagggctggcacccgctggtcgccttcggccgcctggccgatcgcctggagcgccgtttcaaccgctcgcgcctggccggcgaggccgatcccggggtcggctggcgcagccacggggtgaccgcctgggtcctcgcggtactgccgctgaccctgctggcctgggcgctcgctgaacttccctacctcggctggttggtccaggccctggcgctgtacgccgcgctcggcctgcgcagcctcggcgagcacgccgaaccggtggcgctggccttgcgcgccggcgacctggacgaggcgcggcgacgtgtcggctacctggtcagccgcgatacccgcgaactggaccaggccggggtcgcccgcgcagccaccgagtcggtactggagaacggcagcgacgcggtttacgccgccctgttctggttcgccgtggccggcgcgccgggggtggtgctgtatcgcctgagcaataccctggacgcgatgtggggctaccgcaacgcgcgcttcgagcgcttcggctgggctgcggcgaagatcgacgacatcctcaactacctgccggcgcggctggtggcgctgacctacgcgctgctcggcggcacccgccaggccctgcgctgctggcgagagcaggcgccgcaatgggacagccccaacgccggcccggtgatggccgccggcgccggtgcgctgggcgtgtccctgggcggcgcggcgatctaccacggcgagctgcaccagcggccgctcctcggcagcggcccgcagccgcagggccgcgacatctatcgggccctggcgctggtacgccagggcgtgctgttctggctgctggtgctggccggactctgggccatggggtggctgcatgcttga

SEQ ID NO: 14377 - DNA, 984 bp, Pseudomonas aeruginosa
acacggagggcggttgcgcgaggcggcgcgccgctacgacattccgctggcggactggctggacctgtccaccggcatcgcgccctggccgtttccgctgccggcgatccccgagcaggcctggacccgcctgccggagagcgacgacggcctggaagccgctgcctgcctctactacggcgccgaacgggtattgccgctggccggcagccaggcggcgatccaggccctgccaaggttgcggcggggcgggcgggtcggcgtcctgtcgccgtgctatgccgagcacgcccacgcctggcgccaggccgggcacctggtgcgggagatcggcgaggccgaggtcgagccctatctcgacagcctcgacgtgctgctggtggtcaacccgaacaaccccaccgggcgggtcttcgagcccgccgagctgctggcctggcatgcccgcctgcaacgtcgcggcggctggctgctggtcgacgaggcgttcatggactgcaccccgcagtcgagcctggcggcctgtatcaaccgacccggattgatcgtgctgcgctcgttcggcaagttcttcggcctggccggtgcgcggctcggcttcgccctcggcgaacggccgctgttgcaggcgctggccgagcagctcggcccgtggacggtcaatggcccggtgcgccatgtggcccagaatgccttgcgcgaccgccagcaacagcgccagcagcgcgagcgcctgctggccgccagccagcgcctggaggaactgctgcgccgccacggctggccgccggcgggcggcagcgcgctgttccagcgcctggtcgatccacgctgcgcggcgttgcacgactacctggcgcggcgcggcatcctcacccgccagttcgagcagccggccagcctgcgcctcggcctgcccgccgacgaggccgcctgggcccggctggatgccgcgctgctcggcttcaaggagcctgctcatga

SEQ ID NO: 14378 - DNA, 270 bp, Pseudomonas aeruginosa
tcctggtcgccgatatcgaccgcggcggggtcttcgcccacctggtcggcaccctggaactgctctccgactcggagcgggagcgggtcaagggcttcgtcatcaatcgcttccgcggcgacatcgccctgctgcaacccggcctcgactggctggaggcacgcaccggcaagccggtgctcggcgtgctgccctatgtcagcgacctgcacctggaggcggaggacgccatcgacacgcgccaggcggccaaggtcgggccgcgcctga

SEQ ID NO: 14379 - DNA, 843 bp, Pseudomonas aeruginosa
gcctggaggatgcgccgctgtcgggctacgagatccatgccggggtcacccgtggcgaggccctggcgcggccggcggtggtgctcgacgatggtcgcgcggatggtgcccgtagcgtcgacgggaacgtcatgggcacctacctgcacggcctgttcgaatccaccgcggcctgttcggcgctgctgcgctgggccggcctgcgcgaggtccaggcggtggactaccaggccttgcgcgaacgcgacatcgagcggctcgccgacctggtcgagcgccacctggataccgggcgattgctcgccctctgcggagaaccccatgcgtgacctgatccttggcggcgcccgttccggcaagagccgcctggccgagcgcctggccgccgagagcgggctggcggtgagctacatcgccaccgcccaggccggcgacggcgaaatgggccggcgcatcgccgagcaccgcgcgcgccgcccggcccactggcgaaccctggaggagcctctggcgctggcggcgacgctgcgcagcgaggccgaggccggacgctgcctgctggtcgactgcctgaccctgtggctgaccaacctgctgctctgcgacgatccccagcgtctcgacggcgagcgcgaggcgctgctggaatgtctcggcgagctgccgggacggatcatcctggtcagcaacgaaaccgggctcggcgtggtgccgctgggcgaactcagccggcgctacgtcgacgaggccggctggctgcaccaggccatcgccgaacgctgcgaacgggtgaccttcaccgtcgccggcctgcccatgccgttgaaaggagaaccgctatga

SEQ ID NO: 14380 - DNA, 438 bp, Pseudomonas aeruginosa
tcgccgagggcatctcggcctatccgcaggcggtcaccggcgagatgctgcgcaacttcgtccgcggcggcgcggcgatcagcgtgctggcgcgcgaactcggcgccggcctggaggtggtcgacctgggcaccgcgttccccctggaagccttgcccggcgtgcgtcacctgcgcctggcggcgggcaccgcgaacttcgtcgaggccccggcgatgggcgccgaacagtgcctgctggcgctcgaggccgggcgcgaaagcgtgcgccgcgccgagcaggccggcagccagctgttcatcggcggcgagatgggcatcggcaataccaccgcggcggcggccatggcctgcgcgctgctggatgcgccggcgagcgcgctggtcgggccgggaaccgggctggacgccagcggcgtggcgcacaaggccgcggtga

SEQ ID NO: 14381 - DNA, 1545 bp, Pseudomonas aeruginosa
  unsure (1428): Identity of nucleotide at the above locations are unknown.
acccggcctgccgcgactggctgctgttcgcccacagcggtgccgagccgggccatcgccatgtgctcgaagccctggcggcgcaaccgctgctcgacctcggcctgcgcctgggcgagggtagcggcgcggcgctggcggtgccgctgctgcgccaggcctgcgcgctgcacgcggggatggcgaccttcgccgaagcggcggtctcggaccgcccggcatgagcctgcgcctggacctcctgcggcatggcgaaaccgagtccggcggcggtttccgcggcagcctcgacgacgccttgaccgcgcgtggctgggcgcagatgcgcacggcggtggaaggcggacgctgggacctgctggtcagctcgccattgcaacgttgccgcgccttcgccgaggaactggcgcagcgccaggggatcgagctggaactggaaaacgatctgcgcgaactgcatttcggcgcttgggaggggcgctcggcggccgccctgatggacggccacagcgaggcgctcggccgcttctgggccgatccctacgcctttaccccgccgggcggcgagccgctgtccgagttcgaggcgcgggtgctggccgcccagcgacgcctgcgccagcgtcacgccggccgtcgtgtgctgctggtgacccatggcggcgtcatacgcctgttgctcgcttgcgcccgtggcttgccgcgcgagcgcttgctgcaggtggacgtcggtcatggcgcactgttcggcctgcgcgccggagagggcgacgatcgctggcacgaatgccgggaaggggaatagccatgcgcgaagccttgcgctcactgctggtcgccttgcagttcctcacccgcctgccggtgcgcctgtcggcgatgccgacgccggaacagttcggccgcgcggtgctctgctatccactggtcggggtgctgatcggcgtcgtgctgtacgccgcggctctgtcgctcgatggtacgccgcagctgttgcaggcagccttgctgctgagcctgtgggtggcgctgagcggcgcgctgcacctggacggcctggccgacatggcggacgcctgggtcggcgggctgggcgaccgcgagcggaccctggcgatcatgaaggacccgcgcagcggcccggtggcggtggtggtcctggtactggtcctgttgttgaagttctcctccctggcggcgctgctcggccagggcgaggccgggttgttgccgctggccccgtggctggcgcgcagcagcctgccgctgctgttcctgaccacgccatacgcgcgccccggcggcctcggccaggccatcgccgagcacctgccggcgcgcagcctgccgtgggtgctgggggtgagtttcggcctggccctggcgttcggcctggccggcctgctggcgttgctggtgacgctgatnctcttcgcctggctgcgcagccgtttcctcgcgcgcctcggcggcaccaccggggacaccgccggcgcgctggtcgaacttaccgagtgtgcggtgctggtggcgctggctctgtag

SEQ ID NO: 14382 - DNA, 1212 bp, Pseudomonas aeruginosa
atggagcgacccatgccgcgtgccgccttctggatcctgctgtccggagccctgatcctcgccctgtccctcggcgtgcgacatggcttcggcctgttcctcgcgccgatgagcgccgacttcggctggggccgcgaagtcttcgccttcgccatcgccttgcagaacctggtctggggcctggcccagccgttcaccggggcgctcgccgaccgctacggcgcggcgcgggcggtgctggtggggggcctgctgtacgccctcggcctggtcctgatgggactctcgcagtcggccagtgggctgtcgctgagcgccggcctgctgatcggcctgggcctttccggcacctcgttctcggtgatcctcggcgccgtcggccgcgcagtgccggcggagcagcgcagcatggcgatgggtatctccagcgcggccggctccttcggccagttcgccatgctgcccggtaccctcgccctgatcggctggctgggctggtcctcggccctgctcgccctgggcctgctggtggcgctgatcgtgccgctggccgggctgatgaaggatcgcccgttgccgccgcagggccatgaacagagcctcggcgaagcgctgcgcgaggcctgcgcgcattccgggttctggctgctggcgctgggcttcttcgtctgcggcttccaggtggtgttcatcggcgtacacctgccggcctacctggtcgaccagcacctgccggcgcatgtcggcaccacggtgctggcgctggtcgggctgttcaacgtgttcggcacctacatcgccggctggctcggcgggcgctggtcgaagccgcgcctgctgaccgcgctgtacctggtgcgcggggtagtgatcgtgctgttcctctggctgcctctgagcgtctacagcgcctacgccttcggcgtggccatggggctgctgtggctgtccacggtgcccctgaccaacggcaccgtggcgaccctgttcggcgtgcgcaacctgtcgatgctcggcggcatcgtgttcctcttccaccagttgggcgccttcctcggcggctggctgggcggggtggtctacgaccgcaccggcagctacgacctggtctggcagttgtcgatcctgctaagcctgctcgcggcgctgctcaactggccggtgcgcgagcgtccggtggcgcgcctgcaagtggccggaggcgcggcgtga

SEQ ID NO: 14383 - DNA, 1008 bp, Pseudomonas aeruginosa
ggtacctaccgagaaggaccaggtgtcgcgccagttcaggtcttcgccgatggtgttgaagcccagggcctggccgagcgccggtacgccgctgttgcgcacctcgatcttctccaggcggctccagcgggtccagacggcgcccaggtagcccgtccacttgtcgtcgaacttgtgggtgatggaggtatccaccgattccggcagggtgatgtccagcttggcatcgtacttgccgttcaggcccagggcacccggagcgttcttcacttcggtgttgccgcccaggtggtacttgaccttggagtggtaggtcaggccccaggtggtgtcgtcggtcaggtcgaccatcacgccgacgttgtagccgatggcggtgtcgtcgcccttgatgttgatcttggtatcgccgttgctgccgagcaggccattggtggccagggtgttcttcaactggccgtcgatgcggttgaaggtcggaccgaagccgacggaaaccttgtcgttgatcttccaggcgatggtcggctgcacggtgatcacctgcaccttgctataggagccgtgggagctgcccatgaagccgttttcgtaatcgttgatgatgccgtagggcacgtagatgcccaggccgaaagtgaaatcttcgttgatcggcgtggagaagtagccgaacggtacggcggccagcggtaccgagtcgcccttgttgctgccctgggcggtgctgtgggcctggctgatgtcgtccttggccttgacgatggccagaccgccgctgacttcggtgcgtttcagcttggacaggccggccgggttgccgtagatggtgctggcatcgagcgcggacgaggcgcggccggcgtaggcggtgccggcgccgctggcgctctgttcgttgatggcgatgccgttggcgagggtgtaggtggagacagcgctaatggtcagtgcgagagaggttttaaaccatattgttttcattgttggagcaactcctgtgtataa

SEQ ID NO: 14384 - DNA, 432 bp, Pseudomonas aeruginosa
actcgtgcaggcgaccgtgcggctggaatacctggcgccacacgcgagcctgggcgaggtggtcgtgctggtcgggcagtggcagtcgcgcggcttccaccagcgaccaggcgatggccgtgctgtagcgcaggttcaccgtcagttccaggtgcggcgcggcgaggaaggcatgctggctggccaggccgcggacccggctggcgcgctccgggtccagcgccaggtactggtcccagagctgctggtggcgttcgctggcgatccggtacaggccgtggccacggcggtcgtcgagggcgctccccagcgccgactggcaggccgcagcgcccagcagcagcgcttcggcggcggggctgtggcaggacaggtagtccagggtcgggcgtatcacgtgctggcaaagatcgttggcggaaatacccatga

SEQ ID NO: 14385 - DNA, 1584 bp, Pseudomonas aeruginosa
accggcgcgtccttgcttcgcttgtgctgggcggcattctcagcccctgcgcaggctgtagaggaagtcgcggatgatggctttcacttcattggccgcttgccgcttgttgcgtgcatcgcgaagactcatcgcggcctgggtaaggaagccgtagagctggccgaccagggtttcccggcggtagtccttgagttcgccactggccgccagttcgtccaccaggcgcccgacgtagcgcagcgtgtggcgcgagtcgatgcgtttccatcgctcccagccgacgaccgtgatcacctcctgcagcgacagttgccgcttgccgcgcgccatcacgctgtcgatgaaggcctcggccagtgcggcggcctccgcccacttgtcgacatgcgccggcaccctgtccaggtcctcggcgatcgtccgtacctggcgttcgtagcattcggcgagcagttcctgcttgctgccgaagtggtggtagaacgcgcccttggtcacgcgcgcctcgcgggcgatggcgtcgatggagactccgccatagccatgttcgatgaaggcggagagggcgctttccagcagcgcctcgcgggtcgcctcggcattttcctgctgcctgctcttgacattcatactgctgccttcttacataccgtcggtatgttcatgctagcacgcctggcgatccgtcgagcattgcgtccgtcccggctgctcgaacccgcacggcaaaggagggagcgaatgagtaccgcagtggagatcgcctgccgtgacggtgtgcgcctggccggcgaccacttcccggccgtcggcgatgcgcaggggagcatcgtggtggcctgcgcgctcggcgtcaggcgcgccttctaccagcgcttcgccgtcctggccgcggcttccggctatgaggtgctgttgttcagctaccgcggcagcgaaggcgacgaccctgccgtggctagctatcgcctggccgactggggacgcgaggacatcgatgcggcgctggcctggtgccgagcgcgcgcgccggagctaccgcgctatttcgtcggccacagcatcggcgcgcagttgctcggtctggctggtcaggccagcggattgagcggcgccgcgttcgtcgccggttcgtttccgtactggaggcgctggcgaggcaggcaacgctggcagatgttcggcctgttctgcgtggcggtgccgctactgaccggactgctccgacgctttcccagtcgtttcttcggcctcggcagcctggatatgccgagtcatttcatgcgcgactgggcgcgctgggtgcggcagccggactacctcctggcaccgcgcttcggattgcagcggcagggttacgaggcgctggacatccccgtcgccagcttcctgttcgaggacgacgactacgtgccgtgggctgcggcggaaaagcttcaccaggtctatgccgcggcgcacctggagttgcgtcgcaagggacgggccgagggggcagtcgggcatttcgggctgttccgcaacgaggcgttgcagaaggagttgctcgactacttcaggaagctgcccgacgcggcgtaa

SEQ ID NO: 14386 - DNA, 1716 bp, Pseudomonas aeruginosa
ctcggcgggatccggcagcggatggcgaccggtcacgcccttgcgcacgggagcggaaagatcccgttcgaggtcggcgaaatgcgcgccgggaatgtggttctcctgatagacgcgggcaccgtaggacgggtcttcgagggcgaaacggcagtcgaggaccagcaggtcgggttcgctgaggcgggctgccagttgttgcgcggtcagcagttgggcggacgacatcgcggactccttgggtcgggaagcaaagccggtggcggatgggtggatcatgccccttggaccgcgtcgcgtcatcccggcgtcgcgcggcgaggcggagaaatggcgaaaggaaagggctggctccaggcgaggaagattcctactcggtcatcagcctcgcccggcagcgggggatttgtccagacatgcagaatcggctcgttccgagatacccgctcctgtgttctatccctcgggacgcttgtccgattggcttggcccgacgcttgcgccgggctttttttcgcctcggctttttcagggaatcgccagacggccgatccgatcgttttccaggctgccgaagtagagctggtcgcccaccggcttcgccgaggtgatcatgcgcaggtggtggccgctggtgtcgtgcaggctgcggacgatcctgccctgttcgtcgatggcgatgaccagcccgtaggcggtcggcttgggcaggaacatgcgcggcagcttggccagctgcgccttcagccagggatgccggtggaggaagtcggcgtcggccttgcgcggggtcggcagggccacccagaaggtacccttgcggtcgccctggaggttgtccggcaagcccggcaggttgtcgatgaacacctcgtgctggccagccttctcgcctttcagccagtagcgggtgatgcgatagcggtaggtctcgttgaccagtacgaagtcctcgtttgccgagagtgccacgccattggcgaagtacaggtccttgagcagcacctcggtcttgccggtggacgggtcgtagcgcagcaggcggccgtgcggtcgggcctcgagcaggtcgaggatgtagtcgggctggtggaacttgctggaagcgtcgctgaagtagatgcggccgtcgctggcgatgtcgaggtcgtcggtgaaggcgaaggggacaccgtcggcctcggtggcgaggatttccaccttgccctgcggatcgatgcgcagcaggcctttccaggcgtcggcgaggatcaggttgccggcggcatcgaagtccatgcccagcgggcggccgccggtgtcgacgaaggtctcgaccttgccgctggcgtccaggcgtaccacgcggccgtcggcgagaccggcatagacgcggccctggctgtccacggcggtgtcctcggggccgtgcaactggccctggccaagcagctcggccttcatcagggtgtcgttgggttcgaggaccccggtcatctgcggagcggccggagcatcccaggcgagcgggtcgatcgggctggtcttcagggccaggtaaagagccgcgccagccagcaggaggacgattattccgctgagcttcttcatgcagttcccttgttcggattgtcggacaaagggcggagtatggacattcgctacgctcatcggcaagcgcggtgccgagcggaatgctcgcatggcgccaggctctatataatgcgccgcacttga

SEQ ID NO: 14387 - DNA, 282 bp, Pseudomonas aeruginosa
tcgcccaggctgcgcgcctgccgcaggagcgaatggcccgaggcgctgcccgagccgctgccgccggaggtcaccccgctgctcaagagcctgcgcgccatcggccagcgcgaagcggagaccctgggcatggcgcccgaactgatgctgcgcaagaaagtcctcgaggcactgctcaagagcggctatcccgacggtccctacgaactgcccgattccctccgcggctggcgccgcgaacgcatgggccaggccctgctggacgccctggagagcgcatga

SEQ ID NO: 14388 - DNA, 609 bp, Pseudomonas aeruginosa
gcggcgcgcaagattcagatcgtgccggtgcggcatgatggtcgtggtggtggtggtggtggtggtggtgcgagtggccgtgcccgtggtgggcatgccgtcgcgcagcagccaggcgcaggcgagattgaccagcaggccgagcgcggcgaccagcatcgcctgctggtagtggatcgggctggggtcgagcaggcgttcgaccgattggtagagcatcagcccggccaccagcagaagcagcagggcgctggtgtagctgccgagcacctcgatcttccacgtaccgaagctgaagcgcgggtcgttggcatagcgccgcgcggcgccgtaggcgagtaccgcaagacccagggccagggcatgggagctcatgtgccagccgtcggcgagcagggccatggagttgaacagccagccgccggcgatttccgcgaccatcatgcaggcggtgagcaataccgcccagcgcgtgttgcgctcggccagcgggttgccctggtcgaaccgatgggaatggcgcaggggctgggtagtcggggtgccgggcatttgctactgtcctgtcgagacgtcgaaaatatactataccccagtatattaccttga

SEQ ID NO: 14389 - DNA, 465 bp, Pseudomonas aeruginosa
actatcgcgccttttcaccagcccccgatgccatggccgccaaagtcgaacccttctggaaacgcaagaccctcgcccaactcgaccaggacgagtgggagtcgctgtgcgacggttgcggcctgtgctgcctgcagaagctcgaggacgaggacgacggcagcgtctactacacgcgtatcgcctgcaagctgctcgacctgcaaagctgccgctgcaccaactacgccgagcgcatccgtttcgtccccgactgtatccagctcaccccggcgcaggccgacgagttccagtggttgccgccgacctgcggctatcgcctggttgccgaaggcaaggacctgccgctctggcaccacctggtctgcggcgacccggagcgggtccacaaggaacgcatttcccagtccgggcgcatgctcagcgagacccaggtggccgaggacgactgggaggactacctga

SEQ ID NO: 14390 - DNA, 1620 bp, Pseudomonas aeruginosa
tatgtattatcattcgcatatttgcaagggacttccgtatccgacggaagcggggaggcgaggtgttgcagcgggtcaacggcgcggggggcgccgccggaggatgcacggatggatgagcgcttccgtggttccgtctcgcatgcctatcaggcgttccatggcgagttgctgcgcttcctgcgcaagcacctgggcagttcggcggacgccgccgacctcgcccaggatactttcgcccagtggctgaaatggccgggccggcaatcggtcgagcagccgcgcgcatttcttttccagatcgcccgcaacctgttgcgcgaccattggcgccggcagcagagccgcggccaggatctcgaccggccggcggcgaacgacgaacccgccgcgctggaaggcgaggcggccgggccgggcgagcgtttcgaacagcagcagcgtctcagccacctggcggccgcgctggccgagctgccgccgcggcggcgcgaagcgttcgtcctgcacaagttcgacggcctgtcccaggtcgaagtggccgagcgcatgggaatctcccctgagcatggtggaaaagcacatcgccagcgccttgctgcactgcaagcggcggcttggccagggaggcgaaggatgaagccgctggaacgactggaaccgctgttcgcagacgaaaccgaagaggacatcgatcaccgcgccgcctactggttcagccggcgtcgttccgggcatttcagcgctgcctgccgggccgagctggaggattggctacgcgccgatccgcgccatcgcgaagcgctcgagggcatggagcggctctggcgcgaattcgacggcctgccgcgcccggcgctggacgatattcccgagccggtgccggcctggcgcctgccccgggcgctggcggcggcgttcttcgtgttctgcgcgctgctcgtcgccaccctgttctggcgcgaccagtcgctcggaccgaacctcgcctacggcacggcacctggcgagcagcgcgaggtggtcctggcggacggatcgaagctgttcctcgacgtcgatacccaggtgcaggtgcgttacgccgagcgcacccgcgacgtgctgttgaagaaaggcgaggtgttcttcgtggtcagccacgatccggcccggcctttccgggtcggcagcggcgacagccgggtcaccgtactcggtacccagttcagcgtccggcgcaacgcgcaggccctcgccgtggcggtgaaacaggggcgcgtggcgttgcagccgtccctggagaaggatgccgaacatgtgctgctggctggcgacagcgcgcgcctggacctcgccgagcagcgcctggaactcggccatgtggcgccggagcaggtcgccagttggcgcgatgggcaactggtgttccgcgacaagccgctgggcgaactggtggaggaactgtcgcgctatcgcgccgcgccgatccgcctgggagatccccggcttgccggcaagcgggtctccggtacggtgcggatcgcccgccccgacgattttctcctcgccctgccggcgctattgccggtgcgggtgcagccgcaggctggtggcgaggtgctgatcctggcgcgctga

SEQ ID NO: 14391 - DNA, 2244 bp, Pseudomonas aeruginosa
acggccagcatgatcgcggcgagcaggcccatggcgggccagaagcgtcgtttcacgaaggttccctttttcgtggcggaaggccggcgtcgccggcccccgcggtggtcataccaggccgaggaccttgagcaggaaggcgtattccagcgccacgtccttcagcccctggtagcggccgctcatgccgccgtggccggcgccgaggtcggtcttgagcagcagcaggttggcgtcggtcctggtcgcccgcagtttcgccacccacttggcggcttcccagtactgcacgcggctgtcgttgtagccggcgaccaccagcaggtgcgggtagtcctgggccctgacgttctcgtagggcgcgtaggcggcgatccgcgcatgcacctcgggctcctgcgggttgccccactcatcgtattcggtgacggtcagcggcaggtccggattgagcatgctgttcagcacgtcgacgaacggcacctcggcgatggccgcgccgaacagttgcgggcgctggttgagcaccgcgccgatcaacagcccgccggcgctgccgccgctgatggcgaggccctcgggacggcagtagccctcggcgagcaggtgctcggcgcaggcgatgaagtcgtcgaagctgttctgcttgtgttccagcttgccggcccggtaccaggcttcgcccagttcgccgccgccacggacatgggcgatggcgaagacgaagccgcgttcgagcaggctcaggcgggcgtgggagaaccagggatcgaggctatgcccgtaggcgccgtagccatagagatagagcggcgcggggcgcccggcggcgatgccgtcgaggacttccttgcgcgccaccaggctgaccggcacctgcgtgccgtcgccgctgctggcccagatgcgccggctggcgtaggcgtcggcgtcgaaggggccttccaccggggtctgcttgaggacggtctgcgtgccatcggcgaggttcagctggcgtacctgcgccggacgattcagggcctcgtagcgcagtcgcacgcaggggctgtcgaattccaggctgtcctgcacgtagaggctgtaggcggcgtccggcaactgcacgcggtaggccggcaggccctgcggttgcacctcgatcaccggcaggccgccgtcgcgcaggccgaggatcaccgcctcggcgttcaggctgacatcttccagggtccgctgcgggtcgtgggccacgcgcagttgccagtgctcgcgagtcggccgcgactcctcggcctggtagagggcgaagttgatccccgcctggttgctgcggatcagccacaggccccggccgtcgaggcgaccgtggtcggggtagtactcgtggccttcctcgcgcggcgccaggcaacggaacgttccctgcggctggtcggcgtcgagcacccaggcctcgctggtggtcttgctgttgagcaggaggatcagctggcgttccgagctggagcggtagcagtgcaggaagaagcgcccgtcgccttcctcgaacaccagctcggcgccggcctcgcccaggcggtggcgatagagcttgtgcgggcggtgggtgtcgtccagttcgccgaagaacagcgtgcggttgtcgttggcccaggtcaggctgccgtcgcagtcgtcgaagggcagggcctgcaccgcgccgctggcgaggtccttgacgaacaggcggtagatctcgtcgccgctggtgtccaggctgtaggccagcaggctctggtcggggctgatgctgaaggcgccgagggagaggaagccgccgtcggccaactggttgggatcgagcaacagttgctcggcgccttcgtcgacctccaggctgccgtccgccggacgcgggcagcggtagtggcgcgggtattcgtcgccggcggtggtgcgctggtagtacagccacggaccccacggattgggcaacgacaggtcggtctcgcggatgcgtcccctgatctcctcgaacagggtctcgcgcaacccggcctggtcggccagttcgctatccaggtaggcgttctcggccttcaggtagtcgagcacctccggggcgtcgcgctcctccagccaggcgtaggggtcgcttccggcgtcgcggcgggcgatggggggctgcggatggggcatcgggaatcctcgtcgatccggccatgcgcgaggccgggaaatctgaataaaactggcggcgcggcgcccgccatcggtgggtag

SEQ ID NO: 14392 - DNA, 840 bp, Pseudomonas aeruginosa
cgaatatcgcaagaaaggtgtgttcaatgccctgatcagcgacggcgactggctgttcaccttctgctccagcaaactcgcctacattacccgccgtgcgccattcggcccggcgcggttgaaggatgccgacctgaccgtggacttccaggcggaaaccacgccggacgatgtggtcacggtgatcgccaccgagccgctcaccgacaacgagaactggaccttgcagcagagcggcgagtgggtcctctggtggggcggcgaggtgttggccaaggggcgggtctgaatcgccgccgtgaacgaggagagcgcatgttccgcagttacctgagactgctgctgttcaccctgggcctgctgctcggggtgcaggtgcccggtttcatcgacgactacgccaagcgcgtcgacgcccatcgcctggaggccgcgcagaacatccagggcttccagcagaccgccgggcagttcttcaacggtagcctggaggaactggtcaggcattaccgcagcaacagcgatccggtgttccagcgcgacggcgagaacctcgaccgcctgatgcgtcgcgcgcgcatgctcgacgctgagtggcaggccatgcagggtccctggtacgcccgcgcctggcacatgctgcgcgcaccgaaccatgagttgctgatggaaacctatgccagctacagctaccaggtcctgctcaagcccgaggtgatcgcctggggcctgggctgcgccttgctggtcgcctggatcgccgagctgatcgtgtattcgctggcctcgctgttcggcttcggcgaagaccgccgcacccgcgagcgtcactggagctga

SEQ ID NO: 14393 - DNA, 921 bp, Pseudomonas aeruginosa
ggcgcgactcaggccgccgccagttccaggaatgccctgatcacccgtaggccgcggcgcttctccaggcagccgatcaggtggcggttggtcagctcgggaccgaccagcggcaccgcgcgaacccgcggatcgttgccgacctccagggaagacaccacgccgacgcccagttcggcggccaccgcttcggtcaccgcttcccggctgtccagctccagcagtacccgcggctgcacgccctgctcggcacaggcgcggtcgaaggtgcggcgggtgatcgaaccgggttcgcgcagcaccatgatctgctggtcgagctcttccagcggtacgccttcgttgcgttcgcaccagggatgctggcgaggcaacaggggcgcagatgcgcgaattcaccaactcctccaggaacagcccgggacgcgcctcgacctcggtcagcacggggacgtcgacgtgtgcgctgagcagccccgcgaggttctcctgggcgttgcccagacgcaggttgacggtgattcccggatagctcgcgcgcagccgggcgagcatcggcatcaccaggtgcgggccgtcggcggcgacttcgaggcggccggagaccaattgtcgattggcgtcgagcagggcctcggcttcttcctccagggcgaacagggtgcgcgtgatcgccaccaggcgcgagccctcctcggtcagttcgatgcgccgggcggtgcgccggaacagggtgacctggtagtgctcctcgagtgccttgacgtgtccggtcaccgccggctggctgatgcacaggcgctcggcggcgcgggtgaaactgccttcgcgggcgacggcgtcgaaggcgcggagctggaagagattcatggtatcggcctggcttatggctggcatcggaacaaacaatttgaacgatag

SEQ ID NO: 14394 - DNA, 432 bp, Pseudomonas aeruginosa
tcgccgcctccggcaagtgcctggagggcgtccccgggatgggcttcgtcttcgcccgcagcgccgccctggaagccagcgccggcaactgccactccctggccatggacctgcaggaccagcacgcctatatgcgcaagaccgggcagtggcgcttcaccccgccgacccatgtggtcgccgccctgcacgaagcgctcagccagtacgaagaggagggcggcctgccggcgcgccagcggcgctacgcgagcaattgcgaaacgctgctcggcgagatggcccggctcggtttccgcagcttcctgccggcggaaatccaggcgccgatcatcgttaccttccacgcgccgcgcgatccgcgctaccgcttcgccgacttctaccaacgcgtgcgggagaagggcttcatcctctatccgggcaagttga

SEQ ID NO: 14395 - DNA, 900 bp, Pseudomonas aeruginosa
  unsure (344),(593),(673),(683),(696),(705): Identity of nucleotide at the above locations are unknown.
gtcgacaacggcgctggtcgcatcgccggcaaccgaggtgtggtcatcgatgcccggcaggtggacaaccgtgccggcgagattgccagccagggcgtggcgacgctgaacctcactgagcaactggacaaccgtggcggcaagatcgtcggtgacagtggtctgggcatcaccgcgccacgcgtgctcaaccaggacaagggagtactcgccagccgcgatgggctgcgcctgagtggtaccgaattgttcaatggcaatgccggactgctcagcagtcagagacatatagaggtcactctggacggcgtgctggacaatcagggcaagggcgcgctgctcancgacggtaccctgacggtgagcgccgggcgcatacacaaccaggacgccactctgtccagcgccggtgcgctgatactgagcagccaggaggcggtggacaaccgtggcggcaagttggtgacggactccagcctgcgcctgaccatcgccagcctggacaacagccgatcagggatcatctgtgccaacgctgcggcggagatccataccggggtgctgaacaacagccaaaaaggcgatcttggcantaatgaacggctcggcccgattgctactgatgtggataacaaccagaaatgtctgatcacttgcccaggcgtgatcgacnccaatatccngggaactcatccncacgggcanaggccggctggtcattattgccgcatcttactccgacctgaactagggaacccggtccatggggccccaagcccgaatctccacccctggaacccttggtccggcgcccactcgggttggtggtacaccaccggcggggaaaattccccccaaaccagccgtcaaaatccacctaccccgggggggaacaaccag

SEQ ID NO: 14396 - DNA, 489 bp, Pseudomonas aeruginosa
ccaccaccggacagccggcggccagggcggcggcgctgtcgccgccggcggtggaaaaggccagcgggaagttgctggcaccgaacaccgccaccgggccgagaccgattcgccactggcgcaggtcggggcgcggcggggtacgcccgggttgtcctcgatcgatgcgcgcgccgtggaagtcgccacgccgcaggacttcggcgaacagccgcaactggttggcggtacgtgttcgttcgccctggatgcgtgcggcgggcagcgcggtctcgcgacggaccagggcgacgaagtcgtcgcccagggcgtcgaggcgcgaggcgatcgcctcgaggaatccggcgcggcgcgttgcggacagttgccggtagtgtggataggcgcgttcggcggcgcgggcggcggcgtcgacctccgcctcggtggcctggacgaaggcgtagggcagcgcttcgccgctgtcggcgtcgaggctgcgcaggatga

SEQ ID NO: 14397 - DNA, 1590 bp, Pseudomonas aeruginosa
ggttgccggcggcgctgcgagcgccgccgacgtagttgtgaccgaggatgctgggcatggggcctccctggggacggtggacggaatgctctgccgctggccctcgccggccgctccccggggagcgaggcggcgagggcggggcgtcggctacaagccgatgtccggcagcgccggccggctggccagggccttggccatgatccgctcgacgtgctcgcgatcggcgccgcgcagggccaggcgcggtggacgggtgagggcgctgccgcgaccggcgagttgctcgcagagcttgatgcactgcaccaggtcgggacgggcgtcgagatggaggatcggcatcagccactcgtagatcggcatcgcctcggcgaagcgcccggccctggccaggcggaagatggtctcgccttccttcgggaacacgttggacattcccgagatccagccctgggcacccaccgccacgctttccaggaccacgtcgtcgagcccggcgaagaggatgaagcgctcgcccacctggttgcgtacgtcgatgaagcggcgggtgtcgccggagctgtccttgaagcagacgatgttctcgcagtcggccagggaaaccaggatgtccggggtgacgtcgttccggtagatcggcgggttgttgtagaccatcaccggcaggtcggtgccgctggccacgctgcggaaatgctcggcggtctcgtgcggcttggaggaatagaccagcgccggcatcaccatgatgccgtcgacgccgacccgctccaccgccttggccaccttcgccgcgccggcgctggtgaactcggcgatcccgcagatcaccggcacgcggccgccggaggcatccttggcgacctccgtgacggccatcttctcctcgatggtcagcgaggtgttctcgccgacgctgccgcataccaccagcccggacacgccgtcgcgcaccaggttggagatgaccgtgtgggtttcctccaggttcaccgagaaatcggcgttgaattgggtggtgaccgcggggaatacgccgctccagttgacgtgcttgctcatggtttctccttttttcgtatttcgtatacgaattcaatcggaccgctgcggtccgagtcacagggcgacggcagcgttcgccgtcgtgggcgatccggtacgcgccggatcggtttccgcccggccgctgcctgcggtcgggcggggtggtcagcagtggccgccgggccaggtgtcggacagccgatagccttgcggccagggatcgtccggggcgagcaggtactggtggatgccggtgatccaggcccgcccggacaggcacgggaggatcgccgaacggccgccgagttcggtcagcgactcgatgtggcagtggaattccgaaccgatgatggagcgcccgacgaagcgttcgccgacccgcagctggcctttcgcctggagcaccgccatccgcgccgagcagccggtgccgcagggcgagcggtcgatcttgccggggcggatgaccaccgcgttgctcgcgccgaggacaccgtcgcggcgctccggcggcgcggccagctggcagaaggatag

SEQ ID NO: 14398 - DNA, 777 bp, Pseudomonas aeruginosa
tctcgatcattgctgccatctccgttccagccgggcgccgagtcgcgcgaccacccagctcatgaggtaatagacgagccccgcgatgcagagcacgaagagtggttcctggatgcgcgtgacgatggtctgcgaggcgcgcagcagttcgacgatgccgatccagagcaccagcgaggtgtccttcatcaccgacagggtcaggttgacccaaccggggaaggccacccgggcggccatcggcaggacgatgtggaacaggtcctggcgatagctcaggcccagcgaacgcgcggcccggcgcacgctcggcggtaccgagaggacgccgccgcggaccacctcggcgcagtaggcggcggcgtacacgccgagcaccaggcaggccacggcgaaggcgctccagtcgaggccgaggatgctcttgaaggaattgagcaggacgaactggatcagcagcggcacgctgcggaatacgtcgagcagcgccgccagcggcaggctggcgcgtggcagcagggcgcggagcaggccgaagacgacacccagcagggtgccgatcagcatcgccatggcggtgatggcgagggtggtccaggcgccttgcaggaggaacagcaggtcgttggcggtgaggctggtggtgaacacggcattcccctcagtaacggaacaggcgccagcccagcaggcgggcggccagcaccagcagcttggccatggcgaagtagaggacggcggccagggcgaagtattcgaaggtgcggaaggtcttga

SEQ ID NO: 14399 - DNA, 1449 bp, Pseudomonas aeruginosa
acgccgagcgccagtggaaggtgtagtcgaacatcagcagtcctcgctcaaccaggcgggcagcccggcgggggcccgcccgccgacggcggcctcgacgcagccggcgaggccggcgaagcgcacctggcggccgaccagtccgggggcgtagtgggcatacttggcggagttggtcatcagggtgcgcgcgcccggcggcaccagcggttcgtcgagcatgcaccagcaggtgtcggtgaccagccgcgcgccgaacgcctgcagcgtcgccaggtgcccggccgcttcggcctgggcgacgacctgccggctgctggtgatcaccagcgctacctccgggtgtctgcggcggccgtggcagagcgcggcgagctgggcgaattcgctggcggagaagtgcgggttgcccagcgccaccaggtcgatccgcgtctcgccggcgctgtccagctcgcgccaggcgtcgcgcaggcgctcgcgtccgacccgcagggtccgccgcggcgcgcggccgccgaaggcgctggccaggtcaggggcttccggggtgacgccgatgacgtggaacatcggcaccgaggaactggtgcccagcgccgcgccgaaggccttgagcgcgtcgtggtccggctgccgctgccgcaggccgtcgatcgccgggatctgcccgtcgcagagcaggccgcagaggtagccgagggtcgggtagaaggcatcgtcgacgctgccgaggtcttccacttcgatcagtacccgcgcctggcgctgctcgtcgaggtggcagccggccagcggcgcgcgaccggtgagggcgcagcagatatccatgaagtcggcgtacttgttggtgcgtgcgccgagcacgctgttggcgaagagcaccgcgttggactcggcccagacgatctgttcgccggcccgcgcgctgttgtcgagcaggtagggcgcgcaggtgaagctgggctgcgcgcccatgtcgagataggcctgggccagggccgcggctggctcgccgagggcggcgggtacgccctgttcgcgccaacggcgctggtccacggagatggtgttgagggtggtcggtacccgtacccgggcaccgaggtcgcgcagggtttcggcgaagcgcaggccggccgggccggtgtagatgcaagcgtcgatgtgcgcgcgctggatgtcgatcagccgttgcgcgccctgcaacgccgccatgcgcaggacgatgcgcatcgccaggcgtgcggcttcgccgtgttcgccggcgagcagggcctggtcgaaggcgtccagtcgtgggccggcatcggtcgccagcgcttcggcgggtcgggtctccagcggcggcggggcatcgcggtggagttccaggcgtccgtcggccaggcgcgcccagggataggcggcgagttcgtcgaagcgctcgccgagacaggcgatgggtag

SEQ ID NO: 14400 - DNA, 414 bp, Pseudomonas aeruginosa
aggcattgccggcctgtaccggcgagagaccggcgccggcctgcagggccagggcgagggcgaacaagaagccgctccagcaggcgaagaacaggatcgccagcaacaggccgaagcggatgctcggcaggcgcagcagcgacggcggcagcaacggccaggcctggcggcgttcctggcgcagctcggtgcgccacagccaggccagcagcggcaccgccgccgccagcagcagggcgcagggccaggaccagtgcagcgatgggccgagagccaacggcagcagcaggcagaggatcagcgcggcgagcagcagggtgcccggcgcgtcgatgcgggcggcatgctcggcgcgggtttccggtacccagcggcggctgcaaaggagaatgccgaggcagatcggcaggttga

SEQ ID NO: 14401 - DNA, 1170 bp, Pseudomonas aeruginosa
acggcgacgatcagttccagttcggtttcgctggcgccgagggaatgggcgagggcgtcgagggcgacgttgacgatggagaaatcgatcatcggcaacagttgccccgccagcaggatgcagagcccggcgaggccgagccgcgacgacgagacggtgctgggcatgggcggagtccttgtgcggaagggagtgggctggcagcatgcgcttctggctaacccggtaccagttcttgcttatcctggtattggcgctacccgtctgcccttcggaggacttcgccatgcccctcgacgcccctgccagccacgctgcggaaagccccgcgcagccgtcccgcgccgaacagctgggggccttcctgcgccgccggcgggaaagcatcgagccgcagcgggtcggcatttcccgcctcggccgccgacgcacgccgggcctgcgtcgcgaggaggtggcgcagctcgccggggtcggcgtgacctggtacacctggctggagcagggccgcgcggtacgcgcttcggagcaggtgatcggagccatcgcccgggccctgctgtgcaacgagacggaaacccaccacctgttcaacctcgccgggctggccgcgccgacctcggcgcggcgggcggtctgcgagaagccctcggccgccacccaggccatcctcgatgccctcgacccgttgccggccatggtgcagaacgcccgtttcgacatccgcggctacaaccgcgcctattgccggctggtgggcatcgacctggcggagatccccgaggaagaccgcaactgcatctacctggcgctgacccacgagcgctggcgctactgcatggccaaccgcgaggaggcgttgccgcggatggtcggcttcttccgcgcggcaatggtcgagcgcatgggcgatccgctgtgggagcggcagttgcagcgctgcctggaggcttcggcggagttccgcgagatctggcggcgcaacgaggtgatgggtatcgaaaaccagctcaagcgcttccgtcatgcgcgctgcggcgaattcgaactgcagcagaccaactggtggtcggcgccgaagaacggcgatcgcctgctggtcttcgtccccctcgacgaccacgcccgcgactgcctggagcaactgtgagtcggcgccctgtcccgtag

SEQ ID NO: 14402 - DNA, 936 bp, Pseudomonas aeruginosa
cctcgactcgaacctgaccgacggaggcgagcgatgcgcgcgaccacctgcaccccgcgagcgatgcccggggcgacccgcctgctggccgtgcaactgggcatggtactggcctggagttccggcttcgtcggctaccgctatgccatggaacaggcgccggtgttcctcaccagcttctggcgcttcgccgtttgcctggcgctgctgctgcccttcgcctgggccgggctgcgccggttgtcggcgcgccagtggcggcgccaggcgctgatcggggcgttggcctacgcgggctacatcgcgccgatcgccaaggccatcgaactcggcgtctcgccgggcgtggcggcgctgatggccgacctgttgccgctgctggtggccttgctggcgttggtcctgccggggcagcgaacgcggccggggcagtggccggggatcgccctgggcgtcgccggggtgctctgggccgggcatgcggcgctggcgctggggcgggcgccgggctgggcctacggcctgccgctgctgggcatgctagcgctggccctggccaccctgttgcagaagcgctgggacgatgcgccgggatcgctggccgtggtgctgttcgtgcagatcggcgccgcgctgccggcgttcgccggcctggcgctggcggagggtagcatgcggccgccgctgtccggcggattcctgttcgggctcgcctggctggtgctgctgcccaccttcggcggctacggcctgtactggctgggcctgcgccatctttccgcacagggtggcagcgcggcgctgtacctgagcccggcgctgaccctgctatgggcgcactggatgttcgccgagccgctgacacccatgctgctgggtggtctgctgctgtcgctggccggcctcggctggctgaatcgcgccgagcgtcgctag

SEQ ID NO: 14403 - DNA, 1251 bp, Pseudomonas aeruginosa
acagttcgatcatggccgggcactcccggagctggagaggaagcgttgcggcagataaggcgtggcatccagcggcggcgtttcgccgaacaactgggcggcgagcaggcgcgcgctgcccggcgcggtggtcacgcccaggccctcgtggccgaccgccagccacaggcccggctgcgccgggtgctcgccaagcagcggcaggccgtccggagtggcagcgcggaagccggtccaggcacggatcgcattgaggccggcgagccccggcaggtagtccagggcacgccgcagcatgcgcgccagcaccgggccttccacctgcgggtcgagcgtgtcgaactgccgcgaggagccgaggaagacctgcccggtggggcgcggctgggcgttgaaggctaccgaggtaccgctgctggcgtgggcgctgctgacatagccgagttccaccagttgatggcggagggtgccgggatagcggtcggtgatcagcaggtggcctttcttcgggcggatcggcagctccgcgcacagctcgccggcatggatgccgttggccagcaccagcgcctcggcgctcagccagcggccgtcggccaggcgcaggcggctgccgtccacttcgctgacttcggcgtgcaatcgacgcaggcgcgggccggctcgttcgagcagccagcgcgccgcgttgggcgcgtagaggatgccgtcgcccggcaccttcagggcgccggcgaggcctggccgcaagaccggttccaagtcacgcaggcgcgcggcgtcgagcatctcgcaggcgacgccggcggccagcagggcctggcgcttgcgctcggcttcggcgagttcggcggcgtcggcggccagccagagggtgccgcaattgcggtacgcgcagtcttccggcagatccgccgcccaggtgcgccaggcctggatcgagtagtcgctgagggccagttcggccgggttgtcgtccatcgccaccaggtgccccatgcccaccgcggtggcaccgccgcggcggctgtccagcaccagtacgtcgaggccgcgacgcgccagttcatgggcgcaggcgctgccgacgatgccggcgccgaccacgatgacctcggcgttcaccggcggatgccccaggcgaacggatcgtcgtccgccagcagcagggtggcttccgcgctgacgtgggcgcggccgcggatggtcggcacgatacgcccgccgggctggccgtcgagccattcgtaa

SEQ ID NO: 14404 - DNA, 528 bp, Pseudomonas aeruginosa
cggcaacggcaagggcaagagcagctcggccttcggcatggtcgcgcgggccctgggccatggcatgaaggtcggcgttgtgcagttcatcaagggcgccgccagcaccggcgaggaagccttcttccggcgcttccccgaggaagtcagctaccacgtgatgggcgagggcttcacctgggagacccaggaccgccagcgcgacatcgccaaggccgaggcagcctggaaggtcgccgcgcaattgctggccgacccggacgtgggcctggtggtgctggacgaattgaacatcgccctcaagcacggctacctggaactggacagggtcctcgccgacatccaggcgcgcccggccatgcagcatgtggtggtgaccggccgcggcgcgcagccggggatggtcgaggccgccgacacggtgaccgagatgagtctggtcaagcacgcgttcaaggccgggatcaaggcgcagaaaggagtggaattctgatgccggcgccatgcgcggagacgcttcgcccatga

SEQ ID NO: 14405 - DNA, 741 bp, Pseudomonas aeruginosa
cggcttcctatatccatttctacctgccttccaacccgcaggccgccgccgcgttgctggcgcccgcgcgagacgccgactgacatgtccgattcttcccacgccttcagcgccacggaacgcgccgccgtctaccgggccatcgccgagcgccgcgacatgcgccacttcagcggcggcagcgtggcgccggagctgctcgcgcggctgctggaggccgcgcaccaggcgcccagcgtcggcctgatgcaaccctggcgcttcatccgtatcaccgagtcggcgttgcgccgggccatccacgggctggtcgaggaggaacgcggacgcaccgccgaagccctcggcgagcgctccgacgagttcatgcggctcaaggtagagggcgtgctggattgcgccgaactgctggtcgccgctctgatggacgaccgcgagcgccatgtgttcggtcgccggaccctgccgcagatggacctggcgtcgctcgcctgcgcgatccacaacctctggctggccagtcgcgccgagggcctggggatgggctgggtatcgctgttcgatccggccgcgctgggcgagctgctcggcctgccgcccggcagcgaagcggtggcggtgctctgcctgggcccggtggcggagttctacccggcgccgatgctggcgctggagggttggagcgaaccgcgtccgctggccgagctggtctaccagaaccgttggggcgagcgagcatga

SEQ ID NO: 14406 - DNA, 1194 bp, Pseudomonas aeruginosa
tggccgccggcgccggtgcgctgggcgtgtccctgggcggcgcggcgatctaccacggcgagctgcaccagcggccgctcctcggcagcggcccgcagccgcagggccgcgacatctatcgggccctggcgctggtacgccagggcgtgctgttctggctgctggtgctggccggactctgggccatggggtggctgcatgcttgaacacggagggcggttgcgcgaggcggcgcgccgctacgacattccgctggcggactggctggacctgtccaccggcatcgcgccctggccgtttccgctgccggcgatccccgagcaggcctggacccgcctgccggagagcgacgacggcctggaagccgctgcctgcctctactacggcgccgaacgggtattgccgctggccggcagccaggcggcgatccaggccctgccaaggttgcggcggggcgggcgggtcggcgtcctgtcgccgtgctatgccgagcacgcccacgcctggcgccaggccgggcacctggtgcgggagatcggcgaggccgaggtcgagccctatctcgacagcctcgacgtgctgctggtggtcaacccgaacaaccccaccgggcgggtcttcgagcccgccgagctgctggcctggcatgcccgcctgcaacgtcgcggcggctggctgctggtcgacgaggcgttcatggactgcaccccgcagtcgagcctggcggcctgtatcaaccgacccggattgatcgtgctgcgctcgttcggcaagttcttcggcctggccggtgcgcggctcggcttcgccctcggcgaacggccgctgttgcaggcgctggccgagcagctcggcccgtggacggtcaatggcccggtgcgccatgtggcccagaatgccttgcgcgaccgccagcaacagcgccagcagcgcgagcgcctgctggccgccagccagcgcctggaggaactgctgcgccgccacggctggccgccggcgggcggcagcgcgctgttccagcgcctggtcgatccacgctgcgcggcgttgcacgactacctggcgcggcgcggcatcctcacccgccagttcgagcagccggccagcctgcgcctcggcctgcccgccgacgaggccgcctgggcccggctggatgccgcgctgctcggcttcaaggagcctgctcatgagtga

SEQ ID NO: 14407 - DNA, 1098 bp, Pseudomonas aeruginosa
tcgcgggcggaccctgatggtccagggcaccacctcggacgccggcaagagcaccctggtgaccgcgctgtgccgctggctggcccggcgcggcgtcgcggtggtgccgttcaagccgcagaacatggcgctgaacagcgcggtcaccgccgacggcggcgagatcggccgcgcccaggcggtccaggcccaggcctgccggctggcgccgcacaccgacatgaacccggtgctgctcaagccgaacaccgacatcggcgcccaggtgatcatccatggccgcgcggtgaccagcatggacgccgccgcctaccacgactacaagcgcgtggcgatggaagcggtgctggcttcccatgggcggctcgccgccgcctaccgggtggtgatggtggagggcgccggctcgccggcggagatcaacctgcgcgccaacgacatcgccaacatgggcttcgccgaagcggtggactgtccggtgatcctggtcgccgatatcgaccgcggcggggtcttcgcccacctggtcggcaccctggaactgctctccgactcggagcgggagcgggtcaagggcttcgtcatcaatcgcttccgcggcgacatcgccctgctgcaacccggcctcgactggctggaggcacgcaccggcaagccggtgctcggcgtgctgccctatgtcagcgacctgcacctggaggcggaggacgccatcgacacgcgccaggcggccaaggtcgggccgcgcctgaaggtggtggtgccggtgctgccgaggatcagcaaccacaccgatttcgatccgctgcgcctgcacccccaggtcgagttgagcttcgtcggccccggccaggcgctgccgtcggcggacctgatcgtcctgcccggctcgaagagcgtgcgcgccgacctcgcggcgctgcgcgagcgcggctgggacgaggcgatcctccgtcacctgcgctacggcggtcgcctgctggggatctgcggcggcctgcagatgctcggcgagcgcctgcacgatccgctcggcctggaaggcgcggccggcagcagcgctggcctcggcctgctggcgttggaaacgacccttga

SEQ ID NO: 14408 - DNA, 969 bp, Pseudomonas aeruginosa
aaggagaaccgctatgagtctgcaatggtggcgcgacacctgccgcgaggcggacccgcagatgcgccggcgcgcggccgaacgccaggaccggttgaccaagccgcgcggctcgctgggccgcctggagcaagtggcgatcgacctggcggcgttgcaggggcgcgaacgaccgagcctggagaggatctgggtgacggtcttcgccggcgaccacggggtagtcgccgagggcatctcggcctatccgcaggcggtcaccggcgagatgctgcgcaacttcgtccgcggcggcgcggcgatcagcgtgctggcgcgcgaactcggcgccggcctggaggtggtcgacctgggcaccgcgttccccctggaagccttgcccggcgtgcgtcacctgcgcctggcggcgggcaccgcgaacttcgtcgaggccccggcgatgggcgccgaacagtgcctgctggcgctcgaggccgggcgcgaaagcgtgcgccgcgccgagcaggccggcagccagctgttcatcggcggcgagatgggcatcggcaataccaccgcggcggcggccatggcctgcgcgctgctggatgcgccggcgagcgcgctggtcgggccgggaaccgggctggacgccagcggcgtggcgcacaaggccgcggtgatcgagcgtgccctggccctgcacggcgcccatcgcgccgaccccttcgaaaccctccgccgtctcggtggcctggagatcgccgcgctggccggcgcctacctggcctgcgcgcagaaaggcatggtcgccctggtcgacggctacatctgcagcgtcgcggcgctctgcgcggtgcgcctgaacccggcctgccgcgactggctgctgttcgcccacagcggtgccgagccgggccatcgccatgtgctcgaagccctggcggcgcaaccgctgctcgacctcggcctgcgcctgggcgagggtag

SEQ ID NO: 14409 - DNA, 681 bp, Pseudomonas aeruginosa
cggcgcggcgctggcggtgccgctgctgcgccaggcctgcgcgctgcacgcggggatggcgaccttcgccgaagcggcggtctcggaccgcccggcatgagcctgcgcctggacctcctgcggcatggcgaaaccgagtccggcggcggtttccgcggcagcctcgacgacgccttgaccgcgcgtggctgggcgcagatgcgcacggcggtggaaggcggacgctgggacctgctggtcagctcgccattgcaacgttgccgcgccttcgccgaggaactggcgcagcgccaggggatcgagctggaactggaaaacgatctgcgcgaactgcatttcggcgcttgggaggggcgctcggcggccgccctgatggacggccacagcgaggcgctcggccgcttctgggccgatccctacgcctttaccccgccgggcggcgagccgctgtccgagttcgaggcgcgggtgctggccgcccagcgacgcctgcgccagcgtcacgccggccgtcgtgtgctgctggtgacccatggcggcgtcatacgcctgttgctcgcttgcgcccgtggcttgccgcgcgagcgcttgctgcaggtggacgtcggtcatggcgcactgttcggcctgcgcgccggagagggcgacgatcgctggcacgaatgccgggaaggggaatag

SEQ ID NO: 14410 - DNA, 807 bp, Pseudomonas aeruginosa
cacggcgacgaaggcctggtcgaaagcctgccgggcaagctcgacgagccgcgacgcgacctccggcgccaggccctcggcgaccaacagggcgtcgtcgaggctgtcgcggacccgcgccggcagctcggccgagggcagcctcagcgacatcccgtagacgaaactcatcaggctgccgagcagggtcacgccgatcaccccgcccaattcgtaggacacgtcttcgatggcggccgccattccggaactctgttcgtccacgttgagcatcaccgcggtggaggcggcggtcatcgcgccgccgaagccgacgccgagcagcaccaggctggccagttgcgctccggtgacggactggtaggacagggccaggccgagcaatccggcgctgccgagcagcagggaggcgcacatcacccggttctcgccccagcgcggcaccagccagccggccagcggcccgaccaccagcgaggccagcgggatcggcaggacgaacaggccggccttcagcggcgtcaggtcctgcaccagttgcaggtgctggctgaacaccagttccatgccgaccagcgccatggtcgccaccagggccaccgcgacgccgcgggcgaagcgccggttgcggaacagcgcgaagtcgatcatcggttcgcgggcgcggcgctggcggcggacgaacaggtacaggcagagcatgccgccgagcgcggcgaggacgaccagcccgaagtccggggcgcgtgtgctgagttccttgatcgcatacaccaccccgaccaggccgaacatcacctgcagtga

SEQ ID NO: 14411 - DNA, 672 bp, Pseudomonas aeruginosa
gccgagggcgtcccatgggcgccgcgactggccgccgcaggccgggatggccggcagcgccagcaacaaagcgacgaccaccaccgggacgttgatgaggaacaccgagccccaccagaagaactccagcagcacgccgccgaccaccggccccagcgccgcgccggcagaggcgacggaggcccagatgccgatggccagggcgcgttcgcgttcgtcctggaagacatggcggacgatcgacagggtcgccggcatcatcagtgccgcgcccaccgccaacccggcgcgggcggcgatcagcgccgcggcgctgggggcgaaggcggcgcacagcgaggccaggccgaacagcggcaggccggcgaggaacagccgcttgtggccaaggcggtcgctgagcaagccggcgccgggcagcaggccggcgaccaccagcggataggcgttgacgatccagagtttctccgcggccgtcgcgccgaggtcgtgggtcaggcgcggcagggccgtgtagagcacggtcatgtcgatgatgatgaggaacagggcgctggagacgatggccaggaccagccagcggttctgccggaacatgggataacctctgtggcgaacggttcatcgctcgccgtggataacgggaattgcgcgccacgggcgggcgcgtga

SEQ ID NO: 14412 - DNA, 1677 bp, Pseudomonas aeruginosa
ggcccaggaataggccagcgtggcgtagccggagaacatcaggtagtcgtggctggcggtgctcaccagatcgcgttgcttgcgcgcggtgagggcaatgcgcagggtcagcaggttccattgggcgcagagcttgagcagcaccagggcgcggccgcgcatgcgcggctcgttcttcagcaggtcgacggcgaaccgggccacgcccctggtgaagtcgcgcacggccttgccctgggtcatcagcaggaccttgcggccgagcaggtcgagggcctggatgccggtggtgccttcgtagagggtggcgatccgcgcgtcgcggacgatctgctccatgccgtgttcgcggatatagccgtggccgccgaacacctgcatgccgaggttggcgctttccaggccgagttcggtcaggcagcccttgaggatcggcgtgaggaagccgagcttgtcgtcccagcgttcgtattcggcgtcgtcgttgctgaggatgccctggatcatccggtcggcgtactgggtggccaggtagaccagcgcccggccgccttcggcgatggctttctgggtcagcagcatgcgccgcacgtcaccgtggtgcatcaggctgtcggcgacctggtcgggttccttggtcccggagagcgcgcgcatggagcggcgttcgcgggcgtaggcgagggcgccctggtaggccagctcggcggtggccacgccctggatggcggtgccgatgcgggcgctgttcatgaaggtgaacatgcattccaggcccttgttcggcggtccgatgaggaagccggtggcgccgtcgaagttcatcacgcaggtggccgaggccttgatccccatcttcttctccagcgcgccgcaactcacgccgttgcgcgggccgagcgcgccgccttcgccgggaaggaacttgggcacgatgaacagggaaatgccgcgggtgcccttcggtgcgtccggcaggcgggcgaggacgatgtggacgatgttctcggtcaggtcgtgttcgccggaagagatgaatatcttcgtcccgctgatggcgtagctaccgtcggggttggcctcggcgcgggtcttcacctggccgagatcggtgccgcactgcggctcggtgaggcacatggtgccgccccagcggccctcggtgagcggaaccaggtaggtctgcttctgttcctcggtgccgtgctgcatcagggtgttcatcgcgccgagggagaggccgggatacatggagaacggccagttggcggtgcccatcatctcctgcttgagcgcgccgaggctcatcggcaggccctggccaccgtactccaccgggtgcgagaggccctgccagccgccggcgacataggcctcgtaggcttccttgtagcccttcggcgtccgtacttcgccgttctccaggtggcagccttcctcgtcgccgctgtggtagagcggggcgatcacttcctcgcagagcttcgcgcattcgccgaggatcgcatcgaccatgtccggcgtggcttcggctccgttgaccaggttgcggtaatgctcggggaaatcgaagacttcgttgagcaggaagcgcgtgtcgcgcagcggggctttgtaaacgggcatggctacctcggcgatggatggagggcgccgggtgctcccggtcgccgctga

SEQ ID NO: 14413 - DNA, 954 bp, Pseudomonas aeruginosa
tgccagcctggcgcagcaatgccgggaatggcgcacacagccgtacctcgcgctcgataccgagttcatgcgcgtcgataccttctatcccgcggccggtctggtgcaggtgggcgatggccggcaggagtggctgatcgatccgctgctgatccaggactggagccccttcgccgagctgctcgaagacgagcgggtggtgaaggtgctgcatgcctgcagcgaagacctcgaggtgttcctgcgcctcaccggcagcctgccggtgccgctgttcgatacgcagttggccgccgcctatctcggcatggcccattcgatgggctactcgaagctggtgaaggaggtgctggacatcgacctgcccaaggacgagacccgttccgactggttgcaacggccgctcaccgagatgcagatgcgctacgccgccgacgacgtccagcacctcgcccaggtctacctggccctggatgcgcggctgagcgaggagaaacgcgcctggctgctggaggacggcgccgaactggtcgccaacctctgccgcgagagcgatccgcgcgaggcctaccgcgaggtcaagctgggttggcggctgcgtccgcagcaactggcggtgctccgcgaactctgcgcctggcgcgaggagcaggcacgcctgcgcaaccggccgcgcaaccacgtgctgcgcgaacgcaccctgtggccgctggcgcgcctgctgccgaagaacaagaccgacctggcggcgatcgaggacatgcatccgcgcaccgtgcgccaggacggcgacttcctcatcgaactgatcgcccaggctgcgcgcctgccgcaggagcgaatggcccgaggcgctgcccgagccgctgccgccggaggtcaccccgctgctcaagagcctgcgcgccatcggccagcgcgaagcggagaccctgggcatggcgcccgaactga

SEQ ID NO: 14414 - DNA, 936 bp, Pseudomonas aeruginosa
cccatgcgcttgctgattctcgaacgtgaccacgctctctatgccgcgctgctgatggcggccgaccccagcctgaaggtggtggcgggggacgatcccctgcaactcatcgacgccgccagcgagtgctcgatctggctcggccagcccgacctggtggcgcagatgctgcgccagggcgtgcatccggtctgggtgcagtcgacctgggcgggcatcacgccgctgctggccgccgacctgccgaaggactacagcctgacacgcgcggtaggcatcttcggccaggtgatgagcgaatacctgctgacctatatgctcgcccacgagcgccagttcctcggtcgcctggccagccaggtcggttcgcaatgggatagccgcacgcctggcgggttgcgtggccggcaggtggtgatcgtgggcaccggggagatcggccaggcggtggcgcataccctgtccggcttcggcatggacctgaccggggtggcgaagaatccgcgttcgctggtgccgttcaaccgcatggggtcgctcgacgacctcggtcgcctggtggagacggccgactacctgatcaacctgctgcccgacacccccgatacccacgacatctacgaccgtgcgctgttcgcccggctcaagcccacggcgctgtttatcaatgccgggcgtggtgtcgcggtggtggacgccgacctggtggcggcactggagaacaaccaactggccggcgcggtgatcgacgtctgccgcgaagagccgctgccggccaaccacctgttctggcataccccgcgcctcttgctgaccgggcacaccgccgcgccgaccctgccgggggcgatggtcgaactgttccgcgacaacctcgcgcgcttctgggcgggtaccgccatgcgcggcgaggtggacttcgctcgcggctactga

SEQ ID NO: 14415 - DNA, 561 bp, Pseudomonas aeruginosa
gcgagtaccgcaagacccagggccagggcatgggagctcatgtgccagccgtcggcgagcagggccatggagttgaacagccagccgccggcgatttccgcgaccatcatgcaggcggtgagcaataccgcccagcgcgtgttgcgctcggccagcgggttgccctggtcgaaccgatgggaatggcgcaggggctgggtagtcggggtgccgggcatttgctactgtcctgtcgagacgtcgaaaatatactataccccagtatattaccttgaggagagagcggtggcccataccatccatgggaagaagaagctcctggcgcgggtgcgccgcatcgccgggcagacccgggcgctggagcaggcgctggaagagggcagcgaatgcgcggcggtgctgcaacagatcgcggcgatccgcggtgcggtgaacggcctgatgaacgaagtgctggaggggcacatccgcgaacacctcggcgccgagcaggcgagcgcggagcagcgtcgcgaagacctggaactggtggtgaccgcgctgcgttcctacctgaagtag

SEQ ID NO: 14416 - DNA, 1767 bp, Pseudomonas aeruginosa
aaatatttttcattcgcatatgtgggtttttctccctgctgcgtcttctctgctgtccgtcgccgctgccggcgacatccagcagtcacttggggagagttccagcatgaccttgcctttcacccgcgccgcctggcgcccgctgtgttccgccgccgtgctcggcgccgcgttgtgggccgccggcgccagcgctgccgaacgacgcttcgacctgccggcgcagccgctggccgcctcgctgtcgcgcctggcgcagcaggcgcaggtccaggtgctgttcgacgagtcgctcctgcggggcctgcgcgctccggcgctgagcggcagctacggggtgcgcgaggcgctggagcggttgctggtcggttccgagctggagctggtggaggcgggcgacggctacgtggtgcgccggcgccaggtcgatgcctacagcgacaacgcgctgcaactggacgcgcagaccatcgtcggcaacggtcgcgaagtggacgccagcaacgtcggccgttcgaccctgacccggcgggatatcgaacgccagcaggcggacaacatccccagcctgctgcagaccctgcccggagtgaccatgggcggctcgcccaagccgggcggacagaccaccaacatctggggcctgggcgacgccgaggacgtgccctataccctggacggcgcgcagaagagcggcttcgagcgctaccagcagggcaccgtgttcatcgaaccggaaatgatcaagcgcatcgaggtggagaagggaccgcactcggtgttcaccggcaatggcggcttcggcggcaccgtgcacatggagaccaaggacgcgccggacctgctgcgcgaaggccgcgacgtcggcgccatgctcaagtacggctatcactccaacgaccagcagaagatctactccggcgccgtgttcggtcgcagcgaagaccgccgcgtcgatgccctgctctatctcaacggtcgcgacggccgcgacatgaagctggccgacaacctgccgctgtcgcccaccgactacccgatcaaccccaagcgcctgcccaacagcgcccaggacgagaagaccggcctgttcaagctcaacctgcaccccaccgaggagcacgacctgggtttcacctacctgcgctcgaaaagctcgcgctggacgccgttctccgccagcagctacccgaccccgccgagccagtggaccatcgaccgctacggctacgagctgggcctgacccgcctgctggcccaccgcgataccaccgacaccacctggaccggcaagtacaactaccatccgctggacaacccctggatcgacctgcaactgagctattccgacgcccgcaccgagcaactcgaccgtcgcgaggacaccgccttctaccagctcgccaccggtggcaaacggatgcgtaccgagtaccaggacaaggtcctggagctgcgcaacaccagccgtttcgataccggagcgctacagcacgagctgaccctgggcgcggcgctgcacaagcacaagcgcgacatcctcatgcacatgccgggcaagacctacgagaccccgcgctacaactacggctggctgcaaccggcattcatgccggccggcaagcaggacacgcagagcttctacatccaggacgcgatcacctacggcagcctgaccgtcaccccatcgatgcgcttcgacagcgtgcgcaacgacggccaggccaacctggcgccgatctacgacaatcccaagctcggccatga

SEQ ID NO: 14417 - DNA, 507 bp, Pseudomonas aeruginosa
gccccccatcaccgctatcgccacgcacgccgcatgaatgaacaagactatctgatcgcctggggcgcctacgccatcgccggactcggcctgatgctggtgttctggctgatgaccggctggatgtggcgctggctgcgcgaacccctgcggctgatcgtcttcatcctgctgttcacgccgactccggtggacccgcagaacgacctctacgccccggccatcgccatcaccgcgctggatgtcgtgttcaaggtcggcaacaacgcctggcgcgcggtctctgacctggccctggtggcgctgctcggtttcggcctgtacctgctgatcgccgccatccgctggccgctggagcgggcctggaagaatcgtcggcatccgtcgcaggacgccgaggacgagccgaccctgcggcagatgatgcagcccgagttgatgccggacgtcgacacccgcaccgacgagcacggcgaccggcgcatgcgcatcgagccgcgcctgtag

SEQ ID NO: 14418 - DNA, 525 bp, Pseudomonas aeruginosa
cctttcgcgacgaaatccattcttgcgttacgcccggcaggcgttcagcatgaggcgaggcctatgtcgggatttcccatggattgcgtgttctgcgccatagcgggtggccgcgagccggcgcacagactcttcgaggacgagcatttcatcgtcctgctggacatctttccgctgcgaccggcgcacgtgctgatcgtagcccgcgagcacgccccgcacctgagcgatctttccgccgccgcccgcgacgccctcctggcgctcgccgagcgtatcggtcgcgcattgcgccgggccggtttcggcgtggaaggcatcaacctgttgctcaacgatggcgtggcggccaaccagcacgtggcgcacctgcatctgcacctgattccccggcgtcgcggcgacctgccgcgactgctctggcgcgccctgacccgtttcctgccggtcggtcgcgcgagcctgcaggcgcgtctgcagcgggaacgagaactactacgtacagccttgctcagggaggtttga

SEQ ID NO: 14419 - DNA, 777 bp, Pseudomonas aeruginosa
gccatgtgtgaactattgggcatgagcgccaacgtcccgacggacatcgtcttcagcttcaccggactgatgcagcgcggcggcggtaccggcccgcaccgcgacggttggggcatcgccttctacgaaggacgcggcgtgcggctgttccaggacccgctggcgagcgtcgattcggaggtggcgcggctggtgcagcgcttcccgatcaagagcgagacggtcatcgggcacatccgccaggccaacgtcggcaaggtcgggctgagcaacacccaccccttcatccgcgaactcggtgggcgctactggaccttcgcgcacaatggccaactggccgacttccagcccaagcccggtttctaccgcccggtcggcgagaccgacagcgaggcggccttctgcgacctgctgaaccgcgtgcgccgggctttccccgagccggtgccggtggaggtgctgttgccggtgctgatctcggcctgtgacgaatatcgcaagaaaggtgtgttcaatgccctgatcagcgacggcgactggctgttcaccttctgctccagcaaactcgcctacattacccgccgtgcgccattcggcccggcgcggttgaaggatgccgacctgaccgtggacttccaggcggaaaccacgccggacgatgtggtcacggtgatcgccaccgagccgctcaccgacaacgagaactggaccttgcagcagagcggcgagtgggtcctctggtggggcggcgaggtgttggccaaggggcgggtctga

SEQ ID NO: 14420 - DNA, 858 bp, Pseudomonas aeruginosa
acgacaacgagcagaaaagggttcacgacaatgaattacaaccagccagccaccctccaggccgccatcctcgactgggcgggaaccgtggtcgatttcggctccttcgcgccgacccagatcttcgtcgaggctttcgccgaattcggcgtccaggtcagcctggaggaagcgcgcggtccgatgggaatgggcaagtgggaccacatccgcaccctctgcgacatcccggcgatcgccgagcgctaccgcgccgtcttcggccgcctgcccagcgacgacgatgtcaccgccatctacgagcgcttcatgccgctgcagatcgaaaagatcgccgaacattcggcgctgatccccggcgccctgcaggcgatcgccgaactccgcgggatgggcctgaagatcggttcctgttccggttatccggcggtggtgatggagaaggtggtagccctggccgagaccaacggttacgtcgccgaccacgtggtggccaccgacgaagtgcccaacggccggccatggccggcccaggcgctggccaacgtgatcgccctggggatcgacgatgtggcggcctgcgtgaaggtcgacgacacctggccgggtatcctcgaagggcgccgcgccgggatgtggacggtggcgctgacctgctcgggcaatgccctgggcctcacctacgagcagtacaaggcgctgccggcggccgaactggagcgcgagcggacgcgtatcgaacagatgttcgaaggttcgcgtccgcactacctgatcgagaccatcgccgagctgccggcggtggtccgcgacatcaatgcacgcctggcgcgcggcgagatgccgcagggtaactga

SEQ ID NO: 14421 - DNA, 414 bp, Pseudomonas aeruginosa
atgcccgcattattcgcccccggggcctttagttgcccgctgtgttccccggggctttttcttttcctgcctgtttccggcgatgcgaggtgcgcaatgtcgagggtggttgcgggatcgctggtctgcctgctgctcggttcggcgccggcctgggcttccacggccgaggcgtggcaggcgcacgacgccatggtgcgtgccgcctgcctgaaagccagcggcttgcgccaggtacgcgcggtggggcaggtactgcccttcgacgatgaggtgggctattcggcgctgctcctgcagggctgctatccgcagccgcacatgcagggccgccagggccgcgagctgtgtctgtaccggcgcgccaccggcaaggccagcgtcagcgaggccgacgccctgctcaagccttga

SEQ ID NO: 14422 - DNA, 1689 bp, Pseudomonas aeruginosa
ttctgtctgcgttggaagaatatgaatatggcgcgcaaagatttttcttctgctgctctggtgatagataaaggctcatctagccccatcattgcggatcatctgtcaaagaccattaattttgttccggagagttatgtgattaactttccggaaagtccgttgacagtgcggaaattggatttcgggcgatattatggtgtagggtgtgatgaggttacctattattgtcataaagtcatcgaagtgctgctcgggtctgctatagcttcgcaaggtaagactaagtccgtggcgagtattattacttatgcaaagcgcgtttcgagaagctttttatgttattgttcgtttatgtcaatggctatgaagggtgagataggtttgcgacatattgatagggggtttgttgcatcttttattagatatctcgaggcctctggtgctggatatacaactcagaaaaatatttacacctgttgtaagtcagtgcttggcgaattggtacggtgtgggttgctttcaagtgatatatttcctcctaatccttacccgcactccaataggaggaaaagtagtgaaaaagctttttcaaagaaagagtttacacaagttattaatgctttgaaaagagaggtgattgcagtaaaagaggcgtctggtcctattttggcggaaggcttggccttttgtgcggttgcaattgtagctcgtactggattgaatcttacgcctttaatcgaactttccatgagttgtttgcttcctcatccgcttaggcgtgatcgtagtattttgattacttataagcgccgcgctcataaagtgaactgtcagtcagttagtagtggcgctgtgtcgacgctggatgatgaagtagataccctgagtgtggtgctgcccgatatttccgctattataaacatggtcgcagaaaggaatgagtctataaggagtaggggggagtggaaagataggctattcgttcgtgagcgccccttaaagaatcctgatgaaagaactcctgcacctataactattaatactattaatcgagctttggaggcgctggtagttcgtcatgagttgatttctgataatggtgacagactggttgttaatgtgtctagattaaggaagacctttgcaaataaaatatgggagctctcaggtaatgatccttttttaactgcaatgttggctggaaatactccaaaagtcctcctagacagttatttggaagcgccggatgatgctgagaaaaattgggcgttgatgggggaggttcgtaataaagaacttctcgaaaatgatcatgccgattttggtattattccggtaaaagaggtaaatactgctgtggcccgttgcaaggataccgttaacgggcacagggctcccaagaatgggagtcattgtgtggagttcttaaactgctttcgctgcagctctttcgtagtgactgcggatgacctgcatagattattaagcttctattggttgttggttcgtgagcgcgggcgaatcggtgcaaaaaaatgggtgaggttatataggcatataattaaaattattgacgaaaaaatcttgcctaaatttgataagtccactgttgtggctgctagggaaaaagctaggcagaatcctcatccattttggaaagatcctgaaattttggggttggcataa

SEQ ID NO: 14423 - DNA, 1131 bp, Pseudomonas aeruginosa
tgcccaaacaaaaggagtaaacgggtgaaagggtttttcaatggcgcattgcttttgggcactgttctggtcagttctctgagctcggcagcggatctgactctgatgtcttggaacgccatgaggttgggacagggtggggagaagagctttccagcactcgccgaggtggcagggaaagcagatctggtagccattcaggaagtgatgaatgaggaaggactgacaaagttagaggcggagcttgagaaacggaccggggagcaatggtcgacgttggttagccatgcggtgggctcccgctcctacaaagaactctatgctttcctcatgcgtgagagcgttgtcgtatacgaagacggggcagtcgtgtacatggatcgaggtgatcgctttattagggagcccttatcggcccgatttaaatcgaaacgagatggtacgttatttgctgtggccagcattcacgtgttgtacgggaaaggtccccaagaccgtgagccggaggtcagggaattggagagctactgggcgtggctggaaagcatctacccagaaaccccggtcatgctggtaggtgacttcaatatgcctccctctcaccccgcattttccggcctctcacagcacgcaacgcccctcattacaaagggcgcaaccacgctttccgcacgcgaagggctctacgccaatctttacgacaacatctgggtatccaggacgcatcgtctgaagcaggataacgcgggcatcatggactacccccggatgatcggctggagccatgagaaaagccggaagcacgtgagtgatcacgctcccgtattcgtcaccctgggaaatgcgaagctgcgccagggggttgtaacggtccgaccggaggcagaaaggagtcgagttgcggggggcggattgaagcagattttcccgtctcaagctcagaagagcactgcggccatcgcctccaacatagacgatgccgaccatatccgcggaaatgctaactcccgcattttccactggccgggctgcccgagctacgacaaagtatcaccaaagaaccgagtggagttcagcagtgtccaggaggcagaagccgcagggtaccggttggccggcaattgtcgctga

SEQ ID NO: 14424 - DNA, 1290 bp, Pseudomonas aeruginosa
ccaataccgtttctctttcaactgggtctaggaacgagtccgttgggagttgcgatcaggctctgtttctccgataacttcagcactctactgaacaccaaaccttgcgtgtacgaggttctgaaagacgctcaagatgcggccagactgatatttagatcttggcgatacactccagtagaatgctggatgccggttgatacgcgccgagcccccgttatcgccccctccaccataaacatggctgatcgccttttttgcccggccgcagccaccctgaggatgcatatcttgatttggtttcttgagggacagtccagccagcgggacatcattctgggagcgcgtgaagccctcccgccggaagtgaggatttttgcttcacatcgccaagacaggcccgaaatcaccggaagcgccgatgtaagcttccttgaaccgaaggacaaccaggaacgaatcgactgggtgatcgagaccgccctaatgcatgggattaaagtcatcctagccggccgcgtggggagtgtctttgaggctcagcgccatcgattcgaggtcgctggcctggttttggttaccggcggctcgagcatgggtacgttcgagttggtagatgacaagagcaaattcacggcggaagcagagcgtgctggccttgcgtgtgtcccggcgatcacggcacgtaatgcgaaggaactcatcgatgcctacgagtcccttcgtgttcacggcgacgtctgtgtcaaaccagcggtaggtatatatggtcaggggttctggcgcttcaagtctgaagtggattcgtttcgttgcttcgccaaccccgcttctcgggaagtccagttcgagacataccttaatgcctaccgggctggagcggatcgttccgccatgctggtgatgccgtacatgactggaagcgagtgctcgatcgacatggtttgcgaatccggccgccccgtggcatttgttggtcgccggaaagaagggctgcaccagaccttcgagaatgcctcgccggcggtggagctcgctctgaaggctgccgctcacttccagtgcgatggcctggtcaatgtccaaacgcgggatgatttagacggtgtcccacatctgctcgagatcaatccgcggtactccggtggcatcggctacacccgacatacgggagtgaacctgccaggtatcttcgccactagaaggcttggtctggctgagccggtgagtgattggataccgaacatcagggtgaaagccataaccgttgcggtgccagtggcaacttga

SEQ ID NO: 14425 - DNA, 1191 bp, Pseudomonas aeruginosa
taccatttcgccgcatttagtaaggttcgggactcaaggagcaaagcagggatgatggtgatcgcgcctggcgcaaacaccgctttgggagcggcgcaatgttcctggacgctggagtgcggcaatccctcggcattcggggactatgccgctgtcgctatgcttccgctggacgataagcgtcacccaaaaggggaagcagcacttttccaggtttcccaggcctggatgcagtggagcggtgggcaagagaaaatctgctgcaacttgaatctcggccaactcccgaccggtgccgacagggtgctcttagtcgtgtacaccttctcggcaatgggcccagtaagcgacctgcgattactccgcttgcagatcgactctcagatcgagttcaacttgaacctgtccgacaatggtgaatcagcgatcattgtcggtgagttctattgccgcaatcaccagtggaaattccgtgctctggccgaggggtcggcctatggcctagcagctcttggacgtcgcatcggcctgaagatcgacgatgctcacccgcaccgccgctccagttcctcagaacagagccgaccagcatccggagcgacaggcaccggctttgctgtgacttccacccatattctcacctgcgcgcatgtcattgaggacatgaaagagattcacatcgcttcgttcgaaggacgccatcgtgccgaggcagtggttgtagatcaacgcaatgatttggcactccttagagtgcaaggagcgccagcctttaagccggtggctttccgggatggagttgggtgtgaccttggcgagcctgtggtggccctcgggttcccacttgctggtctggccggagggggagtgcacgtcacccaaggtggcgtttcagcactctttggcctgcacaatgactccagcctgctccaattcactgcaccaattcagccgggatcaagtggtagtcccctctttgacgcagctggatcagtagtagggatggtgacttccacgatccctgacgcacagaacatgaacttcgcggtcaaggccgggcttgccctggcgtttcttgatgcctgtggtatcgagccagctcgtacaccaacaggaaagactttctcgacatctcaaatggcccgtgaagctcagcaatcgctatggaaaatcgaggcgcgtaatccatag

SEQ ID NO: 14426 - DNA, 765 bp, Pseudomonas aeruginosa
ttttcgatgggcactaatcgtcccctggtattcgtcgacctcgacgacaccctgttccagacctctcgcaagatggtcgaaggtacgccgcgtactaccgcgacgctggacgtacacggccaacccaatgggtacatgaacccgatccagcactccttcatcaattggctgctggcttctgccgatgtagtgcctgtcactgcgcgtgacgttgaggcctacagccgcgtcaagctccccttcaccgagggggctatctgctcgcatggtggtgtgatgctccactctgacggctcactggatcaggactggcatggccagatggcagaatccctttggggcttccaggatcgactgccagcgttgagcgaagcaaccttgcggatcgggaaggacatgggctattcgctccgcggttgggttgtggaagaagaaggtctgcgccactacgtggtgaccaaacagaacgaatctgatgacgctgtcctctccaaggttctggccgaggttcaagcccgaggcatgctggaaggcatgcacattcacgccaacggcaacaacctcgctttcctgcccaaggggctggccaagcgattggcagttcaagaatggctgcgccgtgacgccaagatcaatggagatcgcccagtccttggcttcggcgacagcattactgacctaggattcatgggcctttgccacatgtgggctacacccgctcgcagccaattggccaaggccgtggaggagatgatcattgagtaa

SEQ ID NO: 14427 - DNA, 1062 bp, Pseudomonas aeruginosa
cggcgacgtgcaactcctactgcatctcaccgagcgcgcaggggtaacggtggaggaggccggcgaggctcttggaccttatcgtgcggtaaccatcatccggagcacgaactgatgaaggcgatttctccattcgccctcggggcgactctgtacatgccggcaacccgcgatgacatcctggatgtggtgttcgggatgaagatccctgagcttcgctcactcgtggtgtgcctggaagatgcagtggcggcgatcgacgtcgaaagtgcactcgcaaatctgcaggccctcctcatgggcattcacgcccgtggcggccgcccggaacaagggccgttgctcttcctccgtcctcgcgatgcagagatggcagcagtgctgaacggatggccgctgatgaagcacgtcaacgggttcgtcgttcccaagctgacgctgaagtctcttcctttctgggaagccgctgttagcaaccctgacctctatctcatgccaaccctggaaacgagcgatgtttacgacccgggtgccatggtggagctcggccaggctctgaaggcaaacctgaaccaacgcatcatcgcactccggattggcgggaacgacctcatgggttgcctcggcctgcgccgcaaccctgccaccacgctctacaacacaccgatgagctacgtgattcccatgctcgccggcgtgatgggagcacagggatttgccctgacggcccctgtattcgagcagttggccacgccccatcttcttcaggaggagttgaagctcgacatcgcacatggcctggtgggcaagacggcaattcatccaagtcagattcgcatcattcaggacactctccgcgtgagcctggaggacctcaactgtgccaaactgatcgtcaacgatgtagcccccgccgtcttcaagcacaacgatgcaatgtgcgaaccggctactcattacaagtgggcagtgaacatccttgagcgcgccaagtggcacggtgtgaaaaccgccgaaatgggcaatggcgagcacagtgtccgcctggccgaggcttactaa

SEQ ID NO: 14428 - DNA, 726 bp, Pseudomonas aeruginosa
gcattgaaatgctggaggctgggccgaaaggagcgaatgtgctctcggtgtttgacttcgatggcactctcacccggcacgacagcttcgtgccgttccttcggtttgccttcggcactcgcgagttcacccaacgcattctcaggttgggcgctgcccacccttaggtatctctccaggggcatgtcccgggatgagcttaaggcccagttgataggcacatttctcgctggcgtggaagccaaatgggtatgtcagaaagctgaagatttttgccagttggtttggcccaagctcatgcgcccatcaggggtaagatcagtcgcggccgaaattgcgtccggagcggaggttacactctgctcggcttctccggcgctggttctgcggcccttcgccgaacgtctcggcatcaagctcatcggtacagaactggaagtggtcgatggtcacttgaccggcaggatcagcggaaacaactgtcgctgcgagaacaaggtacgccgattggaagccatatatggccctctgacacagtatcggttgagggcctggggtgatacccatggcgatcatgaattattggatgcagcgcaagatgcgcattggcgtcattttcaccccgcatggcggcgttcccgctcgcggtatagcaaggccgggagcccggagagtgtttctccgcgtgactcccactcgaactctgaagatcaacaaggagcgtaa

SEQ ID NO: 14429 - DNA, 459 bp, Pseudomonas aeruginosa
gaggaacacatgctcgaatggctgaaaaccaacgcgacgaaagctcgcgagactctgacgactgaggtcgccaagttcaaaaatcgcaccttcatggaggcagtagcaaatgcgtgcgcgctgatctccgcggcggatggtgaaatcaaatccgaggagaagatgaagatgaccggcttcatcaataactccccggaactgaaggtcttcaacctgaacgacgtgatcaaagtcttcagcgacgcctgcggcaagttcgagttcgacttccagattggtcaagctgaagccctgaaggcgatcagcaaggtcaagggcaaggacggcgaagcacggctactggtacgtgtggccagcgccatcggcgcctccgacggtgacttcgatgataaagagaaagcggcatgccgcctgatttgcctagagctgggtctgaacccggcagacttcgaactgtaa

SEQ ID NO: 14430 - DNA, 1047 bp, Pseudomonas aeruginosa
ggaaacttaaacgtggaaacgactcacattggcttcccaccgctgaccatggcggtattcgtcggccttgcacttgccgccctgctgctggacatggttacccatcgcgatgacaagccgatcaccctagcgcgcgcctctatctggtccgtgttctgggtggcgatttctctggcgttcgcaggtttcctctacgtgcagcacggcgctgaagtcgccagcctgttcgtcaccggctacgccttggagaaagtgctgtcggtcgacaacctgttcgtcttcatggccatcttcgcctggttcaaggtaccggatggcctccgtcaccgagttctctattggggcatcatcggcgctatcgtcttccgtggcgtattcgtggtcatcggtaccggcctgctcgcatttggcccctgggtcgagatcgtcttcgcgctgatcgttgcctggaccgctgtgatgatgctcaagggcggtgacgatgatgatgaagaggaggactactcccaacatcttgcctaccgcttcgcgaaaaagctcttcccggtatggccgaagttgtacggtcataacttctttgtgagccgcaagaagctagaagtcgaagtgcagaaacccgagaacaaagacataagcctggcggcgaaaggtggtcttttcgccactccgcttttcttatgcttggtggtagttgaggtgtccgatgttctgttcgccttcgactcggttccggccgtaatcgcggtgagccgtgaacccctgatcgtctactcggcaatgttgtttgccatcctgggtctgcgtaccctctacttcgttcttgaagcactgaagcgctatttggtgcacctcgagaaggcggtcatcgtgctgctgttcttcatcgctgccaagctcggcctgaacgccaccaaccacctgttccatcacggcatcagtatcgacccgaataccagtctgcttatcgtcctggcagttctggcagtcggcatcctcgcaagcgtgatcttcccggaaaaggaagaagcgcaagtcgaaaaccagtaa

SEQ ID NO: 14431 - DNA, 600 bp, Pseudomonas aeruginosa
actgaatcaaggaatcacattatggcagtttctctccaaaagggcggcaacgtcagtctgtccaaagaagcaccaggtctgaccgaggtcatcgtgggcctgggctgggatccgcgcgtaactgacggcaccgagttcgatctcgatgcctccgttttcgtcactggcgaaaacggtaaagttctcaacgacgccagcttcattttctacaacaacaagacgagcgctgacggctccatcgagcatctgggcgacaaccgctccggtcagggcgatggcgacgacgagcaagtcaacgtcaaactgaacggcctgggcgcagacgtgaagaagctggtcttcgccgtcaccatccatgacgccgaagctcgtaagcagtctttcggccaggtgggaaatgcctacatccgtgtcctgaacaaagccgacggcaaagagattgctcgcttcgacctgtccgaagacgcctccaccgagaccgccatgatcttcggcgaactgtaccgtcacaacgacgagttcaagttcaaggcgatcggccaaggttttgctggcggcttgaagcctctggctgaagctcacggcgtgagcatcggctaa

SEQ ID NO: 14432 - DNA, 1230 bp, Pseudomonas aeruginosa
gcagcccggcatttccagaggacctcggaggacgaaatgggatttcgcttcagtaaacgaattacgatcgtgcctggtgttcggatcaacatcagcgggtcgggtatcagcacctctgttgggccacgtggactaagcttaacgatgggcaagcgcggtacctacctcaacgctggcctgcctgggaccggcctcgcttatcgtgaacggctggatcgatcggggacaaggaacgcgccaaaccctgctgcagcctcggcaggctattccgggccgatcaaggtcaaagtcgacgatgatggttcgttgattatcaccgacttggaagacgctccccttccgccggcaatcgtgaagagggtgaaggtagagaagagtgacgagatccaggcgcttctggaaaaagctgcagccaagatcaaccaggcgctcgatgagtgcctatcggctcatatgatgacccctcggccgggttctctgccggcgctaccaccggcattcgatcgtgacgaaccgcggcgaccttcaacgcacgctccagggctgctcgacaagatgctcctgcggagttctaagatggaaaaggaggctcaggaactagaagcacagtaccagcaagatcttttcgagtggaccgctgcacgtgacgctcacgagaaggcgcgatccgacattgataaggccatccgacttgccgcaaagggatacagcgctcagatggagcgtgccctcgactatgtgctatccggcattgcctggccgaaagaaacgctcctcgagtacgagttctcgcatgacgtttcgggcattgctctggacatagatttgcctgatgaaggggatgtgcccaaccgaacggctgaagccaggggcaatggcaagcttaccttcaaaacccggtccgaagctcagactcgtaaggacttcgtctcactttgctacggcaccgttttccgcgtggttggggaggtttttgccttgctcccaggcatccaaaagtgccttgcttccgggtacattcagcgcacagacttggcaacggggagtatcggggatcagtacgtaatctcggcgctgatctctcgtgatcaatgggaaaccttggacttcaaccggctggaggcgatagatccaggtgcgacgttgaaggcattcggggccgtggtgagcgtcgacagaacatcgcggttccgagaaatcacaccaatggacttagccacccttggctga

SEQ ID NO: 14433 - DNA, 240 bp, Pseudomonas aeruginosa
attgagacggtcatggataagttggcgaaagcgttaggggaacgtatccgaatgcagaggaaggtctgccggatttcccaagacgcattggcgctggcgtgcagtctcgaccgcagctatgtaggtcgcatcgagcgtggcgaggtcaacattaccgtcgagaagctctaccgcatcgcaggcgaactcgcctgcgatccttcaagccttctgccaccgccatctgagattctgagctga

SEQ ID NO: 14434 - DNA, 234 bp, Pseudomonas aeruginosa
tcgaggtgtagtgtgggcctggtgaagatttccgagcaattgcacgaagaggcgcgcatcgcctgcaaggccatgtcgcgctcgatcaatgcccaggctgagcactggatgcgcatcggcatgctgatcgaagccaatcccggcctgacctatgcgcaggtgctacgccaattgatggacgaagcgcgcgaaagcgaccgccgcgagcaggacgcggcgaggatctcgggatga

SEQ ID NO: 14435 - DNA, 915 bp, Pseudomonas aeruginosa
gtcgaaaaagaaaccgaaagggttgcgtgcatgagtggcgaactcgcctcgttcgaggtggatgggtatcaactggtctatcaggacctgggtgagggcacgccggtgctactggtccacggttcgctgtgcgactaccgctactggcaatggcagttgcgcagcctcggcgagcaccaccggctgatcgtgccgagcctgcgtcactactaccccgagcgctggggcgggcagggcgcggacttcaccagcgcccgccacgtcgccgacctgctggcgctggtcgagcggctcggcgagccggtacacctgctcggccattcccgtggcggcaacctggcgttgcgcctggcgctggccgctccggacgccctgcgttcgctgagcctggccgatcccggcggcgactatgccgccgaggtctacgcccacgccggcctgcctgcgcccgaggaaccattggaacgcaaccagttccggcgccaggcgctcgaattgatccgtggcggcgaggcggaacggggactggaactgttcgtcgatacggtgagcgggccccggggtatggaaacgctcgtcggcgacgttccgccgaatgacgctggacaacgccatgaccctggtcgggcaggtggccgaccagccgccggcgctggcgctgtcggaactgcgctcgatcgacctgccgagcctgatcctcaatggcgaacgcagcccgctgccattcccggccaccgccgaggcgctggcggcggccctgccgcgcgccgagctgcaacgcatccagggcgcgtcccatggcctcaatgccacccgtccggcggctttcaaccggtcggtactggagttcctggcgcgcgtcgatggcgttgcgccggacgtggaaacgtcctgaagcgaggccgggcgaactga

SEQ ID NO: 14436 - DNA, 600 bp, Pseudomonas aeruginosa
gctgttggcacaggcggtttcccggcgtggtcgccaagactcggagtaatcattattaagcgtgaaatgagacaggataagcgagctcaaccgaaacccccgatcaacgagaacatctcggctcgtgaggtgcggttgattggagctgatggccagcaggttggtgttgtttcgatcgatgaggcgatccgcctagccgaagaggcgaagctggacctggttgagatttcggccgacgcggtgcctcctgtctgccgcatcatggactacggcaagcacctgttcgagaagaagaagcaggctgcggtcgccaagaagaaccagaagcaggcgcaggtcaaagaaatcaagtttcgtccagggacggaagaaggggattaccaggtaaaactacgcaacctggtacgtttccttagtgaaggggacaaggccaaggtatccctgcgattccgcggccgtgagatggctcaccaggagctggggatggagttgttgaagcgggtcgaagcggacctcgtggagtacggcaccgtcgagcagcatcctaagctggaaggacgccagctgatgatggtcatcgctcccaagaagaaaaagtaa

SEQ ID NO: 14437 - DNA, 360 bp, Pseudomonas aeruginosa
ttcatggctcgtgttaagcgtggcgttatcgcccgtcgtcgtcacaagaaaattctgaagctcgccaagggctactacggtgcacgctcgcgcgtgttccgcgttgccaagcaggcggtgatcaaggctggccaatacgcctaccgtgaccgtcgtcagcgcaagcgtcagttccgcgcactgtggatcgcccggatcaacgctggtgctcgtcagaacggtctgtcctacagccgtctgatcgccggcctgaaaaaggcggccatcgagatcgaccgtaaggtcctggccgatctggcagtgaacgaaaaagcggcgtttaccgcgattgtcgagaaagcgaaggcaagcttggcttaa

SEQ ID NO: 14438 - DNA, 375 bp, Pseudomonas aeruginosa
aggccagggttgaggcatatgctggaaccaagtcataacgacgagctgccaccgattcccggcaagcgctacttcaccatcggcgaagtcagcgacttgtgcgcggtcaagccccacgtgctgcgctactgggagcaggagttcccgcagctcaacccggtgaagcgccgcggaaaccgccgctattatcagcgccaggacgtgctgatgatccgccagatccgcgcgctcctctacgaccagggcttcaccatcggcggggcgcgccagcgcctctccggcgacgaggccaaggacgacgtcacccagtacaagcagctcatccgccagatgatcgccgagctggaggaagtcctgctggtcctgaagaagtga

SEQ ID NO: 14439 - DNA, 1794 bp, Pseudomonas aeruginosa
gtcgagaacaacacgatgaacctcagcagtaccattaaatccatccaggacatcatgcgtaaggatgacggcgttgatggcgacgcccagcgcttgggccaactcacctggatgctcttcctcaaagtgttcgaccagcgtgaagaagaatgggaagacgacaaggctgattaccagtcccccttgcctgagcgattccgctggcgtaactgggcaaaatatctccctgatgctgatggcaagaaaaagccgcagatcgcgggcagcgagttaatcggcttcgtcaacaatgagctgtttcctgcactcaaagatcagatagacgccgaccgcagcccccagcacaaggtcatccgtgaagttttccgcgatgccaacaactacatgaaatccggctcgcagatgctcgccgtgatcgaaaagttggacgaggccatcaacttccatgatttcaaaacccgcgccaacctgggtgacgtctacgagcagatgcttaacgacctgcgcggcgctggaaacgcgggtgagttctacaccccgcgtgcaattactgccttcatggccgaccgcgtcaatccgcgtctggacaagcgcgaaactgtgatggacccggcctgcggtaccggcggctttttgaccgccgccatcgaccacttccgcaatcagctcagcatcaaatccagtgccgaagacaaacgcgccattgaagacctaatacacggcatcgaaaaaaagcagctaccccacctgctttgcaccactaatatgctgctgcacggcatcgatgtgcccagccagatcgagcacaaaaacacgctgggcataggttggaacgaatggagtgccaacgacaaggttgattgcatcatcaccaacccgccttttggtggttatgaggatgatggcgtcggtagcgactacccggctgaccttcgcacccgtgagaccgccgacatgttcatggcgctcatcatcaaaaaactattgaaagagaacggccgcgctgccgtggtgctgcccgatggttttttgtttggcgatggcatcaaaggcacgctgaaaaaactgctgctgcgtgactgcaagctgcacaccatcatccgtcttcccaagggggtgttcgctccgtacaccaccatcaagaccaacctgctgttcttcaccaagggcagcgccgtggatgatggtaccgagcactttcacaccgacaccatctggttctacgagcacccctatccgccgggctacaagagctattccaaaaccaaacccatccggctggaagaattcaaacccgagcgggactggtggggcagtgaggccaacgactttgccgaccgcgtggaaaacgaattcgcctggaaggtggatttcaaaaccaaacgcgaacaagccgaagccgccgcgcagccacactggctgcgtgccgaaatgctgaatacccaagccgccgtgttggaaggtgaggcccgtgatctacgcaacagcctggttggcagcaccgacgccgcctatcgcgaaaagatcgaggcgcagattgccgaactgcgcagtcaggccgagccgttgcgcctgcaagcacgtgatgcgcaagcagcgggagaccgcctgtactggccgatcttcaatctcgacctgaaaaatcccaacgcgccggaagaagaaactcacgacccggacttgttgctggagaagtacaaaaaactgttgggcgaaattgaagaaaccgaaaaccagctcaagagcgaactggccgccgcgctagcacatcacttcgtcggcgaggacgcctga

SEQ ID NO: 14440 - DNA, 1761 bp, Pseudomonas aeruginosa
gcgcctgatatgcagctactccgtatcagcattcctgcctttcgcaatctgcgtgatctcgacatcagcttcgcgacgcacttgctgcccggcgagggtgcgcctgcggatgtacaacccaaacagattcgcagccatgccctgatcggccagaacggtaccggcaagtccaaccttatcgaagcgctgatcaccatcttccgtgatgtcgatttggatcgcgaagcagctttcgattacacactggaatacagcattcggggctacgcggtgcgcatcgaggccgacactgccaagcaaaagcgcccctatgtgtgggtggatggaaaggccgaatcgcaacgctatctgctgaaaaaccgcgagctgctgccggcgcacatttttgcctattactccggccgcaacgagcgcatcgaggcgctgtttcaagagcatcagcgccgcttcaacctgcgccaggaaatcaccacagacgaagtgctacctgagcagctgctggaaaactttaccggcaccgaggcagatatcctcgcggtggaagacgccaaacgccggcgggagacgcggctgagacaagcgggcgacgaccgccttcgccgtctgttctactgccgtggtgggcatagtcagctggtgctgttggcctgtttattgtccgatgacccagtgtttcagaaggtgctgaagaacctgcacattgagtcactggaatccgcgctattcgtactcaaggagccgcaccgtctgcgcgaaaagcgccggggtggcaagttcgacgaacaggagctgaatgagggcgatccgcgcttttggtatgcacgcggcaatgtggtcagcgagtttcttgacaagctctggcaagtgtcctgggcgcctattgagcaggaggcgaccaagcagatcgacttccgtggccgcaccgaaaaacaaaagcagctctatctgttcgtgccgagccaggagaagctcaagcagctgggcgagctggtcggcagcaccgacagcttcttccgctatgccgagggagcctacattggcgacctgatcgacgaggtgcggatcacggtcaaaaaacgcgatgagcatggtggtaaggtgagctttacgcatctttcagaaggcgagctgcagatgctcaccgtgcttggcctgatgcgaattacccgcgaagaccactgtctgttcctgcttgatgagccggacactcacctgaatcctatttggaagctgcgctacttcgatgacatcgaaggtgtgctgacctctgaagacggcacgctagtgcaaggtgattcgcaaatcctcatcaccacccacgacccgatgatggtgggcagccttaaacgcgagcaggtacatatcctgaggcgcaacggtagtcgaacagtagtggatatacccgatatgcacccacaaggcatgggggtgactgggctcctcaagagcgagctgttcggcctgtcgtccaccctggatatcgaaaccgagcgacgcctcttccgtcgcaacgagctgtttgtaaagcagccgcgcacgccagtagaagatgccgagctctcacggctttccgccgagctggccgatttggggttttccaccgccgattttcgcgatcccgattacgcgctcttcgtgcgcaagatggcgcagcaccgccgtttcaggaaaccagcgctaacgccggaagagcaagctgaacaggatgcaattgccgactcaataattgacgaaattctgcgtgaggaggccgctgagtga

SEQ ID NO: 14441 - DNA, 543 bp, Pseudomonas aeruginosa
cctgcacgccagcacgccgcagcaggaagtgcaggcggcgatagccaaagcgccggcgctcttgggccagttccaccagttgggcttgcagctcggtgttttgcacactggctcgcggctggtagcgcaacaccgagcgggacagcccgatcaactgacaggcacgacgctcggagatgccggttcgcgcctgcatctcctgcaccgcctcccgccgtgctgtcgggcttacccttttccccgggcgaccactttcagcgactcgatgtcgaggtgggcctcggcgagcaacttcttcaatcggctgttttccagttcaagatccttcaaccgtttggcgtccgccacggtcataccgccaaacttggcccgccaggtgtagaacgaggcatcactgaagccgtgtcggcgacacagttccttcaccggcacaccggcctccgcctgcttgaggaagtcgagaatctgctcttcggtaaaacgctttttcactgccgtctcctgctcggaaaacggactctactaagtttgacatggtactga

SEQ ID NO: 14442 - DNA, 1908 bp, Pseudomonas aeruginosa
cgattcttacaactttcggtccgctcattgggaggcctccgctgctgccgtgggatgggtttccgcgctgggcgccagggccttctcgatggcggcgcgcagccgtgcgcgttcgttgtcgccgtcgtggtaccagccctgggaggaaacccggtggaggtgcgggatcgcccgccgcagcaccgagggtcgccagatttcccgggcgcgggcgcgttccagcagcgggtggcagggggcgtcgcattcgatgccgatggcgtagaggccggtggccgggttctcgatggcgaagtcgaggccgaaggcgtcgccttcgccggcgggtgcggcggaccagcccagcgagcggatgtactcgccgacgatctcgctgaagccgtcgtgtcgctggtagtgctggcggcgctggtcgctgcggtcggtgtgcaggcgctcgagcagttggccggtaccggcgaactcgccggcggacagtgcgcgggcgtattccaggtagccttgcaggtagtcgcgcgggctgctcggcgagcgctgggtgccgagcatgtcggagatgtcgccgatcggcatcgaggtgatcatcaccaccttgcgccgcgcgcgggtcaccgccacgttgaggcggcgctcgccgccggtctgcccgagcacgccgaagttgcgccggaagctgccctggccgttgcggccgaaggtggaggagaagacgatcacgtcgccctgcacgttctccacgttcttcacgaacacgcccatgtcctcgccgtcttcgctgcgctcgcgctcctcgctgtaggcggcgcggaacgtctcgtcctgctcggcgcgcagttccaggcgctcctcgatgaggtcggcctgcttgcggttgaaggtgaccacgcccaccgacggccgcgccgcgtagggttggcgccagagttcggcgaggtagtcgacgactcgctcggcctcgcgctcgttgctctggttctggtacaggccgttcacctggatcagttccagcggcttgatgcgcaggatgttggcctgcggatggcgtaccggcacgctcaggcggttgccgtagaacgaggcgttggagaagccgatcagctcgcggtaggccgagcggtagtggatctgcagggtggtgctgggcagggcgttgcgcgccagttgcaggaggtccgggcagtccttgatctcgcggcggttccaggtgtcctcgtaggcttcgcgctgctcctcgtcggcgtcctcgtcgggcgcttcgccgtcgaacagttcggcctcgtcgctttccacgcggctggagaagaacgcggtcggcggcatctgcttctcgtcgccgctgaccaccgtgacccgcccgcgatagagggtcggcagggcgaactccaccggcatctgcgaggcttcgtcgtagatcaccatgtcgaacagcccggccttgagcggcagcacgcggctggccaggtcggggttcatcagccagaccgggcgcaggctcatcaggccgagttcggcgcccagctcgatgaactcgcgcaggcgccgcgagcgcttgccggtcaggcgggtgacgtcttcccattgcttgcggctgcccaggcgcgcggcgccgatgcccttgccgagcagttcgcggttcagcgcgcgcatctgcacatcggcttcggcgaggctggcgaccctggccctggcttcgtcctggctgaacagcagttccggattgtcttgttccaggcgctgcttccagcccagccgcgcttcgcggttgagcatgcggcgcaccgtggcttcgagttcttcggcgggaatcgcgtcgagtcgttcctggcgctggcgcagcagggccaggaattccaggtcggtggcttcgagctggccggcgcggccacggaagcgctggtaggcgactag

SEQ ID NO: 14443 - DNA, 3603 bp, Pseudomonas aeruginosa
ccagaggcggaccagcggcgcgcagttttcctccaggcgcgccaggctgccgatgtccagcgccgccaggcgctggcgcagggccgggaagtccagcggcggcgagcctttctccagctcgatcagttcgccgagcaggcgccggtagctcagcccggtggcctcgtccacgcggtgcaggctctggtggtagcggtccagttcgccttccagcgcctcgatacgcgccgccaggcgctcgcgctggcgctcccagccctgggcgccgccggcttcggcgaacagcgcttcgagctgctcgcggatgttgcggatcaccggttcgcggtcgcggttgacgtcgttgagcatgacgatgcgctggcccaggccctcggccaccaggcgcttgtgcaccacttccagggcggcgtgcttctggcagacgatcagcaggctgcgctggcggccgatggcgtcggcgaccatgttgacgatggtctggctcttgccggtgccgggcgggccctccaccagcagccccgggctctgccgggcctgcagcacggcggcctcctgggacgggtcgctggccacggtgaagtagcgctgcaactccggcgggctctcgcgggcttccggctcgccgttctcgcgcaggcgcagcgcggtctccagtccggtgccggagggcggcaggctcttcagctggcgcaggtcctcgccgatcgcctggcccatgaaggtgacgtggaacagcaccgcggcgcaggccagttggtcctggtagggcgtgacctcggtggaactcggtggcaatccttccagcaccctagcacgcggcgtggcgagcaggccgaaggcatccatcacatcggcggcgcgcagcgcggagcggccgagcaattcgtcggcgaccttgcgccagcgcttgcacggctcggggccgagcaggctttccagggccgggttgaggcgcacttcctcgcgctcgccgtcgaaggcaagcgccacctggccgcggctgccgacttccagttgcagcttcagcggccacagcagcagcggcacgatgcgcgtgcgggtggtgccgcgcgggtcgcggttgagcaggaaggggaagcccaggtagaggccgtcgatgccggtgtcacgcttgtacagcgagctttgccgggacagcgcgttgagccgcacttccagttgcgggttggcgaggaagctgtccgggtcgaggctcaccgcgcgggcgttgcgttgcagcagatggtcgagcagggcggcggcggggcgtcgcgcgctgtgcagttcgttgaggtcgatgcgtggggtgctcttgccgatgctcatgcgcaccagcggcccgcgcatcaccgcggcgaccactttcttctcgaagaaatcgaggatctgcgacacgtactgctgcttctgcggttccagccactgttccggcgggatcgccagcagcaccaggaccctcgccaacggcatgcgccgctccaggcggaactgctcggcccattcgtcgaccctgggcacgccgctgcgggcgaagccgctgatgcgttcgtcgacgcggcggtacagctcctgccgcgagtgctgcaacaggccgcgcgcggtctccgcgtcgaacaggtgcacatcggcgtcgcgggccaggccggcggcttcctcgacgatcgcctcggcggcacggaactggccgatgttggcgctgagcaggacgatcaggtcttcctcggcgatcacccggcgctcggccagggccagcaggccggggtgctcggtgtccggcaggaggcgctggcgctcctgccactgcgcggcgaggcgcgcccgcgaggtcgacagcaggtagatgcgcaactgttcttcggcgagttcgatgtgctggtgcagggcgcgctggcggacgttctcggcgcgggtcttgagccgcgacagccagctttcggtgtgcaactgttcgagcaggtcgggcaccgagccgctgatcagccggtagccctccagcggatgctccagcagccagccgggggtgacgatctcgccgcgctggatcagcgggatttccgggttcagcagcttgagcgccagcatcagccggaagtcgtcctccagcccctcgtgctgggccacctggcgcaggccggcgagcagcctgggcgacaggccgatgtgctcggcccaggtgacgatcgccccgcgcagcaggtggtcgagggcctccgcccagtgctcggcctgggccgcggccagggcgaagaccgtcggcttgcggaagcgccgtgcgccgagggcgatgctggcgccttcggcgtcgtccttttcgctgtccgccgaggccggcgcgtccaccgcctcgccgttcagccaggcctgtacctgcggccactgccagcgctggtggcggtcgcgtgcaagcaggccgcgcagcagcaggtgcaactgcgggtcgaggtcgtcgggcagcgccacgccgttggccagcacgtggatcaggaaggcgttggcgttgactccttcgaagcaggagccgcgggtcaactgctccagcaggatcatgcccaggctccaccagtcggaagccgccgccacgccgccggcgatcgcctcgggggccatgtagcggctggtctccagcggcgagacgatatccaggtcgaactccgacaggcgcgccgagccgaagccgctgatcaccaggtccagtggctcgtggctgcgcaccagcaggctggccgggcgcaggtcgcggtggcgcaggccggcttcgttgaacacgtgcagggcgtggcccagctcgcggaccacgtggcgcaccgcctcgcggtcctccagcacggtgccgaggtcggcgaggctgccgccggtgagctcctcgaccacttcgtaggcgcgctcgtcccagcggccggtggcgaggatttccggtacgtgttcgcgcggcaggcggcggatcacgtcgtagatcgccgggtccggctcggcgcccgggcgatacagggtgagcaccgcctggcgggcgccttccgcgtgttcggccaggtagcgctcgcgcacgccgtcgctgctggcgatctgccgcagcagacgccagccgtcgatcagggtttccgtgacggcgggctgcggcgtggcctcggcctgcatcggcagcgggccttcggccggcgcggcgccgcactccaggcacatcaggtcgccgggttgcagcgggtggccgttggcgcagagcggggcggacgccgctggcggctcgctggcgggcggcgcgatggcttcctgggtcagcaccggctgtggtcgccagccggcgggatggatggcttcggcggaaaggtcccagccgcagggctggccctggatcgagccttcgcagaagatttccgaaagcgagcgttcgctctggcagttggggcagaaacgtatcatcggtatcgatccattcagcgcggccgatgggcgctgacgctaagttggtggccctgttcgcgcagcaggtcctgtagccgcagcaggtcgtcgcggcgcgggatgccggccatccacacgctgccgtcatggtcgaacatcaggtcgagggccttgtcgtcttcgcgcagtggccgctggtag

SEQ ID NO: 14444 - DNA, 1797 bp, Pseudomonas aeruginosa
accaggatgtcggcgcggctgcgctggcgcagttcgccgagcagggcgaggagggcagcgaactgctcgaagggttcgccgccggagacggtgatgccctcggcctgctccagccatggctggatgtcggcgagcaggcgtgccagggcgatgcgccgccgtcccggcccccaggtatcggcggagatgcagccggggcagcggatgctacagccctggaaccagatgcccaggcgccgtcccgggcccagggtggtcaccgggaagtgcacccgcgacaggctcagttccatctcagcggcgttccagggtcaggccgtcggcgtccagggcgctgatcaggaagcgctcgcccggctgcgcgtcctggtcgaacagtgcccgcgacaacgggttgagcaggcgcgcttcgagctggttgcggatgccgcggccgccgttggacaggtcgcccaggcagaggtcgtgcagcgcctggcgcggcgcctcggccagttcgatgacgaggcgctgctcgcggaggtcggcgaaggtgccgtcgaccatctgggtgaagatctgctcggcgacgtcggcgcggatgaagtcgaagacgatgatgttctcgccgatccggttgaggatttccgggcggttgagaaccagcttgaagtagcgctcgatctcgccgtggaccttgccctgcaccgcctcgaagggctcgccggggagcacgttggcgacccgttcgccgttttccccctggcggtagatgcccaggttcgaggtgcacacgatcagcgcctcggagaagtacacgcgatcgccgcgcccggaggtgagcacgccgtcgtcgaggatctgcaggaacttgtcgaggatccgggggtgggctttctcgatctcgtcgaagagcaccacgctgaagggtttttcgcggatcgcgttggtcagttcgccgccgacgtcgtagccgacgtagccgggcggcgcgccgatcaggcgctggtcggcatgctcggcgctgaactcggacatgtcgaagcggatgtaggcgctctcgtcgccgaacagcaggctggtgacggtcttcgccagctcggtcttgccgaccccggtgggcccggcgaggaaggccacgccgcgcgggcggttgcccttgcggctggcgccgaccccggtcatcgcgcgcttgacgatgtccagcatgtgggtcaccgcgtgctgctggcccttgacccggcggcggacgatctcgtcggcctggcggatgcgctggcggtcgatcttcagccaggggtcttcggtgacgccgaccttgtagcggcgcacggcgtcggcgatgcgttccatggccaggccttccacgcgcgccaactggacgatggcgttgagatcgaggagcagcaggccttcggtgttctcgacgaaggttgcggcggcctgttgcagggcctcctcggcgacgcccgcgccgccgagcccgcggagcagcgccggggccagggcccggcgcgccggctggtcgggcttcgacaccgggatatggcgcaggcgcgggttgtccaccagcagccagtcgggcaggtcgccttccttttccaccacccacagcacgctgttgaagaacggtttgcgctgttccccggcgggacggctgcgggcctggtgggagagcaccagggcctgggtgaacaactggtgctcggcggcgctcagggcgtcgttgcgcaccgccaggcgcgaggcgaagtcgacgatcagggcgatcggctcgccgctacggttgaccaggcgttgcagggtcgcgccgagtag

SEQ ID NO: 14445 - DNA, 1089 bp, Pseudomonas aeruginosa
tcgctcacagcgtgtgtcgtggccacagcatattgccccgagggccatgtctccaaccctgacctcgccggagacgacgaaaaccgctacgagttccgggtgccaggcttggcggagcgcctgctcaaccgtcgtagctccggcagccccagcggaacgcctgcgccgccgcctcgatcccgcggccgatcaccaggcgcggcgggctttcgtcgagatcgggacgcggcggcaacggacggctgtagagcacctccagctcgccgaaaccatccagcgcggcgcgttccgccgggtgcggcgtcgcgccctggcgccgggcgaagtcttcgaggtcgccctcggcgtaggccatcaccagcacgctgctgtcgccgcgtacccgcaccgcgttcaccaggctgccgtcgatgcgcagcggggtggcgaagcggtagagcaggtcgagggtctcgccgggcgcgcgatccagcacttcgacgccctcggcgcgcaggcgctcggcggttgcgcggtcgcggccgtcggggaagtcgccgcggcagtgcagggcgtcggcgaacagtgcggtcaggttcggtgctggcggggcaggggacgtgcaggcggccggcaggagcagcgccaggccggcggcgagacggagcaggtaggggcgggtcatgtagccttccgttggcggacagtgcggtgggagaaattgccagcagacgcttccgagatactggcggcctgcgctcagagcagtacgggcagcgcgtcttcgcccagccccgcttccctcaatcgagccctggccctggcggtcgcgcgcacggcgtcgaggtcgcagccgcgaggaatatagaccggatcgaagccttcgagcaccaggtaggtggaggcctggccgcgggcattcaggtaggcgttgaaagcctggtcggccgggcgcagaaagacatcgcaccagtacggcaagcgctgcgcgaagagcgccttggcgatctccaggtgctcttcgaacagttcgtccatgctgcctcccttctcctgctggaacaacgtcactcttcgctgcgtccgtcgccttcgcgatccctttcatag

SEQ ID NO: 14446 - DNA, 1335 bp, Pseudomonas aeruginosa
ctcctttgcaaggcgttggggcgttcagcccttgcaggccttctctatggtggcgatatcgatcctgcccatcgtcatcatcgcctcgaaggcgcgcctggccgccgcgcggtcggggctggcgatggcttcgctgagtacgcgcggggtgatctgccaggagatgccccacttgtcacggcaccagccgcaggcgctttcctcgccgccattgtcgacgatagcgttccacaggcggtcggtctcggcctggtcgtcggtggcgacctggaaggagaacgcttcgctgtggcggaaggccgggccgccgttgagcccgaggcagggaatgcccatcacccggaactccaccgtcagtacgtcgccctccttgccggaagggtaatcgccgggcgcgcgatggacagccagcacggcgctgtcgggaaatgtctcggcgtagaaggtcgcggcctccagggcggcgctgtcgtaccagaggcagatggtgttcttgctgttcatggcgaggtctccacgggcggggtcgaccccgccagtctagtcggctggcgtgcggcgacctgggcaggcgccgaacgggaggtcgcgccgcgagtgccgatctgcgctaccctatgccgcgtttcgcccggcctcgccgggctttccgggcagcgcctcggcggcgcgccctcgaccatgcaaggacaacccatggaagcggtctccgtctcgcagcatctggctgctctgttcgaatcccaccggatcgactgcgtcgtgcacggcgaatgggtggcgccagccgggcggctaccggcgatccgcgccacctggtatgcgggggagaagaccggacggctggatgtcgacgtgctgctggaggacgagcaccagttgcaggaagccttcgccggcatcggcagcgccgaggacggcttgcaggacgcgttgcgtaacttcgcctccagctctttccacgtgctgctttccgcgctctggggccaggccgaggaggaccaggtgatggtggagacctgggagatcggcgagcggcgtttcgaggtgcatatcggcaacctcggcctgcgcggcgccgaaggcaaggcgccgccgctgccggccgggctgttcccgagcatcgagcgggcgatccgcaccgagccgctggacgcgcgcctgcactggttccggcatttcttctgtgccttcggcaaccagcgcacggtggaagcgctgttcgacaaccagccgtgggaggccggcatgcagaacctggccgctctcgactggcaggattcgcagggttactacagcgtgcgcaacttcctcatgctcaagccgctggcgtag

SEQ ID NO: 14447 - DNA, 1446 bp, Pseudomonas aeruginosa
cgtgatggtcgacagccgtgccatgaccggccccggcggggtggtcctggaaaacgacgcgcaactggagaaattccgccgctgggcgcgcatcgggcgttccgccggcgcgcagttctggttgcagatcaaccatcccggtcggcagatgcaggccaatctcggccagcaggcctgggcaccctcggcggtgccgctggaactgggcgggatgtccaggcacttcgctacgccgaaggcgatggacgaggcgatgatcgccgaggtgatccagcggttcgcccgcagcgccggcctggccgagcgggccggcttcagcggggtggagatccatgccgcccacggttacctgctcagccagttcctctcgccgctgagcaaccgccgcagcgacgcctggggcggctccctggagaatcgcgcgcgcctgctgctggagatcgtccgggcggtgcgcgccgaggttgcccctggcttcgcggtggcggtgaagctgaattccgccgatttccagcgcggcggcttcagcgccgacgatgcccgcgaggtggtacggatgctcgatggcctgggcgtcgacctggtcgagctgtcgggcggcagctacgaggcgccggccatgcagggcgaagcgcgcgacgggcggaccctggcccgcgaggcctacttcgtcgagttcgcccgcgacatccgcgcggcggcgcggatgccggtaatggtcacgggcggcatccgccggcggccggtggccgagcaggtgctggccagcggggtggacatggttggcatcggcacggcgctggcgatcgagccgaacctgccgcgcgactggcgcgccggcaaggactcggcgccgcagttgcggccgataacctggaagaacaaacccctggcatcgctggcgaacatggccgcggtgaagttccagctgcgcaagctgagccggggcagggcgaccaacccacgggtgtcgccgctgtgcgcgttgctcgcgcagcaggccggcgcgctcctgcagacccgccgttaccggcggctcatgcgttcgcgcgccgaagcctgagcaccgtcagcgcctcaggcgccgttgcggtcgagttcggccagcttgcccggcaggccgaaccaggcgtcgtggtcgtcgggcgccggcttcttgcgggtgatctgcgtccagttgggatgcgcggcgagttcgccattgagggcgatgaactgccgttgcccgagcggcacctcgtcctcggcgcgaatcgcggcgaccgggcattccggctcgcagagcgcgcagtcgatgcattcatcggggtggatgacgaggaagttggggccttcgtagaagcagtccacgggacagacttccacgcagtcggtgtgtttgcagcggatgcattcttccagcacgacgaaggtcatgatcgtcctccctggctcaggcgttcgtag

SEQ ID NO: 14448 - DNA, 783 bp, Pseudomonas aeruginosa
aatggacggaggtttttccgggagaaccccatgaaatggcaagaagtcggcgaaacgccctgttcgatggcgcgcagcctggcgatcctcggcgatcgctggacgctgctgatcctgcgcaactgctttctcggcatgcgccgcttcgatgagtttcaggccagcctcggggtcaccccgccaggtactggtcgaccgcctgagccggctggtggaggcgggcgcgctgaaggaaggtgccttaccagaagcgaccgccgcgctacgaataccgcctcaccgacatgggccaggacctggcatccggtgctgctggccctggccaattggggcgaccgctggctcgacgagggccgcggcggctccggtggagtatgtgcacaaggcctgtggccacaagttccggccgaccatggtctgcccggagtgcggcgagccggtgggggcgcgcgatgtgacggcggtgccggggccggggttcgcggcgatggctggcaagctcgcgcagaactgaatccgcgcgcgctctgccaagggcgggccgcgacccgctcggttcgctcagccggccttgcggaagacgaacatcagccccaccacgatcagccccatgcccagcaggctgagccagccgaggcggttgccgaagaccatgaagtccatgatcgcggtcaccgccggcaccaggtagaacaggctggtgacgttgaccaggttgccctgggcgatcagccggtagagcagcagggtcgcgcccaccgagaccacgacgcccatccatag

SEQ ID NO: 14449 - DNA, 660 bp, Pseudomonas aeruginosa
cgcggggaccaggaagccggcgttccattcgaactcgaacggctggaagggcacgaacgccaggcacaggccgaggccggcgaggtactgcaggggcagggtgcccagcgggttctcgcggatgcccttctgcatgatcgagccgccggtgacgccggccagcgccagcagtgcgcagaggatgccggccgtggacatcccggccaggccgatgccctggtagaccaccagcaccaggccggccaggcccagcagcaggccgaacaggcgcgccggcgactgccggcgttcgaggatgacggcggtgaggatcggttgcacgccgaggatggtcgccatcatgccgggagtgacctgcagcttcagcgagaagatatagaagatcggatagatccccagcatcaccaggccggtgagcagggccttgccgcgctcacgcgcgctgcgcggcgcgcgcagcctgagcagcggggcgagcggcagcaggcaggccagggcgatgccgaagcggaacaccaggaaggcgaacggcgaggagtgcgccaggccccatttcgaggcgatggccccgctgctccagagcaggacgaagaggctggtgctggccaggccggccagcgcggatttgttcagtgcaaacatggatctgccaccttgtag

SEQ ID NO: 14450 - DNA, 2334 bp, Pseudomonas aeruginosa
cgcgccgcgttgcggatgatcaggaagaagtccgggccgggcgagagcatgcccagggtggcgagggtggctacgaagagcgaggtttccagcatgattcgatacgcctggcgcaaggcggcgccggttcgctgcggcgccgcgggtcggtggttactgggtcagttcctgttcgctgaacaggccgtcgaagagcatgctcgaaagatagcgctcgccggaatcggggaggatcaccacgatggtcttgccctgcatgttcggctcctcggccaggcgcaccgcggcggccatcgccgcgccggaggagatgccgcagaggatgccttcttcctgcatcaggcgcagcgccatgttcttcgcttcgtcgtcgccgatcttctcgacccggtcgaccagcgacaggtcgaggttcttcggcacgaagccggcgccgatgccctggatcttgtgcggggcgggcttgacctcctcgccggcgagggtctggctgatcaccggcgaggtcaccggctccaccgccacggcgaggatcggcttgccccgggtgttcttgatgtagcgcgagacgccggtgagggtgccgccggtgccgaccccggagaccagcacgtccaccgcgccctcggtatcgttccagatctccgggccggtggtcttctcatggatcgccgggttggccgggttgtcgaactgctgcggcatgaagtacttcccgggatcccccgcgaccagttcctcggccttctggatcgcacccttcatgcccttcgccggttcggtcaggaccagctccgcgcccagcgccttgagcaccttgcgtcgctccaggctcatcgacgccggcatggtcaggatcagtttgtagccgcgtgcggcggcgacgaaggcgaggccgatgccggtgttgccggaggtcggctcgaccagggtcatgccggacttcagtctgccgctggcttcggcatcccagatcatgttcgcgccgatccggcacttcaccgaatagccggggttgcgcccttcgatcttggccaggatggtgacgccgcgcggggcgatgcggttgatctggaccagcggcgtgttgccgatggactgcgcgttgtctgcgaagatgcggctcatgatggtgtccttgtcgcatggagaaagatcaatcagcctattccgcccccgcccgcgcgtccagacgcgttcgaaccagcggcgcgccgcgcgtgtccactgtccaggagggccgtaccgatgaagaaacgctatgccattcccctgggcagcctggcggcgctgcttctgttgttgctggcgctgcacctggcgctgccgtacctggtgcgcgactacctgaacggcaagctggccgacatgggcgactaccgtgggcacatcgccgacgtcgacctggcgctctggcgcggcgcgtatcggatcgacgggctgagcatcgtcaaggacaacggcaaggtgccggtgccgttcctcgacgcgccgagcatcgacctgtcggtgagctggcaggcgctctgggatgatcacgcagtagtggcgcgggtggtcttcgagcgtccgcagctcaacttcgtcgatgccggcggcgaccgcgacgcctcgcagaccggtgccggcaccgactggcgcgagcaactggacaagctgctgccgatcaccctcaacgaggtgcgggtggtggacggcaccctgcgtttccgcaacttcacttcgaagccgccggtgaacctgcacgcctcggcgctcaacgccagcatctataacctgaccaacgtggccgacgcccggggcgagcggccggcgcgtctcgaaggcacggcgcggatactcggccaggcgccgctggaagtggcggcgcatttcgacccgctgagcgacttcgaggacttcgacctgcgcctgcgggtcacccgcgtcgagctgaagcggctcaacgacttcgccagcgcctatggcaagttcgacttcaatgccggcaccggcgacctggtgctggaggcccaggctaagcgcggccagctggatggctacatcaagccgctgctgcgcgacgtggacgtgttcaactggcggcaggacgtggaggatggcgacaagaacctgttccgctcggtgtgggaggcgctggtcggcggtggcgagactgtgctgaagaaccagcgcaaagaccagttcgcaacccgtgtgaacctgagcggtaatatccaccagcgggacgtcagcgcgttccaggcgttcctcgggattctccgcaacgcgttcgtcgaggcgttcaacgctcgtttcgagcgttccccggcgacgcgcgacgacgacggctga

SEQ ID NO: 14451 - DNA, 957 bp, Pseudomonas aeruginosa
atgacccgtctgcgttcacagtgcgcttgtccccgcgttatagtcgggttttcaaacaatactgaactgcccggttttccagccagggcgttaccgttcgaggatttcctgatgaagttcgaaggcacccagtcctacgtcgccaccgacgacctcaagctcgcggtcaacgccgccatcaccctgcagcggccgctgctggtgaagggcgaaccgggcaccggcaagaccatgctcgccgagcagttggccgagtccttcggcgccaagctgatcacctggcacatcaagtccaccaccaaggcccaccagggcctctacgagtacgatgcggtaagccgcctgcgcgattcgcagctgggcgtggacaaggttcacgacgtgcgcaactacatcaagaggggcaagctctgggaggccttcgaggcccaggagagggtgatcctgctgatcgacgagatcgacaaggccgacatcgagttccccaacgacctgctgcaggaactcgacaagatggagttctacgtctacgagaccaacgaaaccatcaaggcgaagcagcgcccgatcatcatcatcacctcgaacaacgagaaggaactgcccgacgccttcctgcgccgctgcttcttccattacatcgccttccccgaccgcgagacgttgcagaagatcgtcgacgtgcactacccgaacatcaagcagtcgctggtcagcgaggcgctggacatcttcttcgacgtgcgcaaggtgcccggcctgaaaaagaaaccttcgacttccgagctggtcgactggctgaagctgctgatggccgacgagatcggcgaagcggtgctgcgcgaacgcgacccgaccaaggcgatcccgccgctggccggcgccctggtgaagaacgagcaggacgtgcagcttctcgagcgcctggcgttcatgagccgccgcgccagccgctga

SEQ ID NO: 14452 - DNA, 873 bp, Pseudomonas aeruginosa
caagtggatcggtaccggcggtaccagtccgttcggctccggcggtttcaacccggagggcatccgcgtcggcgacgccggcaagcgccagggcaaggcggccaaggtctgggaccagcgcgaatacaagaacctcgacgaccaggtcgaactgggtacgcgcaacatcaagatcgccctgcggcgcctgcgcaagttcgcccgcgagggcgcggcggaggagctggacatcgacggcaccatcgaccacaccgcgaaggacgccgggctgctcaacatccagatgcgcccggagcggcgcaacacggtgaagctgttgctgctgctggacatcggcggctcgatggacgcccacgtcaaggtctgcgaggagctgttctcggcctgcaagaccgagttcaagcacctggagtatttctacttccacaacttcatctacgagtcggtgtggaagaacaacctgcgccgcagcagcgaacgcaccgccaccttcgacctgctgcacaagtacggtccggactacaaggtggtgttcgtcggcgacgcggcgatggcgccctacgaaatcacccaggccggcggcagcgtcgagcactggaacgaggaagccggttacgtctggatgcagcgcttcatggagaagtacaagaagctcatctggatcaacccctatccgaaggacacctggaactacacggcgtccaccggcctggtccgcgaactggtcaaggaacagatgtatccgttgaccctgagcggcctggaggagggcatgcgcttcctctcgcgcggttgagccaactgcctgcgggaccggcgacaggcgcggcggcacgcaacttgcctaccctgtgtatcccgtccgcgcggtaa

SEQ ID NO: 14453 - DNA, 711 bp, Pseudomonas aeruginosa
cagcgcggcgcggccaccggtaacgatgggcacgccatgatcgactcgaccttctcccgcgccacctggctcaactcgctgcacatgtcgaccctcactctctcgctgctggagaaggaagggttcgcccgcgagcaactgctcgaaggcagtggcatcacccccgccgacctgctcggccagccgctgcccttgctggaagcggccttcgactatgccggcgacgaggcgatggcgcgggcctacgccgagggtttcgcctgcgagttgcacttcgaacgcgagcgcagcgccatcggcttcgccgccgaatggctggagcgcccgttgccgctggccgacccggtgacccaccgggagatgctggaacagtgccggcggcagaacatcgacctggccgcgcgtcgtgcctggctggacaaggtccgggcgatcctcgccgagcgcttgcaggacccgcccggcctggaggaactggccaggcgcctgaactgttcgtcgcgcagcctgcgccggcaccttcagcagcagcgcaccagctaccagcaattgctcgacgagttgcgcttcgcccgcgccaaggagttgttgcagagcggcgacatgccgatctaccggatcgccgaggaactcggcttcagcgagaccgccagcctgcgccatgccttccagcgctggagcggccagccgccgagccatttccgcgcctga

SEQ ID NO: 14454 - DNA, 426 bp, Pseudomonas aeruginosa
gcagcatcaccggcaccagcaaatagaggttgcgcagcagcgccagggccagcagcaccagtgcgtagagcacgctggagagcagcatcaggcggtcgctgccgaggcgttcgcgcaggcgcggcaggaacgcggcgccgagcaccgcgccgacgccgacgctgcccagcagcaggccgaagtccatggcgttgccatgcagttcgccgcgcacgatcaggggcagcagcgacatgccggcgctggcgccgaggaagaacgccaccgcgcgcaccagcaccgattgcagtggcctcgagctgcggctgtagcgccagccggcgcgcagggcgccgaacaggcgttccgccggcagcaccgagggcacggcctcgcgtttccaggccagcagcacggcgatcaccgcgaagaaggagagggcgttga

SEQ ID NO: 14455 - DNA, 2472 bp, Pseudomonas aeruginosa
gtccagcggcaacaggccggtgccggcatggccacgtccgccgtcgagcttgaagccggcgaagccgtggagatcgaggccgaaaccgacgcggccgggagtataggccgactccaggtcggcgatcaggccgtgtgcccattccttgcggtagccgcgcccggcgtccgcgcggcgatagtcgttgtagaggaagtagttgcggttgagcaggcgccactccaggtagtcgggcgccttggcttcctgtgtcgcggcgtggcacggcgaggtgccgcccagcgccaggaaaagggccaggcggccgaccggtcgaacgcggatcatcgggaaaactccgggcgaggcgggccgcgaagggcccgcccgggtacgtcagaaagcgaagcaggaacagccgaatgcgccccagaaaccctggaagtcgctcaccggtacgttggagtggcgcgcgcggttgtgctcgtgggcgtgtaccgcgcaggcaccgacgcactggtggacctgggcggtcagcggcgcgccttgccgccagtggccgggtaccttggccaccggcgaccagtccggcagcaccggcggcgccggcggaccgagcttgtcgaactcggcggcggcatagacgaccttgccgtcgaccaccgtgagcaccgactcgatccacttgatggcctcttcctcgacgccgaagaagtccgccgacagcgccgccaggtcggcgagctggccaaccttgatctgtcctttcttgccctgctcgctggagaaccaggcgctgccgtgggtgaacagctgcaacgcggtttcccgcggcaggccctgcggatacagggccatgccgccgacggtgcgaccgctgaccagccagtacagcgaggtccaggggttgtagctggagacccgggtggcgtcggtgccggcacccaccggcacgccctcggcgagcatgcgctggatcggcggcgtggcctcggcggccttggcaccgtagcggtcgacgaagtactcgccctggaaggccatgcggtcctggatcgcgatgccgccgccgagtgcccgcacccgctcgatgttgcacggggtgatggtctcggcgtggtcgaagaaccagggcaggccgttgaacggaatgtcgcggtcgaccttctcgaacacgtcgagcatccgcgagatcgattcatcgtaggtggcgtgcaggcggaacggccagcgctgctccaccaggtggcggaccactggctccagctcctgctccatggtctgcggcaggtcagggcgcggttcgaggaagtcctcgaagtcggcggcggagaacaccagcatctcgccggcgccgttgtggcggaagaaatcgctgccctggccgtacttgacgctgccggtccagttcttgaagtcggcgagttcttccttcggtttctgggtgaacaggttgtaggcgatgcgtacggtgagctggccctggtcggccagttcgcgaatcacctggtagtcgtccgggtagttctggaagccgccgccggcgtcgatcgcgctggtcaggccgaggcggttgagttcgcgcatgaactggcgggtggagttgacctggtattccagcggcagcttcggtcccttggccagggtggcgtagagaatcatcgcgttgggccgggcgatcagcatgccggtgggttcgccgctgctgtcgcggacgatctcgccgccgggcgggttgggcgtgtccttggtgtagccgaccacgcgcagggcggcgcggttgagcagggcgcgatcgtacaggtggaggacgaacaccggggtgtccggcgcggccttgttcaattcctccagggtcggcatgcgcttctcggcgaactggaactcgttccagccgccgaccacccgcacccactgggggctgggcgtgcgttcggcctggttcttgagcatgcgcaaggcgtcggccagggagggcacgccttcccagcgcagctccaggttgtagttgaggccaccgcggatcaggtgcaggtgcgagtcgttgagaccggggatcacggtgcgcttctgcaggtcgatcacctgggtggcgctgccgcgatggagcatcgcatcggcgtcgttgccgacggcaaggaacttgccgtccttgatcgccacggcggtggcggtggggttgtcgcggtccacggtgtggaaacggccgttgtgcaggatcaggtcggcggtcatggaacctcctgggttgcttgcgggagaaaggctggcggcgttggcgaagggcagggcggaccacaggactccggcggcgcccagcaccgaactggtagtgaggaaatggcggcggtccttgctcggcggatcgtggctcatggcgtgctcctggcagcggggcggaatcggtcagcgagggcggcggcgagagaggccaccggacaggataggtgcggcgggaaacgtacgggacgaaagagcggttttcccgaatga

SEQ ID NO: 14456 - DNA, 1278 bp, Pseudomonas aeruginosa
ggcggactgtcgattctgctagctggtaatccttcttttattgtctctgtgtgcgctttttgtatggatgtgtcgaatattttgaatatcgccgttcaactttatccagggccgcagttcagtgatttattttctcgaaaagtttgttttttccaatattcatgcttcatagtctggccggccacgggaaattatctgttggcctgcgtgctgttgtgcgcaacagctggaattcatcgttcgttgtcaggaaacaatcatgagccactatctcgaagttctaactccgcagaacagccagatcatcttcatcgaccagcagccacagatggcattcggcgtacagtccatcgatcgccagacgctgaagaacaacgtagtgggcctggccaaggcggcgaaggtattcgacatcccggtcaccatcaccacggtggaaaccgacagcttctccggcccgacctatccggagctgctggcggtgttccccgagcagaagatcctcgaacgcacctcgatgaactcctgggacgaccagaacgtgcgcgactcgctggccgccgcgggccgcaagaaggtcgtggtcgccgggctgtggaccgaggtctgcaacaccaccttcgccctctgcgccatgctcgagggcggctacgagatctacatggtggccgatgcctcgggcggcacctccagcgacgcccacaagtacgccatggaccgcatggtccaggccggcgtggtaccggtgacctggcagcaggtcctgctggagtggcagcgcgactgggcccgccgggatacctacgacgccgtgatggccatcgccaaggagcattccggggcctacggcatgggcgtggactacgcctacaccatggtgcacaaggcgcccgagcgggtgacccacggcgaacgcatcggcccgaatccggccaagtgaatgccggccgtgccgctccggtccgccgggcggcacggccgcgaaggagaacgaagatgaagctctacgtattgtcgctgggcgccggactgttggtggggatcgtctacagcctgctgcaggtgcgttcgccggctccgccgctggtggcgctggtggggttgctcggcatcctgctcggcgagcaggtcatcccggtcggcaagcaattgctcggcggttgcgcgttcgcctcggcctgcgacaaggcgggttcggtcggccatgtgctggggcaactaccgggtcggcatcgcctcgaccaggccgctggcccgtcggaaaaggaaaagggttga

SEQ ID NO: 14457 - DNA, 1200 bp, Pseudomonas aeruginosa
cggacggtacggaagccgccggatgctcggctagaatgccctggcttcggcggtcgccattggccgcccacttcgcaacggaacagggaatcgcagatgaaagcagtacgccagggtcgcggcgtaacggggttgctcatgctcctggcgctggccgggtgcagttcgcggtcggcggagccgccgccgcccaaccccgacgaagtacgggcgaagatcgtccgcctgatgccggccacggtgcgcgatcgccaagggtgggccagcgatatctacgcggccttttccgcccagcagatctaccccagcgacgagaatctctgtgcggtgctggcggtgaccgagcaggagtccacctaccaggtcgacccgccggtggccggcctgggcaggatcgccacccgcgaggtcgagcgtcgtgccggcaagctgcacgtgccggcgttcctggtcagctcggcgctgaatatcaagtcgcccgatggccgcacctacagccagcgcctggccgcggcgcgcacggagaaggaactgagcgagacattcgacgatttcatcgccatcgtgcccatgggcggcaagctgttcggcggcttcaacccggtacacaccggcgggccgatgcaggtcagcatcgctttcgccgagcagcacgcggacggctatccctatccgctggacggcagcatccgccgcgaggtgttcagccggcgcggcggcatgtatttcggcatcgcccacctgcttggctatccggcggactacccggcgccgctgtaccgcttcgccgacttcaacgccggctggtatgccagtcgcaacgccgcgttccagagcgcggtgagtcgcgtctcggggattccgctggcgctggatggcgatctgatccgctacggcacgcgcacgccgggctccaccgaactggccgtgcgcagcctcggcaagcgcctggacatgagcgacgcggcgatccgccgggcgctggagcagggcgacagcccggagttcgccgacagcgcgctgtaccgcaaggtcttcgccctggccgaaagcgccaccggcaagacattgccccgcgccgtgctgccggggatcgccctggagagcccgaagatcacccgcaagctgaccaccgcctggttcgccaagcgcgtcgacgaacgctaccagcgctgcatggcgcgcgtgcggaaacgctga

SEQ ID NO: 14458 - DNA, 939 bp, Pseudomonas aeruginosa
gtctcgcggtacatgcggttggtctcgtggccgagcatctgcttcacgtcagttgttgctgttggtgttctgcgtgtcgccggtgtaaatgttgccctggcggctgaagccggcctcgaactcgacggtctgctcgggcgtcaggcgccagctgagcagcccgtcaatgtccttgttgcgcacgccttcgcgaccggcggggagggtgccggcctgcttgccggtgcggttggattcgtggccggcgttgatgtcccagtcgtccgagtcggtcttggcgatgttgccgtagacgcggtagctgaggttttccgtgagcggcccgttgagaccgaagctcatccgttcgctggcgccttcggccttgtgttgcgggaaattgctgtagacgctgagattaccgtgggtttccgcgccggcctgcttggtgatgatgttcaccacgccgcccgccgcgccgttgccgtagcgcgccgccgccgggccgcggatcacttcgatgcgctcgacctggtcggccggcacccagttggtgtcgccgcggctgtcgcgctcgccgcgccagccgtagcgcaccgagttgcgcgagctgaccggcttgccgtcgaccaggatcagggtgttctccgggcccatgccgcggatgtcgatctgccggttgttgccacgctggccgctggagctgttgccggtcaggttgacccccggcatggtccggatgatctgcgacaggtcgttgctcggcggtcgcttggcgatgtcctcggcggtgatgatggaaacccccggcgcctgcttggtttcctcctgggcggtggcgaccacggtctgctcgcccagctcgatgacggagccgtcgccctggccggcggcgtgtacggcgttggcgagcaggcaactggacagcagcaggaagggaacggcgggaagggcgcgtga

SEQ ID NO: 14459 - DNA, 543 bp, Pseudomonas aeruginosa
cggatggcgttgcgcaggaggttttccatggcctgggccaggctgtccaggtgtacctcgacgcgacagtcgacgcccaagcggcagggtagccgcgccgggtcccagccgctttcgaaacaggcgtcatcgcgcagcgcttcccacaccgacagcgccagcaccggctcggtgggcagttgcgggcgctcggtgtccatccaggcgaggtcgagggtgtcttccagcagtcgttgcatgtcgccgatttcgcgatccaggcgctggcgcaactgttccggcggtagctcgctgtcgtgggcgatgcgcaggcgcgccagcggcgtgcgcagttcgtgggacagggtgcgcagcagcaggcgctgctgggcgagactcaggcgcaggcgctcggccatgtgctccagggcctgggccagctcgcccagttcgtcgcggcgggccgccagcggtgcggcgaggggagtgctttccagttcgtcggcgcgcagggcgtcggcgcgatcgcgcaagcggttcagcggcaccaccaggtggcgatag

SEQ ID NO: 14460 - DNA, 456 bp, Pseudomonas aeruginosa
atcagccaggtcagcagcaggcagaagccgacctgcagcagcgccagtttccataacagcgggtgcctgcgcatcaggggtgttccgtctccaccagcaggtagccctggccgcgtaccgcctggatctgcaggtgacggacggcgaccgcggcgagtttgcgccgcaggttgcagacgtgcacgtcgagaccgcggtcgaggcgcgtgtagctgcggtgcagcacgctccggtagaggaacggcttgctcagcgcctcgccagcgtgttcgcggagcgtcgccaggaggcggtactcggatggcgtcagccccgccggaaggccctggtggagcacatcctgggcctggtcgtcgaacaccagccgggtatcccgccgctgcgccgacggcaggcggtccagtcgtacgcggcgcagcagggcgtcggtgcgggcatccagctcggccaggctga

SEQ ID NO: 14461 - DNA, 3387 bp, Pseudomonas aeruginosa
atgagcggcctaccggtttcccatgtcggcgagaaagtctcgggaggggttatctccaccggctcgcccaccgtgcacgtcggcagcagcgcggtcggcctggccgaccgggtgtccgcctgcgtgccgttggtgggcaagccggtcaacccgatgctcggcagcaagctgctgccggaagaggtcgatttcgccctggcggcgccggacaccttcaccttcgcccgtggctacctgtcgagcaacccccgtatcggccggctcggccggggctggtggctgccgggcgagagcatgcacctggaactgagcgaagacgcctgcgtgctggtcgacgcccagggccgccggatcggctttcctgcgctggctcccggtgcccagcattattccggcagcgaggagctgtggctgcgccgcggcggttcgagcggcggcgaagcgcaggcctggcgcgggcgctgggcggcggtgccggccgaactgcagacgcaggagggctccgtgctggtgctgtccggccacagctacctgcatttccagcgttgccccgacggtatctggcgcctgcaggccagcttcggccgcgccggctaccgcaccgagttccgctggagcggacgtggcctgctcaccggcgtgcgcgacagcgccgggcgcagctatgcgctggtctaccagcaagcctgcgagccgagcgagggcgacgacggcctgcgtctgttcggcgtgatcctggccagccacgacggaccgcctccggactacatcgatccgcagagcccggggctcgactggctggtgcgctaccagttcagcgacagcggcgatctgatcgccgtgcgcgaccgtcttggccaggtggtccgggtattcgcctggcgcgagcacatgctggtcgcccacggcgaaccgggtgggctggaggttcgctacgagtgggatgtccatgctccgcacgggcgggtcgtgaagcagatcgaggcgggcggcctgacccgtaccttccgctacctgcgcgatgccaccgaggtcagcgacagcctcggccgcgtcgaacgctacgagttcgccggcgagggtgggcagcggcgctggaccgcgctggtcagggccgacggcagccgtagcgagttcgactacgacctgttcggccgcctggtcgccatgcgcgatccgctgggacgggagacgcggcgccggcgcgatggccaggggcggatgctcgaggaggagtcgccgggcaaggcgcgctatcgcaagcgcgtcgacgaagagaccgggctgctggtcgagctggaggacgcgatgcagcgccgctggaccttcgagcgcgacgaacggggcaatgcgacgacggtgcgcggcccggccggcagcacccgctacgcctacgaagacccgcgcctgcccgaccggccgacgcgaatcgtcgacccgcgcggcggcgagcggcgcctggagtggaaccgcttcggcctgttggccgcgttgaccgattgttccggccaggtctggcgttacgactacgacaacgaaggacgtttggtcgccagcagcgacccgctgggacaactgacccggcgccgctacgacccgctggggcaactgatcggcctggaattggccgacggcagcgccctgagctatgaatacgacgcccttgggcggcagacccgtatcgccgatgccgaggggcacgccacgctgttttcctgggggcacggcgatctgctggcgcgggtttccgacgccggcggcggcgaattgtcctacctgcacgacgaagccggcaggctggtcgccctgaccaacgagaacggcgtccaggcgcagttccgctacgacctgctggaccgtctggtggaagagaccggcttcgacggtcgtcgccaacgctatcgctacaacgccgctgacgaactgatcgcccgcgaggatgccgacggtcgcgagaccacctatgcctacgaccgcgatggccgcctggcgagcatccgggttcccgccaccgagcacgcaccggccctggtcgagcgttaccgctggttggccgacggccgcctggccagcgccggcggggcggattgcgaggtgcgctacacgtacgacgaggtcggtaacctgcgcctggaaagccaggtacatgccgacggttgggtctacagcgtcgagcacagccacgacgcgctaggcgtgcgccagaccagccgctacggcgacgcgccgccggtcgcctggctgacctatggcccgggtcatctgcacggcgcgctggtcggtgcggtcgagctggccttcgagcgcgatgccctgcaccgtgaggtgcgtcgcgacgcccgccgcgacgggcaggatgacgcgttgttcacccaggagcgccagcacgcgccgctgggacgcctgcagcgcagccgcctgcgtctggccggcggtttcgactggcagcgcggctatcgctacgacggacttggacaactggtcggcatcgacgacaaccagtatccgtcggtgcgctacgaatacgacctcggcggtcgcctgctggccagccggcgcgctggcgcggcggccagcacctaccgatacgacgccgccggcaaccgcctggagggcgtcggcgagtacgcgcgcgaggacgctcgccaggcattcgccgagaacgaactgtaccgctccggtttcagtcgctccgaggtgcgcgcgaaccaggccggcgaaggcccggcgcgctgggccggcaaccgcgtggagaggatcgccggcaaccgctatcgcttcgatgcgctgggcaacctggtcgagcgtatcggcgccgacggcgagcgcctgcgcctggcctacgacggcgcgcagcgcctggtccatctgacgcgcgattacgccgacggcacgcggctggaggcgcgctaccgctacgacgcgctgtcgcgacggatcgccaaggtggtgctgcgcgacggtgtcgagcagcaggtgcgcttcggctgggacggcgatcgccaatgcgccgaagcctttgcgcgggaactgcgcaccaccgttcacgaaccgggcggtttcgtcccgttgctgcgcctggagcaggcctgcgagcccgatcccccggagctgctgcaactgcgccaggcgttcgccgccgaaggccagccgctgccggcgcaatgcgtgccggcgctgggcgaggcgcggatcgcttttttccacaccgatcacctcggtacccccctgcagctgagcgacgaacgtggccaactgcgttggcagggcgttccggacgactggcgggcggtagcgccggaacgacagccgggtgcgcagccgatccgcttccaggggcagtaccacgatgaagaaagcggcctttactacaaccgctaccgttaa

SEQ ID NO: 14462 - DNA, 567 bp, Pseudomonas aeruginosa
tacctgccggaagccgggtgctatgccagccaggacccgctcggcctgggcggtggccccaacctctatgcctatgcgctgaacgcgcccacgatggcgtacgatcccaccggcctgatcatcccgctggtggtgatcggcgccttcgccgcccgcgccgcgatcggagcggcgctgggcgccggcatcgagctggggatgcagaccggcaagcaggtgctggggcagatgaaggacaactgggacagcgatcgcgacctcaccgatatcaagtggaagtgcatcgacatcaactggaaacacgtcggcgcctcggcggccatcggcaccgtggcgccgggcatgctcagcaccggcaagaccgtggtgcagtccgccaaggcgatcaggaccctttccggacaggcggccaacaccgccaaccgcgcggccaagctggccgcgcgcaaggccgcccatgccgataccatcaagaaggccgtggccacccaggccgcctggcagacgggcaagcagatcgtcaaatgcccgctgaaggacgaagaagaggagtgcccgccgcaatga

SEQ ID NO: 14463 - DNA, 1686 bp, Pseudomonas aeruginosa
agctgctggtcgagcccaccggttgcctcggcctggccgccgcccgccagcgcaaggacgaattgcgcggcaagcgggtcgggatcctgctcagcggcggtaacatcgacctggcgcgtttctgcgccttgctcggcggctagccggccgctagaggccgagtccttcgctggctgcccagcgcgccatcaggcggttcgacggcaggctttcgtcgagcagcttgcgcgcgctttccacccccgcgaccggcaggccctgcgggtcgagcaggccgatctgcaccagcacgccggcctggtcccaatagatgtgctcgtggtaaaggcggtcgccgcgaaagcgcaccacgccgagcatggggatttccacgaagcgcccggtgggtgggacgccgggcagcagccagtcgatctcgcagctgtgggtgaagcgcatgacgaactcgtcgaccacctgcagcgcccccaccgtccgcgaaatcggcgtgagggtcatgtccggcgggttgccgtggatgaagtgatggcggtagaagcggctcagttcgcgctggccgacgccgccggtgagggtcgggacatggttgacgtagggctcggcgaccatggtcgccatggtcgcggcgacgtcgcgggtatcgaactcgtggcgcacatgctcgtcccacagcgcggagaggtcgaagttcggcccgatctcccgcttcagggcggcgatgctgcgttcgtgagccatcaggtaggccggtttgtcgaagtgcatgccgccgacgcgggcgaaggcgtgatcgacgccggggtagaggtacaactcggtcttgggcaggttgcgcaggcagggcaggatcgcgtcgcgggcctgctgcgggcagtaggcgtcctgttcggcgaaatgcagcaccagccggcccttgatctgtttcgcctcgtcgagcagcgcctcgatgcccatgccgtagtagcccaccgagcaggagacgtcggtgcgcgtcgcggcgaggtaggccagcttgccgcccatgcagaagccgacgaagccgatcccggcgtggaccacctcctcgcgttggcgcaggtgctcgatacaggcggcgatgtcgtccaccgcggcgtccagatcgatgcgctggaacagctcgatggccttggcgaaggccgcttcgtcgtagcccaggtcgacgcccggctgcagccgccagaacaggtcggggaccagggccacgtagccctcttcggcgtacaggtcggccaccgcgcgcatgttcgcgttgacgccgaagatttcctgaccgatcaccacgcccggccccttgccgctggcggggagcgcgagatacgcgtcgaaccggccgctgccgtcggacgcggcgatgctgacgtactgtcccatgcctggattcctcatcgggttgttgttggagtgggaaaacgggaaagcgaagcgaaccagcctattaggaaccggtcggcgggtcattggctatccgcatgctggcgggagggtatccggattgtccgggagcgaggggcgggaggcggcgcgctcctcggcgagccgctcgcggataccgctcaggcccgctggcgctgccagggcgggccagcggcgaaccgcgcttccacccattggcggaacgcgctggccgccgccgtggcgtatcgcgccgaggggcgcaccaggtag

SEQ ID NO: 14464 - DNA, 855 bp, Pseudomonas aeruginosa
ccgaaagtcgtgtttccgtatcgacaggattcgcctaatgtaaggcggcagcctggacggccatggtccctgtggtcgccgggatcatttcgggagagtcccatgacggcacctttcaaggatcatttctccacgggttcggcgaactacgccgcacatcgtccgacctacccggcgcagttggtcgacgagctggccgcgctctgccccggcacccgcctggccctggactgcggctgcggcaccggacagctcacggtgctgttggccgagcgtttcgaacgggtggtcggtaccgacgccagcgccgcgcagatcgacaaggcgcaggctcgcgagcgggtcgagtatcgcgtggccctggccgaggacagcggactggcggcggccagcgccgacctggtgacggtcgcccaggccgcccactggctggacctgccgcgcttctacgaggaagtccggcgtgtggcccgcgcggacgccatcctggccctggttacctatggcgtattgcatgtcgacggacccatggaaccgctggtccagcacttctaccaccaggtcgtcggcccctactggcctgccgagcggcgccacgtggaggagggctaccgcaatctgccgttccccttcgaggagcgccgcctgccggacctggccatcgaggtggcctggaccctggacgagctgctgggctacgtcggtacctggtcggcggtgaaggaggccggcaaggcccttggccaggatccgggcgccgcgttcgtcgatgagctgcgcgaagcctggggcgacccgcagacgcgctatcgggtcagttggccgctgacggtgcgcgccggggtgatccgctga

SEQ ID NO: 14465 - DNA, 840 bp, Pseudomonas aeruginosa
cgggttctgttcttcttcgccgtggagagtttttctgtgagtggttccctcttggtaccggccagtctcgccagtcgcatcaggctcctgctggtcatgacccggcgcgaggtcgaactgcgttatcgcgacgccatgttgggccgcatctggatcatcgtctcgccgttcctgctcttgctgatctatacgtttgtcttcggcttcgtgctgaagtcgcgctggggtggaagccagagcacgctctccttcgccttgaccctgttttccggactcctgctgaacgggatcctcgctgaaagcctgtccagggccccgactatcatccaggccaacgccaactacgtgaagaagctggtttttcccctggagatactccccctcacaccgctgctggccgctttcttcaacgccatgctcggctacctggtgctctgtatctttcttctcttcagcggcgtcgagccaggctggcaactggttctgctaccgcttgccctgctccccttcctgctctgcgtgacggggctggcgtggttcctcgcggggctcggggtctatgttcgcgacatagggcagttcgtccagtttctcctggtgcttctgctattcatcagcccggtgttctatccgctgtcttccttgccaccggtaatgcagccctacctgtacctcaatccgctgacgatcccggtggaaatggtcagggcgatccttttcgatgctccctatccgacccttggggtcttcagcgtttattgcgttgcgtctctgctggtctgttcatcgggcttcctctggttccgtcgggttcaggaaggttttgcagatgtcctctga

SEQ ID NO: 14466 - DNA, 678 bp, Pseudomonas aeruginosa
accgttatctccttcgatacgcgaaaccctgggctatttctatccggagcgctcgattcaagcagtgctgtgccgctcccaggatctggacggctggttggagcactccctggacctggcccggcaaggtgcggatcggcacgcctacggcagcgaagacatccgctacctgcgggagctggcggaggaggcgccggtagtcgaactcgtcaacaacgtgatgagccaggccatggaaaagcgttcttcggatattcacatcgaaccccgggagttcgacttccgtatccgcttccgcgtcgacggcgtcctgcacgaccaactgagccttccccgcgagcgattcgcggcggtcgtctcgcggatcaagctgatctccgccatcgacatcgcggagcgacggttgccgcaggatggacgcatgagcatccgggtcagcggtacggagctcgacgtgcgggtctccaccttgccaggggtgcatggcgaatcggtggtcatgcgcctgttgccgaaggagcgcgaggggttgcgcctggaccggctcgggatgctcccggaccacttgcggaggatgcgtgcatgggtagcggaaccccacggcatcatcctggtgaccggccccaccggatcgggcaagtccaccacgctctatggcgcgctggaggaaatcaatga

SEQ ID NO: 14467 - DNA, 615 bp, Pseudomonas aeruginosa
tggcgtgcgcaagctcatcagcgtggaagatcccgtggaataccaggtgcccaatatcacccaggtccaggtccatgccgacatcggcctgaccttcgctgccgccttgcgctcgatcctgcggcaggatcccgatgtgatcatgatcggggagatacgcgacctggagacggcggagatcgccgtacagtcctcgctcaccggtcacctggtgctttcgaccctgcataccaacgatgcggtgagcgccttcacgcgtttgatcgacatgggcgtggaacccttcctggtggcttcgccggtgcgcggtgtccaggcccagcgactggtgcgcaggttgtgcgcccactgcgcggaaccttgcgagccaacccttgctgcggccgatctggcagcgacccaggcggccaccgcgcggctgttcccggggcaggcagcgcaatggcgcgtggcgcgaggctgcggccgctgcgaaggtaccggctacagcggccgtgtgggcatctacgaactcgtcgatctgtcttccgagatgcgcgacctgatcgtgcagagagcttccctcgaacagatgcatcggcttgccgccagccagggacagcgcaatctgcgtga

SEQ ID NO: 14468 - DNA, 579 bp, Pseudomonas aeruginosa
ggatgcaggagacctgggcgcgcaggaccgcgctggacgatctgttcaatcaattgcagaccttgggctatcgcgtgcgcagcgatgggcgggagctgctcattggtgagagcggggcggttcccgagcagttgctgcgactgcccgatggctggacggttactgctcggccgccgatacgttacatggcaaacggagtttgcctgggcggaaagttgcaggtccatcatgggcgcgcgacacatacgctgctgcttcagccccctctctgcgcgcccgggacgatccgctgatgccggcgcggcaggaaggcttcacgctcctggaggcggtggttgcgctgacgctcctggcagtggtcggcggtgcgcttttcgcctggctcaacagtgcctttcggagcatgcagcgggtcgaggcggccgagctgcgcatcgagacggcccgggtggcgatggcctatctggagcgcatgaaccctgcgctcgaacccgcaggcagggcccggctggggcattaccggctggagtggcgaagttcgccgctgtccgcgtcgaaagcggcggtgggccgccatag

SEQ ID NO: 14469 - DNA, 597 bp, Pseudomonas aeruginosa
tggaccatgatccgctcgcgacgaaaacagggtgcattcaccctgctcgagatgatcgtggtgctgctggtcgtttccttcatcggcacgttgctcatgcaagggttgagctatgccagcaaggccaaccagtccttgcaccagagcctggggcgcggacaggtccgggcgctgaccttcgattggttccgtgatgcggtggagaacctggtcgctcccgaggctggcgaggtccgctggcgtctgcgaggggacgaactcagtttcgaggccatgtctgccgcggccctggatcgccgtgccggcatcccgacgcccttggccttccggctcgagcggcgggcaggagaggaccggaccgagttgatctatgtgcgaaggctggaggacagtcgctggcccctcctgcatctgcgcggcgaagctcgcttccgctatctggacggtcacggccagtggcaccgggactggccgccgagcgcgcaactggccgatacccttcccgaggcgatggcactggcggctcccgaggagcgcctgtttgtccttgtcgcggtcgtactgcccagagcgaggcccgccgaacatgatttctga

SEQ ID NO: 14470 - DNA, 372 bp, Pseudomonas aeruginosa
acaagtgcaaaattttacttcatggtcggcttggcactccgagccggctcgtccatgctggagcacaactttcccatggataccattgccatgaagttcctgctgcccctgctgctgttattcccgctttccgctctcgccgacgacaaggactacgaccaatgcatactcgactaccaacgcacggcgaagagcggggtggcggttcacttcatcacccaggcctgcgacaagttgtataacgacggctccttcctgctgtcgcgggaaaaggcttattacgagtgtctgctggagaacctgccgggggtggagaacaacctggcggcgcagaagatcaggagcgcttgcgaatcgaagtcgcagaattga

SEQ ID NO: 14471 - DNA, 507 bp, Pseudomonas aeruginosa
agatcggcgcggaagcgcccggcacgcacttcctcggccaggtcgcggttggtggctgcgatcaggcgtacgtcgacgcggtgctcgcgatcggagccgacccgctgcaactgcccgctctgcagcacgcggagcagcttggcctgcaccgccagcggcaactcgccgacctcgtcgaggaacaggctgccgccgtcggccagttcgaacttgccgcgccgttcgttgaccgcgccggagaaggcgccgcgcacatggccgaacaattcgctttccaccagggtctcgggcagcgcggcgcagttgagactgatcatcggcttgccgctgcgcatggaatgccggtggatggattgcgccaccagttccttgccgaccccggtctcgccggtgatcagtacgctcaggtcgctgttggcgaccaggcggatttcttccagcagcgccttgtgcgcggcgctctggccgatcatttcccgtggccgctcgccagcggcttcgagatag

SEQ ID NO: 14472 - DNA, 786 bp, Pseudomonas aeruginosa
attctggtagtttgccttggcacgcttcctgaaatgcttcgaggtgaaacaaaaccttgcatgcgtcaggagtcatctatgttgtccaatgcccaacgtgccctcatcaaagccaccgtaccgctgctggagaccggcggtgaagcgctgatcacccatttctaccgcaccatgctcggcgagtaccccgaggttcgcccgctgttcaaccaggcccaccaggccagcggcgaccagccgcgggcgctggccaatggcgtgctgatgtacgccaggcacatcgaccagttgcaggaactcggcccgctggtggccaaggtggtgaacaagcatgtctccctgcaggtgctgcccgaacactatccgatcgtcggcacttgcctgttgcgggcgatccgcgaggtcctcggcgaacagatcgccaccgacgaagtcctcgaagcctggggcgcggcctaccagcaactggccgacctgctgatcgaggccgaggagtcggtgtatgccgccagcgcccaggccgatggcggctggcgcggcgtgcggcgcttccgcgtggcacgcaagcaggcggagagcgaggaaatcacctcgttctacctggagccggtggacggccagccgctgctggcgttccagccgggacagtacatcggcctgcggctggacatcgacggcgaggaagtgcgccgcaactattcgcttttccgctgccagcaacggccgcgaataccgcatcagcgtcaagcgcgaggcgggtggacgggtctccaattacctgcatga

SEQ ID NO: 14473 - DNA, 372 bp, Pseudomonas aeruginosa
gagcgcccggttaatctgcaaaccgtcgaaagcaacacgattgattcccacggagagattcccatgaagaaactgactgccctgttcgccgccaccgccatcgccctgactgccggcctggcccaggcccgcgacctcggcccggacgaggcgctgaagctgcgtgacgccgggaccatcaagtccttcgaagagctgaacaagaacgccatcgccaagcatcccggctcgagcgtccacgataccgagctggaagaggaatacggccgctacatctaccaggtcgagttgcgcgacccgcagggcgtgaaatgggacctggagctggatgccgctaccggcgccgtgctcaaggaccaccaggacgactga

SEQ ID NO: 14474 - DNA, 1986 bp, Pseudomonas aeruginosa
ggatcacgttcccctggccgacgaactgatggccagcctgacccgccagggctacgcggtggactggctggccgacggccgcgacgcggcggtgcagggcgccagcgagccctacgatctgatcatcctcgacctcggcttgcccgggcgtcccggcctggagatactccaggagtggcgtgggctgggactcgcgactccggtgctgatcctcaccgcgcgcggttcctgggccgaacgcatcgatgggctcaaggccggtgccgacgactacctgaccaagccgttccatccggaagagctggccttgcgcatccaggccctgttgcgccgcgcccatgggctggccaaccagagccagctggaggccgccgggctgcgcctggacgagcagcgccagtgcgtgtgcctgaacggcgccgacgtcgacctgaccgccgccgaattccgcctgctgcgctatttcatgctgcaccccggccaggtcctgtccaaggggcacctggccgagcatctgtacgacggcgagaccgaacgcgattcccacgtcatcgaggtccacgtcaaccacctacggcgcaagctcggccgcgaggtgatcgagacccgccgtggccagggctaccgctacgccggggtggccgccggatgaggtcgatccagcggcgcatgagcgtcggcctgttcgcggtgctgctggtggtcgggctggtcctcgcgcagaccggcctgtggctgttcgaccagggcctgcggcgctatttcgccggcaatctgcgcgaggaggcggagaacctgctggtggccatggtgcgcgggccgaacggcatgcaactggacgagcaacgcctcaacccggcgttccagcgcccgtattccgggcgctatttcgtcatcgagctggaaaaggacacctggcgctcacgctccctgtgggacagcgagctggaagtgccgcacaagaaagggctggtgcagggcctggtcgatgggcccgaggagcagcgactgctggtgttccgcggccactacaagcgcatgggccagaagctgcggatcgtggtggcgcaggactatacgccgatcctggaaagcttcgcccgtgtgcagtggatgggtctgggcgccggcgccctggcgctgctcctggtattgctgttgcagcgcctgaccgtgcgtcgttcgctgcgtccgctggaggaggtgcgcctgcagatcgcccagctgcagcagggccagcgtagccaactggacaaccaggctcccgaggaactggagccgctggtggagcagatcaaccacctgctggcgcacaccgaggagaccctgaagcgttcgcgcaacgccctgggcaacctcggtcacgccctgaagacgccgctggcggtgctggtcagcctcgccgagcgcgaggagatggcgcgccagccggagttgcaacaggtcctgcgcgaacagctggaacagatccagcagcgcctcggtcgcgagttgggcaaggcccgcctggtcggcgaagcgctgcctggcgcacatttcgattgcgccgaggagttgccgtcgctgtgcgacaccctgcgcctgatccacggcccgcacctgcaggtgagctggagcgcgccaccggggctgcgcctgccatgggaccgcgaggacctgctggagatgctcggcaatctgctggacaacgcctgcaagtgggccgatagcgaagtccgcctgaccgtcgcgcagggcgagggcatggtccgcctgaaggtcgacgatgacggccccggtatcctccccgaccagcgccaggcggtgctcgagcggggtacccggctcgacgagcaggtcagcggccatggcctgggcctgggcatcgcgcgcgacatcgccgaggcctgcggtggccgcctgagtctcgaggacagcccgctgggcggcctgcgggtgagcgtcgagttgccgttgcagaagagcggccgcgccgccagggcttaa

SEQ ID NO: 14475 - DNA, 342 bp, Pseudomonas aeruginosa
catcccgggcttcttgcaaggaggtcttggacgatgaaacggcggacgagtacgggccgctggcgctgggcgctgatgctgccggtgctggtgttcctgttgggcgagtccagtggacagcgagaggaggggcggtcgccgcggttacccgcgcaggctcgctacgagcaggccgtggaaaacgcgttgcgcagcgagcgcggcgagccgcgacaggccgggacagcggcagcgaaggtggccgaggcgggagccccggcgcgtctgcgtggctggctgcgctcgctggcccgcctggcgatctgggggacctacggccccccggcgctattcaggccgtga

SEQ ID NO: 14476 - DNA, 876 bp, Pseudomonas aeruginosa
aatcctgctggccaacgtggcgcgcaacggcgtcgacgtcagcgggatcaacgtcacccacgccatgttcatcccagccctgggcatgctcgccgggttgctcatcgcggtgctgttcagctaccgccgcaagcgcgtctacgacttgcagcggatcgagcaggccgaacgcgtcgatgtcagctacaacccgaagagcctggcggtggccggggtatccatcgtcgccgcgttcgtcgcacagctgtggctggactcgatgatcatcggcgcgctggtcggtttcgtggtcttctcgctgtccggcgtggtgcgctggaaggagaccgacgacctgttcaccgaaggcatgaagatgatggccaccatcggtttcatcatgatcgccgcggccggtttcgccgaggtgatgaaggccaccggcgaggtgcagagcctggtcgacgcctcggtggcctggatcggcaacagcaaggcggtcggcgccatgctgatgctgctggtcggcctgctggtcaccatgggcatcggctcgtcgttctccaccgtgccgatcatcgccgcgatcttcgtcccgctggcggtgcaactgggcttcagcccgctggccatcgtcagcatcgtcggcaccgccggcgcgctgggggatgcaggttctccggcgtcggactcgacccttgggccgacctccgggctcaacgtcgacggccagcacaatcacatctgggacaccgtggtgccgaccttcctgcactacaacctgccgttgctggtgttcggctgggccgccgcgatgttgctctgagttccatctcgggcggtcgcctgacggaatgtcgggccggccgcttaagcttccgacgggattgccgatga

SEQ ID NO: 14477 - DNA, 1692 bp, Pseudomonas aeruginosa
gagttgatgatgcgtctgaccctgaaatccaaagtcctcctgctggccatggtgccggtgctgctcttcgccctggtgctcagcggcggagcggtgctgatcctgaaaaaacaggctgatgccgaagtcaaggatacccgcgagcgcctgctcggcgaccgtcgtgccgaactcgagcactacgtgcagatcgccatgggcagtatccaggccgagtacgaccgctcggccaacggcgacctgaatgcccgcgccgaggccatcgcgcgcctgtcgaagatcaagtacggcaaggacggctatatcttcggctacgactcccaggtggtgcgcctgtttcgcggcgacagcccggtggacgtcggcaagagcttccgcgaccgccgcgatcccagcggcgtctacctcaaccgcgaactggtggaggccggccgcaacggcagccactacgtgacctatacctcgccgctgccgggcaacgagagcgtcatggtgcccaagctgtcctacaccctgtacctgccgaagtgggacatggttatcggctcggcgatcaacctcgacggcgtcgaggcccagttggtggaaatcaagcaggacatcgacgagcgtatcggcaccctgatcgccagtatcgtggggatcgccggcgtccttctggtggtcctgctggtgatcggcctggcggtggccaacgcgatgctgcggccgttgcaccagatccgccagaacctcgatgacatcgccgccggcgaaggcgacctgacccgtcgcctaccggtgaccagccacgacgagctgggcgagctggccggttccttcaaccgcttcgtcgagaagatccacggtctggtgcggcagatcgccgggatgaccggcgacctcaagcaactggtggagcagatgtcggcccaggccgagcgttccgagcaggccatggagcgccagcgccacgagaccgaccaggtcgccaccgcgatcaacgagatgtccgccgccgcccatgaagtggcgcagagcgcccagcgcgccgccgaggccgcgcagcagaccgaccacgaaggccaggcggccaagcgcgtggtggacggcagcatcgagcgcatccacgcgctggtggacgagatccgcgacagcgggacttctctggatagcctgcagcaggacgtgcaatccatcgtcagtgtgctcggggtgatccgctccattgccgaacagaccaacctgctggcgctcaacgcggccatcgaggcggcccgtgccggcgaggccggacgtggctttgcggtggtcgccgacgaagtgcgggcgctggccagccgcacccagcagagtacccaggaaatccagggcatgatcgatcgcctgcagcagggcaccaacgccgcggtcgacgccatgcgccgttccggcgaggccggcgagggcaccagcaaccaggccaaccaggccggcgattcgctggatgccatcgcccagctgatcgccaccatcaacgcgatgaacgcgcagatcgccagcgccgccgaggaacagaccgcggtggccgaggagatcaaccgcagcgtgcaccagatcgccggcgcggtggacagcgtcgccgacgaggcccagcagggcgcgcagaccgcccgcagcctggcgcaactgggccagggcctgggccgactggtcggtcagttccgcatctga

SEQ ID NO: 14478 - DNA, 615 bp, Pseudomonas aeruginosa
ctaatgctttgcttcccactgccagatggattggacatgctcgacacgaaactggaatcccggacttttctcctgttgctggcggtggtcacgctcgccttcggctggctcttgctgccgttctacggcgcggtgttctggggcaccatcctggcgatcatcttcgccccggtgcaacgccgcctgcaggtgcgcctgagggatcggaagaacctcgccgcgctgatcaccctgctgatctgcgtgctgatcgtgatcatcccggtgatcttcatcgccggttcgctggtgcaggaaggcgcgagcgtctaccagcgggtcaagtccggcgaactgaacttcgccgcctacctgcagcaggcggtggctgccttgccgccatcggtgcaccagtgggtgggagcgcttcgacctgggccaatctctcgagcctgcaggagaagctctcctcggtggcgatgcaggccagccaggtggtggcgaccaaggcgttcagcatcggccagaacaccctcgacttcgtcatcagcttcggcatcatgctctacctgctgttcttcctcctccgcgacggtcgcgtgctcggccggcggatcaagcaggcggtgccgctga

SEQ ID NO: 14479 - DNA, 528 bp, Pseudomonas aeruginosa
aggtcagccacggacgcaagcgtgccagcggccggatcagcccggcacgctcctgggcatcgatcaccggccccaccggcttgtaggcgcccggggcctcttcgatgcggcgctcctcacggagggtcacgcagtgccagggcagcgcgctgtcgcccgggcctttcagcgctcgtagcgcctgccggcggatgctgcggccggccccatggctgcaggaccatagccagtccgggtgtcccaggccgctggcgatgtacgagtaatcgcccatcgagccgggaatcagcagcagatcgccctggcgggccggcgtggcgcccttgcggtggagattcaggccctgttcctggagcaccacgttgtgcgggacgtccaccagcagggcgctgtcgtcgcgctggaaggtctcgcgcaagaccttgcgcaccagctccgccagcaccacccggttcagccaggcatagcgcgcaggggccacccatggcctggaggtattctccggccagctcgccgcccagcgcgtag

SEQ ID NO: 14480 - DNA, 531 bp, Pseudomonas aeruginosa
atgcgggtcttcttgccgtcatcggaactgtgtccccacagcgcgatgaggaagtacatcggcaccagcatcatttcccagaagaagaagaacaggaacaggtcgatggcgaggaacacgccgatcacaccgcccaggatccacagcaggttcagatggaagaagccgatgcggcgctggatctcgttccaggagcagaggaccgagagcacgccgagcaggccggtgagggcgaccatcagcagcgacaggccatccatcgccaggtggatgctgatgccgagacgctcgatccacagcaccttgaattgcagggtccattccggctcgccgccgggcgcgggcgccagctggaagtcgccggtggcccagatccaaaggctcaggatcaggaccagggtcatcgaaagcagcgcgatccagcggggcagggtcttgctgctgtgttcggcgatccagcagaggaaaccgccgatgaaggggatcaggattagccagggcagaatcatgacaggctcagtctctccgtga

SEQ ID NO: 14481 - DNA, 972 bp, Pseudomonas aeruginosa
gaggtagaaggttcatccgcgcatctcgctggcagcgtcgatatcgagggtgtggaagcggcgatacagttgcagcaggatcgccaggccgatgctcgcttcggcggccgcgaggctcagcaccaggatgaacatcacctggccgtcgggttggccccagcggctgccggcgaccacgaaggcgagggcggcggcgttcatcatcacttccaggctcatcagtacgaacaggatgttgcgtcgcaccatcaagccgaccagtccgagggcgaacaggacgctggcgagggccaggccgtgttccagtggtattgcgttcatagcgttacgttcccttggggcgggcgcagggcgcccgccgaacctttattgtttggcgtcttgacgacccaggtgataggcagcgaccagggccgcgagcaacagcatggaggccagttcgaccaccagcaggtacgggccgtagaggctgatgccgaccgccttggcgtctaccgtggtatggccgatgccggcaccgctcggggtgcgggcgaggaccaccagcagttccaccagcaggaccagggccagggccgaaggcccgacccagatgccgggcgtgagccacttgcgctcctgctcgaccacggccgggccgaggttgagcatcatcaccacgaagacgaacagaaccatgatggcgccagcgtagacgatgatctccagggcaccggcgaagggtgcgccgaggctgaagaaggtcatcgagatggccagcagggaaatgatcaggtagagcagggcatgcaccgggttgctgttggtgatgacccgcagcgtggccagtacggcgacgccggcagcgaaatagaaagcgaattccacgcgacgtctccttatggcagcaggcttttcacgttgatcggttcggcttcgttctgcgcggcgcctttcggcttgccggcgatcgccatccccgcaacgcggtag

SEQ ID NO: 14482 - DNA, 2781 bp, Pseudomonas aeruginosa
ccagagcgggagtcagccaactcattgtgcagcctcctgcagaccttccacggagcagccggcgatcgccgccgggatgccggcgaagccgaccggcaggccgatcaggccggcgccgagttgttcatcgatacgcagcggcaggcgcagggcctggcccttgagctggaagccgagggtcgcgccgtcgttgacgccgaggcggtccgcgtcttccttggacagggcgacgtaggtctccgggatgcgctgctggatcggcgcggcccgcgagctgttttcctcgctgccgaacaggtggtacagcggcactaccttccagctgtcggccttggcgctgaacggcaccggcacggcctggaaccagtcgaggccttcgcccttcggttcgatcaggcgcacgccggggtcgccggcgcgcaggtggccgccgacctcgtcctggaacttgttccaggcctgcggcgagttccagcccggcgaccaggcgaacgggatctgctgacggtcttcctggctgccggagtagccttccatggagaaggcgaacgccgagtcgatgtcctgcggggtgcgcggctcgtgcacgctgatattggcgcgcatggcggtgcgcccgctgtaccggtgcggttcgcgggccagcttgaggcccttgatgcggaacgaggcggccggtgcggcgtcgcggatgccggccaggatcggctttgcctcggccacggcttcggtgacgtggtccaactgggtccagtcgacgcgcttgccttgcagggtgctgtggatcgcatgcagccagcgccagccctcgcggaccatgttcctggcgtcgtagtaggtcgggtcgaacacctggaagaagcgctgggcgcggccttcctggctgaccagggtgccgtcgccttcggcgaagctggccgccggcagcaccaggtgcgccttggcggtggtggcggtctgctggtgatcggcgacgatcaccaccttggccgccgccagggccgcgtcgacacgggcggtgtcggtgcggcgatagagatcgttctccagcaccaccacggcgtcggcctgtccggaggtcagtcgctcgagcgcggcttccacggagtcgccgccgaagagcgccaggccgaggctgttggcttcgccgaccaccaggctgatggaaccgttcttctcgcgctgcttgagggccttggcgatgttcgccgcggcttcgatcaatgccttgttgcccagcgagttgccggacactaccagcggacgcttggccgccagcagggcatcggcgatgcgctgggcgaaggcctgggcctgcgggtcgaggtcggccacggacggggcgcttgggtcgatcgcgtgggccacggcgaagccgaggcgagcgagatcgtccggcgcggcgtgaacggtttcctcggccacgtcgtcgaggcgggtcgcgctgacgctggcgatgaacagcgggttctgcgcatgctgggcgatgttcttcaccgcggcgtcgagccacggctggaccttcatgtcggcagccatctcgacggccttgcccttcaccgactggcgcagggccagggcgatgcgggcggcggtctgggtcaggtcctcgccgaggacgaagaccgcgtcgtggtcctcgatgtcgcggatgctcggcaccggcagcgggccttcctgcatgacctgcaggatcaggcgcaggcggtcgagctcgccttcgttgatgccgctgtagaagttgccttcgccaaccagctcgcgcagggcgaagttgctttccaggctggcgcgcggcgaaccgatgccgaccaccttgcgctccttcagcagggcggcggcctggtcgagggcgccgtccaggctcagcttctgcttgctcagcaccagcagcggctggcgcggacggtcttcgcggttgacgtagccgtagccgaagcgaccgcggtcgcagaggaagtagtggttgaccgagccgttgtagcggttctcgatgcggcggatctcgccgtagcgctcgccggggctgatgttgcagccgctggagcagccgtggcagatgctcggggcgaactgcatgtcccacttgcggttgtagcgctcggagtgggtcttgtcggtgaacacgccggtggggcagacctcggtgaggttgccggagaactcgctttccagcacgccgtcctcgacccgtccgaagtagacgttgtcgtgggcgccgtagacgccgaggtcggtgccgccggcgtagtccttgtagtagcgcacgcagcggtagcaggcgatgcagcggttcatctcatgggcgatgaacgggccgagttcctggttctggtgggtgcgcttggtgaagcggtaccggcgctcgttgtggccggtcatcaccgtcatgtcctgcaggtggcagtgaccgccttcctcgcacaccgggcagtcgtgcgggtggttggtcatcagccattcgacgacgctggcgcggaactgcttggcctcttcgtcttcgatggagatccaggtgttgtcggtggcgggggtcatgcaggacatgacgaggcgaccacgcttgtcgttctcgtcggtgtactgcttcaccgcgcactggcggcaggcgccgacgctaccgagcgccgggtgccagcagaagtagggaatgtcgagaccgagggacagacaggcctgcaggaggttgtctgcaccatcgacttcgagcgtcttgccgtctacgtggatagtggccatggttcaagtcttcgttggcccgttgtcagcgggcgtggctaa

SEQ ID NO: 14483 - DNA, 576 bp, Pseudomonas aeruginosa
aaactcacggttccgtcgggcctgcggccgggccgcggcacgacgacgaaacatcgccggacggctggccgtccggctgcaaagcatcaggcgccgaccgttgccgggcgcggcgcggccgaaggctggcgggagatgcccgcctcgaattcggcacggaaatacttgagggcgctgcccagcggctcgacggctcccggcgcgtgggcgcagaaggtcttgcctgggccgaggaagttgaccagctgctcgagggtctcgaggtcgccgggctggccttcgccccgctccagggcacgcagcagcttcacgctccacggcaggccatcgcggcagggggtgcaccagccgcaggactcgcgggcgaagaactcttccatgttgcgcagcagggaaaccatgttgatgctgtcgtccaccgccatggccaggccggtgcccatccgggtgccgaccttggcgatgccgccggcgaacatctgcgcatccaggtgctccgggagcaggaagccggtaccggcgccgccgggctgccaggccttgagctggaagccgtcgcgcatgccgccggcgtag

SEQ ID NO: 14484 - DNA, 222 bp, Pseudomonas aeruginosa
tgtggcggcccaccggctggcggaatatctgactatagaaggtggcgacgccttcgacgtcgctggccgggatccccagcacctcgccgatcgccgggatggcgccgtccggcacccagccgcgctgtttctggacgatcttcagggcttcgatggacgccgcgcgcgggtcctcgtagtgatgcatttcatgctcgatggacgagcgctcggtttcgctga

SEQ ID NO: 14485 - DNA, 543 bp, Pseudomonas aeruginosa
aaggtgcgccccggtggggcattcagcggggcctttcggcggggcggttgcccagcagggggatcaggctggcggcgaaaatcagggcggcgccgagcagcgacgtgtggctgggcagttcgtcccagcgcagccaggcgatcaccccggcgaaaacgatggccatgtaggcgatcggtccgatcactcccggggaggccagggcataggcctgcgacatggtcagttggccgaggctggcgaacagtccggcgccgagcagcaggagcagttcctggccgttcagcggctgccaggcccaggccagcggcacggcggagaacagggtgccgaacagggcgaagtagaacacgatgcgataggctggctcgctgtcgctcatttcgcggatcgagacgaaggcgcaggcagccatcaggctggaggcgatgccgaccagggcgatcggcgccactaccgcgccgctgggcctggccaccagcagcacgccgaggaagccgaccagggtggcgaccatcatgcggcgggtcagcggctccttga

SEQ ID NO: 14486 - DNA, 249 bp, Pseudomonas aeruginosa
tcgaggaacgccttgaacttgatttcgcggttgcagaggatgtccgggttcggcgtacggccggccttgtactcggcaaggaagtgctcgaacacgttatcccagtattccgcggcgaagttcgccgtgtgcagcttgatgccgatccggtcgcagacggcctgggcgtcggccaggtcctcgcgggcggtacagtattcggtgccgtcgtcctcgtcccagttcttcatgaacaggccttcgacctga

SEQ ID NO: 14487 - DNA, 2268 bp, Pseudomonas aeruginosa
gcccagggtttctgcttcgtcagcgtgacgccatcaggccaggctgtcgatcgccgcgttgaaggtggcgctggggcgcatcaccttgctggtcagctccgggttggagcgatagtagccgccgatctcggccggcttgccctggaccgcattgagttcggcgacgatggtcgcttcctgctcggtcagggccttggccagcggtgcgaagtgcgctttcagctcagcgtcttcgtcctgggcggccagggcctgggcccagtacatcgccaggtagaagtggctgccgcggttgtcgatgtcgccgaccttgcgcgacggcgacttgttgttgtccagcagcttgccggtggcttcgtccagcgccttgccgagcagcttggccttggcgttgccggtcttgatcccggtttcctccagggacacggccagggccaggaactcgcccagggagtcccagcgcaggtagttctcttccaccagttgctggacgtgcttgggtgccgagccgccggcgccggtttcgtacatgccgccgcccgccatcagcggaacgatggagagcatcttggccgaggtgcccagttccatgatcgggaacaggtcggtcaggtagtcgcgcaggacgttgccggtcaccgagatggtgtccttgccgcggatcaggcgttccatgctgacgcgaatggcctcgttgtagcccatgatgctgatgtcgagaccggtcaggtcgtggtccttgaggtacagctcgaccttcttgcgcagttcgcggtcgtgggcgcgctccgggtccagccagaagatcgccggggtatcggactggcgtgcgcgggtgacggccagcttgacccagtcgcggatcggtgcgtccttggtctggcaggcgcgccagatgtcgccggtctccacgtcgtgctgcatcagcacgctgccgtcggccaggaccacgcgcatggtgccgtcggcggtcatttcgaaggtcttgtcgtgggagccgtattcctcggccttctgcgccatcaggccgacgttcggcacgctgcccatggtggtcgggtcgaaggcgccgttggtcttgcagaagttgatcatctcctggtagatgcgggcgtaggtgctttccggcattaccgccttggtgtctttctgcttgccgtccttgccccacatctggccggagttgcggatcatcgccggcatcgaggcgtcgacgatgacgtcgctcggaatgtgcaggttggtgatgcctttcacggagtcgaccatcgccatttccgggcggtggctgtacacctcgtggatgtcgtggaggatctcttcctgctgggaggcgggcagcgacttgatcttgtcgtagacgctggagataccgttgttcgggttcacgccgagctcttcgaagagttggccccacttgtcgaagacgtccttgtagtagacgctcaccgcatgtccgaagacgatcgggtgggaaatcttcatcatggtcgccttgacgtgcagggaccacatgacgccggtttccttgcagtcctgcagggtcttctcgaagaagtcgcgcagcttgccgcagctcatgaacatgctgtcgagcacttcgccttcctgcaggctcagttgcttcttgacctcgaccttgccgtccttgccgacgaattcgatgcgcacgtcaccggccttggccatggtgatggactgttcgctggagaagaagtcgccgccgcgcatgtagtcggcgtgggagcgcgaggccatgctccacttgcccatggagtgcgggtgcttgcgggcgtaggccttcactgcggcaggcgcgcgacggtcggaattgccttcgcgcaggaccgggttcacggcgctgccgaggatcttcgcgtagcgtgcgcgaacctctttctcttcgtcggtctgcgggtcttccgggaagtcgggaaccttgtagcccaggccctgcagctcggcgatcgcgcctttcagctggggcaccgaggcgctgatgttgggcagcttgatgatattggcgtcgggcgaggtggccagggccgccaggcgggcgaggtcgtcttcgatacgctggtcggcttcgaggcggtcggcgaagttggccaggatgcgtcctgcaagagagatgtcgctggtctcgacgtcgatgccggcggaagcggcaaaggccttgacgatggggaggagcgagtaggtggcgagcgcgggtgcttcgtcggtgaaggtgtaggtgatcttcgagcggatggacatctacggtaa

SEQ ID NO: 14488 - DNA, 519 bp, Pseudomonas aeruginosa
ccaggacacctggctgccccaggaaaccctggacgccgtacgcgactacgtggtttccatcaagggcccgctgaccaccccggtcggtggcggcatccgctccctgaacgtggccctgcgccagcaactcgatctctacgtctgccagcgcccggtacgctggttcgaaggcgtgcccagcccggtgaagaagcccggcgacgtggacatggtgatcttccgcgagaactccgaggacatctatgccggcgtcgagtggaaggccggttcgccggaagcggagaaggtcatcaagttcctcaccgaggaaatgggcgtcaagaagatccgcttcaccgagaactgcggcatcggcatcaagccggtttcccaggaaggcaccaagcgcctggtgcgcaaggccctgcaatacgccgtcgacaacgaccgcagttcggtgaccctggtgcacaagggcaacatcatgaagttcaccgagggtgccttcaaggattggggctacgaagtcgcgcgcgatga

SEQ ID NO: 14489 - DNA, 420 bp, Pseudomonas aeruginosa
attcggcgccgagctgctggacggcggtccgtggatgcagttcaagaatccgaagaccggcaagaacgtcgtggtcaaggacgtgatcgccgacgccatgttgcagcagatcctgctgcgccccgccgagtacgacgtgatcgccaccctgaacctgaacggcgactatctctccgacgccctggcggccgaggtcggtggcatcggcatcgcgcccggcgccaacctgtccgattcggtggccatgttcgaggcgacccacggcaccgcgccgaagtacgccggccaggacaaggtcaacccgggttcgctgatcctctccgcggagatgatgctgcgccacatgggttggaccgaggcggccgacctgatcatcaagggcaccaacggggcgatcgccgccaagaccgtgacctatga

SEQ ID NO: 14490 - DNA, 1782 bp, Pseudomonas aeruginosa
agtcgagcgggtggcgcagatccttgcccgccggcgcaagaacaacccgctgctggtaggcgaggcgggggtcggcaagacggccatcgccgagggcctggccaaacgcatcgtcgatggccaggtgccggacctgctggccgacagcgtggtctactccctcgacctgggtgccttgctcgcgggtaccaagtaccgcggcgacttcgagaagcgcttcaaggccttgctcaacgagttgcgcaagcgcccgcacgcggtgctgttcatcgacgagatccataccatcatcggcgccggtgcggcatccggcggggtaatggacgcctccaacctgctcaagccggttctgtcctcgggcgagatccgctgcatcggctcgaccaccttccaggagttccgcggcatcttcgagaaggaccgggccttggcgcggcgcttccagaaggtcgacgtgaccgagccgtcggtggaagacacctatggcatcctcaagggcctcaaggggcgcttcgagcagcatcaccacatcgagtacagcgacgaggcgctgcgcgccgcggccgagctggcggcgcgctacatcaacgaccggcacatgccggacaaggccatcgacgtcatcgacgaggcgggcgcctaccagcgcctgcagccggaagagaagcgcgtgaagcgcatcgaggtggcgcaggtcgaggatatcgtggcgaagatcgcgcggatcccgccgaaacacgtcaccacctccgacaaggagttgctgcgcaacctcgagcgcgacctcaagctgaccgtgttcggccaggacgacgccatcgagtcgctgtccacggcgatcaagctgtcccgggccgggctcaaggcgccggacaagccggtcggctcgttcctcttcgccggtcccaccggcgtgggcaagaccgaggtggcgcggcagttggcgaaggccttgggcgtggagctggtgcgcttcgacatgtccgagtacatggagcggcataccgtgtcgcggctgatcggtgcgcctccgggctacgtcggcttcgaccagggcggcctgctcaccgaggcgatcaccaagaccccgcactgcgtgttgctgctcgacgagatcgagaaggctcacccggaggtcttcaacctgctgctgcaggtgatggaccacggcaccctgaccgacaacaacgggcgcaaggcggacttccgcaacatcatcctgatcatgaccaccaacgccggcgcggaagtggcggcgcgcgcgtcgatcggcttcaaccagcaggatcacaccaccgatgcgatggaagtgatcaagaagagcttcaccccggagttccgcaaccgcctggataccatcatccagttcggccgcctgagcaccgagacgatcaagagcgtggtcgacaagttcctcaccgagctgcaggcgcagctggaggacaagcgcgtccagctcgaggtcagcgatgcggcgcgcggctggctggcggagaagggctacgacgtgcagatgggtgcgcgaccgatggcgcggcttatccaggacaagatcaagcggccgttggccgaggagatcctgttcggcgagctggccgagcatggcggcctggtgcatgtcgacctgaagggcgacgagctggccttcgagttcgagatcacggcggcggagcccgcctgatccgagcgcggcaacgaaaacgcccggcagatgccgggcgttttcttttgcaatcggcgagccgcagcggctcgtgtcgactcagcgggcgcggtaggtga

SEQ ID NO: 14491 - DNA, 1608 bp, Pseudomonas aeruginosa
gaggtgggccgtgaaaagcggcgtgcattgtgccagaaaatcgacaatagcgccacacggctatcaggtgagggcgacccagcgctggttgacgaacagttcgatgggccggtactgggtcttgtagttcatcttgcggcaattcttgatccagtagcccaggtagacggcctgcaggcccaggcgttcggtctcggcgatctgccagaggatcgcgtagcgtcccaggctgcgctgctcttcgtcgggatcgtagaaggtatagacggccgagagtccgttcggcagcacgtccgtcacggctatggccagcaggcggccatgcaggcggaactcgaagaagcagcagaagggcaggtcgcggaccaggaaggtggcgaactggtcgcggctgggcggatacatgtcgccgtcggcgtggcgttgctcgatgtagcgccgatagaggtcgtagtactcctcgttgaagctcggtcgcttgcggatcacctgcagttccgcattgcgcttgaggatgcgccgctgctggcggttcgggctgaagccggcgaccggtatgcgcgcggcgatgcaggcggtgcaatgctggcagtgcggacgatagagatggtcgccgctgcggcggaagccgacctccgacagcgaggcgtacagctgcgtgtccatgggctggctgggatcgaggaacagggtggttgcctgctcatcgggcaggtagctgcacgggtgcggttgcgtcgcgtagaacttcagtcgggcgagttcggtcatggtgaactccagcagggacccataagcaagtttatgccaggcacggaaactcgcctaaaaatccaggtcgccggtaggaggctggtcgcgatagcgttgcaggtagtcggcgaattccccccggctgatggcgcgggcgcccaggctgtgcaggtggcgggtcggcatctggcagtcgatgaggacgaagccggcgtcgcgcagatggcggaccagcgtgacgaagccgaccttggaagcgttgtcggcgcggctgaacatcgattcgccgaagaacagcctgcccatggccaggccgtagaggccgccgaccagttgtcgctcctgccagacttccacggagtgggcgatgccgcgcaggtgcagctcctggtaggccagttgcatcggcgtggtgatccaggtgccgtcggcgtagtcacgcggcgcggcacaagcctggatcaccgcccggaagtcacggttgaaagtgacttcgaagcgttgctggcgcaggcacttggccaggctgcgggaaacgtgcagttcgtcggggaacaggacggtgcgcgggtcgggcgaccaccagaggatcggctggccatcctggtaccaggggaagcagccgtggcgataggctgcgaccaggcgttgcggattgaggtcgccgccggccgcgagcagcccgttgggctcctgcagggccttgtcgaggggcggaaagtcgaagtcggtgcgggaaagccaggtcagcatggcggggtaggggagggcgggcctcccccgggtccgatcaatggtcgtcgaggtatttttcggcatccagcgcggccatgcagccggcgccggcggaagtga

SEQ ID NO: 14492 - DNA, 666 bp, Pseudomonas aeruginosa
cgccgctggcgtcgcccagcacctcgtccagggtggtgttccagtgcaggcgcacgttgccgttctcggccttgtcgaacagcttgtcctggaggatcttctccgagcgcagcttgtcgcgacggtggatcaggtggacttccttggcgatgttggccaggtacagcgcttcctcgacggcggtattgccgccgccgaccacgcagaccacctggttgcggtagaaaaaccgtcgcaggtggcgcaggcggaaacgcccttgcccatgaaggcttcttccgacgacatgcccaggtattgcgcggaggcaccggtggcaatgatcaatgcatcgcaggtataagtgccactatcgcccttcagtgtgaaggggcgctgttgcaactcggcggtgtggatgtggtcgtagacgatctcggtgtcgaaacgctcggcgtgctgctgcatgcgggtcatcagcgccgggccggtaaggccttcgacgtcgcccggccagttgtcgacttcggtggtggtggtcagctggccgcctggctggatgccggtgatcaccactggcttgagattggcgcgtgcggcgtacacggcggcggtatagccggccggaccggagcccaggatgatgaggcgcgaatgcttgacttcactcataaaaagactccataa

SEQ ID NO: 14493 - DNA, 393 bp, Pseudomonas aeruginosa
tcaaggccaacatcccgacccggatcgccttccaggtctccagcaagatcgactcgcgcaccatcctcgaccagggtggcgccgaacaacttctcggccacggcgacatgctctacctgccgccgggcacaggcctgccgattcgcgtgcacggcgccttcgtttccgacgacgaggtgcaccgggtggtcgaggcctggaagctgcgcggcgcgcccgactacatcgaggacatcctcgctggcgtcgacgaaggcggcagcggtggcggttccttcgatggcggcgacggctccggcgaaggcagcgaggacgacccgctctacgacgaggcggtacgtttcgtcaccgagagtcgccgggcatcgatctccgccgtgcaacgcaagctga

SEQ ID NO: 14494 - DNA, 636 bp, Pseudomonas aeruginosa
aggattccgatgcgactgatccgcacgttgttcgttgccgccctggccatgggcgcttcgctggcccatgccgacgacagcgccgctgtccagcgcctgaccggcctgctgaacaaggcccagaccctgaccgcgcgtttttcccaactgaccctggacggtagcggcacgcgcctgcaggaaaccgccggccaactgagcctgaagcggccgggactgttccgctggcataccgatgcgccgaacgagcaattgctcatttccaacggcgagaaggtctggctgtacgacccggacctggagcaggtgaccatccagaagctcgatcagcgcctgacccagacgccggcgctgctgctctccggcgacatctcgaagatcagcgaaagcttcgccatcacctacaaggaaggcggcaacgtagtcgatttcgtgctcaagccgaagaccaaggacaccctcttcgacaccttgcgtctgtcgttccgcagcggcaaggtgaacgacatgcagatgatcgatggcgtcggccagcgcaccaacatcctgttcttcgacgtgaagatgaacgaggcgctggatgccaagcaattcaccttcgacgttccgccgggcgtcgacgtgatccaggagtaa

SEQ ID NO: 14495 - DNA, 1335 bp, Pseudomonas aeruginosa
gcgcaagccgtggatctgttccgcagcgagcccgtcgcgcagcccctggcggcacggctgaggcccgcaaacctggacgagtatgtggggcaggaacacctgctggcccgcggcaagcccttgcgcgaggcgctggagcagggcgcgctgcactcgatgatcttctggggcccgccgggagtcggcaagactaccctggcgcggctgctggcgcaggtgtcggacgcccatttcgagaccatttccgcggtgctgtccggggtcaaggagatccgccaggcggtcgaggtggccaagcagcacgcggcgcaatacgggcgccggaccatcctgttcgtcgatgaggtgcaccgcttcaacaagagccagcaggatgccttcctgccctatgtggaagacggcacgctgatcttcattggcgcgaccaccgagaacccgtccttcgagttgaacaatgcgctgctctcgcgggctcgcgtgtatgtcctcaagagcctcgacgaagccgccctgcgcaagctggtgggccgcgcgctgaacgaggacaagggcctcggcaagcgcaagctgaggctgccggaggagagcttccaggttctcctggccgccgccgacggcgatgggcggcgcctgctgaacctgctggagaacgctgccgacctcgccgaggacggcagcgagatcagccccgagctgctgcagaatctgctcggcgatacccgccgacgtttcgacaagggcggcgaggcgttctacgaccagatcagcgcgctgcacaagtcggtgcgcggctccaatcccgacgcggcactttattggttcgcgcgtatgctcgacggcggctgcgatcccctgtacatcgcccggcgggtggtgcgcatggccagcgaggaggttggcaacgccgatcctcgcgccctcggcctatgcctgtcggcctgggacgtgcaggagcgcctgggcagccccgaaggcgagctggcggtggcccaggccatcgtctacctggcctgtgcgccgaagagcaatgcggtgtacagcgcgttcaacgcggcgatgcgcgacgtcgccgaaagcggctcgcgggaagtgccattgcacttgcgcaacgcgccgaccaaattgatgaagagcctcggctatggcgaggaataccgctacgcccacgacgagccggatgcctatgccgccggagaggattatttccccgaggatctggagccgcggcgttactatcaaccggtgccgaggggcctggaactgaagatccgcgacaagctggaacacctggccgagctggatcgcaccagtccccgccaacgcagaaaatcctga

SEQ ID NO: 14496 - DNA, 636 bp, Pseudomonas aeruginosa
tcgtcggcgaagtcgtgcaactgcgcgacaagctggcctggttcgaaggcgcccgcgaggacgcctgagccttcagccttctccccagatgcccttgccgggaagtcgttcccggcctggtgcgcgcgccaggtcgagacgcgggcccagcggtactatcccggtcgggttgatggtgcggtggctggcgtactagtgccccttgatatgttcgaagtccactgtctcgccgatgcccgggcgttggtacagctcgcgcaaccagccggagagattcgggtagtcttcgatgcgccgcaggttgcacttgaagtgtccgtggtacaccgcatcgaagcgcaccagggtggtgaacaggcggatatcggcctcggtcaggtattcgccggccaggtagcggcgttcgccgagcaagccttccaggtagtccagctcctcgaacaactggacgaaggcctcctcgtaggcgtcctggcgagtggcgaagccagcacggtacacgccgttgttgaccgccggatagatgcgtccgttgaggcgttcgatctcctcgcgcagcggctccgggtagaagtccagcgcgttggcgccgatggcgtcgaaggcgctgttgaagatgcggacgatatcggctga

SEQ ID NO: 14497 - DNA, 450 bp, Pseudomonas aeruginosa
ttcgttgttgacgatcttctgcgcctgcttgtcccacagcagcggcaccgtgacccggccgctgtagtgcgggtcgtcgcgggtgtttcgctggtgcagaaaggccaggccgtcgaggcgatcgccggtggagccgtgggcggggtcgaaggtccagccgttctcgcgcatcagccaactgaccaccgaaacatcgaccagcgactccagccccttcagcttgcgcacgatcagggtccgatgggcccaggggcaggccagcgagacatagagatggtagcgcccgccctcggcggggaacgccggctcgcccagccaatggcggcgctgggcgttttcgcgctggaagcggccgtctttctgtgtgtcataccactggtcgtgccagcggccatcgatcaactgtcccatgagcgggttcctccatacgtcgttggaggaacagtctag

SEQ ID NO: 14498 - DNA, 861 bp, Pseudomonas aeruginosa
agcgcagcgcgcggcgggcggcgggggagtggggagggtcgaatagggcgatggcgaatttcatgctgcgatacgcgaaggatttcttcgaatgataaaccaatgcctgtgttttgccggtccgcaaatgaaaaagcccgtcgcggggacgggcttttccggaggcgttttctatcagtcgtcgccgccggcgatgccgaagatctgcaacaggctgatgaacaggttgtagatcgacacgtacaggctgatggtggccatgatgtagttgcgttcgccgccgtggatgatcgcgctggtctggtagaggatcatcgccgaggagaacaggacgaagccggcgctgatcgccagttgcaggccactgatctggaagaacagcgataccagcacggcgcccagcaggacgaagaagccggcggtgatgaagccggacaggaagctcatgtccttgcgggtggtcagcacataggcggacaggccgaagaacaccagggcggtcatggcgaacgccgaagtgatgacgctgccgccgttgggcaggccgaggtacatgttgaggatcgggccgagcgtgtagcccatgaagccggtcagggcgaaagtgctgaccagaccccaggcgctgttgcgcagcttcacggtgaggaagaacaggccgtagaagccgatcagcaccacgaacacgttcggatagggcaggcgcatctgctgcgaaacgtaggccaccaggccgctgaaggccagggtgagtgccagcaggccgtaggtattgcgcagaacgccgctgacttcacgctgttccgcgacggcggagttcagctgatattgctgttcttgcatggtgtgggtactccttaa

SEQ ID NO: 14499 - DNA, 426 bp, Pseudomonas aeruginosa
ccggccagcgtccagccgatggtgccgttgcgtaatgccgccaccgggttggggatgccggcgttgagcagcgactgggtaccgatgatgctacgagtgcgcccggcacagttgactatcacccgggtgcgcgggtccggcgccagttcggcgacgcgcagcaccagttcggcgccgggcacgctgatgccgccggggatactcatggtctggtattcgtcgaaacgacgggcatccaggatcaccgcgtcggccctggcgtcgagcaaagcctgtacttcctccgcggccagcgatggcgtgtggcgctcggcctccaccagttcgccgaaggccttgctcggcacgttcacatcgctgaacagctcgccgccggcgttgcgccaaccggacaggccgccatcgagcaaggccacgtcgctgtag

SEQ ID NO: 14500 - DNA, 567 bp, Pseudomonas aeruginosa
tcagtggtggtaacgacgaggacctcgcgcgcgatggcgactacctcgaccatgaccgccgctacgcccgtaccgacgaatacctgcaagccctgcgtgctatctggaccgccacgggaccggtggatttcgacggcgagttctaccgcttccagggcgcctcgccagcggtgcgcccgcgccagtcgccgcacataccgatctatttcagtggctcctccgacgcagccatcgaggtcgccgccaggcacgccgacacctacatgctctggggcgagccgctggccgcggtcgacgggcatatccgccgagtgcgcgccgccgccaaggcccagggacgcgatccgcgcttctcggtgtcattccggccgatcgtcgcggataccgaggaggccgcctggaagcgtgccgccgaggtgctcgaacaggtccgcgagaaccgtgcgcgcctcggtctgccgctgcgcgaccaccagccgcagaacgtcggttcgcagcgcctgctggccgccgccgagcagggcgaggtgctcgacagccgtttgtggaccggcgtggcccggctga

SEQ ID NO: 14501 - DNA, 525 bp, Pseudomonas aeruginosa
tcggccatcgcctggcctcggagaccctcgcgccggtcggacctatcctcgacaagccttacatcgccgctttcgcacgcgcccacgaagaggccggcttcgatcgaatcctggtcggctactggtcggaccagccggatggattcctggtggccgccgccgctggcctggccacttcccggatcggtctgctgctggcgcaccgccccggtttcgtcgccccgaccctggccgcgcgcaagctggcgaccctcgaacacctcctcgacgggcgcctggcggtgcatatcgtcagcggcggcagcgacgccgaccagcgcaaggacggcgattatctcgaccacgaccagcgctatgcccgcagcgacgaattcatcgaactgctcaagcgcacctggaccagcaccgaacccttcgatttccacggcgcgtactaccgcgtggagcacgccttctcggccatccgtccgcagcagaaaccgcacattccggtgtatttcggcggctcctcggaagccgcgctga

SEQ ID NO: 14502 - DNA, 477 bp, Pseudomonas aeruginosa
aggtcgccggcaagcaggccgatgtgttcatgctctggggcgaacccctggcacaggccgccgaaaccatctccgctgtgcgcgaacaggcgcgctcgaatggtcgcgaagtggagttcagcctgtcgttccggcccatcctcgggcgcacggaggacgaggcctgggccaaggccgaggcgatacgcgcaagcgccggcgcgcgcctgggcgaggccggcttccccaagggcaagccgcagagcgtcggcgcccagcgtctgctcaaggcggtggagcagggcgagcgcctcgacgagcgcctttggaccggaatcgccaggctggtcggtggcgggcacaactccaccgccctggtcggtaccgcggaacaggtggccgacgccctgctcgcctactacgacctgggcgtgcgcaatatcctcattcgcggtttcgatcccctcgccgatgccgtggaatatggccgcgagctga

SEQ ID NO: 14503 - DNA, 1164 bp, Pseudomonas aeruginosa
cccgcgccaaagtcgccgagcgcgagcgccggcgcgccacggcctgatcccatggccgtcctgcagactccctcggcggcgttcgacgaatggctgccggaactgacccggcaactggcggaaagcgccgatgcccatgaccgcagcggagattttccccatgccaacctggccctgctgcgacaccacgggctgctcgccctggccttgccgcctgcgctcggcggtcccggcgccagcctcggcgagctgcgccgggtaatcggcgcggtggctcgcggcgaaccctccacggccctggtgctgtgcatgcagtacctgcatttgcggcgcctggccgataaccccgattggcccggcgcgctcaagcggcgcgtggcgcgcgaggtgctggagcagggggcgttgatcaatagcctgcgcgtggagcccgagctgggttcgccgtcacgcggcggtctgccgggtacgctggcgcggcgtgtcggcgacggctggcagctgtccgggcacaagctctacaccaccggcattcccggcctgacctggctggcggtatgggcgcgcagcgacgagccgatcccccgcgtgggtacctggctggtgcgccgcgacagcccaggcatccgtatcgtggagagctgggaccatctgggcatgcgcgccagcggcagccacgaggtgctcttcgaagaggtggcggtgcctctggaaaacgccatcggcctgcatccccacgaccagcctccggcgccggaccaggccgtgctgcgcgacttcgcccaggctagcgcggtgttgcttggcgctctctacgacggtatcgccgggagcgcccgcgagtggctcgtcggctggctgcgcgagcgcgtgccggccagtctcggcgcgccgttggcgagcctgccgaggatgcaggaggcgctcggcgagatcgacggcctgctcctgcagaaccgcctgctgctcgatgccgcgtgctgcggacagttgcccgccagcgactccgggctgctcaaggtcgcggtcatcgacaacgcgttggcggtggtcgaggaggccctggaactgagcggcaaccacggcctcagccggcacaatccgctacagcggcactaccgcgacgtgctttgcggacgtgtccacacgccacaggaaagatag

SEQ ID NO: 14504 - DNA, 1032 bp, Pseudomonas aeruginosa
cccaggatagccccggctccgtgcggagctgcctggagattgcccatgaaacgacccctgtgtgtgcttgccggcctgctggccgcgaccctgctggctggagccgccagcgccgccgacctcatcagcctgcgcctgggcgatgtgaagggcgaccgctacgccgccctgcgcgcgtccggcgagctcgacgacctgccgtacaagctggaaatgtcggcgttcccctccggtgcaccggtgctcgaggcgctcaacgccggggccctggacataggctttaccggcgacatcccgttcctcttcgtctacgctgccggcgcgccgctcaaggcggtgggcgcctggcacttcaacccggcgaccgtggcgctggtggtcggcaaggactcgccgatccgttcggtggccggcctcaagggcaagcgcattgccgtcaatcgcggcggctgggggcatttcctcgcccttggcgcgttgcgtcgcgccggcctcggaccgcaggacgtaagcttttccttccttggtccggtggacggccgcgccgccctggtgcgtggctcggtagacgcctgggtgccctgggagccctatacctccagcgccgtgctgctcgatcaggcgcgggtcatcgacaacggtgccgggatcatgaccggctactcctatgccctggccagcgacgctgcgatcgcccgcaagaaggccgcgatcagcgacctgctgacccgcctggcgcgtgcccaggcctgggccctgaggcacccggaggcgttcgccgaggccctggccaaggatctgaacatgccgcgcgaagtcactcggcgctgggttggcgaggcgcgcatcagtcctgtggtcttcggtccggaggttgccgccaccctgcagaccgccgccgatttcttccatgccgaaggcgtgctgccgaagtcgctggaggtcgccccggcgttcgacttcagcctgtccgccggtgccgccgaagtggcccgccagttgcccgccgacctccgcgtcggccagcgttga

SEQ ID NO: 14505 - DNA, 825 bp, Pseudomonas aeruginosa
tcccagaggagtagttgtgtggatatcgcattgcacggcggcgcctggcacgagtcactgggaaagttgctcgaagcgctggaccggccgttcttctggcggatcctggcgcagaccctcggccagttcgcccccgtcgacaactgggcggccctgatattcagcgattccagtcccttgattctttccttcatggaggaggagagagaagaagtcgagccggacccgctgatcagtcgatatataaccggactttatctgcaagatcctttctaccaggtatccaggaactgtcggcgcggcgggctttttcatcttgcggatatcgtctccgaagatttcgaaacgaccgaatattacaatacgtactttgcgcattatgtggtgacggacgaagttcaatataacgtcccgctggatggtgaaagaaccctatgcctgtcgttgggcagcgagagccgcttcggtgccgagcagatcgcgctgttcgagctgcttcgcccgtgggtcatcgcgctgatgaaaaaacgcatccacttcgaggatgcggtcagggaggaggcgaaaccgatcgcagcggcggaggtggaagtccagccctggagagggttgatatcgccgctgaccgcgcgggagtcagatgtcatccggctgatgctggatggatactcgaacaaggaaatagcggatcggctgacgctgtcgatcgccactatcaaggtgcatcgccggcacatctacgcgaagctgaacgtgaagtcccactccgagatattcgcgctgttgatcaacccgcccgcgccgcggctcgccgacgcacgctag

SEQ ID NO: 14506 - DNA, 477 bp, Pseudomonas aeruginosa
tcaacgtcatcctcaagtccgccgacagcggcgggtcggcggccgctgacgtcgggcagaccggcgacggcgacggcttcacccatggcggcggggggaacatcgggctggccttcggcgatagcggcttcgtcaacctcaccgccgaatatcgcgagcaggagcgcacgatgcgcagcggcatcgatgagcgcaccggtcggcgcgacaatatttccatgggcgatcccgcgttccaccggcaatcgttggcgctcaactcgggtttcgggttgggcgacgatatcgaggtgtacggcttcggcacctatacccggcgcaaggcctcctcggcggccaactatcgcctggcttcggtggcgccgacgctgtatccggacggcttcacgccgcgcccgaacagcgacgaggacgactatgcgttcctcgccggggtgcacggcgagcgtctgctggatgcctggcactgggacctga

SEQ ID NO: 14507 - DNA, 1428 bp, Pseudomonas aeruginosa
acgcggcgatctaccgtgaaaccggcaacagcccgagaagcttcgacctggcgcgctaccgcaacagccaatggaccagcaacctggacctggggcgagaattcgaactggatttcctcgctgctccgccgggcgttgtcgctggggtgcggaataccggcgggaaagctaccgcatcgacgcccgcgaaccggcgtcctactacagcggcggggcggaatccctggctggcctctcgccgctcagcgaggggcaatggtcgcggcacgcctgggcgtcctacctggacctgggtacctccctgaccccagcctgggaggtcgacgtggcggtgcgccacgagaaattcagcgacttcggcagcaccaccaacggcaagttcgccacccgttaccagttcgatccgcgggtggcgctgcgcgccagcgtaagcagcgggttccgcgcgccgtccctggtccaggagcactacaccggcctcagcgtcggcccgaccatcgcccttggcctgctggcggccaactcgccggcggcgaagatgctcggcgccgacgaactgcaaccggagaagtcgaccagcttcaaccttggcctggtactcagcccgtgggaaaacgtcgggctgaacatcgacgcctaccagatcagcatccgcgaccgcatcgtcgacagcgccacctattccggccaggaagccatcgatgccctggccgcggcggggatctcgttgccggccagtgccagtacggtcagtacccattacctggccaacggtgccgacacccgcacccgcggtgtcgacatcaccggtcactacctcgtcgcgcttggcgagtacgggcaggtcgactgggaactgtcggccaacttcaaccgcaccaccttgcgcaagaaccatcgaggcgccaacggcgagccgctgctcaatgcccagcaggtcgcctggatcaccagctccaccccgcgcagccaggtttccctcggcggcacctggagccgccaggactgggaggtcagcctgcgcctgacgcgctacggccggaccagctcggaactcgactacacggtagggccggacgcctggtcgacggagaaattcaaccatttcgtcaacgacccgaagtacatcaccgacatcgccgcgcgctaccggctcagcgccgacctgacgctgaccgccggcgccgacaacctgttcgacgtccgtccggacaagctgcccgcgcagaacaccacctatggcgacgtgctgcgctacgacacctatgcctcgcagatcggcttcaacggcgccttctactacctacgcgcggcataccgcttctagagggccaggcgtggcgcaacgagaattttccgcgaccagcggcggtgtgctgctggcgtcggtggtggcgatcatgctcgggcccaccggcatcctgctga

SEQ ID NO: 14508 - DNA, 591 bp, Pseudomonas aeruginosa
gcggatcgacggcgccccaggcctggcgcagcgccagtttctggctggtgctgggcaacccaggtactggcggtgttcgtgatgtccgggatcatgacccatggcgtgccgatgctggtggagcgcggtttgtcccggggcgaggcgggcaccgcgctgtcggcgttgtgggtcggcatgatgctgtcgcagccgctgatgggctggcttctcgaccgcgtggcgacgcctcgggtggcgttgcccttcgccctggcggcggtgctcggcatggcctggttcctggtgggcgacacaccgagcggtctatggctggcggtgttcctggtcggcctgggtggaggaggggaaagcggcaccaccaagtacctgttgatgcgctacttcggcctgcgcagcttcggtgtgatctacggttcgatccagccgttcaccttcgccctgtcgatcagtctcggcgcttacctgctgggctggctgtacgaccgcgccgaaggctacgggacggccgaatgggtgctgctcgcggctttttccctggctgcgtgcagcctgttcgcctttcgcccctatccgcagaaattgccctga

SEQ ID NO: 14509 - DNA, 1209 bp, Pseudomonas aeruginosa
ttgctactttcccggagtgtccgaggagtaccccagcacctgtcacgttttcggccgttgcctgcaattcagccccgtgcgcggcttttatctggacgcaagattcggtctgggtcggtcatcggctggtcgtcatcgaacatgaccagccgagccggtctgtcctgccgcctgccttccgggcctctatcgatcaaccgttgtggcgaccgcgagcggaaggcgcttggcggagggcccgtttcatcttgccttgcgtttcaaggaaaccggcaggccccaggtcaggtcttccatgcctgcttcgccgagtatctcggttttcatcggctggatccgcgcgagcacctggcggcccgtttcatccagccttggctgctcgcgatcgatgaaccttttcgtcagctccatgggcgcgggcctcatgaagacctggatatcctgcaaggcgcacttgatgttttgcgtgtccacggccttgcaggtcttcctgtcatagctcacggccggggtcttcaagtggaaccgatcgctgagcaggatctgcccaggctgaatggtgaaggacagcggggcataggcgtcgggtatctgcgcttgcagcttgatggaggggacatcctcgatcttcgtgccttcggcccaaccggcatccgagaccatttcccgctggctgtattgctgctcggtccagcccacgcattggccggaggccatgtgcacggcgctgcagacattctgtgtgtaggttttgtctgcataggaggcgtcgcgccagtagttctccttcacgaaccggcgatacagcacggcggacaggttcaccgaaccaagtgggctggcagccggctgcccctttggcgccttgatctgggcaagggtgctgtcgatcttgtagtcgatccctccggacagcaggtaggttcccggcgggacgatgttgacctcgaggaagtcccacagatagacggcttccttgatcttctccaggtcgttgttggcaaaggcctgcatgtaggcgatcccgggcacgtccttgttcttgaatatgacccgatgcgagtagctggagaggtccgtcacgctcttgttgggcatgagcgccggtaccagcaccacggacatgccttcgcgggtagcctcatcgatcatgttcaggagctggttggtgggattctgctgggagccgccgagtccggcgttgcctag

SEQ ID NO: 14510 - DNA, 717 bp, Pseudomonas aeruginosa
gtgcggatcaaatctgttttaccgccgtacgactttttccgttccctgcgcctatctaacctgccgctctcttcaacccgggatcggcaggcatctccgctgcggttccagcatgtacggaacaccatgaaaaacattctcctgctcaacggcggaaagcgtttcgcacattccgacggtcgcctcaaccagaccctgcacgaaaccgccctggcccatctggaccgccgtggcttcgacctgcgccagaccttcatcgacggtggctatgacatcccgacggaggtggacaagttcctctgggccgacgtggtgatctaccagatgcccggctggtggatgggcgccccgtggacggtgaagcgctacatcgacgaagtcttcacggccggtcatggcagcctctatgccaacgacggtcgtacccgctccgacagcacgcagaaatatggcagcggcggtctggtgcagggcaagcgctacatgatctcggcgacctggaatgcaccacggcaggcgttcgacgattcgagcgacttcttcgaagggaaaggcgtggatgcggtgtatttccccttccacaaggccaaccagttcctcggcatgtccggcctgccgacgttcctcgcggtggatgtgatgaagcgcccggacgtcccggctaccgtcgctgcctaccaggcgcacctggacagggtgttcgggcgcgccggctga

SEQ ID NO: 14511 - DNA, 966 bp, Pseudomonas aeruginosa
aatgagcgcgcttcgaccgtgtcgaagccacccccgacaacgttgccggcaggtcgctcatcgatttccgacgcctgccgccgaattcaggagattcacatgtgtccttgccctcactcccaggcccagggagaaacggacggagaggctgagtggcataacgccgccctggacttcacccatgcgatgagctacggcgattacctgaagctggacaaggttctggacgcccagttcccgctttcgcccgaccacaacgaaatgctgttcatcatccagcaccagacctcggagctatggatgaagctgatgctccacgaactgcgggccgcccgggagcacgtcaagtcaggcaagctcggtccggcgctgaaaatgctcgccagggtttcgcggatcttcgaccaactggtacacgcctgggcggtgctggccaccatgacgccgaccgagtacaacaccatccgcccgtacctgggccagtcttccggtttccagtcctaccagtaccgcgagatcgaattcatcctcggcaacaagaacgccaccctgctcaagccccatgctcaccgtgccgagctgctggcggccctggagcaggccctgcatacgccgtcgctatacgacgaagcgatccgcctgatggccgcccaggggttgccggtaagccaggagcggctcgcccgggacgcggcggccggcacctgttacgaggcctcggtggaggcggcgtggcgacaggtctaccaggcgccggaacgctactgggacctgtatcagctggcggagaaactgatcgacctggaggactcgttccgccagtggcgcttccgtcacgtgaccacggtggagcgcatcatcggtttcaaacccggcacgggcggaaccgagggagtggggtatctgcgcagcatgctcgataccatcctcttccccgaactgtggcggctccgttccaacctgtag

SEQ ID NO: 14512 - DNA, 594 bp, Pseudomonas aeruginosa
cctggtcatcccggcaagcgctccagagcaggcgcagcggcggtcgccggcggctttccgcgaggtcttcatgcatctgctcgaggctcagcggatgccgcagggcggggccggcccattgcaccagctccttttccgtggcgaaccagcgttgcaggattgggaagtgttccagctggaacgggacgagttgcaattccgggacggaacccgtgccgggtgtgggcatgcggagtgcctcgctcaggtcatcggggggagccggcgtttaaccggggacttcttgacgatggcggtgttggtttccgcgtagccgttgatcctgtccagcagcgtgtcgagctgttccatcgaacgaacctggaggcgggcgatgaagcagtcgtcaccggtgaccttgtcgcactcggtgaactcggcgatgtcctggatctgtcgctcgacctcgtgcagcctgccgggcagggggcggatgcgcacgatcgcctggaactggtagccgaaacagcgggggtcgacatccagggtgtagccgcggatcacgccgcgttcttccagcttgcgcaggcgttcggcgacgctcggggccgatag

SEQ ID NO: 14513 - DNA, 966 bp, Pseudomonas aeruginosa
gtaatgcgatggagggctggaagacgactttggataatcataggcctgtcttgcgggagagcgcccatgaacgatccgatccgtcgcggtacgctggaaatgacttcggccatgctgatctgcggcaccattggctggctggtgctgctctccgggcagcccgtgctggacgtggtgttctggcgctgcgtattcggtttcgccacgctgctggtcgcctgtgccgcgctgggcttcctgcgccgcggcagcctggggcgcgaggcgttcctgctggcgctcctcagcggggtgttcatcgtcggcaactgggtgttgctgttcgcatcctactcacgggcttcgatcgccatcggtaccgcggtctacaacgtccagccgttcatgctggtggggctaggcgcggcgtttctcggcgagaaggtcacggcgcgcaagctgggctggctggggctttcgttcgccggcatgctggcgatcgtcagcgcccacggcgacagcgacgccccgcgcggggactacctgttcggtatcctcctggcgctcgctgccgcgctgctgtatgcctttgccgcgctgatcgtgaagcgcctgcaaggcacgccgccgcatcttatcgccttgatccaggtgggcaccggcgtgctgatgctcgcaccgctggcgaaccttgccgaactgccccgggacgttgctccctgggccagcctggcgaccctgggaatcgtccataccgggctgatgtacgtactgctctacggcgccattcagaaattgccgacggcgctgaccggtgccttgtccttcatctatccggtcgcggcgatcctggtggactggctggtcttcgaacatcgcctgagcctggcccagtggcttggcgtggctgccatcctgctcgccgcggcgggcatgcagcagggttggagcgtgcgcctgccgaggccggcggtgcgtcgcggctga

SEQ ID NO: 14514 - DNA, 1191 bp, Pseudomonas aeruginosa
tggttcgattgtaggattgtcggacaaaaactggagcgcacgatgtttgaaaatttctctcccagcaccatgctggccatcaagaagtacgcctattggctctggctgctgctggcgttgtccatgccgttcaactactggatggcccaggacagcgcacatccggccttctgggcattttccctggtgattgcggtattcggcatcgggccgctgctggacatgctgttcggccgcgacccggccaaccccgacgaggaaacgcagacgccgcagttgctcggccagggctattacgtattgctgaccctggccacggtgccggtgctcatcggtacgctggtgtgggccgctggcgtgttcgtcgctttccaggagtggggctggctcggccggttgggctggatcctctcgatgggcacggtgatgggagcggtggggatcgtcgtcgcccatgagctgatccacaaggactcggcgctggagcaggctgccggcggcattctgctggccgccgtgtgctacgcggggttcaaggtcgagcatgtgcgcggccaccatgtgcatgtgtctacgccggaggacgcttcgtcggcgcgtttcggccagtcggtctaccagttcctgccgcatgcctacaagtacaacttcctcaacgcctggcgccttgaagcggtgcggctgcgcaagaagggcctgccggtgttcggctggcagaacgaactgatctggtggtacctgctgagcctggcgttgctggtcggtttcggttgggcgttcggctggctggggatggttttcttccttggccaagcgttcgtcgcggtgacactgctggagatcatcaactacgtcgagcactacggcctgcatcggcgaaagggcgaggacgggcgctacgagcggaccaaccatacccactcctggaacagcaacttcgtcttcaccaacctggtcctgttccatctgcaacggcattccgaccatcatgccttcgccaaacgcccctatcaggtcctccgtcattatgacgatagcccgcagatgcccagcggttatgccgggatggtggtgctggcgctgatcccgccgctgtggcgggcggtcatggaccccaaggtgcgggcctactatgcgggcgaagagttccagttgacggccgaacagagcgagcggccggcagcttcctga

SEQ ID NO: 14515 - DNA, 1638 bp, Pseudomonas aeruginosa
cgatatctcggcacggaaaggagcccagggatgaacattcggcagagaatcctcgcttcgggcgccatcggcatcgtggctgtggtgctgctaggcggggtcggcttctgggggcaattgcggttgggcaaggcgctgtcggagaacgagctgagcgtcaatgcgctgcgcaaccacatggaaggcgacatgatgcacgacgccttgcgcgccgacgtcctggcggcgttcgtggtccagcccggcgacggcgcggcggccgagcaggtccgccaggacctgcaggagcacagccagtggtttcgcaaggtggtcgagcagaaccaggggctgcctctcaacgacgccatccaccaggcgctggtcgagttgcggcccgacctggaagcctacatcggcgccgccgagagcatcgtcggcaaggcgttgctcgatcccgtggcggcacgggccgagctgccgcagttcgtccaggccttcaaggagctggaagggcgcaacgaagcgctcagcagcctgatcgagaaacacgtcgagcagaccaaccgggcgcgcgaagacagcatgcgctattccgcctggatgctcgcgggcggcatcctggtcgcctgcctggtcctcgggcagctttgtcgccagttgctgcgcgccgtcctcaagcctctgcgcaagctggtcgcctcggcccgggtgatcgcccagggcaacctgcaggagccgatcggtgtcgacagcgacgatgaggccggacagttgcagcgggccttgggcgagatgcaggagaacctgcggcagatgatcaccatcatccgccaggaaagcgaagagctccatgacacctcccaatccatcggccagacctcgcagtcgatcgtcgacggtgccagccaacaggccgacagcgccaccagcatggccgcgagcatggaagagatgatcaccaatatctcgcagatttccgaccacgccgacaacgccagggtgatctcggccaagtccgaggagctggccagcagtggcgggcaggtgatcctcaacgtggtggaagggatgagccgcatcgccgacgtggtcaaccagtcctccaccagcatcaccgctctcggccagtcgtcggacgagatccattcgatcatccaggtgatcaaggggatcgccgagcagaccaacctgctggcgttgaacgccgccatcgaggcggcgcgggccggagaggccgggcgcggtttcgccgtggtcgccgacgaggtacgcgggctggcggcgcggaccacccagtcgacccaggagatcaccgcgatgatcgagcgcatccgcgccagcacggggcaagcgatcaacagcatggaggccggcgtgagccgggtcaacgagggggtgtcgttcgcccgccaggcaggggtgtcgatcaacgagatcctcgatggaacccgtcatgccgcgtcggtggtcgatgagatttcccagaccatccgcgagcagtcgcgcgccagtgatgaaatcgcccagcgcgtggagctcatcgcccagcgttcgcagcagaacacccaggcgatgcacgagatggccgccaccgccaggcgcctgaacgaggttgcagcgaccatgcgctcgtcggtggagcgcttcaagatctga

SEQ ID NO: 14516 - DNA, 1458 bp, Pseudomonas aeruginosa
atacttcaggcaagcatagtccgagtctggcctggacgagggcgcatgcacgcggcggctgggcgagcggaggtgcggatcatggagacgttacccatcaggaaccggcgcttgctggtgatcgatgagcggcaggcggatcgagaccgtgtatgcgggttgttgcagggaaccctaggggccgaatcgcctcccgtggcgcctgagcggggctaccaggtggatacggcgggaagcgccgaggaggcattggggcggatacgctcggccctccaggccgatgcgccgtatgccgtggtcttcctcgggatgccgtcggtaggcgcggatattcccgttctcgagcggttctggcgtctcgactcccgcttgcaggtcgtggtgcatgcgcctcccgccgattttccgctattggcgccgtgggctgcggaagagcgcctgctgctcctcggcctgcctttgcagggacaggaggtccgccagatggccggcaatctcagcgccaagtggaacgtgacggctcacctccagttgcagatgagccggatggaggctgccatccaggagatcacccgggaagtcggccaggccaaggaggcgctggagaaagagatcggcgagcgcaaggaactggaaagccaactggtgcagacggagaagcttgcctcgatcggccacctggccgccggcgtcgcccatgagatcaataaccccatcagctacgtttcctccaactacaccaccctggaggagcacgtcaggcgtttgctggaggtacttgaagcctatgaagaggctcgccccgcgatccgcgacgaggcgctggcaagacgcctggagcagctcggtgagcgggtcgaactggccttcgtcaaggaggatgtcgccgtgttgctgcgcgaatccagggaaggtatagggcgggtgcgcaagatcgtccaggacctgaagaacttctcccgcgtcgacgccgaggacgactggcagtggaccgatctgcaccaggggatcgagtcgaccctcaatatcgtcgccagcgaactgaagtaccgggccgacgtggtccgcgaatacggcgatctacccgaggtgaagtgtctgccgtcgcagatcaaccaggtggtgatgaacctggtgatgaacgcggcccaggcgatggggccggagcggggtcgcatcgtgattcgcacggggcataccgtggagcatgcctggattgaagtggaagactcggggcagggtatctcccccgagatcctgccgcgcatcttcgatccgttcttcaccaccaagccggtaggcaaggggaccggcctggggttgtcgctctcctacggcatcgtccagaaacacggcggcaccatcgaggtacgcagccagccgggagtcggcagcgctttccggatcgtgcttcccctggaatcacccggcaacctgggcggagcccacggaaattaa

SEQ ID NO: 14517 - DNA, 357 bp, Pseudomonas aeruginosa
acagtaccgaagccgatgccctgccgactttccctggttgtatttcccgctctcttctccattgccgctggcgccgcggaggaactcaaggacatggcaggttcgaccatcgtcgttgccggaagactcgaggccgtcgaatgccctggcgcaggcctgtacgattgcacggggtggcctgccaacctgtaccgtttcgagggacaggacgtgtgcctcagcatcgaggctggctgcgattacagttgcgatggcattctcagcgagaagggcggcacgcaatcgatcctggtttccggctcctatcgcgatcacatccgcaaggtggaaggcacgcaggtctcctgcccgcgctag

SEQ ID NO: 14518 - DNA, 270 bp, Pseudomonas aeruginosa
acggactcttcctatatcggccagcatcaccgctcgctaaaacggtcgcacatgcttccaccgagaaaagacatgtccgacacgctctccttcgcctcgcgcctctgcaagttcgtcatcctgctgatcggcggcgccagcctcttcctgtggtggctggggcgaccttaccaggacgccatgtccgccttcgtcccgttgctcatgccgatgctgtttctggtgctggcgttcgacacctttcgcgccttctcccgccccgggcgctag

SEQ ID NO: 14519 - DNA, 552 bp, Pseudomonas aeruginosa
gctatcgagggatcgtcctcgcatggagagaacatcatcatgttcaacactcgttctgtgctcgcgctggtcgtgagcctgtccctgatcggcggtacgcctgccgtcctggccgacccgggcaatggcaagggcaacccgcatggcaaccagatggacggcggaaagggtaacaagggcaacaaaggcaaccagggtggccacgacaaccatggcggccccggcaacaagggcggcggcgccggccagaagggcaacggcggtggcaactgggactcgggaccgcgtatcgacgtcggcggggtacgggtgatcctcggcgacaaccgcggctactggaacccggggccggccctgccgcccggcatccagaagaacctggcgcgcggcaagccgctgccgcccggcatcgccaagaaactcgacgaccgcctgctaggccggctgccgcactacgacggctacgagtggatgcaggccggcaccgacctgctgctggtggcggtggcgaccgggctgatctacgaggtgctggacaacgtcctcgactga

SEQ ID NO: 14520 - DNA, 1629 bp, Pseudomonas aeruginosa
ccccccgttggagcggcggataatcgcgttgcggttgtccgccttacctcatggaagtcgttttcttaccccaggtcaggcccgcaggcgttgcagggcatcgcccagttgcgcggagaggccgtggagatcgcggctggcggcttcggtctgctccacctgttcctggttgctggaggcgatcgaggcgatttccgtgaggttgcgggaaatgtcctcggccacggcggtctgttcctcggcggcggtagcgatctggcggttcatgtcgcggatcgattcgaccgaggcggtgatctggcgcagcatggcgccggcgttggcaacctgctcggcaccggcctcgctgcgcgactgcccgctttcgatggcgcgcgcggcattcaccgcgccgttctgcacggtatcgatgatctggtggatctcggcgatggactcggcggtgcgctgcgccagggtgcggacctcgtcggcgaccaccgcgaagccacggccggcatcgccggcgcgggcggcttcgatggccgcgttgagagcgagcaggttggtctgctcggcgatgccacggatcacgtcgaggaccttgccgatcctgccgctatcgctttccaattggcggatgacctccaccgtatggtcgatctccttgcgcatctcgccgatgctgcgaatcgtttcttccatcacgtcttcgccgcgctgggcggaatcgtccgcctcgtcggcggccctggccgcgtcgccggcgtagcgcgccacttcctgggcggtggcggacatttcctgcatcgccgtggcgacctggtcggtgcggctgaactgctcgcgggtaccggccgccatcaggctggcgatcgcgttcagcgagccgctggcgctgtccaggtcgcgggtactgcgccgcagccggtcgaagatgtccaccaggaagtcgcgcagggtgttggcggccagggccagcttgccgagttcgtccttgcgccggatctcgatgcgctcgccgaagtcgccatggctgagctgggcgatgtgctcgatcaggcgttgcaccggacggaccaggttgcggttgaccagccacaggctgagcagggcgacggccaggctggcgccgatcagcaccaggctgccgagcagcatggtgcgccgggcctccgcgctgatggaggaggaatggagatcactggcctggtgcagttcgtcgcgcagggcctgcatctgcgcggtggtggcacggtcgatgccggtcaccgcctggtcgccggcgatggggtcggcgcccgcctcgaggaaccgttgcctgccttgtcggtaagccgtaccgagtcgccggtgctcttcgcgcaggcgctcgacacgatccttcaactcgccttcggccacgctgcccaggcgcccgaggatgtcctgcaccgctcgctcctgggcttcgaactggctccagtatttcgtctgggcctctgcctggcgtccgcgcagcaggacgttcttccattcctggacctggccgcggaattgcaggttggcctcgtcgatcagttgcgccgcccgcacggggccgccgagcagctcgcggtaggcgcgtacgtcgccggtcagcgagccgaagcaggccagggctatgagtag

SEQ ID NO: 14521 - DNA, 291 bp, Pseudomonas aeruginosa
ctcatggatgtccctcccaccgttcaggatgaacaggccgtttcccgccagttgcactcgttgagtgtgcgcaatctcgctcacctggccgctgccctgacccagctcggcttcgagctgtcgcgcagctccgaccctggcacccgccaggcggccaatgccttcatcggccagttggccaatatcaaccaggacattgatcgacagatcgagctgctcagcgcgctggacgccgacaacgtggggtttcgcctgctggacgaggtgcaatacccggatgcgcccgaatga

SEQ ID NO: 14522 - DNA, 1584 bp, Pseudomonas aeruginosa
cgccctggcggcgcaggacgacggttcagcgacattcccagaacaaccacaacaagggaaagccatgaatcagccgagctatacctcgggtcgccaggatgtcgccttgctggcgaccaccgtcggcgacgccttcgatgccaccgtcgcgcgtcatgccgagcgcgaggcgctggtggtgcggcatcaacgcctgcgctacagctggcggcaactggcggagcgggtcgatgcctacgcccgcgccttcatcgccctgggcctgcgccccggcgaacgcctggggatttgggcgccgaactgcgccgaatggtgcattacccagttcgccagcgccaaggtcggtgcggtcctggtgaacatcaacccggcataccgcagcagcgagctggaatacgctctcaagcagtccggttgcagttggctgatctgcgccgacgccttcaagaccagcgactaccacgcgatgctcggcgacctgctgccggagctggcgcgggcgcgtccgggcgaactggccagcgagcgcctgccggaactgcgcggcgtgatcagcctggccgagcgggcgccggcgggcttcctgcactggcagggcctgccggggctggccgccgcggtaggcgccgaggaactgcgccagcgccaggcctcgctgcagttcgacgagccgatcaacatccagtacacctccggtaccaccggcttccccaagggcgccaccctcagccactacaacatcctcaacaacggctacatggtcggcgaaagcctcggactcggcgcggaagaccgcctggtgatcccggtgccgctgtatcactgcttcggcatggtgatgggcaacctcggctgcgtcacccacggctcgaccatgatctacccggcgcccagcttcgacgccgaggcgaccctgctggccgtggccgaggagcgcgccaccgcgctgtacggggtaccgaccatgttcatcgccgagctggatcatccgcgccgccgcgaattcgacctttccagcctgcgcaccggaatcatggccggcgccacctgcccgatcgaggtgatgcggcgggtcattggcgacatgcacatggccgaggtgcagatcgcctacggcatgaccgagaccagtccggtgtcgctgcagaccggtccggacgatggcctggagctgcgcgtgaccactgtcggacgcacccagccgaggctggagagcaagatcgtcgaccagacgggcagggtggtgccgcgcggcgagatcggcgagctgtgcacccgcggctacagcgtgatgctcggctactggaacgacccccaggccaccgccgaggccatcgacccggcgcgctggatgcacaccggcgacctggcggtgatggacgacgacggctacgtgcggatcgtcgggcgcagcaaggacatgatcatccgcggcggcgagaacatctatccgcgcgaactggaggagttcttcttcactcacccggcggtggccgacgtgcaggtgatcggcatccccgacgagcgctatggcgaggaaatcgtcgcctggatcaagctgcatccgggccaccacgccgatga

SEQ ID NO: 14523 - DNA, 1122 bp, Pseudomonas aeruginosa
ggtggcgggcggcgcgcagcgaggcgagaggggcgggtgaagaacgacggcgagactcaggcgagtaccaagggcaccatctcggtgcgcctggtcggcgaagcgctggtggagtggcgccggcagggcggcgagcagggggaggtcctccaggccgccggtatcgatccgcagctgctcggcaaaccctacgcgcgggtcacctcgcacgcctattcgcggctctggctggatctcgctcggcgcatggacgacgagttcttcggcatggactcgcggcgcctgaagagtggcagcttcgctttcatgagccgctgcgcgatccacgagcagaccctggagccggcgctgaccggcatcctgcgattcctctgcctgcagttcgacgacttccagccgcgcctgcagcgccgcggcggcctggcggaaatcgtcctcgacgaggcgccgggccggtacgggcgagcgctgtcctacttcaccctatggatgatcacccatggcctggcctgctggctggtcggccggcgcatcccgatcctggccatcgacctgcgctgtccgcagccggactacatcgaggactaccgggtgatgttcagcgacaacctgcgtttctcccgtcccctcagccgcctgctgttcaatgccgactgcctggccttgccggtccgccgcgacaagcgggagctgcggcgcttcctgctcggcgcgccggccaacatcctggtccgctatcgcgatccgcagagcctggcggcgcggatcaaggcctacctgcgcagcctgcggccgggacgctggccggacgcggacgcgctcgccgggcatttcttcatggcgccctcgaccctgcgccgcaagctgtccctggaagggcagagctaccaggcgctgaaggaccaggtccgccgcgacctggccatcgcgcggctggacgccggcgcggcgaatttcgccgaactggcgctggagctgggcttcgccgatggcagcgcgttccacaaggcgttcaagaagtggaccggctcgacccccgggcagtaccggacgcaggtcgcggcggaaaccgcgtcggccgagtcgtcaggcgtcttgtccgaaacgctcggccatcgatag

SEQ ID NO: 14524 - DNA, 741 bp, Pseudomonas aeruginosa
agcctttcgacattgccccgcgtcggccacggcgtgaagattccggctactccatacaaaaacaagccgaggagtcctgcaatgcgcgactacgccaccactgccgccgggttcgacttgcagcggaccgccgccgccacgctttccggtacgctccaggcgctcaacgcctgcgtcgaatgctgcgaccggcatgccctgccgggacggatcgcgttgttctgggagggcaaggatggcagtcgcgccagctataccttcagcgagctgaaagcgctctccggacgtttcgccaatttcctccaggcccagggcgtacgcccgggcgactgcgtcgccggcctgttgccgcgcacgcccgagctgctggtcaccatcctcggcgcctggcgcctgggcgcggtgtaccagccgctgttcaccgccttcggcccgaaggccatcgaacaccggcgtggcgaccgccggcagcaaggtgctggtcaccgatgcggccaaccgcgacaagctcgacgaactcgccgatccgcctctggccgtcaccgtcggcggaccgaaggggcagggcatccgtcgcggcgatttcagcttctgggccgagctggagtgctatccggccgaattcgaaccggttccgcgcagcggcgaggatccgttcctgatgatgttcacctccggcaccaccggcctggccaaaccggtgccggtgccgctttaggagatccccgccttcgtcggtga

SEQ ID NO: 14525 - DNA, 1050 bp, Pseudomonas aeruginosa
tcggcaagcccgacccggagcgcaccgaactggtcaaggccttcgtcgtgctctgcgccggccaccggccgacgccggaactggcggacgcattgcagcgatacgtgcgccagcgcctgtcggcgcacgcctacccgcgggagatcgagttcctcgaggaactgccgaagactcccagcggcaagatccagcgctttctcctgcgcaaccaggagatcgcccggcaacgcgaggcggccccacgggcggccgccgcgaactgattcagcaggagaaaacgacgtgcgtatcgaaaatcgagtgttcctggttaccggcggcagctccggcctcggcgccgccaccgcgaagatgctggtggagcagggtggcaaggtggtgctggccgacatcaacgccgaggccggcgcggccaatgccgccgagcttggcgcccaggcgcgcttcgtcagggccgacatcgccagcgaggccgacggccgccaggccgtggccgctgcactggaggccttcggcggcctccatggcctggccaattgcgcgggcgtggcgccggccgagaaggtcctcggacgcaatggcatccatgccctggagagtttccgccgggtcatcgacatcaacctggtgggcagtttcaacatgctgcgcctggccgccgaggccatgtcccagggccagccggacgagggcggcgagcgcggggtgatcgtcaataccgcctcggtggcggcgttcgacgggcagatcggccaggccgcctattccgcctcgaagagcggggtggtcggcatgaccctgcccatcgcccgcgagctggcgcgcttcggcatccgggtgatgaccatcgccccgggcatcttcgagacaccgatgatggccggcatgccccaggaggtgcgcgactccctcggcgccagcgtgccgttcccgccgcgcctggggcgtccggacgaatacgccgcgctggtccggcagatcatcgagaacagcatgctcaacggcgaagtgattcgcctcgacggcgccatccgcatggccgcccgctaa

SEQ ID NO: 14526 - DNA, 1260 bp, Pseudomonas aeruginosa
ccctgctcaacgccctgcagcagtacgacctggaacgcggcgtggcggcggtctgcatcggcggcggcgaggcgaccgcgatcgccgtcgagcgcttgcgctgatgcaggcagtgaagaagaggaacccgcgatgattccctgcgaagaagagatccagatccgtgacatggcgcggcagttcgcccaggaacggctgaaaccgttcgccgccgactgggaccgcgagcaccgtttcccggccgaggcaatccgcgagatggccgacctcggcttcctcggcatgctggtgcccgaggaatggggcggcgcgcagaccgggcacctggcctacgccatggccctcgaggagatcgccgctggcgacggcgcctgctcgaccatcatgagcgtgcacaactcggtcggctgcatgccgatccacaagttcggcagcgccgagcagaaggagcgcttcctccgtccgctggcccagggttcgatgctcggcgccttcgccctgaccgagccgcaggccggttccgacgcgagcttcctgaagacccgcgcccgccgcgacggtgaccactacgtgctgaacggtgccaagcagttcatcacttcgggcagccacgcggggatggtgatcgtcttcgcggtcaccgatccggatgccggaaagcgcggcatcagcgcgttcatcgtgcccaccgacacgcccggctacgaggtggtgcggatcgaggacaagctcggccagcacgcctcggacacctgccagctggccttcaacgacctgcgtatcccggccacgctgcgcctgggcgaggagggcgagggctaccgcatcgccctggccaacctcgaaggcggccgcatcggcatcgccgcccaggcggtcggcatggcgcgcgcggcgttcgaggcggcgcgcgactacgcccatgagcgggaaaccttcggcaagccgatcatcgagcaccaggcggtggccttccgcctggccgacatggccacccgcatcgccgtggcgcggcagatggtccaccacgccgccagcctgcgcgaagccggcctgccgtgcctgaccgaagcctcgatggccaagctgttcgcctcggagatggccgaggaagtttgctccgcggcgatccagaccctcggtggctatggctacctcaaggacttcccggtggaacgcatctatcgggacgtgcgggtctgccagatctacgagggcaccagcgacgtgcagcgcctggtgatcgcgcgcagcctgtag

SEQ ID NO: 14527 - DNA, 432 bp, Pseudomonas aeruginosa
atgaccatgcaacccttcgtcgtcgaacgtctcgatcacatcgtcctgcgggtccgcgacctggaacgcagcatcgcgttctatcgcgatgtcctcggttgcgtggtggtgaagtggcgcgacgacctggagctggcccatctgcgcctgggcacgtcgatgctcgatctggtcgcggtgtccggggcgctcggccgggagggcggtgcggctccgggtggggaagggcgcaacgtcgaccatttctgcgtgcgcatcgagccgttcgacgaggccgcgctggtcgcccatctcgaggggttcggcctggtcccgcaggttcccgcggaaatccgcttcggcgccgagggcgacggctggtcgctgtactttttcgacccggatggcaatcgagtggagctgaaggggccgcgggtggacaatcctgcctga

SEQ ID NO: 14528 - DNA, 201 bp, Pseudomonas aeruginosa
cccagccgggggatgcctggcgaccctggaggcgctgtgctagtgtccgccgggtacccgatggctgtgtggcttggcgccttgccggccctgtggtctgccgcggacggggatggccaggccatccgctcgaccaatcgccgtggcgaagcgtgcgtgtcgccgctccttcggccgacaaggaatgcgttccatgcctga

SEQ ID NO: 14529 - DNA, 723 bp, Pseudomonas aeruginosa
ccgcgaagtccgctcgcttttctaccacgcctaccgccacgaaccgaccttcgcctacctgatggatgcgcagcgcgccggctacgaccagcgcgtgcgtgcctgcgtccgggagatggtcgagcgccatctgggcgaagagttgccggccatcggcctgttcatcgacgatcggctggtcgcggcggccctgatcacgccgccgcagcggcgcctggatatcaccgagagctggagctggcgcctgcgcatgctgttcagcgtcggcctggccgcgacccggcgctacctggattaccaccgggcggtgcaggcctgcctgccggtcggcccccaccaccagttgccgatgctcggcgtgcatcccgagtaccagggcaggcagatcggcgagcagttgctggccgccgtgcagcgctggtgcgccgaggactccgcttcgcaggggctggtcctggataccggcaatgcgcgctacctggacttctaccagcggcacggctaccgcgagatcggcgaggtgacgctgggagcggtgcgcgagcacgtcctcctgcatcctggcgagacgccggcggcgacctgagcgttcccccggacgcgcgagaaaagccatgcctgtcaggcgcttggcgtcataaaacccgaatgtcaggaggtggtcggcggcgtccgcgcaaatctggacgcgcgccacccgcctgcgtagcatccgcgccatga

SEQ ID NO: 14530 - DNA, 405 bp, Pseudomonas aeruginosa
actgcgctggtcgccggcctgcctggcggggctgcgcctgtgcctgcagcgggtggccgccgagcgggtcgcgctggacctgccgccgagcggcgacagcgccgacagcgggccgatcagcctgccgacgctgaaactgccgctgagcatcgaactcggcgaagtggcggtcggcagcttcctgctcgacggcaaccagcaggtcgccgaactcaagctggcggcccattggctggccgacggcctgcacatcgactcgctgacggcgcggggcttcggcctggacctggcgctccaggggcgcttgcagccgagcggcgactggcccttgcaggccgaagccacgctcggcctgcccgctcccgaaggcaagccgtggaagctggccgtccaggtcggcggtga

SEQ ID NO: 14531 - DNA, 897 bp, Pseudomonas aeruginosa
gctgcagcaggcgctgaccctgaaaggccgcagcagcggttacctggacggcagcctggaaggacagttgcaggcgctggcggaaaacctgccggcacgattgctgatccgcgccgacggtttcaagggtacggccggactaccggacaccttgaccctgaatgccatccagctcgatgccggcggcgatctcaagagcggttacctgatccgcggcggcgccagcctgccgggcgagggcggggcggtggcgttgagcctggacgggcgggtcgacgcccagggcgcggatatccgccaactgcgcctggacgctggcggcgagcagcgcctggagctggtcggacgcctggactggcgcgaaagcctggccgccgacgcgaccctggactggaaggacttcccctggctgcgcctgtatccgctggcggagccgccgccggtgacgctgaagaccttcaaggcggaagtgcattaccaggaccagcgctacctgggcaatttcagcgcggcggcgagcggtccggcgggcgacttcacgctggccagcccggtgtccggcgacctcgtccagctcaacctgccgtcgttgcagctccgcgccgggcaaggccaggccgagggccgggtgacgttgcgtttcgacaatggcgtggcttgggataccgccctgcagctcagcgaactgaacccggcgtactgggtcgccgagctgccgggttcactggccggtcccttgcgcagccagggaagtgttcgcgacgagcggctggcgttgggcgtggatctcgacgtcaagggccgcctgcgcggccagccggcgctattccaggcgcgcgccgaaggcgaggggcagcgctggacgctgggcaacctcgacctgcgcctgggggataa

SEQ ID NO: 14532 - DNA, 1632 bp, Pseudomonas aeruginosa
caaggtgcacggcagcggggcgctcgaccagcgcctgcaaggccgcctggacatcgccctgaaccgtctcggccagctttggccgcaactcttcggtcgcctcgagggacgcctcgacctggctggcagcctcgcggcgccgcaaggcaggctgaacctcaagggacagcagatcgcctacgccgagcagcgcatcgccggcctcgacctgcaggcgaacctcgatgcccggcagaacggcactctggcgctggtcgcttccggcctgcgcagcggcgaaaccgatctcggcctgttcaaggccaatgcccgcggcgaccaacgccgccagcaactggaactggacctgcaaggtgccttgctcaagctcggcctggccttcgacgggcaactggagcgcggcaactggcgcggtcgcctggcgcgcggcgagttgagcagcggcggccaggactggaagctacagcagccggcgcgcctggagcggttggccgacggcaaggtcaatttcggcgcacattgctgggtatccggcggcgccagcctctgcggcggcgagcagcgcctgctgcccgagccgcggctgcgctacaccttgcgcgacttcccgctggacagcctgaagcaatggttccccgaggacttcgcctggcagggcaagctgaacggcgacctgcaactggacgttccggcccgcggcccgagcggcgtggtcagcctggacgccggcagcggtacgctgcgcctgcgcgaccagggccagtgggtcgacgtcggctacgacagcctgcgcctggagagccggttggcgcccaaccgcgtcgatacctccctcgacttccgcggaccgaagctcggcgagttgcgggtgcaggcgcagatcgacccgcgcccggcgagcaagccgctgagcggcgagttcagcctggccggcctcgacctgtcggtggcgcgcccgttcgtgccgatggtggagaaactgcaaggcaggctgaacggcagcggccggctgtccggcggcctgctggcgccgcgggtcgacggacgggtgacgctgagcgacggcaacattggcggcggcgagctgccgaccagcttcgagaacctttccctcgacgctcgcatcgctggcgaaagcctggaactcggcggcggctggcgcagcggcaggtacggccagggcagcctgtccggcaacctgagctggggcgacgcgctgaacgtcgccctgaacatccgtggcaaccgcctgccggtggtggtcgatccctatgcgcaactggaggtggaaccggacctgaagatcggcatggccgggcaggagctggcgatctccggcaaggtcctggtgccgcgtggcgacatcaccatccgccagttgccgccatccacggtcaaggtctccgacgacgcggtgatcgtcggctccgagcagcccgagcagcagccgctgaagatgaagatggacatcgatgtcgaggtcggccaggacaagctggcgttctccggcttcggcctcagcgccgaactggccggccacctgcacatcggagacaacctggatacccgcggcgagctgaacctgaacaagggccgctatcgtgcatacggccagcgcctgacgatccgtag

SEQ ID NO: 14533 - DNA, 780 bp, Pseudomonas aeruginosa
aatggagcgggcgccgaccgccaggtcggtgcccgaagcaactcggcacaaggactggctgacatgatttccgtctatcaactcaaaccgcgctttcagaatcttcttcgtcccggcgtgcagcgcctctaccagcgcggcatcactgccaaccaggtgaccctggcggcttgcctgctgtccctgctggtcggcgcgctggtcgccggtttcgccagccatctctggctgttcgccctcgttccgctgtggatgttcctgcgcatggcgctgaacgcggtggacggcatgcttgcccgcgagttcggccagaaatccgacctgggcgcctacctcaacgaactcaccgacgtgatcgccgacagcggcctgtacctgccgttcgccctgttgccgggagtcaacccgctgtgggtggtgctggtggtgctgctggcggtgatcagcgaatatgccggcgcgctgggcaccatggtcggcgcttcgccgccgctacgacggcccgatgggcaaaagcgaccgggcgctgtgtttcggcgtgatcggcgccggggtggccagcggcctgttgccgctggcctggatcgactggctgatgttgctgatcgcggccctgctgttgctgaccatcggcaaccgcgtgcgccagggcctggccgagctgtccgcgagtcgacggggcagcaacggccaggcctgagagggaacgggcgaacgccatggaggtgggcgcccgcaggaagcaaccccgccgggatcccggccggggcaacgacatag

SEQ ID NO: 14534 - DNA, 1770 bp, Pseudomonas aeruginosa
ggacatcacatgcgcgacgtacaggaactgcgtttcaccacccacgacggggtagagctcttctaccgccactggccggccagccgcccggcgccggacggcacgcgccaggcggtgctgctgttccaccgcggccatgagcactccgggcggatcgcccatctggtcgacgaactcgacctgccggaacacgacttcttcgcctgggacgcccgtggccacggcctctcgccaggcgcccgcggcgacagcccgagctttgctaccagcgtgcgcgacgtacagaccttcgtcgaccatatccaggccgtccacggtatcgccgaagagcggatggcggtggtggcgcagagcgtcggcgcggtgctggtttccacctgggcccacgactacgcgccgaaggtgcgcgcactggtgctggcttcgccggcgttccaggtcaagctctacgtgccgttcgcccgcagcgggctgaaactgatgcgcctgtggcgcggcaatttcttcgtcaacagctatgtcaaggcacgcttcctcagtcacgacccgcagcggatcgcctcctacgacagcgacccgctgatcgccaaggcgatctcggtgaacgtcctgctcggcctctacgaagctgccgagcgggtggtagcggacgcacaggcgatccagattcccacccaactgctgatttccggggccgacttcgtcgtccatcgtgcgccgcaggagcgcttcttcgagcgtctcggcagcctgcgcaaggaaaagcacatcctgcccggcttcttccacgacacccttggcgagcgcgatcgtcacctggccgtcggccgtgcccggcgcttcctcctcgaggcattcgccacggcccccgaacgaccgagcctgctcgatgccgaccgcctgggccatacctgcgccgaggccgaggcgctggccgcgccgttgccgaagaactcgccgcgcgatctctactggcgcgccacccgtgccggcctgcgcctgggcagcctgtggtcggatggggtcaagctgggcttcgacaccggcttcgattccggcagcaccctcgactatgtctaccgcaaccagccctgcggcagcggcccactgggtcgcctgatcgaccgcaactacctggactccatcggctggcgcggcatccgccagcgcaagctgcacgctgaggagctgctgcgcctggccatgcagcggttgcgcgaggagcagcgcgaggtgcgcatcgtcgacatcgccgccggccacggccgctacatcctcgaagccctgcaaggcgtcgagccgctgccggaaagcatcctcctgcgcgactacagcgagatcaacgtgcgtgacggcagcgccctgatcgaaagcaagggcctcgccggcatcgcccgcttcgtcaagggcgacgccttcgatcgcgccgacctggcggcgctgcaaccgaagccgagcctcggggtggtttccgggctctacgagctgttcgccgacaaccgcatggtcggcgactccctcgccggcctcggcgaggcgctggaggagggcggctacctggtttacaccggacagccctggcacccgcagctggaactgatcgcccgcgcgctgaccagccaccgccagggccaggcctgggtgatgcggcgccggacccaggcggaaatggaccagctggtggccgccgccggcttccgcaagatcacccagcgggtcgaccagtggggcatcttcagcgtatcgctggcgcagaaggtcgcccgctga

SEQ ID NO: 14535 - DNA, 498 bp, Pseudomonas aeruginosa
gcgggagcgtgccggagccatcggcggaactgggcgaggtgcgccatgcctgagcaaaccctggccctggtggcggccctgctgcgccgtggccgcgagcttgaccggctgtccgccgcactgaccctgctggccatcgggctgggcctgtaccaggccgtgcaaggcatcggctggcgctatttcgctgcggcgatgctggcgatcgccctgctcggcctgtggcagaagtactgggcgctgcgagtggccctggacgccgaactgttcgaacgtttcagccacgtcggcgacaggctggaagcgcagacccaagacctggaccgggccctggccgatctcggcctggcccgaccggacgccgcagggcgcacctggaaccagcgcagccacggcgccctgcgcctgctacgctggcaggcgctggcctgtggcgcccagttcctgctggccttgtcgtgcctgttgtcgatccctctattcaacgctcaaacctga

SEQ ID NO: 14536 - DNA, 1041 bp, Pseudomonas aeruginosa
gcttcggcaagccgctggtcgccacggcggaagaaggcaaggaggcgttcctcgaacgagcgcgcatggccctgctggacctggcgccggaagaggaggcctgagatgaacgaacagacctggatgctcttcggcgggatcggcgcgctgctgctgctcgcctcgctggtcggcttcgtcctcaagtggcgcgccggtcccggcccgaacgcggtgatcgacaacctgaacgcacggatcaacgcctggtgggcgatggtcctggtgatcggtttcgccttctggcttggccaggcggcggtgatcctgctgttctatggcgtgtcgttctacgccctgcgcgagttcatcaccctcaccccgacccggcgcagcgactacccggcgctggtggcggcgttctacttcgtgctgccgatgcagtacctgctgatctacatcgactggtacagcatgttctcgatcttcatcccggtgtacgtgttcctgctgttgccgatcctcgcctcgctgggcggcgacaccaagcacttcctcgaacgcgcctcgaaagtgcagtggggcctgatgctggcggtgttctgtatctccttcgtgccggcgctgctgaccctcgacatccccggcttcgaggggcgcaacctgctgctgatcgcctacctggtgatcgtcgtgcagctctccgacgtgatgcagtacatctgcggcaagctgttcggcaagcgcaagatcgctcccaacctgtcgccgtcgaagaccgtcgaaggcttcgtcggcggcatcgccctggccaccgccatcggcgcctcgctgtggtggatcaccccgttcaacctctggcaggcggcgttgatcgcgctgctgatcaacctgctgggcttcttcggcggcctggtgatgtcggcgatcaagcgcgaccgtggggtcaaggactgggggcacatgatcgaaggtcacggtggcatgctcgaccgcctggactcggtgtgcttcgccgcgccgatcttcttccacgtggtgcgctactggtggacgccctga

SEQ ID NO: 14537 - DNA, 957 bp, Pseudomonas aeruginosa
ttacggttttaccattcgtattttccaaataatcgagggtgtccgatggatcgtttccaggccatgcaggccttcacccgcatcgtcgagctgggcgccttcggcaaggccgcggacagcctggagctgccgcgcgccagcgtgacccaggcgatccagcaactggaggcgcaccttggcgtgcagttgctgcagcgcaccacccgccaggtaagcctgaccctcgacgggcaggcctactacgagcgttgcgtgcgcctgctggcggacctggaggaggcggaaagctgctttccacgcgtcctgaacaacccgcgcgggcgcttgcgggtcgacctgccgggcgcactggggcggatgcgggtgattccgttcctgccggagttctgcgagcgctacccggaactggagctgcagttgagcagcaacgatcgcctggtcgacctgctgcgcgagggcgcggactgcgtgctgcgggtcggcgaactgcacgattccagcctggtcggccggcacctggccgacctgccgcaggtcacctgcgccagcgccgcctacctggagcgtcatggccatccgcggcagctcgccgagctcggcgggcacctcgcggtgaactaccagtcgccttccagcgggcgtaccttcgacttcgagttcagcgtcgacgggcgtctgcgcacgttgccgatgcgcagccgggtcagcgtcaacaacgccgatgcctacgtcgccgcctgccgggccgggctcgggctgatccaggcgccgcactatcacgtcgccgccggcctggccgacggtagcctccgacaagtgctcggagaatggttgccgccatcgctgccgctgcatgccgtgtatccctcgcagcgccagttgtcgccgcgggtgagggtgttcgtcgactggctggtggaactgttcggtcgccaggcggccggcgagacgcaatga

SEQ ID NO: 14538 - DNA, 1596 bp, Pseudomonas aeruginosa
agtcctcgccctcggccaggtgtcggcgcaggtcctcggcgagggcttcgaaatgctgtctctggtgcatcaggcgtctcccccgaatacgtccacatcgctgaatacgcaggccggcgaggcgtggccgacacggatcacctggttcggctcgcccttgccgcagtagggggtgccgagcacctcgaaggtgccggcgtcgcccaccgcgctgaggttgcgccagaactgcgcggagatgccccggtagttggggtttttcaccacgcccttgagttcgccgtcctcgatcaactggccccattcgcagccgaactggaacttgttgcgtgcgtcgtcgatcgaccaggagcggttgtaggacatcagcaccccgcgctcgataccggccaccagctgcgcgaagctcttgtcaccgggctccaggttgagattggccatgcggtcgatgggcgcgcggttccaactgctggcgcggctgttggcgacgccctccaggccgctgcggtgttgcgacagggcgccgccgagcgggcgcagcaggcggccttcgcggatcaggtattccttgcgcgcggggctgccgtcgtcgtcctggcggtagctggccagctcctcggggatttccgggtcgaagctgacgttgagcaggctggagccgtactggtagcgaccgaagtcctcggtcttgatgaagctggtcccggcgtagttgcgctcgtcgccgaggatgcgatccagctccagcgggtggccgatcgactcgtggatctgcaggatcatctggtccggcatcagcagcaggtcgcagcggccgctcggggtgttcggcgccgccagcagttgcagggcctggtcggcgatgcgcggcgcggcgccgaccaggccgaggcgctcgatcacttcggcgccgccctgctggccggcatggtggccgccgaaactgcgggtctggctgtcatggccgtcgtaggcggtgacgctggcgccaggatagacgaagcgctgctcgtggtattgctcggcgccggcgctgttcaggtagagctgttcctggcggctgacttcgaggaatacgctccagttcaccaggcgctcgtcgcgcggcaccttggcggactcctcggcgagcagttcgtagcactcggcgagggaggggaaaggggcgtcctggttcggcgagcgatactgcgagcggccgcttgccggcggcaatccgcggacgtcgaacagggcgtgccgggcgatccgctcggcttgccgttcggcctgctccagggcggcctgcaggccggccgcggagagatcgttggtggcggcgtaggcttccacgccgttcagccgtacgcagagcatggcgccgcggtcctggctgaagtgcggcggttcgttgacgttgcggcgcaccgagaggtactcgccgctacgctggacgtagcgcaaggagtggaattcggcgcgactgcggagcgccgcgaagcggtgtttcaacgggtcgatcatctgtgcgtccctggccgattgcggagtgggcgaatgcagaacgctatatttcaagccttcgtccgtaacggagcaagccgtttgttgtcatag

SEQ ID NO: 14539 - DNA, 1245 bp, Pseudomonas aeruginosa
atccaagttccgtaccctgcgcccgtggctgatcaccgccctggccttcgccgccgtgatcggcctggtgatgtggctggcggcgcccgcctcggcaccgtcctccgacgggcgacccggtcgcggcggcaagccgggcgccgcgctgcccaaggccaacgcgctcaccgtcggcgtggccagggtggagcagggcgacctggcgctgcatttcaacgcgcttggcaccgtcaccgccttcaacacggtgaacgtcaagccgcgggtcaacggcgagctggtcaaggtgctgttccaggaggggcaggaggtcaaggccggcgacctgctggcggtggtcgacccgcgcacctacaaggcggcgctggcccaggccgagggcacgctgatgcagaaccaggcgcaactgaagaacgccgagatcgacctgcagcgctacaaggggctgtacgccgaggactcgatcgccaagcagaccctggatacccaggaagcccaggtccgccagttgcagggcaccatccgtaccaaccagggccaggtcgacgacgcccgcctcaatctgaccttcaccgaggtccgcgcaccgatttccgggcgcctcggcctgcgccaggtggacatcggcaacctggtcaccagcggcgataccacgccgctggtggtgatcacccaggtcaagccgatctcggtggtgttcagcctgccgcagcagcagatcggcaccgtcgtcgagcagatgaacggccccggcaagctggcggtcaccgcgctggaccgcaaccaggacaaggttctcgccgaaggcaccctgaccaccctggacaaccagatcgacaccaccaccggcacggtcaagctcaaggcgcgcttcgagaacgccgacggcaagctgttccccaaccagttcgtcaacgtgcgcctgctggcgcataccctcaagggcgtgctgaccattccagccaacgccgtgcagcgcggcaccaacggtatctatgtgtacgtggtcggcgccgacaacaaggtcagccagcgcagcgtcgccatcggcaccagcgagaacgagcgggtggtggtggaaagcggcctgaaggccggcgagcaggtggtggtggaaggcaccgaccgcctgcgcgacggtatggaagtgcgtgtcgccgaggcctccccgcaggtcctcgagggcgagccgcagaaaccgcagactggccgccccagcggcctccagggcgactcggtgggtag

SEQ ID NO: 14540 - DNA, 3132 bp, Pseudomonas aeruginosa
atgaacccgtcccgcccgttcatcctgcggccggtcgcgaccaccctgctgatggtggcgatcctgctctcgggcctgatcgcctaccgcttcctgccgatctcggcgttgccggaagtggactacccgaccatccaggtggtcaccctgtaccccggcgccagcccggagatcatgacctcgtcgatcaccgcgccgctggagaaccagctcgggcagattccggggctcaacgagatgtcttccagcagttccggcggcgcctcggtgatcaccctgcaattcagcctgcagagcaacctcgatgtcgccgagcaggaagtccaggcggcgatcaacgccgcgcagagcctgctgcccaacgacctgccgaaccagccggtgttcagcaaggtgaatccggcggacgcaccgatcctgaccctggcggtgatgtccgacggcatgccgctgccgcagatccaggacctggtggatacccgcctggcacagaagatctcgcagatctccggggtcggcctggtcagcatcagcggcggccagcgcccggcggtgcgggtgcgcgccaacccgacggcgctggcggcggcggggctgagcctggaggacctgcgcagcacggtgaccagcaacaacctcaacggccccaagggcagcttcgacggcccgacccgtgcctcgaccctggacgccaacgaccagttgcgctcggccgacgcctaccgcgacctgatcatcgcctacaagaacggctcgccgctgcgcatccgcgacgtcgccagcgtcgaggacgacgccgagaacgtgcgcctggccgcctgggccaacaacctgccggcggtggtgctgaacatccagcgccagccgggggccaacgtgatcgaggtggtcgatcggatcaaggcgctgctgccgcagctgcaatcgaccctgccgggcaatctcgacgtgcaggtgctgaccgaccgcaccaccaccatccgcgcctcggtcaaggacgtgcagttcgagctggcgctggcggtggcgctggtggtgatggtcaccttcctgttcctgcgcaacgtctacgccaccctgattcccagcttcgccgtgccgctgtcgctgatcggtaccttcggcgtgatgtacctgtccggcttctcgatcaacaacctgaccctgatggcgctgaccatcgccaccggcttcgtggtcgacgacgcgatcgtcatggtggagaacatcgcccgctacctggagcagggcgactcgccgctggaagcggcgctcaagggctcgaagcagatcggcttcaccatcatctcgctgaccttctcgctgatcgccgtgctgatcccgctgctgttcatgggcgacgtcgccgggcggctgttccgcgagttcgccatcaccctggcggtggcgatcctgatttccggcttcgtctccctgacccttacgccgatgctcagcgccaagctgctgcgccacatcgacgaggaccagcagggccgcttcgcgcgcgccgcggggcgggtcatcgatggcctgatcgcacaatacgccaaggccctgcgggtggtcctgcggcaccagccgctgaccctgctggtggccatcgccaccctggcgctgaccgcgctgctctacctggccatgcccaagggcttcttcccggtgcaggacaccggggtgatccagggcgtcgccgaagcgccgcagtcgatctccttccaggccatgtccgagcgccagcgcgcccttgccgaggtggtgctgaaggacccggcggtggccagcctgtcctcctacatcggcgtcgacggcagcaacccgaccctcaacaccggccgcctgctgatcaacctcaagccgcacagcgagcgcgacgtcaccgccagcgaagtgatccagcgcctgcagcccgaactcgaccacctgcccgggatcaagctgtacatgcagccggtgcaggacctgaccatcgaggaccgggtcgcccgcacccagtaccagttcaccttgcaggacgccgacccggacgtgctcgccgagtgggtgccgaagctggtggcgcggctgcaggagttgccgcagctcgccgacgtcgccagcgactggcaggacaagggcttgcaggcctacctgaacatcgaccgcgacaccgcctcgcgcctcggcgtgaagctctccgacatcgacagcgtgctctacaacgccttcggccagcggctgatctcgaccatcttcacccaggccacccagtaccgcgtggtgctggaggtggcgccgcagttccagctcggcccgcaggccctggagcagctctacgtgccgtccagcgacggcacccaggtgcgcctgtcgagcctggcgaaggtggaggagcggcataccctgctggcgatcaaccatatcgcccagttcccctcggcgaccctgtcgttcaacctggccaagggttactccctgggcgaggcggtcgaggcgatccgtggcgtcgaggccagcctggagctgccgctgagcatgcagggcagcttccgcggcgcggcgctggccttcgaggcctcgctgtcgaacacgctgctgctgatcctcgcctcggtggtgaccatgtacatcgtcctgggcatcctctacgagagcttcatccatccggtgaccatcctctcgaccctgccctcggccggggtcggcgcgctgctggcgctgatgctggcggggcaggagatcggcatcgtggcgatcatcggcatcatcctgctgatcggcatcgtcaagaagaacgcgatcatgatgatcgacttcgccctcgacgccgagcgcaacgaaggcaagccgccccatgaggcgatctaccaggcctgcctgctgcgcttccggccgatcctgatgaccaccatggccgcgctgctcggcgcgctgccgctgatgctcgccggcggcgccggcgccgagctgcgccagccgctgggcatcaccatggtcggtggcctgctgctgagccaggtcctgaccctgttcaccaccccggtgatctatctctacttcgaccgcctggcccgtcgctgggcggcctggcgcaagcagcgcgggctggacctgaacaccgaggccgggttcgacggggacgccgggcgatga

SEQ ID NO: 14541 - DNA, 291 bp, Pseudomonas aeruginosa
gcgcgaagatgggcgagtaccgcaagatcctctcttccgatccggcggtggaaaacgtggtcggcttcatcggcggcggccgctggcagtcgagcaacaccggttcgttcttcgtcaccctcaagccgatcggcgaacgcgacccggtggagaaggtcctcacccggctgcgcgagcggatcgccaaggtgcccggcgcggcgctctatctcaacgccggccaggacgtgcgcctgggcggccgcgacagcaacgcgcagtacgaattcaccctgcgcagcgacgacctga

SEQ ID NO: 14542 - DNA, 1686 bp, Pseudomonas aeruginosa
ccctgtacaccaccccggtggtctacctctatctcgaccgcctgcgccactgggtcaaccagaaacgcggcgtacgcacggacggtgcgctggagacacccctatgaaacacaccccctcgttgctcgccctggccctggtcgccgccctcggcggctgcgccatcggccccgactaccagcgaccggacctggcggtgcccgccgaattcaaggaagccgaaggctggcgccgcgccgagccgcgcgacgtgttccagcgcggcgcctggtgggagctgtacggcgaccagaccctgaacgacctgcagatgcacctggaacgttccaaccagaccctggcccagtcggtggcgcagttccgccaggccgaggcgctggtgcgcggcgcgcgggcggcgttcttcccgtcgatcaccggcaacgtgggcaagacccgcagcggccagggcggcggcgacagcaccgtgcgcctgcccgacggctccactgtgagcagcggcggtggttccggtgcgatcagcaacagttactcgaccagcctcggtgtcagctgggaggtcgacctctggggcaagctgcgccggcaactggaggccaaccaggcgagcctgcatgccagcgccgccgacctcgccgcggtgcgcctcagccagcagtcgcaactggcgcagaactacctgcaactgcgggtgatggacgaacagatccgcctgctcaacgacacggtgacggcctacgagcgttcgctgaaggtggccgagaacaaataccgcgccggcatcgtcaccagggccgacgtggcccaggcccgcacccagttgaaaagcacccaggcccaggccatcgacctgaagtaccagcgtgcccagctggagcacgccatcgccgtgctggtcggcctgccgccggcgcaattcaacctgccgccggtggcgagcgtgccgaagctgccggacctgccggcagtggtgccgtcgcaattgctcgagcggcggccggacatcgcctcggcggaacgcaaggtgatttccgccaacgcccagatcggcgtggccaaggccgcctatttccccgacctcaccctgagcgccgccggcggctaccgcagcggcagcctgagcaactggatcagcacgccgaaccgcttctggtcgatcggcccgcagttcgccatgaccctgttcgacggcggcctgatcggctcccaggtggaccaggccgaggcgacctacgaccagaccgtggcgacctaccggcagaccgtgctcgacggtttccgcgaggtggaggactacctggtgcaattgagcgtcctcgacgaggagagcggggtgcagcgcgaagccctggagtcggcccgcgaggcactgcgcctggccgagaaccagtacaaggccggcaccgtcgactacaccgacgtggtcaccaaccaggccaccgcgctgagcaacgaacgcaccgtgctgaccctgctcggcagccgcctgaccgccagcgtccagttgatcgcggcaatgggcggcggctgggacagcgccgatatcgagcggaccgacgagcggctcggccgggtcgaggagggcctgccgccttcgccctgagttcttctcgctgcctgttcctgacgaatgcctttccccgctattgcgcttgcatgacacaccgccgtccgcgtctcggctag

SEQ ID NO: 14543 - DNA, 1341 bp, Pseudomonas aeruginosa
cctgggcggccacccggcggaagcggttcaacggttcgaggccggcacgcaccacccaccaggcggtcagggcgatcaatggcaggaggaagggcagggccagcagggtggcgcggaggaaaccgtcgagcaggcgctcgtcggcgttgcgctcgctgctcagcaacacctgtaccggggtgccgttcttcatgcgcatggaagcgccgatgctcagcaggcgctggtcgttgccggtgctccagctctggaacaccggctggcgggcatccgcctgcaagcgggcgagaagcgcgcggttggccgcgacgctggccgcggcctggtcgccgaagctcatcagcggctggccgctgcggctgtcgagaatgctcaggtgcaggccgctgtgagccaccagttggtcctgcagggcatgcgcctgtacggccgggtcgctgcgcaggtcgagatcgtcttccaggctgtggcggatctgctccagcttcaattgcaggttttcccgctcgcgggcttccagctcgcggccgaggttccagtgcgccattgcgccgagcgccagggccagcagcgcgccgagggcgccgaccagcagggccaggcgcagcgacagtcggcctggtggcgtcatcggcgcgcttccaggacgtagccgacgccgcgaatggtatggatcagcttgaggtcgaagccgtcgtcgatcttcgcccgcaggcggcagatggcgacttccaccacgttggagtcgttgtcgaagttcatgtcccagatcagcgagatgatctgcgtccgggtgatgacgtcgccgttgcgccgcatcagcaggtgcagcagggcgaactccttggtcgtcaggttgatccgcacccggccgcggaaggcccggtggcggctggcgtccagctccaggtcggcgacccgcaggacgtcctgcatcggtgcctggtcgtggcggcgcagcagcgagcggacccgcgccagcagttcggggaactggaacggcttgaccatgaagtcgtcggcgccgagatcgaggccgcgcaccttgtcggtcagcctgccatgcccggtgagcatcatcacccgcgcgctgctgcgttcgcgcaggcggcggagcaggtcccagccgtcgatgccgggcaggttgacgtcgaggatcaccagttcgtaagggtgttgcaaggccatgtgcaggccgtcgatgccatcgttggcgcggtcgacgatgtagccgctttcggtcaggccctggtgcaggtagtcggcagtcttgacttcatcttcgataataaggatgcgcatgttcgcccctatataaagtatggattcatttgcaagtaa

SEQ ID NO: 14544 - DNA, 1554 bp, Pseudomonas aeruginosa
gcatggagcgcctgctcggcgaagacatcggccacctcggccagtgagatttccggggcgggccgccggcgcgccccccgaacggttcgggagaacagaatgggcaagaagacgattatcgcggtgaccgcactggcactgctcggcctgggcggcggcgcctacctggagctgggcgggaaggcgccggccggcgccggcgaagcggccgccgagggcgagggcagcggaccgcgcggcggcatgttgttgcgccagggcgacctgaccctggaactgctggtgccggaggacggcagcccgctcaaggcctgggtcgagcgcggcggcaaggcgctggcgccgcaggaggtggtcctcggcgccgacgtcgagcgtgccaccggcgaggtcgaggacctgctgttcaaggccagcggcgatggcctggtggccaatgccgggatcgccgagccgcatgccttcaccgcgcgcctcaagctgatggccggcaagcagggctacgacttcgccttcacccgcgaggagggcaagctggagctggatgccgagcagatcgaggccgccggcatcaccctcgatacggcgcggacgatcagcctggcccaggtggtctcgctgcccggcgagatccgcttcaacgaggaccgcaccgcgcatatcgtcccgcgcctgccggggatcgtcgacagcgtgccggccaatcttggccaggcggtgaagcagggcgagctgctggcggtgatcagcagcccgcagttgtccgaccagcgcagcgaattcgccgccgcccagcgccgcctgagcctggcgcagagcacctacaagcgcgagcagcagctgtggaaggagggcatttccgccgagcaggaattcctgctcgcccgccagggtttgcaggaagccgagatcgcgctgaacaacgcgcgggcgaagatcgccgcgctcggcggcaatcccagcctgcagggcggcaaccgctacgagctgcgcgcgccgttcgccggggtgctggtggaaaagcacctgacccagggcgagccggtggacggcaccgccaacgtcttcaccctgtccgacctgtcctcggtctgggccaccttcaacgtgcccgcgcaactgctcggccaggtccgcgtcggcagcaaggtcaaggtgctcgcccaggcgctggatagcgaggtggagggcaccgtgtcctacatcggcgacctgctcggcgagcagacccgcgcggccaccgcccgggtcaccctgagcaaccccgagagcacctggcgcccgggtctgttcgtttccgtgcaggtggccgaggcgacccgcaaggaagtcctgacggtcgccgacggcgcggtgcaggacgtcgacggcgaggacgtggtgttcgtccgcgtggccgatggcttcgtggtccagccggtcaagctgggcatcagcgacggccagcgcgtcgaggtcctcgagggcctgcgcgccggcagccaggtcgccgccagcggcagcttcatcctcaaatccgaactgggcaagggctcggcggaacacggtcactga

SEQ ID NO: 14545 - DNA, 1995 bp, Pseudomonas aeruginosa
gtcccgctccaggagtcttcgcatgttcgaacgcatcatccaattcgccatcgagcaacgctggctggtcctgctggcggtgctggggatggccggggtcggcatcggcagctaccagaagctgtccatcgacgcggtcccggacatcaccaacgtccaggtgcagatcaataccgccgcccccggctactcgccgctggaagtggagcagcggatcacctacccggtggagaccgtcatggccggcctgccgggtttgcaggaaacccgttcgctgtcgcggccggggatttcccaggtgacggtgatcttcgaggagggcaccgatatttacttcgcccgccagcaggtcaacgaacgcctgagcacggcgcgcgagcaactgccggaagacatctcgccgaccctcgggccgatctccaccggtctcggcgagatctacctgtggacggtggaggccgaggagggcgcgaccaaggaggacggcagcgcctacacgcccaccgacctgcgcaccatccaggactggatcatccgtccgcagttgcgcaacgtgaagggcgtggccgagatcaacaccatcggcggctacgccaagcaattcctcatcgccccggatccgaagaagctcgcggcctacaagctgaccctcggcgacctgcagaacgctgtgctgcgcaacaacgagaacgtcggcgccggctacatcgagcggcgcggcgagcagttgctgatccgcgcgccgggccaggtcaaggacatggacgatatccgcgggatcatcgtttccaacgtcgacggcgtgccgatccgtatccgcgacgtcgccgaggtcggcctgggcaaggagctgcgcaccggcgcggccaccgagaacggccgcgaagtggtgctcggcacggtgttcatgctgatcggcgagaacagccgggaagtggcccaggcggtcggccagcgcctggaggagatcaaccggaccctgcccaagggggtcaaggcgatcaccgtctacgaccgcaccaccctggtggacaaggccgtggccacggtgaagaagaacctggtggaaggcgcggcgctggtgatcgcggtgctcttcctgttcctcggcaacatccgcgcggcgttgatcaccgccaccatcatcccgctgtcgatgctgttcaccttcaccgggatggtcggcaacagggtcagcgccaacctgatgagcctcggcgcgctggacttcggcatcatcgtcgacggcgccgtggtgatcgtcgagaacgccatccgccgcctggcccacgcccaggcccaccacggccgccagctgacccgcgcggaacgtttccacgaggtcttcgccgcgtccagggaggcgcgccgggcgctggtcttcggccagatcatcatcatggtggtgtacctgccgatcttcgccctcaccggggtcgaggggaagatgttccacccgatggcgttcaccgtggtcaccgcgctgctcggcgcgatgatcctctcggtgaccttcgtcccggcggcgatcgcgctgttcatcaccggcaaggtcaaggaggaggagaacttcgtcatgcgccgcgcgcgtctggcctacgaaccggcgctgcgctgggtgctcgggcaccgcgcgctggtggtcggcggcgccctcggcgcgatcctgctcaccgggctggtggcctcgcggatgggcagcgagttcattcccagcctcagcgagggcgacttcgccatgcagggcctgcgggtgccgggcaccagcctgacccagtcggtcgagatgcagcagaccctggagaggaagctgatgggcaagttcccggagatcgagcgggtcttcgcccgcaccgggaccgccgagatcgcctccgacctgatgccgccgaacgcctccgacagctacgtgatgctcaagccgcagagccagtggccggacccgaagaagtcgcgggaggcgctgctggaagaattgcaggccgcggcccttga

SEQ ID NO: 14546 - DNA, 1311 bp, Pseudomonas aeruginosa
ggtgccgggcagcgtctacgagttctcccagccgatccagttgcgcttcaacgaactgatctccggggtgcgcagcgacgtcgcggtgaaggtcttcggcgacgacatgcaggtgctcaacgacaccgcggagaagatctccaaggtgctgcaaggcatcgacggcgcctccgaggtgaaggtcgagcagaccaccggcctgccggtgctgacggtggacatcgaccgcgacaaggcggcacgcttcggcctcaatgtcggcgacatccaggacaccgtggccaccgccctcggcggacgcaacgccggtaccctgttcgagggcgaccgccgcttcgacatcgtcatccgcctgccggaaaccctgcgcgccgacctgccggcactgtccaacctgctgatcccgctgccgccgaacaacctggcgcggatcgacttcatcccgctgtcggacgtggcgcgcctcgacctctcgccgggaccgaaccagatcagccgggagaacggcaagcggcgcatcgtggtcagcgccaacgtgcgcggccgcgacatcggctcgttcgtgctggaagcgcaacagaagctgcaggacggggtgaagatcccggccggctactggaccacctggggcggccagttcgaacagttgcagtccgccgccaagcgcttgcaggtagtggtgccggtggcgctgctgctggtgttcaccttgctcttcgccatgttcaacaacgtcaaggacggcctgctggtgttcaccggcatccccttcgccctcaccggcggggtgctggccctgtggctgcgcgggataccgctgtcgatctcggcggcggtgggtttcatcgccctgtccggggtggcggtgctcaacggcctggtgatgatctccttcatccgcaacctgttgcaggaaggacgcagcctcgaccaggcggtgtgggagggcgccatcacccgcctgcgtccggtgctgatgaccgccctggtggcgtccctcggtttcgtgccgatggccctggccaccggcaccggcgccgaggtgcagcggccgctggcgacggtggtgatcggcggcatcctgtcctcgaccatgctgaccctgctggtgctgccggtgctctatcgctggacccacgggcgcgacgccggaccgcgcgaggagacgccggcggccggctgaagcgggcgcgcaagcgggccggcaggggaaaccctggcggccctttttcgttggccgttggacggattccgttcgattaccgcacgcgattgccggcccggattgtcgccggcggagggcttgcgtag

SEQ ID NO: 14547 - DNA, 1035 bp, Pseudomonas aeruginosa
tgtgggtggacgttccgcgcccggcgcttggcgccgcgcggcgataacaacaacgatagcagcctgagtgtcctgcccatgaatgcctccttgctcagcgagcgcagccgggtgttcgaacgtgccgacccctatgcggtgtccggctatgtcaaccggcacgtcggtacgcactgcatacgcctgccggcctccggcaggccgcaagccagcctcgaccaccgcaccttcgccagcctcgacctgtgccggatcagctacggcgcggcggtacgggtcacctcgccggcgctggagagcatcttccacctgcagatcctcctgcgcggccactgcctgtggcgcggcggcgggcaggaacacgccctggcgccgggcgagctgttgctgatcaacccggacgatccggtcgacctgacctattcggcggactgcgagaaattcatcgtcaagctgccctgcgcgctgctcgaagcgatctgcgccgagcagcgctggagccatccggcgcgcggcgtgcgtttcctcgaacatcgctatcgcctggaccagctggaaggcttcgtcggcctgctcgccctggtctgccgcgaggccgagtccggcgagcggctggcgcgggtcgacagccacttcgagcagatcctcggcagcaagctgctgaccctgctgaagaccaacgtcagccgcgaggaccccggcgatgcgcaggtcgtcttcgcccgcctcgatgcctacatccgccgccatctgcagagcgagatcgaggtcgcggcgctggccgagcaggcgcacatgagcacccgttcgctgtacgcgctgttcgagcgccagcttggcgagagccctcggcaatacattcgccggctgcgcctggagcgcatccgcgcctgcctggaagaccccggctgccgggtacgcaacctcaccgaactggccctggacttcggtttcgcccacctcggccgcttcgccgagcaatatcgccggcagttcggcgagctgccttcggaaaccctgcgccggcgcgcctag

SEQ ID NO: 14548 - DNA, 1686 bp, Pseudomonas aeruginosa
gcggcgtgcgcaccgaggacgaagggctgttcgtattgcagcatcgctactggcaggaggcgctgctcgccgccctggagcgcgaacggacgcagcgcgtggcgctgcgggaggtggcgtcatgagcctgggctacgacgccctgcgcgatttcctctaccgcgaggcgcgctatctcgacgacaaggattgggacgcctggctggcgttgtacgccgcggacgccagtttctggatgccgtcctgggacgaccgcgaccagctcaccgaggacccgcagcgggaaatctcgctgatctggtacggcaaccgcggcggcctggaggaccgggtattccgcatccgcaccgagcgctccagcgcgaccctgccggacacccgcacctcgcacaacctgagcaacatcgaactgctcggcgaggacgacggcatctgccgcgcgcgctgcaactggcacaccctgagctatcgctacaagaccgtggacagctacttcggcaccaccttctacgacctcgacgtacgcggcgagagtccgctgatcaaggccaagaaagtgatcctgaagaacgactacgttcgccagctgatcgacgtctaccacgtctgacgcccgcgccggcgggctgtcgagggacatgccatgaaccatcggatcgcactcaacttcgaagacggggtgacccgcttcatccatgccgcgcccggcgagaccgtggccgacgcggcctaccgccagggcatcaacatccccctggactgccgcgacggcgcctgcggcacctgcaagtgcctggccgaggccgggcgctatgcgctgggccaggactacatcgacgatgccctcagcgccgaggaagccgcccgcggctacgtgctgacctgccagatgcgcgccgaaagcgactgcgtgctgcgcgtgccggcgtcctcgaccctgtgcaggaccggccaggcgcgctacgaggcgcgcatcagcgaagtccggcaactctcgccgagcaccatcggcctgtcgctgcgcggcgaggcgctggccagcctggcgttcctgcccgggcagtacgtcaacctccaggtacccggcagcgagcagcgccgcgcctactccttcagctcgctggcgaaggacggcgaggtcagcttcctgatccgcaacgtccccggcgggctgatgagcggcttcctcagtggcacggccagggccggcgacagcctggcgatggacggcccgctgggcagtttctacctgcgcgagattcaccggccactgctgatgctggccggcggcaccggcctggcgccgttcaccgcgatgctcgaacggatcgccgaacagggcagcgcgcacccgctgcacctggtctacggggtgacccacgacgtcgacctggtcggtctcgagcgcctggaggcgttcgccgaacggattcccggcttcacctggagcgcgtgcgtggccagcgccgacagcgactatccgcgcaagggctacgtgaccgagcacatcgccgcgcagcacctgcacgagggcgacgtcgacatctacctgtgcgggccgccgccgatggtcgaggcggtcgagcgctacctgcgcgagcagggcgtgcgcccggcgaatttctactacgaaaagttcgccgccagcgcggcctgaacccgagcgagccaaggagattcccatga

SEQ ID NO: 14549 - DNA, 411 bp, Pseudomonas aeruginosa
ggaactgcaggtggttctgcggattcggccggttggcgaaggagtaggcgcgccggcagtcgctgccgggtacttgcaggcgcgcgtactggccgggcaggaagtccaactggcggcccgcggcgccggcgtcgaggcggagcagcgcggtgtcctcggagagcaggcgcagttcgcgcaccacgccgctgtgcgcctgggccgcggcggcgtggcagagggtcgaggcgaagtcgaagtagaaggccgcgtcggagcgcacccgggtctggcaggcgagcaccttgcgctgctccaggtcggcggcggagagggtgtcctcgtcggcgtagtccaggctgtagctgcccgcctcgcagcggcccatgcaggtgccgcagaccccttcgcggcagtccagcggcaggttga

SEQ ID NO: 14550 - DNA, 3900 bp, Pseudomonas aeruginosa
cccgcactcgcagcaggccttcgccttcctcggcgatgcgcacgttgccgatctggtgcagggtgcgcggcatcggcacggtggacgcggccttgccggtgcggatacggaacacccggtcttccaggccggcacggctggggtagtagatcagcgacatctcgcgcttcggatcgcgggtgtagcgctgctcggactcccactgcggcaggtggaactcgcactgttcgtcgaactgcgcgaggtagccgtcccagtcctgggcatcgcagagttcggcgtggcggtagaggaactgttcgacgcggtactgcagtccggcgttcatggggtcacctccttcgcgcgcagggccaggcgctccaggccgtcgaggaggaagcgccgccaatgcgcgtgctggttgacgtagaggccttcgtgggtgatctcggtgccggtcagcagcggcgcgatacccagcgcctggctgttcggcgtcgcgccttcgagccacttgccgtggccgcgggagatgtcgctccagcgctccaggcgggcttggaagccacgctgggcttcgcggaactccaccaggtcgtcgggcgtgcccatcccggagacgttgaagaagtcctcgaactggcggatccggttctcccggtcggcgtccgactcgccctttacgccgatgcactggctgacgatctcggtacggttccaggccagcgggcggacgatgcgcagctgcgagctgatctggtcgatgacgaacaggctggggtagagattgaggttgcgcaggcgatgcatcatccactcggcgcgggcctggccgtattccgccaccagccgcggcatcacgctggcgtagccggggcgtacggcggggttgggcatctcgctgaagagcacgctgtggccgttggcgaaggagaaccagccgtcgtcggtggccgcgtcgccggcgccgagcttgctgtagtcgagggtggcggccacgccgccgcgctcggcctcgacctgctggcggtgctgcacggtggctacgtagttgtagtgcactgtgctgacgtgatagccgtccaggccattctcgttctgcagcttccagttgccttcgtaggtgtaggtggaggtgccgggcaacacttccagctcgccgctgggagactgcgccaccagcatgtcgaggaacacccgggcgtcgccgaggaagtccaccaggtcgtcctcgccggcgacgtccaggctgacgaagacgaagcccctgtagctctggatgcgcgctttcttcaggccacgggtggccttgtcgaagccttccgggtattcgcccggcgccttgaccttcaccagccggccgtcgttcttgtagcaccaggcatggaacggacaggtgaaggtcgactggttgcccttgccgacccgcaccagggtcgcgccgcgatgctggcaggcgtcgaccagcgcgtgcaactggccgttgccgtcgcgggtgacgatcagcggctggcgtccggcgcgcagggtgacgaagtcgtggggcctggccagttcgctttcgtggcaggcgtagatccagttcttttcgaagatcagctccatctccaggtcgaacagctccggttcggtgaacatgtcccgggcgatgcggaagatgccttcctcgggacggaagtcgaggcagccgccgacatagtcgcgccactgttcgaggcttctgcgggtagcgttcatgcgttctcacccttgtgcgttgtcgttatgggtgacccattcaacggccgcgagcgggggcgggctatccgcttagtcgacgatgcgcatcccgaaaatccgcagccgccgaggagcggccggggggctcgcggagggctcggccgaggttcgagcggcgcttgcggcggacgctttgtccggaaagtcggcgaacgctatccggatagtggaggatgcggggagccggccttgcgccggcatatgccttgcattttgctgaaaacagagcgccagcagagcgcacccccagccttgccgtgtcgagtgccgaaccatgatgaggacccatcccgtcgccgatcgtggcgatctccatgccgaccacctggacctggccgccgcccgttcctggatgtcgaaggtctgcgggccgcaccggctcgaagcggcgagcccgggactggtgcagttcgagcaccacggcaacgtgctgaagtcgatgtgcaccacccttggctacatcggctacggtaccgacgtcaccatcaccgtcgaggatgccgcggcgttcaacgcctacagcctgagcctgccgctcagcggcgagcaggagctgtgccggggcgggctgcgcctgctctccgacgtccgccgcggggtgatcatcgcgcccaacgagcgccaggagctgagcatcgccggggactgccgcaagctgcaggtggtgatcggccgcacggcgatgcgcaaggtcctggaggagatgttgcagcggccgatcgatacgcccttgcgcttcgatccggagatggatgccctggatggcgcctccgcgtcctggtggcgcaccgtgcggcacatcagcgaggagatggcgcgcagcgaactctacgcccaggcgtttttcagcagcgacctggaacgcgcgctgatcaagggactgatcctggcccagccgaacaactacagcgaggccctgcagcagggccttggcgggcgcccgccgcactacctgctgcgcgcccgcgagtttctccaggccaacgcccgcgagaccctgagcctggaggacgtggaacgcgccgccggggtctcgcggttcaagctgttcgagggcttccgtcgctacttcggggtgtcgccgatgagctacctgaagcactaccggctcgccgcggtgcgcgaggaaatcctcgccagcggcggcgcccgcagcatctcgacgatcgccctgggctggggcttcagccacctcggacgcttctccgtggactaccgcaagcgcttcgaggaaaccccgagcatgacccagcgccgcgctgcgcggcgctcctgagagggcgttcaggcgtcctcgcggccgatcagcgccaggcagcgccgcaggtgcggggagccgtcgccctggcgccggctgacgatgatcggcgaggtcagggaggcgtcggccagggcctggtaggcgacgtcgtcgcggtgctgcaactgcaccgaggccggcaccagggtcgcgccgagtccggcggcgaccaggccgatggcggtctgcatctcgttggcccattgcgtcacgcgcaggctcaggccgtgggtggcgaacagcgccagcacgtggtcggcgtatctcggccgcggctggccggggtagagcacgaacggctcgcgcgacaggcgctccaagctcagcggctggccgagcaacgggtgcccggcgggcagggcggcgaccagcggctcttcgctgagcacgctctggcggatcgccgggtcgtcgatgccggatgcgtccgaaaccgatgtcgatacgcccgctcttcagcgcctcgacctgttgcagggtggtcatctccagcaggcccagctccagctccgggtcgccgagcaggtggcggatcagctccggcagcacgccatacagcgccgagggcacgaagccgatgccgaaccactggcgctggccctggcccgatccgccgggtgctgtcgcagatgctttccagttggtccaggagcgtcgcgctctgttcgtggaagaagcgcccggcttcggtcaggcgcagcggccggccgcgctccagcagggccaccccgagcatttcctcgagttgctggatctgccggctcagcggtggctgggcgatgtgcaactgctcggcggcgcgggtgaagttgagggtccgggccagcgcctggaagtag

SEQ ID NO: 14551 - DNA, 1212 bp, Pseudomonas aeruginosa
cccggctgccgctgtttccctacatggacatcgagatcgacgggctttgccggcatccctcgtcgatccatgccgacgaccgctgagattcccttcccacgcccgacaacaacaagcagaggcaaacgccatgaccgtgaagatttcccagactgccgacgtccagcgcttcttcgaagaggccagcggccagctcaacgaacgcggcgatccgcgcaccaaggccctggtgcggcgcgtcctcgacgacacggcgaagctgatcgaagagatgcaggtcacgcccgacgaattctggaaagcggtggactacctgaaccgcctgggcagccgccaggaggccggcctgctggccgccgggctgggcctggagcattacctggacctgctgctcgacgcccaggacgccgaggccggcctcaccggcggcacgccgcgcaccatcgaagggccgctgtacgtcgccggcgcgccgctgagcgatggcgaggcacggatggacgacggccgcgacgccggcaccgtgatgttcctccagggccgcgtcagcggtcccgacggccagccgctggccggggccatcgtcgatgtctggcacgccaatacccaaggcacctattcctacttcgacagcagccagtccgaatacaacctgcgccggcgcatccgcaccgacgccgacggccgctaccgtgcgcgcagcatcgtgccgtccggctacggttgcccaagcgacggcccgacccaggaactgctcgaccgcctcggccgccacggccagcggccggcgcacattcacttcttcgtctcggcgcccggccatcgccacctgaccacccagatcaacctggcgggcgaccgctacctgtgggacgacttcgcctatgccacccgcgatgggctgatcggcgacctgcgcttcaacgacgaccccgccgcggcccgcgaccgcggcgtggagggcggacgcttcgccgaactggatttcgacttccagctccagtccagcccggcgcccgccgccgagcgccgcagccagcggccgcgggcattgcaggagtaaggcgggaaacggggagggcggctggtcgctggcgaccatgccgccttcttccgccaggcgcgacggcggataaaaaaaggcgccatgactggcgcctcaggacttgtccaaaggagcaacccaaaaaggacaagtgtattgctcggtga

SEQ ID NO: 14552 - DNA, 780 bp, Pseudomonas aeruginosa
gcgggccgaagggcggttcctggccgggcatggcttcgacctgccggtgggcgccgcgacccgaacctcggccacgccattccacccatgccgcccgggcaccggcgtgcccgtggcagcccaggctacgggcgccgcgtagccagccaagcgggagtcgacatggcctcgtggaccttggtggacgccagtgcgatcgctgtccgccatccctacaccttctacaaaccggacgcggagaccatcgatcgggtcgccgccggggaaagcgtcaagctgatcttcgccttcgataccgacaaccccgatgcgccgcgcgccgagcggctctgggtgacggtcgagggcatcgaggcggatggcgccttcagcggccgcctggacaactatccgcaatacatccgcgacctgtcgctgggcgagcgcatcgtcttcgaggcgcggcacatcatcaacaccgagcacgacccgcgggaaacgccgatctcgcgctatgcccggcgctgcttcgtgacgcgccgggtgatagacgaggggaaggcggtcggctacctctaccgcgaggcgccggaagaggaaaacgacagcggctggcgactgatggccggcgacgagtcggacgactacatgaataccgccgggaccaccgcctacgtcagcctgggctcggtgctgaacgccgacgacagcatcctgccgctgctcgacgcgccgccgggacgggcgttcgagcggctggccgacggttccttcatcgaggtgcagggaccggagggttga

SEQ ID NO: 14553 - DNA, 1611 bp, Pseudomonas aeruginosa
caggtcttctggaatcggtccggccaggccttcggcaagacgctggacgtgttcggcggacaccggcggttgggcgtcgtacaccacgcagccgtcgaacacggccaggcgatgggccagcaggagttggcgttcggcgggggagagttccattctctgtggtcctgtcgattcggggcggccactctagcacggcgagggtgcgcgttccgcaacgccttggctatcatgcgcggctttccatccgccctggccggagtccgtcgaaccatgcacaccttgcagcaactgcgcagcggcgaactggccggcgccacgcgcctggacctgtcctgcggcctgcgcgagttcccccgggaaatcttcgagctggccgactccctggaggtgctcaacctcagcggcaacgccctggacagcctgccggacgacctcgggcggctgcatcgtctcaaggtgctgttctgttccgccaacgacttcgacgaattgccggcggcggtgggggactgtccggcgctgagcatggtcggcttcaagtccaaccgcatcgagcgggtgccggccgcggccctgccgccagcgctgcgctggctgatcctcaccgacaaccggattgccacgctgcccgaggaactgggtcgccggccgttgcagaagctgatgctggccggcaaccgcctggaggccttgcccgagagcatggccgcttgcgaaggcctggaactgctgcggatcgccgccaaccgtttccagcgcctgccggcctggctggcgacgctgccgcgcctggcctggctggcctacgccggcaacccgttgtgccgtctgccggcgctggccgacagcggcatcgctgcgctggactggagcgagctgagcctggacggtttgatcggcgaaggagcctccggggtcatccatcgcgccggctggcaccagccggacggctcgacgcgcacggtggcgctgaagctgttcaagggcgaagtgaccagcgatggcacccccgccagcgagatggccgcctgcctggcggcggggcgccatgcgcaattgatcgaggtgctcggccagctcgccgggcatccgcaagggcgcgacgggctggtgctggagctgctcgacgacgcctatcgcaacctggcggggccgccgagcctggagtcctgtacccgcgacgtctatccgccgggactgcgcttcgagctggccacggcgctgcgcctggcggcctcgctcgccgcgttgatggcccatctgcatggacgcggcatcagccatggcgacttctatgcgcataacatcctctggcgcgaggatggcgcctgcctgctgggcgatttcggcgccgcgtcctttctcccggacgacgccgtgctcgccggcgccctgcggcgcctggaagtacgtgccttcgcctgcctgctggaagagttgctcgagcgcagcgaggcgccgccggggcaggcctcgctacgtgcggcgctggtcgagttgcagcgacgttgcgcgctgccacgggtgagcgagcggccggacttcggcgagatccaggcgatcttgcgcgaccttgccgctcgcagccaggcgtttcctcaagttcgatga

SEQ ID NO: 14554 - DNA, 783 bp, Pseudomonas aeruginosa
aggcccatcgccgccgggacccgcctcgggaaccagcgcttgaccacgcccggtaccagcgcctggatgatcgccacgccgctgccggccagcgcggcgctggcgatcagcgccagcccgctatccagttccaggcgccagaggcaggctgcggcgatggccagcagtccgcagacgatgccgcggtgctcggccagccagcgcccgagccagggcagcaacagcgccaccaggcccatgcagagcaccggcaacaccgtcagcagcgacgcgccctggaagccgagaccggtgccggcggtgatttcctcgagcagcgggccgatgccggtgaggatcggtcgcaggttgatgccgaggcagaagatcaccagcaggccgacccaactgacctccgccgcgccgacgccgctggcggcctggccgccagaagggattcgcgcgctcatgcctggcgttgccgccattgccggtacagaccctcttcgccggcaggacgcagggcgcgtagcggcaggctctgccgctgtggcgggcgcgccatctcggcgtagagcgtggcagtggacaggccgaacgcttcgccgtcctcgttggaataggcgaaccaggccgcctggatgccgcagagatgcatggcggccagacacatcgggcagggatggccgctggcgtagatcacacaaccgtccagacgcgggctgccgagcgcctgactggcctggcggatcgcctgcagttcggcgtgggcactgggatcgtgggtctcgtggatctggttga

SEQ ID NO: 14555 - DNA, 954 bp, Pseudomonas aeruginosa
gcgttggcgaaaagtatggcgtcgatgtcatgtatgctgaaattaaatgatgtaatgcctttcagtgggagtgtgcatgctcgatctggtcctgctccgtaccttcgtcagcgttgtcgacaccggcaacttcacccgcgccggcgaacacctgcacctgacccagtccaccgtcagccagcaggtcatccgcctcgaacagaacctcggttgccgcctgctcgaccgcagccagcggcaggttttgccgaccgaggaaggcgagcgtctgcttggatacgcgcggcgcctgctgcggctctcggacgaggccagcgaggccctcagcccggcccatggcgacggcgtgctgcgcctcggcgtgccggaagacctcgccggcgaagtgctgatgccggtgctgacgcgcttcaccgaagagcgtccgcgactgcgcctggaggtcgagagcggtctcagccatcacctgctgcgcctctatcgcagcggcgagctggacctgctgctggtcaagcagtggggggccgacagcgactgccatgcacgctgggccgagccgctgggctggttcggcagcgccgcgcggccgttcggcgagggttcgccggaggagccggtgccgctggtggtgttcccggtcggcgcgctgtatcgccaggagatgatccatgccctggagagcatcgggcgtcgctggcgcatcggctattccagcgccagcctggccagcctggtggccgcggtcggcgccggactgggggtcagcctgctgccgctgggctgcgtcgggcccgagcatctcctgcttggcgcgcaggccggcttcccgcccatcgctggcctggagctggcgctctacgcgcggcccgagctggacagcgccgggcgcacctccgcgaccgcttgcgcgacctctgcgatgcgcgcctggaagggttgcagggcgagcgttga

SEQ ID NO: 14556 - DNA, 519 bp, Pseudomonas aeruginosa
atagttggcgcggcgcacgacgaggacgatccccggcgcctccgcgcgcaggcggcggagcaggggcggcaacaggccgaactcgacgtcgtcggaaaggccgatgcggaacaccgcggtgctggtcgccggatcgaactcgctggcgcggctcatggcggtggagatggagtccagcgccggcgacaggtgggcgaagatttcctgggctcgcgcggtgggctccatgctgcgtccggtacggacgaacagcgggtcgtcgaacagcgtgcgcaggcgcgacagcgcggcgctgatggccggctggccgaggaacagtttctctgcggcgcgggtcacgctgcgttcgtgcatcagagtctcgaacacgatcagcaggttcagatcgacgcggcgcaggtcgtttcggttcatggcgttcctcgtttccaggggctagaggctgcaaccgcgggggctcgccgtcaagccttgcgtgcgagacggggcggggcctggcgaggtgccggaggggcatag

SEQ ID NO: 14557 - DNA, 1128 bp, Pseudomonas aeruginosa
tgcactgcagaggtttgcgatgtcccgagtgatccgttttcatcagtttggcccgccagaggtcctcaaatgcgaagagctgccgaccccggcgccggccgcaggggaagtcctggtgcgtgtccaggcgatcggcgtgagctggaaggatgtgctctggcgtcagaacctggccccggagcaggctgcgctgccgtccggtctcggcttcgaactggccggcgaggtgctggcggtcggcgccggcgtcagcgacctgccgctgggttcccgcgtggccagtttccccgcccatacccccgatcattatccggcctatggcgacgtggtgctgatgccacgcgcggccctggcggtctaccccgaggtactcaccccggtggaggccagcgtctactacaccggcctgctggtggcctatttcggcctggtcgacctggccgggttgaaggccgggcagaccgtgctgatcaccgaggcggcgcgcatgtacgggccggtctcgatccagttggccaaggctctcggcgcgcgggtgatcgcttccaccaagtccgccgaggagcgcgagttcctccgcgagcagggcgccgacaaggtggtggtgaccgacgagcaggacctggtcctggaagtcgagcgcttcaccgagggcaagggcgtcaatgtcatcctcgacgaattgggcggcccgcagatgaccctgctcggcgatgtctccgccacccgcggcaagctggtgctgtatggctgcaacggcggcaacgagtcggcgttcccggcctgcgccgcgttcaagaagcacctgcagttctaccgccactgcctgatggatttcaccggtcatccagagatgggcctggaacgcaacgacgagtcggtgagcaaggccctcgcgcacatcgagcaactgacccgcgatcgcctgctcaagccggtggtcgaccgggtattcgagttcgaccaggtggtcgaggcgcaccgctacatggaaacctgtccgaagcgcggccgggtggtgatccacgtcgccgattgaggacgatccgcagcgaaagagcccggccatcgagccgggctttttcgtgggggacagaggtctctgggttctggtcgccagcgcgttag

SEQ ID NO: 14558 - DNA, 468 bp, Pseudomonas aeruginosa
gtgcgttcgaagccttcgaacaacgggatgttcagttgcaggccgatgctgcggtcgcgttcgcgggtatcgccgttgaacgccatcgcctggtcgctatggctgcgtgccaggttggcgctcagcgccaggctcggccggccggcggcgcggctttcctccaccgaggcggcggcggctttcagccgcgcctgggcggcgagcagcgccggatgctcgcggcgggcttcggcgagcatctcgtcgatggccttgacgaagccggtgtcgggttgcgcctccagctcgccggagaggcgcagcggggtatccggcgccaggcccatgcgcagggcgatgacgccgaaggcgttgctcagggcgccttcgtcgcggacctgggcgaagctcgcctgggacagcgcggtctgcgcctgcaggcgatcggaaagggcggcggcgccggcccggtacttggcgtcggcggct

SEQ ID NO: 14559 - DNA, 297 bp, Pseudomonas aeruginosa
ccagactgcgcctgcccgccgcgcggcgggcctccgtccaacttctcagaaatggagcgcaccatgtctgtcgacctgaagaaaatcgccgctgcctttcccgagttccagttgtccagcaagagccgccacgacggcgcgctgttgttgcagttgcaggccgccgacggccgctacgtggctcgcaccataccctcgccgcagctcagcgcgccgccggagaccgagtggctgatccgcagcatccgccgggaactggccgtgccgggcatggaaatggcgatggcggcacgctga

SEQ ID NO: 14560 - DNA, 477 bp, Pseudomonas aeruginosa
gttgctgcaggtcgccaggtccaccgggccgacatagggattgccccagcccatcacgcagccgaccatgtggttgcgctggcgctcccaggtctgtggcgggtactgcttgtgccaggcgttgtagagctggcgatcctgcttcgacaggcgcaggccgtagcggtcgctcatgtagaagtaggtgcgggcgatcatcccgcggatctgcgggcgtggcatcgccttgcgcgccttgaagtccaccaccatcgggcaggcgccatattgctggggtttctgcggcagccagccgaagccgaagttgctgcggtcgccgttgacctcgccgatgctcggcaccaggttgtgcaggtcggcttcggcgcgctggtaggtgctgtcgtgcctcgcgcagttgctccgcccgccgttctgccagcagcgccgctggtgaccgatcacccaggccgggacgatgtgaaatgtgcccgttaa

SEQ ID NO: 14561 - DNA, 1218 bp, Pseudomonas aeruginosa
atagttacacatttccttgtcgtaggagtctggggtgtctaccgtgactcatattgcaagctttatggggcgggtgagatggagttggtcttcgcagatgaggggttccaaataaacggggttagctaccctggatttcctatcatcctaacagcagaactacggtcaattcccgaggtaagcgccttcttgatttaccgctgccttcacagggggcgagttgaaagtaaacatacatgggcctcatacgggcaagccctttacgactatttaggttttctaaatgctgccaatcgagactggagagatgttggtttttttgagctgggctcgagcccactggctgcataccgtgactggtcgatgcgtagttgcgggcttagcgaaaacaccataaatcttagactgcgagttgtttgctctttctataactatgcaaggcgccaaggttggatagagagggttccatatgatgttgaaacagtaagggtcgcagtccattctgtatttttggctcatgtggatgtaactggaggatatgtcgcttctcccgatatactaatgaaggggaagagaacagcaataaaaattttaactaaagagcaggttagaatttttttaaatgccgtaagttgttctactcaaaagcttattgcacgactagccctaagtagtgggttgaggaaggaagagctccttacatttccaagctcctatatatttgatcccgctcaaatatctaaaggcagttctcactttagagttttctgtagtccaaaggatatggagcttaaggggaataaggcgcgggagattgacatccctcgctcgcttatggcggcgctatggcagtacaaaattcatgagcgtaatcggagtatgcagacctcatgtgtagagtcaattccgttgtttctatctaggtatggtgtgccttacagtcctaaaggccagagtctaaaccatatgtggaaagatctggggcttcctttcacagtcactcctcatatgctccgccatacctatgcgacgcatacactccatgacatgcgcaggcgtaagagtgttatagatccgttgctatatgtgcgggataggctcggccactccagtgtggctactacgcagaggtacttgcacttaatttctatgattgaagatgatgttatgggagagtatcaagaatttattgattctgtctgcgttggaagaatatga

SEQ ID NO: 14562 - DNA, 1098 bp, Pseudomonas aeruginosa
tcattgagtaatctccttgctaccctgaataccgtcggcagcggaagctacgcgccggaagacgtccatttccttctgcggtcggtgcaaatgaatgtcaccgatgtcgaggagaaggagcgcctgattcagaccaatcagaagcactattcggagatgatcagccaagaacacgcgcctaccgacgttcacaagtccctgtacgctcgcgcgctagtgctgaacggtgctcgcatggctgaagatgttcaatctctggctttggcgttgagtgccgtctgcaccggctccagcatcgcactggtttccttcgtgcgcgccggccttccccttggcgtcctgctccgtcgggcactggtcgagatgggccgtgacgcccaccactatggcgtaagcattatccgtgatcgtgggatcgatacagtggccctcgaagcgatcatccagttgcacggtgctgagaacattgtcttcgtggatggctggaccggcaagggagcaatctctggcgagctcaagcggacgctaggtgccgacaagcgtttcccggaagagccccgactcgttgtgttagccgacccctgcggccgcgcatggctcgccgcctccgcagaggactgggttatcccgtccggaatcttgggcgcaaccgtttccggcttggtgtctcgctccatctggccgactcaaggtgggcttcatggttgcgtggtctacgaccacttgagtgaacacgacgttactcgtgaattcatcgacaagatcgaggctgagcgccaagcgctgagtagcgtccaaaccgcatcgccctggacgcacgagcagagcctgaagctccaggccgcggccgaaaacgtggttacctccctggctacccgctttggcatcagcaacctgaaccgcgtgaaaccaggtattgccgaggctacccgagcggtcctgcgccgagtgcccgatcacgtgctggtgcgagatcgtaatgacggcgacgtgcaactcctactgcatctcaccgagcgcgcaggggtaacggtggaggaggccggcgaggctcttggaccttatcgtgcggtaaccatcatccggagcacgaactga

SEQ ID NO: 14563 - DNA, 1233 bp, Pseudomonas aeruginosa
cggccgcactgcggacgacctcgtcaacttggctattcaggcggtacgcgcatgacaaccctggtacctggcggtaatgcgccggttgccaccggccaactgcgtgtggacatcagttatacgccggctccaggcgcagacatcgatatctctgcattcgccctaaccacctcggggaaggttcgcggcgatggcgacatgtgcttctacggtcaaaccagtattctgggtggagctgttcagctaacagccaattcggccggtcgtgctgagttcacagtcgacctcagccgtgttgatcctgccgtggagaaagttgccctcaccgcaaccatctacgaaaacaaggcaaccttcgatcgcgtgtcgacgctatcgctagcgctcactggagggatcgaagctcagatcccaacacacgggatgaatgaaaccgccctcatcctcggtgagttctaccttcggcagggagcgtggaagtttcgttgtgtcgcccagggcttcgcgggaggcttgggaccgctggcaaagcacttcggcgtcgaaatcgctgcacctccttccgcgccggcaccgactcccgctgcgccgcctcaagtacctccagccccgccgaagccgaccatcagcctcagcaaggtaacgctcgacaagtctcgctcgagcatcagcctggacaagcctgctgcagggtttggtgagatcaaggtgaacttgaactggaaccaaggtggaagtggcggtgtactcggcggcatctttggcaagagcaagtccgtcgacctcgacgttgggtgtctcttcgaactgcaagatggctacaagggagttgttcaggccctgggggaggccttcggtgatctgaacgatgagccctacattcagttgatgggcgacgaccgaactggttctgttgctggcggcgagtggatgcacatcaacggccggcagtggagcgagatcaaacgcatcctggtcttcgcgttcatctacgaaggtgctccgaactggaaagctaccgacggcgtcgtgacgatcttcatcccgggccagccagaaatcgaagttcgcctgaacgaagaaggtggacgctatgggatgtgcgccatcgccttgcttgaaaacgtaaacggggccgttaaggtctcccgcagagtcgacttccaccgtgggcaccaagatatggacaaagcctacggctgggggatgcgctggacggcgggctccaagtaa

SEQ ID NO: 14564 - DNA, 600 bp, Pseudomonas aeruginosa
caaccacaaggagctgtatacatggcactgtctctgcaaaaaggtggcaacctctccctgtctaaagaggcgcctggcctaaccaaaattctggtaggcctgggttgggaccctcgctccaccgatggcacccagttcgacctcgacgccagcgctttcctgctaaacgcctccggtaaagtccgcggcgatgcagacttcatcttctacaaccaactcaagagtccggacggttccgttgagcataccggcgacaaccgtgatggcgccggcgacggtgacgacgaggctatcaaggtcgatctgagccgcgtgccggtcgacgtcgacaagatcgccttcaccgtgacgatccatgacgctgaaaatcgtcgccagaacttcggtcaggtcggcaactccttcatccgtatcgttaacgagaccaacggctccgagattgttcgttacgatctggccgaagacgcctcgactgaaaccgcgatgatcttcgccgagttgtaccgccacaacagcgaatggaagttccgcgctgttggtcaaggctacgctggtggcctgaaggccctggccaacggttacggtctgaccgtcaactga

SEQ ID NO: 14565 - DNA, 1107 bp, Pseudomonas aeruginosa
aacaaaatgaaggccgccgacatgttcgatcttgaccactccctcgctcaggaaatcgtcgaccgagcgatggccatccttccgcgaaacgtgaacgtgatggatagccagggcttgatcattgggacgggcgaggctgagcgcctctatacccgccacgaaggggcccagctggtcctcaccaacagcagggctgttgagatcgacaacgcagccgctggcgctctcaggggcgtgcaagaaggggtgaacttcccgctttgcctggatggccaggtgatcggcgttattggcgtatctggtgcgcctgatgaggtacgcacgttcgctgagatggttcgaatgaccgctgagatgctggtcgcccaacgaaatgatcagcagcaccggatttggctccagaagcggatcgaagacgttctgacagccatcctcctgtctggccaatctgctcaacgggccatcgttgaggcccaacgattggggctgagacctgaccttcgccgcacggcagtccttctcgagatggcaaccccagaagaccttgacctggcggccgaatggattcggcaccaggccgcagacgcctggtgcgttcctctacatgccttgggcctagtctggtgtccaccccggtcagcaccaccggattttcgtgagcggatagcccgcgctggaattccgtttacccgggtagcgatcggaactcctaacaccgaaacgaaggctctacattctgaagttgagcagctatcggacttgatggcctatgcccaagccaaaatgccagatgcacaatggctggacctggctgatcacagaattccggtggcggtgtggcgctttcgttctgagaacggctttctgcaactggcactcccctacgtcgctctgcagcaagaggacagcaatgggcagcttcgcaggacattgaaatgctggttcgagcatggaagtgacggccagtcctgcgccgaggccctgaatatccaccggaatagccttcgctacagacttgagcgaattgccgatatttccggggtcgacctcgcatcaccgaaaggtacgactgaactctacttggcgatgatcctggcggcagagtaa

SEQ ID NO: 14566 - DNA, 1218 bp, Pseudomonas aeruginosa
aggatgatctcgatgcaacttcgtgcagcagtctccggtctgcttctggccctcctggccggccaaactgtggcagcaagctttgactgctccaaggccagcagcttccccgaaacagaaatctgccgtgatggctacctgtccgggttggacgagtggttagctagatcctataagaccgccctggaggtaaatcctggccagtctgatgcggtccgtcagtcgcaacgtgaatggctcgcgacaaggaatgcgtgtactgaccagcagtgcctcgacagcactatcggcgcccgcatccaggcgcttgatcaatatgtgacggcggagaagggtaaggctgcatcggctttagcccatgcccagctgaacaagcatcaggaagcggaggccatcaggcagcggcaaactgcggagcgtctagggactgaagaagcagctcgacaggcgcagatcgagaatcagcgccagttggcaatcatcgaactccagcagcgtggtcaggccgcccaagcgctcgaaactcaacgtgctggagagcaccagcaggtaccagcccagatcccgcagtaccaaccccctcaaaaggttgcgccagcttcgagtgcaacctcgtcctcgccgtcataccgctcgccggagaaaactctgtggcagcagttcaaatctagcccggcctggaagtacttgctgctggcgggggcacttctgacagcttgggcgatgtggagacaccatcaggggcaaacaaccatctacaacgactacacggatgccgcgattacgaacctcttgccggctgcaggcgtggtactggccttcttgatgaactggctcgagctgcctcgtcaactcgcaatggtggcaggcgtcacgggtttcatgcttgcattgatgttcgcggtgtatgcgtcggtgcgaaccaatcagggatggatgagcatcagcttgtcgctcatcgccaagatgactctggtgtcagtattctatgcagtaataggcgcactggtggcatcgctattcttaagcaccaagtacaaaggggagtcccaggcgagagcgaatgcaaggaaccgacgggagaagaaagaaacgatggccatgatctccgtgctcactactgcctacaccttcctttcggcttggctgtgccgacggcaagagttcatctctgtttctgaatgcctagcttttgactcgaccgcaagcgttgcttaa

SEQ ID NO: 14567 - DNA, 1314 bp, Pseudomonas aeruginosa
cctcgcttcatgcaatccaggcttactttgcctgcacataaaccaaggaataggcgaccagaattgaatcaatccctcaagcccggcgagaacaccaccatcaaccagtcgaaaggtcaggtgctggtaacgcattctgccggcgcaaacctcgacgtgaacctgacggccttcctcatcactgactccggaaaagtggtcgatgacagtgggatggtcttcttcaatgcgccggagcatgcgtccggcgcggccgcattctcgcctcccatcatccaggccggctcgatcagtcacagcatcagctttgatctgagtcgcctgccagcctctatctcgaagatcgccatcaccttgacccaagatggcaccggaggaggtttcgcaggagtaccaaacctcagcgcacgtgttcttgccggcgaccaggtgctggatcttgcgcctggggcatttgagcgggagacgggcatcatcgtactcgagctctacgtccgaaacggtcaagcgaaggcgcgctctgtctggcagggtttcgcctcgggcctggtcgggctctgtggcatgtatggagtcgaggtcgacgatgagccggcaactgccccgatcccagccgcgccccctgcgaaaccggtcagcatcaccaagacggtgatcaccttggacaaacccgggaacacgcacaaggtctctctggagaaaggcgcggccgcgccgaaggtcatcaaggtcagcgccaggtgggtggacaacggagacggtcgagacaacgacgaccttgacctgcgaatcggtatccttcgcccagacggtcggatgtccatcattcaggcgcctgacaagcgcggttccttcgaggctgaccccttcgtattccataccggcgatgtggtaagcgcgagcacctctgccccagggatcgaaaccgtcgagatcaatgcagccatctctcatcttatgggcggtaaagtcgcgctggtctgcagcgtctattccgccgtcgacaacggagcagtgtcggttgcctccctcaagccgaaaatgcggatggagtacggggacgaggtcgtagagtgtgccttcgaattcaaaggaggatttttcagtagcctggtttacacctacgtcttggggatgatcgagatcgatggcgacgaaattcgcatcagccccagtggcgttacctccaaaactggatcggaagccacgccttggctaacccgcaaaggggatagggtcgagttgacgatggacggcccgcatgtatttaaaggccgtccgcttgagcgcaaagggaacaagcattacgtgtga

SEQ ID NO: 14568 - DNA, 1125 bp, Pseudomonas aeruginosa
tggacgaagcgcgcgaaagcgaccgccgcgagcaggacgcggcgaggatctcgggatgatcaagagcgcggaggaaatccagcgcatgagcgtggccggcgcgctcaccgcgaaagtcctcgaagccctcgacgaggtggtgcggccaggcatcagcacggcagagatcgaccgcttctgcgagcgctacatcgtcgacaccctcgcggcgattcccggcagcaaggggcagtacggctatccgttcacggtgaacacctcggtcaacgaggtggtctgtcatggctggccgtcggcgcagcagatcctccgcgacggcgatatcgtcaacgtcgacgtcacggtgatcaaggacggctatttcggcgacagcagcaagatgtaccgggtcggcgccatcgaccgccaggcgcagaagctgctcgacgtcacccgcgaatgcctgtaccgggcgatccgcgtggtgcgcccggacgccaccctcggcgatatcgggcatgccatccagagtcacgccgaagccaacggttattcggtggtccgcgaatactgcgggcatggcatcggccgcaagatgcacgaggcgccgcaggtcctgcacttcggtcgcgctggcgcgggtgcgcggctgaaggccgggatgaccttcaccatcgaaccgatgatcaaccagggcggccacgcggtgaagctgcacaaggacggctggaccgtgaccacccgcgaccgccgcctgtcggcccagtacgagcacaccgtgctggtcaccgagcggggttgccgggtcctgaccctgcgcgacgaggagcgcgaggcgctggccgacctggctggctgatcgacgcccggcctggttacactgcgacgacttttccgaagggaggctggcgggtgtccggcaggcgttttggcgagttcgaactgcgcgccacctggttgcgcgaggacagcggctatctggccgagatcgagataaccagcatcgacgacggacgcaccgaatggctggtgctgccgggccagccgccgtgcgagagtccggcggccgcgctgtcgctggcggaagcggcgctgtaccgggtgcgcggcttcgatgcgcggggccggccgctgttttccgactga

SEQ ID NO: 14569 - DNA, 294 bp, Pseudomonas aeruginosa
acgatcatggaaaagtccatcaagatgctgttcgatgccttccaggccacctttgccgtatccacccagatgcgtccggacggcggcgccctgctgaccctgcgcaacggcgaagagatcgtgacccgtcgcgtggtgtccgccgcccagttggccgacgagaagcgcatgtactggttcatcaacgccgtgcgccgtgacctggccctggaggcggggagcctgccggtggatgtggtcggcaccctgcgtcgtctgcaggagcgcggcctgccgagctacatggcgggctga

SEQ ID NO: 14570 - DNA, 345 bp, Pseudomonas aeruginosa
gcgggccccggggtatggaaacgctcgtcggcgacgttccgccgaatgacgctggacaacgccatgaccctggtcgggcaggtggccgaccagccgccggcgctggcgctgtcggaactgcgctcgatcgacctgccgagcctgatcctcaatggcgaacgcagcccgctgccattcccggccaccgccgaggcgctggcggcggccctgccgcgcgccgagctgcaacgcatccagggcgcgtcccatggcctcaatgccacccgtccggcggctttcaaccggtcggtactggagttcctggcgcgcgtcgatggcgttgcgccggacgtggaaacgtcctga

SEQ ID NO: 14571 - DNA, 2010 bp, Pseudomonas aeruginosa
ggcaggccggcccggcgggcgacgcttactggcacatcccaacccacgtggcctttggtaggggtcaccactaggagaggaggcgccatgcccatcattactcttcccgacggcagtcaacgttccttcgatcacccggtctccgtggccgaggtggcccaatccatcggcgcgggcctggccaaggcgaccctcgccggcaaggtcgacggccgcctggtcgacgcctgcgacaccatcgatcgcgacgcgaccctgcagatcatcacgcccaaggacgaggaaggactggagatcatccgccactcctgcgcccacctggtcggccatgcggtccagcagctctatccgaccgcgaagatggtcatcggcccggtgatcgaggaaggcttctactacgacatcttcttcgagcgccccttcacccccgaggacatggcggcgatccagcagcgcatgcgcgagctgatcgacaaggactacgacgtgatcaagaagatgaccccgcgcgccgaggtcatcgagctgttcaagtcccgtggcgaagactacaagctgcgcctgatcgacgacatgccggacgagaaggccatgggcctgtacttccatgaggagtacgtggacatgtgccgcggcccgcacgtgccgaacacccgcttcctcaaggcgttccaactgaccaagatttccggcgcctactggcgcggcgactcgaagaacgagcagttgcaacgcatctacggcaccgcctgggccgacaagaagcaactggcggcctacatccagcgcatcgaagaggccgagaagcgcgaccatcgccgcatcggcaagcagctcgacctgttccacctgcaggaagaagcgccgggcatggtgttctggcacccgaatggctggagcgtctaccaggtgctcgagcagtacatgcgcaaggtccagcgcgaccatggctatgtcgaagtgcgtaccccgcaggtggtcgaccgcatcctctgggagcgttcgggccactggtcgaactacgccgagaacatgttcaccacctcctcggaaagccgcgactacgcggtcaagccgatgaactgcccgtgccacgtgcagatcttcaaccagggcctgaagtcctaccgcgacctgccgctgcgcctcgccgagttcggcgcctgccaccgcaacgagccttccggcgcgctgcacgggatcatgcgcgtacgcggctttacccaggacgacgcgcatatcttctgcaccgaagagcaggtgaagaaggaagcggccgatttcatcaagctgaccttgcaggtctaccgcgacttcggtttcaccgacatcgccatgaagctgtcgacccgtccggccaagcgcgtcggttccgacgagctgtgggatcgcgccgaaggcgcgctggccgatgcgctgaacgaatccggcctggcctgggaataccagccgggcgagggcgcgttctacgggccgaagatcgagttcaccctgaaggactgcctcggtcgtaactggcagtgcggcaccctgcagtacgacccgaacctgccggagcgcctggacgccagctacatcgccgaggacaacaaccgcaagcgcccggtgatgctgcaccgtgcgatcctcgggtccttcgagcgcttcatcggcatgctcatcgagcactacgccggagccttcccggcctggctggcgccgacccaggcagtggtgatgaatatcaccgacaagcaggccgatttcgccgccgaggtggtgcggatcctcggggaaagcggattccgtgccaagtccgacttgagaaacgagaagatcggctttaaaatccgcgagcatactttgctcaaggttccctatctcttggttattggagatcgggaagttgaatcgaaggccgtcgcggtgcgtacgcgcgaaggggaagacctgggctccatgcccgtcacccagttcgctgagctgttggcacaggcggtttcccggcgtggtcgccaagactcggagtaa

SEQ ID NO: 14572 - DNA, 219 bp, Pseudomonas aeruginosa
tcactcaatgcggagtatccgaacatgccaaagatgaagaccaaaagtggcgcggccaagcgcttcaagaagactgctggtggcctcaagcacaagcacgccttcaagagccacatcctgaccaagatgaccaccaagcgtaagcgtcaactgcgcggcacctcgatgctgaacaagtctgacgttgcgcgcgtagaacgctccctgcgtctgcgctga

SEQ ID NO: 14573 - DNA, 1065 bp, Pseudomonas aeruginosa
gggaagagccttaccgctcttcccctattttgtatctggagtccatacatggaaaacctggatgcgctggtctctcaagcattggaggctgtgcgacacaccgaagacgtcaatgccctggagcagatccgggttcactacctcggcaagaaaggcgaactgacccaggtgatgaagaccctgggcgacctgccggccgaagagcggccgaaggttggcgcgctgatcaacgtggccaaggaaaaggtccaggatgcgctgaacgcgcgtaagaccgagctggaaggggccgcgctggccgcccggctggccgcggagcgcatcgatgtcaccctgcccggtcgtggccagctgagcggcggcctgcatccggtcacccgcacgctggagcgcatcgagcagtgcttcagccgcatcggctatgaagtcgccgaaggcccggaagtcgaagacgactaccacaacttcgaagcgctcaacattccgggccaccacccggcgcgtgccatgcacgacactttctatttcaatgcgaacatgctgctgcgtacccacacctcaccggtgcaggtgcggaccatggagtcccagcagccgccgatccgcattgtctgcccggggcgcgtctaccgctgcgactccgacctgacccactcgccgatgttccaccaggtggaaggtctgctggtggacgagggcgtcagcttcgccgacctcaagggcaccatcgaggaattcctccgcgccttcttcgagaagcagctcgaagtgcgcttccgtccgtccttcttccccttcaccgagccctcggccgaagtggacatccagtgcgtgatctgcagcggcaacggctgccgcgtgtgcaagcagaccggctggctggaagtcatgggttgcggcatggtgcacccgaacgtgctgcgcatgtccaacatcgatcccgagaaattccagggcttcgccttcggcatgggcgccgagcgcctggccatgctgcgctacggggtgaacgacctgcgtctgttcttcgataacgatctgcgcttcctcggacaattccgctag

SEQ ID NO: 14574 - DNA, 657 bp, Pseudomonas aeruginosa
ctgcctgtcgctcgccggcctggcccgcgaagtcagcgccatctacgacgtaccgctggcgccggtggcggtggacgcggtcgccgcgcagcacgacgagacccgtccggtcgagctcgccgcgccggctgcctgcccgcgctacctcggccgggtgatccgcaacgtcgacctgagccggccgaccccgttgtggatggtcgagcgcctgcgccgttccgacattcgcagtatcgatccggtggtcgacgtcaccaactacgtgatgatcgaactgggccagccgatgcatgccttcgaccttgccgagatcaacggcggcgtgcgcgtgcgcatggccgaggacggcgagaagctggtcctgctcgacggccaggaaatcaccctgcgcgccgacaccctggtgatcgccgaccaccagcgcgccctggccatcgccggggtgatgggcggcgagcacagcggcgtcagcgacagcactcgcgacctgttcctcgaagccgcgttcttcgacaccatcgccctggccggcaaggcccgctcctatggcctgcacaccgactcctcgcatcgcttcgagcgcggcgtcgacagccagttggcgcgcaaggccatggagcgcgcgacgcgcctgatcctcgacatcgtcggcggtga

SEQ ID NO: 14575 - DNA, 663 bp, Pseudomonas aeruginosa
accggggccgatcgtcgagcaggtcagcgaagcgcacctgccgaaggtcgcgccgatcaccctgcgcgccgagcgcgtgacccagatgctcggcatgccgctggacgccgccgagatcgtgcgcctgctgcaagccctggaactaacggtggtagccgacggggaagggcagtggtcggtcggcgtaccgagccatcgcttcgacatttccctggaagtcgacctgatcgaggaactggcccgtctctacggctacaaccgcctgccggtgcgctacccgcaggcgcgcctggcgccgaacaacaagccggaagcgcgcgccgcgctgccgctgctgcggcgcctgctggtcgcccgcggctatcaggaagcgatcaccttcagcttcatcgatccggccctgttcgaactgttcgatccgggcacccagccgctgaccctggccaacccgatctccgccgacatggcggcgatgcgttccagcctctggccgggcctggtcaaggcgctgcagcacaacctcaaccgccagcagtcgcgggtccgcctgttcgaaagcggcctgcgcttcgtcggtcaactggaaggcctgaagcaggaagccatgctcgccggcgccatctgcggcaagcgcctgccggaaggctgggccaacggccgtga

SEQ ID NO: 14576 - DNA, 2454 bp, Pseudomonas aeruginosa
agctctttgggggttgtcatggacggggcgcagtattctgagcgcgacatctgcacgaagctcataactccggccatacaaaaagcaggctggctgcagcatcagtttcgtgaggaagtaagtctcactgacggtcgtgtaatcgtgcgagggaagctggcgacccgagtaaagaatcctgacgccaaaggtggccctaaacgtgcggactttgttctctatgcccgtccgaacctacctattgcggtgattgaggccaagcaagccaggttttccgttgggcatggaatgcagcaggctctggcttatgcggagatgttggatgctccatttgctattagtagcaatggtgaaggattcctctttcatgaccgcactggcttaacgcagcctatcgagcgtgagctctcgctcaccgagttcccatcactagacgatctgtggccgctttaccagcaatggaaggggctcgtcacagacactgtggtcaaactcgtcgagcagcctttttactccgacggaagcggcaaggagccgcgctattaccagcgcgtcgccatcaaccgttccatcgaggccatcgccaaaggccagcagcgggtgttgttggtcatggccaccggcaccggcaaaacctacacggcattccagatcatttggcggctgtggaaggctaaggccaagaagcgcattctgtttttggccgaccgcaacatccttgtcgaccagactatgcagcaggatttcgccccttttggtgaggtgatgcacaaggtcactaatcgcgaggtcaagaagaactacgaaatctatctggcgctctatcaggctgtaactgggcgtgaggagtggaaacagatctatcgtcagttcccggccgatttcttcgatctggtggtcatcgatgaatgccatcgcggaagtgctgctgatgactctgcctggcgggacgtgctcgactacttcagcagtgctacccacctgggtctgaccgccacacccaaggaaacgaaggaagtcagcaacatcacctactttggtgaccctgtttatacgtattcgctcaagcagggcatcgaggatggtttcctcgcgccttataaggtcatccgcattgctaccgatgccgacgccgtgggctacacccccgagaagggcaaggtcgacaagctcggccaaacggtggaacagcgccaatacaacaccaaggatttcgaccgcaatctggtgctagaaaagcgcactaggctcgtggccagcaaagtgtgggaatacctcaaagctactgacccaatggctaaaaccatcgtgttttgcgacgatcaggatcacgccgagcggatgcggcaagagctggtcaagctcatacccgctgctgctagcaaccgtcgttacgtgatgcgcatcactggtgacgacaacgaaggcaaggctcagctttcctacttcatcgacaacgacgagctttacccggtcatcgccaccacctccaagctgctcaccaccggagtggatgccaaaacctgcaagctcatcgtgctggaccagaacatcaactcgatgaccgagttcaagcagatcatcggtcgcggcacccgcctgcgcgaggactaccagaagctctacttcaccatcatggatttcaagggcgccacgcgtttgtttgctgaccctgatttcgacggcgagcccgtgatgatctacgagcccaaacctgaagagccggtagtgccgccagaaaccatcgaggcactggcaataggcgagcaggagctgccaccctatgtccccgatgccactggcggcgctgaagtcttccctagtggcaataccggtggaacgagcggcgaaggtcgcgttaagtatgtgatcgacgatgtgagcgtgcgtgtcgcggtagagcgttcgcaatacctcgacgccgacggcaaactcatcaccgaggattaccgcgttctgctcaaggacgatatcaggaaagcactgcaggctgagttcggcacgctcaccgatttcctgcgccgctggaacagtgctgagcgcaagcaagctgtgcttaaagaactggccgatcacggcgttccactcgaaatcctgcagcaaaccgtgaccaacggtagcgagctggatgtattcgatctggtcgcccacgtggctttcgaccagaagccgctcacccgccgcgagcgcgccaacaacgtcaagaggcgtgatgtgttcggcaagtacggcgagcaggcccgcgccgtgctcgaagccctgctggataaatttgccgatcacggcgtgcaggacatcgaagacgccaaggtgctggagctaccgccgtttgaccagttcggcagcaaaactcagatacgccgcggcatcttcggcagcgtcgagcaatacacgcaggccgtgcaagagcttgaacaagcgctctacgaccagaacgaactgaaacaagcctga

SEQ ID NO: 14577 - DNA, 1125 bp, Pseudomonas aeruginosa
gctatcggctgttgctcgttggtgcgtactttttcggaacgatccgcttttatccaagctagtaagctaggcaaagaagttttttgtacgtatgaatattgccgtcgatatggtgatctgataggggcgcaaatgactcgtttgtggatggtgcgtggtgaatcaggaagtctttacgatgcctttcgcgagcgtgaagtggcggcagtcggctggagtcagttagcacctcatgcaacgcctggtattgggcgtaaagagctcactgctaagtatcaagagcttgagccccagcttaaaaagggctcggtggttgccggtgcttcgcaagtttggcgcttcgtgaacgaggtcgcggtcggtgattgggttgtaacttactcgccagctaatcgtttgtatcttgttggtaaggtagcaggggagccggagcatcatccggaatgggccgagcaaggcatggctctgacgcgcaaggttcagtggcagcgacaagagctccctcgcgataacttaggtaccagcaccaagaatagtttgggctcgactttgaccttgttcgaagtaccttccgatgccgctgctgaagtgtttgaggcgttgaaaggcaagccagtaacgccgaaggaagatgaggccgaggaaagtattgctgacccgctggctgatgttgaagctcaggcactagagcgtatcaaggatcgtgtaagcgagctggattgggatgacatgcagcagctagtagcaggaattcttcgtgctatgggctacaagacccaagtctcgccacctggctctgatcgaggcaaggacatcgttgcctcgcctgacggcttcggtttcgagcatccacgtattgtcgtagaggttaaacaccgcaaagggcagatgggtagccaggagattcgcagctttctgggtggccgacataaggatgatcgaggcctctatgtcagtaccgggggcttcagcaaagatgcgcagtacgaggctgacagggcctctatccctttggccatgtggaccttagatcacgtagtgcgtgcgttgatcgaacactatgacgcaactgatgctgagaccaagcgcattgtgccgttgaagcgattgtattggcctgcgtga

SEQ ID NO: 14578 - DNA, 243 bp, Pseudomonas aeruginosa
cgcatctgctttgcgcagattgtcggcggcttcaccatcgctttgagttgcagcaagcaaatccgtccctacatggtttgcggatcgcggcaaccgcggcatggctcgccattcactagcgcgctgatgaatctggtgtgcgatagcatcgaccagcgtctggccaggggcatcggcgaggaggaaaaccttatttttgctgttggcgaagtggatctgactttcgctatcgccgtgttttag

SEQ ID NO: 14579 - DNA, 999 bp, Pseudomonas aeruginosa
tttttcctgcttcagctgctgctggcgagttcgccaacttgcagcaaattctgccggggtgagattgccaatcgcgctgtgcggtcggtgttcgttgtaatcccgccgccaggcctcgatgcggattctcgcttcggccagcgaacagaaccagtgctcattgaggcattcgtcccggaacttaccgttgaacgactcgatgaaggcattctgcgtgggcttaccaggctgaatcagcttcagcttgatgtcgcgctgataggcccattgatcgagtgccttgccggtgaactcgggcccctggtcggtgcggatcgctttcgggtagccgcgaaaccgcgccatctcgtccagcgcccgtgtgacacgaaagccgctgataccgtgctccaccaggatgccgaccgactccttggtgaagtcatcgaccaccgtcaggcatttgatccgccgcccggtgctcagtgcatcgaagacgaagtccatcgaccagacctggtttggtgcgctcggcaaactcagacgttcgcgctccaccgcgacgccatggcggcggcgccgccgtttcaccatcaagccggcagcgcggtacaggcgatagatccgcttgtggttgacctgcacgccagcacgccgcagcaggaagtgcaggcggcgatagccaaagcgccggcgctcttgggccagttccaccagttgggcttgcagctcggtgttttgcacactggctcgcggctggtagcgcaacaccgagcgggacagcccgatcaactgacaggcacgacgctcggagatgccggttcgcgcctgcatctcctgcaccgcctcccgccgtgctgtcgggcttacccttttccccgggcgaccactttcagcgactcgatgtcgaggtgggcctcggcgagcaacttcttcaatcggctgttttccagttcaagatccttcaaccgtttggcgtccgccacggtcataccgccaaacttggcccgccaggtgtag

SEQ ID NO: 14580 - DNA, 1245 bp, Pseudomonas aeruginosa
ccgaggctggcgaggccctggagcacggcctggcggcgggcgagggcggcctgttgctggaggtgggcggtgaggatggcgttgcatcgctcggtgagttcggcgagttgctgcggatctctgtcgggctggcaggcggcggcgcgctggagcagttcggcgtgttcggcggcgccgagggcggcgacttcgctggcgaggtcttgcaggtgttccaggcgctggcgttgctgctggtgttcgcgggcggcctgggcgaggtcgaggaccaggctgtcgagcagcaggttgcggcgctccgggcgctgttcggcttcggcgcgtgccagtcgctcgaggaacgcttgggcgctggcctcgccttgcagcagttgcagttcggcgatgtgccggtcgatgcgcgccaggcgctgttcgcgcggggcgtcctgttgctggcgggcgcgccactgttccagggtgatgggcgtttcgtcggtcttcaggcgctgggcgagttcgtgctgggcttcgctgaggcgttcctcggcgggggcgctggcgagggcggcaaaaccttgggcgagcagggcttccgcgtcgtcgcggagggcgccgtcggccagcgcttgcagggtttgccggactgccgcgctggcggcatcgggcttggcgtcgagggcctggagcagggcgctggcgttttcctggaggcggcggtgttgctggcgtgattccgcggcctggcggatggcgcgctcttcgcgttcggcgaggtcgcgcttgaggaattcgctttcgatcttcacctgtagttgcacgtccagccagcgttcctgttcgagccagggcgtgcaggctggcgcggcgggcgtgggcggcggcgcgctcggcgtcgctgagctgggcgagccggctggcctggttttcccagcgcgcgagggccttgtccaggcgttgcaggtcgcgctcgcaggtggcgatggcttcttcccgggtgacgattcttacaactttcggtccgctcattgggaggcctccgctgctgccgtgggatgggtttccgcgctgggcgccagggccttctcgatggcggcgcgcagccgtgcgcgttcgttgtcgccgtcgtggtaccagccctgggaggaaacccggtggaggtgcgggatcgcccgccgcagcaccgagggtcgccagatttcccgggcgcgggcgcgttccagcagcgggtggcagggggcgtcgcattcgatgccgatggcgtag

SEQ ID NO: 14581 - DNA, 819 bp, Pseudomonas aeruginosa
gcgactagttgcggtagcgcctcgcgcaggcggccgagggccggcaggttgctctggttgccggcgatggcgcggtgcagctgttccagcagttcgtcgccgagccagtcggcgagcaccttcagtttgtccaggctgagctggcgtgcggcctggcggatcagcgcggcgtcgaggtcgccgagcagcgcttcgaagcgctgtttctcgccggtgaggatcaccgcgtcgagctgctcggcgcgcggcgcttgggccaggccacgagccaggacctggatctcgcgcagctgctggctggcgtggccggccaggccggtcagttccggaccggcatcggtggcgactgtcgccagccccaggctctgttgcagcgccgccagttgccggcgcagcggccgccactggcgctccaggtcgcaggcgccgaggagggcggccaggcggctgtcgtcgtcggcctcgccgtgctcgcgcaggaagcgccgcaggcggccgcgccgcagcaggcgcagcgggttgagccgagccagccaggtgcgtgcctcgagcacctggcgggcgtgggcctggaagcgttcgaggttgttctcttcgagcatggcgagggccggcgacagcagcggcgcatgccgttcgaggtcgagctggcgcagttgccgttcgatctgctcggcctccgccagcaggccgtcgccacggctcggctgccctggcgtggcgtcgcggaacagcggcagccagtgggccaggcgctggcgctgctcctcgcgcaaattcagcagggtaccgacctggcttgccagccaggcgcggtag

SEQ ID NO: 14582 - DNA, 732 bp, Pseudomonas aeruginosa
aggccgtcgatgccggtgtcacgcttgtacagcgagctttgccgggacagcgcgttgagccgcacttccagttgcgggttggcgaggaagctgtccgggtcgaggctcaccgcgcgggcgttgcgttgcagcagatggtcgagcagggcggcggcggggcgtcgcgcgctgtgcagttcgttgaggtcgatgcgtggggtgctcttgccgatgctcatgcgcaccagcggcccgcgcatcaccgcggcgaccactttcttctcgaagaaatcgaggatctgcgacacgtactgctgcttctgcggttccagccactgttccggcgggatcgccagcagcaccaggaccctcgccaacggcatgcgccgctccaggcggaactgctcggcccattcgtcgaccctgggcacgccgctgcgggcgaagccgctgatgcgttcgtcgacgcggcggtacagctcctgccgcgagtgctgcaacaggccgcgcgcggtctccgcgtcgaacaggtgcacatcggcgtcgcgggccaggccggcggcttcctcgacgatcgcctcggcggcacggaactggccgatgttggcgctgagcaggacgatcaggtcttcctcggcgatcacccggcgctcggccagggccagcaggccggggtgctcggtgtccggcaggaggcgctggcgctcctgccactgcgcggcgaggcgcgcccgcgaggtcgacagcaggtag

SEQ ID NO: 14583 - DNA, 624 bp, Pseudomonas aeruginosa
ccctccagcggatgctccagcagccagccgggggtgacgatctcgccgcgctggatcagcgggatttccgggttcagcagcttgagcgccagcatcagccggaagtcgtcctccagcccctcgtgctgggccacctggcgcaggccggcgagcagcctgggcgacaggccgatgtgctcggcccaggtgacgatcgccccgcgcagcaggtggtcgagggcctccgcccagtgctcggcctgggccgcggccagggcgaagaccgtcggcttgcggaagcgccgtgcgccgagggcgatgctggcgccttcggcgtcgtccttttcgctgtccgccgaggccggcgcgtccaccgcctcgccgttcagccaggcctgtacctgcggccactgccagcgctggtggcggtcgcgtgcaagcaggccgcgcagcagcaggtgcaactgcgggtcgaggtcgtcgggcagcgccacgccgttggccagcacgtggatcaggaaggcgttggcgttgactccttcgaagcaggagccgcgggtcaactgctccagcaggatcatgcccaggctccaccagtcggaagccgccgccacgccgccggcgatcgcctcgggggccatgtag

SEQ ID NO: 14584 - DNA, 1017 bp, Pseudomonas aeruginosa
ggtggtttcacggccgggcgacgaactcgcctccatcgacgggttcgccaggccgcatgggcgctaccgccggtcgcgttttccttgtccaggcggcgcaacgcaggcggctttctactttacacaggggacggcggccgcagggtggcgccgttgcctgcatccacaccgatcgggagaagcgacatgggttacgtgacaacgaaggatggcgtcgaactcttctacaaggactgggggccgcgcgacgcccaggtgatctacttccatcatggctggccactgagttccgacgactgggatgcgcagatgctgttcttcctcgccgagggctttcgcgtagtggcccacgatcgccgtggccacggtcgctccagccaggtctgggacggccatgacatggaccactacgccgacgacgtggcggcggtggttgagcgcctcggggtgcgcggggcgatccatgtcggccattccaccggcggcggcgaggtcgtccactacatcgcccgctatcccgacgacccggtgccgaaggcggcgatcatcagcgcggtaccgccgctgatggtgaagaccgagggcaatccgggcggcctgccgaagagcgtcttcgacgatctccaggcgcagctcgcggccaatcgcgcgcagttctaccaggacattcccgccggcccgttctatggctacaaccgtcccggggcgcagccctcggaagggatcgtccgcaactggtggcggcagggcatgatgggcggcgccaaggcccactacgatgggatcgtggccttttcccagaccgacttcagcgatgacctgaagcgcatcgacatcccggtgctggtgatgcatggcgacgacgaccagatcgtgccctacgagaattccggcgtactctcggcgaagctgctgcgcaacggcacgctgaagatctatccggggttcccgcacggcatgccgaccacccaggccgaggtgatcaacgccgacctgctggccttcatccgcggctga

SEQ ID NO: 14585 - DNA, 1245 bp, Pseudomonas aeruginosa
ggtaggcccatgaacctgttcgacacgctgacgcttcccaacggctcgaccattcccaatcgcctcgccaaggccgccatggaggagaacatggccgatgccgcgcaggccccctccgaacgcctgatgcgcctctaccaggcctgggccgacggcggcgccgggctgctgatcagcggtaacgtgatggtcgacagccgtgccatgaccggccccggcggggtggtcctggaaaacgacgcgcaactggagaaattccgccgctgggcgcgcatcgggcgttccgccggcgcgcagttctggttgcagatcaaccatcccggtcggcagatgcaggccaatctcggccagcaggcctgggcaccctcggcggtgccgctggaactgggcgggatgtccaggcacttcgctacgccgaaggcgatggacgaggcgatgatcgccgaggtgatccagcggttcgcccgcagcgccggcctggccgagcgggccggcttcagcggggtggagatccatgccgcccacggttacctgctcagccagttcctctcgccgctgagcaaccgccgcagcgacgcctggggcggctccctggagaatcgcgcgcgcctgctgctggagatcgtccgggcggtgcgcgccgaggttgcccctggcttcgcggtggcggtgaagctgaattccgccgatttccagcgcggcggcttcagcgccgacgatgcccgcgaggtggtacggatgctcgatggcctgggcgtcgacctggtcgagctgtcgggcggcagctacgaggcgccggccatgcagggcgaagcgcgcgacgggcggaccctggcccgcgaggcctacttcgtcgagttcgcccgcgacatccgcgcggcggcgcggatgccggtaatggtcacgggcggcatccgccggcggccggtggccgagcaggtgctggccagcggggtggacatggttggcatcggcacggcgctggcgatcgagccgaacctgccgcgcgactggcgcgccggcaaggactcggcgccgcagttgcggccgataacctggaagaacaaacccctggcatcgctggcgaacatggccgcggtgaagttccagctgcgcaagctgagccggggcagggcgaccaacccacgggtgtcgccgctgtgcgcgttgctcgcgcagcaggccggcgcgctcctgcagacccgccgttaccggcggctcatgcgttcgcgcgccgaagcctga

SEQ ID NO: 14586 - DNA, 1458 bp, Pseudomonas aeruginosa
aagcagtccacgggacagacttccacgcagtcggtgtgtttgcagcggatgcattcttccagcacgacgaaggtcatgatcgtcctccctggctcaggcgttcgtagcggcgggcgtcgccagccgttccaggcgcgccggcacgtacttgtgccagggcgtgccggcgaggaagtcgcgctgggtgcagtcggtcacctcgttgggcgccacgccccggcgcaccacctcgccctcggcgttgcggtagtccaggccctggccgttgggcagggagatattgcccggctgcatcatgtcgctgatctccacttccgcctcgacctcgccgcggcgggtcaccacgcgcagcacctcgccgtcggcgcagcccagcgcctcggcgtcctgcgggctgatgcgcagggtgccgtagcgcccgcggcggtgccagccggtgtcgcgcacggcggtattgctggtgtcgctgcgccgctcgccggcggcgaggatgaacgggtaggccggatcgtggggtggcgcgctgtgggcgagcttggccagttccggcaacagttcggggatgtgcaggttgatccgctgttcgggacgggcgacggcctgccagctttcggcgtaggtggtttcggcgaagaccaccccggacgggttgtcgagcatggcctggaacaggcggtcggcggccagcggcggcaacccgtcgaagccggcgcgggcagcggtcttgcggttgttcagcacgtgcagttggcagatgccccagatcgccgcggccgcttccatgccggcgggcagggtcgggccgagggtacggtagagcaggaccggcgcgtatttcatgaccttggggcgggtcgccgcggcggcgaggaaagccgccgagaatgccttgcgcccgagcttcagggccaggcgcaacggccggtagtctttctcgccgagcacgcccatggcttccagcaggcgggcgtggatctccgcttccggcagggtgccggggcgcgccgggaacagcggcgcgcgcaggtggaaggcgttgcgcgggaattccaggttgaagaaggtcgcctcggccttttcgaactggctcgccgccggcagcacgtagtcggcgtggcgcgcggtctcggtcatggccacgtcgatcaccaccgacaactccagggcgcgcatggcttcgcgcatgcgctggctatcggccagcgaatgcagcgggttgccggtctccaccagcatggcgcgatagcgcttgggatggtcggtgaggatttcctctggaatcacgttgcagggaatcaggccgatgatgatcttggcattggccaccgggctgcgcttctcgacgcgtggcgcgcccctcttgcccatcgaggtatcgcccttgctcgccttggacagcgagaggaagggcacgaaggcgttgctggtgccggggcgcccgtaatggccggtgagtaa

SEQ ID NO: 14587 - DNA, 402 bp, Pseudomonas aeruginosa
tcctgcgcaactgctttctcggcatgcgccgcttcgatgagtttcaggccagcctcggggtcaccccgccaggtactggtcgaccgcctgagccggctggtggaggcgggcgcgctgaaggaaggtgccttaccagaagcgaccgccgcgctacgaataccgcctcaccgacatgggccaggacctggcatccggtgctgctggccctggccaattggggcgaccgctggctcgacgagggccgcggcggctccggtggagtatgtgcacaaggcctgtggccacaagttccggccgaccatggtctgcccggagtgcggcgagccggtgggggcgcgcgatgtgacggcggtgccggggccggggttcgcggcgatggctggcaagctcgcgcagaactga

SEQ ID NO: 14588 - DNA, 480 bp, Pseudomonas aeruginosa
gccgccgcgccagccgctgagtgcgtcggccctttccgaggaaagggctgcggggcggcacgccagacagcggaggaacatcccatgctcagcggaagttgcctgtgcggcgcggtaggctatgaaatcgacgcgcccatcgagtcggccagtcattgtcattgcagccagtgccgcaaggcccacggcgcggcgttcgccacctacggcaaggtgcgccgcgaggcgttccgctatgtcgccggagcggacgcggtggccgaataccactcgtcgccaggcgtcacccgtaccttctgccgccactgcggatcgaacctgcagtggcttggcggcaacgaggacccgacgtacacctctattgccctcggcaccctcgactcgccgctgccatcggtagcgcagcggcacatctacgtgggttcgaaagccgactggtacgtcatcgccgacgacctgccgcaggaacaccaatactga

SEQ ID NO: 14589 - DNA, 1230 bp, Pseudomonas aeruginosa
ccggcgctcgcgcgccgggatcaacggacaacagacgaggtcgcagccatgctgctcaacctgttcaacgaaatgcgcgcagccaaggtgccggtgtcggtgcgcgagctgctcgacctgatcgatgccctgaagcaccgcgtggtgttcgccgacatggacgagttctactacctggcgcgcaccatcatggtcaaggacgagcgccacttcgacaagttcgaccgggccttcggcgcctacttcaagggcctggagaagctcgacgaccacctcaagtcgctgatccccgaggaatggctgcgcaaggagttcgagcgcctgctgaccgacgaggaaaaggcgcagatccagtccctcggcggcctggacaagctgatcgaggagttcaagaaacgcctcgaggaacagaaggagcgccatgccggcggtaacaagtggatcggtaccggcggtaccagtccgttcggctccggcggtttcaacccggagggcatccgcgtcggcgacgccggcaagcgccagggcaaggcggccaaggtctgggaccagcgcgaatacaagaacctcgacgaccaggtcgaactgggtacgcgcaacatcaagatcgccctgcggcgcctgcgcaagttcgcccgcgagggcgcggcggaggagctggacatcgacggcaccatcgaccacaccgcgaaggacgccgggctgctcaacatccagatgcgcccggagcggcgcaacacggtgaagctgttgctgctgctggacatcggcggctcgatggacgcccacgtcaaggtctgcgaggagctgttctcggcctgcaagaccgagttcaagcacctggagtatttctacttccacaacttcatctacgagtcggtgtggaagaacaacctgcgccgcagcagcgaacgcaccgccaccttcgacctgctgcacaagtacggtccggactacaaggtggtgttcgtcggcgacgcggcgatggcgccctacgaaatcacccaggccggcggcagcgtcgagcactggaacgaggaagccggttacgtctggatgcagcgcttcatggagaagtacaagaagctcatctggatcaacccctatccgaaggacacctggaactacacggcgtccaccggcctggtccgcgaactggtcaaggaacagatgtatccgttgaccctgagcggcctggaggagggcatgcgcttcctctcgcgcggttga

SEQ ID NO: 14590 - DNA, 1584 bp, Pseudomonas aeruginosa
cagccgtgggcggatccgccaggggcaggcgacgaccgtcgcccgggaggctcaaggcctggccgcgccgtgcaggtaatggcggatgcgcacctccacgccggcgctctggaagcgccgggcggcggcctcgacccgcaactcgccgcgggtcacccgctggtggtggcgcaggtgttccagccaggattcgtcgatgaaaaactccagccacaggcgacggttgccgctgtcctggaccagcccccaggacaccgcgccgttgcgccgacgcatggcgcgcacctcgaccatcgccgcctggaatgccgcggcgtcctgcgggtcgatgtcgtactcgagggtgaccatcaccgggccgcgttcctggtccacctcttcgtcgaccagtggtgccggccagtgcagcgacggcgcgaggtcctcggcctcggtgaccggcagccggcagcgcagcgacgcgaacaggccgagcagcagcgcggcgctggcgcagagcagggcgaaggtgatcgacaggtggctggcgaccagaccccacagggcgccgccggcggccatgctgccgaagaacaccaggatgtagaccgccagcgcgcgggcgcggacccaggccggcacggaggtctgcgcggcgacctgcaggctggagagcacggcgatccatgccgcgccgctgagcagcatcaccggcaccagcaaatagaggttgcgcagcagcgccagggccagcagcaccagtgcgtagagcacgctggagagcagcatcaggcggtcgctgccgaggcgttcgcgcaggcgcggcaggaacgcggcgccgagcaccgcgccgacgccgacgctgcccagcagcaggccgaagtccatggcgttgccatgcagttcgccgcgcacgatcaggggcagcagcgacatgccggcgctggcgccgaggaagaacgccaccgcgcgcaccagcaccgattgcagtggcctcgagctgcggctgtagcgccagccggcgcgcagggcgccgaacaggcgttccgccggcagcaccgagggcacggcctcgcgtttccaggccagcagcacggcgatcaccgcgaagaaggagagggcgttgagggcgaaggtcagccaggggccgaccaggctcaccagcaccccggcgatggccggtccgaccgcccgcgccaggttgaccccgacactggacagcgccaccgccgccggcagttcgtccttgcccaccagttccggagtggtggcgctccaggccggcatcatcagcgcggtgccgatgcccatgcacagggtcaggccgagcagcagccagacgctggtcaactggagcagggtgaggctggccagcagggtggccaccaaggccatccacaattgcacgccgagcaggtagcggcgcttgtcgacgatatcggcgagggcgccggccggcagggccaggaagaacatcggcagcgatccggcgacctgtaccagggccacgttcagcgggctggcggagagcgaggtcatcagccagccggcgcccacctcatgcatccaggtgccgatgttcgaggtgatgctggccagccatag

SEQ ID NO: 14591 - DNA, 768 bp, Pseudomonas aeruginosa
tctggccggccacgggaaattatctgttggcctgcgtgctgttgtgcgcaacagctggaattcatcgttcgttgtcaggaaacaatcatgagccactatctcgaagttctaactccgcagaacagccagatcatcttcatcgaccagcagccacagatggcattcggcgtacagtccatcgatcgccagacgctgaagaacaacgtagtgggcctggccaaggcggcgaaggtattcgacatcccggtcaccatcaccacggtggaaaccgacagcttctccggcccgacctatccggagctgctggcggtgttccccgagcagaagatcctcgaacgcacctcgatgaactcctgggacgaccagaacgtgcgcgactcgctggccgccgcgggccgcaagaaggtcgtggtcgccgggctgtggaccgaggtctgcaacaccaccttcgccctctgcgccatgctcgagggcggctacgagatctacatggtggccgatgcctcgggcggcacctccagcgacgcccacaagtacgccatggaccgcatggtccaggccggcgtggtaccggtgacctggcagcaggtcctgctggagtggcagcgcgactgggcccgccgggatacctacgacgccgtgatggccatcgccaaggagcattccggggcctacggcatgggcgtggactacgcctacaccatggtgcacaaggcgcccgagcgggtgacccacggcgaacgcatcggcccgaatccggccaagtga

SEQ ID NO: 14592 - DNA, 1008 bp, Pseudomonas aeruginosa
atttccccggaacggctccctcggattaatctctgggggagctttcgtgcgtcgtttttcgcgtcgagagaaaagtgtcacgagatcatcaggcgcatggaatcagggggagtcatgactgttgccatagacagaacaaagggcgaccaatccacgccagggaacatcataaggggagaagggtacgccttgattcgcaatagtgaggcgactcccgatccggacaaggtgatccatattccttgtgccgattcgttttccgtcatcgtgcagttgcgcgatttcaattcccatcgtctctggaatggaaacaaactggttttcgatggcggacatccacggaaaagtatctccatcgcctatcttggcgatgaaataaagtgccagcaccggacaacttacgacaatgtccgcttcatgttgccgcgcgcttcgataaaggagtttctctacgaagaagggcaacgcgcgtccgccgagccggagcggatcatcggtgtcgacgatccggtggtctatcacctggcgctggcgctgctgcccagcttcgccagggcgggcgagcgcaacgaactgttcatcgagcaggtcatgctggcgctgttgacccacgttcaggatcgcttcgcttcgacccaggtcccggtctgcaccggcaagggcctggcgccctggcaattgcgcagggccaaggagctgatcgccgggcatctggccgagggcgtgtcggtggcgcgcctggccgaggagtgcgggctctcgcgcagctatttcaccaaggccttcaagtgcagcaccggtgtttcgccccacgaatggctgatgcgcatgcgcgtcgaccgggccaaggagctgatgctgggcagcgacgaaccgctttcgcagatcggcgtcgcctgcggcttttccgaccagccgcatttctcgcggatctttctccggctggccggcgcctcgccctcgacctggcgtcgggtcaagcggcagcgcaccgacgcagcgctgtga

SEQ ID NO: 14593 - DNA, 684 bp, Pseudomonas aeruginosa
ccaccgcctggttcgccaagcgcgtcgacgaacgctaccagcgctgcatggcgcgcgtgcggaaacgctgagtccatcgtcgcgcgggtcgaacctggcgccgccgcgggagtctgccgtcctgtcagccaagctcatggagaagcagcgtatgaagacccgatacagcgccgaggcaccggcgcgcgacgaactggaccggctcgccggtccgacgctggtggagttcggtaccgactggtgcggccattgccaggccgcccagccgctgctggcggaagtattcagcgactacccggaggtcggccacctgaaggtcgaggacggtcccgggcgccgcctggggcgctcgttccaggtcaagctgtggccgaccttcgtctttcttcgcgacggccgggaggtggcgcgggtggtccgccccggcagcgccagcgtgctggaagaagcgttcgagagcctggtcggcgagggctgaggacccggcccgcgggccgggcggcgttcaggccggcatcgcgtgatccacctgttcgcggatctcctggtagcgcagttccatcagcttgcgctgctcgcgccgggccagggcctgggcgtagcggcgtttctcgatcgcggtctccggctccagcggacgcaccgccaccggccggcgctggtcgtccatcgccaccatggtga

SEQ ID NO: 14594 - DNA, 801 bp, Pseudomonas aeruginosa
cgtgcagcgcatggcggcgccgctgggcgaattgttcgccgcggtcggcgtgcgtttcgtgcagggcagcgcgcagcgcatcgacgtggccggcaagtgggtggagtaccgcgatgccgagggcacgctggcgcaactggactacgaccgcctggtgctggcggccggcagcggcgtgtggcgtccggcgagtgtcgtcggcatcgacgctgccttcgatgtcgaccagttggaagacgccctgcgcctagaggcacacctgcatgccctgcgcgacttgccggattcaccggcacgcaacaccgtggtggtcgccggcggcggcttcaccggcatcgagaccgccaccgagatgccggcgcgcctgcgggcgatcctcggcgagaaagcggcgctgcgagtgatcgtggtcgatcgcggcgccgccatcggcgcatcgatgggcgcggacctgagcggcttgatcgccgaggcctcggcggaactgggcgtggagtggtgcctggggcgttcggtggcggcggtggatgccgagggcgtgacgctcgacgacggccagcggatcgaggcgaagaccgtggtctggaccgtgggcgtgcgggccagcaccctgaccgggcagattccgggcgagcgcgatgcccagggtcgcctgcatgtcgaccgcaacctcaaggtgctcggtctcgacgatgtctacgccaccggcgacgtggcccgcgcggctaccgacgagctcggcaaccatgccctgatgacctgccagcacgccatcgccctgggtcgctcggccggcaataa

SEQ ID NO: 14595 - DNA, 420 bp, Pseudomonas aeruginosa
cgcaccgagttgcgcgagctgaccggcttgccgtcgaccaggatcagggtgttctccgggcccatgccgcggatgtcgatctgccggttgttgccacgctggccgctggagctgttgccggtcaggttgacccccggcatggtccggatgatctgcgacaggtcgttgctcggcggtcgcttggcgatgtcctcggcggtgatgatggaaacccccggcgcctgcttggtttcctcctgggcggtggcgaccacggtctgctcgcccagctcgatgacggagccgtcgccctggccggcggcgtgtacggcgttggcgagcaggcaactggacagcagcaggaagggaacggcgggaagggcgcgtgaggacatcggggatctccgggcaatgcagcgaaatgcaagagatcacaaatga

SEQ ID NO: 14596 - DNA, 618 bp, Pseudomonas aeruginosa
ccgtgccgtcctcgggcgagtgacggatggcgttgcgcaggaggttttccatggcctgggccaggctgtccaggtgtacctcgacgcgacagtcgacgcccaagcggcagggtagccgcgccgggtcccagccgctttcgaaacaggcgtcatcgcgcagcgcttcccacaccgacagcgccagcaccggctcggtgggcagttgcgggcgctcggtgtccatccaggcgaggtcgagggtgtcttccagcagtcgttgcatgtcgccgatttcgcgatccaggcgctggcgcaactgttccggcggtagctcgctgtcgtgggcgatgcgcaggcgcgccagcggcgtgcgcagttcgtgggacagggtgcgcagcagcaggcgctgctgggcgagactcaggcgcaggcgctcggccatgtgctccagggcctgggccagctcgcccagttcgtcgcggcgggccgccagcggtgcggcgaggggagtgctttccagttcgtcggcgcgcagggcgtcggcgcgatcgcgcaagcggttcagcggcaccaccaggtggcgatagagcagcaggccgagcagggcggccagcagggtcgggactatgccgtgggtga

SEQ ID NO: 14597 - DNA, 843 bp, Pseudomonas aeruginosa
aggtcaggtggctcgactcctcggcgcttagcggcgtgctgccgaggctttccaggtgcggtccgaccagcgccacccaggtatcttccttcgccgacagttccttgcggaagcgttcggcgcccgcggcaccctcgctgcgccaggcatcctccgcctgccgcgcgtagtccgccaggtagctgcggtcggccggggcgaggaagtaggtgctgcgctccaccgacaggccccaggtgtagatcagccaggtcagcagcaggcagaagccgacctgcagcagcgccagtttccataacagcgggtgcctgcgcatcaggggtgttccgtctccaccagcaggtagccctggccgcgtaccgcctggatctgcaggtgacggacggcgaccgcggcgagtttgcgccgcaggttgcagacgtgcacgtcgagaccgcggtcgaggcgcgtgtagctgcggtgcagcacgctccggtagaggaacggcttgctcagcgcctcgccagcgtgttcgcggagcgtcgccaggaggcggtactcggatggcgtcagccccgccggaaggccctggtggagcacatcctgggcctggtcgtcgaacaccagccgggtatcccgccgctgcgccgacggcaggcggtccagtcgtacgcggcgcagcagggcgtcggtgcgggcatccagctcggccaggctgaacggcttcggcaggtagtcgtcggcgccgcgggtgaagccgctgatgcgatcctgttcggcgcccagggccgacatcagcatcaccggcgtggcctgctcgcggcgcagcgactccagcagcgccaggccgtcgaggccgggtag

SEQ ID NO: 14598 - DNA, 870 bp, Pseudomonas aeruginosa
tggcgggggcggcgcgcagttcgagagcgagctggactgtatcgacgccggccaggctttccgccccttgccgtcgaccccggtgccggtggtgcgcggcccgcagaccgcggtggtggtcgggcccaagggcgaggagatctggaccgaccagtacggccgggtgaaggtgcatttccactgggaccgccacgaccagtccaacgagaacagctcctgctggatgcgcgtctcccaggcctgggcggggaagaactggggctcgatccagatcccgcggatcggccaggaagtgatcgtcagcttcctcgaaggcgacccggaccggccgatcatcaccgggcgggtctacaacgccgagcagacggtgccctacgagctgccggcgaacgctacccagagcggcaccaagagccgttcgagcaagggcggcacgccggccaacttcaacgagatccgcatggaggacaagaagggcgccgagcagttgttcatccatgccgagaggaaccaggacatcgaggtcgagaacgacgagacccactgggtcggccacgaccggaccaagaccatcgaccacgacgagacggtgcatgtgaagcacgatcgcaccgagaccgtggacaacaacgagaccatcaccgtgcatgccaaccgcagcaagacggtcgaccgcaacgagacggtcaggatcggcatgaacaagacggaaaccatcctcatggcctcgttgcagaacgtcggcatggggcgcatggaaaacgtcgggctcggctacagcctgaacgtcggcatgatgatgaacaccgtggtcgggctgaaccagagcacccaggtgatgaagaagaagaccttgtcggtgggcgatag

SEQ ID NO: 14599 - DNA, 423 bp, Pseudomonas aeruginosa
gcgaagacgcctgcgtgctggtcgacgcccagggccgccggatcggctttcctgcgctggctcccggtgcccagcattattccggcagcgaggagctgtggctgcgccgcggcggttcgagcggcggcgaagcgcaggcctggcgcgggcgctgggcggcggtgccggccgaactgcagacgcaggagggctccgtgctggtgctgtccggccacagctacctgcatttccagcgttgccccgacggtatctggcgcctgcaggccagcttcggccgcgccggctaccgcaccgagttccgctggagcggacgtggcctgctcaccggcgtgcgcgacagcgccgggcgcagctatgcgctggtctaccagcaagcctgcgagccgagcgagggcgacgacggcctgcgtctgttcggcgtga

SEQ ID NO: 14600 - DNA, 498 bp, Pseudomonas aeruginosa
cccgtaccttccgctacctgcgcgatgccaccgaggtcagcgacagcctcggccgcgtcgaacgctacgagttcgccggcgagggtgggcagcggcgctggaccgcgctggtcagggccgacggcagccgtagcgagttcgactacgacctgttcggccgcctggtcgccatgcgcgatccgctgggacgggagacgcggcgccggcgcgatggccaggggcggatgctcgaggaggagtcgccgggcaaggcgcgctatcgcaagcgcgtcgacgaagagaccgggctgctggtcgagctggaggacgcgatgcagcgccgctggaccttcgagcgcgacgaacggggcaatgcgacgacggtgcgcggcccggccggcagcacccgctacgcctacgaagacccgcgcctgcccgaccggccgacgcgaatcgtcgacccgcgcggcggcgagcggcgcctggagtggaaccgcttcggcctgttggccgcgttga

SEQ ID NO: 14601 - DNA, 627 bp, Pseudomonas aeruginosa
cctatggcccgggtcatctgcacggcgcgctggtcggtgcggtcgagctggccttcgagcgcgatgccctgcaccgtgaggtgcgtcgcgacgcccgccgcgacgggcaggatgacgcgttgttcacccaggagcgccagcacgcgccgctgggacgcctgcagcgcagccgcctgcgtctggccggcggtttcgactggcagcgcggctatcgctacgacggacttggacaactggtcggcatcgacgacaaccagtatccgtcggtgcgctacgaatacgacctcggcggtcgcctgctggccagccggcgcgctggcgcggcggccagcacctaccgatacgacgccgccggcaaccgcctggagggcgtcggcgagtacgcgcgcgaggacgctcgccaggcattcgccgagaacgaactgtaccgctccggtttcagtcgctccgaggtgcgcgcgaaccaggccggcgaaggcccggcgcgctgggccggcaaccgcgtggagaggatcgccggcaaccgctatcgcttcgatgcgctgggcaacctggtcgagcgtatcggcgccgacggcgagcgcctgcgcctggcctacgacggcgcgcagcgcctggtccatctga

SEQ ID NO: 14602 - DNA, 1872 bp, Pseudomonas aeruginosa
cgatcccggtggaaatggtcagggcgatccttttcgatgctccctatccgacccttggggtcttcagcgtttattgcgttgcgtctctgctggtctgttcatcgggcttcctctggttccgtcgggttcaggaaggttttgcagatgtcctctgaggccgtttccccgggcccgcagatgacggccgagtggataccgctggggcagcgtttgctcgaacgcgggttggtgagcggccaggaactcgagcgggcgctcgacctgcaacgccggcttggcggccgtctgggaggcattctcgtgcgttccggagccatctcggaaaataccctcatgcaggtgctggcggagcaactgcggttgccgctggtgggggacgacctgcggaagccgagcgaagagtccatcgccgcattcctgctcagtaccccgatcaataccgactggttcgtcgaagagcaactggtggtctgggaggagggcgaacaactgctgttcgcggcgcgtgaaccgttatctccttcgatacgcgaaaccctgggctatttctatccggagcgctcgattcaagcagtgctgtgccgctcccaggatctggacggctggttggagcactccctggacctggcccggcaaggtgcggatcggcacgcctacggcagcgaagacatccgctacctgcgggagctggcggaggaggcgccggtagtcgaactcgtcaacaacgtgatgagccaggccatggaaaagcgttcttcggatattcacatcgaaccccgggagttcgacttccgtatccgcttccgcgtcgacggcgtcctgcacgaccaactgagccttccccgcgagcgattcgcggcggtcgtctcgcggatcaagctgatctccgccatcgacatcgcggagcgacggttgccgcaggatggacgcatgagcatccgggtcagcggtacggagctcgacgtgcgggtctccaccttgccaggggtgcatggcgaatcggtggtcatgcgcctgttgccgaaggagcgcgaggggttgcgcctggaccggctcgggatgctcccggaccacttgcggaggatgcgtgcatgggtagcggaaccccacggcatcatcctggtgaccggccccaccggatcgggcaagtccaccacgctctatggcgcgctggaggaaatcaatgatggcgtgcgcaagctcatcagcgtggaagatcccgtggaataccaggtgcccaatatcacccaggtccaggtccatgccgacatcggcctgaccttcgctgccgccttgcgctcgatcctgcggcaggatcccgatgtgatcatgatcggggagatacgcgacctggagacggcggagatcgccgtacagtcctcgctcaccggtcacctggtgctttcgaccctgcataccaacgatgcggtgagcgccttcacgcgtttgatcgacatgggcgtggaacccttcctggtggcttcgccggtgcgcggtgtccaggcccagcgactggtgcgcaggttgtgcgcccactgcgcggaaccttgcgagccaacccttgctgcggccgatctggcagcgacccaggcggccaccgcgcggctgttcccggggcaggcagcgcaatggcgcgtggcgcgaggctgcggccgctgcgaaggtaccggctacagcggccgtgtgggcatctacgaactcgtcgatctgtcttccgagatgcgcgacctgatcgtgcagagagcttccctcgaacagatgcatcggcttgccgccagccagggacagcgcaatctgcgtgaagatggcttgatcaaggcctggttgggtatgaccagtcttgacgaggtgcatcgcgtgaccagcggctaa

SEQ ID NO: 14603 - DNA, 1233 bp, Pseudomonas aeruginosa
gcccatgaatttcatctaccaggccgtcgatcgcaagggcaggcgcgttcgtggcgaactctgcctcccaacgcgccaggatgcgctgcggcagttgcagcgccaggggctcaccccgctcagcctggaggtgaaacgccgcaacctgggctcgcgacgtcggctcaaggccgaggaattgaacatggccatccacgagctggccaccatgctcgcggcgggagtgagcatggccgacgcggtggaggctcaggagcgaggcgcgcgccacccgaagttgattaccgccctgcaggcgatggccaatggcctgcgccaggggcaatcctttcccgtggtgctggagagcgccggcctcgacttgccgcgctatgtatatcaactggtggcggccggcgagatgaccggaaacctcgcaggagccttgagggactgtgccacgcagatggaatacgaacggcgaacccgcgccgagttgcaaggggcgctgatctaccctgcgattctggtgctcagcggggtgctcgccgtggcgaccctgttcgtcttcgtcgttccgaaattcgccaatctcctgaacgagactgcccagctcccgtggcttgcctgggcagtgctgagcatcggggtatggagcaacgagagttccggcttgctggcgttcgccgtcctgctgcttgctggcggcatcgccgtggcgctgcgcaatccggcgctccgcgcccatgcgctcgaccagttggtgcgcctgcccgtagtcggggaatggttgatgcaggcggaaatagcgcaatggtcgaaggtgcttggaaccctgctgggaaatcgtgtgccgctggtggaggccctgctgctttccgccgctggcgtccgcattgcccggcagcgccggaccctggagcgagtcacccaggatgtgcgggccggcatcgccttgtcggcagcgttggaggagcgccaggcggtcacgtccatcggttcgagcctggtgcgggttggagaggcttccgggcagctcgcggagatgctgcagagcctggcgacgctctatggagaggccgggcaggcgcgaatgaaaaaggccctggtactgatcgagcctttggcgatcctgctgatcggctctgtgttcggcctgatcattaccggcgtggtactggcgattaccagcgccaacgacatggtgctttgaatgccgggtatcgatgccgcggctggttggatgagacgtga

SEQ ID NO: 14604 - DNA, 447 bp, Pseudomonas aeruginosa
agtggaaaccgtatgaacagagctgcacaacagggcttcaccctgctcgagatgattgtggtgttggtgattatcggcatgctgatggggctcgtcgggccgcgactgttcaatcaggccgacaaggcgaaggcgcagacggcggatacccaggtgaagatgctcaagggcgcgttgctcaccatgcgcctggacatcggccggctgccgaccgaagaagaaggcctggcgctactcaacacgccgccttccgatgaacgtctcggggctttctggcacgggccctacctagagggcggcgtaccgctggacccctggaaccggccttacctgtacagcgacaggccgagtgccgaacaacccttcactctctacagccagggcgcggatgggcagcccggtgggaaaggcctggatgccgatgtcggttacgcgcccaaacgttga

SEQ ID NO: 14605 - DNA, 609 bp, Pseudomonas aeruginosa
gagcggggcggttcccgagcagttgctgcgactgcccgatggctggacggttactgctcggccgccgatacgttacatggcaaacggagtttgcctgggcggaaagttgcaggtccatcatgggcgcgcgacacatacgctgctgcttcagccccctctctgcgcgcccgggacgatccgctgatgccggcgcggcaggaaggcttcacgctcctggaggcggtggttgcgctgacgctcctggcagtggtcggcggtgcgcttttcgcctggctcaacagtgcctttcggagcatgcagcgggtcgaggcggccgagctgcgcatcgagacggcccgggtggcgatggcctatctggagcgcatgaaccctgcgctcgaacccgcaggcagggcccggctggggcattaccggctggagtggcgaagttcgccgctgtccgcgtcgaaagcggcggtgggccgccatagcggcagtccgggcatttacgacgtgaccttgttcagggtcgtcgccagcatccgggccggcgatggaacgccgcagacgctgcaactggagcttcccgggtacgtggtcatcccagcgcgactgggtgatggaccatga

SEQ ID NO: 14606 - DNA, 1299 bp, Pseudomonas aeruginosa
tctatgtgcgaaggctggaggacagtcgctggcccctcctgcatctgcgcggcgaagctcgcttccgctatctggacggtcacggccagtggcaccgggactggccgccgagcgcgcaactggccgatacccttcccgaggcgatggcactggcggctcccgaggagcgcctgtttgtccttgtcgcggtcgtactgcccagagcgaggcccgccgaacatgatttctgatggcgcacgccgacatgcggcgtctgcccgctcgtctggcttcgttctggtcggagtggtctggttcctggccatcatgaccctgctggccagtgccgctgtactctgggtcgggcgctcgctggatgccacggaaaaccggcgcaaggtgctgcttcgtgagctggaggagcatgccttgctggcgcgggtccaatggctggtggctacccagcgctataccgtcgcgggcctgagcgtaccgggaaatgctggcgccgcgccgagcaaggtggacatggacacttcgatcctgcccattggcggggagctgcctctggatggccgggagttctgcatggccaatggctggtgcgttgcgctgctcgatcgctccgcgcgcctcagtctttccggcatcgatccgcgggtactgtccaggctgctggcggggttgggggttcccgccgagcaggtgcaggtcatggtcgcccaatggttcagctatctctatcccggcgccgctccacgactgggtagtgccgcgcaagccagcgacaggtcctctccgggccaggcccggcgccgtccgttgcgctcggtgatggaagtcttccggctggaggcctggcgcccctgggaagcgcatttgctcgacgccggttggcgcgatctggttgcggcggacgaggcggcgctgaacatcaacactgcggatgcccgaatcctgtctcttgcctggggactaccggaggacgctgtcggccgactgctgcaagcccgctggcagcgtccgttcacccggatgtcggacctgcatgacgtcctcgggggtcatgcgaggctggttcccgaggatggatgggcgcgcctggccagtccggtcctgtcgattcggctctacccgccaggagccgagcaggggacggaatacgaggtccgcttcaactcagagcaccgcctgctgccaccctggcagcttctctcgaagaggtccgtgaagataaatgatcgctactcgaatcctccgttgcatcccgatatcgcccccggggttcttgccgccccgcttgtggcaaggccgtggtaa

SEQ ID NO: 14607 - DNA, 1209 bp, Pseudomonas aeruginosa
ctgccttgtcctgagccatttctttcccagcccaccccagccagaacaatgggttcggttgctccgggggctggcgggaatacgcatcccggagagcctggttgccgagcctggagagtcactgggccgtccctgggccgttccggcggcggaagcaacgctgctgcgatgggagcgttggttgccgcatgggctcatagccaccctgttgctgggatgcggattcaatctgggggaaggtttgtcctggtggtgggccgagcgtgcgctgcgaacgcagtacgaccagctgagcgaccaggtctcgccgatcctcagcgcacgcaaccaggccttgcagaccaatcggatggccacggagctggggcgcgctttgcagcatcgctcgcaggtggcgctgctgggacaggtagcggaactgttgccgaaggacagtcggttgctcgcctggcgctatcgaggctccgagctggagttgcggattggcaccgacagtgtcgacccgcgtctctatgtgcggcgtttcatggaatcggggagtttcgaagatgtcagggtggaaccttcgcagagcgaggggctatcgctgagcctggtcctgcgtacgccgggggagggtgcctgatgtcggacttccagcgatcactgcagttccaggggcggaacctgcaacgacaatggcaggaaaaacctctcttgcgcatggccatctggagcctgtgcctgctgctggttgtgcatctggtcatgctcagcatggattggagggaggaacgaggggaggaatatcgtcgtctagccggggaatggctcaagctccaggacgtttcccggcagaccgcctggccggagcgggcgatgcaggcggagcaggtactgaaccttcagcgagagcgcttctggcaggcgccgaatgcgtcgcaggcgagggccgatgtgcaggcctggctgaccgagcgggttcgcctggcgggcgtccctgacgcggaagtgagcgtactgcttcctcgcggcttcgagaagcaagggacgatcgcgcgtatcgaggcccaggttcgcgggcagttgcagccagcctcgttcagtcggttgttgcaggatatagaagcggagcagcggcaagtatcggtggagtttctggaactgaacaatatgttgtcgcccatgctcaatctacaattgtcgttcctgttcgtagcggcctattga

SEQ ID NO: 14608 - DNA, 501 bp, Pseudomonas aeruginosa
agcagatggcgaagcgccaggggagagtcgggcgaatcaatcgccccgatattcgcaaccgctggtgcaagtttcgtggacgcggaccttggagagttccggcaacagcggcttgagttgttgccagatccagcggcagaggttttcgctggtggggttttccaggcctggaatatcgttcagataattgtggtcgagttgctcgtagatcggcttgaagatcgccttgatttccgcgaagtcgcggatccagccggtatgcggatcgacctcaccttcgatgtggatggcgacacggaacgagtggccgtgcaggcgcccgcatttgtggccttcggggacgtggggcaggcgatgggcggattcgaaggtgaattctttgaagagttccactgtagtgcgctctggatcggggttatcggacaaccggaatgggggcgccatggtagcaggtttgcgcgccggacccggtctgctccgaccgggcggtcgtttacctga

SEQ ID NO: 14609 - DNA, 297 bp, Pseudomonas aeruginosa
ccgtggcggcggcgaggctggcgaaggcctccagggtatccaggtcggcgctggcgaagcgcgacggatcgagggtatccagggtcagcaagccccagggctggtcgtcgaggtacagcggacagcccaggcaatcatggatttccaggtggccgtggaggccttccaccagaccgtcgtagggatcgggcaggccgcagtcggcggggaagcgggtcggcccgcggcgctccaggagggcctcgaggcgcggatgttcgccgacccggaagcgccggccgagggtgtccgggctga

SEQ ID NO: 14610 - DNA, 780 bp, Pseudomonas aeruginosa
tcgaggccgaggagtcggtgtatgccgccagcgcccaggccgatggcggctggcgcggcgtgcggcgcttccgcgtggcacgcaagcaggcggagagcgaggaaatcacctcgttctacctggagccggtggacggccagccgctgctggcgttccagccgggacagtacatcggcctgcggctggacatcgacggcgaggaagtgcgccgcaactattcgcttttccgctgccagcaacggccgcgaataccgcatcagcgtcaagcgcgaggcgggtggacgggtctccaattacctgcatgaccgggtcgccgagggcgacgagctggatctgtttccgccggctggcgatttcgtcctgcgtgacagcgacaagccgctggtgctgatcaccgccggcgtcggcatcaccccggccctggccatgttgcaggaagcgctgccgcaggcgcggccgatccgcttcatccattgcgcccggcatggcggcgtgcatgccttccgcgactggatcgaagacgtgtcggcgcagcacgagcaggtcgagcacttcttctgctacagcgaaccgcgcgccggcgacagtgccgacgccgagggattgctgagccgcgagaaactggccgactggttgccgcaggagcgcgacctggacgcctacttcctcggaccccggcctttcatggcgcaggtcaagcgccacctggccgacctcggcgtaccctcgcagcaatgccactacgagttcttcggtccggccgccgcgctggacgcctga

SEQ ID NO: 14611 - DNA, 312 bp, Pseudomonas aeruginosa
agcgacgggccggcgcgaggtgcgtcggccctttttcggaaaaaggagatcgagatgaacgctctgttcgattgtccacggcgggtgctgcggatcggtcacgggctgctggcggccggcctggcgctgctcgtcgccggcgtgatcgccgcctatttcctcgaccgctacctgaacatgccggcgctggtgttttcccatgcgctggtgatcctcggcccgaccctgttgaagatcggctacgtgatgcgcctgagcgcgctgttccgcatgcgtcgacccggttgggaggtctgctgtgcaagtgcttga

SEQ ID NO: 14612 - DNA, 1278 bp, Pseudomonas aeruginosa
tcgttccaggctgatggccataccgccgatctggcgcctgggcttccgcccgttcttcctcggcggcgcgctgttcgcggtcctcgccatcgcgctctggctagcggcgctggccgggctctggagcggctggcaaccggtcggtggctggctggcctggcatcgtcacgaaatgctcttcggtttcggcgtggcgatcatcgccggcttcctgttgaccgccgtgcagacctggaccggcgtacccggcctgcagggcaaacccctggccctgctcgccgggctctggctggcggcgcgcctggcctggctattcgatgcgccgctggcgctgctgctggtgctgcaactgagcttcctgccgctattggcctgggctatcggtcgcagcctgtggcgggtgcggcagaagcgcaattacccggtggtgggcctgttgctgctgttgaccctggccgacgccctggtcctgctcggcctgttcgagggcaacgacgactggcaacggcgtgcctccatcgccgcgctatggctgatcgccgggatgatgaacctgatcggcgggcgggtgatcccgttcttcacccaccgcggtctcggccgtcagcagcaggtgccggcgatcgcctggctggacaatggcatcctgctgggctgcgtgctggtggcgctgctcaccgccgcgggcgtcacgacgcagccgacgccctggcttgcaggactgttcgccgccctcggtggtgcgcaactgtggcgcctgtggcgttggcgcgatcgcggcatctggcaggtgccgctgctctggtctctgcacctggcatatttctggatcgccgtggcgccgcttggcatggcgctctggagcctgggcctggcgctggcgccgagccaggcgctgcacgcgctggcggtgggcggcatgggcgggttgatcctggcgatgctggcacgggtcactctcggccataccggtcgcgcgctgcaaccgccggcagcgatgccctgggctttcgctctgctcaatctcggctgcgcggcgcgggtgttcctgcccagcctgttgccggcgaactgggcgctgcccctggcaggcggactgtgggctttggcgttcctgctgttcgcctggttctatgcgccgatgctgtgtcgtccgcgggtcgacggccatcccggttgatcagggggcttgccgcagacgccgcagctcctggttcagccagtcggcggagttgcgcgtctgcgtggcgcagcgcacctggtagggcttgccgctga

SEQ ID NO: 14613 - DNA, 726 bp, Pseudomonas aeruginosa
actggaactggatgcccgcaacggccgcatcctgaaggacgaggaagacgactgatgcggttgctgctggttgaggatcacgttcccctggccgacgaactgatggccagcctgacccgccagggctacgcggtggactggctggccgacggccgcgacgcggcggtgcagggcgccagcgagccctacgatctgatcatcctcgacctcggcttgcccgggcgtcccggcctggagatactccaggagtggcgtgggctgggactcgcgactccggtgctgatcctcaccgcgcgcggttcctgggccgaacgcatcgatgggctcaaggccggtgccgacgactacctgaccaagccgttccatccggaagagctggccttgcgcatccaggccctgttgcgccgcgcccatgggctggccaaccagagccagctggaggccgccgggctgcgcctggacgagcagcgccagtgcgtgtgcctgaacggcgccgacgtcgacctgaccgccgccgaattccgcctgctgcgctatttcatgctgcaccccggccaggtcctgtccaaggggcacctggccgagcatctgtacgacggcgagaccgaacgcgattcccacgtcatcgaggtccacgtcaaccacctacggcgcaagctcggccgcgaggtgatcgagacccgccgtggccagggctaccgctacgccggggtggccgccggatga

SEQ ID NO: 14614 - DNA, 2217 bp, Pseudomonas aeruginosa
tgctgccggtgctggtgttcctgttgggcgagtccagtggacagcgagaggaggggcggtcgccgcggttacccgcgcaggctcgctacgagcaggccgtggaaaacgcgttgcgcagcgagcgcggcgagccgcgacaggccgggacagcggcagcgaaggtggccgaggcgggagccccggcgcgtctgcgtggctggctgcgctcgctggcccgcctggcgatctgggggacctacggccccccggcgctattcaggccgtgaacggtcaggccttgaactgttccatcaggccctgctggtggttggccaggcggttcagcgactgactgacctgggccgactcctcggcctggctcgacagcgactcggtgacgtcacggatcgccgcgacattgcggttgatctcctcggctaccgagctctgttcctcggcggcgctggcaatctgcaggttcatgtcgttgatcaccgtcaccgcctcgccgatccgttgcagcgcggccaccgcttcatccacctgctcgacgctgccctgggcctggcgatggctgccatgcatggcgtcgaccacgtcgcgggtgccctgttgcaggccttcgatcaccccgcggatctgttccaccgagtcctgggtgcgccgggcgaggttgcgcacttcgtcggcgaccaccgcgaagccgcggccggcgtcgccggcgcgggccgcctcgatggccgcgttgagcgccagcaggttggtctgctcggcgatggcgcggatcacttccagcaccgaaccgatttcctcgctgctgctggccagttgctcgacctggcccatggcgctggtcaggttggcggccaggctgtcgatgctctgtgtggtgcggtcgatcagcgccaggccgtcgcgggtcgcctggtcggcaccgcgcgcggcgtcggcggcctgggcggcgctacgggcgacgtcctgggcagtggcggtcatctcgtgggatgcggtggcgacctggtcgatctcgcggaactgctgctgcatgccggcgctggtctggctggaaatcgccgccgactggtcggcggtactgcgcgcatcgcgcaccgagaccttcacgtcgcggatgatcggctgcagcttgtcgagaaaacggttgaaccaaccggccagttcgcccagctcgtcgcgcccggtgtgcggcagacgctgggtcaggtcgccttcgccgctggcgatgtcgcgcagcatgtgggcgacgccgaggatcggccgggtcacgccgcgggcgctcagccacagcaccagcaggccgagcaccgcggcgccgaggccgaggcccagttcgacccaggtgccttcgcgacgcatgtcgtccagttgccgctccagcgccagggccgggccgagcagggcgctcttcggcacttcgaggagcacgccccagggcttggcgccgggaatcggctgcaacggttgcagcaccttgaggtcgtcgttctcgttgaacaaccggctcttgccggcggccagcagttgcaggagttcgccggcgtgctgcggatccgccttggccaggttcttgccgagcaggccggcgtcgcggctgttgccggcgaacagcccggccgggctgaggatgccgacctggccgacgccgtcatagagttcgcggttgccctgttcgctgagcgcctgcaggttgctcaggttgatgtccaggcccatcacgccgatcaccttgccatccagttcgaggggaaaggcgatgctggtcatcagcagttggcgttcgccgaccttgtcgaagtaaggatcgagcacgcagggttgcccgctttccttcgggcaggtgtaccaggcgttgtaggccgcgccgctgggcccgctgctggtgtcggcgagttcggactcgatcatcgactcggattccagctgtcccggcgtggcctgcgcccagtacagggagaagcgtcccttgtcgttgctgcccagggccggctggtccaacaacagttcgtccttgccgtccagcgcattgggttcgaagaccacgtactggccgagcacttcgggattggcggcgagcgcggtgcgcacctggcgggtcaggtcttcgcgcaggtcgtaggcatcgaggaagcgcttctgcgcctggtcgcggaggaacaggatctgccgggagaagcccttgccgtactggaaggcatccatgaaatagcgctggatgcgtaa

SEQ ID NO: 14615 - DNA, 1440 bp, Pseudomonas aeruginosa
ccaggcgacattcgcgcatgcgcggctttgacaggcggggatggctgtagcagagtacgccccttttttcggccgcagacggtcgagttcgtttcatttgcaaggagttcaacgatgaacgcagtggtgctggcggtggggctgatgctcgtcctcagcctttgccgtgtgcatgtcgtgctggcgctgatcatcggcgcggtggtcggcggactgttcggtggcctaggccttgaggggactctcaaggccttcaacggcggcctcggcgggggtgccacggtggccctgtcgtacgccatgctcggcgccttcgccgtggccatcgcccgctccggcgtggcccatgcgctggccgacaaggtcctggcgctgctcggccggcacgacgagcagggcaagggcgccggtgcgttcaagtggatcctggtcggcctgctgctctgcgtggcggtatcctcgcagaatatcctgccgatccatatcgccttcatcccgctgctggtgccgccgctgctctatgtgctgagcaagctgcagatcgaccggcgattgatcgcctgcgtcatcaccttcggcctgatcaccccgtacatgttcctgccggtgggcttcggcaacatcttcctcaatgaaatcctgctggccaacgtggcgcgcaacggcgtcgacgtcagcgggatcaacgtcacccacgccatgttcatcccagccctgggcatgctcgccgggttgctcatcgcggtgctgttcagctaccgccgcaagcgcgtctacgacttgcagcggatcgagcaggccgaacgcgtcgatgtcagctacaacccgaagagcctggcggtggccggggtatccatcgtcgccgcgttcgtcgcacagctgtggctggactcgatgatcatcggcgcgctggtcggtttcgtggtcttctcgctgtccggcgtggtgcgctggaaggagaccgacgacctgttcaccgaaggcatgaagatgatggccaccatcggtttcatcatgatcgccgcggccggtttcgccgaggtgatgaaggccaccggcgaggtgcagagcctggtcgacgcctcggtggcctggatcggcaacagcaaggcggtcggcgccatgctgatgctgctggtcggcctgctggtcaccatgggcatcggctcgtcgttctccaccgtgccgatcatcgccgcgatcttcgtcccgctggcggtgcaactgggcttcagcccgctggccatcgtcagcatcgtcggcaccgccggcgcgctgggggatgcaggttctccggcgtcggactcgacccttgggccgacctccgggctcaacgtcgacggccagcacaatcacatctgggacaccgtggtgccgaccttcctgcactacaacctgccgttgctggtgttcggctgggccgccgcgatgttgctctga

SEQ ID NO: 14616 - DNA, 1950 bp, Pseudomonas aeruginosa
cgcgcccggggtcagcttcaccgcccagtcgccgcggcgtgcggcggcgacctcttcggcgctgaccggtcgcgaccattcgcagtcacgggcggcctgggcgtcccaactggcgctgttgtgtcgcaggacgtcgatttcgtggaaggtgggcatgaggcctccgggttcatccatggagcgcggagcatgccacggcagcggggcagggtgcgtggggcgggccaaagaaaaaccccgccgaggcggggttttcgtggagcgggcgactcagccggcgagggccaggccggaatgctggaggatttccagcagcggctgcgggtagacgccgaggaagaacgccagcagggcgatggccaccagcatgatgccgccggcgcgctggccccagttgaacggtgcgtcgtgctggcggatgccgggctcgaccaggaacagggtgaccatgacccgcaggtagtagtacaggccgatggcgctgcccagcaccagggcgccgatcagccaccacaggtgcgactcgacgccgaccgcgatcacgtagaacttgccgatgaagccggcggtcagcgggatgcctgccagcgacagcatcatcacggtcatcaccgcggtcagtaccggccggcgccagaacaggccgcggtactcgaacagcgcatcggcgtcgcggccgctgtacggggtggacatcagggtgatcacgccgaacgcgccgagggaggtcagtacgtaggtggccaggtagacgccgaccgcttccacggccatgcccttgctggcgatcagggcgaccagcaggtagcccaggtgggcgatggacgagtagccgagcaggcgcttgatgttgctctgggtcagtgccagcaggttgccgaagaggatcgaggcgaccgcgatgacgctcagggagatgttcagcagttggttgtccagggccgccggggcgatctggaacagccgcagcagcacggcgaacaccgcgaccttgctggcggtggcgaggaacgccgagaccggcgccggggcgccttcgtagacatccggggtccacaggtggaagggcaccagcgacagcttgaagcccaggccgaccagcatcatgcctacgccaacgctgaccagcggaccgctcagcacgtgctcggcaaccttggcgccaaggccggcgaagcccagggtaccggactcggcgtagagcagggccatgccgaacagcaggaaggcggacccggcggccgagagcacggtgtacttgatgccggcttccagcgagcgcttgttgaagaaggcgtaggcgaccatcccgtagaccgggaccgagagcagctccaggccgatgaacaggctggccaggtgctgcgcgctgaccagcaccaggccgccggcggtggccagcagcaggagcaggtacagctcttcgcggttacccggatagctttccatgtaggcgtgggcgagggtcacgcaggccagggcggagaccagcaccagggccatgtagaagcaggcgtagttgtccaccagcaccagcggtgtcacctcgatcggggtgacgccgaggaccggcagcagcgacagcagggccaggttgaggccgatcaccgagagggtggcggtgaacgagtgattgcgtttccaggctaccgccagcatcaccaccaccagggtggcgctggtgatcagcagtggcaggagcgcgatgaagtgttgaatcgtaaaggtcatttcgcgactaccgtcctgcaagggtggaaagggctgcgcccagccattgctgcacgccgtgcatgctggccgcggagatgtccagcactggctgcgggtagaccccgagcaggaccagcaggaccgccaggccgagcaccatgctcagttcgcgggcatcgaggccgaggatcggctcgtcggactggctggggccgaagtaggcgcggtggatcatga

SEQ ID NO: 14617 - DNA, 816 bp, Pseudomonas aeruginosa
acaggccgtggcaacgggcgatcaggtagacgccggcggtcaccatggtggcggcgtggatcagcgcggaaaaccggggtcgggccggccatggcgtcggccatccaggtctgcagcggcagctgggcggacttgccgaccgcgccgccgagccagggccagggtcgccagggtcagccagaggttgccttccgggaacttctgcggcgccagcaccagcagctcctggatgttcagggtgccgaactgctggaacaggatgaacaggccgaaagccatgaacacgtcgccgacgcgggtgacgatgaatgccttgagcgccgcgttaccgttgttgcgattgctgtagtagaagccgatcagcaggtagctgcacaggcccacgccttcccagccgaagtagaggaacagcaggttgtcgcccagcaccaggaacagcatgctggcgatgaacaggttggtgtaggcgaagaagcgcgaatagccggtttcgccacgcatgtaccaggaggcgaacaggtggatcaggaagccgacgccggtaaccacgccgagcatggttaccgagaggccgtccaggtacagggtgaagttggtgctgaagtcgccggccgccatccactgccacagcaccaggctgtaggcaccgccttccggcggactgctgtggaagctgaagatggcccaggccgcgctcagggcggagaggccgaccgagccgacgccgaccagcgccgaaaggttttccgaccacctgccgcgggagaacgacagcagcaggaagccgaccagggggaacaggaaggtaagaggtag

SEQ ID NO: 14618 - DNA, 918 bp, Pseudomonas aeruginosa
tcacggtggttctccttactgggccgcggccagcacgagcgcgccggtcaccagcaggttgatcagggtcagcggcaggcacaccttccagctgaacgccatcacctggtcatagcgcggacgcggcagcgaggcgcggatcaggatgaagagcatgatgaagaagccggtcttggcggcgaagtagaagaacgacagccagcgcagggtgtccaggaacggaccgtgccagccgccgaagaacagggtcgccagcagccccgagaccagtacgatgccgatgtattcgccgacgaagaacatgccccatttcatcccggcgtactcgatgtggtagccgtccgccagttcgtgctccgcttccggctggtcgaacgggtgacggtgggtcacggcgacgccggcgatgatgaaggtgcagaagccgaagaactgcggaatgatgaaccagacgttgtcgatctggtactggacgatgtcgcgcatgttgaacgagccgacctgggcgacgatgcccatcagcgacagggccaggaacacctcgtaggagatggtctgggccgaggcgcgcaggctgccgagcagggcgaacttgttgttgctcgaccagccggcgaacagcacggcgtacaccgtcaggccggccatggcgaagaagaacaggatgccgatgttcaggtccgccacgccccaggtgggggtgatcggcacgatggcgaaggcgacgagcagggcgcccatcgcgatcaccggggccagggtgaagatcatcttgtcggcgaacggcggggtccagtcctccttgaagaacatcttgaccatgtccgcgccgagctggaacgcaccgaacggaccgacccggttggggccgtagcggtcctgccagaggccgagcaggcggcgctcgacccagcttag

SEQ ID NO: 14619 - DNA, 303 bp, Pseudomonas aeruginosa
cagggcgccgcagatgaccacggcgagcagcaccacgatggccttgaccacggtgaggatgatggtgaccagagcgggagtcagccaactcattgtgcagcctcctgcagaccttccacggagcagccggcgatcgccgccgggatgccggcgaagccgaccggcaggccgatcaggccggcgccgagttgttcatcgatacgcagcggcaggcgcagggcctggcccttgagctggaagccgagggtcgcgccgtcgttgacgccgaggcggtccgcgtcttccttggacagggcgacgtag

SEQ ID NO: 14620 - DNA, 528 bp, Pseudomonas aeruginosa
gggtcatacgtaggcctccagcagtttggcgacaccgtcgggacgcacgtcgccatgagtgtcgtcgtcgatcatcagcgccggggccttgtcgcagttgcccaggcagcagaccgggagcagggtgaagcgtccgtcggcggtagtctggccgagaccgatgccgagttgcttctggatctcgccgaccaccgactcgtggccgccgatgtagcagaccatgctgtcgcagacgcggatgatgtggcggcccaccggctggcggaatatctgactatagaaggtggcgacgccttcgacgtcgctggccgggatccccagcacctcgccgatcgccgggatggcgccgtccggcacccagccgcgctgtttctggacgatcttcagggcttcgatggacgccgcgcgcgggtcctcgtagtgatgcatttcatgctcgatggacgagcgctcggtttcgctgaggacgaaacggtcggtctgaatcaggttgctctggctcatgtcagcggtccacgtcagccataa

SEQ ID NO: 14621 - DNA, 345 bp, Pseudomonas aeruginosa
ccatgcagcggtcgtaggcgtcgccgttgtgggccagcggtacctcgaactcgaagttctcgtagccggagtaggggcgggccttgcgcaggtcgaagtcgcaaccggtggcgcgcaggccggcgccggtggtgccccactcgagggcttccttggtgttgtactgggcgacgccgatggtccggccgcgcaggatgctgttcttcagggccgcggtctcgtactcgtcgaggcgcttgggcatccagtcgaggaactcgcggaccagcttgtcccagccgcgcggcaggtcgtgggcgacgccgccgatgcggtaccaggccgggtgcaggcggaagccggtga

SEQ ID NO: 14622 - DNA, 966 bp, Pseudomonas aeruginosa
aggtctcggcgccaaagcgggaattcagttcgacgacgatatcctggtcgtctgccttgtaaggcgggatgtacagagcggagtctgcagtcatggtctcggtcgctttcggtcaacggtggggtgaacgcggctggtctcggccggccagcggggctggccgggagttccggatcacacttcgtcggggctgcgcaggttggtcacctggatgcgctgctcgcgtttcaggtctttctgggccggcatttcggcgcggtagaccccctggtcgccaacgacccaggacagcgggcggcgctcctggccgatggattcctgcaacagcatcaagccttgcaggaacgcctccggacggggcgggcagccggggatgtagacgtccacggggaggaacttgtcgaccccctggaccaccgaatagatgtcgtacatgccgccggaattggcgcacgagcccatggagatgacccacttgggttcgagcatctgctcgtagaggcgctggatgaccggggccatcttgatgaagcaggtgccggcgatgaccatgaagtcggcctggcgcggcgacgcccggatcacttcggcgccgaagcgggcgatatcgtgcggcgcggtgaaggcggtggtcatctccacgtagcagcacgacagcccgaagttatagggccagagcgagttcttgcgaccccagttgacggtggagttcagcacatcctcgagcttgcccatgaagatgttcttgtgaacctggccctcgaccagcgggtcggctacggtttcccgttcgcctatcgggtattggtcgttggccgcatcgggatcgatccgggtaagtttgtattgcatcgccaaagcctcattgttttagcttcgcctgccgcttgcgacggctttcgggagcccaatcgagcgcaccgatccgccaaagatagacaagacccgccaacagaattgctatga

SEQ ID NO: 14623 - DNA, 2211 bp, Pseudomonas aeruginosa
agaggggagcctgcattccacccgctttgcccgggcttgcccacggctgtagcggcgacctgcgccggcattccggccaacgcaggtcgtcgtggcgcgtcagagcaggcgtcggccgtcttcgcgggtgatcaccacggtggccgagcgtggccggcggcccggcccgtccggccaggtgctgaggaggttatcggcggtcgagccttcccccgggtgctggatgttgatgaacagcgtacggaagtccggcgtcgcggcaatgccggtcacctcgcaacccagcggaccggtgaggaagcgcttcagttcgccggtgcgcgggtcggccaccagcatctggttgttgccgaacgggccgctgctcaactggctgccgctcatgtcggtctggatccacaggcggccttccgggtcgaaccagaggccgtcggggctggccaggatattgtcctggttcagcggcttgccgtccgggccgcggctgtcttcgccgggaccggcgagcatgaacaggtcccaggtgaagcgttgcccggcatagtcgcggctgcgttcgcgccagcggatgatatggccgtaggcgttcttcacccgtgggttggcggcgtcggcgacggtgcgcgacgtgttgttggtgagggtgaagtagacgtcgccgttgtccgggttgaccgcgccccactccgggcgatccatcttggtcgcgccgaggacatcggcggccaggcgggtgttgatcagcacttcgccctggtcggcgaagctcaccccggccttgcgacaggccgcgcggaagttgccgtcggcgatgtccagcggcagccactggccgctgccatcggcgttgaagcgggcgacgtagagggtaccttcgtcgagcaggcgagcgttgctgcgacccggacggaacttgtcgcggctgacgtacttgtagatgtactcgttctgcgagtcgtcgccggagtagcagactacctggcggcccggcttgaccggggcgaagaccaggccttcgtgggcgaagcggccgagagcggtgcgcttgaccggtaccgattgcgggtcgaacgggtcgatctcgacgatccagccgaagttgttcggttcgttgcggtagtcgtcctgagcctgtttgcccttgcgggtggcgtcgaagcgctcgaactcgtcgcccgccagggtctcccagccgaaacggctggtgttgcgaatgccgtagcgggtcagttcgcgcggcagttcgctgtcctgggtggagaaatagccgacccagttctcctcgcaggtgaggtaggtgccccagggggtgaaaccgttggaacagttgttgtgggtgccgcgggtgcgggtgccgtccggactgtggcgggtgcgcagcagttcgtggccgcgcgccgggccggcgatacgcatcggcgtggcggcggtgatccgccgattgcgttgcgacggtacgacattccactcgccacgcacgttgcgacggatctccacgacggaaacgccatgggcgttgatttccttgcgcacttcatcggcgacggtgcgcttgccatcgaccacggtcgggccattggtgtgcagcagcggcgcgtcgatgtattcatggttgagcaccagcaggccatggttgctgatgtgtccgccgccgaagccgaactgcgcgtcgatcgggaagaagtgcatgccgtcgtggtgcatgccgatctgttcggcctggtcctgggcgctgttgctggcgtcgtcgaggaatcccggataactgccgctgatcggggtgccccagggtatgaagggcgtcgccttgtagccggcgggcacccggatggtatcggcgcggccgctggcgatggcttcgaagggcaagcggttgcggcgtttgaaaggcaagccgcgcaggccttccgcggcgggcgcctgcgcttcggcgggagcggcgctggcggggagcgcgacgccgaggaaggcgagggcgccgagcgccgcgccgccggccaggacctggcggcggccgaggccggcgatcaggtcgttcatgtgcgggttgttcgaatggttgctgggcaactcgtcgccatcaccgaacaggatggcatcttttttctccaggctcacggacgtgctccttgtgggctgatcgacggagcattgacgctaaccgctgaaagcgacgggacgatgacaggcactcgaggccttttgccatga

SEQ ID NO: 14624 - DNA, 2154 bp, Pseudomonas aeruginosa
aacaaaaacgcccggcgcagccgggcgtgcaaaagggttgcgtgctcagatgcgcttggcctgggcggcggcattgccgacgtagccggccggggtcagcttcttcagctcgaccttggcctcggcgggaatcgccagctcttcgatgaaagtctgcaaggcttcggcgctgatgcctttgccgcgggtcagttccttcagcttctcgtaggggttttccacgccatagcgacgcatcacggtctgcaccggctcggcaaggacttcccagcaggcgtccaggtcctcggcgatgcgctgggcgttcagctccagcttgccgatgcccttcaggctggcctcgtaggcgatgacgctgtgggcgatgccgacgccgaggttgcgcagcacggtggagtcggtcaggtcgcgctgccagcgcgagatcggcagcttgctggccaggtgctggaacagcgcgttggcgatgccgaggttgccctcggagttctcgaagtcgatcgggttgaccttgtgcggcatggtcgaggagccgatctcgccggccacggtcttctgcttgaaatagccgagggagatgtagccccagacgtcgcggtcgaagtcgatgaggatggtgttgaagcgggcgatcgcatcgaacagctcggcgatgtagtcgtgcggctcgatctgggtggtgtaggggttgaaggtcaggccgaggtcgccttcgatgaactggcgggcgttggcttcccagtcgacttcgggataggcggacaggtgggcgttgtagttgcccacggcgccgttgatcttgcccagcaactcgatgccggcgacctgcttgatctgccgctccaggcggtagacgacgttggccagttccttgcccagggtggtcggcgaggcgggctggccgtgggtgcgggagagcatcggcacgtcggcgaatttcaccgccagttcgcggatggcctcggcgatctggcgcatcagcggcagcagcacgctgtcgcgaccctcgcggagcatcagggcgtgggacaggttgttgatgtcctcggaggtgcaggcgaagtggatgaactcgctgaccgcggccagctccgggagcttggcggcctgttccttgagcaggtactccacggctttcacgtcgtggttggtggtgcgctcgatttccttgatgcgttcggcgtgttccagctggaagtcgctggccaggctgtcgagcagggcgttggcttcggcggagaacggcgcgacctcgggaatcccggcgtgggcggcgaggcgctgcagccagcggacttccaccatgacgcggaaacggatcaggccgtattcgctgaagatcggacgcaggctgctggttttgccggcatagcggccatcgacgggggataccgcggtgagcgaggaaagctgcatgagacgttctcgtggctggaagtcaacgaaaaaggggcgcatatcatacatgaaaggtgcgccccggtggggcattcagcggggcctttcggcggggcggttgcccagcagggggatcaggctggcggcgaaaatcagggcggcgccgagcagcgacgtgtggctgggcagttcgtcccagcgcagccaggcgatcaccccggcgaaaacgatggccatgtaggcgatcggtccgatcactcccggggaggccagggcataggcctgcgacatggtcagttggccgaggctggcgaacagtccggcgccgagcagcaggagcagttcctggccgttcagcggctgccaggcccaggccagcggcacggcggagaacagggtgccgaacagggcgaagtagaacacgatgcgataggctggctcgctgtcgctcatttcgcggatcgagacgaaggcgcaggcagccatcaggctggaggcgatgccgaccagggcgatcggcgccactaccgcgccgctgggcctggccaccagcagcacgccgaggaagccgaccagggtggcgaccatcatgcggcgggtcagcggctccttgatccacaggtgtgcgatcagcggcgtgaacaccggcgcggcatagctgaacagcatggcgtcggtcagcggcaggtgggcgagggcgtagaagtagcagtacatgccgcccaggccgtaggtggtgcgcagcaggtgcgatag

SEQ ID NO: 14625 - DNA, 1359 bp, Pseudomonas aeruginosa
tgcgctcgcctgtttagactaaggaagatgtggtttccgggcggacaactgggctaccctagaaggctgcaacagggttttaaccacaacacggagttcagcatgggataccaaaagatccaggtgccggcgaccggtgacaaaatcactgtgaatgccgacatgtccttgagcgtaccgaagaacccgatcatcccgttcatcgagggtgatggcatcggcgtcgatatcagcccggtcatgatcaaggttgtcgacgctgcagtggaaaaagcatacaagggcgagcgcaagatcgcctggatggaagtctacgccggcgagaaggccacccaggtgtatgaccaggacacctggctgccccaggaaaccctggacgccgtacgcgactacgtggtttccatcaagggcccgctgaccaccccggtcggtggcggcatccgctccctgaacgtggccctgcgccagcaactcgatctctacgtctgccagcgcccggtacgctggttcgaaggcgtgcccagcccggtgaagaagcccggcgacgtggacatggtgatcttccgcgagaactccgaggacatctatgccggcgtcgagtggaaggccggttcgccggaagcggagaaggtcatcaagttcctcaccgaggaaatgggcgtcaagaagatccgcttcaccgagaactgcggcatcggcatcaagccggtttcccaggaaggcaccaagcgcctggtgcgcaaggccctgcaatacgccgtcgacaacgaccgcagttcggtgaccctggtgcacaagggcaacatcatgaagttcaccgagggtgccttcaaggattggggctacgaagtcgcgcgcgatgaattcggcgccgagctgctggacggcggtccgtggatgcagttcaagaatccgaagaccggcaagaacgtcgtggtcaaggacgtgatcgccgacgccatgttgcagcagatcctgctgcgccccgccgagtacgacgtgatcgccaccctgaacctgaacggcgactatctctccgacgccctggcggccgaggtcggtggcatcggcatcgcgcccggcgccaacctgtccgattcggtggccatgttcgaggcgacccacggcaccgcgccgaagtacgccggccaggacaaggtcaacccgggttcgctgatcctctccgcggagatgatgctgcgccacatgggttggaccgaggcggccgacctgatcatcaagggcaccaacggggcgatcgccgccaagaccgtgacctatgacttcgaacgcctgatggacggcgcgaccctgctgtcctgctcggagttcggcgacgcgatgattgccaagatgtag

SEQ ID NO: 14626 - DNA, 399 bp, Pseudomonas aeruginosa
ctttccagaaaggcaaagctttttttcctcatgcatgcacctagccagattcgactaacattcaatcaggaccatcccgagcctcatgagcacgaggacgaaggggcggggctcgcggtacaggagtcgaagcctgtattacagccgccaccgttgtataaggtggtactgttcaacgacgattacacgccgatggactttgttgttgaagtgctggaagtgttcttcaacatggaccgggaaaaagccaccaagatcatgttgacggtacatactcagggtaaggcggtctgcggcttgtttacccgggacgtggccgaaaccaaggcgatgcaggtcaatcagtatgcacgggagagccagcatccattgctctgcgagatagagaaagacagttga

SEQ ID NO: 14627 - DNA, 2304 bp, Pseudomonas aeruginosa
tcggatgtttgggagcgaggtgaagccatgttgaatcgagagctcgaagtcaccctcaatctcgccttcaaggaggcgagggccaaacgccatgaattcatgacggttgagcacctgctgctggccttgctggacaatgaggcggcggcaacggtattgcgtgcgtgcggtgccaacctggacaagctgcggcgcgacctgcaggaattcatcgattccaccacgccgctgatcccgcagcacgacgacgagcgcgaaacccagccgacgctgggcttccagcgcgtcctgcagcgtgcggtgttccacgtgcagagttccggcaagcgcgaagtgaccggggccaatgtcctggtggcgatcttcagcgaacaggaaagccaggcggtgttcctgctcaagcagcagagcatcgcgcgtatcgatgtggtgaactacatcgcccatggtatctccaaggtgcccgggcatgccgaacatccgcaggatggggagcaggatatgcaggatgaggaaggtggcgagtcggccacgtccaaccatccgctggacgcctatgccagcaacctcaacgaactggctcgccaggggcggatcgacccgctggtggggcgtgagcatgaagtcgagcgggtggcgcagatccttgcccgccggcgcaagaacaacccgctgctggtaggcgaggcgggggtcggcaagacggccatcgccgagggcctggccaaacgcatcgtcgatggccaggtgccggacctgctggccgacagcgtggtctactccctcgacctgggtgccttgctcgcgggtaccaagtaccgcggcgacttcgagaagcgcttcaaggccttgctcaacgagttgcgcaagcgcccgcacgcggtgctgttcatcgacgagatccataccatcatcggcgccggtgcggcatccggcggggtaatggacgcctccaacctgctcaagccggttctgtcctcgggcgagatccgctgcatcggctcgaccaccttccaggagttccgcggcatcttcgagaaggaccgggccttggcgcggcgcttccagaaggtcgacgtgaccgagccgtcggtggaagacacctatggcatcctcaagggcctcaaggggcgcttcgagcagcatcaccacatcgagtacagcgacgaggcgctgcgcgccgcggccgagctggcggcgcgctacatcaacgaccggcacatgccggacaaggccatcgacgtcatcgacgaggcgggcgcctaccagcgcctgcagccggaagagaagcgcgtgaagcgcatcgaggtggcgcaggtcgaggatatcgtggcgaagatcgcgcggatcccgccgaaacacgtcaccacctccgacaaggagttgctgcgcaacctcgagcgcgacctcaagctgaccgtgttcggccaggacgacgccatcgagtcgctgtccacggcgatcaagctgtcccgggccgggctcaaggcgccggacaagccggtcggctcgttcctcttcgccggtcccaccggcgtgggcaagaccgaggtggcgcggcagttggcgaaggccttgggcgtggagctggtgcgcttcgacatgtccgagtacatggagcggcataccgtgtcgcggctgatcggtgcgcctccgggctacgtcggcttcgaccagggcggcctgctcaccgaggcgatcaccaagaccccgcactgcgtgttgctgctcgacgagatcgagaaggctcacccggaggtcttcaacctgctgctgcaggtgatggaccacggcaccctgaccgacaacaacgggcgcaaggcggacttccgcaacatcatcctgatcatgaccaccaacgccggcgcggaagtggcggcgcgcgcgtcgatcggcttcaaccagcaggatcacaccaccgatgcgatggaagtgatcaagaagagcttcaccccggagttccgcaaccgcctggataccatcatccagttcggccgcctgagcaccgagacgatcaagagcgtggtcgacaagttcctcaccgagctgcaggcgcagctggaggacaagcgcgtccagctcgaggtcagcgatgcggcgcgcggctggctggcggagaagggctacgacgtgcagatgggtgcgcgaccgatggcgcggcttatccaggacaagatcaagcggccgttggccgaggagatcctgttcggcgagctggccgagcatggcggcctggtgcatgtcgacctgaagggcgacgagctggccttcgagttcgagatcacggcggcggagcccgcctga

SEQ ID NO: 14628 - DNA, 279 bp, Pseudomonas aeruginosa
gggagggcgggcctcccccgggtccgatcaatggtcgtcgaggtatttttcggcatccagcgcggccatgcagccggcgccggcggaagtgatggcctggcggtagacgtggtcggccacgtcgccggcggcgaacacgccttcgatgctggtctgggtggcattgccttcgctgccgccgtggatccgcaggtagccgtcgcgcatttccagttggccctggaacaggtcggtgttcggcttgtggccgatggcgatgaacacgccggccagcgatag

SEQ ID NO: 14629 - DNA, 1224 bp, Pseudomonas aeruginosa
ccaggtgcagaatgccgccggtcggctcggtgcggtatccgccgatatcctgttcatgacgctcggctacttcgcctacctctttccgctgttgctgggcatcaagacctggcaggtattccgccgccgcaacctgccgtgggaatggaacacctggctgttttcctggcgcctggtcgggctgatcttcctgatcctggccggctcggcactggcctacatccatttccacgccagcggccacatgccggccagcgcctcggccggcggcgccatcggccagagcctgggccgcgtcgcggtggatgcgctgaacgtgcagggcagcacgctggtgttcttcgccctgttcctcttcggcctgacggtgttcgccgacctctcctggttcaaggtgatggatgtcaccggcaagatcaccctggacttcttcgaactgatccagaacgccttcaatcgctggatgggcgcgcgcgccgagcgcaagcaactggtcgcgcaactgcgcgaggtcgacgagcgcgtcgccgaggtggtggcgccgagcgtgccggaccgccgcgaacagtccaaggccaaggagcgcctgctggaacgcgaagaggccctggccaagcacatgagcgagcgggagaagcgcccgccgccgaagatcgatccgccaccgccgccgaaggccccggagccgagcaagcgcgtgctgaaagagaagcaggcgccgctgttcgtcgatacggcggtggagggcaccctgccgccgctgtcgctgctcgacccggcggaagtgaagcagaagagctactcgcccgagtcgctggaggcgatgtcgcgcctgctggagatcaagctgaaggagttcggcgtcgaggtcagcgtggattcggtgcatccgggccccgtgatcacccgtttcgagatccagcccgcggcgggggtcaaggtcagccgcatttccaacctggccaaggacctggcgcgctcgctggcggtgatcagcgtgcgggtggtggaagtgattcccggcaagaccactgtcggcatcgagattcccaacgaagaccggcagatggtgcgcttctccgaagtgctgtcgtcgccggagtacgacgagcacaagtccaccgtgccgctggccctgggccacgacatcggcggtcggccgatcatcaccgacctggcgaagatgccgcacctgctggtggccggtaccaccggctccggtaa

SEQ ID NO: 14630 - DNA, 1017 bp, Pseudomonas aeruginosa
gtcggtgggggtcaacgccatgctcctgtcgatcctgttcaagtccacgccgagcgaggcgcgactgatcatgatcgacccgaagatgctcgaactgtcgatctacgaagggatcccgcacctgctctgcccggtggtcaccgacatgaaggaagccgccaacgccctgcgctggagcgtggcggagatggagcggcgctaccgcctgatggcggccatgggtgtgcgcaacctggctggcttcaaccgcaaggtgaaggacgccgaggaggctggcacgccgctgaccgacccgctgttccgtcgcgaaagcccggacgacgagccgccgcagctgagcaccctgccgaccatcgtggtggtggtcgacgaattcgccgacatgatgatgatcgtcggcaagaaggtcgaggagcttatcgcccgtatcgcgcagaaggcgcgggcggccggtatccacctgatcctggcgacccagcggccgtcggtggacgtgatcaccggcctgatcaaggccaacatcccgacccggatcgccttccaggtctccagcaagatcgactcgcgcaccatcctcgaccagggtggcgccgaacaacttctcggccacggcgacatgctctacctgccgccgggcacaggcctgccgattcgcgtgcacggcgccttcgtttccgacgacgaggtgcaccgggtggtcgaggcctggaagctgcgcggcgcgcccgactacatcgaggacatcctcgctggcgtcgacgaaggcggcagcggtggcggttccttcgatggcggcgacggctccggcgaaggcagcgaggacgacccgctctacgacgaggcggtacgtttcgtcaccgagagtcgccgggcatcgatctccgccgtgcaacgcaagctgaagatcggctacaaccgcgccgcgcggatgatcgaggcgatggagatggccggcgtggtcaccccgatgaataccaacggctcccgcgaagtcatcgcgccggcgccggttcgtga

SEQ ID NO: 14631 - DNA, 489 bp, Pseudomonas aeruginosa
acctgctggagaacgctgccgacctcgccgaggacggcagcgagatcagccccgagctgctgcagaatctgctcggcgatacccgccgacgtttcgacaagggcggcgaggcgttctacgaccagatcagcgcgctgcacaagtcggtgcgcggctccaatcccgacgcggcactttattggttcgcgcgtatgctcgacggcggctgcgatcccctgtacatcgcccggcgggtggtgcgcatggccagcgaggaggttggcaacgccgatcctcgcgccctcggcctatgcctgtcggcctgggacgtgcaggagcgcctgggcagccccgaaggcgagctggcggtggcccaggccatcgtctacctggcctgtgcgccgaagagcaatgcggtgtacagcgcgttcaacgcggcgatgcgcgacgtcgccgaaagcggctcgcgggaagtgccattgcacttgcgcaacgcgccgaccaaattga

SEQ ID NO: 14632 - DNA, 1473 bp, Pseudomonas aeruginosa
agatccgcgacaagctggaacacctggccgagctggatcgcaccagtccccgccaacgcagaaaatcctgagcggtatgggctcggcggagctagccaggcttccgcgacggcgtcgatgacgtcgccggggccggcgaagcgccaaccgggccacgaaccgccgataaccgacacgagacgagaaaagagcatgctcgatcccaaactggtacgcacccagccgcaagaagtggctgcccgcctggccacccgtggcttccaactggatgtcgcacgcatcgaagcgctggaagagcagcgcaagtcggtacagacccgtaccgagcagctgcaagccgagcgcaacgcgcgttccaaggcgatcggccaggccaagcagcgtggcgaggacatcgcgccgctgctggccgatgtcgatcgcatgggctccgagctggaggaaggcaagcgccagctggacgccatccagggcgaactggatgccatgctgctgggcattcccaacctgccgcacgagtcggtgccggtcggtgccgacgaggacgccaacgtcgaagtgcgtcgctggggcacgccgaagaccttcgatttcgaggtcaaggaccatgtcgccctcggtgaacggcacggctggctggatttcgagaccgctgccaagctttccggcgcgcgcttcgccctcatgcgcggcccgatcgcccgcctgcatcgcgccctggcgcagttcatgatcaacctgcataccgccgagcatggctacgaggaggcctacaccccttatctcgtccaggctccggcgctgcaaggcaccggccagttgccgaagttcgaggaggacctgttcaagatcggccgcgacggcgaagctgacctctacctgatcccgaccgccgaggtttcgctgaccaacatcgtctccgggcagatcctcgacgccaagcaattgccgctgaagttcgtcgcccataccccgtgcttccgcagcgaggccggtgcctccgggcgcgatacccgcggcatgatccgccagcatcagttcgacaaggtggagatggtgcagatcgtcgatccggccacttcctacgaggcgctggaaggcctgaccgccaacgccgagcgcgtcctgcaactgctcgagttgccgtatcgggtgctggcgctgtgcaccggcgacatgggcttcggttcgaccaagacctacgacctggaagtctgggttcccagccaggacaagtaccgcgagatttcctcctgctccaactgcggcgacttccaggcccggcgcatgcaggcccgctaccgcaatccggaaaccggcaagcccgagctggtgcacaccctcaacggctccggcctggccgtcggccgcaccttggtggcggtactggagaactaccagcaggcggacggctcgatccgtgtgccggaagtcctcaagccctacatggctggcatcgaggtgatcggctga

SEQ ID NO: 14633 - DNA, 939 bp, Pseudomonas aeruginosa
catggatttcctgccgctgttccactccttgcaagggcgcctcgcgctggtggtcggtggcggcgaagtcgccctgcgcaaggcgcgcctgctggccgacgccggcgcgcgcctgcgcgtggtcgcgccgcagatccacatcgaactgcggcatctggtggagcagggcggcggcgagctgctcgaacgcgactaccaggacggcgaccagcccggctgcgccctgatcatcgccgccaccgacgacgaaccgctgaacgccgaggtgtcgcgagcggccaatgcgcgcgggataccggtcaacgtggtggacgcgccggccctgtgcagcgtgatcttcccggccatcgtcgaccgttcgccgctggtggtggcggtctccagcggcggcgatgcgcccgtgctggcgcggctgatccgggccaagctggaaacctggattccctcgacctacgggcaactggccggactcgccagccgcttccgccaccgggtcaaggaattgctacccgacctgcagcagcgccgggtgttctgggaaaacctgttccagggcgagatcgccgagcgtgtcctggccggccgtccggcggaagccgagcgtctcctggaagagcgtctggccggaggcctcgcgcacatagccacgggcgaggtatatctggtcggggccgggccgggggatccggacctgctgacgttccgtgccctgcgcctgatgcagcaggccgacgtggtgctttacgatcgcctggtggcgccgtcgatcctcgaattatgccgccgcgatgccgaacgcctgtacgtcggcaagcgccgcgccgaacatgcggtgccgcaggatcggatcaaccgcctgctggtggagctggccagccagggcaagcgcgtgctgcgcctgaagggcggcgacccgttcatcttcggccgcggcggtga

SEQ ID NO: 14634 - DNA, 420 bp, Pseudomonas aeruginosa
aaaccgtcgaaggggagactcttccgtgagttcgaatctcaccgcctccgccatatccgcgtactgaaaagccccgctgagcggggcttttgcattttcggggcgccgctcttccgcacttccgggtcgtttccgcagcctgcccggcgtcgattcgatgactctccgatttcgtcgggtaatggcttcagatcacgaagaagccgtgggttccgtcgcgaccgagttgctccaccaggccgaactcccagtccaggtagccctgcatcgcttcgcgcggattgtcggtaccttcgtaggggcggcggtagcggtcaatgcgcggcgacgccaacaggctttcgccgtcttccgtcggcaggcccgcggcgacccaggcgctggtgccgccgtcgagaaggaacaccggcttgccgctga

SEQ ID NO: 14635 - DNA, 459 bp, Pseudomonas aeruginosa
agtcggcgtcggagagtccgtccagtaccgcgacctgccagcccatctgggccagccaggaggcgctcatgttggcgcgtacgccatcgtcgtccaccagtaccaggcgcgcgccgcgcacgctggcgacatggtcggtttcctgaaccagctggccaccgggcgtggagcgggagccaggcaggtgaccggcttcgtattcctcgggcgtgcgtacgtcgagcaggtaggtggtgcggtcgtgctcgtcctgccattgggccagaccggccaggtcgaggcgttcgacgccggcgcggtcggcgacggcacgggcgcgctgggcggcggccttgcgtgtgtcctgcgagatcgcaccgaagcgtcgcgtctggccgtgttccagttgctgaccggccagcgtccagccgatggtgccgttgcgtaatgccgccaccgggttggggatgccggcgttga

SEQ ID NO: 14636 - DNA, 588 bp, Pseudomonas aeruginosa
tcggcgtgtcgcggcgcggcacccgggcatggatctccagttccagcctggacagcggcaggttggcggcgaacaggggatgggcctgggcgaacgggtcctcctcgcgcacgtcgagcagcgccagctcccggcgggcgaggagagcggcgcggatatcgtggaaggtgcgtacggcgatctggctcatgcggggttctctttcgacaggtcccagatattgggcaagcggctgttggaatagccggaaatgaagggtttttcctcaccttcggcgctgaacacggcacgccgtaccgcaccgatattggcgccgtagacgtggatactgatggatgtgcggtcgctgaaggcgttgctcacctggtgcacgtcgccaatgcgtggcgacagcgcttcgacctcgccgggctccaggcgtcgacgggctccgctgggatgcggacgcccccccgcatcgaaggcgtacggctgcgagtattcggccccgcggagcatgccgatcaggccccagacccgatgatcgtgtaccggtgtgatctggcccggcccccagacgaagctgaccaccgagaagcgctgccgtga

SEQ ID NO: 14637 - DNA, 285 bp, Pseudomonas aeruginosa
ccgctaccgcgatcagttgcgggtgctgcaactggaggatttccagccgctgatccagctctggctggtgcgtccgcgcctgctgggcaatctggaaacgccggcacggctgttcggcagggcggtggccgaggggttggatatgcaagccggttgagtagcggcgccgggagatccccgggagacgggagcgtgaatgagaaggggctgcagtcgggatcaacattcccctgcgagccccttttcgcttcagagggaagagggagcgagggctgctatgcatag

SEQ ID NO: 14638 - DNA, 2145 bp, Pseudomonas aeruginosa
ccatatcgcccgcctgccgctgttgcggcacgccggttgaggagctccgatgaaactcaagcaatacctgctaaccagcttcgccacgcttctgctcggtgcctccctggcccaggccgcagagctgccgacgttgcgtgtgggcgaccagaactactacaacgtgcgggcttccatggaggcctcgggagttctcgaaggcgcgccttaccaggtcgaatggaagcatttccagtccgccgcgccggtggccgaagggttgcaggccggagcgctggacctgggtttcctcggcgactcgggcttcatcttcctcgccgccaagggtgcgccggtgaagctggtcggcgtctcgcggcagaaccccgataccatagccctgctggtgccgaaggattctccggtgcgcagcattgccgatctcaagggcaggaaagtcgcctactggcccggtgcctggagccagcaactgaccttgcgcgcgctggagaaagccggcctgccgaaggactacgtggagttcgtcaagctgatgccgatcgacgccgccgccgccttgccgcgcggcagcatcgatgcctttccggtgtgggagccgtatatctcgcagcagatcgtggtttccggcgcacggccgattctcaccgcccgcgacctgatgccggggctgtccagcatcgccgccaacgctgcttccatcgagcccaggcgcgcgcagatcgccgacttcctcggccgcctgcgcaaggcacgggcctgggtcgaggcacacaaggagcagtacgccgacctctgggcgcagaaggccaatctcgaccgggcagtctcccgccattggatcggccaggccggcatgagcgtcggcccggtatacgcccaggccgccaccgactaccaggagaccgcggatttcctgctgcagaccggtgccttgcccaagccgttcgacacttccacggggatcgacacgtctttcaacgaagccttccactgagtacggaccatgagcatccagtttctcggcatgatcggccatcgcctggcctcggagaccctcgcgccggtcggacctatcctcgacaagccttacatcgccgctttcgcacgcgcccacgaagaggccggcttcgatcgaatcctggtcggctactggtcggaccagccggatggattcctggtggccgccgccgctggcctggccacttcccggatcggtctgctgctggcgcaccgccccggtttcgtcgccccgaccctggccgcgcgcaagctggcgaccctcgaacacctcctcgacgggcgcctggcggtgcatatcgtcagcggcggcagcgacgccgaccagcgcaaggacggcgattatctcgaccacgaccagcgctatgcccgcagcgacgaattcatcgaactgctcaagcgcacctggaccagcaccgaacccttcgatttccacggcgcgtactaccgcgtggagcacgccttctcggccatccgtccgcagcagaaaccgcacattccggtgtatttcggcggctcctcggaagccgcgctgaaggtcgccggcaagcaggccgatgtgttcatgctctggggcgaacccctggcacaggccgccgaaaccatctccgctgtgcgcgaacaggcgcgctcgaatggtcgcgaagtggagttcagcctgtcgttccggcccatcctcgggcgcacggaggacgaggcctgggccaaggccgaggcgatacgcgcaagcgccggcgcgcgcctgggcgaggccggcttccccaagggcaagccgcagagcgtcggcgcccagcgtctgctcaaggcggtggagcagggcgagcgcctcgacgagcgcctttggaccggaatcgccaggctggtcggtggcgggcacaactccaccgccctggtcggtaccgcggaacaggtggccgacgccctgctcgcctactacgacctgggcgtgcgcaatatcctcattcgcggtttcgatcccctcgccgatgccgtggaatatggccgcgagctgatcccgctgacccgcgccaaagtcgccgagcgcgagcgccggcgcgccacggcctgatcccatggccgtcctgcagactccctcggcggcgttcgacgaatggctgccggaactga

SEQ ID NO: 14639 - DNA, 528 bp, Pseudomonas aeruginosa
cctggctggcggtatgggcgcgcagcgacgagccgatcccccgcgtgggtacctggctggtgcgccgcgacagcccaggcatccgtatcgtggagagctgggaccatctgggcatgcgcgccagcggcagccacgaggtgctcttcgaagaggtggcggtgcctctggaaaacgccatcggcctgcatccccacgaccagcctccggcgccggaccaggccgtgctgcgcgacttcgcccaggctagcgcggtgttgcttggcgctctctacgacggtatcgccgggagcgcccgcgagtggctcgtcggctggctgcgcgagcgcgtgccggccagtctcggcgcgccgttggcgagcctgccgaggatgcaggaggcgctcggcgagatcgacggcctgctcctgcagaaccgcctgctgctcgatgccgcgtgctgcggacagttgcccgccagcgactccgggctgctcaaggtcgcggtcatcgacaacgcgttggcggtggtcgaggaggccctggaactga

SEQ ID NO: 14640 - DNA, 873 bp, Pseudomonas aeruginosa
acatgccgcgcgaagtcactcggcgctgggttggcgaggcgcgcatcagtcctgtggtcttcggtccggaggttgccgccaccctgcagaccgccgccgatttcttccatgccgaaggcgtgctgccgaagtcgctggaggtcgccccggcgttcgacttcagcctgtccgccggtgccgccgaagtggcccgccagttgcccgccgacctccgcgtcggccagcgttgaggagttacggaatgcgtcagaccctgagcctgttcctgcttctctgcctgctcgtcggccaggcctgtgccgacgagcgcgtgaccctgcgcctggccgaccagaagggcaacatgcgcgcccagttggaggctgccggcgcgctggacgacctgacctacgacatccgctggttcgaattccccgccgccgcccccctcgccgaagcactcaatgccggtgcggtggatgccggcatcatcggcgacgcgccattgctcttcgccctggccgccggtgcccggctgaaggccatcgccgtcgacaaatccgatccctacggtaccgccgtgctggtgagaggggattcgccgctgcgctcggccaacgacctgaaaggtcagcgcattgccaccgggcgcggttccatcggccacttcgtcgcgctcaaggccttggcctcggtcgggctgggcgagaaggacgtcgaattccgcttcctcggcccggtggacgcgaaaatggccctcgccaatggttccgtggatgcctgggcgacctgggagccctacaccgcgttcgcggagaccgccgacaaggctcgggtactggtcgacggtcgcggcctgtgggctggcaacagcttcctcgctgctaccgatag

SEQ ID NO: 14641 - DNA, 189 bp, Pseudomonas aeruginosa
cgcactggccgacccggcgaaacgcgccgtgctgcaggactacctgcaacgcctggccagcgcccagcgctgggcgtacctgcacctggacgagtattcgcgaagcctggcgcagatcatcggcttccccgaggacgccgcgcgcttgcagttcgaacgccggcgcttgcgttggcaggcgctggatga

SEQ ID NO: 14642 - DNA, 1290 bp, Pseudomonas aeruginosa
gcatggttttctccatcaggcatgcccggggctttcccgccctgggggagaggtatctctatcggtcgcaggtcagccggcaagccgcatcctgacggacgaggcagagcctcgcccggtgaaagacgcgaacgccggtcctggcggacctcgctggatttttctggctccgggcgctcccgcgcttccagggggcgtctcgggcgggtgtcagctcccggtcttgacccggctccagacccgggtacggattctctcgaccttcagtggcagggtttccagcgggaagagggtcgccatggtttccttgctcaggtaaaccgccgggttttcccgcagcttccgctctaccagcggcagcgccgcctggttgccattcggatagcccacgtagttggaggtcctggcgatgacctccggacgcagcaggtagtcgatcagcgcataaccctgctgcggatgcggtgcatccttgagcagcaccatgttctcggcccagaccagcgagccttcccggggaatgctgtaggcgatatggcgaccgttcccggcctgttcgttgttgacctgggccatgtaggccgtaccctgccagccgaccaccacgcagacgttgccgttggagagatcggtgtcgactctggaggagtcgaaatagcgaatgtaggggcgaaccttcagcaacagttcctgggctttctggtagtcctcgggattctggctgttgtgcggcaggcccaggtagttgagggcgatggacaccagctcggtggaggagtccagcgtggccacgccgcactggctgaggcgggagatgttctcctccttgaagaccaggtcccaggagtcgaccggcgcgtcggggccgagcagcttgcggaccttgtccacgtcgtaggcgatcccggtggttccccagagataaggtacggcatagcgattgccgggatcgttggcctgaagcttcccgaggatgtccgcgtcgaggttcttccagtgggggagccggtcgcggtcgagttcctggaggacgcccgccttgatcagcccgggcaggatgttggaggtgatcaccaccacgtcgtagccggagcggccgaccatcagtttgccctgcgcggtctcggcgctgtcgaaggtgtcgaggacgacacgggtgccggtttccttctggaaagccttgggcgtttccggggcgatgaagtcataccagttgtaaagatggacgctggtttgcgcagcccatgcactgtccgccgctgtcgcaccgatcgtcgtcaggatcgataa

SEQ ID NO: 14643 - DNA, 906 bp, Pseudomonas aeruginosa
aaaagccggcgtcggattgcactcatgggcgaattccatccaggacgattcgaccatgcccgatgtacgtctttcctctcgttcgttgacccccgtgctctgtgcggtggggctcgcctgcgcgctgcagggcgaggtgcaggccgccgacggtgggccgcgcgacgcggccacggcgccccgggtattcgacatagcgcccggcgaactggccgaggtgttgttgaacatcgtgcgccagggacacgtgccgatcgccttcgaccagcgcctggtggcggggttgcgcggaccggatatccgcggccggctcagtgtcgaggacgccttgcggcgtgccctggccggcagcgggctggcatacgcgcaggacgaaagcggtgccttcgtcctgcgccgcggacaggcgcctgtgcaggagacgcgaggtgcggcggtggcaccgaccttgtccaccgtggtggtcaccggcacgcgcaagagcgatgtgaaggcgcaggacagcctgagcccgatcgatgtggtcagcgctacccagctacgcagcagcggtgcggtcgacctgcgcgatgcgctggtcaaactgctgccctcgctgacccgccaggcccagccgttcaacgcctcggcgttgacccacacgcagtcgctgcgcgggctgagccccaaccatgtgctggtgctggtgaacggcaagcgtcgccacgaaacggccaatctcaatatcagcggcgggctggagaagggctccaccggggtcgatctggacaccatcccgatcaacgccatcgaacgtgtcgaggtgctgcgcgacggtgcttcggcacagtacggttcggacgccatcgccggggtgatcaacgtcatcctcaagtccgccgacagcggcgggtcggcggccgctga

SEQ ID NO: 14644 - DNA, 1308 bp, Pseudomonas aeruginosa
aaccggcaacagcccgagaagcttcgacctggcgcgctaccgcaacagccaatggaccagcaacctggacctggggcgagaattcgaactggatttcctcgctgctccgccgggcgttgtcgctggggtgcggaataccggcgggaaagctaccgcatcgacgcccgcgaaccggcgtcctactacagcggcggggcggaatccctggctggcctctcgccgctcagcgaggggcaatggtcgcggcacgcctgggcgtcctacctggacctgggtacctccctgaccccagcctgggaggtcgacgtggcggtgcgccacgagaaattcagcgacttcggcagcaccaccaacggcaagttcgccacccgttaccagttcgatccgcgggtggcgctgcgcgccagcgtaagcagcgggttccgcgcgccgtccctggtccaggagcactacaccggcctcagcgtcggcccgaccatcgcccttggcctgctggcggccaactcgccggcggcgaagatgctcggcgccgacgaactgcaaccggagaagtcgaccagcttcaaccttggcctggtactcagcccgtgggaaaacgtcgggctgaacatcgacgcctaccagatcagcatccgcgaccgcatcgtcgacagcgccacctattccggccaggaagccatcgatgccctggccgcggcggggatctcgttgccggccagtgccagtacggtcagtacccattacctggccaacggtgccgacacccgcacccgcggtgtcgacatcaccggtcactacctcgtcgcgcttggcgagtacgggcaggtcgactgggaactgtcggccaacttcaaccgcaccaccttgcgcaagaaccatcgaggcgccaacggcgagccgctgctcaatgcccagcaggtcgcctggatcaccagctccaccccgcgcagccaggtttccctcggcggcacctggagccgccaggactgggaggtcagcctgcgcctgacgcgctacggccggaccagctcggaactcgactacacggtagggccggacgcctggtcgacggagaaattcaaccatttcgtcaacgacccgaagtacatcaccgacatcgccgcgcgctaccggctcagcgccgacctgacgctgaccgccggcgccgacaacctgttcgacgtccgtccggacaagctgcccgcgcagaacaccacctatggcgacgtgctgcgctacgacacctatgcctcgcagatcggcttcaacggcgccttctactacctacgcgcggcataccgcttctag

SEQ ID NO: 14645 - DNA, 663 bp, Pseudomonas aeruginosa
tgcgcgacgaggtgcagcgtgattaaggtgctggtggtcgacgaccacgatctggtacgcaccggtattacccgcatgctggccgacatcgaaggcttgcaagtggtcggccaggccgactgcggtgaagactgtctgaaactggcccgcgaactgaagccggatgtcgtcctgatggacgtgaagatgcccggtatcggcggcctggaggcaacccgcaagctgctgcgcagccagcccgacatcaaggtcgtggtagtcaccgtctgcgaagaggatccgttccccacccgcctcatgcaggccggcgccgccggctacatgaccaagggcgcggggctggaggaaatggtccaggcgattcgccaggtcttcgccggccagcgctatatcagcccgcagatcgcccagcaactggcgctgaagtccttccagccgcagcagcacgattcccccttcgattcgctgtccgagcgcgagatccagatcgccctgatgatcgccaactgccacaaggtgcagagcatctccgacaagctgtgcctgtcgccgaagaccgtgaatacctatcgctaccgcatcttcgagaagctctcgatcaccagcgacgtggagctggcgctgctcgccgtccgccacggcatggtcgatgccgccagctag

SEQ ID NO: 14646 - DNA, 1827 bp, Pseudomonas aeruginosa
atgagcgccgttttcgacgcaagcgctttcctcgctacctgcagcaatcgtccgggcgtctaccgcatgttcgatgcggacgccaagcttctctacgtgggcaaggcgaagagcctgaagaagcgcctggccagctatttccgcaagtccggcctggcgccgaagaccgctgcgctggtggcgcggatcgcccaggtggaaaccaccatcaccgccaatgaaaccgaggcgttgctgctggagcagacgctgatcaaggagtggcggccgccctacaacatcctgctgcgggacgacaagtcctatcccttcgtgttcctctccagcgaggacgagtatccgcggctgtccctgcaccgtggcgcgaagaagcgcaaggggcgttacttcggtccctatccgagcgcgggagcgatccgcgagagcctcaacctgctgcagaaggcgtttctcgtccgccagtgcgaggacagctatttccgcaaccgtacgcggccctgcctgcaataccagatcaagcgctgcaaggggccctgcgtggggctggtcagtcctgaggagtacgccgaggacgtgcgccactcggtgatgttcctcgaaggaaggagcaacgcgctggccgacgagctgaacgtcggcatggagcaggcggcgatgcgcctggacttcgagaaggcggcggagttgcgcgaccaggtggcgatcctgcggcgggtccaggaccagcagagcatggaaggtggcaacggcgacgtcgacatcgtcgccgccatcgtcacccctggcggcgcttgcgtacacctgatcagcgtacgcggcgggcgggtgctgggcagcaagaacttcttcccgcaggtcgcgatcgaggaggaggtgggcgaagtgctgctggcgttccttggccagtactatctcagccaccaggagcgcgacctgccggcggagttgatcgtcaacgtgacgcacgaggatttcccggtgctggtttcggcgatcgccgaagcgcgaggccgcgaactggagatcagctaccgggtgcgtggtacccgcgcccgctggcagcaactggcggtgaccaacgccgaacaggccctgggcgcacgcctggccaaccgccagcatgtggcggcacgcttcgaagcccttgccgaggcgctcgacctggcggagccgccgcaacgcctggagtgcttcgatatcagtcactccagcggcgaggccaccgtggcttcctgcgtggtgttcggcccggaagggccgctgaagtcggactatcgccgctacaacatcgaaggcgtcacggccggcgacgactacgcagcgatgcaccaggcgctgacccgccgcttcagtcgcctgaaggacggcgaggggaagatgcccgacattctcctggtggatggcggcaaggggcaattggccatggcccaggatgtgctccaggaactggcggtcgccggtctgatcctgctcggcgtggccaagggcgtgacccgcaagccggggctggaaaccctctacctgaacgatgcctcccacgagttcaccctgccggccgattcgccggcgctgcacctgatccagcagatacgtgacgaagcgcaccgtttcgccatcaccggccaccgtgcgcggcgcggcaaggcacggcggacgtcgacgctggaggacgtccctggcgtcggcccgaaacgtcggcgcgacctgctcaagcatttcggcgggttgcaggaattgtcgcgggcgagtatcgatgaactggccaaagcccccggtatcagtaaaaagcttgccgagcagatttatgccgtcctgcacagcgagtag

SEQ ID NO: 14647 - DNA, 594 bp, Pseudomonas aeruginosa
aatgccggctcacctcgcagcctagatggtccgatgaatatccccaatctgctcacgttactgcgcgtcctgctcattccgatcttcattctgctgttctatctgccgacgtcctggagctacctgaccgccagtgccgtgttcgccctggccgccgccaccgactggctggacggctacctcgcccggcgcctcggccagagcacgccgttcggcgccttcctcgacccggtcgcggacaagctgatggtggcggttgcgctggtcttgctggtggaagagcacgccaacctgtggctgaccctgccggcggtgatcatcatcggccgcgagatcgtggtttccgccttgcgtgagtggatggccgaactgggggcgagggcgcaggtcgcggtgtccaacctgggcaagtggaagaccgcggcgcagatgctggcgctggtcattctcctggcgaatccgccgctgatgaccttctgggtgattctcggctacgtgctgctgatcatctccgcggcgctgaccctgtggtccatggtgcactacctgctggccgcgtggccgcatctgtcgaccaccccgaaagagaaataa

SEQ ID NO: 14648 - DNA, 1395 bp, Pseudomonas aeruginosa
cctctccatcccgatcagcatcggcgtggcgaggaaccagccggagctgcagggcatcctggagaaggcgcagctggcgatcgctccggaagaagtggcggaaatcctccaccgctgggagcctcgcttcgccaagggaggggcggacttctggcgcgatcaccggagcaagattctgcagatcggcggattgttcggcgtactgatttccatctccctcatctggggtttctacctgatgcgccaggtgcgcaagacccgccaggcagaagagcaagccgacgctgccaaccgtgccaagagcgtgtttctttcgacgatgagtcacgagatccgcacgccattgaatgcggtcatcggcctgcaggaactggtgctgaaaaagggcgagaagggcgtgttggacctagattcgctgagcattgcccaggaggccgcccaggggttgctgcttctgctgggcaatattctcgatttgtcgcggatcgaatccggtcggttcgattcagctcccgaatcagtgcttcctggcgagttgatcagaggaatcctgccgttggttggtgggctgacgcggcagaagaatctttccctggcactggaactcgacggggatctcgagcactgggtgctggtggatcccctgcatttcaagcaggtgttgttcaacctgctgggcaatgccatcaagttcaccgagcgcggaggggtaacggtgcgggcagtggggcggcgcgaggcggagaggcttcatttgctgctcgaggtaagcgacaccggcctcggtatttcggaggaggaccaggccaggctgttccggccattctcgcaggtcggctcgcctgcgcttggccaggcgtccggcagcggcctggggttgtacatcagccgacgcctggtgcacctgatgggcggccagatcagcctgcgcagcgaactgggcaacggctcctgcttctcggtcgagttcgatcttccgctgaccgagcctccgcccagcgagtccagcgaagcgcgttccggagttgccgaggtcgaggagcggaaagaggcaagggcgctctcgatattgcttgcggaagaccatccgttcaatcggctgaccctgaccatgcaattggaaagccttgggcaccgggtgacctccacggaagatggcgaggaagcattcgaacgttggcagggcgaagacttcgacgtcgtgattaccgacggcatgatgccgcggatggatggctacgagctggcgcgacggatccggtcgcaagaagcccttggcggtcggcgtcgctgcttggtgatagcgcttaccgccagcgccgagaaggatgcgctggagcgttgcctggctgccggcatggaccgggtcctgttcaagccgactacgctcgatga

SEQ ID NO: 14649 - DNA, 327 bp, Pseudomonas aeruginosa
tgcacgacgccttgcgcgccgacgtcctggcggcgttcgtggtccagcccggcgacggcgcggcggccgagcaggtccgccaggacctgcaggagcacagccagtggtttcgcaaggtggtcgagcagaaccaggggctgcctctcaacgacgccatccaccaggcgctggtcgagttgcggcccgacctggaagcctacatcggcgccgccgagagcatcgtcggcaaggcgttgctcgatcccgtggcggcacgggccgagctgccgcagttcgtccaggccttcaaggagctggaagggcgcaacgaagcgctcagcagcctga

SEQ ID NO: 14650 - DNA, 465 bp, Pseudomonas aeruginosa
agaaggcgagcggcgcgggatgtgctagggtgcccgtttgcagggaggacccagggcatggagcacccatacaagaccccagaggcggacctggccgaggagaagctgactgcgagaggtttcctttccggcgggcagccgctgtggaaggcattctggctgttcttcgctgcgggtttcttattgctcagcgtcgccgccaggcaggcgatggtggccattgtcgatccgctgatgcaggaagctcccggcgaacatgcggtggccctgaccttgtggggaatggtcggtgtcgagctggttaggctggcctacctgtgcctcagcctcgtcgtggtctggcgctgcgggcgcaattcccgctgggcggctgcgcgccatgccagcagggcggtgctgttggcactgatactcctgaccctttactcgatctatctggtctgggccttgctcgccagtccctga

SEQ ID NO: 14651 - DNA, 636 bp, Pseudomonas aeruginosa
cgggtagcgcttcaggttgcggatcgactcccagcggaaggtgccgatggataccatgatcatcaccgccaccagggccgccatgggaatccgcccgacccagtcgctgaggaacaccaccatcagcagcagcgcgacgccggccatcagggtcgagagccggctgcgcccgccggatttaacattgatcaccgactggccgatcatcgcgcagccagccatgccgccgagcaggccggtggcgatgttcgccaggccctggcccttgcattcgcggttcttgtcgctgccggtgtcggtcatctcgtcgacgatggtggcggtcatcagcgactccagaaggccgaccaccgccagggcggcggagtagggcaggacgatcagcagggtgtcgaggttcagcggcacgtccggccagaggaacagcggcaggctgtcgggcaactgacccatgtcgccgacggtgcggatgtccaggcccaggtagatggatatgccggtgaggaccaggatgcataccagcggagagggcagcagccggccgatccggggcaggtgcgggaagccgtagacgatcgccaggcccgcggcggtcatcgcgtagaccggccagccgacatcggtgagttcgggtag

SEQ ID NO: 14652 - DNA, 402 bp, Pseudomonas aeruginosa
ctgggccatgaagatgaggatcgccagggcattgacgaaaccggtcaccaccgagcgcgagacgaagcgcatcagcgaacccaggcgcaggtagccggcgagtatctgcagcacgccgcagagcagggtcgccgccagcaggtattgcaggccgtggtccttcaccaggttgaccatcagcagcgccatggcgccagtcgcggcggagatcattcccggacggccgccggcgaaggcgatcaccaccgccatgctgaaggaggcgtacaggccgatcttcgggtcgaccccggcgatgatggagaaggcgatggcctcggggatcagcgccagggcgacgaccaggccggcgagcaggtcgccgcggaggttggagaaccagttctgtttcagcgtctgtag

SEQ ID NO: 14653 - DNA, 774 bp, Pseudomonas aeruginosa
cgccacaacgctatccgccatgaccccccgttggagcggcggataatcgcgttgcggttgtccgccttacctcatggaagtcgttttcttaccccaggtcaggcccgcaggcgttgcagggcatcgcccagttgcgcggagaggccgtggagatcgcggctggcggcttcggtctgctccacctgttcctggttgctggaggcgatcgaggcgatttccgtgaggttgcgggaaatgtcctcggccacggcggtctgttcctcggcggcggtagcgatctggcggttcatgtcgcggatcgattcgaccgaggcggtgatctggcgcagcatggcgccggcgttggcaacctgctcggcaccggcctcgctgcgcgactgcccgctttcgatggcgcgcgcggcattcaccgcgccgttctgcacggtatcgatgatctggtggatctcggcgatggactcggcggtgcgctgcgccagggtgcggacctcgtcggcgaccaccgcgaagccacggccggcatcgccggcgcgggcggcttcgatggccgcgttgagagcgagcaggttggtctgctcggcgatgccacggatcacgtcgaggaccttgccgatcctgccgctatcgctttccaattggcggatgacctccaccgtatggtcgatctccttgcgcatctcgccgatgctgcgaatcgtttcttccatcacgtcttcgccgcgctgggcggaatcgtccgcctcgtcggcggccctggccgcgtcgccggcgtag

SEQ ID NO: 14654 - DNA, 1806 bp, Pseudomonas aeruginosa
acatgctcttcgacttcaccgacaccgctcgccggtgtccgtcgtagcgccctggcggcgcaggacgacggttcagcgacattcccagaacaaccacaacaagggaaagccatgaatcagccgagctatacctcgggtcgccaggatgtcgccttgctggcgaccaccgtcggcgacgccttcgatgccaccgtcgcgcgtcatgccgagcgcgaggcgctggtggtgcggcatcaacgcctgcgctacagctggcggcaactggcggagcgggtcgatgcctacgcccgcgccttcatcgccctgggcctgcgccccggcgaacgcctggggatttgggcgccgaactgcgccgaatggtgcattacccagttcgccagcgccaaggtcggtgcggtcctggtgaacatcaacccggcataccgcagcagcgagctggaatacgctctcaagcagtccggttgcagttggctgatctgcgccgacgccttcaagaccagcgactaccacgcgatgctcggcgacctgctgccggagctggcgcgggcgcgtccgggcgaactggccagcgagcgcctgccggaactgcgcggcgtgatcagcctggccgagcgggcgccggcgggcttcctgcactggcagggcctgccggggctggccgccgcggtaggcgccgaggaactgcgccagcgccaggcctcgctgcagttcgacgagccgatcaacatccagtacacctccggtaccaccggcttccccaagggcgccaccctcagccactacaacatcctcaacaacggctacatggtcggcgaaagcctcggactcggcgcggaagaccgcctggtgatcccggtgccgctgtatcactgcttcggcatggtgatgggcaacctcggctgcgtcacccacggctcgaccatgatctacccggcgcccagcttcgacgccgaggcgaccctgctggccgtggccgaggagcgcgccaccgcgctgtacggggtaccgaccatgttcatcgccgagctggatcatccgcgccgccgcgaattcgacctttccagcctgcgcaccggaatcatggccggcgccacctgcccgatcgaggtgatgcggcgggtcattggcgacatgcacatggccgaggtgcagatcgcctacggcatgaccgagaccagtccggtgtcgctgcagaccggtccggacgatggcctggagctgcgcgtgaccactgtcggacgcacccagccgaggctggagagcaagatcgtcgaccagacgggcagggtggtgccgcgcggcgagatcggcgagctgtgcacccgcggctacagcgtgatgctcggctactggaacgacccccaggccaccgccgaggccatcgacccggcgcgctggatgcacaccggcgacctggcggtgatggacgacgacggctacgtgcggatcgtcgggcgcagcaaggacatgatcatccgcggcggcgagaacatctatccgcgcgaactggaggagttcttcttcactcacccggcggtggccgacgtgcaggtgatcggcatccccgacgagcgctatggcgaggaaatcgtcgcctggatcaagctgcatccgggccaccacgccgatgacgaacagttgcgggcgttctgcaaggcgcgtatcgctcacttcaagatcccgcgccacttcaagttcgtcgacgagttcccgatgaccgttaccggcaagatccagaagttccgcatgcgcgagatcagcatcgaagagattcgcctgctcgcgctgcgccaggggcgcgattga

SEQ ID NO: 14655 - DNA, 447 bp, Pseudomonas aeruginosa
aagcgctctccggacgtttcgccaatttcctccaggcccagggcgtacgcccgggcgactgcgtcgccggcctgttgccgcgcacgcccgagctgctggtcaccatcctcggcgcctggcgcctgggcgcggtgtaccagccgctgttcaccgccttcggcccgaaggccatcgaacaccggcgtggcgaccgccggcagcaaggtgctggtcaccgatgcggccaaccgcgacaagctcgacgaactcgccgatccgcctctggccgtcaccgtcggcggaccgaaggggcagggcatccgtcgcggcgatttcagcttctgggccgagctggagtgctatccggccgaattcgaaccggttccgcgcagcggcgaggatccgttcctgatgatgttcacctccggcaccaccggcctggccaaaccggtgccggtgccgctttag

SEQ ID NO: 14656 - DNA, 1482 bp, Pseudomonas aeruginosa
  unsure (63): Identity of nucleotide at the above locations are unknown.
gagatccccgccttcgtcggtgacatgcgcgaggcggtggacctgcgcccaaaggacgcaatnttggaacctcgccaatccgggttggccctacgggctcctaactacgctgtcgccggtcccttcgccatgggccatcggaccaccttctacgaagggccgttcagcgtggaaagcacctgccggatcatccgtggactacggcatcaccaaccttgccggatcgcccaccgcctatcgcctgctgatggccgccggcgcggccgcggaaactgcgctgaaggggcgcatgcgcgcggtcagcagcgccggcgagccgttgaccccggaggtgatccgctggttcgccgacaggctcggcaccaccatccacgatcattacgggcagaccgagctgggcatggtgctgtgcaaccaccatgccctggcgcatccggtgcgggtcggcgccgccggattcgcctgtcccgggcaccgggtagtagtgctggacgacgatctcaacgaactgccgcccggccagccaggcatcctcgccctcgaccggcggcgttcgccgctgatgtggtttcccggctaccagggcctggaaaccgcagccttcgtcggcgactactacctgagcggcgataccgtcgaactcaacgaagacggcagcatcagcttcgtcggccgcgccgacgacgtcattaccacctctggctaccgggtcggcccgttcgatgtggagagcgcgctgatcgaacacccggcagtgatggaggcggcggtgatcggcaagcccgacccggagcgcaccgaactggtcaaggccttcgtcgtgctctgcgccggccaccggccgacgccggaactggcggacgcattgcagcgatacgtgcgccagcgcctgtcggcgcacgcctacccgcgggagatcgagttcctcgaggaactgccgaagactcccagcggcaagatccagcgctttctcctgcgcaaccaggagatcgcccggcaacgcgaggcggccccacgggcggccgccgcgaactgattcagcaggagaaaacgacgtgcgtatcgaaaatcgagtgttcctggttaccggcggcagctccggcctcggcgccgccaccgcgaagatgctggtggagcagggtggcaaggtggtgctggccgacatcaacgccgaggccggcgcggccaatgccgccgagcttggcgcccaggcgcgcttcgtcagggccgacatcgccagcgaggccgacggccgccaggccgtggccgctgcactggaggccttcggcggcctccatggcctggccaattgcgcgggcgtggcgccggccgagaaggtcctcggacgcaatggcatccatgccctggagagtttccgccgggtcatcgacatcaacctggtgggcagtttcaacatgctgcgcctggccgccgaggccatgtcccagggccagccggacgagggcggcgagcgcggggtga

SEQ ID NO: 14657 - DNA, 567 bp, Pseudomonas aeruginosa
cgacgagcagccgccgaaggcccggctggacaagatcccgaccctgaagccggcgttccgcgaaggcggcacggtgaccgcggccaactccagttcgatttccgacggcgccgccgcgctggtcctgatgcgcctttccgaggccgagcgacgcgggctcgcgccgttggcggcgattcgtgggcatgcttcgttcgccgacgcgccgaacctgttccccaccgcgccggtcggtgcggtgaagcgcctgatgcagcgtaccggctggtcgctgggcgaggtcgacctgttcgaggtcaacgaagccttcgccgtggtcggcatggcggcaatgcgcgacctcgacctgtcccacgagcgcctcaacgtccacggcggcgcctgtgcgctgggccatccgatcggcgcgtccggcgcgcggatcgtcgtgaccctgctcaacgccctgcagcagtacgacctggaacgcggcgtggcggcggtctgcatcggcggcggcgaggcgaccgcgatcgccgtcgagcgcttgcgctgatgcaggcagtgaagaagaggaacccgcgatga

SEQ ID NO: 14658 - DNA, 441 bp, Pseudomonas aeruginosa
tcgtcttcgcggtcaccgatccggatgccggaaagcgcggcatcagcgcgttcatcgtgcccaccgacacgcccggctacgaggtggtgcggatcgaggacaagctcggccagcacgcctcggacacctgccagctggccttcaacgacctgcgtatcccggccacgctgcgcctgggcgaggagggcgagggctaccgcatcgccctggccaacctcgaaggcggccgcatcggcatcgccgcccaggcggtcggcatggcgcgcgcggcgttcgaggcggcgcgcgactacgcccatgagcgggaaaccttcggcaagccgatcatcgagcaccaggcggtggccttccgcctggccgacatggccacccgcatcgccgtggcgcggcagatggtccaccacgccgccagcctgcgcgaagccggcctgccgtgcctga

SEQ ID NO: 14659 - DNA, 384 bp, Pseudomonas aeruginosa
tctgctcgcgcatccagcggttggccgggtcctgatcggtgctctcgtgccagtacaggtgggtttccagcttcggcacgtcgctcaccggcagcaccgcgtagtgcaggtcgtggtgacgggcgaagcgttccggcacggtcatcgccatgtcggtctgctggaccaccgtggaggccatcaggtagtgctgcgagcgcagcgcgatcttgcgctggatgcccatcttgcccagcgccaggtcgatgtagccgaggccgctgcggcggctggaaatatggatgtgggtcaggcccaggtaatcgtccagggccagcttcggcttgcccgccagtgggtggccgcggcgcatggcgcagacgtagcggtcctccatcagcttga

SEQ ID NO: 14660 - DNA, 1302 bp, Pseudomonas aeruginosa
gccctgttccggcatcgttaccagcgcctttgtccgatgcctcgcctgccaacccgtcagaaggtatcccccatggatttcgcctattcccccaaggtccaggagctgcgtgaacgcgtcagcgcgttcatggaagcgcatgtctatcccgccgaagccgtgttcgagcgccaggtcgccgagggcgaccgctggcagccgacggcgatcatggaagagctgaaggccaaggccaaggccgaagggctgtggaacctgttcctgcccgagtccgagtacggtgccgggctggccaaccacgaatacgcgccgctggcggaaatcatgggccgttcgctgatcgggccggaacccttcaactgcgccgcgccggataccggcaacatggaggtgctggtgcgctacggcagcgaggagcagaagcgcacttggctggaaccgctgctgagcggcgagatccgctcggccttcgccatgaccgaaccgggcgtggcctcgtccgacgccaccaatatggaggcgcgcgccgagcgccagggcgacgactgggtgatcaacgggcgcaagtggtggacttccggcgcctgtgatccgcgctgcaagatcctgatcttcatgggcctgaccaacccggacgcgccgcgccaccagcagcactcgatgatcctggtaccggtcgacacccccggggtgaagatcctccgtccgctgccggtgttcggctacgacgacgcgccgcatggccatgccgaagtgctgttcgagaacgtgcgggtgccctacgagaacgtcatcctcggcgagggccgcggtttcgagatcgcccaggggcgcctcggcccgggccgcatccaccactgcatgcgctccatcggcatggccgagcgcgccctcgaactgatgtgcaagcgcgcggtcagccgtaccgcgttcggcaagccgctggcgcgcctgggcggcaacatcgaccacatcgccgactcgcggatggagatcaacatggcgcgcctgctgaccctgcaggccgcctacatgatggataccgtgggcaacaagatcgcccagagcgaaatcgcccagatcaaggtggtggcgcccaacgtggcgttgaaggtgatcgaccgggcgatccagatgcacggtggcgccggggtttccaacgacttcccgctggcttactggtacgccatgcagcgcaccctgcgcctggccgacggcccggacgaggtgcaccgcgcggcgatcggcaagttcgagctgggcaagtacgtgcccagggagatgctgcgcagcagccgctga

SEQ ID NO: 14661 - DNA, 783 bp, Pseudomonas aeruginosa
tgtccgccgggtacccgatggctgtgtggcttggcgccttgccggccctgtggtctgccgcggacggggatggccaggccatccgctcgaccaatcgccgtggcgaagcgtgcgtgtcgccgctccttcggccgacaaggaatgcgttccatgcctgatcaggtcaccgatgtccgtctgctcgacgacggctatagccgcgaagtccgctcgcttttctaccacgcctaccgccacgaaccgaccttcgcctacctgatggatgcgcagcgcgccggctacgaccagcgcgtgcgtgcctgcgtccgggagatggtcgagcgccatctgggcgaagagttgccggccatcggcctgttcatcgacgatcggctggtcgcggcggccctgatcacgccgccgcagcggcgcctggatatcaccgagagctggagctggcgcctgcgcatgctgttcagcgtcggcctggccgcgacccggcgctacctggattaccaccgggcggtgcaggcctgcctgccggtcggcccccaccaccagttgccgatgctcggcgtgcatcccgagtaccagggcaggcagatcggcgagcagttgctggccgccgtgcagcgctggtgcgccgaggactccgcttcgcaggggctggtcctggataccggcaatgcgcgctacctggacttctaccagcggcacggctaccgcgagatcggcgaggtgacgctgggagcggtgcgcgagcacgtcctcctgcatcctggcgagacgccggcggcgacctga

SEQ ID NO: 14662 - DNA, 516 bp, Pseudomonas aeruginosa
cctcggcgagcgggacgaggcggcgttgcaacgtttccgtcgcaatgccgaggcgcaggcggaaaaggcggcccaggcgctcggctacttccaggcgcagatcgacagcgaggtgaaggacggcaagccgccgaagctcacgctcaaggtagtgcccggcgagcccgtgcgcctgcgccaggtgaacatccaggtgctcggcgaggccgccagcctggagagcttccgcttgccgtcgggcaagcaactgaaagcgggcgcgaagctgaaccagggtgtctacgaggacgccaagcggctgatccagaaccaggcctcgcgctacggcttcttccagggccgcttcagcacccagcgcctgagcatcgatccgcgcgccggcatcgccgacatcgacctggtctacgacagcggccagcgctacaccttcggcaaggtgagcttcgacggcgactcgatcatcgaggaagaactgttgcgccgcatggtgccgttcaaggccggccaaccctatga

SEQ ID NO: 14663 - DNA, 4497 bp, Pseudomonas aeruginosa
cctgggattcgagtcggaaatctccgcaccacggcagaacgtcggcgcctggtacgagattcccctcgatccgccgctcaccgacaagctgcgcttcaccagcggctaccagttcgaagacctagtcgacaccgagagcaagctgctgacccttggcggcgaatggcacagcaagcagcccgatggctggcagcgggtggtttcgctgaactggatgcgcgaggagtacaagctgggcgacgactccgggctgagcagcttcctgatgccggggatcggctactcgctgctggagaccgacaacaaggtcgaccccagccatggctaccgcctgcagttcaacgtcaagggggcgaaggaaggcctgctggccgacgccgacgtcctccatgtcgacgccatggccaagggcctgaccagcttcgccggcggccatcgcctgctcggccgcctgcaggtaggcggaatcgccaccaacgactacaagtcgatcccgccctcgctgcgcttcttcgctggcggcgaccagagcgtgcgtggctacgactaccggacgctgtcgccggagaattccgatggcgacaagatcggcggccgctacatgatcgccggcagcgtcgagtatcaatatccgctggccgagcgctggcgcctggcgaccttcgtcgaccagggcaacgccttcaactcgctggacttcccgtcgatcaagaccggggtcggcttcggcgtgcgctgggtctcgccggtcggcccgttgcgcctcgacctggcccatgcgctcgacgacgacggcggtttccgcctgcacttctccatggggccagaactgtgaaggcgctgaagatcaccttgctggccatagtcgggctgctcctcgcgctgctcctgggactcgctgcgctgctcggcacccaggccggcagcgcctggctgctcggccgcgtgccgggcctgcaggtcagcggcttcgagggtcgcctcggtggcgcctggcaggcacggcggctgtcctgggcgcaggatggtacgcaactggtcgtcgagcggcctgaactgcgctggtcgccggcctgcctggcggggctgcgcctgtgcctgcagcgggtggccgccgagcgggtcgcgctggacctgccgccgagcggcgacagcgccgacagcgggccgatcagcctgccgacgctgaaactgccgctgagcatcgaactcggcgaagtggcggtcggcagcttcctgctcgacggcaaccagcaggtcgccgaactcaagctggcggcccattggctggccgacggcctgcacatcgactcgctgacggcgcggggcttcggcctggacctggcgctccaggggcgcttgcagccgagcggcgactggcccttgcaggccgaagccacgctcggcctgcccgctcccgaaggcaagccgtggaagctggccgtccaggtcggcggtgagctgcagcaggcgctgaccctgaaaggccgcagcagcggttacctggacggcagcctggaaggacagttgcaggcgctggcggaaaacctgccggcacgattgctgatccgcgccgacggtttcaagggtacggccggactaccggacaccttgaccctgaatgccatccagctcgatgccggcggcgatctcaagagcggttacctgatccgcggcggcgccagcctgccgggcgagggcggggcggtggcgttgagcctggacgggcgggtcgacgcccagggcgcggatatccgccaactgcgcctggacgctggcggcgagcagcgcctggagctggtcggacgcctggactggcgcgaaagcctggccgccgacgcgaccctggactggaaggacttcccctggctgcgcctgtatccgctggcggagccgccgccggtgacgctgaagaccttcaaggcggaagtgcattaccaggaccagcgctacctgggcaatttcagcgcggcggcgagcggtccggcgggcgacttcacgctggccagcccggtgtccggcgacctcgtccagctcaacctgccgtcgttgcagctccgcgccgggcaaggccaggccgagggccgggtgacgttgcgtttcgacaatggcgtggcttgggataccgccctgcagctcagcgaactgaacccggcgtactgggtcgccgagctgccgggttcactggccggtcccttgcgcagccagggaagtgttcgcgacgagcggctggcgttgggcgtggatctcgacgtcaagggccgcctgcgcggccagccggcgctattccaggcgcgcgccgaaggcgaggggcagcgctggacgctgggcaacctcgacctgcgcctgggggataacaaggtgcacggcagcggggcgctcgaccagcgcctgcaaggccgcctggacatcgccctgaaccgtctcggccagctttggccgcaactcttcggtcgcctcgagggacgcctcgacctggctggcagcctcgcggcgccgcaaggcaggctgaacctcaagggacagcagatcgcctacgccgagcagcgcatcgccggcctcgacctgcaggcgaacctcgatgcccggcagaacggcactctggcgctggtcgcttccggcctgcgcagcggcgaaaccgatctcggcctgttcaaggccaatgcccgcggcgaccaacgccgccagcaactggaactggacctgcaaggtgccttgctcaagctcggcctggccttcgacgggcaactggagcgcggcaactggcgcggtcgcctggcgcgcggcgagttgagcagcggcggccaggactggaagctacagcagccggcgcgcctggagcggttggccgacggcaaggtcaatttcggcgcacattgctgggtatccggcggcgccagcctctgcggcggcgagcagcgcctgctgcccgagccgcggctgcgctacaccttgcgcgacttcccgctggacagcctgaagcaatggttccccgaggacttcgcctggcagggcaagctgaacggcgacctgcaactggacgttccggcccgcggcccgagcggcgtggtcagcctggacgccggcagcggtacgctgcgcctgcgcgaccagggccagtgggtcgacgtcggctacgacagcctgcgcctggagagccggttggcgcccaaccgcgtcgatacctccctcgacttccgcggaccgaagctcggcgagttgcgggtgcaggcgcagatcgacccgcgcccggcgagcaagccgctgagcggcgagttcagcctggccggcctcgacctgtcggtggcgcgcccgttcgtgccgatggtggagaaactgcaaggcaggctgaacggcagcggccggctgtccggcggcctgctggcgccgcgggtcgacggacgggtgacgctgagcgacggcaacattggcggcggcgagctgccgaccagcttcgagaacctttccctcgacgctcgcatcgctggcgaaagcctggaactcggcggcggctggcgcagcggcaggtacggccagggcagcctgtccggcaacctgagctggggcgacgcgctgaacgtcgccctgaacatccgtggcaaccgcctgccggtggtggtcgatccctatgcgcaactggaggtggaaccggacctgaagatcggcatggccgggcaggagctggcgatctccggcaaggtcctggtgccgcgtggcgacatcaccatccgccagttgccgccatccacggtcaaggtctccgacgacgcggtgatcgtcggctccgagcagcccgagcagcagccgctgaagatgaagatggacatcgatgtcgaggtcggccaggacaagctggcgttctccggcttcggcctcagcgccgaactggccggccacctgcacatcggagacaacctggatacccgcggcgagctgaacctgaacaagggccgctatcgtgcatacggccagcgcctgacgatccgtagggcgcggctgtttttcgccggaccgatcgaccagccgtacctggatatcgaggcgatccgccgggtcgacgacgtggtcgccggcctgcgcctgaccggcagcgccgagcagccgaccagcgcggtattctccgaaccggcgatgagccaggagcaggcgctgtcctacctggtgctggggcggccgatgagcaccggcgaagacagcaacatgctcggcgaggcggccctggccctgggcctggccggtagcgcgccgctcaccggggaaatcgccaagcagctcggcatccaggacttccagctggacaccgagggcaccggcaacagcaccagcgtggtcgccagcgggaatatcaccgacaagctcagcctgcgctatggtgttggagtgttcgaaccggcaaataccatcgccttgcgctaccagttgaccaaacgcctctatctcgaagcggcgagcggcctggccagttcgctggacctgttcttcaagcgcgatttctga

SEQ ID NO: 14664 - DNA, 258 bp, Pseudomonas aeruginosa
tcagcgaatatgccggcgcgctgggcaccatggtcggcgcttcgccgccgctacgacggcccgatgggcaaaagcgaccgggcgctgtgtttcggcgtgatcggcgccggggtggccagcggcctgttgccgctggcctggatcgactggctgatgttgctgatcgcggccctgctgttgctgaccatcggcaaccgcgtgcgccagggcctggccgagctgtccgcgagtcgacggggcagcaacggccaggcctga

SEQ ID NO: 14665 - DNA, 420 bp, Pseudomonas aeruginosa
agctcttctaccgccactggccggccagccgcccggcgccggacggcacgcgccaggcggtgctgctgttccaccgcggccatgagcactccgggcggatcgcccatctggtcgacgaactcgacctgccggaacacgacttcttcgcctgggacgcccgtggccacggcctctcgccaggcgcccgcggcgacagcccgagctttgctaccagcgtgcgcgacgtacagaccttcgtcgaccatatccaggccgtccacggtatcgccgaagagcggatggcggtggtggcgcagagcgtcggcgcggtgctggtttccacctgggcccacgactacgcgccgaaggtgcgcgcactggtgctggcttcgccggcgttccaggtcaagctctacgtgccgttcgcccgcagcgggctga

SEQ ID NO: 14666 - DNA, 435 bp, Pseudomonas aeruginosa
tttccggggccgacttcgtcgtccatcgtgcgccgcaggagcgcttcttcgagcgtctcggcagcctgcgcaaggaaaagcacatcctgcccggcttcttccacgacacccttggcgagcgcgatcgtcacctggccgtcggccgtgcccggcgcttcctcctcgaggcattcgccacggcccccgaacgaccgagcctgctcgatgccgaccgcctgggccatacctgcgccgaggccgaggcgctggccgcgccgttgccgaagaactcgccgcgcgatctctactggcgcgccacccgtgccggcctgcgcctgggcagcctgtggtcggatggggtcaagctgggcttcgacaccggcttcgattccggcagcaccctcgactatgtctaccgcaaccagccctgcggcagcggcccactgggtcgcctga

SEQ ID NO: 14667 - DNA, 1545 bp, Pseudomonas aeruginosa
tgcggcgccggacccaggcggaaatggaccagctggtggccgccgccggcttccgcaagatcacccagcgggtcgaccagtggggcatcttcagcgtatcgctggcgcagaaggtcgcccgctgatggcgccgcgcgagccgggggtactgaagcgggcggtgctctggctgctgttcctcggcccgttcttcttcgccagctatggcctggccaactggttgaccagccagcgcggcgacgtcggcagcctggtcttcgactgggaacgcgggatgccgctgtggccctggaccatcctgccgtactggtcgatcgacctgctctacggcctgtcgctgttgttgccgcgggacaagcgcgagctggacacccactgcctgcgcctgctcagcgcccaggtgctgtcggtgacctgcttcctgctgttccccctgcgcttcaccttcgaacggccggaactgggcggcgtgttcggctggctgttcgacgtgctgatggggttcgacaaaccgtacaaccaggcaccgtcgctgcacatcgccctgctggtagtgctctgggtctgctacgcgcgctacgccagcggcgcctggcgctggctgctgcatggctggttcgcgctgatcgggctgtcggtgctgaccacctggcagcaccatttcatcgacgtgcccaccggcgcgctggccggttggctgtgcgtctggctgtggccgcaggcgcagcccgcgccgttcgcccgcgccagtctgagccgcgaccggcaacggcggcggctggccgctcgctacggcctcggcgcgctggcctgcgccgccgtcgcctttgccgtcggcggtgcggcgttgtggctgtgctggccggcgctggcgctggcgctggtggcgctgaactacctgctgttcggcgccgccggcttccagaagggcagcactggccgcctgagcgtcgccgcgcgctggctgctggcgccatatctgcttgccgcgcggatcaacgcctggctctggacccgtcgccggccgcagccggacgaggtgctgccgggcctctggttggggcgcctgccgtcgtccgcggaactggccgacagccgcttccgcgcattgctcgacgctaccgccgaactttcctgcgagccgcaggggctggcctatcgcagcctgccgttgctcgacctggtcgcgccggacgtcgaggactgccggcgcgccgcggtgctgatcgacgaactgctggcgcaagggccgctgctggtggcctgtgccctgggctattcgcgcagcgccacgctggtcgccgcctggctgctgctcagcggccgcgcggcggacgtcgagtcggccgtggcggtgttacgtcgggcgcgaccgcaagtgctgctgggcgaggcccagcggcggaccctcgcggcgctgagcgggagcgtgccggagccatcggcggaactgggcgaggtgcgccatgcctgagcaaaccctggccctggtggcggccctgctgcgccgtggccgcgagcttgaccggctgtccgccgcactga

SEQ ID NO: 14668 - DNA, 585 bp, Pseudomonas aeruginosa
agcgtgctagcatcgtcgccggccccgaatgcttccgccgccggccacagggccggcggcttctcactgactagaaggatcaacgcaatggctcaagtgactctcaagggcaacccggtcaacgtcgatggccagctcccgcagaaaggcgcccaggctccggccttcagcctggtcggcggcgacctcgctgacgtgaccctggaaaacttcgccggcaagcgcaaggtgctgaacatcttccccagcgtcgacaccccgacctgcgccacctcggtgcgcaagttcaacgtcgaggccggcaagctggccaacaccgtggtgctgtgcatctccgccgacctgccgttcgcgcagaagcgcttctgcggcgccgaaggcctggagaacgtagtcaacctgtcgaccctgcgcggtcgcgagttcctcgagaactatggcgtggccatcgccagcggcccgctggccggcctggccgcgcgcgccgtggtggtgctcgacgagcagaacaaggtgctgcacagcgaactggtcggcgaaatcgccgacgagccgaactacgcggcggccctggcggctctctga

SEQ ID NO: 14669 - DNA, 1509 bp, Pseudomonas aeruginosa
tggcgccagaatatcggcggtcgttcttcggattgcgcacgcggcgctcccgggcggcgaaccgccggggagcgccgcgcgggctcagagcgtgagggtgaagcgcccggtcaacgcgcccggcaggtgcatcgagtcggtctggcgttcgccgtaggtattgctggacaggcgcagttcgcgctcgtggctgaggtcttccaggtgggcgccgaggaagctgtacaggctgtcgtcgaagcgcatggtgctgaccggcgcccggatctggccgttctccacccagaaggtggcgaagcgggtcattccggtcaggcgtgcggcgggcatgtccgagtagttcaggtaccacaggttgccgatgtacaggccggtatccagggcctcgaggatgcgcgcctgctccaggctgccgccggccatgtccagcgccgtgggcgcctcgttggcgccggcgccattggctaccaggccatattcgcgggcgctgcgcgaactcaccaggcgtccgctcaggcggccgttgccgaccagttcgacctcggcgcgcggcgagccttccgcgctgaatgccggggagggcgaggtggcagggcgctcggcgaggttcagcagcgggctgagcagggcgtcgccgttctgcaggcgttgcagggggctttcgccggtagccagggcgcgcgcggagaaaccgccccagcagagcatctgcatgacttcttcgagcgccgccggcgccaggtaggcgcggtagtcgccggggcgcaactggcgcagcggcttgcccaggtggccgagctgctcccgggcctgttcgaagcgccgggcgaaggcttcgtcgtcccagcgctggccggcgtagtcggccttcaccgcctggccgttgccgtggaacaggctccagtcgaagttgaagctgctgccggcatgccagccgaaggcgccccaggagttggcgaagccacggaacagcggtccggcggcatagatgccgaccaggtcgaggtcgcgcgcctggcgttcgaggctggccagcagcgccccgctgtcgggcgctgcgccgaggtcctggttctctcgctgccaggccgtggtgtcgagcagcagatagggatcggcgggaatccaggccaggctctggcgcagttgccgaaggccttcggccagacgctggcggtcttcttccggcgcgccggagagcgtcaggtcgaggctcgcctggcgttcgtcgcggatcagccggagcagcgcgctggcctggcgcacccgaccggcctggcgcacccgcgcccggttgaagcggatgaactcggagtcctcggcgctgtaccagagggtgaagtcctcgccctcggccaggtgtcggcgcaggtcctcggcgagggcttcgaaatgctgtctctggtgcatcaggcgtctcccccgaatacgtccacatcgctgaatacgcaggccggcgaggcgtggccgacacggatcacctggttcggctcgcccttgccgcagtag

SEQ ID NO: 14670 - DNA, 1290 bp, Pseudomonas aeruginosa
agaagaaccatgactccaacgaccggtaaatccaagttccgtaccctgcgcccgtggctgatcaccgccctggccttcgccgccgtgatcggcctggtgatgtggctggcggcgcccgcctcggcaccgtcctccgacgggcgacccggtcgcggcggcaagccgggcgccgcgctgcccaaggccaacgcgctcaccgtcggcgtggccagggtggagcagggcgacctggcgctgcatttcaacgcgcttggcaccgtcaccgccttcaacacggtgaacgtcaagccgcgggtcaacggcgagctggtcaaggtgctgttccaggaggggcaggaggtcaaggccggcgacctgctggcggtggtcgacccgcgcacctacaaggcggcgctggcccaggccgagggcacgctgatgcagaaccaggcgcaactgaagaacgccgagatcgacctgcagcgctacaaggggctgtacgccgaggactcgatcgccaagcagaccctggatacccaggaagcccaggtccgccagttgcagggcaccatccgtaccaaccagggccaggtcgacgacgcccgcctcaatctgaccttcaccgaggtccgcgcaccgatttccgggcgcctcggcctgcgccaggtggacatcggcaacctggtcaccagcggcgataccacgccgctggtggtgatcacccaggtcaagccgatctcggtggtgttcagcctgccgcagcagcagatcggcaccgtcgtcgagcagatgaacggccccggcaagctggcggtcaccgcgctggaccgcaaccaggacaaggttctcgccgaaggcaccctgaccaccctggacaaccagatcgacaccaccaccggcacggtcaagctcaaggcgcgcttcgagaacgccgacggcaagctgttccccaaccagttcgtcaacgtgcgcctgctggcgcataccctcaagggcgtgctgaccattccagccaacgccgtgcagcgcggcaccaacggtatctatgtgtacgtggtcggcgccgacaacaaggtcagccagcgcagcgtcgccatcggcaccagcgagaacgagcgggtggtggtggaaagcggcctgaaggccggcgagcaggtggtggtggaaggcaccgaccgcctgcgcgacggtatggaagtgcgtgtcgccgaggcctccccgcaggtcctcgagggcgagccgcagaaaccgcagactggccgccccagcggcctccagggcgactcggtgggtagcgggagcgctgaatga

SEQ ID NO: 14671 - DNA, 2751 bp, Pseudomonas aeruginosa
acaccgaggccgggttcgacggggacgccgggcgatgagtctgtccacgcccttcatccgccgcccggtcgccaccacgctgctgaccctggcgttgctgctggccggcaccctgtcgttcggcctgctgccggtggcgccgctgcccaacgtcgattttccggccatcgtggtcagcgccagcctgccgggcgccagcccggaaaccatggcctcgtcggtggccacgccgctggagcgctcgctgggacggatcgccgggatcagcgagatgacctccagcagttcgctgggctcgaccaccgtggtgctcgtgttcgacctggagaaggacatcgacggcgccgcccgcgaggtgcaggcggcgatcaacggcgcgatgagcctgctgcccagcggtatgccgaacaatcccagctaccgcaaggccaacccctcggacatgccgatcatggtcctcaccctgacctcggagacccagagtcgcggcgagatgtacgacctcgcctcgaccgtgctggcgcccaagctgtcgcaggtgcagggggtagggcaggtgagcatcggcggcagctcgctgccggcggtgcgggtcgacctcaacccggatgccatgagccagtacgggctgtccctggacagcgtgcgcacggccatcgccgcggccaacagcaacggccccaagggcgccgtcgagaaggacgacaagcactggcaggtggacgccaacgaccagttgcgcaaggcccgcgagtacgagccgctggtgatccactacaacgccgacaacggcgccgcggtgcgcctcggcgacgtggccaaggtcagcgactcggtggaggacgtgcgcaacgccggcttttccgacgatctgccggcggtgctgctgatcgtcacccgccagcccggcgccaacatcatcgaggccaccgacgccatccacgcgcaactgccggtgttgcaggaactgctcgggccgcaggtcaagctgaacgtgatggacgatcgcagcccgtcgatccgtgcgtcgctggaagaggccgagctgaccctgctgatctcggtggcgctggtgatcctggtggtcttcctgttcctgcgcaacggccgcgccacgctgatccccagcctggcggtgccggtctcgctgatcggcaccttcgcggtcatgtacctgtgcgacttcagcctgaacaacctgtcgctgatggcgctgatcatcgccaccggcttcgtggtggacgacgccatcgtggtggtggagaacatcgcccgacgcatcgaggagggcgatccgccgatccaggcggcgatcaccggtgcccgccaggtcggtttcaccgtgctgtcgatgacgctctcgctggtcgcggtgttcatcccgctgctgctcatgggcggcctcaccgggcggttgttccgcgagttcgcggtgactctctcggcggcgatcctggtgtccctggtggtatccttgaccctcacgccgatgctctgcgcgcgtatactgcgtccgctgaaacggcccgaaggcgcttcccaggcgcggcgcagcgatcgcttcttcgccgccttcatgctgcgctaccgcgccagcctgggctgggcgctggagcactcgcggctgatggtggtgatcatgctggcttgcatcgccatgaacctctggttgttcgtggtggtgcccaagggcttcctcccgcagcaggactccgggcgcctgcgcggttacgcggtggccgaccagagcatctcgttccagtccctgagcgcgaagatgggcgagtaccgcaagatcctctcttccgatccggcggtggaaaacgtggtcggcttcatcggcggcggccgctggcagtcgagcaacaccggttcgttcttcgtcaccctcaagccgatcggcgaacgcgacccggtggagaaggtcctcacccggctgcgcgagcggatcgccaaggtgcccggcgcggcgctctatctcaacgccggccaggacgtgcgcctgggcggccgcgacagcaacgcgcagtacgaattcaccctgcgcagcgacgacctgaccctgctccgcgaatgggcgccgaaggtcgaggcggcgatgcgcaagctgccgcagctggtggacgtcaacagcgactcccaggacaagggcgtgcagacccgcctggtgatcgaccgcgaccgcgcggcgaccctggggatcaacgtgggaatggtcgacgcggtgctcaacgactccttcggccagcgccaggtgtcgaccatcttcaacccgctgaaccagtatcgggtggtgatggaggtcgaccagcagtaccagcagagcccggagatcctccgccaggtccaggtgatcggcaacgacggccagcgcgtgccgctgtccgcgttcagccactacgaaccgagccgggcaccgctggaggtcaaccaccagggccagttcgccgccaccacgctgtccttcaacctggcgccgggcgcgcagatcggcccgacccgcgaggccatcatgcaggccctggagccgctgcacatcccggtggacgtgcagaccagcttcgagggcaacgccggcgcggtgcaggacacgcagaaccagatgccctggctgatcctcctggcgctgctggcggtgtacatcgtcctcggcatcctctacgagagctacgtgcacccgctgaccatcctctcgaccctgccttcggccggggtcggcgcgctgctcgcgctgatcctctgccgcagtga

SEQ ID NO: 14672 - DNA, 1890 bp, Pseudomonas aeruginosa
gctgagcctgatcgcgctgatcggcatcatcctgctgatcggcatcgtcaagaagaacgcgatcatgatgatcgacttcgccctggaggccgagcgcaaccacggcctgagcccgcgcgaggcgatcctcgaggcctgcatgatgcgcttccggccgatcatgatgaccaccctggccgccttgctcggcgccttgccgctgatcttcggcatcggcggcgacgccgcgctgcgccggccgctgggcatcaccatcgtcggcgggctgatcggcagccagttgctgaccctgtacaccaccccggtggtctacctctatctcgaccgcctgcgccactgggtcaaccagaaacgcggcgtacgcacggacggtgcgctggagacacccctatgaaacacaccccctcgttgctcgccctggccctggtcgccgccctcggcggctgcgccatcggccccgactaccagcgaccggacctggcggtgcccgccgaattcaaggaagccgaaggctggcgccgcgccgagccgcgcgacgtgttccagcgcggcgcctggtgggagctgtacggcgaccagaccctgaacgacctgcagatgcacctggaacgttccaaccagaccctggcccagtcggtggcgcagttccgccaggccgaggcgctggtgcgcggcgcgcgggcggcgttcttcccgtcgatcaccggcaacgtgggcaagacccgcagcggccagggcggcggcgacagcaccgtgcgcctgcccgacggctccactgtgagcagcggcggtggttccggtgcgatcagcaacagttactcgaccagcctcggtgtcagctgggaggtcgacctctggggcaagctgcgccggcaactggaggccaaccaggcgagcctgcatgccagcgccgccgacctcgccgcggtgcgcctcagccagcagtcgcaactggcgcagaactacctgcaactgcgggtgatggacgaacagatccgcctgctcaacgacacggtgacggcctacgagcgttcgctgaaggtggccgagaacaaataccgcgccggcatcgtcaccagggccgacgtggcccaggcccgcacccagttgaaaagcacccaggcccaggccatcgacctgaagtaccagcgtgcccagctggagcacgccatcgccgtgctggtcggcctgccgccggcgcaattcaacctgccgccggtggcgagcgtgccgaagctgccggacctgccggcagtggtgccgtcgcaattgctcgagcggcggccggacatcgcctcggcggaacgcaaggtgatttccgccaacgcccagatcggcgtggccaaggccgcctatttccccgacctcaccctgagcgccgccggcggctaccgcagcggcagcctgagcaactggatcagcacgccgaaccgcttctggtcgatcggcccgcagttcgccatgaccctgttcgacggcggcctgatcggctcccaggtggaccaggccgaggcgacctacgaccagaccgtggcgacctaccggcagaccgtgctcgacggtttccgcgaggtggaggactacctggtgcaattgagcgtcctcgacgaggagagcggggtgcagcgcgaagccctggagtcggcccgcgaggcactgcgcctggccgagaaccagtacaaggccggcaccgtcgactacaccgacgtggtcaccaaccaggccaccgcgctgagcaacgaacgcaccgtgctgaccctgctcggcagccgcctgaccgccagcgtccagttgatcgcggcaatgggcggcggctgggacagcgccgatatcgagcggaccgacgagcggctcggccgggtcgaggagggcctgccgccttcgccctga

SEQ ID NO: 14673 - DNA, 1569 bp, Pseudomonas aeruginosa
accgccgctccagcgcgccccgctgcggacgccctggaccctgctggcgctcggcctggcgctgttcctcgccggtttctgcggcgagtaccggctgtggcggcgccgcgccggttgctgaaaccggcgtcaggcagcgcccgtcgaagggaacagcaggcgcaggtgggtcttctgctgcggtacgctttccgcttcggcgcggccgccgtggtaggccatgatcgattgcacgatggccagtcccaggccggtgccggcctgggctccagtctggcgtccggcgcggcggtagaagcgctcgaacaggtgcggcaggtactccggcgggatgcccggaccgtcgttgctgaccctcacctcggtgtgccccgcgcgttccccgatccgcacgtcgatgcgcccgccttgcggggtgtggcgcacggcgttggacaccaggttggaaatggcgcgctggatcatcaggttgtcgccgtgggcgaagccgttgccggacaggcgcagttcgacgcccttgtcctcggcgaccatctcgtacaggtcgatgaccttggccgcctgctcgtgcagggcgacgcagccgaactgggcctggatcgccgggttgtccacctgcaccaggaacagcatgtcggtgacgatccgcgacagccgctccagttcctcggcattggactccagggcttcgcggtatgccgcgccgtcgcgatgctggctgagcagcacctggttgcgcaccagcaggttgcagatcggcgcgcgcagttcgtgggccaggtcgtcggagaactgcgagagctggcgtacgccatcctcgaggcggccgagcatgtggttgaagctgcgggccaggctgtccagctcgcgcggcaggttctgctcggggatgcggtaggagagatcctgcgggctgacctgggcggccacccggcggaagcggttcaacggttcgaggccggcacgcaccacccaccaggcggtcagggcgatcaatggcaggaggaagggcagggccagcagggtggcgcggaggaaaccgtcgagcaggcgctcgtcggcgttgcgctcgctgctcagcaacacctgtaccggggtgccgttcttcatgcgcatggaagcgccgatgctcagcaggcgctggtcgttgccggtgctccagctctggaacaccggctggcgggcatccgcctgcaagcgggcgagaagcgcgcggttggccgcgacgctggccgcggcctggtcgccgaagctcatcagcggctggccgctgcggctgtcgagaatgctcaggtgcaggccgctgtgagccaccagttggtcctgcagggcatgcgcctgtacggccgggtcgctgcgcaggtcgagatcgtcttccaggctgtggcggatctgctccagcttcaattgcaggttttcccgctcgcgggcttccagctcgcggccgaggttccagtgcgccattgcgccgagcgccagggccagcagcgcgccgagggcgccgaccagcagggccaggcgcagcgacagtcggcctggtggcgtcatcggcgcgcttccaggacgtag

SEQ ID NO: 14674 - DNA, 519 bp, Pseudomonas aeruginosa
ccgacgccgcgaatggtatggatcagcttgaggtcgaagccgtcgtcgatcttcgcccgcaggcggcagatggcgacttccaccacgttggagtcgttgtcgaagttcatgtcccagatcagcgagatgatctgcgtccgggtgatgacgtcgccgttgcgccgcatcagcaggtgcagcagggcgaactccttggtcgtcaggttgatccgcacccggccgcggaaggcccggtggcggctggcgtccagctccaggtcggcgacccgcaggacgtcctgcatcggtgcctggtcgtggcggcgcagcagcgagcggacccgcgccagcagttcggggaactggaacggcttgaccatgaagtcgtcggcgccgagatcgaggccgcgcaccttgtcggtcagcctgccatgcccggtgagcatcatcacccgcgcgctgctgcgttcgcgcaggcggcggagcaggtcccagccgtcgatgccgggcaggttgacgtcgaggatcaccagttcgtaa

SEQ ID NO: 14675 - DNA, 1437 bp, Pseudomonas aeruginosa
acggttgcgtggttccgggccggtaatggatcgccgtcgccgacgacgatcagcagacgaggagcggaacatgccgatacttcggccactggccagcgcggggaaacgcgcctgctggctactgatgggactctgcctgggcctgccggccctggcgaacgaagcgccggtgagtttcaacggcacttcgatcagcctcgagcaggcgttggagcgggccctgcggagcaaccccgagctggcggcggtggggcgcgagaccgagatcgccagcggcgcgcggcagcaggccgggctgatccccaacccggatctgtcctggagcgtcgaggacacccgccagggcaatcgccagaccagcgtcagcatcgcccagccgctggagctgggcggcaagcgcggtgcgcgggtggaggtggcgaaacgcggcagcgagatcgcctggacccaactggaagtccgtcgcgccgaactgcgcgcccaggtccgcggcgcctactacgcggcgctgaccgcgcaggagcgggtgcgcctggcgaagacctccctggacctggccaggcgcgcgctgcaggccgccgaccgacgggtcaaggccggcagcatctcctcggtggaacgggttcgcgcccaggtcctggcggacaacgcccagctcgacctgagccaggcggagctggagcagcagcgcacctatgtgcagctgtcgagcacctgggacgagccgcagccaggcttcgccagggtcggcggcgcgctcgacgcggtgccggcgagcatcacccgtggcgccttgctgcgccatctcgacgagtcgccgaccctgcgcctggcggcccaggaggtcgcgcgcggcgaggcccaggtcgacctggagaagcgccagcgcatccccaacctgacggtcagcatcggcagcaagtacgaccagaccgcccgcgacggacgtggcgaacgggtcaacctgatcggcctgtcgatgccgctgccgctgttcgaccgcaaccagggcaacatctacgccgcccagagccgcgccgaccaggcccgcgacctgcagcgcgcgaccctgctgcgcctgcgcagcgaagcggtacaggcctacgaccagttgcgcacctcggaacaggagctggcgctggtccgtcgcgacctgctgcccggcgcacagagcgcgctggactcgatgacccgcggcttcgagatgggcaagttcaacttcctcgacgtgctcgatgcccagcgcaccctggtcggcgtccgtgcccagtacgtgcgcgcgctggacgccgcggcacaggcgcgggtgagcatggagcgcctgctcggcgaagacatcggccacctcggccagtgagatttccggggcgggccgccggcgcgccccccgaacggttcgggagaacagaatgggcaagaagacgattatcgcggtga

SEQ ID NO: 14676 - DNA, 3396 bp, Pseudomonas aeruginosa
cggtcgccgacggcgcggtgcaggacgtcgacggcgaggacgtggtgttcgtccgcgtggccgatggcttcgtggtccagccggtcaagctgggcatcagcgacggccagcgcgtcgaggtcctcgagggcctgcgcgccggcagccaggtcgccgccagcggcagcttcatcctcaaatccgaactgggcaagggctcggcggaacacggtcactgagtcccgctccaggagtcttcgcatgttcgaacgcatcatccaattcgccatcgagcaacgctggctggtcctgctggcggtgctggggatggccggggtcggcatcggcagctaccagaagctgtccatcgacgcggtcccggacatcaccaacgtccaggtgcagatcaataccgccgcccccggctactcgccgctggaagtggagcagcggatcacctacccggtggagaccgtcatggccggcctgccgggtttgcaggaaacccgttcgctgtcgcggccggggatttcccaggtgacggtgatcttcgaggagggcaccgatatttacttcgcccgccagcaggtcaacgaacgcctgagcacggcgcgcgagcaactgccggaagacatctcgccgaccctcgggccgatctccaccggtctcggcgagatctacctgtggacggtggaggccgaggagggcgcgaccaaggaggacggcagcgcctacacgcccaccgacctgcgcaccatccaggactggatcatccgtccgcagttgcgcaacgtgaagggcgtggccgagatcaacaccatcggcggctacgccaagcaattcctcatcgccccggatccgaagaagctcgcggcctacaagctgaccctcggcgacctgcagaacgctgtgctgcgcaacaacgagaacgtcggcgccggctacatcgagcggcgcggcgagcagttgctgatccgcgcgccgggccaggtcaaggacatggacgatatccgcgggatcatcgtttccaacgtcgacggcgtgccgatccgtatccgcgacgtcgccgaggtcggcctgggcaaggagctgcgcaccggcgcggccaccgagaacggccgcgaagtggtgctcggcacggtgttcatgctgatcggcgagaacagccgggaagtggcccaggcggtcggccagcgcctggaggagatcaaccggaccctgcccaagggggtcaaggcgatcaccgtctacgaccgcaccaccctggtggacaaggccgtggccacggtgaagaagaacctggtggaaggcgcggcgctggtgatcgcggtgctcttcctgttcctcggcaacatccgcgcggcgttgatcaccgccaccatcatcccgctgtcgatgctgttcaccttcaccgggatggtcggcaacagggtcagcgccaacctgatgagcctcggcgcgctggacttcggcatcatcgtcgacggcgccgtggtgatcgtcgagaacgccatccgccgcctggcccacgcccaggcccaccacggccgccagctgacccgcgcggaacgtttccacgaggtcttcgccgcgtccagggaggcgcgccgggcgctggtcttcggccagatcatcatcatggtggtgtacctgccgatcttcgccctcaccggggtcgaggggaagatgttccacccgatggcgttcaccgtggtcaccgcgctgctcggcgcgatgatcctctcggtgaccttcgtcccggcggcgatcgcgctgttcatcaccggcaaggtcaaggaggaggagaacttcgtcatgcgccgcgcgcgtctggcctacgaaccggcgctgcgctgggtgctcgggcaccgcgcgctggtggtcggcggcgccctcggcgcgatcctgctcaccgggctggtggcctcgcggatgggcagcgagttcattcccagcctcagcgagggcgacttcgccatgcagggcctgcgggtgccgggcaccagcctgacccagtcggtcgagatgcagcagaccctggagaggaagctgatgggcaagttcccggagatcgagcgggtcttcgcccgcaccgggaccgccgagatcgcctccgacctgatgccgccgaacgcctccgacagctacgtgatgctcaagccgcagagccagtggccggacccgaagaagtcgcgggaggcgctgctggaagaattgcaggccgcggcccttgaggtgccgggcagcgtctacgagttctcccagccgatccagttgcgcttcaacgaactgatctccggggtgcgcagcgacgtcgcggtgaaggtcttcggcgacgacatgcaggtgctcaacgacaccgcggagaagatctccaaggtgctgcaaggcatcgacggcgcctccgaggtgaaggtcgagcagaccaccggcctgccggtgctgacggtggacatcgaccgcgacaaggcggcacgcttcggcctcaatgtcggcgacatccaggacaccgtggccaccgccctcggcggacgcaacgccggtaccctgttcgagggcgaccgccgcttcgacatcgtcatccgcctgccggaaaccctgcgcgccgacctgccggcactgtccaacctgctgatcccgctgccgccgaacaacctggcgcggatcgacttcatcccgctgtcggacgtggcgcgcctcgacctctcgccgggaccgaaccagatcagccgggagaacggcaagcggcgcatcgtggtcagcgccaacgtgcgcggccgcgacatcggctcgttcgtgctggaagcgcaacagaagctgcaggacggggtgaagatcccggccggctactggaccacctggggcggccagttcgaacagttgcagtccgccgccaagcgcttgcaggtagtggtgccggtggcgctgctgctggtgttcaccttgctcttcgccatgttcaacaacgtcaaggacggcctgctggtgttcaccggcatccccttcgccctcaccggcggggtgctggccctgtggctgcgcgggataccgctgtcgatctcggcggcggtgggtttcatcgccctgtccggggtggcggtgctcaacggcctggtgatgatctccttcatccgcaacctgttgcaggaaggacgcagcctcgaccaggcggtgtgggagggcgccatcacccgcctgcgtccggtgctgatgaccgccctggtggcgtccctcggtttcgtgccgatggccctggccaccggcaccggcgccgaggtgcagcggccgctggcgacggtggtgatcggcggcatcctgtcctcgaccatgctgaccctgctggtgctgccggtgctctatcgctggacccacgggcgcgacgccggaccgcgcgaggagacgccggcggccggctga

SEQ ID NO: 14677 - DNA, 1839 bp, Pseudomonas aeruginosa
cgattacttgcgttctctgctcgaggaagaccccgagcgcggcgtctaccgctgcaagcgggagatgttcaccgatccacgcctgttcgaactggagatgaagcacatcttcgagggcaactgggtctatctcgcccacgaaagccaggttgccggagtcaacgactacctgaccacccagatcggccgccagtcgatcgtcatcgcgcgcaaccgcgacggccagctcaacgccttcatcaacgcctgcagccaccgtggcgcgatgctctgccggcacaagagcggcaatcgcagcagctatacctgtccgttccacggctggaccttcaacaactccggcaagctgctcaaggtcaaggacccggccgaggccggctacccgcagggcttcaactgcgagggctcgcacgacctgacccgggtggcgcgcttcgagtcctaccgtggcttcctgttcggcagcctcaaccccgatgtcaggccgctggccgagcacctgggcgagtcggcgaagatcatcgacatgatcgtcgaccagtcgccggaaggcctcgaggtgctgcgcggctcttccagctatgtctacgaaggcaactggaagctcaccgccgagaacggcgccgacggctaccacgtcagctcggtgcactggaactacgcggcgacccagagccagcgccagcagcgcgacgccgcggacccgctgcggaccatgagcgccgcgggctgggcccggcagggcggcggcttctactcgttcgagcatggccacatgctgctctggagtcgctgggccaaccccgaggaccggccggccttcgagcgccgcgccgagcttgcccgcgacttcggcgaggcccgcgccgactggatgatcgagaactcgcgcaacctctgcctgtaccccaacgtgtacctgatggaccagttcagctcgcagatccgcatcgcccggccgctgtcggtggaccgcacggaaatcaccatctactgcatcgcgccgaaaggcgagagcgccgaggcgcgcgcccggcgcatccgccagtacgaggacttcttcaacgtcagcggcatggccaccccggacgacctggaggagttccgttcctgccagcagggctaccagggcagcgtggtcggctggaacgacctgtcgcgcggcgccgaacactggatagagggcgccgacgcggcggccgcggccatcgacctgcggccgcgcctgagcggcgtgcgcaccgaggacgaagggctgttcgtattgcagcatcgctactggcaggaggcgctgctcgccgccctggagcgcgaacggacgcagcgcgtggcgctgcgggaggtggcgtcatgagcctgggctacgacgccctgcgcgatttcctctaccgcgaggcgcgctatctcgacgacaaggattgggacgcctggctggcgttgtacgccgcggacgccagtttctggatgccgtcctgggacgaccgcgaccagctcaccgaggacccgcagcgggaaatctcgctgatctggtacggcaaccgcggcggcctggaggaccgggtattccgcatccgcaccgagcgctccagcgcgaccctgccggacacccgcacctcgcacaacctgagcaacatcgaactgctcggcgaggacgacggcatctgccgcgcgcgctgcaactggcacaccctgagctatcgctacaagaccgtggacagctacttcggcaccaccttctacgacctcgacgtacgcggcgagagtccgctgatcaaggccaagaaagtgatcctgaagaacgactacgttcgccagctgatcgacgtctaccacgtctga

SEQ ID NO: 14678 - DNA, 1047 bp, Pseudomonas aeruginosa
cgcccgcgccggcgggctgtcgagggacatgccatgaaccatcggatcgcactcaacttcgaagacggggtgacccgcttcatccatgccgcgcccggcgagaccgtggccgacgcggcctaccgccagggcatcaacatccccctggactgccgcgacggcgcctgcggcacctgcaagtgcctggccgaggccgggcgctatgcgctgggccaggactacatcgacgatgccctcagcgccgaggaagccgcccgcggctacgtgctgacctgccagatgcgcgccgaaagcgactgcgtgctgcgcgtgccggcgtcctcgaccctgtgcaggaccggccaggcgcgctacgaggcgcgcatcagcgaagtccggcaactctcgccgagcaccatcggcctgtcgctgcgcggcgaggcgctggccagcctggcgttcctgcccgggcagtacgtcaacctccaggtacccggcagcgagcagcgccgcgcctactccttcagctcgctggcgaaggacggcgaggtcagcttcctgatccgcaacgtccccggcgggctgatgagcggcttcctcagtggcacggccagggccggcgacagcctggcgatggacggcccgctgggcagtttctacctgcgcgagattcaccggccactgctgatgctggccggcggcaccggcctggcgccgttcaccgcgatgctcgaacggatcgccgaacagggcagcgcgcacccgctgcacctggtctacggggtgacccacgacgtcgacctggtcggtctcgagcgcctggaggcgttcgccgaacggattcccggcttcacctggagcgcgtgcgtggccagcgccgacagcgactatccgcgcaagggctacgtgaccgagcacatcgccgcgcagcacctgcacgagggcgacgtcgacatctacctgtgcgggccgccgccgatggtcgaggcggtcgagcgctacctgcgcgagcagggcgtgcgcccggcgaatttctactacgaaaagttcgccgccagcgcggcctga

SEQ ID NO: 14679 - DNA, 1452 bp, Pseudomonas aeruginosa
ccgcgccggccgtcccagtcggcgtccgcctcggctgagcaccgggacgaagcggaagccgggaagccgctcggcgtagccggcgatccgctgcaattcgcagagatcggcggcgcggcgtaccccgtagtagagatgcaccgcccgatcgcagccgcgctcggccagttcgtcgagcatgccgaggaacgcagacaggccggtgccgccggccaccagcagcaacgggcgctccacctgacgcaggtagaaggtgcccagcggcgcctcgaagcggatctcgtcgccgacccggcaaccttggcgcaggtagtcgctcatggcgccgcccgggagcaggcggatgaggaactgcaggtggttctgcggattcggccggttggcgaaggagtaggcgcgccggcagtcgctgccgggtacttgcaggcgcgcgtactggccgggcaggaagtccaactggcggcccgcggcgccggcgtcgaggcggagcagcgcggtgtcctcggagagcaggcgcagttcgcgcaccacgccgctgtgcgcctgggccgcggcggcgtggcagagggtcgaggcgaagtcgaagtagaaggccgcgtcggagcgcacccgggtctggcaggcgagcaccttgcgctgctccaggtcggcggcggagagggtgtcctcgtcggcgtagtccaggctgtagctgcccgcctcgcagcggcccatgcaggtgccgcagaccccttcgcggcagtccagcggcaggttgatgccgtggcgcagggcggcgtcgaggagcaggtcgtcgtggccgacgggcaggaacagggtcttgccgtcggcgaagctgagggcgactttgtgattcatcgtgacggggcccgccgttcagaggtggtagaagtcgaggaccgagtcgatccggtcgttgagcaggacgatgtgcttgcgcgcgatcagccaggcctcgccatggggtttcaggcggtaggtggcatggccgaagaagctgccggtctggtccaggcgctggaacagggtctgccagttgacccgcactcgcagcaggccttcgccttcctcggcgatgcgcacgttgccgatctggtgcagggtgcgcggcatcggcacggtggacgcggccttgccggtgcggatacggaacacccggtcttccaggccggcacggctggggtagtagatcagcgacatctcgcgcttcggatcgcgggtgtagcgctgctcggactcccactgcggcaggtggaactcgcactgttcgtcgaactgcgcgaggtagccgtcccagtcctgggcatcgcagagttcggcgtggcggtagaggaactgttcgacgcggtactgcagtccggcgttcatggggtcacctccttcgcgcgcagggccaggcgctccaggccgtcgaggaggaagcgccgccaatgcgcgtgctggttgacgtag

SEQ ID NO: 14680 - DNA, 1056 bp, Pseudomonas aeruginosa
aaacagagcgccagcagagcgcacccccagccttgccgtgtcgagtgccgaaccatgatgaggacccatcccgtcgccgatcgtggcgatctccatgccgaccacctggacctggccgccgcccgttcctggatgtcgaaggtctgcgggccgcaccggctcgaagcggcgagcccgggactggtgcagttcgagcaccacggcaacgtgctgaagtcgatgtgcaccacccttggctacatcggctacggtaccgacgtcaccatcaccgtcgaggatgccgcggcgttcaacgcctacagcctgagcctgccgctcagcggcgagcaggagctgtgccggggcgggctgcgcctgctctccgacgtccgccgcggggtgatcatcgcgcccaacgagcgccaggagctgagcatcgccggggactgccgcaagctgcaggtggtgatcggccgcacggcgatgcgcaaggtcctggaggagatgttgcagcggccgatcgatacgcccttgcgcttcgatccggagatggatgccctggatggcgcctccgcgtcctggtggcgcaccgtgcggcacatcagcgaggagatggcgcgcagcgaactctacgcccaggcgtttttcagcagcgacctggaacgcgcgctgatcaagggactgatcctggcccagccgaacaactacagcgaggccctgcagcagggccttggcgggcgcccgccgcactacctgctgcgcgcccgcgagtttctccaggccaacgcccgcgagaccctgagcctggaggacgtggaacgcgccgccggggtctcgcggttcaagctgttcgagggcttccgtcgctacttcggggtgtcgccgatgagctacctgaagcactaccggctcgccgcggtgcgcgaggaaatcctcgccagcggcggcgcccgcagcatctcgacgatcgccctgggctggggcttcagccacctcggacgcttctccgtggactaccgcaagcgcttcgaggaaaccccgagcatgacccagcgccgcgctgcgcggcgctcctga

SEQ ID NO: 14681 - DNA, 1170 bp, Pseudomonas aeruginosa
gcagcgaaccgtcgaaaacccgaccgcaaccctggtggacccccgagaatgagccaagccgtgatccaaagcctcgagtcgatcatcgtcgacctgccgaccatccgcccgcacaagctggccatgcacaccatgaaccggcagaccctggtgatcctccgcctgcgttgcagcgacggcatcgagggcctcggcgaagccaccaccatcggtggcctggcctacggcagcgagagcccggagagcatcaagagcaatctcgacgcgcatttcgccccgttgctgctgggccagccggcggacaacgtgaatgccgcgatgcagcgcctggaccgacacatcaggggcaacaccttcgcccgctcggcggtcgagaccgccttgctcgacgcccatggcaagcgcctcggcctggccgtcagcgaactgctcggcggccgcctgcacgacagcctggaggtggcctggaccctggccagcggcgacaccggccgcgacatcgaggaagccgagcggatgctcgacctgcgccgccaccggcatttcaagctgaagatcggcgccggtgaggtggatgccgacgtggcccacgcgatcgccatcaagcgcgccctcggcgagcgcgccagcgtgcgggtggacgtcaaccaggcctgggacgaaggcgttgcccagcgtgcctgcgcgacgctcggcgacaacggcatcgccctgatcgaacagcccattgcccgccacaaccgcgtcggcctggcgcgcctgagcagccgcggcggcgcgccgatcatggccgacgaggccatcgagagcgtcgaggatgccttccatctggctcgcgagggcgccgccccggtgttcgccctgaagatcgccaagaacggcggaccgcgcgcggtgctgcgtagcgcggcgatcgccgaggcggccgggatcggcctgtacggcgggaccatgctcgagggcggcatcggcaccctggccgccgcccacgccttcgtcaccctcgaccgcctggcctggcacagcgaactgttcggcccgttgctgctgaccgaggacatcctcctcgagtcgccacgctaccaggatttccacttgcacgtgccgcgtgcgccgggtctcggcctggcgctcgacgaggagcgcctggcgcgcttccgccggcgctga

SEQ ID NO: 14682 - DNA, 1299 bp, Pseudomonas aeruginosa
agccgtcccgcagacagaggagaaacgaccgatgctgttccacgtgaagatgaccgtgaagttgcccgtcgacatggacccgcaacaggccgagcggctcaaggccgaggagaaggaaatggcccagcgcctccagcgcgagggcagctggcggcacctctggcggatcgccgggcactacgccaactacagcctgttcgacctgcccagcgtcgaggcgctgcacgacaccctgacccggctgccgctgtttccctacatggacatcgagatcgacgggctttgccggcatccctcgtcgatccatgccgacgaccgctgagattcccttcccacgcccgacaacaacaagcagaggcaaacgccatgaccgtgaagatttcccagactgccgacgtccagcgcttcttcgaagaggccagcggccagctcaacgaacgcggcgatccgcgcaccaaggccctggtgcggcgcgtcctcgacgacacggcgaagctgatcgaagagatgcaggtcacgcccgacgaattctggaaagcggtggactacctgaaccgcctgggcagccgccaggaggccggcctgctggccgccgggctgggcctggagcattacctggacctgctgctcgacgcccaggacgccgaggccggcctcaccggcggcacgccgcgcaccatcgaagggccgctgtacgtcgccggcgcgccgctgagcgatggcgaggcacggatggacgacggccgcgacgccggcaccgtgatgttcctccagggccgcgtcagcggtcccgacggccagccgctggccggggccatcgtcgatgtctggcacgccaatacccaaggcacctattcctacttcgacagcagccagtccgaatacaacctgcgccggcgcatccgcaccgacgccgacggccgctaccgtgcgcgcagcatcgtgccgtccggctacggttgcccaagcgacggcccgacccaggaactgctcgaccgcctcggccgccacggccagcggccggcgcacattcacttcttcgtctcggcgcccggccatcgccacctgaccacccagatcaacctggcgggcgaccgctacctgtgggacgacttcgcctatgccacccgcgatgggctgatcggcgacctgcgcttcaacgacgaccccgccgcggcccgcgaccgcggcgtggagggcggacgcttcgccgaactggatttcgacttccagctccagtccagcccggcgcccgccgccgagcgccgcagccagcggccgcgggcattgcaggagtaa

SEQ ID NO: 14683 - DNA, 1620 bp, Pseudomonas aeruginosa
gtggaaaattacgtttccgataacttcggcgatgctccgttgcatggcggaggagtctgcgcgaagcgcattaagtgcgagttaagattgcggaaaagtaatccccgcctcatgtctgcgtcatttccccggttccagaatcagccccacggtcaatgccggttgcggcaggactgcgcgggggcgcgatcgaccagaagttcacgcacagccagcgccgcaaggcatggccgcagaagaaaaacagacatgaaccgatctggagcaatcgccatgcaaggggatggaaagaaacgactgtggacgcttccactgctgctgggcgccggactgatggcctcggccgtcgccgaggagaacgccgagcggagcaaggaaggtttcatcgagggcagcgaggtcaacctgctgctgcgcaacttctacttcaaccgcgacttccgcaagggccaatcgagcccggcgggcggcggctacaccgaggagtgggtgcagggcttcatggccaacttttcctcgggcttcacccagggcacgctgggcgtcggcatcgacgccttcgcccagctcggcgtgcgcctggacagcggcggcgggcgttccggcgccggcggtagcgtcgacctgctgccctatgacgaccaggggaggccgcaggacaactattcgcgagccggcggcgcggtcaagctgcgctggtatggcaccgtgctgcgggtcggcgacgtgttcccggaaaccccggtaatccagtacggcaacagccggctgttcccctccagcttccgtggcttcaccctggtcaacgacagcctggcgaagggcctgaccctgcaggccggcaagctgaactcgatgacccagccgaacagcaccagcggcagcgacgacttctacagcttctacaccggccggcgcatcgactcgccgtgggtcgcctacgccggcggcgactaccaggccaccgagcactggagcgtcagcctctacggcagccgccagaaggacgcctgggaccagtactacgccggcaccagcttcaactatccgctggacgacaagctgtccctgctcggcggcgccaactactacaaggtcaaggaccagggcaggcaggtgatgggcgaactcgacaacgacatctggagcgtgcgcggcggcttcgcctacggtccgcaccaggtgctgctgtcgtaccagcgcaacaacggcgacgacgacttcgactacctgcgccagaccgactccatctacctggacaactcgatccagtacagcgacttcaactcgcccaaggaacgctcgctgatgctccgctacgacctcgacatggccgccttcggcgtgccggggctgagcttcatgacccgctatggcaagggctgggacgccgattattcgaatgccaacagcgtctacatgcgcaccgacgccaacggcaacccgctgaccaaccagggccgctgggaacgcgacgtggaggtcaagtacgtggtgcagggtggcgcggccaaggacctggcgttccgcgtgcgccaggccaccgtgcgctccgacagcttcgagtcggacctcgacgaagtccgcctgatcgtcgaatacccgctgcaagtcctctga

SEQ ID NO: 14684 - DNA, 456 bp, Pseudomonas aeruginosa
tcgtcgggactgcggttgctgcccatctttcccgacctgacccgcctggcgtcgctgcgctcgcgctcggcgcggctggcgagggccagacgcagggcgctggccctcgccggcgactcctccagcagcggtcgcgccatgatccgcgcggcgtcggcgtcgccgtattgcagggcgaggagcaccgtattcgggtcggagatcgcgccgagccgcaacaggcgttcggccaggaccgcatcgaggtgcgcggcgccaatctgcaggctgtcctggtgcaccgcgacgccctggtcgagcagccatctggcggcctccaggcgcccgcgggcgaggcaggcctccagcacaccgccgcgtccgcgcaaggtttcggcgaagtcgcagccggcatcgcgcaggcgttgcagcaggtcgatgtcgccgtcttgcgcagcttcggccagggccagttga

SEQ ID NO: 14685 - DNA, 255 bp, Pseudomonas aeruginosa
ccgcaggctgataaatatcaacgtagttctagcgggcttggagctagactgacaagtatgtcaggaacgcggccaacgagggtaaacatggattcctacggcgtcactttcgcaatcatcgtgctgggcatgctcttcatcggcacgggtttcaccaagcgcgacacgccgttcggcctgttcctcatgtgggtcggggtgatctgcatgctggccatcatcagctaccgcatctatatcgccacccattactga

SEQ ID NO: 14686 - DNA, 426 bp, Pseudomonas aeruginosa
cggttggtactcttcaggtcggcgccgtggagcagggtcaggcgcaggatttccaggcggccctcggcgccggccagcagatacgggctgtcgagccggctgttctgccggttgacgtcggcgccggcctcgatcaactggcgcgccaccgccaggtggtcgttggcggtggccagcagcagcggggtgctaccgtcggcgctgggcgcgtcgacctcgaccttgcgttcgagcaggctggcgacctgcgcggtatcgccgcgacgcgcggcttcgagcaatgctccggcgtcgctcgcgccggcgcctccgctgaatgctgcgcagaccagcatggctccgctcctgcatagattggccagggacatgtcgatgggctccgataggcgttggcgaaaagtatggcgtcgatgtcatgtatgctga

SEQ ID NO: 14687 - DNA, 1473 bp, Pseudomonas aeruginosa
tgcctttcagtgggagtgtgcatgctcgatctggtcctgctccgtaccttcgtcagcgttgtcgacaccggcaacttcacccgcgccggcgaacacctgcacctgacccagtccaccgtcagccagcaggtcatccgcctcgaacagaacctcggttgccgcctgctcgaccgcagccagcggcaggttttgccgaccgaggaaggcgagcgtctgcttggatacgcgcggcgcctgctgcggctctcggacgaggccagcgaggccctcagcccggcccatggcgacggcgtgctgcgcctcggcgtgccggaagacctcgccggcgaagtgctgatgccggtgctgacgcgcttcaccgaagagcgtccgcgactgcgcctggaggtcgagagcggtctcagccatcacctgctgcgcctctatcgcagcggcgagctggacctgctgctggtcaagcagtggggggccgacagcgactgccatgcacgctgggccgagccgctgggctggttcggcagcgccgcgcggccgttcggcgagggttcgccggaggagccggtgccgctggtggtgttcccggtcggcgcgctgtatcgccaggagatgatccatgccctggagagcatcgggcgtcgctggcgcatcggctattccagcgccagcctggccagcctggtggccgcggtcggcgccggactgggggtcagcctgctgccgctgggctgcgtcgggcccgagcatctcctgcttggcgcgcaggccggcttcccgcccatcgctggcctggagctggcgctctacgcgcggcccgagctggacagcgccgggcgcacctccgcgaccgcttgcgcgacctctgcgatgcgcgcctggaagggttgcagggcgagcgttgagcgctgtctccgggctatgatccggctccctcagcgaatggacacggaagcccgccacatgtcccgacccaccctgcaagtcgacctgctggtcgagtccttcaattacaaggcctggtccgaccgccgcaccctcgatgccatcgcccggatcgacgccgaggcgttcccggcctcgctggccttcgccttgcaacagctcaatcacatggcgatcgtcgaggaactgttcagggcgcgcctgctgggcgagccggcgccccaccaacagaccaacagcgaggtggtgcctggctacgacgtcctgcgtcgccggctggaggattcggccgcctggttcgccggctatgtcgccgagctgccgctggagcgtcgcggcgaatggctgcgcttccgcttcgccgatggccgcgacggcggcatgacgcgccaggagatcctcttccatatcgtcaaccatggcacctaccatcgcggcgccatcggtcatgccctcgacctggcgggcgcgccccggccggcggatacctacaccctgtatatccactccgcgcagccggagcggcgggaatag

SEQ ID NO: 14688 - DNA, 3144 bp, Pseudomonas aeruginosa
acagacccagggcggacgcgagcccgctccggatcgactgcgcgtgaatcatgcatgcacctctggcaggcctttgtcgttggcggcgcggcgcgcttcgcggttctccacgaagcggcggatgaggacgtagaacaccggcgtcagcagcaggccgaagaaggtcaccccgatcatcccggagaacaccgccacgcccatcgcatggcgcatctcggcgccggcgccggtggagatcaccagcggcaccacgcccatgatgaaggcgatggacgtcatcaggatcggccgcaggcgcaggcggcaggcttccagcaccgcggcgacgcggtccatgccttcctcctgcttgtccttggcgaactcgacgatcaggatcgcgttcttgcacgccagccccaccagaacgatcaggccgatctgggtaaagatgttgttgtcgctgccggccaggatcaccccggtgatcgccgacagcagggtcatcggcacgatcaggatcaccgccagcggcaggctccagctctcgtactgggcggccagcacgaggaaggccagcagcacgcagagcgggaagacgaacagcgcggtattgccggcgaggatctgctggtaggtcagctcggtccactcgtaggtcatgccgttgggcagttcctccttcagcagcttctcgatcgccgcctgcgcctggccggagctgtagcccgcggccggggcgccgttgagttcggcggtgatgaagccgttgtagtgcatcacacggtccggaccggaggtgtcgctgaccttgatgaaggacgccagcgggaccatctcgccgaggttgttgcgcaccttcagctggccgatctgctcgggttcgaggcggaactgctgctcggcctggacgttgacctgataggtacggccgaagcggttgaagtcgttcgcgtacagcgagccgaggtagacctgcagggtgtcgaagatgtcgctgatcgccacgccgtgggtcttggccttctcgcggtcgatgtcggcgtcgatctgcggcacgttgacctggtagctggagaacaccgagctgggttccagctcaggcagcgcacgggccttggtgatgatgttctgggtctgcttgaacagctcctcgtagccctggttgccacggtcctcgatctgcaggcggaagccgccgatggtccccagcccctgtaccggcggcggcgggaagatcgcgatgtaggcgtcctggatgtcggcgtacttggcgttcagcgcggcggcgatggccccggccgactggctcgggtccttgcgctcgtcgaacggcttcagcggggtgaacacgatgccgctgttcgggctgttggtgaagccgttgatcgacaggccggggaaggccaccgagtccgccacgccgggctgcgccagggcgatctcggacatctgcttgatcaccgcctcggtacggtccaggctggccgcgtcgggcaactgggcgaaggccaccaggtactgcttgtcctgctgcgggacgaaaccggtcggcgtgctggagaagccgaagtaggtcagcaccatcagtccgccgtagaccagcagggcgatcgagctgccgcgcaggacccggttcaccgtgccgacgtagccatggctggcgcggtcgaagaaacggttgaacggacggaacagccaactgccgaggagcttgtcgaggaacaccgagaagcggtccttcggctcgtggtggcccttgagcaggaccgccgccagcgctggcgacagggtcagcgagttgaacgccgagatcaccgtggagatcgcgatggtcagggcgaactggcggtagaactgcccggtgaggccggagatgaacgcggtcgggatgaacaccgcgcagagcaccagcgccgtggcgatgatcggcccggtcacctcgcgcatggcacgcttggtggcttccaccggcttgaggccgaggccgatgttgcgctcgacgttctccaccaccacgatggcgtcgtccaccacgatgccgatggccagcaccaggccgaacagcgacagcgcgttgagcgagaagccgagcatgtgcatcaccgcgaaggtgccgatcagcgacaccggcaccgcggccagcgggatgatcgaggcgcgccaggtctgcaggaacaggatcaccaccagcaccaccagcaccagggcttcgaacagggtgtgcaccaccgcctcgatggagccgcggacgaagatggtcgggtcgtagacgatggagtagtccatgccttgcgggaagctgtgcttcagctcggccatcttctcccgcaccaggttggagatctcgatggcgttcgagccgggacgctggaagatcgggatcgccaccgccggcttgttgttcagcagcgagcgcagggcgtactggttggagcccagctcgacccgggcgatgtcgcgcagacgggtgatctcgccgttggcgccggcgcggatgatgatgttctcgaactcttcctcggtgaccaggcgaccctgggtgttgatcgacaactggaagctggtatcgctcggcgccggcggcgcgcccagggtgccggcggcgacctggcggttctgctcgcggatggcgttgaccacgtcggtggcggtgaggttgcgcgaggcgaccttgttcgggtccagccagacgcgcagcgaatagtcgccgaggccgaacaactggacgtcgccgacgccgtcgaggcgggccagttcgtccttcacgttgagcaccgcgtagttcgacaggtagagcatgtcgtagcggttatccggcgaggtcaggtgcacgaccatggtcaggtcgggcgaggccttgtcgacggtgatgccgagccgggtcacttcttccgggagcttcggctcggtccgggtgacgcggttctgcacctgcacctgggcgttgtccaggtcggtgccgagggcgaaggtgatggtcagggtcagcttgccgtcggaggtcgactgggaggacatgtagagcatgttctccaccccggtgatcgcctgttcaaggggagaggcgacggtctcgccgatgactttcgggttggcgccggggaagttggcgcggaccacgacggtcggcggcaccacttccgggtattcgctgatgggtag

SEQ ID NO: 14689 - DNA, 1350 bp, Pseudomonas aeruginosa
ctggaacagggagatggcgccgccaatcaggatcagcagcgacagcaccgcggcgaagatcggccgctggatgaagaattgggagaaattcatcggttcttcctatcgccgcgctcagccgcgcggctagttgcgagtggcgttgtccttggacgccgccaccttcggtggttcgctgtcgccgaccgactgccgcaggcgcgcgagggtggccagggtgtcggcgctggccatctcgaccttctgcggatccacctgcatgcccgggcggacccgctgcaggccattcacgacgatccggtcgcccttgctcaggccgctgcggacgatgcgcaggccctccagcttcggtcccatctcgacggtgcggtagacggtcttgttgtcgccatccaggaccagcacgaacttcttgcccaggtcggtgccgaccgcttcgtccttgatcagggtggcggcgtaggtcttgctgccgaccaacttcaggcgcacgttgaggcccggggtgaactcgcccttggcgttgtcgaacacggcgcggccgcggatggtgccggtacgcgggttgacctggttgtcgaggaagtccagccggcccaggtgcgggttgccgtcctcgctgctcaggccgaggtagaccgggctctcgctgcgcgtgtcgcgaccggcctggcgggccagctcgacgtacttgaggaacacgcgttcgtcggcgtcgaagtaggcgtagaccttgtcggtgctgaccagggtggtgagcagggtttccccggagttgaccaggttgccggcggtgacctcggcgcggctgacgcgaccgtcgatcggcgcggtgatccgggtgaagctcaggttcaggcgcgccgcgtccagttgcgcctgggtcgcggcgaccgccgccttggcttcctgggcggcggtggtgcgggcgtcggcgaattccgcggagatcgcgttgctggcgcgcaggcgttcgccgcgctgggcttcgttgacgctccgcgcctgggccgcgcgggcctgttgcacctgggcttcgaggcgcttgacctcggcctcgaacgggcgcgggtcgatctggaacagcaggtcgcctttcttcaccagtgcgccttcatggaaggccacgcggtcgatgtagcccgacacccgcgggcgcagctccaccgactccggggcctccaggcggccggtgaattcgtcccactcgttcagcggttgttcgatgacttcggcgacgctgaccttgggcgccgccatgccttgggtggtttccggggccttgccgcaggcgctcaggaccagtacggccgcgagtgcgagggggtagcgccaggagaagtgggatga

SEQ ID NO: 14690 - DNA, 435 bp, Pseudomonas aeruginosa
ttggcgcggcgcacgacgaggacgatccccggcgcctccgcgcgcaggcggcggagcaggggcggcaacaggccgaactcgacgtcgtcggaaaggccgatgcggaacaccgcggtgctggtcgccggatcgaactcgctggcgcggctcatggcggtggagatggagtccagcgccggcgacaggtgggcgaagatttcctgggctcgcgcggtgggctccatgctgcgtccggtacggacgaacagcgggtcgtcgaacagcgtgcgcaggcgcgacagcgcggcgctgatggccggctggccgaggaacagtttctctgcggcgcgggtcacgctgcgttcgtgcatcagagtctcgaacacgatcagcaggttcagatcgacgcggcgcaggtcgtttcggttcatggcgttcctcgtttccaggggctag

SEQ ID NO: 14691 - DNA, 1056 bp, Pseudomonas aeruginosa
ggttattcaccccgtgatgcactgcagaggtttgcgatgtcccgagtgatccgttttcatcagtttggcccgccagaggtcctcaaatgcgaagagctgccgaccccggcgccggccgcaggggaagtcctggtgcgtgtccaggcgatcggcgtgagctggaaggatgtgctctggcgtcagaacctggccccggagcaggctgcgctgccgtccggtctcggcttcgaactggccggcgaggtgctggcggtcggcgccggcgtcagcgacctgccgctgggttcccgcgtggccagtttccccgcccatacccccgatcattatccggcctatggcgacgtggtgctgatgccacgcgcggccctggcggtctaccccgaggtactcaccccggtggaggccagcgtctactacaccggcctgctggtggcctatttcggcctggtcgacctggccgggttgaaggccgggcagaccgtgctgatcaccgaggcggcgcgcatgtacgggccggtctcgatccagttggccaaggctctcggcgcgcgggtgatcgcttccaccaagtccgccgaggagcgcgagttcctccgcgagcagggcgccgacaaggtggtggtgaccgacgagcaggacctggtcctggaagtcgagcgcttcaccgagggcaagggcgtcaatgtcatcctcgacgaattgggcggcccgcagatgaccctgctcggcgatgtctccgccacccgcggcaagctggtgctgtatggctgcaacggcggcaacgagtcggcgttcccggcctgcgccgcgttcaagaagcacctgcagttctaccgccactgcctgatggatttcaccggtcatccagagatgggcctggaacgcaacgacgagtcggtgagcaaggccctcgcgcacatcgagcaactgacccgcgatcgcctgctcaagccggtggtcgaccgggtattcgagttcgaccaggtggtcgaggcgcaccgctacatggaaacctgtccgaagcgcggccgggtggtgatccacgtcgccgattga

SEQ ID NO: 14692 - DNA, 810 bp, Pseudomonas aeruginosa
cgggaaggcaatgaagcgcgagaaggttcgggacaggcaggcggcagggaagatctcggcgacccacatcatcgccaatcccaccctggccagggaatggatcgtgttcttcaagaaggacggcgggcgcagctatttcctggtcgacgagagcgacgaggtgatgtcgttccgccggctcgacgacgcggtcaaggagctgcgcgggctgggcatcaagttcgcggagatccatctctaggagcggcgtcgcgcggtcgccactggccagccttgcgcgcccgcgcttcttcctcggcgaaccggtactggccgcgcgcctcggccgtctggccgctgtccggcgcgtcgcgccagctggccaggccaatggtcagcagggccagcccggcatccagggtatgtccgcaggtggggcagtcggccggggtgacccaggccgcgccgaggatgcggaagcgcgcgtcgcggccttgctcgcggatggtcgccgatttgccgagcagcatgtcttccagggcttcccgggcgcgccgacgccagggctcggcggccggtagctcgacggcattgagctggatgcgcagcgccttgttcgcgccgggcaggcggcagcccaggctggcgtcgtcgtgtatcgccaccaccgtgcagtcgaagcggcgctccccggcgtcggcggcgaacgccagggcggcgcagagcggcaacagggcgagggtgcggaagatcatgggctactccggcggaggtcagcgtcgacgcgaggataggttgctgcaggtcgccaggtccaccgggccgacatag

SEQ ID NO: 14693 - DNA, 1893 bp, Pseudomonas aeruginosa
aattttggggttggcataatgattttggctaaggatgttagctattatcaacaagaagcactgagaaaggctcgtgaaggtcacacgcacctgcctatagcagtcaccgctacacggctaggggacgggacatacaaagtcttaagttatctcgcggatgacgtttggcgattcccaaacgcgatttttccaccagggactgctgaccacgataaatgcattcgattcggtaagattccagagcgttggcgctcagttctgaaaatagttatgcttgaatactatttaaacggcatagagggccgggtgcgaccagtcggatcttcgttaatttcttttttcaaaaatgtatcattatttttgaagtttgctggtgtttatgtcgagtgcttgtctgaaatttcagaatttctgtgtatgcagtatgttaattatttaaaaaatagtagaagtagatctggtgataagttttctaagtcctatctttgtacgcgattgagctcggtgcacacactgcatctgctcagtaaagttactactactcccatggtgcacccttggcctgaaagtagcgcgactgagttgtcaggcgcaaatcgtgctcactgggcccaatcaaagaccttgccaattccagataacaagctcgcggaaatttttcgtgcggctgtatcacgtctagagcgcgcagacgagacattagcgcttgcggaaatggtttccgattggcaagcccaatattcctattctggcactgtaaacgcaaaacttgcggctacgggataccggggtggcattttagggttgagacttgagaaaaatctcctgctagatgcctgcagtatcgtcattcttctaacgagcggtataagagtttcagagctcatgagcttaaaagtaggcgctcactacgtacgtgatggggaagatggtactaagttttactggatgtctggagtatccacaaagaccaaagagggtaaggtagattggctagtcacaaagcttacccatgaagcgctagatgttgcggggaaggtcaccgcagagattcgtgccgagctaaatgatagatacagtttggctaagtcggcaaataatctgatagagatgcatgattatgaagcgcatctcgattctttgttccttgggtggggagggcatgcacataaactccaagtttttgctgcacaaaccattagggcaagattaaagcggtttatgctggctcataatattgactgggaggtcgcgccacaccaatttagaaggacgttcgctcgatatgtggctcgcagtcaactcggtgatgttcgttatcttcgtgatcatttcaaacattggacgctggatatgactgcgatatatacagaggatcaagttagagataaagagctgtttgatgaaatctatgttgcaatgcgtcacgaaaagatgctggtgcttgaaagtgtttttgaagaagatgcattagtttctggtggtttggcagagaccattcgtatttttcgatcctctgatgaggcgattcggacttacaaaagccgccgtgaaatggttcagtttgtatcggaggttgtgcatctgagaagtactggtattgcatggtgtactgcagatagtacgggctgctccggtggcagtgtcttggataaaactcgatgtggtgattgctcgaaaagtcttatcgatgaatcgcggctgccacattgggtaggcatatatactcaaatgttggagcttaaagctatcgctaatgactgtggtccaggtgcgggtgcacgaattgacagcgatattcgacggtgtgaagtcgtccttcaagagcttggagctgatattgaggagcttaagctcggtgttttacttgaacgggggcttcgtcatgcataa

SEQ ID NO: 14694 - DNA, 1167 bp, Pseudomonas aeruginosa
gcgttagggtcagccctcgtgccaaacaaggaagcattcatggaaaatatcatagtaccaacgtccgtacgcgcccaactcaagcgagggctcctcgaggtcaaagtcgaagacaccgttctccctccagctgacctgttcggtttcgcagagcgccggaatcccaagcgagcattccttttcgtgtcgaaagtgctgggccgccatatacccgtgcgcccctcggttatggctgccagcttcgagagcctagccgccgaaatcccgcctgatctccccggtccggtgctggtcattggcatggccgaaacggcggttggcctcggtgccggtgtgcaccgcgccttcagtgccacccgctctgacagtgtgtacctcatcagcactcgccacccccttggtactgacctcttcgctcgattcgaggaagagcatagccatgcgagtgcacacctgatccacatgcccgttgatcccgaaatcagggaagcgatgcttcaggcgcggtcgctggtgctggtggacgatgaggcttctactgggaagaccttcgtcaatctgcaccgcgccttggtagaggccggactgagcaagatcgaacgtatcgtcacgtgcgtcctcacggactggtctgctggcgctgtgcgcaaaaccatcggggaatcagccactgcagtttcgctgatgcagggttcctaccagttccatgaaaacccagctgccccgctacccgaaatgcccgacgtgggagcagtttccatcggcgagtggcctctttcggctgacaaggactgggggcgtttgggcgttcgtcgtgtggacgacacgcttgcccccgacatccgggttcaccctaacgagaaagtcatcgtggtgggtacaagtgagttcgtttggcgtcccttcctgctggctgagcgactggaacgtgctggtgtggacgtgcacttcagttctaccacccgctctccaatcgccctgggccatgccatcgagcacgccctgtcgttctcagataactacggtcttggcatcccgaacttcctctacaacgtgaagccggggcagtttgaccgagtcctgatctgctccgagactcccgagcaggctgctcctgcagagctggttgctgccctgaatgccgaggtgattttcgatgggcactaa

SEQ ID NO: 14695 - DNA, 249 bp, Pseudomonas aeruginosa
gcgcgccaagtggcacggtgtgaaaaccgccgaaatgggcaatggcgagcacagtgtccgcctggccgaggcttactaatgagcattgaaatgctggaggctgggccgaaaggagcgaatgtgctctcggtgtttgacttcgatggcactctcacccggcacgacagcttcgtgccgttccttcggtttgccttcggcactcgcgagttcacccaacgcattctcaggttgggcgctgcccacccttag

SEQ ID NO: 14696 - DNA, 615 bp, Pseudomonas aeruginosa
agatcaacaaggagcgtaagcatggcaatcaccctgagcaaaaatcagagcatttcgctggaaaaaactgccggcagcggcctgacctcggtcagcctcggactgggttgggatccggtaaagtctggaggtttcctctccaagctcctcggcggtggcaacgacgagatcgacctcgacgcctcctgcattctgctggacgggaacatgaagccggtggatctggtttggttccgtcagctcagctcgaaggacggctccatcaagcactccggcgacaatctcaccggtgaaggcgatggcgacgatgaaaccatcaacgtcgacctgcagcgtctgccagcctccgtccagcacctggtgttcaccgtcaacagcttccgcggtcagaagttcgaccaggtggaaaatgcttattgccgaatcgtgaacaactcgaagagccaggagctggcgcgcttcaacctcgctgagaagggccagcacaccggcgtagtaatggctagcctcagccgcaagggtaacgattgggacttcaaggcgatcggccagtccactaacggccgcactgcggacgacctcgtcaacttggctattcaggcggtacgcgcatga

SEQ ID NO: 14697 - DNA, 1362 bp, Pseudomonas aeruginosa
gcctgtgaaattaccgtgatggggaatggaatgaagttaaaatcactggcaatggcagtacctttagcactggctggctgcggcttcgttaacgaccagaagctcaattttgctcatcaggagtatatgcaggagtgctttgccactatttccaatagttgtaacgacaaagcgatcgactacaacatcatgcttctggaaacaattaaggacaaaatgattgaggcagggcctgagcgtctagatctcaaaggggaaagtgctgagagatttgaagatcatgtagagaaatctatcgaaaaaatggtcgagcattttgaagtcatgaggcccggctttttcactcgtgtatttatgggtaggttcgagccatttgatgggaagtctgtaagaattcttgaggcatcagatgcagacgaactttttagtgtaatccttgaggagtatgcgaagcggctcctagaaaacagaaagaaactacaggaaatttgggaaaaaacgccgaatatggtttccgaagcgtcagagccggtcggggctctcaaagaggagcctgttcaatctgcctcgcaagatgttgaggctaatgggcttaaggtagcggttgacgcggcgattattgagcacgcacagcagaatgccgccagtgaatacggcgaagctcgccgttacctgcaagtggatttcgacgggaatggcagcactgatgcagttgtgatgtacactcttgagccaactaatggcggtaattacagcaatcaatatcttgttcccctcatccgtaacggtgatgcgtgggaagctaagacacgcctcgatatcatgaactctgcctctgatttggctgacgaaggcaatggcgttctgagctatatcgagctctcgcacggcccagatgatgcagattgctgcccatccatggagacaaaacgtctgtataagtggaatggttctgtcttgcaggagtacaaaaatgatggtgcagtgccgacacaggcatcatccaaatctcttgctgaaccgcctttctactcagtgctcacgctgaatgattcatcggacgaaaaagaagtgacgaccaagcgaattttagagtgcagcatggcctcaaagcttgttgggcagttagactcgatagacatcattgcagataagattaatcggaccggtttggccaatgctattaaccctaacccagaaattatggccgattatcatcagatgattaaaaaggattggtcgctaaaagatatgaatcgagcaagccaagatgagtatttagtggggatctataattctgaattctgccataagctccacgagcagccggcaattcaggtttccgatgtcccaggcgattag

SEQ ID NO: 14698 - DNA, 1221 bp, Pseudomonas aeruginosa
ttccaacctatccgcaccagagctcgtgcagaaacaatccctctcaacaacatcgcgaagcctgaggggaactgcatgaaagtcgtgatcgcgccggactcgttcaaagaaagcctacctgcagagctcgttgcagaagccattgctcaaggagtgcgggattcggctccagacgctgaaatcgtgtgcatgcccatggcagacggcggtgagggcaccgtcgacgccgttctggctgccaccggtggagagcggcgggtcagtaccgtccaaggaccacttggggcggaagtccaagcggcttggggctggcttaacgagtctcgcaccgctgtgattgaaatggcggcagccagtggcattcacttggttctggccgcggaacgcgacgctacgcgcgcgtccaccttcggaaccggtcaactggtccagcaagccctgaattctggcgcgcaacgaatcatcatggggtttggggggagcgcgaccaatgatggcggtaccggaatgctgcgagcgcttggtgccaggttcctcgactctgccggcgatgacatcgaggagggtggcctggcgctcaaagctcttcgccagatcgacttgagcggactcgatgagaggctacataaagtccggattgaagttgcctgtgatgtcaacaatccattgaccggactgcacggagcctcacacgttttcggcccgcagaaaggtgcaactcctgatcaggtcttggctttggatgaggctctgaatacgtatgccgatattgtggccgcgcttctccagaaagacgtacgtgactttcctggggctggcgcggcggggggaatcgggttcgccaccaaagcatttctaggtgcggaattccggcctggtgttcaactgatcgcggatttgtctggactgagtcaggcggttcaaggagcagaccttgtgatcaccggcgaagggaagctggatgaacagacgctgttcggaaagacacctgccggggtggctgtgatcgcttctgctgcgggagtgcctgtcgtggcaatcgctggcacgctgggagtcggatatcagctgctgcgcgacattggaatcgttgcagccttctccatcacctctgggcccatgacgctcgaatcagcgtgctccgacgccgcaactcttctccggcatagggcatcggatttagtgcaactgtggaaggttgctagagtagggggttcctga

SEQ ID NO: 14699 - DNA, 243 bp, Pseudomonas aeruginosa
gccgggtacgtcggcaagcgcaagcagatccgcagggagctgtttctgattgagatgggcctggtggtatcgtggaagaatctaattgccctgatcgattcgcactacccagaggagaagggcattcgcccggcgtacccgttgatggcaatgctgagcgtgcatctgattcagaactgggctaggtgtctctactgtcggcaagatcttctgaaagagtcgagcgactggagttctgtgtaa

SEQ ID NO: 14700 - DNA, 912 bp, Pseudomonas aeruginosa
gcactggatgcgcatcggcatgctgatcgaagccaatcccggcctgacctatgcgcaggtgctacgccaattgatggacgaagcgcgcgaaagcgaccgccgcgagcaggacgcggcgaggatctcgggatgatcaagagcgcggaggaaatccagcgcatgagcgtggccggcgcgctcaccgcgaaagtcctcgaagccctcgacgaggtggtgcggccaggcatcagcacggcagagatcgaccgcttctgcgagcgctacatcgtcgacaccctcgcggcgattcccggcagcaaggggcagtacggctatccgttcacggtgaacacctcggtcaacgaggtggtctgtcatggctggccgtcggcgcagcagatcctccgcgacggcgatatcgtcaacgtcgacgtcacggtgatcaaggacggctatttcggcgacagcagcaagatgtaccgggtcggcgccatcgaccgccaggcgcagaagctgctcgacgtcacccgcgaatgcctgtaccgggcgatccgcgtggtgcgcccggacgccaccctcggcgatatcgggcatgccatccagagtcacgccgaagccaacggttattcggtggtccgcgaatactgcgggcatggcatcggccgcaagatgcacgaggcgccgcaggtcctgcacttcggtcgcgctggcgcgggtgcgcggctgaaggccgggatgaccttcaccatcgaaccgatgatcaaccagggcggccacgcggtgaagctgcacaaggacggctggaccgtgaccacccgcgaccgccgcctgtcggcccagtacgagcacaccgtgctggtcaccgagcggggttgccgggtcctgaccctgcgcgacgaggagcgcgaggcgctggccgacctggctggctga

SEQ ID NO: 14701 - DNA, 402 bp, Pseudomonas aeruginosa
ccaagatttccggcgcctactggcgcggcgactcgaagaacgagcagttgcaacgcatctacggcaccgcctgggccgacaagaagcaactggcggcctacatccagcgcatcgaagaggccgagaagcgcgaccatcgccgcatcggcaagcagctcgacctgttccacctgcaggaagaagcgccgggcatggtgttctggcacccgaatggctggagcgtctaccaggtgctcgagcagtacatgcgcaaggtccagcgcgaccatggctatgtcgaagtgcgtaccccgcaggtggtcgaccgcatcctctgggagcgttcgggccactggtcgaactacgccgagaacatgttcaccacctcctcggaaagccgcgactacgcggtcaagccgatga

SEQ ID NO: 14702 - DNA, 2388 bp, Pseudomonas aeruginosa
gagaacaggatgaaattcagtgaaaagtggctgcggagctgggcaaatccgcaggtttcccatgacgagctggtcgctcgcctgtccatggtcggcctcgaggtcgacgccgacctgccggtcgccggcgccttcagcggcgtggtggtcggcgaggtgctctcgaccgaacagcatccggacgccgacaagctgcgcgtctgccaggtcagcaacggcagcgagaccttccaggtcgtctgcggcgcgcccaacgtgcgcgcgggcctgaagattcccttcgccatgatcggcgccgaactgccgggcgacttcaagatcaagaaagccaagctgcgtggcgtcgagtccttcggcatgctctgctcggccaaggaattgcagatcagcgaagagaacgccggtctgctcgagctgccggccgacgcgccggtcggccaggacgtccgcacctacctggagctggacgactacaccatcgaggtcggcctgaccccgaaccgcggtgactgcctgtcgctcgccggcctggcccgcgaagtcagcgccatctacgacgtaccgctggcgccggtggcggtggacgcggtcgccgcgcagcacgacgagacccgtccggtcgagctcgccgcgccggctgcctgcccgcgctacctcggccgggtgatccgcaacgtcgacctgagccggccgaccccgttgtggatggtcgagcgcctgcgccgttccgacattcgcagtatcgatccggtggtcgacgtcaccaactacgtgatgatcgaactgggccagccgatgcatgccttcgaccttgccgagatcaacggcggcgtgcgcgtgcgcatggccgaggacggcgagaagctggtcctgctcgacggccaggaaatcaccctgcgcgccgacaccctggtgatcgccgaccaccagcgcgccctggccatcgccggggtgatgggcggcgagcacagcggcgtcagcgacagcactcgcgacctgttcctcgaagccgcgttcttcgacaccatcgccctggccggcaaggcccgctcctatggcctgcacaccgactcctcgcatcgcttcgagcgcggcgtcgacagccagttggcgcgcaaggccatggagcgcgcgacgcgcctgatcctcgacatcgtcggcggtgaaccggggccgatcgtcgagcaggtcagcgaagcgcacctgccgaaggtcgcgccgatcaccctgcgcgccgagcgcgtgacccagatgctcggcatgccgctggacgccgccgagatcgtgcgcctgctgcaagccctggaactaacggtggtagccgacggggaagggcagtggtcggtcggcgtaccgagccatcgcttcgacatttccctggaagtcgacctgatcgaggaactggcccgtctctacggctacaaccgcctgccggtgcgctacccgcaggcgcgcctggcgccgaacaacaagccggaagcgcgcgccgcgctgccgctgctgcggcgcctgctggtcgcccgcggctatcaggaagcgatcaccttcagcttcatcgatccggccctgttcgaactgttcgatccgggcacccagccgctgaccctggccaacccgatctccgccgacatggcggcgatgcgttccagcctctggccgggcctggtcaaggcgctgcagcacaacctcaaccgccagcagtcgcgggtccgcctgttcgaaagcggcctgcgcttcgtcggtcaactggaaggcctgaagcaggaagccatgctcgccggcgccatctgcggcaagcgcctgccggaaggctgggccaacggccgtgacggcgtggacttcttcgacgccaaggccgatgtcgaggcagtgctggccagtgccggcgccctcggcgacttcagcttcgtgcccggtgagcacccggcgctgcacccggggcagaccgcgcgcatcgagcgggacgggcggctggtcggctacctgggcgcgctgcatccggaactggcgaagaaactcgacctcgagcagccggtgttcctcttcgagctgctgttggccgaagtggtcgacggtcacctgccgaagttccgcgagctgtcgcgcttccccgaagtgcgccgcgacctggcgctgctggtggatcaggacgtgccggcacaagacatcctgacacaaatccgtgcggcggccggcgaatggctgacggacctcaggctgtttgatgtgtatcacggtaaaggcattgatccgcatagaaaaagccttgccgtcggcttgacctggcagcatccatcgcgcactcttaatgacgatgaagtcaatagcacgacgcagaacatcgtcacgtcgttggaagaaaggttcaatgccacgttaaggaaatag

SEQ ID NO: 14703 - DNA, 306 bp, Pseudomonas aeruginosa
cgtatgggggctctgacgaaagctgaaattgcggaacgtctgtacgaagagctgggcctgaacaaacgggaagccaaggagttggtggagctgttcttcgaagagatccgccaggcgctggagcacaacgagcaggtcaagctgtccggtttcggcaacttcgacctgcgcgacaagcgccagcgccccggacgcaacccgaagaccggcgaagaaatcccgatcacggcccgccgcgttgtcacctttcgtccagggcagaaactgaaggccagggttgaggcatatgctggaaccaagtcataa

SEQ ID NO: 14704 - DNA, 2049 bp, Pseudomonas aeruginosa
agaaaccgaaaaccagctcaagagcgaactggccgccgcgctagcacatcacttcgtcggcgaggacgcctgatggacgcgcagcggtttttggcagagtttgggcatattgccaatgcaccggggggcattagcaagttgcgggagttagttctccagcttgcaattttcgggaaacttactgagcgcgttgcagatgacactagtgcgcttgagttgatagaagccaacaagattagtcaggagagtttggtcgcacaaaagctgctaaagcggcgactcgctccaaaacctgtcattgagagcgatcatccttggatgctgccggcgggttgggcttggacgcgcttgggtgcagttaccaactatggagatgctcctaaaatcgagtttgaggacgtgaaggaagacacctgggtgctcgagcttgaggatattgagaaaggcacctcaaggcttattgccaaagtcctcgcgcgcaaaagaagatttaagagcacgaagaatggatttcctgcaggtgcagtgctttacgggaagcttcgcccttatctcgacaaggtcctagtcgccgattcacccggagtatgttccacggaaataagcccgatctcattctttgagaatattgatgcaggttatttgcgctggtatttgaagtcgccttactttattacctatgcggatagttcaacttatggcatgaatcttccgcgactcggaacggactctgctcgcgaagcgctatttgcttttcctccccaaaaagagcaatccctcatcgtagccaaagtcgacgagctgatggctttgtgcgacaagctggaggcacaacagcaagcccgccgcaaactgcaaaacgtactgcggcagtccaccctgcaagccgttgccagcgccactagcccgcacgaactaaaagctacctgggcacgcttatccgagaacttcggacggctgtttcatacgccggaggatgtagatgacgttgtcgctgagctgaaaaatctagcagtccgcggtctgcttgcggaggcctctgaggccccacctgaccttgatgcaatcaaagcggattgctcgcgattgcgggctcagtacattacaggcggtctgatacgtcgccaaaagcttgttggcatggctgagtgcgaagagatctaccccgatcattgggcggtcaccgctttcgatgaagtggcggtcgttattggcggcgttaccaaggggcgcgatcttcgtggcaagcaggtaatggtatgcccgtacttagccgtggccaatgttcagcgcgggcatttcaaactcgaaggtttgaagtcgatagagattgccgctgatgagctagcgaagtaccaggttcacgaaggcgatctcttgatcacagaaggtggagattgggacaaggtcggccgcaccgcaatttggcgtggcggtatagaaaactgtctgcatcaaaatcatgtgtttaaggcccgagtccccagcgggcagttgcttaatgagtgggttgaattggttttcaactccggcattggacgagattattttgccggggcctccaagcagacgacgaatcttgcatctatcaacatgacgcaggttcgcagttttgcgctcccgatcccgccactggacgagcagcagcgaattctttctgtgctctccgaactgaccactcattgcaacaaatggcgtcgccagttggagcggaagcaggcgatgtcagcgctccttgctggtgccgttgtttctagtttcaccggtatcaccatcgaacaagaagaggaacctatgaaagccccgcaaaccgaattgatcgctcctctgcgcttgggaacagcgcctgatatcaaagctcaagcaccgctggccactaccctggcccgccacaatggcgagatgagcgcgaaagatttgtggcagcgctttggtggtgaaatcgatgccttttacgcgcaactgaaaactgaagtggcccgcggttggattctggagccgacccccgccgaaatgcgtgaaaagccagccgacacggtgagcgcctga

SEQ ID NO: 14705 - DNA, 879 bp, Pseudomonas aeruginosa
gtgatttggatcgacctcaagaataaatatcctactactgctatcccgaactgggatccaaaggctacagctcagcaatggattccttggacgcaggagaggtgggatgcatggttagctaggtccaaacagttggttgcccaattggcggcgcttgacgctgcaggtcaacgtgaagagcgaaacgcgttgatagatgccaatagtgggcattggggagagctgaaagattggttattagcattatcggctggtaaatgttggttttcggaagttcgtgagctgtattcgcactatgatgttgagcactttcgaccaaagaaagaagctaaggctttagattccgctgtacgtgatgggtactggtggctggcttttgattacatgaattttcgtgcttgcggcaatgtaggtaaccgcaagaaagggggctggtttccgcttaaagatggatctctgtgctcgacatttgctgaccaatgtgaggagtcggagacacgttatctgcttgatcctgttgacgatgacgatgtggatttgattgccttcgatgaggaaggaaaagtcatccctatgcctggtacatctgagtgggatcaacagcgtgttcaacaaactgttactcgactgaagctcaatgatcatgtgcctttagctgaggagagacggaaggtttggcaaaaagttgacggccttattgaggatttcaaggctgctaaagcgcgttgtgggggtaataacccagcggctaaggccaagcttttggaggtgcgcagtaacattcgagaaatgacaagtcggactgctgagctatcggctgttgctcgttggtgcgtactttttcggaacgatccgcttttatccaagctagtaagctag

SEQ ID NO: 14706 - DNA, 240 bp, Pseudomonas aeruginosa
agcgattgtattggcctgcgtgaactcatgaggattattcgcctgaaggaggtaatcgattcgacgggcctcgcacgatccacaatctacaagctcattggcgagggggaattcccaaaaccagttcccctggttggtcggagtgttggttgggttgaaagcgaggttcacgagtggatccggagcaggatagcccagcgagacctcagagaggtttcgatagcttcatcgacgctgtga

SEQ ID NO: 14707 - DNA, 273 bp, Pseudomonas aeruginosa
ccgcgaaaccgcgccatctcgtccagcgcccgtgtgacacgaaagccgctgataccgtgctccaccaggatgccgaccgactccttggtgaagtcatcgaccaccgtcaggcatttgatccgccgcccggtgctcagtgcatcgaagacgaagtccatcgaccagacctggtttggtgcgctcggcaaactcagacgttcgcgctccaccgcgacgccatggcggcggcgccgccgtttcaccatcaagccggcagcgcggtacaggcgatag

SEQ ID NO: 14708 - DNA, 807 bp, Pseudomonas aeruginosa
gccgagccagccaggtgcgtgcctcgagcacctggcgggcgtgggcctggaagcgttcgaggttgttctcttcgagcatggcgagggccggcgacagcagcggcgcatgccgttcgaggtcgagctggcgcagttgccgttcgatctgctcggcctccgccagcaggccgtcgccacggctcggctgccctggcgtggcgtcgcggaacagcggcagccagtgggccaggcgctggcgctgctcctcgcgcaaattcagcagggtaccgacctggcttgccagccaggcgcggtagggcgtcgggtcgtcgacctcgaagctcgccgggtgttcgtcgagggctttctgccgggcgttctccgcttcgccgaaggcgcgcaggctgtcggcgaaggcgtgcagggtggcctggtcggtggcgaaggcgcgcagttgcgccagcgggctgccttcgtagcgggccggtagccagaggcggaccagcggcgcgcagttttcctccaggcgcgccaggctgccgatgtccagcgccgccaggcgctggcgcagggccgggaagtccagcggcggcgagcctttctccagctcgatcagttcgccgagcaggcgccggtagctcagcccggtggcctcgtccacgcggtgcaggctctggtggtagcggtccagttcgccttccagcgcctcgatacgcgccgccaggcgctcgcgctggcgctcccagccctgggcgccgccggcttcggcgaacagcgcttcgagctgctcgcggatgttgcggatcaccggttcgcggtcgcggttga

SEQ ID NO: 14709 - DNA, 1200 bp, Pseudomonas aeruginosa
cgggccgtccgggatttgacgagcctgtgggcgagccttgcgctaaaacgccagcccggcgacaaaccgggccggcgccgggcttcacttgccggtcttcaccgtgttccaggtgcgcgtgcgcacgcggtcgatcttctgcggcatggactcgagggcgaacagcttggccatcttctcctgcggcgggtagatcgccgggtcggccttgatctcggcgtccaccagcgggtcggcggccaggttgccgttggcgtagtgcacatggttgctgatcgcggccatcacctcgggacgcagcaggtagttcatgaaggcgtagccggccttctcgtcgggcgcgtcgaccggcatcgagaccatgtcgaaccacagcggcgagccttccttcggcgtcgagtagcgcacttccacgccgttgttggcctccttggcgcgggtcgcggcctgcaggatgtcgccggagaaaccgaccaccatgcagatctcgccgttggccaggtcgctgacgtacttcgaggagtggaagtagcggatgtacgggcgcaccttcagcagcgccgcctgggcctgcttgtagtcgtcggccttctggctgtggtgtggcaggccgaggtagttgagggtgatgggcagcagctcggggccgttgtccagcaccgccaccccgcacttgctcagtttctgcatgtattcgggcttgaagaatatatcccaggagtccagcggcgcgtcgtcgccgagcaccgccttgatcttcgccgggttgtagccgatgccggtggtgccccagaggtaggggaagccgtactggttgcccggatcgttgacctccagggccttgagcagcaccgggttgaggttcttccagttgggcagctgggacttgtccagcttcttcagggcgccggcctggatctgcttggccatgaagtggttcgacgggaataccacgtcgtagccggattggccggtcatcagcttgccgtcgagggtctcgttgctgtcgtagacgtcgtaggtggcctggatgccggtttccttggcgaagttcgccacggtttcgggagcgatgtattcggaccagttgtagatcttcaggttgtccgcggcgagggttgcgccgctgccgcaagcgagggcgaggagggtgagggaagcgatgcgggtcttcattgttgtaggtgtcctgtcggctga

SEQ ID NO: 14710 - DNA, 438 bp, Pseudomonas aeruginosa
agctgttgctgctgctggacatcggcggctcgatggacgcccacgtcaaggtctgcgaggagctgttctcggcctgcaagaccgagttcaagcacctggagtatttctacttccacaacttcatctacgagtcggtgtggaagaacaacctgcgccgcagcagcgaacgcaccgccaccttcgacctgctgcacaagtacggtccggactacaaggtggtgttcgtcggcgacgcggcgatggcgccctacgaaatcacccaggccggcggcagcgtcgagcactggaacgaggaagccggttacgtctggatgcagcgcttcatggagaagtacaagaagctcatctggatcaacccctatccgaaggacacctggaactacacggcgtccaccggcctggtccgcgaactggtcaaggaacagatgtatccgttga

SEQ ID NO: 14711 - DNA, 507 bp, Pseudomonas aeruginosa
tggcggatgcgcacctccacgccggcgctctggaagcgccgggcggcggcctcgacccgcaactcgccgcgggtcacccgctggtggtggcgcaggtgttccagccaggattcgtcgatgaaaaactccagccacaggcgacggttgccgctgtcctggaccagcccccaggacaccgcgccgttgcgccgacgcatggcgcgcacctcgaccatcgccgcctggaatgccgcggcgtcctgcgggtcgatgtcgtactcgagggtgaccatcaccgggccgcgttcctggtccacctcttcgtcgaccagtggtgccggccagtgcagcgacggcgcgaggtcctcggcctcggtgaccggcagccggcagcgcagcgacgcgaacaggccgagcagcagcgcggcgctggcgcagagcagggcgaaggtgatcgacaggtggctggcgaccagaccccacagggcgccgccggcggccatgctgccgaagaacaccaggatgtag

SEQ ID NO: 14712 - DNA, 408 bp, Pseudomonas aeruginosa
cgccagccggcgcgcagggcgccgaacaggcgttccgccggcagcaccgagggcacggcctcgcgtttccaggccagcagcacggcgatcaccgcgaagaaggagagggcgttgagggcgaaggtcagccaggggccgaccaggctcaccagcaccccggcgatggccggtccgaccgcccgcgccaggttgaccccgacactggacagcgccaccgccgccggcagttcgtccttgcccaccagttccggagtggtggcgctccaggccggcatcatcagcgcggtgccgatgcccatgcacagggtcaggccgagcagcagccagacgctggtcaactggagcagggtgaggctggccagcagggtggccaccaaggccatccacaattgcacgccgagcaggtag

SEQ ID NO: 14713 - DNA, 438 bp, Pseudomonas aeruginosa
gcaggcgccactccaggtagtcgggcgccttggcttcctgtgtcgcggcgtggcacggcgaggtgccgcccagcgccaggaaaagggccaggcggccgaccggtcgaacgcggatcatcgggaaaactccgggcgaggcgggccgcgaagggcccgcccgggtacgtcagaaagcgaagcaggaacagccgaatgcgccccagaaaccctggaagtcgctcaccggtacgttggagtggcgcgcgcggttgtgctcgtgggcgtgtaccgcgcaggcaccgacgcactggtggacctgggcggtcagcggcgcgccttgccgccagtggccgggtaccttggccaccggcgaccagtccggcagcaccggcggcgccggcggaccgagcttgtcgaactcggcggcggcatagacgaccttgccgtcgaccaccgtga

SEQ ID NO: 14714 - DNA, 414 bp, Pseudomonas aeruginosa
cccacggcgaacgcatcggcccgaatccggccaagtgaatgccggccgtgccgctccggtccgccgggcggcacggccgcgaaggagaacgaagatgaagctctacgtattgtcgctgggcgccggactgttggtggggatcgtctacagcctgctgcaggtgcgttcgccggctccgccgctggtggcgctggtggggttgctcggcatcctgctcggcgagcaggtcatcccggtcggcaagcaattgctcggcggttgcgcgttcgcctcggcctgcgacaaggcgggttcggtcggccatgtgctggggcaactaccgggtcggcatcgcctcgaccaggccgctggcccgtcggaaaaggaaaagggttgagcgttatatcatcgagtaacagcgcagtaatctggtag

SEQ ID NO: 14715 - DNA, 1776 bp, Pseudomonas aeruginosa
tgctgggcagcgacgaaccgctttcgcagatcggcgtcgcctgcggcttttccgaccagccgcatttctcgcggatctttctccggctggccggcgcctcgccctcgacctggcgtcgggtcaagcggcagcgcaccgacgcagcgctgtgaaccgcgaccgtgcgtgacggacggtacggaagccgccggatgctcggctagaatgccctggcttcggcggtcgccattggccgcccacttcgcaacggaacagggaatcgcagatgaaagcagtacgccagggtcgcggcgtaacggggttgctcatgctcctggcgctggccgggtgcagttcgcggtcggcggagccgccgccgcccaaccccgacgaagtacgggcgaagatcgtccgcctgatgccggccacggtgcgcgatcgccaagggtgggccagcgatatctacgcggccttttccgcccagcagatctaccccagcgacgagaatctctgtgcggtgctggcggtgaccgagcaggagtccacctaccaggtcgacccgccggtggccggcctgggcaggatcgccacccgcgaggtcgagcgtcgtgccggcaagctgcacgtgccggcgttcctggtcagctcggcgctgaatatcaagtcgcccgatggccgcacctacagccagcgcctggccgcggcgcgcacggagaaggaactgagcgagacattcgacgatttcatcgccatcgtgcccatgggcggcaagctgttcggcggcttcaacccggtacacaccggcgggccgatgcaggtcagcatcgctttcgccgagcagcacgcggacggctatccctatccgctggacggcagcatccgccgcgaggtgttcagccggcgcggcggcatgtatttcggcatcgcccacctgcttggctatccggcggactacccggcgccgctgtaccgcttcgccgacttcaacgccggctggtatgccagtcgcaacgccgcgttccagagcgcggtgagtcgcgtctcggggattccgctggcgctggatggcgatctgatccgctacggcacgcgcacgccgggctccaccgaactggccgtgcgcagcctcggcaagcgcctggacatgagcgacgcggcgatccgccgggcgctggagcagggcgacagcccggagttcgccgacagcgcgctgtaccgcaaggtcttcgccctggccgaaagcgccaccggcaagacattgccccgcgccgtgctgccggggatcgccctggagagcccgaagatcacccgcaagctgaccaccgcctggttcgccaagcgcgtcgacgaacgctaccagcgctgcatggcgcgcgtgcggaaacgctgagtccatcgtcgcgcgggtcgaacctggcgccgccgcgggagtctgccgtcctgtcagccaagctcatggagaagcagcgtatgaagacccgatacagcgccgaggcaccggcgcgcgacgaactggaccggctcgccggtccgacgctggtggagttcggtaccgactggtgcggccattgccaggccgcccagccgctgctggcggaagtattcagcgactacccggaggtcggccacctgaaggtcgaggacggtcccgggcgccgcctggggcgctcgttccaggtcaagctgtggccgaccttcgtctttcttcgcgacggccgggaggtggcgcgggtggtccgccccggcagcgccagcgtgctggaagaagcgttcgagagcctggtcggcgagggctga

SEQ ID NO: 14716 - DNA, 1482 bp, Pseudomonas aeruginosa
agagccatcactaactccgatagaaatattcgcaatattctgcgcggttttcaggtcgctcacaaggacaggtcgttcgctgtcttccgcctcgaagcgctctatctccgatccttttcgtatgttttcgacgtcttttcctctctttcacggcgaggggcgattgcctgtcggaacgcttttcggggattgatcttcttaactacgacaaatatagtcgtagttacggagaggcttttctccggatatcccgtcctttccctccaggagcccccaatgaaacaacgtatcctgatcgtcggtgccggattcgccggcatgtggagcgcgctgagcgcagtgcgccagctcgaccgccagggccgcgacgacgtcgaggtcgcggtgctcgcgccgcagcccgagctgcgcatccgcccgcgtttctacgagcctgacgtgcagcgcatggcggcgccgctgggcgaattgttcgccgcggtcggcgtgcgtttcgtgcagggcagcgcgcagcgcatcgacgtggccggcaagtgggtggagtaccgcgatgccgagggcacgctggcgcaactggactacgaccgcctggtgctggcggccggcagcggcgtgtggcgtccggcgagtgtcgtcggcatcgacgctgccttcgatgtcgaccagttggaagacgccctgcgcctagaggcacacctgcatgccctgcgcgacttgccggattcaccggcacgcaacaccgtggtggtcgccggcggcggcttcaccggcatcgagaccgccaccgagatgccggcgcgcctgcgggcgatcctcggcgagaaagcggcgctgcgagtgatcgtggtcgatcgcggcgccgccatcggcgcatcgatgggcgcggacctgagcggcttgatcgccgaggcctcggcggaactgggcgtggagtggtgcctggggcgttcggtggcggcggtggatgccgagggcgtgacgctcgacgacggccagcggatcgaggcgaagaccgtggtctggaccgtgggcgtgcgggccagcaccctgaccgggcagattccgggcgagcgcgatgcccagggtcgcctgcatgtcgaccgcaacctcaaggtgctcggtctcgacgatgtctacgccaccggcgacgtggcccgcgcggctaccgacgagctcggcaaccatgccctgatgacctgccagcacgccatcgccctgggtcgctcggccggcaataacgtggccgccgacctgctcggcgtcgagccgattccctacagccaggtgaaatacgtgacctgtctcgatctcggcggctggggcgcggtgttcaccgagggctgggaccgccaggtacggttcgtgcgcgaggagggcaagaagatcaagaccgagatcaatggcgtgtggatctacccgccggcggcggaccgcgccgtggcgctggcagcggccgacccgctgattccggtggtagcgtag

SEQ ID NO: 14717 - DNA, 705 bp, Pseudomonas aeruginosa
ggcaggtcctggcgttgcagcaggctgcggtccatggtcgcctcggggtccggttgcgccagcggcgcgccgccgggcagggccgccgccagggcgaggcccagggcggcgacgagcagggaggttctcatcaggctttctcgttatggctcaaaacgacgcggtcaggctggtatagaaggtccgtccgggctcgttgtaggtcgccgcgccggccccgtcgatgccgaccacgccctgggcattgccggcgcggaacaggcgcttgtcgaacaggttgtcgacgccggcgccgaggctcaggttcttgctcaaccgataggtgccgccaaggccggcgatggcgtagggcgagagctggtcgttggcgctgccggtgacacggtcgccgtgatagtcgtatttcttcggcttctgcttgccgtaccaggtgaccgtggcttgcagcgagaggtcgtcggtggcctgccagtcgagcatcgagttgagggtgtagcgcggcgtcaccgagagcacgtcgccggtttccttgttcttcgattgcagcatgtaggtgaagttgttgctccacttcaggccgtcggccaggggcagggtcagggtgccttcgaggccctcgaccaccgccttgggcacgttctcccactggtagatcgccgcgttggcgtagtcgcccttgccgccgctggcgtggtcgaccggtga

SEQ ID NO: 14718 - DNA, 405 bp, Pseudomonas aeruginosa
caggccggattcgatcttgttcttgtagtcgttgcggaagtaggtcagccccgctaccaggccgtcgtggctgtactcgatgcccagttccttgttcacgctggtctcggccttgaggccgtcgttgccgcgcaggtagcaactggtgctttgcccgtagcaaccctggccacggctgtacagcaggtattcggggttcagctggtacaggttgggggccttgtaggcgcgggcgataccggccttcagggtgacccgctcggtgagcgcgtgggacaggttcagcgatgggctccagttatcgccgacgatgtcgtggtggtcccagcgcaggcctggggtgagcatggtgccgggcatcagctcgatgttgtcctcggcgaacagcgagaagatccgcgctga

SEQ ID NO: 14719 - DNA, 2340 bp, Pseudomonas aeruginosa
ttcacgttcgtgaatatctcatttttgccgggtatcgggcaatgggccaatgcgccgcagcgtgctcggagcggaaatacttttcgacaaagccgtcgttgcttcggctttggttctggcttagggtcggcgggtccgcaggaggcgggcaggagtgtcgtggctattggccagcctttcgcgacggcactgggttgtacgatcatctggcgcgctgctggcgcgttgttcgggccgcccgccgcaggtgactatcaaggaagattccccatgctgttctcccaacacacccgcctggtacacgtggactccccgctgggacccgaggtcctgcaactgcaacggctggagggtcgcgaagagctgggccggctgttcagccacgagctcgaactggtctcgagcaatcccgccttgcctctggatgccctgttgggcaagccgatgagcctcgcgctggaactccccggcggcagccggcggtatttccacggcatcgtcgcgcgctgtagccagggcgccggcgccggccagttcgccagctaccaggtcaccctgcggccctggctgtggctgctgacgcgcacctccgactgccgcatcttccagaaccagaaggtcccggacatcatcaagcaggtgttccgcgacctcggcttctccgacttcgaggacgccctgagccgctcctaccgcgagtgggaatactgtgtgcaataccgcgagaccagcttcgatttcgtcagccggctgatggagcaggaaggcatctactactggttccgccacgaaaagaagcgccacatcctggtgctctccgatgcctacggcgcgcaccacagcccggccggctacaccagcgtgccctattacccgccgagcctcggccaccgcgagcgcgaccacttcttcgactggcacatggcgcgcgaggtccagcccggctcgctgagcctcaacgactacgacttccagcgtcccggcacccgcctggaagtgcgctccaatgtcgggcgcgcccatgccgcggccgactacccgctctacgactaccctggcgagtatgtgcagagtcaggacggcgaacactatgcacggacccgcatcgaggcgatccagacccagtacgagcgagttcgcctgcggggatgcgccaggggtatcggggcgggccatctgttccacctgagcaactacccgcgcctggaccagaaccgcgaatacctggtggttggcgccgagtaccgggtagtccaggaactctacgagaccggtaatggcgggggcggcgcgcagttcgagagcgagctggactgtatcgacgccggccaggctttccgccccttgccgtcgaccccggtgccggtggtgcgcggcccgcagaccgcggtggtggtcgggcccaagggcgaggagatctggaccgaccagtacggccgggtgaaggtgcatttccactgggaccgccacgaccagtccaacgagaacagctcctgctggatgcgcgtctcccaggcctgggcggggaagaactggggctcgatccagatcccgcggatcggccaggaagtgatcgtcagcttcctcgaaggcgacccggaccggccgatcatcaccgggcgggtctacaacgccgagcagacggtgccctacgagctgccggcgaacgctacccagagcggcaccaagagccgttcgagcaagggcggcacgccggccaacttcaacgagatccgcatggaggacaagaagggcgccgagcagttgttcatccatgccgagaggaaccaggacatcgaggtcgagaacgacgagacccactgggtcggccacgaccggaccaagaccatcgaccacgacgagacggtgcatgtgaagcacgatcgcaccgagaccgtggacaacaacgagaccatcaccgtgcatgccaaccgcagcaagacggtcgaccgcaacgagacggtcaggatcggcatgaacaagacggaaaccatcctcatggcctcgttgcagaacgtcggcatggggcgcatggaaaacgtcgggctcggctacagcctgaacgtcggcatgatgatgaacaccgtggtcgggctgaaccagagcacccaggtgatgaagaagaagaccttgtcggtgggcgatagctacgaagtgagcgtgggcggcagcgacgatggctctaagatcaccctggacggtcagagcatcaccctcggcagccagcgcatcgagctgaccgccgaccgcgagatcctcttgcgctgcggccagagcacgatccgcctgacgccgggggagatcgagatcctctcgcccaatgtcgatatcaactgttga

SEQ ID NO: 14720 - DNA, 1179 bp, Pseudomonas aeruginosa
gcggcgggcggatgtcctgtcgcggcttttcccaaggaaggatggatagatgagcggcctaccggtttcccatgtcggcgagaaagtctcgggaggggttatctccaccggctcgcccaccgtgcacgtcggcagcagcgcggtcggcctggccgaccgggtgtccgcctgcgtgccgttggtgggcaagccggtcaacccgatgctcggcagcaagctgctgccggaagaggtcgatttcgccctggcggcgccggacaccttcaccttcgcccgtggctacctgtcgagcaacccccgtatcggccggctcggccggggctggtggctgccgggcgagagcatgcacctggaactgagcgaagacgcctgcgtgctggtcgacgcccagggccgccggatcggctttcctgcgctggctcccggtgcccagcattattccggcagcgaggagctgtggctgcgccgcggcggttcgagcggcggcgaagcgcaggcctggcgcgggcgctgggcggcggtgccggccgaactgcagacgcaggagggctccgtgctggtgctgtccggccacagctacctgcatttccagcgttgccccgacggtatctggcgcctgcaggccagcttcggccgcgccggctaccgcaccgagttccgctggagcggacgtggcctgctcaccggcgtgcgcgacagcgccgggcgcagctatgcgctggtctaccagcaagcctgcgagccgagcgagggcgacgacggcctgcgtctgttcggcgtgatcctggccagccacgacggaccgcctccggactacatcgatccgcagagcccggggctcgactggctggtgcgctaccagttcagcgacagcggcgatctgatcgccgtgcgcgaccgtcttggccaggtggtccgggtattcgcctggcgcgagcacatgctggtcgcccacggcgaaccgggtgggctggaggttcgctacgagtgggatgtccatgctccgcacgggcgggtcgtgaagcagatcgaggcgggcggcctgacccgtaccttccgctacctgcgcgatgccaccgaggtcagcgacagcctcggccgcgtcgaacgctacgagttcgccggcgagggtgggcagcggcgctggaccgcgctggtcagggccgacggcagccgtag

SEQ ID NO: 14721 - DNA, 993 bp, Pseudomonas aeruginosa
cgcgttgttcacccaggagcgccagcacgcgccgctgggacgcctgcagcgcagccgcctgcgtctggccggcggtttcgactggcagcgcggctatcgctacgacggacttggacaactggtcggcatcgacgacaaccagtatccgtcggtgcgctacgaatacgacctcggcggtcgcctgctggccagccggcgcgctggcgcggcggccagcacctaccgatacgacgccgccggcaaccgcctggagggcgtcggcgagtacgcgcgcgaggacgctcgccaggcattcgccgagaacgaactgtaccgctccggtttcagtcgctccgaggtgcgcgcgaaccaggccggcgaaggcccggcgcgctgggccggcaaccgcgtggagaggatcgccggcaaccgctatcgcttcgatgcgctgggcaacctggtcgagcgtatcggcgccgacggcgagcgcctgcgcctggcctacgacggcgcgcagcgcctggtccatctgacgcgcgattacgccgacggcacgcggctggaggcgcgctaccgctacgacgcgctgtcgcgacggatcgccaaggtggtgctgcgcgacggtgtcgagcagcaggtgcgcttcggctgggacggcgatcgccaatgcgccgaagcctttgcgcgggaactgcgcaccaccgttcacgaaccgggcggtttcgtcccgttgctgcgcctggagcaggcctgcgagcccgatcccccggagctgctgcaactgcgccaggcgttcgccgccgaaggccagccgctgccggcgcaatgcgtgccggcgctgggcgaggcgcggatcgcttttttccacaccgatcacctcggtacccccctgcagctgagcgacgaacgtggccaactgcgttggcagggcgttccggacgactggcgggcggtagcgccggaacgacagccgggtgcgcagccgatccgcttccaggggcagtaccacgatga

SEQ ID NO: 14722 - DNA, 789 bp, Pseudomonas aeruginosa
agaaagcggcctttactacaaccgctaccgttaatacctgccggaagccgggtgctatgccagccaggacccgctcggcctgggcggtggccccaacctctatgcctatgcgctgaacgcgcccacgatggcgtacgatcccaccggcctgatcatcccgctggtggtgatcggcgccttcgccgcccgcgccgcgatcggagcggcgctgggcgccggcatcgagctggggatgcagaccggcaagcaggtgctggggcagatgaaggacaactgggacagcgatcgcgacctcaccgatatcaagtggaagtgcatcgacatcaactggaaacacgtcggcgcctcggcggccatcggcaccgtggcgccgggcatgctcagcaccggcaagaccgtggtgcagtccgccaaggcgatcaggaccctttccggacaggcggccaacaccgccaaccgcgcggccaagctggccgcgcgcaaggccgcccatgccgataccatcaagaaggccgtggccacccaggccgcctggcagacgggcaagcagatcgtcaaatgcccgctgaaggacgaagaagaggagtgcccgccgcaatgatcaagcattacctgctgatgaccctcgtctgcataccgctggcgttgctctatgtctgcctggaatggttcttcggcaacacctgggtgaccgtcggggtgttcttcggcgtgctcgtcgtgctgcgcctcgggctctacctctaccgccgctcgaagggcatcagggacggctacctggacgagtga

SEQ ID NO: 14723 - DNA, 1125 bp, Pseudomonas aeruginosa
ggccgacccggcatcgcggagcatcgacccatgcagggcctcttcgtcaatggctccgccagtcttccgccgccgatgctgtcgcgcaggcgctgctggcggcgttcgcctggtaacctggcgaactgcctgtcttctttgccaaggtccgaggagccgaccatgcacgacctgcctacctacgacgatgtgatcgccgccgccgcgcggatcgccgggcatgccaaccgcacgccggtgatgtcctcgcgtaccctcgacgaagaactcggcgcggaagtcttcttcaaatgcgaaaacctgcagcgcatgggagcgttcaagttccgcggcgccttcaacgcgctgtcgcggttttccgctgagcagcgtgccgccggggtggtggcgttctcctccggcaaccacgcccaggccatcgccctctcggcgcgcttgctggggatcccggcgaccatcgtgatgccggccgacgcgccggcggtgaagatcgaggcgacccgtggctacggcgggcaggtagtgctctatgaccgctatacggaagatcgcgagcagatcggccgcgacctggcgcagcgccatggcctgaccctgatcccgccctacgatcaccccgacgtgctggccgggcagggcaccgcggccaaggaactgttcgaagaagtcggtccgctggacgccttcttcgcgcccctcggcggcggcggcttgctctccggctgcgccctggcgatccgcgcgctggcgccggcctgccggatctacggggtggagccggaggccggcaacgatggccagcgttcgctgcgcagcggcgccatcgtgcatatcgatacgccgcagaccctcgccgatggcgcccagacccagcatttgggcaatctcaccttcccgctgatccagcgcaacgtcgatgacatcctcaccgccagcgacgccgaactggtggatggcatgcgcttcctcgccgcgcggatgaagctgctggtcgagcccaccggttgcctcggcctggccgccgcccgccagcgcaaggacgaattgcgcggcaagcgggtcgggatcctgctcagcggcggtaacatcgacctggcgcgtttctgcgccttgctcggcggctag

SEQ ID NO: 14724 - DNA, 1173 bp, Pseudomonas aeruginosa
gaaccggtcggcgggtcattggctatccgcatgctggcgggagggtatccggattgtccgggagcgaggggcgggaggcggcgcgctcctcggcgagccgctcgcggataccgctcaggcccgctggcgctgccagggcgggccagcggcgaaccgcgcttccacccattggcggaacgcgctggccgccgccgtggcgtatcgcgccgaggggcgcaccaggtagacgccggcgtcggcgtccagttgccactccggcagcacccgtaccagcctgccggcttcgaggtcgcggctcatcagccactcgccggcggcgaagatacccaggccctggcgtgcggcgcagagcagggcctcgttgtcgttgctgaccatcgagccgcgtacccgcacgggctgctgttcgtcctggcgggtcagcttccactccgggtacgagtgcagtccgctgaagccgaggcaattatgtgccgccaggtcggccgggatacgcggtaccccatgccgcttcaggtagtcgggagcggcgccgaggatgcgccgatgggcgcacagccgcctggccaccaggcggctgtcggccagttcgccgacccggatcgcgaggtcgaagccttccgcgatgatgtcgacgaagcgctccgaatagtcggtttccagcaccacctgcggatgcgccagggcgaactccgccagcagcggaccgagccagagccggcccatcgccgacggcagggcgatgcgcaggcgtccgcgcagttgcgcggcgcccaggctggcttcgtgctcggcctcgtcgagcaggtcgacggcctggcggaagcggctcgccaggcgctcgccttcatcggtgaagcgcagttgccgggtggtgcgttcgaccaggcggatgccgaggcgacgctccagtgcgccgagccgcttcgagagcaccgagggatggcgttgcagggcgcggccggcggcggcgaacgaaccgtgctcggccagggccaggagcgtggcgacttcatcggcctgccggctgtcgaacggttgcatgcatgcgcctcttgcgggtgggtcagggcaagagtaccagcgcgccttgcgagcgtccctccagcagatcggtatgcgccacggccgcctcggccagcgggtagcgccgccagacccggggctgaatga

SEQ ID NO: 14725 - DNA, 1203 bp, Pseudomonas aeruginosa
ccagcggctaagcccatgaatttcatctaccaggccgtcgatcgcaagggcaggcgcgttcgtggcgaactctgcctcccaacgcgccaggatgcgctgcggcagttgcagcgccaggggctcaccccgctcagcctggaggtgaaacgccgcaacctgggctcgcgacgtcggctcaaggccgaggaattgaacatggccatccacgagctggccaccatgctcgcggcgggagtgagcatggccgacgcggtggaggctcaggagcgaggcgcgcgccacccgaagttgattaccgccctgcaggcgatggccaatggcctgcgccaggggcaatcctttcccgtggtgctggagagcgccggcctcgacttgccgcgctatgtatatcaactggtggcggccggcgagatgaccggaaacctcgcaggagccttgagggactgtgccacgcagatggaatacgaacggcgaacccgcgccgagttgcaaggggcgctgatctaccctgcgattctggtgctcagcggggtgctcgccgtggcgaccctgttcgtcttcgtcgttccgaaattcgccaatctcctgaacgagactgcccagctcccgtggcttgcctgggcagtgctgagcatcggggtatggagcaacgagagttccggcttgctggcgttcgccgtcctgctgcttgctggcggcatcgccgtggcgctgcgcaatccggcgctccgcgcccatgcgctcgaccagttggtgcgcctgcccgtagtcggggaatggttgatgcaggcggaaatagcgcaatggtcgaaggtgcttggaaccctgctgggaaatcgtgtgccgctggtggaggccctgctgctttccgccgctggcgtccgcattgcccggcagcgccggaccctggagcgagtcacccaggatgtgcgggccggcatcgccttgtcggcagcgttggaggagcgccaggcggtcacgtccatcggttcgagcctggtgcgggttggagaggcttccgggcagctcgcggagatgctgcagagcctggcgacgctctatggagaggccgggcaggcgcgaatgaaaaaggccctggtactgatcgagcctttggcgatcctgctgatcggctctgtgttcggcctgatcattaccggcgtggtactggcgattaccagcgccaacgacatggtgctttga

SEQ ID NO: 14726 - DNA, 534 bp, Pseudomonas aeruginosa
agggcggcgtaccgctggacccctggaaccggccttacctgtacagcgacaggccgagtgccgaacaacccttcactctctacagccagggcgcggatgggcagcccggtgggaaaggcctggatgccgatgtcggttacgcgcccaaacgttgaccaggccgcgttcaccttgctcgaactgctggtggtgctggtgatcgtcggggccattgctgcggtggcgttgcccggcctggtgaggatgcaggagacctgggcgcgcaggaccgcgctggacgatctgttcaatcaattgcagaccttgggctatcgcgtgcgcagcgatgggcgggagctgctcattggtgagagcggggcggttcccgagcagttgctgcgactgcccgatggctggacggttactgctcggccgccgatacgttacatggcaaacggagtttgcctgggcggaaagttgcaggtccatcatgggcgcgcgacacatacgctgctgcttcagccccctctctgcgcgcccgggacgatccgctga

SEQ ID NO: 14727 - DNA, 1113 bp, Pseudomonas aeruginosa
atgatcgctactcgaatcctccgttgcatcccgatatcgcccccggggttcttgccgccccgcttgtggcaaggccgtggtaaggatggccgggcgcagcttgagtgggtacgtagaggtacagggttggcgcggcgcgccccagcgcagtggatcgtggatcgggcgtggtgtgtctatcgctgtctcgatctcaatcatgtgccgcgctctgaccggtatcaggcactggcgttgaagcttgccgccctggcgccttttcgccgcgcaggccattacgtagcctggcggggtggccatgctctggtctggttctgggatgaggaggtccgggaggccgttgccgaagactgcgtcgaccaacctcggcgttatcgctgtatccccgaatccctgctgcaggctccccctcggtcgatcgcggaaggcgagacggttcggctgcttcgggttcgctccgggctggatctccaggtctggagagatgactgccttgtcctgagccatttctttcccagcccaccccagccagaacaatgggttcggttgctccgggggctggcgggaatacgcatcccggagagcctggttgccgagcctggagagtcactgggccgtccctgggccgttccggcggcggaagcaacgctgctgcgatgggagcgttggttgccgcatgggctcatagccaccctgttgctgggatgcggattcaatctgggggaaggtttgtcctggtggtgggccgagcgtgcgctgcgaacgcagtacgaccagctgagcgaccaggtctcgccgatcctcagcgcacgcaaccaggccttgcagaccaatcggatggccacggagctggggcgcgctttgcagcatcgctcgcaggtggcgctgctgggacaggtagcggaactgttgccgaaggacagtcggttgctcgcctggcgctatcgaggctccgagctggagttgcggattggcaccgacagtgtcgacccgcgtctctatgtgcggcgtttcatggaatcggggagtttcgaagatgtcagggtggaaccttcgcagagcgaggggctatcgctgagcctggtcctgcgtacgccgggggagggtgcctga

SEQ ID NO: 14728 - DNA, 1947 bp, Pseudomonas aeruginosa
atcggcttgaagatcgccttgatttccgcgaagtcgcggatccagccggtatgcggatcgacctcaccttcgatgtggatggcgacacggaacgagtggccgtgcaggcgcccgcatttgtggccttcggggacgtggggcaggcgatgggcggattcgaaggtgaattctttgaagagttccactgtagtgcgctctggatcggggttatcggacaaccggaatgggggcgccatggtagcaggtttgcgcgccggacccggtctgctccgaccgggcggtcgtttacctgagttgcaggcggcgcgccaggcgcgccaggttggcgcgatccaggcccagctcgcgtgcagccgaggcccagcttccctggtggcgggccaggcagtcctggatcaggcggcgttggtaggcgtcggtggccgcgcgcaacgagtgaccggtcgttggcgcggcgggcgcgggctcgaccacgctgcgaggtggcgcgggggtttccgcgggcaggtcgagatcctgccgatgcagggtgacgatccgcgaccgctccggattgtggccgagggccttgagcgaggcgcggccgaccaggtgctcgagttcgcgcacgttgcccggccagcgatagtcgaggagcgcggcctgggcctcgtggtccaggcgcaggctgcgcagtcccaggcgcggtcggttttcctcgaggaagtagccggccagcaggaggatatcgcggccgcgctcgcgcagcggcggcacgcgcaagggatagacgctgaggcgatggtagagatcggcgcggaagcgcccggcacgcacttcctcggccaggtcgcggttggtggctgcgatcaggcgtacgtcgacgcggtgctcgcgatcggagccgacccgctgcaactgcccgctctgcagcacgcggagcagcttggcctgcaccgccagcggcaactcgccgacctcgtcgaggaacaggctgccgccgtcggccagttcgaacttgccgcgccgttcgttgaccgcgccggagaaggcgccgcgcacatggccgaacaattcgctttccaccagggtctcgggcagcgcggcgcagttgagactgatcatcggcttgccgctgcgcatggaatgccggtggatggattgcgccaccagttccttgccgaccccggtctcgccggtgatcagtacgctcaggtcgctgttggcgaccaggcggatttcttccagcagcgccttgtgcgcggcgctctggccgatcatttcccgtggccgctcgccagcggcttcgagataggcctcggcgcgctggtgctcgtcctcggcgcggcgggtcaggtcgcgcatccgctcgctggccttgaccgtggcggcggcgaggctggcgaaggcctccagggtatccaggtcggcgctggcgaagcgcgacggatcgagggtatccagggtcagcaagccccagggctggtcgtcgaggtacagcggacagcccaggcaatcatggatttccaggtggccgtggaggccttccaccagaccgtcgtagggatcgggcaggccgcagtcggcggggaagcgggtcggcccgcggcgctccaggagggcctcgaggcgcggatgttcgccgacccggaagcgccggccgagggtgtccgggctgaggccgtccaccgccagcgggatcaggtattcgccgtccaggcgcagcagcgcggtggcgtcgcagggcagcaggtcgcgcagggcctggagcaggcggcggtagcgttcgtcttccggcaggtcgcgggacaggtcggcaaccagcgggatcagggtggcaagcaaggggttggtggtcatttcgacctctttgcagtcctaatgactctgaatggttgcagtcattatgacctatgccggcctgcaaggcccgtgaattctggtagtttgccttggcacgcttcctga

SEQ ID NO: 14729 - DNA, 729 bp, Pseudomonas aeruginosa
agcgctgatcacccatttctaccgcaccatgctcggcgagtaccccgaggttcgcccgctgttcaaccaggcccaccaggccagcggcgaccagccgcgggcgctggccaatggcgtgctgatgtacgccaggcacatcgaccagttgcaggaactcggcccgctggtggccaaggtggtgaacaagcatgtctccctgcaggtgctgcccgaacactatccgatcgtcggcacttgcctgttgcgggcgatccgcgaggtcctcggcgaacagatcgccaccgacgaagtcctcgaagcctggggcgcggcctaccagcaactggccgacctgctgatcgaggccgaggagtcggtgtatgccgccagcgcccaggccgatggcggctggcgcggcgtgcggcgcttccgcgtggcacgcaagcaggcggagagcgaggaaatcacctcgttctacctggagccggtggacggccagccgctgctggcgttccagccgggacagtacatcggcctgcggctggacatcgacggcgaggaagtgcgccgcaactattcgcttttccgctgccagcaacggccgcgaataccgcatcagcgtcaagcgcgaggcgggtggacgggtctccaattacctgcatgaccgggtcgccgagggcgacgagctggatctgtttccgccggctggcgatttcgtcctgcgtgacagcgacaagccgctggtgctga

SEQ ID NO: 14730 - DNA, 1236 bp, Pseudomonas aeruginosa
gcgcgctgttccgcatgcgtcgacccggttgggaggtctgctgtgcaagtgcttgatcgttccaggctgatggccataccgccgatctggcgcctgggcttccgcccgttcttcctcggcggcgcgctgttcgcggtcctcgccatcgcgctctggctagcggcgctggccgggctctggagcggctggcaaccggtcggtggctggctggcctggcatcgtcacgaaatgctcttcggtttcggcgtggcgatcatcgccggcttcctgttgaccgccgtgcagacctggaccggcgtacccggcctgcagggcaaacccctggccctgctcgccgggctctggctggcggcgcgcctggcctggctattcgatgcgccgctggcgctgctgctggtgctgcaactgagcttcctgccgctattggcctgggctatcggtcgcagcctgtggcgggtgcggcagaagcgcaattacccggtggtgggcctgttgctgctgttgaccctggccgacgccctggtcctgctcggcctgttcgagggcaacgacgactggcaacggcgtgcctccatcgccgcgctatggctgatcgccgggatgatgaacctgatcggcgggcgggtgatcccgttcttcacccaccgcggtctcggccgtcagcagcaggtgccggcgatcgcctggctggacaatggcatcctgctgggctgcgtgctggtggcgctgctcaccgccgcgggcgtcacgacgcagccgacgccctggcttgcaggactgttcgccgccctcggtggtgcgcaactgtggcgcctgtggcgttggcgcgatcgcggcatctggcaggtgccgctgctctggtctctgcacctggcatatttctggatcgccgtggcgccgcttggcatggcgctctggagcctgggcctggcgctggcgccgagccaggcgctgcacgcgctggcggtgggcggcatgggcgggttgatcctggcgatgctggcacgggtcactctcggccataccggtcgcgcgctgcaaccgccggcagcgatgccctgggctttcgctctgctcaatctcggctgcgcggcgcgggtgttcctgcccagcctgttgccggcgaactgggcgctgcccctggcaggcggactgtgggctttggcgttcctgctgttcgcctggttctatgcgccgatgctgtgtcgtccgcgggtcgacggccatcccggttga

SEQ ID NO: 14731 - DNA, 1464 bp, Pseudomonas aeruginosa
ggtagtccagctcgcgggcgtccagtacgctggcccagtacaggctctggaaggccacctcgccggcttccgcgccgagacgtcggcgcagcgccgccaccagttcgcgggcgtagctgtgcagaccgtcctcgtcgcggctatcgggctggtcgccgatgccgtggatcagcgctacggccagtttcatgcaggatccttctcgtcggtggcggctcagtccagcgcttgcaggcgttcgccgagccggccgccgtcgaccagttcgaggaattcgtcgccgagcctgcggctttccgccatcgcctggcgccagtagcgctcgcggccgtcgtcgtcgccgaggtagcgggtgaagtccttgcggtccggcagcttggcgtgcggcaggcgcgccaggtactcgcgcgacggcgccagcagcagcacgtcctgcaggcgcccggcgtcgccacggcgccagggcaagcccttgtcgaaccagccggggatcaccttgtcggtgaagtgcgggtagagcaccacgccgcggtcctcgtagggcaggtcgagatggtagtcgagcaggccgccgtcgcggtaggtgccggggccggcgccaggcaggtcgcggacgccttccatgaccatcgggatcgagccggaggcgagcagcgcctggcgcaggttgccgccgtccaggtgcaggtagcgcgacgggaagtcggtcagcgcggccagcggcggcgcctggcgggcgtcatgcaggatcacccgttcgaagtggcggtgcagatggcggcggccgatcaggttgtcgcggatcaccgaggacagccccaggccgaggctggccttgtggtcgtgggcgaggcgcccgtggctcttcaccaccaccacgttgaggcggtacagcgggttgtcgaggatccgcgcgtcctggccggcgagcaggtcgtcgagcatcgccgcgcacttgcgcgagacttcggcgatgctcacgcccttgggaaaacgctgccgggtgtacagctcgccgaggcgggtgaggccggccacggcgtcgggcaggcaggcactggcgaagcgccaggaaccgatggaggcgccgatcagcgagcgttcacgcggggcgcgcggcagccactcgccgaagatcgccaggtccagtccctggatgcccagcgcctttggcccgccggcggcaccggggacgatgccgacgtcggccggctgcaggccgcgctcgcggatgcgggcgagggcgcggcgaccggccttgagggtcagtgcgggggacttgatctggatggctggcatgctggtcttctcccttgcggaccggcgattataggacgagttgtcgcaggaccaagcgctttcgaacgccggcgagccccatcgcagaggctttccgttaccctatggcgcgccccggccatgtccttgcggcaaattcagcttcaattaagagcgcccggttaa

SEQ ID NO: 14732 - DNA, 519 bp, Pseudomonas aeruginosa
cgccgggaccatcaagtccttcgaagagctgaacaagaacgccatcgccaagcatcccggctcgagcgtccacgataccgagctggaagaggaatacggccgctacatctaccaggtcgagttgcgcgacccgcagggcgtgaaatgggacctggagctggatgccgctaccggcgccgtgctcaaggaccaccaggacgactgatgaagtggctcatgcgctacgccgggatcgtcgcactggtcctggcggtcatcagcctcgaagcgatggcgcgcgacctggaccaggacgaggtcctgcgcctgcgccaggacggtgtgatacagccgctcgaatccctcatgcaggaagccctggggcgttaccccggggcgcgcctgctggaggtcgagctggaagaggaagacgacgtgtatgtctacgaggtggagctgctcacccgcgacggcgtcgtgcgtgaactggaactggatgcccgcaacggccgcatcctgaaggacgaggaagacgactga

SEQ ID NO: 14733 - DNA, 645 bp, Pseudomonas aeruginosa
tcgagacccgccgtggccagggctaccgctacgccggggtggccgccggatgaggtcgatccagcggcgcatgagcgtcggcctgttcgcggtgctgctggtggtcgggctggtcctcgcgcagaccggcctgtggctgttcgaccagggcctgcggcgctatttcgccggcaatctgcgcgaggaggcggagaacctgctggtggccatggtgcgcgggccgaacggcatgcaactggacgagcaacgcctcaacccggcgttccagcgcccgtattccgggcgctatttcgtcatcgagctggaaaaggacacctggcgctcacgctccctgtgggacagcgagctggaagtgccgcacaagaaagggctggtgcagggcctggtcgatgggcccgaggagcagcgactgctggtgttccgcggccactacaagcgcatgggccagaagctgcggatcgtggtggcgcaggactatacgccgatcctggaaagcttcgcccgtgtgcagtggatgggtctgggcgccggcgccctggcgctgctcctggtattgctgttgcagcgcctgaccgtgcgtcgttcgctgcgtccgctggaggaggtgcgcctgcagatcgcccagctgcagcagggccagcgtag

SEQ ID NO: 14734 - DNA, 465 bp, Pseudomonas aeruginosa
ccaactggacaaccaggctcccgaggaactggagccgctggtggagcagatcaaccacctgctggcgcacaccgaggagaccctgaagcgttcgcgcaacgccctgggcaacctcggtcacgccctgaagacgccgctggcggtgctggtcagcctcgccgagcgcgaggagatggcgcgccagccggagttgcaacaggtcctgcgcgaacagctggaacagatccagcagcgcctcggtcgcgagttgggcaaggcccgcctggtcggcgaagcgctgcctggcgcacatttcgattgcgccgaggagttgccgtcgctgtgcgacaccctgcgcctgatccacggcccgcacctgcaggtgagctggagcgcgccaccggggctgcgcctgccatgggaccgcgaggacctgctggagatgctcggcaatctgctggacaacgcctgcaagtgggccgatag

SEQ ID NO: 14735 - DNA, 681 bp, Pseudomonas aeruginosa
cggccccggtatcctccccgaccagcgccaggcggtgctcgagcggggtacccggctcgacgagcaggtcagcggccatggcctgggcctgggcatcgcgcgcgacatcgccgaggcctgcggtggccgcctgagtctcgaggacagcccgctgggcggcctgcgggtgagcgtcgagttgccgttgcagaagagcggccgcgccgccagggcttaacagttcttcaccatttgccgacactcccggcaagatttcctcctgcgctttccctagcatcccgggcttcttgcaaggaggtcttggacgatgaaacggcggacgagtacgggccgctggcgctgggcgctgatgctgccggtgctggtgttcctgttgggcgagtccagtggacagcgagaggaggggcggtcgccgcggttacccgcgcaggctcgctacgagcaggccgtggaaaacgcgttgcgcagcgagcgcggcgagccgcgacaggccgggacagcggcagcgaaggtggccgaggcgggagccccggcgcgtctgcgtggctggctgcgctcgctggcccgcctggcgatctgggggacctacggccccccggcgctattcaggccgtgaacggtcaggccttgaactgttccatcaggccctgctggtggttggccaggcggttcagcgactga

SEQ ID NO: 14736 - DNA, 1317 bp, Pseudomonas aeruginosa
ctgacctgggccgactcctcggcctggctcgacagcgactcggtgacgtcacggatcgccgcgacattgcggttgatctcctcggctaccgagctctgttcctcggcggcgctggcaatctgcaggttcatgtcgttgatcaccgtcaccgcctcgccgatccgttgcagcgcggccaccgcttcatccacctgctcgacgctgccctgggcctggcgatggctgccatgcatggcgtcgaccacgtcgcgggtgccctgttgcaggccttcgatcaccccgcggatctgttccaccgagtcctgggtgcgccgggcgaggttgcgcacttcgtcggcgaccaccgcgaagccgcggccggcgtcgccggcgcgggccgcctcgatggccgcgttgagcgccagcaggttggtctgctcggcgatggcgcggatcacttccagcaccgaaccgatttcctcgctgctgctggccagttgctcgacctggcccatggcgctggtcaggttggcggccaggctgtcgatgctctgtgtggtgcggtcgatcagcgccaggccgtcgcgggtcgcctggtcggcaccgcgcgcggcgtcggcggcctgggcggcgctacgggcgacgtcctgggcagtggcggtcatctcgtgggatgcggtggcgacctggtcgatctcgcggaactgctgctgcatgccggcgctggtctggctggaaatcgccgccgactggtcggcggtactgcgcgcatcgcgcaccgagaccttcacgtcgcggatgatcggctgcagcttgtcgagaaaacggttgaaccaaccggccagttcgcccagctcgtcgcgcccggtgtgcggcagacgctgggtcaggtcgccttcgccgctggcgatgtcgcgcagcatgtgggcgacgccgaggatcggccgggtcacgccgcgggcgctcagccacagcaccagcaggccgagcaccgcggcgccgaggccgaggcccagttcgacccaggtgccttcgcgacgcatgtcgtccagttgccgctccagcgccagggccgggccgagcagggcgctcttcggcacttcgaggagcacgccccagggcttggcgccgggaatcggctgcaacggttgcagcaccttgaggtcgtcgttctcgttgaacaaccggctcttgccggcggccagcagttgcaggagttcgccggcgtgctgcggatccgccttggccaggttcttgccgagcaggccggcgtcgcggctgttgccggcgaacagcccggccgggctgaggatgccgacctggccgacgccgtcatag

SEQ ID NO: 14737 - DNA, 315 bp, Pseudomonas aeruginosa
tcaccccgtacatgttcctgccggtgggcttcggcaacatcttcctcaatgaaatcctgctggccaacgtggcgcgcaacggcgtcgacgtcagcgggatcaacgtcacccacgccatgttcatcccagccctgggcatgctcgccgggttgctcatcgcggtgctgttcagctaccgccgcaagcgcgtctacgacttgcagcggatcgagcaggccgaacgcgtcgatgtcagctacaacccgaagagcctggcggtggccggggtatccatcgtcgccgcgttcgtcgcacagctgtggctggactcgatga

SEQ ID NO: 14738 - DNA, 639 bp, Pseudomonas aeruginosa
cctgcagcaggacgtgcaatccatcgtcagtgtgctcggggtgatccgctccattgccgaacagaccaacctgctggcgctcaacgcggccatcgaggcggcccgtgccggcgaggccggacgtggctttgcggtggtcgccgacgaagtgcgggcgctggccagccgcacccagcagagtacccaggaaatccagggcatgatcgatcgcctgcagcagggcaccaacgccgcggtcgacgccatgcgccgttccggcgaggccggcgagggcaccagcaaccaggccaaccaggccggcgattcgctggatgccatcgcccagctgatcgccaccatcaacgcgatgaacgcgcagatcgccagcgccgccgaggaacagaccgcggtggccgaggagatcaaccgcagcgtgcaccagatcgccggcgcggtggacagcgtcgccgacgaggcccagcagggcgcgcagaccgcccgcagcctggcgcaactgggccagggcctgggccgactggtcggtcagttccgcatctgacccttcccccgcgcgaccgctgccggcaaaagagccagccggcagtggtgcgccacagagccttcctgtcattattcggcggagtcggccggcagtcgtga

SEQ ID NO: 14739 - DNA, 1119 bp, Pseudomonas aeruginosa
acgatccacgtccgccggctgactaatgctttgcttcccactgccagatggattggacatgctcgacacgaaactggaatcccggacttttctcctgttgctggcggtggtcacgctcgccttcggctggctcttgctgccgttctacggcgcggtgttctggggcaccatcctggcgatcatcttcgccccggtgcaacgccgcctgcaggtgcgcctgagggatcggaagaacctcgccgcgctgatcaccctgctgatctgcgtgctgatcgtgatcatcccggtgatcttcatcgccggttcgctggtgcaggaaggcgcgagcgtctaccagcgggtcaagtccggcgaactgaacttcgccgcctacctgcagcaggcggtggctgccttgccgccatcggtgcaccagtgggtgggagcgcttcgacctgggccaatctctcgagcctgcaggagaagctctcctcggtggcgatgcaggccagccaggtggtggcgaccaaggcgttcagcatcggccagaacaccctcgacttcgtcatcagcttcggcatcatgctctacctgctgttcttcctcctccgcgacggtcgcgtgctcggccggcggatcaagcaggcggtgccgctgagccaggaacacaagcaccacctgttcgccaagttcaccacggtgatccgcgccacggtgaagggcaacatcgccgtggctgccacccagggcgctctcggcggcctgatcttctggctgctgggcatcgagggcgccttgctctggggcaccctgatggccttcctgtcgctgctgccggccatcggcgcggcgctgatctgggcgccggtggcggcctatttcctgctcaccggggcgatctggcagggcgtagtgctgatcctgttctgcgtggtggtgatcggcctggtggacaacatcctgcgcccgatcctggtcggcaaggacaccaagatgccggactacgtggtgctgatctccaccctcggcggcatggccctgttcggtctcaacggcttcgtcatcggcccgctgatcgctgcgctgttcatggccagctgggacctgttcactggccgcgaggaagaaccgcaggcctga

SEQ ID NO: 14740 - DNA, 1536 bp, Pseudomonas aeruginosa
atcgtaaaggtcatttcgcgactaccgtcctgcaagggtggaaagggctgcgcccagccattgctgcacgccgtgcatgctggccgcggagatgtccagcactggctgcgggtagaccccgagcaggaccagcaggaccgccaggccgagcaccatgctcagttcgcgggcatcgaggccgaggatcggctcgtcggactggctggggccgaagtaggcgcggtggatcatgatcagcgagtagaccgaggcgaagaccaggccgaaggtggcgatcacgatgatcaccgggaccaccttgaaggcgccgatcaggatcaggaactccccgacgaagttgccggtaccgggcaggcccagcgacgccgaggcgaagaacaggctgatcgccggcaggtagggcatgcgcgaccacaggccgcccatcttgcgcatgtcacgggtatgcaggcgctcgtagagctggccgcagaggatgaacagcgccgcggcggagaggccgtgggcgatcatctgcaccaccacgccctgcagcgcgacctggctgccggagtagatgccgatcatcacgaagcccatgtgcgaaacgctggagtaggcgaccaggcgcttgatgtcggtctgcgcgaaggacagcagggcaccgtagaagatgccgatgatgccgagccacatggcgatcggcgcgaattccgccgaggcgttggggaacagcggcagggcgaagcggatcaggccgtaggcggcggtcttcaggaggatgccggcgaggtccacggagccggcggtgggcgcctgggcgtgggcgtccggcagccaggaatgcaccggcaccaccggcatcttcaccgcgaaggcgacgaagaagccgagcatcagcagccattccacgtgggggctcagctgggtcttcagcagggtggcgtagtcgaaggtgatcacgccggtggcattgaagttgacgaacaccaggccgaggatcgccaccagcatcaccaggccgctggcctgggtgaagatgaagaacttggtggcggcgtagatgcgggtcttcttgccgtcatcggaactgtgtccccacagcgcgatgaggaagtacatcggcaccagcatcatttcccagaagaagaagaacaggaacaggtcgatggcgaggaacacgccgatcacaccgcccaggatccacagcaggttcagatggaagaagccgatgcggcgctggatctcgttccaggagcagaggaccgagagcacgccgagcaggccggtgagggcgaccatcagcagcgacaggccatccatcgccaggtggatgctgatgccgagacgctcgatccacagcaccttgaattgcagggtccattccggctcgccgccgggcgcgggcgccagctggaagtcgccggtggcccagatccaaaggctcaggatcaggaccagggtcatcgaaagcagcgcgatccagcggggcagggtcttgctgctgtgttcggcgatccagcagaggaaaccgccgatgaaggggatcaggattag

SEQ ID NO: 14741 - DNA, 1416 bp, Pseudomonas aeruginosa
ccagggcagaatcatgacaggctcagtctctccgtgaattcgttaggccagcagcagcgcgccgagcaggatggcggctccacccaccagggaagcggcgtaccagcgcaggcggccgttctcggtgaggctgaggaggttgtgtccgccgcgcacgctgaacggaacgacgcccagggtacggtcgatggggtcgcgccccagcaattggcagagcagcaggtagggtttcacgaacagcttgtcgtacagccagtcgaagccccaggcgtggtaccaccaggtaccgaagaagcgacccggggcgctcttcgccagggcgctgacgaagcggcgctggccgaggaagagcagggcggccagcaggataccggcgatggcgatggcacccgaggccagttccaggctgtgcttggcttcgccacctgcgtggccgacgctttccggcaggacgccagccagcggcggggtgatcagggcgccgacgaaggtcgacaggacgatcagcacgctgagcggcaaccagtgggaaatcccgtggccggcgtgggcttcggtcttcggctcgccgtggaaggcgacgaagatcaggcggaaggtgtagatcgaggtcaggaacgcacccaccaggccggcgatcagcagttcgcgatggccgctggcgaaggcctcccagaggatctcgtccttggagtagaagcccgcggtgaggaagggcagggcggccagcgccgcaccgccgaccacgaagctggcgtaggccagcggcagcttcttccacaagccgcccatcttgaagatgttctgctcgtggtggcaggcgacgatcaccgcgcccgaggcaaggaacagcagggccttgaagaaggcgtgggtcatcaggtggaagatcgccgcgtcccaggcgccgacgccgagggcgaggaacatgtagccgatctggctcatggtcgagtaggcgaggatgcgcttgatatcggtctgtaccagggcggcgaagccggccaggaccaaggtcaccgcgccgacgatgccgaccagttcgaggatgtccggggccagggtgaacaggccgtggcaacgggcgatcaggtagacgccggcggtcaccatggtggcggcgtggatcagcgcggaaaaccggggtcgggccggccatggcgtcggccatccaggtctgcagcggcagctgggcggacttgccgaccgcgccgccgagccagggccagggtcgccagggtcagccagaggttgccttccgggaacttctgcggcgccagcaccagcagctcctggatgttcagggtgccgaactgctggaacaggatgaacaggccgaaagccatgaacacgtcgccgacgcgggtgacgatgaatgccttgagcgccgcgttaccgttgttgcgattgctgtag

SEQ ID NO: 14742 - DNA, 297 bp, Pseudomonas aeruginosa
gcaccgccttccggcggactgctgtggaagctgaagatggcccaggccgcgctcagggcggagaggccgaccgagccgacgccgaccagcgccgaaaggttttccgaccacctgccgcgggagaacgacagcagcaggaagccgaccagggggaacaggaaggtaagaggtagaaggttcatccgcgcatctcgctggcagcgtcgatatcgagggtgtggaagcggcgatacagttgcagcaggatcgccaggccgatgctcgcttcggcggccgcgaggctcagcaccaggatga

SEQ ID NO: 14743 - DNA, 1491 bp, Pseudomonas aeruginosa
tggccatggttcaagtcttcgttggcccgttgtcagcgggcgtggctaatagaaactcacggttccgtcgggcctgcggccgggccgcggcacgacgacgaaacatcgccggacggctggccgtccggctgcaaagcatcaggcgccgaccgttgccgggcgcggcgcggccgaaggctggcgggagatgcccgcctcgaattcggcacggaaatacttgagggcgctgcccagcggctcgacggctcccggcgcgtgggcgcagaaggtcttgcctgggccgaggaagttgaccagctgctcgagggtctcgaggtcgccgggctggccttcgccccgctccagggcacgcagcagcttcacgctccacggcaggccatcgcggcagggggtgcaccagccgcaggactcgcgggcgaagaactcttccatgttgcgcagcagggaaaccatgttgatgctgtcgtccaccgccatggccaggccggtgcccatccgggtgccgaccttggcgatgccgccggcgaacatctgcgcatccaggtgctccgggagcaggaagccggtaccggcgccgccgggctgccaggccttgagctggaagccgtcgcgcatgccgccggcgtagtcctcgaacagctcgcgggcgctgacgccgaacggcagttcccacaggccggggttcttcaccttgccggagaagcccatcagcttggtgcccatgtcttcgctgccggggcgggccagggtcttgtaccagtccacgccgttgccgacgatggccggcacgttgcacagcgtctccacgttgttcacgcaggtcggcttgccccagacgccgacggcggcagggaagggcggtttggaacgcgggttggcgcggcggccttccagcgagttgatcagcgcggtctcttcgccgcagatgtagcggccggcaccggtgtggacgaacagctcgaaatcgaagccgctgccgaggatgttcttgccgagcaggccggcggccttggcttcgtcgatggcgcggttgaggttgcgcgccgcgtcgacgtattcgccgcgcaggaagatgtagccgcggtaggccttcagcgcgcgcgcggaaatcagcatgccttccaccagcaggtgcggcagctgctccatgagcatgcggtccttccaggtgttcggctccatctcgtccgcgttgcacagcaggtagcggatgttcagcgactcgtccttcggcatcaggccccacttcacgccggtggggaagcccgcgccgccgcggcccttgaggccggagtccttgacggtctggacgatgtcgtcctgggccatctgggtcagcgccttgcgcgccgcggcatagccgtccttgctctggtattcctcgagccagacgggctgggcgtcttcgcgcaggcgccaggtcagcggatgggtttccgccgaacgcgccatgcggttggccggaccaatggaggtaagggtcatacgtag

SEQ ID NO: 14744 - DNA, 1227 bp, Pseudomonas aeruginosa
atcaggttgctctggctcatgtcagcggtccacgtcagccataacgaaatcgatgctacccaggtaggcgatcaggtccgcgatcatgctgccgttgatcaccgaggggatctgttgcaggtgcgcgaagctgggcgtccggatacgcgtgcggtagctcatggtgctgccgtcgctggtcaggtagtagctgttgatacccttggtcgcctcgatcatctggaaggcttcgttggccggcatgaccgggccccaggaaacctgcaggaagtgggtgatcagggtttcgatgtgttgcagcgtgcgttctttcggcggcggcgtggtcagcggatggtcggccttgtaagggccttccggcatgttcttcaggcactgttcgatgatccgcaggctctggcgcatctcgcccatcttgaccatgcagcggtcgtaggcgtcgccgttgtgggccagcggtacctcgaactcgaagttctcgtagccggagtaggggcgggccttgcgcaggtcgaagtcgcaaccggtggcgcgcaggccggcgccggtggtgccccactcgagggcttccttggtgttgtactgggcgacgccgatggtccggccgcgcaggatgctgttcttcagggccgcggtctcgtactcgtcgaggcgcttgggcatccagtcgaggaactcgcggaccagcttgtcccagccgcgcggcaggtcgtgggcgacgccgccgatgcggtaccaggccgggtgcaggcggaagccggtgatggcctcgaccaccttgtaggcgcgctggcggtcggtgaaggtgaagaacaccggggtcatggcgccgacgtcctggatataggtgcccaggtacagcaggtggttcaggatacggaagaactccgccatcatgatccggatcacgtcgacccgctgcggcaccttgatcccggcgagcttctccaccgagagtacgtagggcaggttgttcatcaccccgccgaggtagtcgatgcggtcggtgtagggaatgaaactgtgccaggactggcgctcggccatcttctcggcgccgcggtggtggtagccgatctccgggacgcagtcgatgatctcctcgccgtccagctgcaggatgatgcggaacgcgccgtgggcggacgggtggttcgggccgaggttgaggaacatgtagtcctcgttctcgcccgtggcgcttcatgccccagtcttccggcttga

SEQ ID NO: 14745 - DNA, 609 bp, Pseudomonas aeruginosa
agcgcagggcccccggtccaggtcctgcttggcggcggacagggagtagggatcgaactcggtggcgcgcgccgggtagtccttgcgcagcggatggccctgccaggtcggcggcatcagcatgcgggtcaggtgcgggtggccggtgaaggtgatgccgtacatgtcccacacttcgcgctcgtaccagttggcgttgggccagatacgggtggcggtgggcaggttgaggtcgcgctcggacaaggcgaccttgatcatcacgtcactattacgctccagcgacatcaggtggtagaacacgctgaagtcggcgctcggcaggccgcggcgatgggtgcgcagccgctcgtcgacgccgtgcaggtcgtagagcatcacgtagggcttgggtacctgacggaggaaggtcaggacttcgatcagtctttcgcgcgggacccagagcaccggcatgccggtacgggtgggctggacggtgaaggtctcggcgccaaagcgggaattcagttcgacgacgatatcctggtcgtctgccttgtaaggcgggatgtacagagcggagtctgcagtcatggtctcggtcgctttcggtcaacggtggggtga

SEQ ID NO: 14746 - DNA, 213 bp, Pseudomonas aeruginosa
acgtcgccgttgtccgggttgaccgcgccccactccgggcgatccatcttggtcgcgccgaggacatcggcggccaggcgggtgttgatcagcacttcgccctggtcggcgaagctcaccccggccttgcgacaggccgcgcggaagttgccgtcggcgatgtccagcggcagccactggccgctgccatcggcgttgaagcgggcgacgtag

SEQ ID NO: 14747 - DNA, 1737 bp, Pseudomonas aeruginosa
caggcactcgaggccttttgccatgatccggaaatgaaaaaccccggccggagccggggttttcgcgaggcgggccgggcagatcgtggctgcccggctggcccctgttccttagtggaactggttcatggtgttgtctttgccgctggccttcagagcggcttcgccagcgaagtactctttatggttgtcgccgatgtcggagcccgccatgttctggtgcttgacgcaggcgatgccctggcgcagttcctggcgctgcacgcccttcacgtaggccagcatgccttcgtcggcgaagtagcccttggccaggttgtcggtggacagcgcggcggtgtggtaggtcggcagggtgatcaggtggtggaagatgccggcgtgggccgagccatcgcgctggaaggtgcggatcttctcgtcggcgaccttggccagctcggtgtcgtcgtactcgacgctcatcagcttgttgcggtcgtaggcggaaacgtccttgccttcggcgacgaacgcatcgaacacctgctggcggaagttcagggtccagttgaaggacgggctgttgttgtagaccagcttggcgttcggaatcacttcgcggatgcgatcgaccattgccttgatctggccgacgtgcggcttctcggtttcgatccagagcaggtcggcgccgttctgcagcgaggtgatgcagtccaggacgcagcgatcttcgccggtgcccttgcggaactggaacaggttggaagccaggcgcttcggacgcagcagcttgccttcgcgcttgatcacgacgtcgccgttgcccagctcggcctcggagatttcttcgcaatccaggaaggagttgtacaggtcgcccaggtcgcccggctcgttggtcacggcgatctgcttggtcaggccggcgcccagggagtcggtacgggcgacgatcacgccatcgtccacgcccagctcgaggaaggcgtagcgtacggcattgatcttggcgaggaagtcgatgtgcggaacggtgaccttgccgtcctggtggccgcactgcttctcgtcggacacctggttctcgatctggatgcagcaggcgccggcttcgatcatcttcttggccagcagataggtcgcctcggcgttgccgaagccggcgtcgatgtcggcgatgatcggcaccacgtgggtttcgaagttgtcgatctgggccagcagctcggcttccttggccttgtcgccagcggcgcgggcagcgtccaggccggtgaacagcaggtccagctcgcgggcgtcagcctggcgcaggaaggtgtacagctcttcgatcaggccggaaaccgcggttttctcgtgcatggactggtccggcagcgggccgaagtcggagcgcagcgcggcgaccatccaaccggacaggtagaggtagcgcttgttggtggtcttcaggtgcttcttgatcgagatcagcttctgctgcccgatgaagccgtgccagcaacccagcgactgggtgtagacggaggagtccgcatcgtattcggccatgtccttgcgcatgatggccgcggtgtacttggcgatatccaggccggtcttgaagcggttctggatacgcatgcgagctgcgtactcggggttgatcgcgctccagctgctgccgttcttctctttcagcgcggcaactgccttgatctcgttctgatatgcggacatggtcaatccttcaagaaatgtattggttga

SEQ ID NO: 14748 - DNA, 1317 bp, Pseudomonas aeruginosa
gcgagaaaatgcacggcttcgtcgtcttcggcgtcccactccagttccggcggaaccgactgttcggcaatgaagaccgcttcgcggatgcggcgcagctcggcattgtccttctgccagtcggctacgcgtacgcggatcttattcatctgcaaactccaaactgccctgtttgaccaactccgccaacagcttacgcgcatcgtcatcggccagccattggccgaggttttccagatgcaacgcatcggccgagcagaccagcttcagcagttccttgagctgcccgggcaggagtacgctctggccgctggcgaacagcaccaggccgatgtcgatctcgctccaggccaggcgggcgctggggttgcgcaccagcagcgcgccatcctcgagggcgccgaacagctcctcttcggggatctcctcgccggcaaccagttcgggatagcgcggttcggtcatgaactggccgaaccaagtcagcagcaggcgctcgtcgctcatgtgctcctggatcaggccctgcaggcgctccagagcgtcgcgctggatctggtgcggatcgtcgcctaccggttgcaggccggcatcggtgtagcgctcctcgtcggagaggaactggccgaggaagtcggtgaaatgggtcagcacttcggcggcgctgggcgcgcggaagccgatcgagtaggtcatgcactcgtcttcggcaatgccgtagtgggcgaggcgcgggggcaggtagagcatgtcgccgggctccaggacccactcgtcgctctgttcgaagtcggcgaggatgcgcaggtcggcgtgctcgcgcagcgggctgtcgctgctgcacatctgtccgactttccagcgccggcgtccgtggccctgaagcaggaatacgtcgtagttgtcgaagtgcggaccgacgccgccgccgggagcggcgtagctgatcatcacgtcgtcgatccgccagctgggcaggaagcggaattgctccagcagttgggcgacttccgggacgaactggtctaccgcctgcaccagcagggtccagtcctgttccggcaggtgctggtagtcctcctcctggaacgggccacggcgcatttcccacggggttttcccgtgttcgaggacgatgcgcgattccatcgactcctccagcgacaacccggccagctcgtcggcggacagcgggctttcgaagtccgggatcgcctggcggaccagcagcggtttgcgctgccagtagtcgcggaggaattcggcagcggtcagtccgcccagaagttgcaggggagtatcagcattcatggttaa

SEQ ID NO: 14749 - DNA, 1242 bp, Pseudomonas aeruginosa
tctgcccggtgcgtgccagcttgtcgaccagggctgcggattcgaagacggcgccgagggcaatcagttgctgtcgcggatcgctcacgggcgtcctccgaaatcccaggcttccgccgtttcgatcacgccgccgccgaggcagacgtcgccgtcgtagaacaccaccgattgccccggggtcaccgcgcgctgcggttcgtcgaacaccgcgcggtagccttcggcggttttctccaggacgcagtcctggtcgctctggcggtagcgcaccttggcccgcaggcggcgcggccgctccagttcgaccgggttgacccagtagattcgcgaggccagcagggcgcgggagaacagcagcgggtggtcgttgccctggccgaccagcagcacgttgcgttgcaggtccttgccgagcacgtaccagggatcgtcgccggcttccttgagaccgccgatgccgaggccctggcgctggccgatggtgtggtacatcaggccgctgtggcgaccgatgaccttgccttcgatggtctcgatgtcgcccggctgggccggcaggtactgcttgaggaaatcggtgaagcgtcgctcgccaatgaagcagatgcccgtggagtccttcttcttcgccgtggcgaggccatgcttctcggcgatggcgcggacttccggcttctccagttcgccgacggggaacaggctgcgggcgatctgctcgccgcccaccgcgtgcaggaagtagctctggtccttgttcgggtccaggcccttgagcagctcggtgcgcccgtcgcggtcgcggcgccgcacatagtggccggtggcgatcaggtccgcgccgagcatcagcgcgtagtcgaggaacgccttgaacttgatttcgcggttgcagaggatgtccgggttcggcgtacggccggccttgtactcggcaaggaagtgctcgaacacgttatcccagtattccgcggcgaagttcgccgtgtgcagcttgatgccgatccggtcgcagacggcctgggcgtcggccaggtcctcgcgggcggtacagtattcggtgccgtcgtcctcgtcccagttcttcatgaacaggccttcgacctgatagccctgctgcaacaggagcagggcggagacggacgagtcgacgccgccggacatgccgacgatcacgcgctcgcggcgtggggtgggggcggattcagacatagcgatcaggcgtcacgggcgaattcgtaa

SEQ ID NO: 14750 - DNA, 2505 bp, Pseudomonas aeruginosa
tttttcagagtttccctaaagccgtacaataggcgcgttttgaccaagacagcttctaaagcaccagccgtgcgcaggaaaaatagcgatttgaaggattcgaccaccgcgagccatgccgccgcatggcgtcagcaactgcattcccgcctgaaggaaggggtcctgatcgcgctgggcgcgctctgcctctacttgtggatggctctgctcacctatgacccggccgatccgagctggagtcactcgagccaggttgaccaggtgcagaatgccgccggtcggctcggtgcggtatccgccgatatcctgttcatgacgctcggctacttcgcctacctctttccgctgttgctgggcatcaagacctggcaggtattccgccgccgcaacctgccgtgggaatggaacacctggctgttttcctggcgcctggtcgggctgatcttcctgatcctggccggctcggcactggcctacatccatttccacgccagcggccacatgccggccagcgcctcggccggcggcgccatcggccagagcctgggccgcgtcgcggtggatgcgctgaacgtgcagggcagcacgctggtgttcttcgccctgttcctcttcggcctgacggtgttcgccgacctctcctggttcaaggtgatggatgtcaccggcaagatcaccctggacttcttcgaactgatccagaacgccttcaatcgctggatgggcgcgcgcgccgagcgcaagcaactggtcgcgcaactgcgcgaggtcgacgagcgcgtcgccgaggtggtggcgccgagcgtgccggaccgccgcgaacagtccaaggccaaggagcgcctgctggaacgcgaagaggccctggccaagcacatgagcgagcgggagaagcgcccgccgccgaagatcgatccgccaccgccgccgaaggccccggagccgagcaagcgcgtgctgaaagagaagcaggcgccgctgttcgtcgatacggcggtggagggcaccctgccgccgctgtcgctgctcgacccggcggaagtgaagcagaagagctactcgcccgagtcgctggaggcgatgtcgcgcctgctggagatcaagctgaaggagttcggcgtcgaggtcagcgtggattcggtgcatccgggccccgtgatcacccgtttcgagatccagcccgcggcgggggtcaaggtcagccgcatttccaacctggccaaggacctggcgcgctcgctggcggtgatcagcgtgcgggtggtggaagtgattcccggcaagaccactgtcggcatcgagattcccaacgaagaccggcagatggtgcgcttctccgaagtgctgtcgtcgccggagtacgacgagcacaagtccaccgtgccgctggccctgggccacgacatcggcggtcggccgatcatcaccgacctggcgaagatgccgcacctgctggtggccggtaccaccggctccggtaagtcggtgggggtcaacgccatgctcctgtcgatcctgttcaagtccacgccgagcgaggcgcgactgatcatgatcgacccgaagatgctcgaactgtcgatctacgaagggatcccgcacctgctctgcccggtggtcaccgacatgaaggaagccgccaacgccctgcgctggagcgtggcggagatggagcggcgctaccgcctgatggcggccatgggtgtgcgcaacctggctggcttcaaccgcaaggtgaaggacgccgaggaggctggcacgccgctgaccgacccgctgttccgtcgcgaaagcccggacgacgagccgccgcagctgagcaccctgccgaccatcgtggtggtggtcgacgaattcgccgacatgatgatgatcgtcggcaagaaggtcgaggagcttatcgcccgtatcgcgcagaaggcgcgggcggccggtatccacctgatcctggcgacccagcggccgtcggtggacgtgatcaccggcctgatcaaggccaacatcccgacccggatcgccttccaggtctccagcaagatcgactcgcgcaccatcctcgaccagggtggcgccgaacaacttctcggccacggcgacatgctctacctgccgccgggcacaggcctgccgattcgcgtgcacggcgccttcgtttccgacgacgaggtgcaccgggtggtcgaggcctggaagctgcgcggcgcgcccgactacatcgaggacatcctcgctggcgtcgacgaaggcggcagcggtggcggttccttcgatggcggcgacggctccggcgaaggcagcgaggacgacccgctctacgacgaggcggtacgtttcgtcaccgagagtcgccgggcatcgatctccgccgtgcaacgcaagctgaagatcggctacaaccgcgccgcgcggatgatcgaggcgatggagatggccggcgtggtcaccccgatgaataccaacggctcccgcgaagtcatcgcgccggcgccggttcgtgattga

SEQ ID NO: 14751 - DNA, 816 bp, Pseudomonas aeruginosa
cggcacgcgcctgcaggaaaccgccggccaactgagcctgaagcggccgggactgttccgctggcataccgatgcgccgaacgagcaattgctcatttccaacggcgagaaggtctggctgtacgacccggacctggagcaggtgaccatccagaagctcgatcagcgcctgacccagacgccggcgctgctgctctccggcgacatctcgaagatcagcgaaagcttcgccatcacctacaaggaaggcggcaacgtagtcgatttcgtgctcaagccgaagaccaaggacaccctcttcgacaccttgcgtctgtcgttccgcagcggcaaggtgaacgacatgcagatgatcgatggcgtcggccagcgcaccaacatcctgttcttcgacgtgaagatgaacgaggcgctggatgccaagcaattcaccttcgacgttccgccgggcgtcgacgtgatccaggagtaagcgcaagccgtggatctgttccgcagcgagcccgtcgcgcagcccctggcggcacggctgaggcccgcaaacctggacgagtatgtggggcaggaacacctgctggcccgcggcaagcccttgcgcgaggcgctggagcagggcgcgctgcactcgatgatcttctggggcccgccgggagtcggcaagactaccctggcgcggctgctggcgcaggtgtcggacgcccatttcgagaccatttccgcggtgctgtccggggtcaaggagatccgccaggcggtcgaggtggccaagcagcacgcggcgcaatacgggcgccggaccatcctgttcgtcgatga

SEQ ID NO: 14752 - DNA, 1041 bp, Pseudomonas aeruginosa
ggtgcaccgcttcaacaagagccagcaggatgccttcctgccctatgtggaagacggcacgctgatcttcattggcgcgaccaccgagaacccgtccttcgagttgaacaatgcgctgctctcgcgggctcgcgtgtatgtcctcaagagcctcgacgaagccgccctgcgcaagctggtgggccgcgcgctgaacgaggacaagggcctcggcaagcgcaagctgaggctgccggaggagagcttccaggttctcctggccgccgccgacggcgatgggcggcgcctgctgaacctgctggagaacgctgccgacctcgccgaggacggcagcgagatcagccccgagctgctgcagaatctgctcggcgatacccgccgacgtttcgacaagggcggcgaggcgttctacgaccagatcagcgcgctgcacaagtcggtgcgcggctccaatcccgacgcggcactttattggttcgcgcgtatgctcgacggcggctgcgatcccctgtacatcgcccggcgggtggtgcgcatggccagcgaggaggttggcaacgccgatcctcgcgccctcggcctatgcctgtcggcctgggacgtgcaggagcgcctgggcagccccgaaggcgagctggcggtggcccaggccatcgtctacctggcctgtgcgccgaagagcaatgcggtgtacagcgcgttcaacgcggcgatgcgcgacgtcgccgaaagcggctcgcgggaagtgccattgcacttgcgcaacgcgccgaccaaattgatgaagagcctcggctatggcgaggaataccgctacgcccacgacgagccggatgcctatgccgccggagaggattatttccccgaggatctggagccgcggcgttactatcaaccggtgccgaggggcctggaactgaagatccgcgacaagctggaacacctggccgagctggatcgcaccagtccccgccaacgcagaaaatcctgagcggtatgggctcggcggagctagccaggcttccgcgacggcgtcgatga

SEQ ID NO: 14753 - DNA, 1407 bp, Pseudomonas aeruginosa
tcggctgacatggatttcctgccgctgttccactccttgcaagggcgcctcgcgctggtggtcggtggcggcgaagtcgccctgcgcaaggcgcgcctgctggccgacgccggcgcgcgcctgcgcgtggtcgcgccgcagatccacatcgaactgcggcatctggtggagcagggcggcggcgagctgctcgaacgcgactaccaggacggcgaccagcccggctgcgccctgatcatcgccgccaccgacgacgaaccgctgaacgccgaggtgtcgcgagcggccaatgcgcgcgggataccggtcaacgtggtggacgcgccggccctgtgcagcgtgatcttcccggccatcgtcgaccgttcgccgctggtggtggcggtctccagcggcggcgatgcgcccgtgctggcgcggctgatccgggccaagctggaaacctggattccctcgacctacgggcaactggccggactcgccagccgcttccgccaccgggtcaaggaattgctacccgacctgcagcagcgccgggtgttctgggaaaacctgttccagggcgagatcgccgagcgtgtcctggccggccgtccggcggaagccgagcgtctcctggaagagcgtctggccggaggcctcgcgcacatagccacgggcgaggtatatctggtcggggccgggccgggggatccggacctgctgacgttccgtgccctgcgcctgatgcagcaggccgacgtggtgctttacgatcgcctggtggcgccgtcgatcctcgaattatgccgccgcgatgccgaacgcctgtacgtcggcaagcgccgcgccgaacatgcggtgccgcaggatcggatcaaccgcctgctggtggagctggccagccagggcaagcgcgtgctgcgcctgaagggcggcgacccgttcatcttcggccgcggcggtgaggaaatcgacgaactggctgcccacggcatacctttccaggtcgtgccgggaatcactgcggccagcggctgcgcggcctacgccgggattccgctgactcatcgcgaccatgcgcaatcggttcgtttcgtcaccggtcatctgaaggacggcaccaccgacctgccgtggcaggacctggtagcgcctggccagaccctggtgttctacatgggcctggtgggattgccggtgatctgcgagcaactggtcgcccacggtcgctccgcacagaccccggcggcgctgatccagcaggggaccaccgcccagcagcgggtattcaccggaaccctggaaaacctgccgcaactggtggctgagcacgaagtgcatgcgccgaccctggtgatcgtcggcgaagtcgtgcaactgcgcgacaagctggcctggttcgaaggcgcccgcgaggacgcctga

SEQ ID NO: 14754 - DNA, 1059 bp, Pseudomonas aeruginosa
aaagccccgctgagcggggcttttgcattttcggggcgccgctcttccgcacttccgggtcgtttccgcagcctgcccggcgtcgattcgatgactctccgatttcgtcgggtaatggcttcagatcacgaagaagccgtgggttccgtcgcgaccgagttgctccaccaggccgaactcccagtccaggtagccctgcatcgcttcgcgcggattgtcggtaccttcgtaggggcggcggtagcggtcaatgcgcggcgacgccaacaggctttcgccgtcttccgtcggcaggcccgcggcgacccaggcgctggtgccgccgtcgagaaggaacaccggcttgccgctgagtgcctggacttccgccacggcgaagcgtgccagcaggctgctgccgcaggtgagtacgtagcgctcggccgtgcccagccgttccagtgcctgcttcaactggctgcgcaatacccaggcggcgccggggatgtggcgtttcgcatagttggcgctggcggtgaagtcgagcacccgggtgcccggttcgcccagccagtcggcgagggtggtcgggtcgatggtgtcggcccggggttgcctcggcagcggcgcgctccaggcgcccctctcgctgaagtcggcgtcggagagtccgtccagtaccgcgacctgccagcccatctgggccagccaggaggcgctcatgttggcgcgtacgccatcgtcgtccaccagtaccaggcgcgcgccgcgcacgctggcgacatggtcggtttcctgaaccagctggccaccgggcgtggagcgggagccaggcaggtgaccggcttcgtattcctcgggcgtgcgtacgtcgagcaggtaggtggtgcggtcgtgctcgtcctgccattgggccagaccggccaggtcgaggcgttcgacgccggcgcggtcggcgacggcacgggcgcgctgggcggcggccttgcgtgtgtcctgcgagatcgcaccgaagcgtcgcgtctggccgtgttccagttgctgaccggccagcgtccagccgatggtgccgttgcgtaa

SEQ ID NO: 14755 - DNA, 699 bp, Pseudomonas aeruginosa
tgccgccaccgggttggggatgccggcgttgagcagcgactgggtaccgatgatgctacgagtgcgcccggcacagttgactatcacccgggtgcgcgggtccggcgccagttcggcgacgcgcagcaccagttcggcgccgggcacgctgatgccgccggggatactcatggtctggtattcgtcgaaacgacgggcatccaggatcaccgcgtcggccctggcgtcgagcaaagcctgtacttcctccgcggccagcgatggcgtgtggcgctcggcctccaccagttcgccgaaggccttgctcggcacgttcacatcgctgaacagctcgccgccggcgttgcgccaaccggacaggccgccatcgagcaaggccacgtcgctgtagccgaggtcgaggaggcgttgcgcggcgaccggcgccaggccttcgccgtcgtcgtagacggtaatcggcgtgtcgcggcgcggcacccgggcatggatctccagttccagcctggacagcggcaggttggcggcgaacaggggatgggcctgggcgaacgggtcctcctcgcgcacgtcgagcagcgccagctcccggcgggcgaggagagcggcgcggatatcgtggaaggtgcgtacggcgatctggctcatgcggggttctctttcgacaggtcccagatattgggcaagcggctgttggaatag

SEQ ID NO: 14756 - DNA, 927 bp, Pseudomonas aeruginosa
tatgcgagaaatgcaattggtgccggccccatgaaaatcgatgacatcgacgccttcgtcgcggtgatccgcaacgcttccctgagccaggccgccgagagcctgggcctgacccagtctgcgatcacccggcgggtacagagcctggaggagtccctcggagtggcattgctggaccgcaataccaagccgctcaaacccaccgccagcggactgcgggtctacgaacagtgccggcgggtgctgcgcgaggtggatggcctgcgtgaactggtggccggtgacgccacaccaagtggcgtgctgcgcctgggcgtgccgcagagtatcggcgaggtggtgttgctggatgcccttcggcggctggccgacgagtacccggagctgcgcgcgcaggtcggcactggctggggcagccatttgctggcgcgcctggagaatgccgaactggacgcggcagtggtgttgtttccgccaagcaaggtgttccccgaagaactcggcgccacgcccctagggcgcatggaactctgcgtggtggtcgcccgcgacagtgccatccaggcgcgacgcctgctcgattgctaccaccatggctgggtgctcaaccccgatggctgcggcttccgtgccggcctgcaacgggccctggccgatcagggcctgggcctgcaactgaacctcgagactttcggcagcgagctgcaactgggcctggtcgccgcgggtcggggtctcggcctggtgccggcgccggccctggcgcgtagccgctaccgcgatcagttgcgggtgctgcaactggaggatttccagccgctgatccagctctggctggtgcgtccgcgcctgctgggcaatctggaaacgccggcacggctgttcggcagggcggtggccgaggggttggatatgcaagccggttga

SEQ ID NO: 14757 - DNA, 1170 bp, Pseudomonas aeruginosa
gaaaagcacccatgcagatgtttttcttataacgacagccgccaaccttatcagtcgagcggcccaggcgagggcaacagcgtgagcgtggaaattctcggcatgatcaccgccacaccgagttccgaggtggaccagccgttgggggaggctgtggacgccggtttcgtccggcgtttcgcccaggcccatgaggacgccggcttcgaccgggtgctggtggggtatttcagcaatgccgccgagggcgcggtggtcagttccttcgtcgccgctgccacccggcgccttggcgttctcctggcctatcgcccgggggtgatcgcagcgccgctggcggcacgccaactggccaccctagatcagttcagcgagggccgcctggccctgaacgtagtcagtggtggtaacgacgaggacctcgcgcgcgatggcgactacctcgaccatgaccgccgctacgcccgtaccgacgaatacctgcaagccctgcgtgctatctggaccgccacgggaccggtggatttcgacggcgagttctaccgcttccagggcgcctcgccagcggtgcgcccgcgccagtcgccgcacataccgatctatttcagtggctcctccgacgcagccatcgaggtcgccgccaggcacgccgacacctacatgctctggggcgagccgctggccgcggtcgacgggcatatccgccgagtgcgcgccgccgccaaggcccagggacgcgatccgcgcttctcggtgtcattccggccgatcgtcgcggataccgaggaggccgcctggaagcgtgccgccgaggtgctcgaacaggtccgcgagaaccgtgcgcgcctcggtctgccgctgcgcgaccaccagccgcagaacgtcggttcgcagcgcctgctggccgccgccgagcagggcgaggtgctcgacagccgtttgtggaccggcgtggcccggctgaccggggcgcgctggaactccaccgccctggtaggcacccccgagcaggttgccgctgcgcttggcgagtactaccggctgggcgtctcgaccttcctgattcgaggcttcgagccgctcggcgacgccgtgcgctacggccagggcctgattcccgccatacatgaccatatcgcccgcctgccgctgttgcggcacgccggttga

SEQ ID NO: 14758 - DNA, 954 bp, Pseudomonas aeruginosa
ggagctccgatgaaactcaagcaatacctgctaaccagcttcgccacgcttctgctcggtgcctccctggcccaggccgcagagctgccgacgttgcgtgtgggcgaccagaactactacaacgtgcgggcttccatggaggcctcgggagttctcgaaggcgcgccttaccaggtcgaatggaagcatttccagtccgccgcgccggtggccgaagggttgcaggccggagcgctggacctgggtttcctcggcgactcgggcttcatcttcctcgccgccaagggtgcgccggtgaagctggtcggcgtctcgcggcagaaccccgataccatagccctgctggtgccgaaggattctccggtgcgcagcattgccgatctcaagggcaggaaagtcgcctactggcccggtgcctggagccagcaactgaccttgcgcgcgctggagaaagccggcctgccgaaggactacgtggagttcgtcaagctgatgccgatcgacgccgccgccgccttgccgcgcggcagcatcgatgcctttccggtgtgggagccgtatatctcgcagcagatcgtggtttccggcgcacggccgattctcaccgcccgcgacctgatgccggggctgtccagcatcgccgccaacgctgcttccatcgagcccaggcgcgcgcagatcgccgacttcctcggccgcctgcgcaaggcacgggcctgggtcgaggcacacaaggagcagtacgccgacctctgggcgcagaaggccaatctcgaccgggcagtctcccgccattggatcggccaggccggcatgagcgtcggcccggtatacgcccaggccgccaccgactaccaggagaccgcggatttcctgctgcagaccggtgccttgcccaagccgttcgacacttccacggggatcgacacgtctttcaacgaagccttccactga

SEQ ID NO: 14759 - DNA, 1092 bp, Pseudomonas aeruginosa
gtacggaccatgagcatccagtttctcggcatgatcggccatcgcctggcctcggagaccctcgcgccggtcggacctatcctcgacaagccttacatcgccgctttcgcacgcgcccacgaagaggccggcttcgatcgaatcctggtcggctactggtcggaccagccggatggattcctggtggccgccgccgctggcctggccacttcccggatcggtctgctgctggcgcaccgccccggtttcgtcgccccgaccctggccgcgcgcaagctggcgaccctcgaacacctcctcgacgggcgcctggcggtgcatatcgtcagcggcggcagcgacgccgaccagcgcaaggacggcgattatctcgaccacgaccagcgctatgcccgcagcgacgaattcatcgaactgctcaagcgcacctggaccagcaccgaacccttcgatttccacggcgcgtactaccgcgtggagcacgccttctcggccatccgtccgcagcagaaaccgcacattccggtgtatttcggcggctcctcggaagccgcgctgaaggtcgccggcaagcaggccgatgtgttcatgctctggggcgaacccctggcacaggccgccgaaaccatctccgctgtgcgcgaacaggcgcgctcgaatggtcgcgaagtggagttcagcctgtcgttccggcccatcctcgggcgcacggaggacgaggcctgggccaaggccgaggcgatacgcgcaagcgccggcgcgcgcctgggcgaggccggcttccccaagggcaagccgcagagcgtcggcgcccagcgtctgctcaaggcggtggagcagggcgagcgcctcgacgagcgcctttggaccggaatcgccaggctggtcggtggcgggcacaactccaccgccctggtcggtaccgcggaacaggtggccgacgccctgctcgcctactacgacctgggcgtgcgcaatatcctcattcgcggtttcgatcccctcgccgatgccgtggaatatggccgcgagctgatcccgctgacccgcgccaaagtcgccgagcgcgagcgccggcgcgccacggcctga

SEQ ID NO: 14760 - DNA, 405 bp, Pseudomonas aeruginosa
cgcggtgttgcttggcgctctctacgacggtatcgccgggagcgcccgcgagtggctcgtcggctggctgcgcgagcgcgtgccggccagtctcggcgcgccgttggcgagcctgccgaggatgcaggaggcgctcggcgagatcgacggcctgctcctgcagaaccgcctgctgctcgatgccgcgtgctgcggacagttgcccgccagcgactccgggctgctcaaggtcgcggtcatcgacaacgcgttggcggtggtcgaggaggccctggaactgagcggcaaccacggcctcagccggcacaatccgctacagcggcactaccgcgacgtgctttgcggacgtgtccacacgccacaggaaagatagcgtctggagcgcggcggggagggcggcgctga

SEQ ID NO: 14761 - DNA, 2070 bp, Pseudomonas aeruginosa
gtctttgaaacgtacctcccacgattctcgaccctggccttgtcggcgaccgcaccggcggaacggatagcccaggatagccccggctccgtgcggagctgcctggagattgcccatgaaacgacccctgtgtgtgcttgccggcctgctggccgcgaccctgctggctggagccgccagcgccgccgacctcatcagcctgcgcctgggcgatgtgaagggcgaccgctacgccgccctgcgcgcgtccggcgagctcgacgacctgccgtacaagctggaaatgtcggcgttcccctccggtgcaccggtgctcgaggcgctcaacgccggggccctggacataggctttaccggcgacatcccgttcctcttcgtctacgctgccggcgcgccgctcaaggcggtgggcgcctggcacttcaacccggcgaccgtggcgctggtggtcggcaaggactcgccgatccgttcggtggccggcctcaagggcaagcgcattgccgtcaatcgcggcggctgggggcatttcctcgcccttggcgcgttgcgtcgcgccggcctcggaccgcaggacgtaagcttttccttccttggtccggtggacggccgcgccgccctggtgcgtggctcggtagacgcctgggtgccctgggagccctatacctccagcgccgtgctgctcgatcaggcgcgggtcatcgacaacggtgccgggatcatgaccggctactcctatgccctggccagcgacgctgcgatcgcccgcaagaaggccgcgatcagcgacctgctgacccgcctggcgcgtgcccaggcctgggccctgaggcacccggaggcgttcgccgaggccctggccaaggatctgaacatgccgcgcgaagtcactcggcgctgggttggcgaggcgcgcatcagtcctgtggtcttcggtccggaggttgccgccaccctgcagaccgccgccgatttcttccatgccgaaggcgtgctgccgaagtcgctggaggtcgccccggcgttcgacttcagcctgtccgccggtgccgccgaagtggcccgccagttgcccgccgacctccgcgtcggccagcgttgaggagttacggaatgcgtcagaccctgagcctgttcctgcttctctgcctgctcgtcggccaggcctgtgccgacgagcgcgtgaccctgcgcctggccgaccagaagggcaacatgcgcgcccagttggaggctgccggcgcgctggacgacctgacctacgacatccgctggttcgaattccccgccgccgcccccctcgccgaagcactcaatgccggtgcggtggatgccggcatcatcggcgacgcgccattgctcttcgccctggccgccggtgcccggctgaaggccatcgccgtcgacaaatccgatccctacggtaccgccgtgctggtgagaggggattcgccgctgcgctcggccaacgacctgaaaggtcagcgcattgccaccgggcgcggttccatcggccacttcgtcgcgctcaaggccttggcctcggtcgggctgggcgagaaggacgtcgaattccgcttcctcggcccggtggacgcgaaaatggccctcgccaatggttccgtggatgcctgggcgacctgggagccctacaccgcgttcgcggagaccgccgacaaggctcgggtactggtcgacggtcgcggcctgtgggctggcaacagcttcctcgctgctaccgatagcgcactggccgacccggcgaaacgcgccgtgctgcaggactacctgcaacgcctggccagcgcccagcgctgggcgtacctgcacctggacgagtattcgcgaagcctggcgcagatcatcggcttccccgaggacgccgcgcgcttgcagttcgaacgccggcgcttgcgttggcaggcgctggatgagcgaacgctcggccagcagcaggagaccgccgatttctaccaggcccatggattgattccgcagcgcctcgatgtgcggccgaccttcgccagcggctttgcggtcaggcaggcgtcggatgcggatatccggtag

SEQ ID NO: 14762 - DNA, 1077 bp, Pseudomonas aeruginosa
ttgataactataagttatttatcgattgttttttattcaaataatctatccgttccgtcgccggcagctggaactcccgtccctgcgggcgctcgcacctatcctaggagtcatcgcatgtctcgtccgttcctgcgtcgcttggccatcgtgtttgccgcttccgtcgtcctgtcgggcattggtggcgcacaggccgaggaggtcctgcgcatcggcttccagaaatcctcgactctgctgaccctgatccgcagccagggcaccttcgagcgcgagttggccaggcagggcatccgggtgtcctggcatgagttccccagcggcctgccgttgctcgaatcgctcaatgtcggcaacgtcgatctctccgccgacgtcgccgacaccgtgccggtgttcgcccaggcggcgggtgctcgcctgacctacttcgcccgcgaaacaccttcgcccgcggcgcaggcgatactggtcggcgaacattcgccgctgaagtccctggccgagctgaagggcaagcgcatcgccgtgaccaaggccgccggcagccactacctgctgatcgccgcgctggccagcgccgggcttgagttctccgacatccagccagcctacctgacgccagccgacggccgcgccgccttcgagaacggcaaggtcgacgcctgggtgacctgggacccctacgtggcaagcgcccagcgccagcaacgcgcgcgggtactggccgacggccagggcctggccagctaccagcgctactacctcgcctccagcgactacgccaggaaacatcctgaagtgctccagcaggtcttcgccgaactgcagcgcaccgggcgctggctcaagagccacccggccgacgcggccaaggtgctggggccgctgtggggcaatctcgatgccgctaccgtcgagcaggcgaatgcgcggcgcagctacgacgtacaaccggtgagcgcagatggtctcgacgagcaacagcgcatcgccgacgccttccacgcccagggactgctacccaaaccggtggatgcgcgcgccgtggaggtatggcagccgcggcactga

SEQ ID NO: 14763 - DNA, 1722 bp, Pseudomonas aeruginosa
ggttatgcgaaattcatattgcccgacgctgaaaaagccggcgtcggattgcactcatgggcgaattccatccaggacgattcgaccatgcccgatgtacgtctttcctctcgttcgttgacccccgtgctctgtgcggtggggctcgcctgcgcgctgcagggcgaggtgcaggccgccgacggtgggccgcgcgacgcggccacggcgccccgggtattcgacatagcgcccggcgaactggccgaggtgttgttgaacatcgtgcgccagggacacgtgccgatcgccttcgaccagcgcctggtggcggggttgcgcggaccggatatccgcggccggctcagtgtcgaggacgccttgcggcgtgccctggccggcagcgggctggcatacgcgcaggacgaaagcggtgccttcgtcctgcgccgcggacaggcgcctgtgcaggagacgcgaggtgcggcggtggcaccgaccttgtccaccgtggtggtcaccggcacgcgcaagagcgatgtgaaggcgcaggacagcctgagcccgatcgatgtggtcagcgctacccagctacgcagcagcggtgcggtcgacctgcgcgatgcgctggtcaaactgctgccctcgctgacccgccaggcccagccgttcaacgcctcggcgttgacccacacgcagtcgctgcgcgggctgagccccaaccatgtgctggtgctggtgaacggcaagcgtcgccacgaaacggccaatctcaatatcagcggcgggctggagaagggctccaccggggtcgatctggacaccatcccgatcaacgccatcgaacgtgtcgaggtgctgcgcgacggtgcttcggcacagtacggttcggacgccatcgccggggtgatcaacgtcatcctcaagtccgccgacagcggcgggtcggcggccgctgacgtcgggcagaccggcgacggcgacggcttcacccatggcggcggggggaacatcgggctggccttcggcgatagcggcttcgtcaacctcaccgccgaatatcgcgagcaggagcgcacgatgcgcagcggcatcgatgagcgcaccggtcggcgcgacaatatttccatgggcgatcccgcgttccaccggcaatcgttggcgctcaactcgggtttcgggttgggcgacgatatcgaggtgtacggcttcggcacctatacccggcgcaaggcctcctcggcggccaactatcgcctggcttcggtggcgccgacgctgtatccggacggcttcacgccgcgcccgaacagcgacgaggacgactatgcgttcctcgccggggtgcacggcgagcgtctgctggatgcctggcactgggacctgagcagtggctacggcgccgaccgtcccgatatcggcatgacccagtcggtgaacgcggcgatctaccgtgaaaccggcaacagcccgagaagcttcgacctggcgcgctaccgcaacagccaatggaccagcaacctggacctggggcgagaattcgaactggatttcctcgctgctccgccgggcgttgtcgctggggtgcggaataccggcgggaaagctaccgcatcgacgcccgcgaaccggcgtcctactacagcggcggggcggaatccctggctggcctctcgccgctcagcgaggggcaatggtcgcggcacgcctgggcgtcctacctggacctgggtacctccctga

SEQ ID NO: 14764 - DNA, 402 bp, Pseudomonas aeruginosa
acatcgacgcctaccagatcagcatccgcgaccgcatcgtcgacagcgccacctattccggccaggaagccatcgatgccctggccgcggcggggatctcgttgccggccagtgccagtacggtcagtacccattacctggccaacggtgccgacacccgcacccgcggtgtcgacatcaccggtcactacctcgtcgcgcttggcgagtacgggcaggtcgactgggaactgtcggccaacttcaaccgcaccaccttgcgcaagaaccatcgaggcgccaacggcgagccgctgctcaatgcccagcaggtcgcctggatcaccagctccaccccgcgcagccaggtttccctcggcggcacctggagccgccaggactgggaggtcagcctgcgcctga

SEQ ID NO: 14765 - DNA, 1653 bp, Pseudomonas aeruginosa
ccgccggcgccgacaacctgttcgacgtccgtccggacaagctgcccgcgcagaacaccacctatggcgacgtgctgcgctacgacacctatgcctcgcagatcggcttcaacggcgccttctactacctacgcgcggcataccgcttctagagggccaggcgtggcgcaacgagaattttccgcgaccagcggcggtgtgctgctggcgtcggtggtggcgatcatgctcgggcccaccggcatcctgctgaacaccttcagtctgttcatcgcaccgatgagcgccgagtacgcctgggaccgcgccgaggtgtcgttgctggtgacgctgttcggactggcggtcgccatcaccagcccgctcaagggctggctgatcgaccgttggggcgcgcggcggacaatgctcgggctgaccgcggccctgtcgctgccgctgctcggcctggcggcggtgaatgccgtctggcaactctacgcgctgttcctgctgatcggcctgctggcgccaggcaacctgccttacggacgtatcctcggactctggttccgccaacgcctgggcgtggcctacggcctgttaggcctgggcttcggggtgggcgggccgctgggcctgctggtcggccaccagagcctcgaagcgtggggctggcgcggcgctttcctggtctacggcgtgctcgaactgggcctggcgctgccgctgctggcctggctgttccgcgagccagcgccggatgctggcgtggccgccggcacggccgtagcggaaaccgcgctgagcggatcgacggcgccccaggcctggcgcagcgccagtttctggctggtgctgggcaacccaggtactggcggtgttcgtgatgtccgggatcatgacccatggcgtgccgatgctggtggagcgcggtttgtcccggggcgaggcgggcaccgcgctgtcggcgttgtgggtcggcatgatgctgtcgcagccgctgatgggctggcttctcgaccgcgtggcgacgcctcgggtggcgttgcccttcgccctggcggcggtgctcggcatggcctggttcctggtgggcgacacaccgagcggtctatggctggcggtgttcctggtcggcctgggtggaggaggggaaagcggcaccaccaagtacctgttgatgcgctacttcggcctgcgcagcttcggtgtgatctacggttcgatccagccgttcaccttcgccctgtcgatcagtctcggcgcttacctgctgggctggctgtacgaccgcgccgaaggctacgggacggccgaatgggtgctgctcgcggctttttccctggctgcgtgcagcctgttcgcctttcgcccctatccgcagaaattgccctgaagggaatcatgccggctagcgttcgccctggcgccgcgcggtcttgccggcgaggcgggcctggcgatagtcgttggcgcactgtcccgtccagcgacggaaggcgtggcgaaaactggaggtatccatgtagcccagcctctcggcgacttcctcgatgcgcagtcgctcgtcccgcagcagttggcgcgccctgtcgtggcggaccaggtcgagcacttcccggtagttggtgccctcgtcggcgagccgtcggcgcagcgtccgttcggtga

SEQ ID NO: 14766 - DNA, 1413 bp, Pseudomonas aeruginosa
cgccgcggcgggcggcggctagcggggatttccggccacgcgtgccgtgcccgggcctcgcttgccttcccggcgcgccggactcccggtggcctggaggacaggaaaagcgagcggcgaggtgtcggcgagcagggtcaactcgatcttctgatagggtcggtgggctgtccggggcggctaggatggacattttcatcgtctcgggcaggcctgtcgcgaccgcgcgaagtcgcgacggatgccgctgctaaggagcaacggatgaccgttcttatccagggggccgggatcgccggcctggcgctggcgcgcgaattcaccaaggcaggcatcgactggctgctggtcgagcgggccagcgagatcaggcccatcggtaccggcatcaccctggcgagcaatgcgttgacggcgttgtccagcaccctggatctcgaccggctgttccgccgtggcatgccgttggccggcatcaacgtatacgcccacgacggttcgatgctgatgtcgatgccttccagtctgggtgggagttcccgcggcggcctggcgttgcagcgccacgagctgcatgcggcgctactggaggggctggatgaatcgcgcattcgggtcggggtctccatcgtgcagatcctcgacggactcgaccacgaacgcgtgaccctgagcgacggcactgtccacgactgttcgctggtggtcggtgcggatggcattcgttcgagcgtgcgacgttatgtctggccggaggcgaccttgcgtcattccggcgaaacctgctggcgcctggtcgttccccatcggctggaggacgccgagctggcgggagaggtctgggggcacggcaagcgcctcggcttcatccagatcagcccgcgcgagatgtatgtctacgcgaccctgaaggtgcgccgggaggagcccgaggacgaggagggcttcgtcaccccgcaacggctggccgcccactacgcggacttcgacggcatcggcgcgagcatcgcccggctcataccgagcgccaccacgctggtgcacaacgacctcgaggagttggccggcgcctcctggtgccgcggacgggtagtgctgatcggtgacgccgcacacgccatgacgccgaacctggggcagggcgcggccatggccctggaggacgccttcctgctggcgcgcctgtggtgtctggcgccgcgcgccgagacgctgatcctgttccagcagcaacgcgaggcgcggatcgagttcatcaggaagcaatcctggatcgtcggccgccttggtcaatgggaatcgccctggagcgtctggctgaggaataccctcgttcgcctggtgccgaatgccagtcgcaggcgcctccaccagcgtcttttcaccggtgtcggtgagatggccgcgcagtag

SEQ ID NO: 14767 - DNA, 3045 bp, Pseudomonas aeruginosa
ggcggctgccagagcgagtgtcgacaggcgtgggttcctgggaaaagtatccatctacctgctaacatggcggcatcgttgccgatgtatccgcaggctccgggtcgcggatgcgctgctttctgtccggccggagaactttgccatcgtagactcgacatgctgacaaggtcgttgctgtccgcggtcttttgcctgttgctgatcgctctgcagccgctgcccgtcgaagccgaatccatcctgccggatgggcgtacgacgacaacgatgcgtccctggctcgataaacgagccaggcagtggctggatgcacgggagccgctgacggtaggcgtggtttcccccgactatccgccgttgtccatcttctacgcaggctcctacaagggcttcacggccgattacctggccctggtgttcgagcggccgttgcgcgtcagggactttccgtcgcggcaggcggcaatcgacgcgttgtcgcaaggggagatcgacctgcttggcgtcggtagcgaggtcgaggcccgacaacacggcttgctggcatccgctgcgtatctttccgaccggccggtactggtgtcttccagcggtgccccgttcgattcgcaggcggagtcctggctggccacggtcaagggctatcttcccgccgaacgtatcaaagctgcctatccgcacagcaggatcatctggttcgactcgccgcagcttgccctggaagcgctgagcatgggggatgtcgatggcgtgctgggggacgcagtttccacgcactacctcatccagacccattacctgctgaacttgcgcatcgagaacttcgcacccatcgacagccagggtttccgtttcctgctccggccaggtgacgaacctctgctcgcgctcatcgatcgcgccctgccgcatattagcgggcgctacggcgacgaactgttgcgcagctggagcgccgggcggcgcctgcgcttcgacgagccccgggtgacgctgtcgccggcggagcagcgttggctctccgcgcacccggtcgtgccggtggtgatcaaccattcccttggcgcgctcgggcaactggataacgaggggaggctgagtggtatcgggcgtgactatctggacctgatcggcaagcgcagtggcctgcagttttccttcactggagcacgcaacttcgtcgagacgaaaagccgactggatgcgggggaggcattggttacgccgaccatgccttcgtcggagcgcttcgattccggcctcgaagtgctgacgccctatctacgcagcaccacggtgctgatgggcgcccgccagggtggccgggatgaaagggtggggcgtgtccatggcctcgcggacctggcgggcaagcgattggcgacgacgattggctattttctcaacgacttcattcgacgcgagcacccggagatcaagctccaggtctatccgaccttcctcgccgccatgcgcagcgtagacgccggccagagcgaggccgccatcagcagcgactataccggtcgctatctgtccgcccagcatttcgacaaccggatccaggtcgtcggtatcctcgatgacctctccatcccgatcagcatcggcgtggcgaggaaccagccggagctgcagggcatcctggagaaggcgcagctggcgatcgctccggaagaagtggcggaaatcctccaccgctgggagcctcgcttcgccaagggaggggcggacttctggcgcgatcaccggagcaagattctgcagatcggcggattgttcggcgtactgatttccatctccctcatctggggtttctacctgatgcgccaggtgcgcaagacccgccaggcagaagagcaagccgacgctgccaaccgtgccaagagcgtgtttctttcgacgatgagtcacgagatccgcacgccattgaatgcggtcatcggcctgcaggaactggtgctgaaaaagggcgagaagggcgtgttggacctagattcgctgagcattgcccaggaggccgcccaggggttgctgcttctgctgggcaatattctcgatttgtcgcggatcgaatccggtcggttcgattcagctcccgaatcagtgcttcctggcgagttgatcagaggaatcctgccgttggttggtgggctgacgcggcagaagaatctttccctggcactggaactcgacggggatctcgagcactgggtgctggtggatcccctgcatttcaagcaggtgttgttcaacctgctgggcaatgccatcaagttcaccgagcgcggaggggtaacggtgcgggcagtggggcggcgcgaggcggagaggcttcatttgctgctcgaggtaagcgacaccggcctcggtatttcggaggaggaccaggccaggctgttccggccattctcgcaggtcggctcgcctgcgcttggccaggcgtccggcagcggcctggggttgtacatcagccgacgcctggtgcacctgatgggcggccagatcagcctgcgcagcgaactgggcaacggctcctgcttctcggtcgagttcgatcttccgctgaccgagcctccgcccagcgagtccagcgaagcgcgttccggagttgccgaggtcgaggagcggaaagaggcaagggcgctctcgatattgcttgcggaagaccatccgttcaatcggctgaccctgaccatgcaattggaaagccttgggcaccgggtgacctccacggaagatggcgaggaagcattcgaacgttggcagggcgaagacttcgacgtcgtgattaccgacggcatgatgccgcggatggatggctacgagctggcgcgacggatccggtcgcaagaagcccttggcggtcggcgtcgctgcttggtgatagcgcttaccgccagcgccgagaaggatgcgctggagcgttgcctggctgccggcatggaccgggtcctgttcaagccgactacgctcgatgagctcgctcgggcgctgaacgggggagagccgctcatgcctacgagcgtcgattcgcaatga

SEQ ID NO: 14768 - DNA, 624 bp, Pseudomonas aeruginosa
aagtgcccgactggttgccgttttgcgtgccgcgagcggatgtatcgggtaatctctcgcagaaatgaaccagcactagtgaagcgaacgatgggttttgaacaacttgccgagctgagagaccgtctgcgcgcacaggcggcgcaggcgaaaccggctcaaaccaaaagctccgcgggacgcgcgaagaaacgtgaagccgtcgagccgggagtcgaggctatctggaggctgcaacggcattttccgctggcgtttccgaaaagtcccgcggccaaggttccgctcaagcagggtattctccaggatgcgcagcagcacctcgaactactgggaatcaccgccgaacaactgaaacaggccatcgccacctggtgccagggcagccgctactggagttgtatggtggaagatgcgccgcgactggatctgcaaggccaggttgccggcaaggtaaccgccgagcaggcggtgtatgcgcggcggcaggcgtctcgccggcagcgcgagcagatgcgcgagaagcgcgccaagcgtgcacaggcgggtggcgaggcgccggccgccacggaggcgccgacgcctgaagcgcccgcaaccgaagcgagccccgaggcgaactga

SEQ ID NO: 14769 - DNA, 333 bp, Pseudomonas aeruginosa
tcgccggggcagggcgcgtcggatcctggcgcgctcctcggttgccggtcgctgcgggcccatttcgcggacgtctgggcccgtttctcccggcttgtgctacgcaatagcctgatctgcaaagtttttttcgtagagcgcttgccaagctcggcgaatccgtccataattgcgtccattccagcgatgggtgagctaaaaatctttttaaatcaaagggttataagttcaaagtcgcgtcaggaaagagatttcagcgatatgccaaacgcatgtcgcttcgctcaaaggctgagtagcagagtggttatgcaccggattgcaaatccgtga

SEQ ID NO: 14770 - DNA, 969 bp, Pseudomonas aeruginosa
cgccgccctggacttcacccatgcgatgagctacggcgattacctgaagctggacaaggttctggacgcccagttcccgctttcgcccgaccacaacgaaatgctgttcatcatccagcaccagacctcggagctatggatgaagctgatgctccacgaactgcgggccgcccgggagcacgtcaagtcaggcaagctcggtccggcgctgaaaatgctcgccagggtttcgcggatcttcgaccaactggtacacgcctgggcggtgctggccaccatgacgccgaccgagtacaacaccatccgcccgtacctgggccagtcttccggtttccagtcctaccagtaccgcgagatcgaattcatcctcggcaacaagaacgccaccctgctcaagccccatgctcaccgtgccgagctgctggcggccctggagcaggccctgcatacgccgtcgctatacgacgaagcgatccgcctgatggccgcccaggggttgccggtaagccaggagcggctcgcccgggacgcggcggccggcacctgttacgaggcctcggtggaggcggcgtggcgacaggtctaccaggcgccggaacgctactgggacctgtatcagctggcggagaaactgatcgacctggaggactcgttccgccagtggcgcttccgtcacgtgaccacggtggagcgcatcatcggtttcaaacccggcacgggcggaaccgagggagtggggtatctgcgcagcatgctcgataccatcctcttccccgaactgtggcggctccgttccaacctgtagtaccggatgaggtgcagcatccgcctgcgcctcagtcgttgccggcgcctcccgccgcccactcttgccgcaaaagccccatgagaacgacattccagcgttcccggccgacccgggtggcggagcggcgcaagccttcttcgcggaaccccgcgcgtcgatag

SEQ ID NO: 14771 - DNA, 1794 bp, Pseudomonas aeruginosa
tcaggcgttggtcgatgtcgtcggtcatgtcggcctcgaaagttttttttcaaaatagccctgataaaaaaggtcgtcacgggtttttgcctgagtaatgcgatggagggctggaagacgactttggataatcataggcctgtcttgcgggagagcgcccatgaacgatccgatccgtcgcggtacgctggaaatgacttcggccatgctgatctgcggcaccattggctggctggtgctgctctccgggcagcccgtgctggacgtggtgttctggcgctgcgtattcggtttcgccacgctgctggtcgcctgtgccgcgctgggcttcctgcgccgcggcagcctggggcgcgaggcgttcctgctggcgctcctcagcggggtgttcatcgtcggcaactgggtgttgctgttcgcatcctactcacgggcttcgatcgccatcggtaccgcggtctacaacgtccagccgttcatgctggtggggctaggcgcggcgtttctcggcgagaaggtcacggcgcgcaagctgggctggctggggctttcgttcgccggcatgctggcgatcgtcagcgcccacggcgacagcgacgccccgcgcggggactacctgttcggtatcctcctggcgctcgctgccgcgctgctgtatgcctttgccgcgctgatcgtgaagcgcctgcaaggcacgccgccgcatcttatcgccttgatccaggtgggcaccggcgtgctgatgctcgcaccgctggcgaaccttgccgaactgccccgggacgttgctccctgggccagcctggcgaccctgggaatcgtccataccgggctgatgtacgtactgctctacggcgccattcagaaattgccgacggcgctgaccggtgccttgtccttcatctatccggtcgcggcgatcctggtggactggctggtcttcgaacatcgcctgagcctggcccagtggcttggcgtggctgccatcctgctcgccgcggcgggcatgcagcagggttggagcgtgcgcctgccgaggccggcggtgcgtcgcggctgaggcgcgggggaaagaaaaagccccgcgacgaggcggggcttttctacggcgatctcggccgatcagttgccgaagaccttgaagcgttcgctttcggcgatgaaggctttctcgcccgccggagcggcgatggcgccgaaaggcatctgtgcgcgcagcttccagctttccggcaggttccaggtcttgtgggtctgcgcatctaccagcgggttgtagtgctgcaggctggcgccgaccttgtgctcggcgagggcggtccagaccgcgaactgggccatgccgctggcctgctccgaccacaccgggaagttgtcggcgtagagggcgaactgctcctgaagctggcgcactaccgtctggtcttcgaagaacagtacggtgccggcaccggcggcgaaggaattgagcttggtttcggtggcggcgaaagcgtcggcgggaacgatcttcttcaactcgtccttggcgatgttccagaactgctcgtgctcggcgccgaacaggacgaccacccgcgagctctgcgagttgaacgcggaagggctgtgcgagacggcctccttgaccagttcgacgattttctcctgggagacgggcagttgcttgtccagggcgtagatggtgcggcggttcttgatggaggagaggaatgcgtcagacatcgtgaggctccttgtttggaaattggattcgatattagcgacggcctcgatgagatcaatgggaaataa

SEQ ID NO: 14772 - DNA, 753 bp, Pseudomonas aeruginosa
ctatccttagcgatatctcggcacggaaaggagcccagggatgaacattcggcagagaatcctcgcttcgggcgccatcggcatcgtggctgtggtgctgctaggcggggtcggcttctgggggcaattgcggttgggcaaggcgctgtcggagaacgagctgagcgtcaatgcgctgcgcaaccacatggaaggcgacatgatgcacgacgccttgcgcgccgacgtcctggcggcgttcgtggtccagcccggcgacggcgcggcggccgagcaggtccgccaggacctgcaggagcacagccagtggtttcgcaaggtggtcgagcagaaccaggggctgcctctcaacgacgccatccaccaggcgctggtcgagttgcggcccgacctggaagcctacatcggcgccgccgagagcatcgtcggcaaggcgttgctcgatcccgtggcggcacgggccgagctgccgcagttcgtccaggccttcaaggagctggaagggcgcaacgaagcgctcagcagcctgatcgagaaacacgtcgagcagaccaaccgggcgcgcgaagacagcatgcgctattccgcctggatgctcgcgggcggcatcctggtcgcctgcctggtcctcgggcagctttgtcgccagttgctgcgcgccgtcctcaagcctctgcgcaagctggtcgcctcggcccgggtgatcgcccagggcaacctgcaggagccgatcggtgtcgacagcgacgatga

SEQ ID NO: 14773 - DNA, 474 bp, Pseudomonas aeruginosa
gcggtacttcctcgttgctgtgctttgctgacagggaaggatcgcgaatcagggtttttcgcctctttcgtttatgaacaggaattcatatatcggagatcaatcatggcttggaaaggtgaggttctggctaataacgaagcagggcaggtaacgtcgattatctacaatccgggcgatgtcattaccatcgtcgccgccggttgggccagttacggacctacccagaaatgggggccgcagggcgatcgggagcatccggaccaagggctgatctgccacgatgcgttttgtggtgcgctggtcatgaagattggcaacagcggaaccattccggtcaataccgggttgttccgttgggttgcacccaataatgtccagggtgcaatcactcttatctacaatgacgtgcccggaacctatggcaataactccggctcgttcagtgtcaatattggaaaggatcagtcctga

SEQ ID NO: 14774 - DNA, 1002 bp, Pseudomonas aeruginosa
ccctttactcgatctatctggtctgggccttgctcgccagtccctgagcgacgcgccgaggctggcgagcatgctggtacggcccactccacgtgcctgcgttggctaacgccgcagccagtcctccagttgctccggcagcatcggctgggcgatcagatagccctggccctcgtggcagccccaggcttgcagcaggtggaaggtgtcgtgggtctcgatgccttccgcgaccacccgataacccaactggctggccaggccgatcaccgcctgggtgacgctctgcgccttcggcgagccggcgaggtcgcgggtgaacgattggtcgagcttgatggcggtgattggcagatcgcgcaggtaggtccagttgctgtagccggtgccgaagtcgtccaccgcgatgcccatgccaagctcccgggcacgcagcagcaccgagccgaccgccgaggcgtcgcggatgagtacgctttcggtgaattccagctcgagggcggaaaggtcgatgttgtaggttttggcgagtctgacggcctcttccaggaagctgctgtcttccatgtccgatgccgatacgttgatcgccagcctgagcgggatgttccgtgcgttccattgcgccagctgggccatggcatggcgcagcacccagtcgctgagggggcgcatcagtgcggttttctccgccaggggcacgaattcggcggggctgacgaagccgagttgcgggtgccgccagcgcagcagcgcttccacgcccgtgcacctgcctgtcggcaggtcgattttcggctgatacaccagatggaagccttcttcggttccgatcgcctgggacagcgaggtcagcaatgtgaaggcacgctgctgggcctggtccagcggcgggttgtagcgggcccagccgacaccgcggtcgcgggcgtcgtcggccgcgctgaccaccaggcgcagccagtcctgatcgccgtcgaggggatcgtcggcaagcggtag

SEQ ID NO: 14775 - DNA, 501 bp, Pseudomonas aeruginosa
ccggcgagtatctgcagcacgccgcagagcagggtcgccgccagcaggtattgcaggccgtggtccttcaccaggttgaccatcagcagcgccatggcgccagtcgcggcggagatcattcccggacggccgccggcgaaggcgatcaccaccgccatgctgaaggaggcgtacaggccgatcttcgggtcgaccccggcgatgatggagaaggcgatggcctcggggatcagcgccagggcgacgaccaggccggcgagcaggtcgccgcggaggttggagaaccagttctgtttcagcgtctgtagcatcgggatacccaggggcgaggcacggcccgtgcagtcggtcgacagcgcgggccgcgggatggcattggaaaaaacaagggatgacgacaggcgttcaggcgaacgaacgctggccacggtcgttcggaccgtggccggaaggggcaggcatggctatggcggagtgggcagccaggtcatcggggagtag

SEQ ID NO: 14776 - DNA, 552 bp, Pseudomonas aeruginosa
ggaaatgctatgagaagcaaggcgtccggcttggcgctggtggtagtggcggggcttgtggcgggttgcgccagcagtggctatcagcccgaggtcgactggccggccggctggcaggtgatcaccgagagcatcccacccgaggccagcgacgtggagcaactgggctcccggcaactggcgaccaagctcgggccgggaggcgagaaggaagccagcatcgagttgctcagcctgaagatgatggaagaggagtcggtggagatcgacggccagttccagagtgtcttcgatgtcgtccaatcgggctaccgcaaggccgggctgggctcgcgctgcaccacaccgatccgctcgaacctcggcggcctggcatcgctggagacccactgccggatcagccagggcaacgaggtgctgctgacccagatcgtggcgatggccctgggacagcgcgcgatgtactccctggtatataccgccagtccggccaacagcgtggtctaccggcagagctacctgcgcacccgggccagcctggtcctgcgctga

SEQ ID NO: 14777 - DNA, 1248 bp, Pseudomonas aeruginosa
ccgttaccggcaagatccagaagttccgcatgcgcgagatcagcatcgaagagattcgcctgctcgcgctgcgccaggggcgcgattgagaggatggagccgcgccccgctcctgcgctaaggtggcgggcggcgcgcagcgaggcgagaggggcgggtgaagaacgacggcgagactcaggcgagtaccaagggcaccatctcggtgcgcctggtcggcgaagcgctggtggagtggcgccggcagggcggcgagcagggggaggtcctccaggccgccggtatcgatccgcagctgctcggcaaaccctacgcgcgggtcacctcgcacgcctattcgcggctctggctggatctcgctcggcgcatggacgacgagttcttcggcatggactcgcggcgcctgaagagtggcagcttcgctttcatgagccgctgcgcgatccacgagcagaccctggagccggcgctgaccggcatcctgcgattcctctgcctgcagttcgacgacttccagccgcgcctgcagcgccgcggcggcctggcggaaatcgtcctcgacgaggcgccgggccggtacgggcgagcgctgtcctacttcaccctatggatgatcacccatggcctggcctgctggctggtcggccggcgcatcccgatcctggccatcgacctgcgctgtccgcagccggactacatcgaggactaccgggtgatgttcagcgacaacctgcgtttctcccgtcccctcagccgcctgctgttcaatgccgactgcctggccttgccggtccgccgcgacaagcgggagctgcggcgcttcctgctcggcgcgccggccaacatcctggtccgctatcgcgatccgcagagcctggcggcgcggatcaaggcctacctgcgcagcctgcggccgggacgctggccggacgcggacgcgctcgccgggcatttcttcatggcgccctcgaccctgcgccgcaagctgtccctggaagggcagagctaccaggcgctgaaggaccaggtccgccgcgacctggccatcgcgcggctggacgccggcgcggcgaatttcgccgaactggcgctggagctgggcttcgccgatggcagcgcgttccacaaggcgttcaagaagtggaccggctcgacccccgggcagtaccggacgcaggtcgcggcggaaaccgcgtcggccgagtcgtcaggcgtcttgtccgaaacgctcggccatcgatagggtga

SEQ ID NO: 14778 - DNA, 1089 bp, Pseudomonas aeruginosa
  unsure (116): Identity of nucleotide at the above locations are unknown.
tgttcacctccggcaccaccggcctggccaaaccggtgccggtgccgctttaggagatccccgccttcgtcggtgacatgcgcgaggcggtggacctgcgcccaaaggacgcaatnttggaacctcgccaatccgggttggccctacgggctcctaactacgctgtcgccggtcccttcgccatgggccatcggaccaccttctacgaagggccgttcagcgtggaaagcacctgccggatcatccgtggactacggcatcaccaaccttgccggatcgcccaccgcctatcgcctgctgatggccgccggcgcggccgcggaaactgcgctgaaggggcgcatgcgcgcggtcagcagcgccggcgagccgttgaccccggaggtgatccgctggttcgccgacaggctcggcaccaccatccacgatcattacgggcagaccgagctgggcatggtgctgtgcaaccaccatgccctggcgcatccggtgcgggtcggcgccgccggattcgcctgtcccgggcaccgggtagtagtgctggacgacgatctcaacgaactgccgcccggccagccaggcatcctcgccctcgaccggcggcgttcgccgctgatgtggtttcccggctaccagggcctggaaaccgcagccttcgtcggcgactactacctgagcggcgataccgtcgaactcaacgaagacggcagcatcagcttcgtcggccgcgccgacgacgtcattaccacctctggctaccgggtcggcccgttcgatgtggagagcgcgctgatcgaacacccggcagtgatggaggcggcggtgatcggcaagcccgacccggagcgcaccgaactggtcaaggccttcgtcgtgctctgcgccggccaccggccgacgccggaactggcggacgcattgcagcgatacgtgcgccagcgcctgtcggcgcacgcctacccgcgggagatcgagttcctcgaggaactgccgaagactcccagcggcaagatccagcgctttctcctgcgcaaccaggagatcgcccggcaacgcgaggcggccccacgggcggccgccgcgaactga

SEQ ID NO: 14779 - DNA, 1995 bp, Pseudomonas aeruginosa
ttcagcaggagaaaacgacgtgcgtatcgaaaatcgagtgttcctggttaccggcggcagctccggcctcggcgccgccaccgcgaagatgctggtggagcagggtggcaaggtggtgctggccgacatcaacgccgaggccggcgcggccaatgccgccgagcttggcgcccaggcgcgcttcgtcagggccgacatcgccagcgaggccgacggccgccaggccgtggccgctgcactggaggccttcggcggcctccatggcctggccaattgcgcgggcgtggcgccggccgagaaggtcctcggacgcaatggcatccatgccctggagagtttccgccgggtcatcgacatcaacctggtgggcagtttcaacatgctgcgcctggccgccgaggccatgtcccagggccagccggacgagggcggcgagcgcggggtgatcgtcaataccgcctcggtggcggcgttcgacgggcagatcggccaggccgcctattccgcctcgaagagcggggtggtcggcatgaccctgcccatcgcccgcgagctggcgcgcttcggcatccgggtgatgaccatcgccccgggcatcttcgagacaccgatgatggccggcatgccccaggaggtgcgcgactccctcggcgccagcgtgccgttcccgccgcgcctggggcgtccggacgaatacgccgcgctggtccggcagatcatcgagaacagcatgctcaacggcgaagtgattcgcctcgacggcgccatccgcatggccgcccgctaatacaggaggaagatcccatgacccgcgaagatccgatcgtcatcgtcagcgccgtccgcaccccgatgggcggcttcctcggcgacttcaaggacgtcaacgccgctaccctcggtgccgcggcggtgcgcgccgcggtggagcgggcgcgcctgcaagccgacgaagtggacgaggccgtgctcggctgcgtgctcgccgccggccagggccaggcgccggcgcgccaggcggtgcttggcgccggactggcgcgcggcacgccgtgctcgacgctgaacaagatgtgcggctcgggcatgaaggcgctgatgctcgcccatgacacgttgctcgccggcagcgccggggtcgcgctggccgggggcatggaaagcatgtccaacgcgccctacctgctggagcgcgcccgtagcggctaccgcatgggccacggcaaggtgctcgaccacatgttcctcgacggcctcgaagacgcctacgacaagggccgcctgatgggcaccttcgccgaggactgtgccgaggcctacggcttcacccgcgaagcacaggacgagttcgccgtggcctcgctgacccgcgcgcagcaagccatgcgcgacgggcgcttccaggccgagatcgtgccgctgacggtcaccgtcggcaagaccgagcgcctggtggatagcgacgagcagccgccgaaggcccggctggacaagatcccgaccctgaagccggcgttccgcgaaggcggcacggtgaccgcggccaactccagttcgatttccgacggcgccgccgcgctggtcctgatgcgcctttccgaggccgagcgacgcgggctcgcgccgttggcggcgattcgtgggcatgcttcgttcgccgacgcgccgaacctgttccccaccgcgccggtcggtgcggtgaagcgcctgatgcagcgtaccggctggtcgctgggcgaggtcgacctgttcgaggtcaacgaagccttcgccgtggtcggcatggcggcaatgcgcgacctcgacctgtcccacgagcgcctcaacgtccacggcggcgcctgtgcgctgggccatccgatcggcgcgtccggcgcgcggatcgtcgtgaccctgctcaacgccctgcagcagtacgacctggaacgcggcgtggcggcggtctgcatcggcggcggcgaggcgaccgcgatcgccgtcgagcgcttgcgctga

SEQ ID NO: 14780 - DNA, 1230 bp, Pseudomonas aeruginosa
gcgggaaaccttcggcaagccgatcatcgagcaccaggcggtggccttccgcctggccgacatggccacccgcatcgccgtggcgcggcagatggtccaccacgccgccagcctgcgcgaagccggcctgccgtgcctgaccgaagcctcgatggccaagctgttcgcctcggagatggccgaggaagtttgctccgcggcgatccagaccctcggtggctatggctacctcaaggacttcccggtggaacgcatctatcgggacgtgcgggtctgccagatctacgagggcaccagcgacgtgcagcgcctggtgatcgcgcgcagcctgtagcggcgactatccgtcgtttccgcaacggcgccttctcccttcagggagagggcgcactgaggcacctcggaagcaaatgcccgagcctcgttcgccctacgccccttggcaggcgctcacgccggctgcgccgccttgttctcgcgcgcggtgacctgctggcacagctcgatgatctgctcgcgcatccagcggttggccgggtcctgatcggtgctctcgtgccagtacaggtgggtttccagcttcggcacgtcgctcaccggcagcaccgcgtagtgcaggtcgtggtgacgggcgaagcgttccggcacggtcatcgccatgtcggtctgctggaccaccgtggaggccatcaggtagtgctgcgagcgcagcgcgatcttgcgctggatgcccatcttgcccagcgccaggtcgatgtagccgaggccgctgcggcggctggaaatatggatgtgggtcaggcccaggtaatcgtccagggccagcttcggcttgcccgccagtgggtggccgcggcgcatggcgcagacgtagcggtcctccatcagcttgacgtggcgcacctggggatcggtgttcagcggcgcgtcgacggcgaagtcgaggcggccggcggcgagttccttggtggtctcgcggcgcttggcgaggaagctctcgatatgcacgttcggcgccaggcggcgcaagcgctggaacagcggggggaggatgaccgcttcggtgaggtcggtcatgctgatgcggtaggtcttgttcgcctgctgcggatcgaagctgcggctctcctgcaccgaaacccgcagcaactgcagcgcgttgcgcaccgggccgatgatgttctgcgccataggggtcggcaccatgccttgggcggtgcgcacgaatag

SEQ ID NO: 14781 - DNA, 1152 bp, Pseudomonas aeruginosa
tcgaccgggcgatccagatgcacggtggcgccggggtttccaacgacttcccgctggcttactggtacgccatgcagcgcaccctgcgcctggccgacggcccggacgaggtgcaccgcgcggcgatcggcaagttcgagctgggcaagtacgtgcccagggagatgctgcgcagcagccgctgacggctgtggtataggggaaaggcccgcgggtgcgggcctttttcattccggggactccgcccctttttcctcggcgttgcgttccagctgccacgcgcgacggctgtgcagcagggcggcgaactcgcgggccgcccgctcgttgcggaagcagatcccacgcgtgccgaggcggacccgccagaaaggttcagcgtgggtgtccagacgttcgatccagagcgtgttcggcattcggttcggccttgtcctcgacggtggctttcggcgtgcgggtcttcagcagggagagcaggatgccgcccgccagcaggccgaaggttacgccaagcgagaggccggcgggaatcttgccgatcacaccgtggagcatgatcttcgcaccgatgaacaccagcaccagggccagggcgtatttcaggtagacgaagcggtggatcatcgccgccagcgagaagtacagggcgcgcaggccgaggatggcgaagatgttcgaggtgtagacgatgaacgggtcctgggtgatggcgaagatcgccggcacgctgtccaccgcgaacaccaggtcggccagctcgatcagcaccagggcgaagaacagcggggtggcgtagcgcaccagcttgccgctggcgtccggcaggcggacgaagaagtgatgctcgtgcagttccttggtcacccgcatgtgcttgcgcaggaaacgcagcaccgggttgtgctcgaggtcgggttcttcctcgtgcttgttgaacagcatcttcacgccgctgaacagcaggaaggcgccgaacacgtacatgatccagtcgaactccttcaccagcgcggcgcccaggccgatcatgatcgcccgcaggacgatggcgccgaggatgccccagaacagcacctggtgctggtagcggcgggggatgccgaagaaactgaagatcatcgccatgacgaacacgttgtccatcgatag

SEQ ID NO: 14782 - DNA, 1011 bp, Pseudomonas aeruginosa
gtcagacgggtgacgctaaggttacagcgttggggaatcatggccctgcgccattgtctcggtcaggaagtcgagaaacacccgggtcttgccggccagttggcgcgatggatagaccgcgtggatcgccgtctcgtcggccttccagtcagccagcaattcaaccaggcggccttcggccagttccgcctgtacgtacagccgtgggatcaggctcaagccgaagccggcgagcagggcatcgcgcaccgccaggctggaggacacccggtaacggccggcgataggcaccgctatgcactcgcggtccttgcggaaggtccagcggtcggcatggccagagaggctgaagcggatgcactcgtgttcgcgcagggcctccggccgcagcggctggccatgctgactgaggtaggccggcgccgcgcagagcacgtgctccaggaccagcagcgggcgggcgaccaggccggagtccgcaacccggtcgctaccacgcagggccaggtcgatgccttcggcgatcaggtcctggcggccgtcctgcaggagcagttccaggcgcaggtccggataacgctggagaaaagccggaatggccggggtcaggcaggtgagggcgagggtcagcggggcgctgacccgcagcaggccgctggggccctgctgcatcgaagtgagcgcggcgtcggcggcctcgaggtcgtcgaggatgcgctccaggcgctgccggtagacttcgccggcctcggtcaggctcatgctgcgggtggtgcgattgatcaggcgcaccttgaggtgcgcttccagctcggcgacgttcttgctcacggcggccggcgagagattcatctgccgggccgcggcggcgaagccgccattcgcggccacggcgcggaagaccttgagggcggtgaggtgatccacggggataattcactgtcagtaatcaatgaatcagggattaaaccattatcaacccgaggtgtgctggctaaagtcttgccatag

SEQ ID NO: 14783 - DNA, 1149 bp, Pseudomonas aeruginosa
gcctcaggccagttccagccagatcggggcgtgatcggagggcttctccatgccgcgcaggtcgtagtcgatgccggcgtccttgaagcgcgactgcagcacccggctggccaggatcacatcgatgcgcaggccgcgcttggggttgtcctcgaagccacggctgcggtagtcgaaccagctgaagcggtcgttcacctccggattcagggcccggaagctgtcgaccaggccccagttcttcaacgtagccagccattcgcgctcttccggcaggaagctgcacttgccggtcttcagccagcgcttgcggttttcctcgccaatgccgatgtcgcagtcctccggcgagatattgatgtcgcccatcaccaccagggcttgctcgggcttgaagctgttctccagcagcgactggagatcggcgtagaagcgctgcttggccgggaacttggtcggatgctcgcggttctcgccttgcgggaagtaaccgttcatcacggtgatcgggttgccctgggcgtcgctgaaggtgccccagatgaagcgccgctgggattcctcgccgtcgctcgggaagccgcgatgcagttccaggggcgcctggcgggagagcagggcgacgccgtagtggcctttctgcccgtggtagtggacgtggtagccgagcgcctcgatctcggcctggggaaactggtcgtcggcgaccttggtttcctgcagcccgatcacgtcgggctggtgccgctcgatcagcgccgccaactggtgcggccgggcgcgcagaccgttgatattgaaagagacgattttcatggtgggcgtcctggcaaaacaggaatgctagcccagccgggggatgcctggcgaccctggaggcgctgtgctagtgtccgccgggtacccgatggctgtgtggcttggcgccttgccggccctgtggtctgccgcggacggggatggccaggccatccgctcgaccaatcgccgtggcgaagcgtgcgtgtcgccgctccttcggccgacaaggaatgcgttccatgcctgatcaggtcaccgatgtccgtctgctcgacgacggctatagccgcgaagtccgctcgcttttctaccacgcctaccgccacgaaccgaccttcgcctacctga

SEQ ID NO: 14784 - DNA, 1818 bp, Pseudomonas aeruginosa
aacccgaatgtcaggaggtggtcggcggcgtccgcgcaaatctggacgcgcgccacccgcctgcgtagcatccgcgccatgagactgactcaaggattgttccggttcccactggccgggctgctgtgcctgagtacggccgccttcgcggagagccagcttagcgtgcgcgtcacccccgccaatgccgccctgaaggccaatatcgaggcctacgtgggtagcctcggcgagcgggacgaggcggcgttgcaacgtttccgtcgcaatgccgaggcgcaggcggaaaaggcggcccaggcgctcggctacttccaggcgcagatcgacagcgaggtgaaggacggcaagccgccgaagctcacgctcaaggtagtgcccggcgagcccgtgcgcctgcgccaggtgaacatccaggtgctcggcgaggccgccagcctggagagcttccgcttgccgtcgggcaagcaactgaaagcgggcgcgaagctgaaccagggtgtctacgaggacgccaagcggctgatccagaaccaggcctcgcgctacggcttcttccagggccgcttcagcacccagcgcctgagcatcgatccgcgcgccggcatcgccgacatcgacctggtctacgacagcggccagcgctacaccttcggcaaggtgagcttcgacggcgactcgatcatcgaggaagaactgttgcgccgcatggtgccgttcaaggccggccaaccctatgactccgaactgatcgccgaactcaaccagaacctgcaatccagcggctacttcgagggagtgcgggtcgacgccgcgccgacccaggctcaggccgacggcgcgcgccaggcgatcccggtagcggtccggctggaggcgcgcaagccccggaccatgggcgtcggcctcggtttctcgaccgacgtcggggcgcgcgcgaggttcaactggacccgccattgggtgaatgccgaaggacatagcctgggattcgagtcggaaatctccgcaccacggcagaacgtcggcgcctggtacgagattcccctcgatccgccgctcaccgacaagctgcgcttcaccagcggctaccagttcgaagacctagtcgacaccgagagcaagctgctgacccttggcggcgaatggcacagcaagcagcccgatggctggcagcgggtggtttcgctgaactggatgcgcgaggagtacaagctgggcgacgactccgggctgagcagcttcctgatgccggggatcggctactcgctgctggagaccgacaacaaggtcgaccccagccatggctaccgcctgcagttcaacgtcaagggggcgaaggaaggcctgctggccgacgccgacgtcctccatgtcgacgccatggccaagggcctgaccagcttcgccggcggccatcgcctgctcggccgcctgcaggtaggcggaatcgccaccaacgactacaagtcgatcccgccctcgctgcgcttcttcgctggcggcgaccagagcgtgcgtggctacgactaccggacgctgtcgccggagaattccgatggcgacaagatcggcggccgctacatgatcgccggcagcgtcgagtatcaatatccgctggccgagcgctggcgcctggcgaccttcgtcgaccagggcaacgccttcaactcgctggacttcccgtcgatcaagaccggggtcggcttcggcgtgcgctgggtctcgccggtcggcccgttgcgcctcgacctggcccatgcgctcgacgacgacggcggtttccgcctgcacttctccatggggccagaactgtga

SEQ ID NO: 14785 - DNA, 1767 bp, Pseudomonas aeruginosa
cggcagcgccctgatcgaaagcaagggcctcgccggcatcgcccgcttcgtcaagggcgacgccttcgatcgcgccgacctggcggcgctgcaaccgaagccgagcctcggggtggtttccgggctctacgagctgttcgccgacaaccgcatggtcggcgactccctcgccggcctcggcgaggcgctggaggagggcggctacctggtttacaccggacagccctggcacccgcagctggaactgatcgcccgcgcgctgaccagccaccgccagggccaggcctgggtgatgcggcgccggacccaggcggaaatggaccagctggtggccgccgccggcttccgcaagatcacccagcgggtcgaccagtggggcatcttcagcgtatcgctggcgcagaaggtcgcccgctgatggcgccgcgcgagccgggggtactgaagcgggcggtgctctggctgctgttcctcggcccgttcttcttcgccagctatggcctggccaactggttgaccagccagcgcggcgacgtcggcagcctggtcttcgactgggaacgcgggatgccgctgtggccctggaccatcctgccgtactggtcgatcgacctgctctacggcctgtcgctgttgttgccgcgggacaagcgcgagctggacacccactgcctgcgcctgctcagcgcccaggtgctgtcggtgacctgcttcctgctgttccccctgcgcttcaccttcgaacggccggaactgggcggcgtgttcggctggctgttcgacgtgctgatggggttcgacaaaccgtacaaccaggcaccgtcgctgcacatcgccctgctggtagtgctctgggtctgctacgcgcgctacgccagcggcgcctggcgctggctgctgcatggctggttcgcgctgatcgggctgtcggtgctgaccacctggcagcaccatttcatcgacgtgcccaccggcgcgctggccggttggctgtgcgtctggctgtggccgcaggcgcagcccgcgccgttcgcccgcgccagtctgagccgcgaccggcaacggcggcggctggccgctcgctacggcctcggcgcgctggcctgcgccgccgtcgcctttgccgtcggcggtgcggcgttgtggctgtgctggccggcgctggcgctggcgctggtggcgctgaactacctgctgttcggcgccgccggcttccagaagggcagcactggccgcctgagcgtcgccgcgcgctggctgctggcgccatatctgcttgccgcgcggatcaacgcctggctctggacccgtcgccggccgcagccggacgaggtgctgccgggcctctggttggggcgcctgccgtcgtccgcggaactggccgacagccgcttccgcgcattgctcgacgctaccgccgaactttcctgcgagccgcaggggctggcctatcgcagcctgccgttgctcgacctggtcgcgccggacgtcgaggactgccggcgcgccgcggtgctgatcgacgaactgctggcgcaagggccgctgctggtggcctgtgccctgggctattcgcgcagcgccacgctggtcgccgcctggctgctgctcagcggccgcgcggcggacgtcgagtcggccgtggcggtgttacgtcgggcgcgaccgcaagtgctgctgggcgaggcccagcggcggaccctcgcggcgctgagcgggagcgtgccggagccatcggcggaactgggcgaggtgcgccatgcctga

SEQ ID NO: 14786 - DNA, 1035 bp, Pseudomonas aeruginosa
ccggctgtccgccgcactgaccctgctggccatcgggctgggcctgtaccaggccgtgcaaggcatcggctggcgctatttcgctgcggcgatgctggcgatcgccctgctcggcctgtggcagaagtactgggcgctgcgagtggccctggacgccgaactgttcgaacgtttcagccacgtcggcgacaggctggaagcgcagacccaagacctggaccgggccctggccgatctcggcctggcccgaccggacgccgcagggcgcacctggaaccagcgcagccacggcgccctgcgcctgctacgctggcaggcgctggcctgtggcgcccagttcctgctggccttgtcgtgcctgttgtcgatccctctattcaacgctcaaacctgaagagtcttcccatgctcgaatcagtcgtcgcctatggcatcatcgccggcgcccgcgccatcaccggcttgcgcagcctctggctgggcaccacgccgatccccaagcaacgcatctattacgccaaccacagcagccatggcgacttcgtcctgctctgggcctcgctgccgccggaggtgcggcggcgtacccggccggtggcgggcgccgactactggaacaaggccggcctgcgcagctacgtgatcaacaaggtgttcaacggcgtgctggtcgaccgccagcgcagcgaggtcaatgccaatccgctcgaacccctcgaccgcgccctggacggcggcgattcgctgatcatcttccccgagggcacccgcaacctggacgatgaggtcaagctgttgccattcaagagcggtatctaccacctgtccctggcccacccggacgtcgagctggtgccggtctggctggccaacctcaaccgggtcatgcccaagggccgcatgctgccgttgccgctgctctgcaccctgagcttcggcaagccgctggtcgccacggcggaagaaggcaaggaggcgttcctcgaacgagcgcgcatggccctgctggacctggcgccggaagaggaggcctga

SEQ ID NO: 14787 - DNA, 1155 bp, Pseudomonas aeruginosa
ttcgccctacaaccaggctccggcatacggggacgtgaccgcagcttcactgtctcagagattgaccaggcgcatgccttcctcgctatagcgactgccggcgaccgcctcggcggggaagatcgcatccagctcggccagttccgccgcgctcaggcgcaattccgtcgcggcgacgttctcctccaggtagcgccgctgtttggtgccgggaatcgggatcaggtcatcgccctgcgccagcacccaggccagcgccagttgcgagggtttcacgcccttggctgcggccagttcgccgaccttgtccaccagcttcaggttcttcgcgaagttctcgccctggaagcgcgggctgaaacgacggtagtcgtcggcggcgaagtcttccggacgcttcagggtgccggtaaggaaacctcggcccagcgggctgtaggggacgaaggcgatgcccaggcgacggcaggcggcgagcaccccggtgtcctccggatcgcgggtccacagcgagtactcgctctgcaacgcgctgatcgggtgcacccggtgggcacgctcgagggtttccgccgaggcttcgctgagaccgatgtggcggatcttgccggccttcaccaggtcggcgagggcgccgacgctgtcctcgatgggtacctgcgggtccatgcggtgctgatagtacaggtccaggcggtcggtaccgaggcgcttcaggctgccttcgatggcgcggcggatgtacgccgggctgccgtcgacgccgcgcgcccggggattggcagggtcgcggacgatgccgaacttgctggccaggaacacctgctcgcgtttgccgcgcagggcctcgccgagcagttcctcgttactgtgcgggccgtacatgtcggcggtatcgaagaagttcagcccgagttccacggcgcgatgcagggtggcgatggcctcctggcggtcgccgccggtggtgtagaagtcggtcatgcccatgcagccgaggccaatggcggagacggaagggccgttgtggccgagttgacgggttttcatgtgtcgagcctcgcgggagggaaggaaaacgtcgtcattcttcgctctgcattggtctggataaagcccataattacggttttaccattcgtattttccaaataa

SEQ ID NO: 14788 - DNA, 774 bp, Pseudomonas aeruginosa
tcgagggtgtccgatggatcgtttccaggccatgcaggccttcacccgcatcgtcgagctgggcgccttcggcaaggccgcggacagcctggagctgccgcgcgccagcgtgacccaggcgatccagcaactggaggcgcaccttggcgtgcagttgctgcagcgcaccacccgccaggtaagcctgaccctcgacgggcaggcctactacgagcgttgcgtgcgcctgctggcggacctggaggaggcggaaagctgctttccacgcgtcctgaacaacccgcgcgggcgcttgcgggtcgacctgccgggcgcactggggcggatgcgggtgattccgttcctgccggagttctgcgagcgctacccggaactggagctgcagttgagcagcaacgatcgcctggtcgacctgctgcgcgagggcgcggactgcgtgctgcgggtcggcgaactgcacgattccagcctggtcggccggcacctggccgacctgccgcaggtcacctgcgccagcgccgcctacctggagcgtcatggccatccgcggcagctcgccgagctcggcgggcacctcgcggtgaactaccagtcgccttccagcgggcgtaccttcgacttcgagttcagcgtcgacgggcgtctgcgcacgttgccgatgcgcagccgggtcagcgtcaacaacgccgatgcctacgtcgccgcctgccgggccgggctcgggctgatccaggcgccgcactatcacgtcgccgccggcctggccgacggtag

SEQ ID NO: 14789 - DNA, 1359 bp, Pseudomonas aeruginosa
ggatcgctgatggaaagcttgcagaagtgggtggtcgacctgaacggcgtggtctgggggccgttgatgctggtgctgattctcggcaccggcctgtacctgatgctggggttgaagttcatgcccctggtgcgcctgggagtcggctttcgcctgctctggcaggggcgtagcaaggatgacgagagcagcggcgagatcagcccgttccaggcgctgatgacctgcctggcggccaccgtcggtaccggcaacatcgccggggtggccacggcgatcttcctcggcggcccgggcgcgctgttctggatgtggtgcaccgcgctggtgggaatggccaccaagttctccgaagtggtgctggcggtgcactaccgcgagaaggatgagcgcaacgaacacgtcggcggtccgatgtatgccatcaagaacggtctgggcaagcgctgggcctggctcggcgcggccttcgcgctgttcggcgggctcgccggcttcggtatcggcaacatggtccaggtcaacagcatggccgatgccctggaggtttccttcggcgtgcccgactgggtcaccggggtcgccaccatgctcgtcaccgggctggtgatccttggtggcatccgccgtatcggcaaggtcgccgaagccctggtgcccttcatgtgcgtcggctacatcgtcgcctcggtgatcgtcctggtggtccatgccgaggcgattcccggcgcgttccaactgatcttcacccacgccttcacgccgatcgccgccaccggcggcttcgccggcgcagcggtgatggcggcaatccgtttcggtgtcgcacgcgggatcttctccaacgaggccggcctcggcaccgccggcatcgcccaggccgccggcacgacccatagcgcggtgcgttcgggcctgatcggtatgctcggcaccttcatcgataccctgatcatctgcagcctgaccggcctggcgatcatcacctcgggcgtctggaccagcggcgccagcggcgcggcgctgtcctcggcggcgttcgaggcggcgatgccgggcgtcggccactacatcctgtcgctggccctggtggtgttcgcctataccaccatcctcggctggagctactacggcgagcgctgctgggagtacctggcgggcacccgggcgatcctgccgttccggatcgtctggaccctggcgattccgttcggcgccatgacccagctggacttcgcctggctggtggcggataccctcaacgcgctgatggcgattcccaacctgatcgccttgctgctgctgagtccggtggtgttccgcctgacccgggagtatttcgccaaggccaggagttga

SEQ ID NO: 14790 - DNA, 3003 bp, Pseudomonas aeruginosa
aggccggcgagcaggtggtggtggaaggcaccgaccgcctgcgcgacggtatggaagtgcgtgtcgccgaggcctccccgcaggtcctcgagggcgagccgcagaaaccgcagactggccgccccagcggcctccagggcgactcggtgggtagcgggagcgctgaatgaacccgtcccgcccgttcatcctgcggccggtcgcgaccaccctgctgatggtggcgatcctgctctcgggcctgatcgcctaccgcttcctgccgatctcggcgttgccggaagtggactacccgaccatccaggtggtcaccctgtaccccggcgccagcccggagatcatgacctcgtcgatcaccgcgccgctggagaaccagctcgggcagattccggggctcaacgagatgtcttccagcagttccggcggcgcctcggtgatcaccctgcaattcagcctgcagagcaacctcgatgtcgccgagcaggaagtccaggcggcgatcaacgccgcgcagagcctgctgcccaacgacctgccgaaccagccggtgttcagcaaggtgaatccggcggacgcaccgatcctgaccctggcggtgatgtccgacggcatgccgctgccgcagatccaggacctggtggatacccgcctggcacagaagatctcgcagatctccggggtcggcctggtcagcatcagcggcggccagcgcccggcggtgcgggtgcgcgccaacccgacggcgctggcggcggcggggctgagcctggaggacctgcgcagcacggtgaccagcaacaacctcaacggccccaagggcagcttcgacggcccgacccgtgcctcgaccctggacgccaacgaccagttgcgctcggccgacgcctaccgcgacctgatcatcgcctacaagaacggctcgccgctgcgcatccgcgacgtcgccagcgtcgaggacgacgccgagaacgtgcgcctggccgcctgggccaacaacctgccggcggtggtgctgaacatccagcgccagccgggggccaacgtgatcgaggtggtcgatcggatcaaggcgctgctgccgcagctgcaatcgaccctgccgggcaatctcgacgtgcaggtgctgaccgaccgcaccaccaccatccgcgcctcggtcaaggacgtgcagttcgagctggcgctggcggtggcgctggtggtgatggtcaccttcctgttcctgcgcaacgtctacgccaccctgattcccagcttcgccgtgccgctgtcgctgatcggtaccttcggcgtgatgtacctgtccggcttctcgatcaacaacctgaccctgatggcgctgaccatcgccaccggcttcgtggtcgacgacgcgatcgtcatggtggagaacatcgcccgctacctggagcagggcgactcgccgctggaagcggcgctcaagggctcgaagcagatcggcttcaccatcatctcgctgaccttctcgctgatcgccgtgctgatcccgctgctgttcatgggcgacgtcgccgggcggctgttccgcgagttcgccatcaccctggcggtggcgatcctgatttccggcttcgtctccctgacccttacgccgatgctcagcgccaagctgctgcgccacatcgacgaggaccagcagggccgcttcgcgcgcgccgcggggcgggtcatcgatggcctgatcgcacaatacgccaaggccctgcgggtggtcctgcggcaccagccgctgaccctgctggtggccatcgccaccctggcgctgaccgcgctgctctacctggccatgcccaagggcttcttcccggtgcaggacaccggggtgatccagggcgtcgccgaagcgccgcagtcgatctccttccaggccatgtccgagcgccagcgcgcccttgccgaggtggtgctgaaggacccggcggtggccagcctgtcctcctacatcggcgtcgacggcagcaacccgaccctcaacaccggccgcctgctgatcaacctcaagccgcacagcgagcgcgacgtcaccgccagcgaagtgatccagcgcctgcagcccgaactcgaccacctgcccgggatcaagctgtacatgcagccggtgcaggacctgaccatcgaggaccgggtcgcccgcacccagtaccagttcaccttgcaggacgccgacccggacgtgctcgccgagtgggtgccgaagctggtggcgcggctgcaggagttgccgcagctcgccgacgtcgccagcgactggcaggacaagggcttgcaggcctacctgaacatcgaccgcgacaccgcctcgcgcctcggcgtgaagctctccgacatcgacagcgtgctctacaacgccttcggccagcggctgatctcgaccatcttcacccaggccacccagtaccgcgtggtgctggaggtggcgccgcagttccagctcggcccgcaggccctggagcagctctacgtgccgtccagcgacggcacccaggtgcgcctgtcgagcctggcgaaggtggaggagcggcataccctgctggcgatcaaccatatcgcccagttcccctcggcgaccctgtcgttcaacctggccaagggttactccctgggcgaggcggtcgaggcgatccgtggcgtcgaggccagcctggagctgccgctgagcatgcagggcagcttccgcggcgcggcgctggccttcgaggcctcgctgtcgaacacgctgctgctgatcctcgcctcggtggtgaccatgtacatcgtcctgggcatcctctacgagagcttcatccatccggtgaccatcctctcgaccctgccctcggccggggtcggcgcgctgctggcgctgatgctggcggggcaggagatcggcatcgtggcgatcatcggcatcatcctgctgatcggcatcgtcaagaagaacgcgatcatgatgatcgacttcgccctcgacgccgagcgcaacgaaggcaagccgccccatga

SEQ ID NO: 14791 - DNA, 3402 bp, Pseudomonas aeruginosa
ggcgatctaccaggcctgcctgctgcgcttccggccgatcctgatgaccaccatggccgcgctgctcggcgcgctgccgctgatgctcgccggcggcgccggcgccgagctgcgccagccgctgggcatcaccatggtcggtggcctgctgctgagccaggtcctgaccctgttcaccaccccggtgatctatctctacttcgaccgcctggcccgtcgctgggcggcctggcgcaagcagcgcgggctggacctgaacaccgaggccgggttcgacggggacgccgggcgatgagtctgtccacgcccttcatccgccgcccggtcgccaccacgctgctgaccctggcgttgctgctggccggcaccctgtcgttcggcctgctgccggtggcgccgctgcccaacgtcgattttccggccatcgtggtcagcgccagcctgccgggcgccagcccggaaaccatggcctcgtcggtggccacgccgctggagcgctcgctgggacggatcgccgggatcagcgagatgacctccagcagttcgctgggctcgaccaccgtggtgctcgtgttcgacctggagaaggacatcgacggcgccgcccgcgaggtgcaggcggcgatcaacggcgcgatgagcctgctgcccagcggtatgccgaacaatcccagctaccgcaaggccaacccctcggacatgccgatcatggtcctcaccctgacctcggagacccagagtcgcggcgagatgtacgacctcgcctcgaccgtgctggcgcccaagctgtcgcaggtgcagggggtagggcaggtgagcatcggcggcagctcgctgccggcggtgcgggtcgacctcaacccggatgccatgagccagtacgggctgtccctggacagcgtgcgcacggccatcgccgcggccaacagcaacggccccaagggcgccgtcgagaaggacgacaagcactggcaggtggacgccaacgaccagttgcgcaaggcccgcgagtacgagccgctggtgatccactacaacgccgacaacggcgccgcggtgcgcctcggcgacgtggccaaggtcagcgactcggtggaggacgtgcgcaacgccggcttttccgacgatctgccggcggtgctgctgatcgtcacccgccagcccggcgccaacatcatcgaggccaccgacgccatccacgcgcaactgccggtgttgcaggaactgctcgggccgcaggtcaagctgaacgtgatggacgatcgcagcccgtcgatccgtgcgtcgctggaagaggccgagctgaccctgctgatctcggtggcgctggtgatcctggtggtcttcctgttcctgcgcaacggccgcgccacgctgatccccagcctggcggtgccggtctcgctgatcggcaccttcgcggtcatgtacctgtgcgacttcagcctgaacaacctgtcgctgatggcgctgatcatcgccaccggcttcgtggtggacgacgccatcgtggtggtggagaacatcgcccgacgcatcgaggagggcgatccgccgatccaggcggcgatcaccggtgcccgccaggtcggtttcaccgtgctgtcgatgacgctctcgctggtcgcggtgttcatcccgctgctgctcatgggcggcctcaccgggcggttgttccgcgagttcgcggtgactctctcggcggcgatcctggtgtccctggtggtatccttgaccctcacgccgatgctctgcgcgcgtatactgcgtccgctgaaacggcccgaaggcgcttcccaggcgcggcgcagcgatcgcttcttcgccgccttcatgctgcgctaccgcgccagcctgggctgggcgctggagcactcgcggctgatggtggtgatcatgctggcttgcatcgccatgaacctctggttgttcgtggtggtgcccaagggcttcctcccgcagcaggactccgggcgcctgcgcggttacgcggtggccgaccagagcatctcgttccagtccctgagcgcgaagatgggcgagtaccgcaagatcctctcttccgatccggcggtggaaaacgtggtcggcttcatcggcggcggccgctggcagtcgagcaacaccggttcgttcttcgtcaccctcaagccgatcggcgaacgcgacccggtggagaaggtcctcacccggctgcgcgagcggatcgccaaggtgcccggcgcggcgctctatctcaacgccggccaggacgtgcgcctgggcggccgcgacagcaacgcgcagtacgaattcaccctgcgcagcgacgacctgaccctgctccgcgaatgggcgccgaaggtcgaggcggcgatgcgcaagctgccgcagctggtggacgtcaacagcgactcccaggacaagggcgtgcagacccgcctggtgatcgaccgcgaccgcgcggcgaccctggggatcaacgtgggaatggtcgacgcggtgctcaacgactccttcggccagcgccaggtgtcgaccatcttcaacccgctgaaccagtatcgggtggtgatggaggtcgaccagcagtaccagcagagcccggagatcctccgccaggtccaggtgatcggcaacgacggccagcgcgtgccgctgtccgcgttcagccactacgaaccgagccgggcaccgctggaggtcaaccaccagggccagttcgccgccaccacgctgtccttcaacctggcgccgggcgcgcagatcggcccgacccgcgaggccatcatgcaggccctggagccgctgcacatcccggtggacgtgcagaccagcttcgagggcaacgccggcgcggtgcaggacacgcagaaccagatgccctggctgatcctcctggcgctgctggcggtgtacatcgtcctcggcatcctctacgagagctacgtgcacccgctgaccatcctctcgaccctgccttcggccggggtcggcgcgctgctcgcgctgatcctctgccgcagtgagctgagcctgatcgcgctgatcggcatcatcctgctgatcggcatcgtcaagaagaacgcgatcatgatgatcgacttcgccctggaggccgagcgcaaccacggcctgagcccgcgcgaggcgatcctcgaggcctgcatgatgcgcttccggccgatcatgatgaccaccctggccgccttgctcggcgccttgccgctgatcttcggcatcggcggcgacgccgcgctgcgccggccgctgggcatcaccatcgtcggcgggctgatcggcagccagttgctgaccctgtacaccaccccggtggtctacctctatctcgaccgcctgcgccactgggtcaaccagaaacgcggcgtacgcacggacggtgcgctggagacacccctatga

SEQ ID NO: 14792 - DNA, 462 bp, Pseudomonas aeruginosa
tcgcggcaatgggcggcggctgggacagcgccgatatcgagcggaccgacgagcggctcggccgggtcgaggagggcctgccgccttcgccctgagttcttctcgctgcctgttcctgacgaatgcctttccccgctattgcgcttgcatgacacaccgccgtccgcgtctcggctagagtgcggtggcggatgtggaggtgaatacgtgtcggggaagtttccggaaatgccctcgcgccgaggctactggctcggctggttgtgccgcctggccatgcttggcggcgtcgctgcgatgttctgggcgctgctgcaatgcttcgtcctgctgcacggtgaaccgccgctccagcgcgccccgctgcggacgccctggaccctgctggcgctcggcctggcgctgttcctcgccggtttctgcggcgagtaccggctgtggcggcgccgcgccggttgctga

SEQ ID NO: 14793 - DNA, 603 bp, Pseudomonas aeruginosa
aagcgctcgaacaggtgcggcaggtactccggcgggatgcccggaccgtcgttgctgaccctcacctcggtgtgccccgcgcgttccccgatccgcacgtcgatgcgcccgccttgcggggtgtggcgcacggcgttggacaccaggttggaaatggcgcgctggatcatcaggttgtcgccgtgggcgaagccgttgccggacaggcgcagttcgacgcccttgtcctcggcgaccatctcgtacaggtcgatgaccttggccgcctgctcgtgcagggcgacgcagccgaactgggcctggatcgccgggttgtccacctgcaccaggaacagcatgtcggtgacgatccgcgacagccgctccagttcctcggcattggactccagggcttcgcggtatgccgcgccgtcgcgatgctggctgagcagcacctggttgcgcaccagcaggttgcagatcggcgcgcgcagttcgtgggccaggtcgtcggagaactgcgagagctggcgtacgccatcctcgaggcggccgagcatgtggttgaagctgcgggccaggctgtccagctcgcgcggcaggttctgctcggggatgcggtag

SEQ ID NO: 14794 - DNA, 1452 bp, Pseudomonas aeruginosa
ttcttccgtcaccttgccgataagccccgctacctaacatctgccgcatcccggaagtgcaacttcgaatatcgccggcgagatatcgccgatgaacggttgcgtggttccgggccggtaatggatcgccgtcgccgacgacgatcagcagacgaggagcggaacatgccgatacttcggccactggccagcgcggggaaacgcgcctgctggctactgatgggactctgcctgggcctgccggccctggcgaacgaagcgccggtgagtttcaacggcacttcgatcagcctcgagcaggcgttggagcgggccctgcggagcaaccccgagctggcggcggtggggcgcgagaccgagatcgccagcggcgcgcggcagcaggccgggctgatccccaacccggatctgtcctggagcgtcgaggacacccgccagggcaatcgccagaccagcgtcagcatcgcccagccgctggagctgggcggcaagcgcggtgcgcgggtggaggtggcgaaacgcggcagcgagatcgcctggacccaactggaagtccgtcgcgccgaactgcgcgcccaggtccgcggcgcctactacgcggcgctgaccgcgcaggagcgggtgcgcctggcgaagacctccctggacctggccaggcgcgcgctgcaggccgccgaccgacgggtcaaggccggcagcatctcctcggtggaacgggttcgcgcccaggtcctggcggacaacgcccagctcgacctgagccaggcggagctggagcagcagcgcacctatgtgcagctgtcgagcacctgggacgagccgcagccaggcttcgccagggtcggcggcgcgctcgacgcggtgccggcgagcatcacccgtggcgccttgctgcgccatctcgacgagtcgccgaccctgcgcctggcggcccaggaggtcgcgcgcggcgaggcccaggtcgacctggagaagcgccagcgcatccccaacctgacggtcagcatcggcagcaagtacgaccagaccgcccgcgacggacgtggcgaacgggtcaacctgatcggcctgtcgatgccgctgccgctgttcgaccgcaaccagggcaacatctacgccgcccagagccgcgccgaccaggcccgcgacctgcagcgcgcgaccctgctgcgcctgcgcagcgaagcggtacaggcctacgaccagttgcgcacctcggaacaggagctggcgctggtccgtcgcgacctgctgcccggcgcacagagcgcgctggactcgatgacccgcggcttcgagatgggcaagttcaacttcctcgacgtgctcgatgcccagcgcaccctggtcggcgtccgtgcccagtacgtgcgcgcgctggacgccgcggcacaggcgcgggtgagcatggagcgcctgctcggcgaagacatcggccacctcggccagtga

SEQ ID NO: 14795 - DNA, 1131 bp, Pseudomonas aeruginosa
gatttccggggcgggccgccggcgcgccccccgaacggttcgggagaacagaatgggcaagaagacgattatcgcggtgaccgcactggcactgctcggcctgggcggcggcgcctacctggagctgggcgggaaggcgccggccggcgccggcgaagcggccgccgagggcgagggcagcggaccgcgcggcggcatgttgttgcgccagggcgacctgaccctggaactgctggtgccggaggacggcagcccgctcaaggcctgggtcgagcgcggcggcaaggcgctggcgccgcaggaggtggtcctcggcgccgacgtcgagcgtgccaccggcgaggtcgaggacctgctgttcaaggccagcggcgatggcctggtggccaatgccgggatcgccgagccgcatgccttcaccgcgcgcctcaagctgatggccggcaagcagggctacgacttcgccttcacccgcgaggagggcaagctggagctggatgccgagcagatcgaggccgccggcatcaccctcgatacggcgcggacgatcagcctggcccaggtggtctcgctgcccggcgagatccgcttcaacgaggaccgcaccgcgcatatcgtcccgcgcctgccggggatcgtcgacagcgtgccggccaatcttggccaggcggtgaagcagggcgagctgctggcggtgatcagcagcccgcagttgtccgaccagcgcagcgaattcgccgccgcccagcgccgcctgagcctggcgcagagcacctacaagcgcgagcagcagctgtggaaggagggcatttccgccgagcaggaattcctgctcgcccgccagggtttgcaggaagccgagatcgcgctgaacaacgcgcgggcgaagatcgccgcgctcggcggcaatcccagcctgcagggcggcaaccgctacgagctgcgcgcgccgttcgccggggtgctggtggaaaagcacctgacccagggcgagccggtggacggcaccgccaacgtcttcaccctgtccgacctgtcctcggtctgggccaccttcaacgtgcccgcgcaactgctcggccaggtccgcgtcggcagcaaggtcaaggtgctcgcccaggcgctggatag

SEQ ID NO: 14796 - DNA, 1392 bp, Pseudomonas aeruginosa
acaataacaacggaggccccggccatgtccctgggtagcgattacttgcgttctctgctcgaggaagaccccgagcgcggcgtctaccgctgcaagcgggagatgttcaccgatccacgcctgttcgaactggagatgaagcacatcttcgagggcaactgggtctatctcgcccacgaaagccaggttgccggagtcaacgactacctgaccacccagatcggccgccagtcgatcgtcatcgcgcgcaaccgcgacggccagctcaacgccttcatcaacgcctgcagccaccgtggcgcgatgctctgccggcacaagagcggcaatcgcagcagctatacctgtccgttccacggctggaccttcaacaactccggcaagctgctcaaggtcaaggacccggccgaggccggctacccgcagggcttcaactgcgagggctcgcacgacctgacccgggtggcgcgcttcgagtcctaccgtggcttcctgttcggcagcctcaaccccgatgtcaggccgctggccgagcacctgggcgagtcggcgaagatcatcgacatgatcgtcgaccagtcgccggaaggcctcgaggtgctgcgcggctcttccagctatgtctacgaaggcaactggaagctcaccgccgagaacggcgccgacggctaccacgtcagctcggtgcactggaactacgcggcgacccagagccagcgccagcagcgcgacgccgcggacccgctgcggaccatgagcgccgcgggctgggcccggcagggcggcggcttctactcgttcgagcatggccacatgctgctctggagtcgctgggccaaccccgaggaccggccggccttcgagcgccgcgccgagcttgcccgcgacttcggcgaggcccgcgccgactggatgatcgagaactcgcgcaacctctgcctgtaccccaacgtgtacctgatggaccagttcagctcgcagatccgcatcgcccggccgctgtcggtggaccgcacggaaatcaccatctactgcatcgcgccgaaaggcgagagcgccgaggcgcgcgcccggcgcatccgccagtacgaggacttcttcaacgtcagcggcatggccaccccggacgacctggaggagttccgttcctgccagcagggctaccagggcagcgtggtcggctggaacgacctgtcgcgcggcgccgaacactggatagagggcgccgacgcggcggccgcggccatcgacctgcggccgcgcctgagcggcgtgcgcaccgaggacgaagggctgttcgtattgcagcatcgctactggcaggaggcgctgctcgccgccctggagcgcgaacggacgcagcgcgtggcgctgcgggaggtggcgtcatga

SEQ ID NO: 14797 - DNA, 945 bp, Pseudomonas aeruginosa
ccgagcacatcgccgcgcagcacctgcacgagggcgacgtcgacatctacctgtgcgggccgccgccgatggtcgaggcggtcgagcgctacctgcgcgagcagggcgtgcgcccggcgaatttctactacgaaaagttcgccgccagcgcggcctgaacccgagcgagccaaggagattcccatgaacgacagattccgcgacaaggtcgccctggtcagcggcgccgcccagggtatcggcctgggcgtggtccggcgcctgctggaggaaggcgcgcgggtggtggcggtggaccgctccgagctggtccacgaactggccggtgacgcctgcctgtgcctgaccgccgacctggagcgctatgccgaatgccagcgggtactggagcggaccctggagcgtttcggccggctggacatcctggtcaacaacgtcggcggcaccctttgggcgaagccctaccaacactacgccgaggacgagattgaggccgagctgcggcgttcgctgctgcccaccttgtggtgttgccgagcggcgctgccggcgatgctggggcagggcagcggggcgatcgtcaacgtctcgtcggttgccacccgcggggtcaaccgggtgccctatggcgccgccaagggcggggtgaacgcgctgaccgcctgcctggcgttcgagaccgccgaccagggcatccgcgtcaacgcggtggcgccgggcggcaccgacgcgccgccgcgaaggattccgcgcaacgccgcggcgcagagcgaggaggagcggcgctggtatcgacagatcgtcgagcagaccctcgacagcagcctgatgaagcgctacggcagcatcgacgagcaggtcgcggcgatccttttcctcgcctccgacgaggcgtcctacatcaccggcgtgaccctgccggtagctggcggcgacctcggctga

SEQ ID NO: 14798 - DNA, 441 bp, Pseudomonas aeruginosa
ccgaggacatcctcctcgagtcgccacgctaccaggatttccacttgcacgtgccgcgtgcgccgggtctcggcctggcgctcgacgaggagcgcctggcgcgcttccgccggcgctgaagccgtcccgcagacagaggagaaacgaccgatgctgttccacgtgaagatgaccgtgaagttgcccgtcgacatggacccgcaacaggccgagcggctcaaggccgaggagaaggaaatggcccagcgcctccagcgcgagggcagctggcggcacctctggcggatcgccgggcactacgccaactacagcctgttcgacctgcccagcgtcgaggcgctgcacgacaccctgacccggctgccgctgtttccctacatggacatcgagatcgacgggctttgccggcatccctcgtcgatccatgccgacgaccgctga

SEQ ID NO: 14799 - DNA, 414 bp, Pseudomonas aeruginosa
tggcctcggccgtcgccgaggagaacgccgagcggagcaaggaaggtttcatcgagggcagcgaggtcaacctgctgctgcgcaacttctacttcaaccgcgacttccgcaagggccaatcgagcccggcgggcggcggctacaccgaggagtgggtgcagggcttcatggccaacttttcctcgggcttcacccagggcacgctgggcgtcggcatcgacgccttcgcccagctcggcgtgcgcctggacagcggcggcgggcgttccggcgccggcggtagcgtcgacctgctgccctatgacgaccaggggaggccgcaggacaactattcgcgagccggcggcgcggtcaagctgcgctggtatggcaccgtgctgcgggtcggcgacgtgttcccggaaaccccggtaa

SEQ ID NO: 14800 - DNA, 819 bp, Pseudomonas aeruginosa
tccgcgcggcgtcggcgtcgccgtattgcagggcgaggagcaccgtattcgggtcggagatcgcgccgagccgcaacaggcgttcggccaggaccgcatcgaggtgcgcggcgccaatctgcaggctgtcctggtgcaccgcgacgccctggtcgagcagccatctggcggcctccaggcgcccgcgggcgaggcaggcctccagcacaccgccgcgtccgcgcaaggtttcggcgaagtcgcagccggcatcgcgcaggcgttgcagcaggtcgatgtcgccgtcttgcgcagcttcggccagggccagttgacgcagccttggctcggcggccaggctgccgtcggcgagggccggccgccagtcgaggatgcgctggcgcagcaggacttccaggcggcccttcagcgccttgccgggctccccagcggcctccagggcgtccagcgcttccagtagctcgtcggccacgccgcaggcgttctcggcgtcgaacgggtcctgttcgaaggacagcaggcggaacagcccgccgacgtcgtcggccaggcgcgtcaccgaatcctggtgcaggcgtccggcccaggccggcggcaggccgtggctccaggcgattaccgcgccatgctcggggccgggttcgacgcagacgtagagccgctccaggtactcgaagccaccgaacggcaggtaggccagcttgccgttccagtcgcggccttcttctgccgcggcttccgccgccagctcgcgctcgtgttcgatccagccccagaggtcgtggtagccgtcgctgtccggatagaacagttcgctga

SEQ ID NO: 14801 - DNA, 1389 bp, Pseudomonas aeruginosa
aagagaacgggtggcggtggccgtcgtagtcgacttccaggtcatagccgaggcgcccgccgaaacaggtgcgccagaggcgtagcaggtcttctggaatcggtccggccaggccttcggcaagacgctggacgtgttcggcggacaccggcggttgggcgtcgtacaccacgcagccgtcgaacacggccaggcgatgggccagcaggagttggcgttcggcgggggagagttccattctctgtggtcctgtcgattcggggcggccactctagcacggcgagggtgcgcgttccgcaacgccttggctatcatgcgcggctttccatccgccctggccggagtccgtcgaaccatgcacaccttgcagcaactgcgcagcggcgaactggccggcgccacgcgcctggacctgtcctgcggcctgcgcgagttcccccgggaaatcttcgagctggccgactccctggaggtgctcaacctcagcggcaacgccctggacagcctgccggacgacctcgggcggctgcatcgtctcaaggtgctgttctgttccgccaacgacttcgacgaattgccggcggcggtgggggactgtccggcgctgagcatggtcggcttcaagtccaaccgcatcgagcgggtgccggccgcggccctgccgccagcgctgcgctggctgatcctcaccgacaaccggattgccacgctgcccgaggaactgggtcgccggccgttgcagaagctgatgctggccggcaaccgcctggaggccttgcccgagagcatggccgcttgcgaaggcctggaactgctgcggatcgccgccaaccgtttccagcgcctgccggcctggctggcgacgctgccgcgcctggcctggctggcctacgccggcaacccgttgtgccgtctgccggcgctggccgacagcggcatcgctgcgctggactggagcgagctgagcctggacggtttgatcggcgaaggagcctccggggtcatccatcgcgccggctggcaccagccggacggctcgacgcgcacggtggcgctgaagctgttcaagggcgaagtgaccagcgatggcacccccgccagcgagatggccgcctgcctggcggcggggcgccatgcgcaattgatcgaggtgctcggccagctcgccgggcatccgcaagggcgcgacgggctggtgctggagctgctcgacgacgcctatcgcaacctggcggggccgccgagcctggagtcctgtacccgcgacgtctatccgccgggactgcgcttcgagctggccacggcgctgcgcctggcggcctcgctcgccgcgttgatggcccatctgcatggacgcggcatcagccatggcgacttctatgcgcataa

SEQ ID NO: 14802 - DNA, 1428 bp, Pseudomonas aeruginosa
tctgcatgctggccatcatcagctaccgcatctatatcgccacccattactgaagcgccacccgcgcctgcaatggcgggcgcggaggtccgccgctcagtcgcgcgtctcgcccatggcccgggcatagccggacggggcgaagcgcagggtcaccagcaacatcgccaccacgctcgccgcgagcagcagccaggaggcctggaagctgccggtgacgtcgcgcagccagccggtcaggtagggcacgatgccggtgatgatgaagccgatgccttgcacgaaggccgccaggcttcccgccgcacgcggctcgtggaggtggtcgagggtcagggtcaggctgagggcgaagcaggcgcccaggccgtagccgatcaacgccacccacagcgccgcgtgctgcagcggcatcagcagcaggccgcagaagccgccgagctggaccagcagcgcggccagcagccagggccggcggtcgaggcggcggcgaatcagcagcggcacgctgagcgcggcgagcacctggaagatggtcatgatcccgaccagcccgccgctgtcctgggcgctccagccgagctggcggtagtacaccggcaaccaggccaccatgctggtgtagccgccgttgatcagcccgaaatacaccgccagcagccagccacggcgattgccgaagaagtgccggaccggcccctcgccagcgctcggcagcacctcccttggccgcgcgaacatccacagcagcagcgccagcagggccggtacggcccaggcgccgaggccggcctgccagttggagaagtgttcggcgatccgcgggctgagcaccgccgcggttccgccgccggccatcagcgaggccgagtagaggcccatcgccgccgggacccgcctcgggaaccagcgcttgaccacgcccggtaccagcgcctggatgatcgccacgccgctgccggccagcgcggcgctggcgatcagcgccagcccgctatccagttccaggcgccagaggcaggctgcggcgatggccagcagtccgcagacgatgccgcggtgctcggccagccagcgcccgagccagggcagcaacagcgccaccaggcccatgcagagcaccggcaacaccgtcagcagcgacgcgccctggaagccgagaccggtgccggcggtgatttcctcgagcagcgggccgatgccggtgaggatcggtcgcaggttgatgccgaggcagaagatcaccagcaggccgacccaactgacctccgccgcgccgacgccgctggcggcctggccgccagaagggattcgcgcgctcatgcctggcgttgccgccattgccggtacagaccctcttcgccggcaggacgcagggcgcgtagcggcaggctctgccgctgtggcgggcgcgccatctcggcgtag

SEQ ID NO: 14803 - DNA, 483 bp, Pseudomonas aeruginosa
aacaccggcgtcagcagcaggccgaagaaggtcaccccgatcatcccggagaacaccgccacgcccatcgcatggcgcatctcggcgccggcgccggtggagatcaccagcggcaccacgcccatgatgaaggcgatggacgtcatcaggatcggccgcaggcgcaggcggcaggcttccagcaccgcggcgacgcggtccatgccttcctcctgcttgtccttggcgaactcgacgatcaggatcgcgttcttgcacgccagccccaccagaacgatcaggccgatctgggtaaagatgttgttgtcgctgccggccaggatcaccccggtgatcgccgacagcagggtcatcggcacgatcaggatcaccgccagcggcaggctccagctctcgtactgggcggccagcacgaggaaggccagcagcacgcagagcgggaagacgaacagcgcggtattgccggcgaggatctgctggtag

SEQ ID NO: 14804 - DNA, 417 bp, Pseudomonas aeruginosa
aactgcccggtgaggccggagatgaacgcggtcgggatgaacaccgcgcagagcaccagcgccgtggcgatgatcggcccggtcacctcgcgcatggcacgcttggtggcttccaccggcttgaggccgaggccgatgttgcgctcgacgttctccaccaccacgatggcgtcgtccaccacgatgccgatggccagcaccaggccgaacagcgacagcgcgttgagcgagaagccgagcatgtgcatcaccgcgaaggtgccgatcagcgacaccggcaccgcggccagcgggatgatcgaggcgcgccaggtctgcaggaacaggatcaccaccagcaccaccagcaccagggcttcgaacagggtgtgcaccaccgcctcgatggagccgcggacgaagatggtcgggtcgtag

SEQ ID NO: 14805 - DNA, 936 bp, Pseudomonas aeruginosa
cccctggaaacgaggaacgccatgaaccgaaacgacctgcgccgcgtcgatctgaacctgctgatcgtgttcgagactctgatgcacgaacgcagcgtgacccgcgccgcagagaaactgttcctcggccagccggccatcagcgccgcgctgtcgcgcctgcgcacgctgttcgacgacccgctgttcgtccgtaccggacgcagcatggagcccaccgcgcgagcccaggaaatcttcgcccacctgtcgccggcgctggactccatctccaccgccatgagccgcgccagcgagttcgatccggcgaccagcaccgcggtgttccgcatcggcctttccgacgacgtcgagttcggcctgttgccgcccctgctccgccgcctgcgcgcggaggcgccggggatcgtcctcgtcgtgcgccgcgccaactatctattgatgccgaacctgctggcctcgggggagatctcggtgggcgtcagctacaccgacgaactgccggccaacgccaagcgcaagaccgtgcgccgcagcaagccgaagatcctccgcgccgactccgcgcccggccaactgaccctcgacgactactgcgcgcgaccgcacgcgctggtgtccttcgccggcgacctcagcggcttcgtcgacgaggaactggagaaattcggccgcaagcgcaaggtggtcctggcggtgccgcagttcaacggcctcggcaccctcctggccggcaccgacatcatcgccaccgtgcccgactacgccgcccaggcgctgatcgccgccggcggcctacgcgccgaggacccaccgttcgagacccgggccttcgaactgtcgatggcttggcgcggcgcccaggacaacgatccggccgaacgctggctgcgctcgcggatcagcatgttcatcggcgatccggacagtctctga

SEQ ID NO: 14806 - DNA, 417 bp, Pseudomonas aeruginosa
acgccaagtacgccgacatccaggacgcctacatcgcgatcttcccgccgccgccggtacaggggctggggaccatcggcggcttccgcctgcagatcgaggaccgtggcaaccagggctacgaggagctgttcaagcagacccagaacatcatcaccaaggcccgtgcgctgcctgagctggaacccagctcggtgttctccagctaccaggtcaacgtgccgcagatcgacgccgacatcgaccgcgagaaggccaagacccacggcgtggcgatcagcgacatcttcgacaccctgcaggtctacctcggctcgctgtacgcgaacgacttcaaccgcttcggccgtacctatcaggtcaacgtccaggccgagcagcagttccgcctcgaacccgagcagatcggccagctga

SEQ ID NO: 14807 - DNA, 1188 bp, Pseudomonas aeruginosa
cctgttcgggcgcatccgccgtcagctggagtccagcgacgccctcagcgaagcggccgaggccgacctgcagcaactgcaggtcagcctgatcgccgagctggtggacgcctacggccaactgcgcggcgcgcaactgcgcgagaagattgccctgagcaacctggagaaccagaaggagtcgcgccagctcaccgagcaactgcgcgacgccggggtcggtgccgaactcgacgtactgcgcgccgatgcgcgcctggcggccaccgccgccagcgtgccgcaactgcaggcggaagccgagcgcgccaggcaccgtatcgccaccctcctcggccaacggccggaagagttgacagtggacctttcgccgcgcgacctgccggcgatcaccaaggccctgccgatcggcgatcccggcgaactgctgcgccgccggccggacatccgcgccgccgaacggcgcctggccgccagcaccgccgacgtcggcgtggccaccgccgacctgttcccgcgggtcagcctcagcggcttcctcggcttcaccgccgggcggggctcgcagatcggctcaagcgccgcccgcgcctggagcgtcggcccgagcatcagttgggccgccttcgacctcggcagcgtgcgtgcccgcctgcgcggcgccaaggccgacgccgacgccgcgctggccagctacgaacagcaggtgctgctggccctggaagaatcggcgaatgccttcagcgactatggcaagcgccaggagcgcctggtctcgctggtccgccagtcggaagccagccgcgccgccgcgcaacaggcggcgatccgctaccgcgaaggcaccaccgatttcctggtgctgctggacgccgaacgcgagcaactctccgccgaagatgcccaggcccaggccgaggtcgagctgtaccgcggcatcgtggcgatctaccgctccctcggcggtggctggcaacccagcgcctgaaccggctatcccccggccgatggaaatcggccactccagccccgcgattgcagctcctggtcgcggggcttttttatgcgcagcgcgggggctcggtcgagccccacgtcgtttctcggcgatggcgtagaggctcggcgggcattgccgcgggctattcccgccgctccggctgcgcggagtggatatacagggtgtag

SEQ ID NO: 14808 - DNA, 420 bp, Pseudomonas aeruginosa
tggctgagaccgctctcgacctccaggcgcagtcgcggacgctcttcggtgaagcgcgtcagcaccggcatcagcacttcgccggcgaggtcttccggcacgccgaggcgcagcacgccgtcgccatgggccgggctgagggcctcgctggcctcgtccgagagccgcagcaggcgccgcgcgtatccaagcagacgctcgccttcctcggtcggcaaaacctgccgctggctgcggtcgagcaggcggcaaccgaggttctgttcgaggcggatgacctgctggctgacggtggactgggtcaggtgcaggtgttcgccggcgcgggtgaagttgccggtgtcgacaacgctgacgaaggtacggagcaggaccagatcgagcatgcacactcccactgaaaggcattacatcatttaa

SEQ ID NO: 14809 - DNA, 711 bp, Pseudomonas aeruginosa
catcgacgccatacttttcgccaacgcctatcggagcccatcgacatgtccctggccaatctatgcaggagcggagccatgctggtctgcgcagcattcagcggaggcgccggcgcgagcgacgccggagcattgctcgaagccgcgcgtcgcggcgataccgcgcaggtcgccagcctgctcgaacgcaaggtcgaggtcgacgcgcccagcgccgacggtagcaccccgctgctgctggccaccgccaacgaccacctggcggtggcgcgccagttgatcgaggccggcgccgacgtcaaccggcagaacagccggctcgacagcccgtatctgctggccggcgccgagggccgcctggaaatcctgcgcctgaccctgctccacggcgccgacctgaagagtaccaaccgctatggcggcaccgcgctgatcccggcctgcgaacgcggccatgtggaagtggtgaagaccccgctgcaagccggggtcgatcccaaccatgtcaacaagctcggctggaccgggctgctcgaggcgatcctgctgagtgacggcggtccgcgccaccaggagatagtgcgcctgctgatcgacgccggcgccgacgtcaacctggccgatgccgacggcgtcagcccgatggcccacgcccgccagcgcggccagggcgggatcgagcggctgctgctggccgccggcgcccaatga

SEQ ID NO: 14810 - DNA, 948 bp, Pseudomonas aeruginosa
cgggctggcgctgatcgccagcgccgcgctggccggcagcggcgtggcgatcatccaggcgctggtaccgggcgtggtcaagcgctggttcccgaggcgggtcccggcggcgatgggcctctactcggcctcgctgatggccggcggcggaaccgcggcggtgctcagcccgcggatcgccgaacacttctccaactggcaggccggcctcggcgcctgggccgtaccggccctgctggcgctgctgctgtggatgttcgcgcggccaagggaggtgctgccgagcgctggcgaggggccggtccggcacttcttcggcaatcgccgtggctggctgctggcggtgtatttcgggctgatcaacggcggctacaccagcatggtggcctggttgccggtgtactaccgccagctcggctggagcgcccaggacagcggcgggctggtcgggatcatgaccatcttccaggtgctcgccgcgctcagcgtgccgctgctgattcgccgccgcctcgaccgccggccctggctgctggccgcgctgctggtccagctcggcggcttctgcggcctgctgctgatgccgctgcagcacgcggcgctgtgggtggcgttgatcggctacggcctgggcgcctgcttcgccctcagcctgaccctgaccctcgaccacctccacgagccgcgtgcggcgggaagcctggcggccttcgtgcaaggcatcggcttcatcatcaccggcatcgtgccctacctgaccggctggctgcgcgacgtcaccggcagcttccaggcctcctggctgctgctcgcggcgagcgtggtggcgatgttgctggtgaccctgcgcttcgccccgtccggctatgcccgggccatgggcgagacgcgcgactgagcggcggacctccgcgcccgccattgcaggcgcgggtggcgcttcagtaa

SEQ ID NO: 14811 - DNA, 1290 bp, Pseudomonas aeruginosa
cgaggcctgccccggcggcgcctcgctgcgctcgagcaactcttccagcaggcaggcgaaggcacgtacttccaggcgccgcagggcgccggcgagcacggcgtcgtccgggagaaaggacgcggcgccgaaatcgcccagcaggcaggcgccatcctcgcgccagaggatgttatgcgcatagaagtcgccatggctgatgccgcgtccatgcagatgggccatcaacgcggcgagcgaggccgccaggcgcagcgccgtggccagctcgaagcgcagtcccggcggatagacgtcgcgggtacaggactccaggctcggcggccccgccaggttgcgataggcgtcgtcgagcagctccagcaccagcccgtcgcgcccttgcggatgcccggcgagctggccgagcacctcgatcaattgcgcatggcgccccgccgccaggcaggcggccatctcgctggcgggggtgccatcgctggtcacttcgcccttgaacagcttcagcgccaccgtgcgcgtcgagccgtccggctggtgccagccggcgcgatggatgaccccggaggctccttcgccgatcaaaccgtccaggctcagctcgctccagtccagcgcagcgatgccgctgtcggccagcgccggcagacggcacaacgggttgccggcgtaggccagccaggccaggcgcggcagcgtcgccagccaggccggcaggcgctggaaacggttggcggcgatccgcagcagttccaggccttcgcaagcggccatgctctcgggcaaggcctccaggcggttgccggccagcatcagcttctgcaacggccggcgacccagttcctcgggcagcgtggcaatccggttgtcggtgaggatcagccagcgcagcgctggcggcagggccgcggccggcacccgctcgatgcggttggacttgaagccgaccatgctcagcgccggacagtcccccaccgccgccggcaattcgtcgaagtcgttggcggaacagaacagcaccttgagacgatgcagccgcccgaggtcgtccggcaggctgtccagggcgttgccgctgaggttgagcacctccagggagtcggccagctcgaagatttcccgggggaactcgcgcaggccgcaggacaggtccaggcgcgtggcgccggccagttcgccgctgcgcagttgctgcaaggtgtgcatggttcgacggactccggccagggcggatggaaagccgcgcatgatagccaaggcgttgcggaacgcgcaccctcgccgtgctag

SEQ ID NO: 14812 - DNA, 1287 bp, Pseudomonas aeruginosa
agtggccgccccgaatcgacaggaccacagagaatggaactctcccccgccgaacgccaactcctgctggcccatcgcctggccgtgttcgacggctgcgtggtgtacgacgcccaaccgccggtgtccgccgaacacgtccagcgtcttgccgaaggcctggccggaccgattccagaagacctgctacgcctctggcgcacctgtttcggcgggcgcctcggctatgacctggaagtcgactacgacggccaccgccacccgttctctttcagcgaactgttctatccggacagcgacggctaccacgacctctggggctggatcgaacacgagcgcgagctggcggcggaagccgcggcagaagaaggccgcgactggaacggcaagctggcctacctgccgttcggtggcttcgagtacctggagcggctctacgtctgcgtcgaacccggccccgagcatggcgcggtaatcgcctggagccacggcctgccgccggcctgggccggacgcctgcaccaggattcggtgacgcgcctggccgacgacgtcggcgggctgttccgcctgctgtccttcgaacaggacccgttcgacgccgagaacgcctgcggcgtggccgacgagctactggaagcgctggacgccctggaggccgctggggagcccggcaaggcgctgaagggccgcctggaagtcctgctgcgccagcgcatcctcgactggcggccggccctcgccgacggcagcctggccgccgagccaaggctgcgtcaactggccctggccgaagctgcgcaagacggcgacatcgacctgctgcaacgcctgcgcgatgccggctgcgacttcgccgaaaccttgcgcggacgcggcggtgtgctggaggcctgcctcgcccgcgggcgcctggaggccgccagatggctgctcgaccagggcgtcgcggtgcaccaggacagcctgcagattggcgccgcgcacctcgatgcggtcctggccgaacgcctgttgcggctcggcgcgatctccgacccgaatacggtgctcctcgccctgcaatacggcgacgccgacgccgcgcggatcatggcgcgaccgctgctggaggagtcgccggcgagggccagcgccctgcgtctggccctcgccagccgcgccgagcgcgagcgcagcgacgccaggcgggtcaggtcgggaaagatgggcagcaaccgcagtcccgacgactacctggccctggccgagcgcctggagcgcttcctcgccgagctgccaggctga

SEQ ID NO: 14813 - DNA, 471 bp, Pseudomonas aeruginosa
agagcgggcgtatcgacatcggtttcggacgcatccggcatcgacgacccggcgatccgccagagcgtgctcagcgaagagccgctggtcgccgccctgcccgccgggcacccgttgctcggccagccgctgagcttggagcgcctgtcgcgcgagccgttcgtgctctaccccggccagccgcggccgagatacgccgaccacgtgctggcgctgttcgccacccacggcctgagcctgcgcgtgacgcaatgggccaacgagatgcagaccgccatcggcctggtcgccgccggactcggcgcgaccctggtgccggcctcggtgcagttgcagcaccgcgacgacgtcgcctaccaggccctggccgacgcctccctgacctcgccgatcatcgtcagccggcgccagggcgacggctccccgcacctgcggcgctgcctggcgctgatcggccgcgaggacgcctga

SEQ ID NO: 14814 - DNA, 1401 bp, Pseudomonas aeruginosa
gaacgcatgaacgctacccgcagaagcctcgaacagtggcgcgactatgtcggcggctgcctcgacttccgtcccgaggaaggcatcttccgcatcgcccgggacatgttcaccgaaccggagctgttcgacctggagatggagctgatcttcgaaaagaactggatctacgcctgccacgaaagcgaactggccaggccccacgacttcgtcaccctgcgcgccggacgccagccgctgatcgtcacccgcgacggcaacggccagttgcacgcgctggtcgacgcctgccagcatcgcggcgcgaccctggtgcgggtcggcaagggcaaccagtcgaccttcacctgtccgttccatgcctggtgctacaagaacgacggccggctggtgaaggtcaaggcgccgggcgaatacccggaaggcttcgacaaggccacccgtggcctgaagaaagcgcgcatccagagctacaggggcttcgtcttcgtcagcctggacgtcgccggcgaggacgacctggtggacttcctcggcgacgcccgggtgttcctcgacatgctggtggcgcagtctcccagcggcgagctggaagtgttgcccggcacctccacctacacctacgaaggcaactggaagctgcagaacgagaatggcctggacggctatcacgtcagcacagtgcactacaactacgtagccaccgtgcagcaccgccagcaggtcgaggccgagcgcggcggcgtggccgccaccctcgactacagcaagctcggcgccggcgacgcggccaccgacgacggctggttctccttcgccaacggccacagcgtgctcttcagcgagatgcccaaccccgccgtacgccccggctacgccagcgtgatgccgcggctggtggcggaatacggccaggcccgcgccgagtggatgatgcatcgcctgcgcaacctcaatctctaccccagcctgttcgtcatcgaccagatcagctcgcagctgcgcatcgtccgcccgctggcctggaaccgtaccgagatcgtcagccagtgcatcggcgtaaagggcgagtcggacgccgaccgggagaaccggatccgccagttcgaggacttcttcaacgtctccgggatgggcacgcccgacgacctggtggagttccgcgaagcccagcgtggcttccaagcccgcctggagcgctggagcgacatctcccgcggccacggcaagtggctcgaaggcgcgacgccgaacagccaggcgctgggtatcgcgccgctgctgaccggcaccgagatcacccacgaaggcctctacgtcaaccagcacgcgcattggcggcgcttcctcctcgacggcctggagcgcctggccctgcgcgcgaaggaggtgaccccatga

SEQ ID NO: 14815 - DNA, 537 bp, Pseudomonas aeruginosa
atcacaaagtcgccctcagcttcgccgacggcaagaccctgttcctgcccgtcggccacgacgacctgctcctcgacgccgccctgcgccacggcatcaacctgccgctggactgccgcgaaggggtctgcggcacctgcatgggccgctgcgaggcgggcagctacagcctggactacgccgacgaggacaccctctccgccgccgacctggagcagcgcaaggtgctcgcctgccagacccgggtgcgctccgacgcggccttctacttcgacttcgcctcgaccctctgccacgccgccgcggcccaggcgcacagcggcgtggtgcgcgaactgcgcctgctctccgaggacaccgcgctgctccgcctcgacgccggcgccgcgggccgccagttggacttcctgcccggccagtacgcgcgcctgcaagtacccggcagcgactgccggcgcgcctactccttcgccaaccggccgaatccgcagaaccacctgcagttcctcatccgcctgctcccgggcggcgccatga

SEQ ID NO: 14816 - DNA, 204 bp, Pseudomonas aeruginosa
catttcgacgccgcccgcctgcgcgacgaagctttcgacctctacctgtgcgggccgccgccgatggtcgaggcggtccgccagtggcttgcgcgagcgctcccttggagcatctacggctgtacctggagaagttcaccgaaagcggcgactgatgcgctcagccgaggtcgccgccagctaccggcagggtcacgccggtga

SEQ ID NO: 14817 - DNA, 1293 bp, Pseudomonas aeruginosa
cgcgtgctgctggggatatccgttgcctgcggatcgctggccgattcctgcacgccgtggcggtcggcgctaggcgcgccggcgcagggtttccgaaggcagctcgccgaactgccggcgatattgctcggcgaagcggccgaggtgggcgaaaccgaagtccagggccagttcggtgaggttgcgtacccggcagccggggtcttccaggcaggcgcggatgcgctccaggcgcagccggcgaatgtattgccgagggctctcgccaagctggcgctcgaacagcgcgtacagcgaacgggtgctcatgtgcgcctgctcggccagcgccgcgacctcgatctcgctctgcagatggcggcggatgtaggcatcgaggcgggcgaagacgacctgcgcatcgccggggtcctcgcggctgacgttggtcttcagcagggtcagcagcttgctgccgaggatctgctcgaagtggctgtcgacccgcgccagccgctcgccggactcggcctcgcggcagaccagggcgagcaggccgacgaagccttccagctggtccaggcgatagcgatgttcgaggaaacgcacgccgcgcgccggatggctccagcgctgctcggcgcagatcgcttcgagcagcgcgcagggcagcttgacgatgaatttctcgcagtccgccgaataggtcaggtcgaccggatcgtccgggttgatcagcaacagctcgcccggcgccagggcgtgttcctgcccgccgccgcgccacaggcagtggccgcgcaggaggatctgcaggtggaagatgctctccagcgccggcgaggtgacccgtaccgccgcgccgtagctgatccggcacaggtcgaggctggcgaaggtgcggtggtcgaggctggcttgcggcctgccggaggccggcaggcgtatgcagtgcgtaccgacgtgccggttgacatagccggacaccgcataggggtcggcacgttcgaacacccggctgcgctcgctgagcaaggaggcattcatgggcaggacactcaggctgctatcgttgttgttatcgccgcgcggcgccaagcgccgggcgcggaacgtccacccacactacgcaagccctccgccggcgacaatccgggccggcaatcgcgtgcggtaatcgaacggaatccgtccaacggccaacgaaaaagggccgccagggtttcccctgccggcccgcttgcgcgcccgcttcagccggccgccggcgtctcctcgcgcggtccggcgtcgcgcccgtgggtccagcgatag

SEQ ID NO: 14818 - DNA, 510 bp, Pseudomonas aeruginosa
agcaccggcagcaccagcagggtcagcatggtcgaggacaggatgccgccgatcaccaccgtcgccagcggccgctgcacctcggcgccggtgccggtggccagggccatcggcacgaaaccgagggacgccaccagggcggtcatcagcaccggacgcaggcgggtgatggcgccctcccacaccgcctggtcgaggctgcgtccttcctgcaacaggttgcggatgaaggagatcatcaccaggccgttgagcaccgccaccccggacagggcgatgaaacccaccgccgccgagatcgacagcggtatcccgcgcagccacagggccagcaccccgccggtgagggcgaaggggatgccggtgaacaccagcaggccgtccttgacgttgttgaacatggcgaagagcaaggtgaacaccagcagcagcgccaccggcaccactacctgcaagcgcttggcggcggactgcaactgttcgaactggccgccccaggtggtccagtag

SEQ ID NO: 14819 - DNA, 597 bp, Pseudomonas aeruginosa
ccggccgggatcttcaccccgtcctgcagcttctgttgcgcttccagcacgaacgagccgatgtcgcggccgcgcacgttggcgctgaccacgatgcgccgcttgccgttctcccggctgatctggttcggtcccggcgagaggtcgaggcgcgccacgtccgacagcgggatgaagtcgatccgcgccaggttgttcggcggcagcgggatcagcaggttggacagtgccggcaggtcggcgcgcagggtttccggcaggcggatgacgatgtcgaagcggcggtcgccctcgaacagggtaccggcgttgcgtccgccgagggcggtggccacggtgtcctggatgtcgccgacattgaggccgaagcgtgccgccttgtcgcggtcgatgtccaccgtcagcaccggcaggccggtggtctgctcgaccttcacctcggaggcgccgtcgatgccttgcagcaccttggagatcttctccgcggtgtcgttgagcacctgcatgtcgtcgccgaagaccttcaccgcgacgtcgctgcgcaccccggagatcagttcgttgaagcgcaactggatcggctgggagaactcgtag

SEQ ID NO: 14820 - DNA, 1761 bp, Pseudomonas aeruginosa
ctgccgatgccgaccccggccatccccagcaccgccagcaggaccagccagcgttgctcgatggcgaattggatgatgcgttcgaacatgcgaagactcctggagcgggactcagtgaccgtgttccgccgagcccttgcccagttcggatttgaggatgaagctgccgctggcggcgacctggctgccggcgcgcaggccctcgaggacctcgacgcgctggccgtcgctgatgcccagcttgaccggctggaccacgaagccatcggccacgcggacgaacaccacgtcctcgccgtcgacgtcctgcaccgcgccgtcggcgaccgtcaggacttccttgcgggtcgcctcggccacctgcacggaaacgaacagacccgggcgccaggtgctctcggggttgctcagggtgacccgggcggtggccgcgcgggtctgctcgccgagcaggtcgccgatgtaggacacggtgccctccacctcgctatccagcgcctgggcgagcaccttgaccttgctgccgacgcggacctggccgagcagttgcgcgggcacgttgaaggtggcccagaccgaggacaggtcggacagggtgaagacgttggcggtgccgtccaccggctcgccctgggtcaggtgcttttccaccagcaccccggcgaacggcgcgcgcagctcgtagcggttgccgccctgcaggctgggattgccgccgagcgcggcgatcttcgcccgcgcgttgttcagcgcgatctcggcttcctgcaaaccctggcgggcgagcaggaattcctgctcggcggaaatgccctccttccacagctgctgctcgcgcttgtaggtgctctgcgccaggctcaggcggcgctgggcggcggcgaattcgctgcgctggtcggacaactgcgggctgctgatcaccgccagcagctcgccctgcttcaccgcctggccaagattggccggcacgctgtcgacgatccccggcaggcgcgggacgatatgcgcggtgcggtcctcgttgaagcggatctcgccgggcagcgagaccacctgggccaggctgatcgtccgcgccgtatcgagggtgatgccggcggcctcgatctgctcggcatccagctccagcttgccctcctcgcgggtgaaggcgaagtcgtagccctgcttgccggccatcagcttgaggcgcgcggtgaaggcatgcggctcggcgatcccggcattggccaccaggccatcgccgctggccttgaacagcaggtcctcgacctcgccggtggcacgctcgacgtcggcgccgaggaccacctcctgcggcgccagcgccttgccgccgcgctcgacccaggccttgagcgggctgccgtcctccggcaccagcagttccagggtcaggtcgccctggcgcaacaacatgccgccgcgcggtccgctgccctcgccctcggcggccgcttcgccggcgccggccggcgccttcccgcccagctccaggtaggcgccgccgcccaggccgagcagtgccagtgcggtcaccgcgataatcgtcttcttgcccattctgttctcccgaaccgttcggggggcgcgccggcggcccgccccggaaatctcactggccgaggtggccgatgtcttcgccgagcaggcgctccatgctcacccgcgcctgtgccgcggcgtccagcgcgcgcacgtactgggcacggacgccgaccagggtgcgctgggcatcgagcacgtcgaggaagttga

SEQ ID NO: 14821 - DNA, 738 bp, Pseudomonas aeruginosa
ctttatagcaatgcacttaaacatttacttgcaaatgaatccatactttatataggggcgaacatgcgcatccttattatcgaagatgaagtcaagactgccgactacctgcaccagggcctgaccgaaagcggctacatcgtcgaccgcgccaacgatggcatcgacggcctgcacatggccttgcaacacccttacgaactggtgatcctcgacgtcaacctgcccggcatcgacggctgggacctgctccgccgcctgcgcgaacgcagcagcgcgcgggtgatgatgctcaccgggcatggcaggctgaccgacaaggtgcgcggcctcgatctcggcgccgacgacttcatggtcaagccgttccagttccccgaactgctggcgcgggtccgctcgctgctgcgccgccacgaccaggcaccgatgcaggacgtcctgcgggtcgccgacctggagctggacgccagccgccaccgggccttccgcggccgggtgcggatcaacctgacgaccaaggagttcgccctgctgcacctgctgatgcggcgcaacggcgacgtcatcacccggacgcagatcatctcgctgatctgggacatgaacttcgacaacgactccaacgtggtggaagtcgccatctgccgcctgcgggcgaagatcgacgacggcttcgacctcaagctgatccataccattcgcggcgtcggctacgtcctggaagcgcgccgatga

SEQ ID NO: 14822 - DNA, 480 bp, Pseudomonas aeruginosa
accgcttccgccgggtggccgcccaggtcagcccgcaggatctctcctaccgcatccccgagcagaacctgccgcgcgagctggacagcctggcccgcagcttcaaccacatgctcggccgcctcgaggatggcgtacgccagctctcgcagttctccgacgacctggcccacgaactgcgcgcgccgatctgcaacctgctggtgcgcaaccaggtgctgctcagccagcatcgcgacggcgcggcataccgcgaagccctggagtccaatgccgaggaactggagcggctgtcgcggatcgtcaccgacatgctgttcctggtgcaggtggacaacccggcgatccaggcccagttcggctgcgtcgccctgcacgagcaggcggccaaggtcatcgacctgtacgagatggtcgccgaggacaagggcgtcgaactgcgcctgtccggcaacggcttcgcccacggcgacaacctga

SEQ ID NO: 14823 - DNA, 3411 bp, Pseudomonas aeruginosa
agggcgtggacagactcatcgcccggcgtccccgtcgaacccggcctcggtgttcaggtccagcccgcgctgcttgcgccaggccgcccagcgacgggccaggcggtcgaagtagagatagatcaccggggtggtgaacagggtcaggacctggctcagcagcaggccaccgaccatggtgatgcccagcggctggcgcagctcggcgccggcgccgccggcgagcatcagcggcagcgcgccgagcagcgcggccatggtggtcatcaggatcggccggaagcgcagcaggcaggcctggtagatcgcctcatggggcggcttgccttcgttgcgctcggcgtcgagggcgaagtcgatcatcatgatcgcgttcttcttgacgatgccgatcagcaggatgatgccgatgatcgccacgatgccgatctcctgccccgccagcatcagcgccagcagcgcgccgaccccggccgagggcagggtcgagaggatggtcaccggatggatgaagctctcgtagaggatgcccaggacgatgtacatggtcaccaccgaggcgaggatcagcagcagcgtgttcgacagcgaggcctcgaaggccagcgccgcgccgcggaagctgccctgcatgctcagcggcagctccaggctggcctcgacgccacggatcgcctcgaccgcctcgcccagggagtaacccttggccaggttgaacgacagggtcgccgaggggaactgggcgatatggttgatcgccagcagggtatgccgctcctccaccttcgccaggctcgacaggcgcacctgggtgccgtcgctggacggcacgtagagctgctccagggcctgcgggccgagctggaactgcggcgccacctccagcaccacgcggtactgggtggcctgggtgaagatggtcgagatcagccgctggccgaaggcgttgtagagcacgctgtcgatgtcggagagcttcacgccgaggcgcgaggcggtgtcgcggtcgatgttcaggtaggcctgcaagcccttgtcctgccagtcgctggcgacgtcggcgagctgcggcaactcctgcagccgcgccaccagcttcggcacccactcggcgagcacgtccgggtcggcgtcctgcaaggtgaactggtactgggtgcgggcgacccggtcctcgatggtcaggtcctgcaccggctgcatgtacagcttgatcccgggcaggtggtcgagttcgggctgcaggcgctggatcacttcgctggcggtgacgtcgcgctcgctgtgcggcttgaggttgatcagcaggcggccggtgttgagggtcgggttgctgccgtcgacgccgatgtaggaggacaggctggccaccgccgggtccttcagcaccacctcggcaagggcgcgctggcgctcggacatggcctggaaggagatcgactgcggcgcttcggcgacgccctggatcaccccggtgtcctgcaccgggaagaagcccttgggcatggccaggtagagcagcgcggtcagcgccagggtggcgatggccaccagcagggtcagcggctggtgccgcaggaccacccgcagggccttggcgtattgtgcgatcaggccatcgatgacccgccccgcggcgcgcgcgaagcggccctgctggtcctcgtcgatgtggcgcagcagcttggcgctgagcatcggcgtaagggtcagggagacgaagccggaaatcaggatcgccaccgccagggtgatggcgaactcgcggaacagccgcccggcgacgtcgcccatgaacagcagcgggatcagcacggcgatcagcgagaaggtcagcgagatgatggtgaagccgatctgcttcgagcccttgagcgccgcttccagcggcgagtcgccctgctccaggtagcgggcgatgttctccaccatgacgatcgcgtcgtcgaccacgaagccggtggcgatggtcagcgccatcagggtcaggttgttgatcgagaagccggacaggtacatcacgccgaaggtaccgatcagcgacagcggcacggcgaagctgggaatcagggtggcgtagacgttgcgcaggaacaggaaggtgaccatcaccaccagcgccaccgccagcgccagctcgaactgcacgtccttgaccgaggcgcggatggtggtggtgcggtcggtcagcacctgcacgtcgagattgcccggcagggtcgattgcagctgcggcagcagcgccttgatccgatcgaccacctcgatcacgttggcccccggctggcgctggatgttcagcaccaccgccggcaggttgttggcccaggcggccaggcgcacgttctcggcgtcgtcctcgacgctggcgacgtcgcggatgcgcagcggcgagccgttcttgtaggcgatgatcaggtcgcggtaggcgtcggccgagcgcaactggtcgttggcgtccagggtcgaggcacgggtcgggccgtcgaagctgcccttggggccgttgaggttgttgctggtcaccgtgctgcgcaggtcctccaggctcagccccgccgccgccagcgccgtcgggttggcgcgcacccgcaccgccgggcgctggccgccgctgatgctgaccaggccgaccccggagatctgcgagatcttctgtgccaggcgggtatccaccaggtcctggatctgcggcagcggcatgccgtcggacatcaccgccagggtcaggatcggtgcgtccgccggattcaccttgctgaacaccggctggttcggcaggtcgttgggcagcaggctctgcgcggcgttgatcgccgcctggacttcctgctcggcgacatcgaggttgctctgcaggctgaattgcagggtgatcaccgaggcgccgccggaactgctggaagacatctcgttgagccccggaatctgcccgagctggttctccagcggcgcggtgatcgacgaggtcatgatctccgggctggcgccggggtacagggtgaccacctggatggtcgggtagtccacttccggcaacgccgagatcggcaggaagcggtaggcgatcaggcccgagagcaggatcgccaccatcagcagggtggtcgcgaccggccgcaggatgaacgggcgggacgggttcattcagcgctcccgctacccaccgagtcgccctggaggccgctggggcggccagtctgcggtttctgcggctcgccctcgaggacctgcggggaggcctcggcgacacgcacttccataccgtcgcgcaggcggtcggtgccttccaccaccacctgctcgccggccttcaggccgctttccaccaccacccgctcgttctcgctggtgccgatggcgacgctgcgctggctgaccttgttgtcggcgccgaccacgtacacatag

SEQ ID NO: 14824 - DNA, 558 bp, Pseudomonas aeruginosa
ataccgttggtgccgcgctgcacggcgttggctggaatggtcagcacgcccttgagggtatgcgccagcaggcgcacgttgacgaactggttggggaacagcttgccgtcggcgttctcgaagcgcgccttgagcttgaccgtgccggtggtggtgtcgatctggttgtccagggtggtcagggtgccttcggcgagaaccttgtcctggttgcggtccagcgcggtgaccgccagcttgccggggccgttcatctgctcgacgacggtgccgatctgctgctgcggcaggctgaacaccaccgagatcggcttgacctgggtgatcaccaccagcggcgtggtatcgccgctggtgaccaggttgccgatgtccacctggcgcaggccgaggcgcccggaaatcggtgcgcggacctcggtgaaggtcagattgaggcgggcgtcgtcgacctggccctggttggtacggatggtgccctgcaactggcggacctgggcttcctgggtatccagggtctgcttggcgatcgagtcctcggcgtacagccccttgtag

SEQ ID NO: 14825 - DNA, 390 bp, Pseudomonas aeruginosa
gtgcgcgggtcgaccaccgccagcaggtcgccggccttgacctcctgcccctcctggaacagcaccttgaccagctcgccgttgacccgcggcttgacgttcaccgtgttgaaggcggtgacggtgccaagcgcgttgaaatgcagcgccaggtcgccctgctccaccctggccacgccgacggtgagcgcgttggccttgggcagcgcggcgcccggcttgccgccgcgaccgggtcgcccgtcggaggacggtgccgaggcgggcgccgccagccacatcaccaggccgatcacggcggcgaaggccagggcggtgatcagccacgggcgcagggtacggaacttggatttaccggtcgttggagtcatggttcttcttcaggcttag

SEQ ID NO: 14826 - DNA, 1521 bp, Pseudomonas aeruginosa
caacaaacggcttgctccgttacggacgaaggcttgaaatatagcgttctgcattcgcccactccgcaatcggccagggacgcacagatgatcgacccgttgaaacaccgcttcgcggcgctccgcagtcgcgccgaattccactccttgcgctacgtccagcgtagcggcgagtacctctcggtgcgccgcaacgtcaacgaaccgccgcacttcagccaggaccgcggcgccatgctctgcgtacggctgaacggcgtggaagcctacgccgccaccaacgatctctccgcggccggcctgcaggccgccctggagcaggccgaacggcaagccgagcggatcgcccggcacgccctgttcgacgtccgcggattgccgccggcaagcggccgctcgcagtatcgctcgccgaaccaggacgcccctttcccctccctcgccgagtgctacgaactgctcgccgaggagtccgccaaggtgccgcgcgacgagcgcctggtgaactggagcgtattcctcgaagtcagccgccaggaacagctctacctgaacagcgccggcgccgagcaataccacgagcagcgcttcgtctatcctggcgccagcgtcaccgcctacgacggccatgacagccagacccgcagtttcggcggccaccatgccggccagcagggcggcgccgaagtgatcgagcgcctcggcctggtcggcgccgcgccgcgcatcgccgaccaggccctgcaactgctggcggcgccgaacaccccgagcggccgctgcgacctgctgctgatgccggaccagatgatcctgcagatccacgagtcgatcggccacccgctggagctggatcgcatcctcggcgacgagcgcaactacgccgggaccagcttcatcaagaccgaggacttcggtcgctaccagtacggctccagcctgctcaacgtcagcttcgacccggaaatccccgaggagctggccagctaccgccaggacgacgacggcagccccgcgcgcaaggaatacctgatccgcgaaggccgcctgctgcgcccgctcggcggcgccctgtcgcaacaccgcagcggcctggagggcgtcgccaacagccgcgccagcagttggaaccgcgcgcccatcgaccgcatggccaatctcaacctggagcccggtgacaagagcttcgcgcagctggtggccggtatcgagcgcggggtgctgatgtcctacaaccgctcctggtcgatcgacgacgcacgcaacaagttccagttcggctgcgaatggggccagttgatcgaggacggcgaactcaagggcgtggtgaaaaaccccaactaccggggcatctccgcgcagttctggcgcaacctcagcgcggtgggcgacgccggcaccttcgaggtgctcggcaccccctactgcggcaagggcgagccgaaccaggtgatccgtgtcggccacgcctcgccggcctgcgtattcagcgatgtggacgtattcgggggagacgcctga

SEQ ID NO: 14827 - DNA, 1347 bp, Pseudomonas aeruginosa
ccgggcgcttcaccctcacgctctgagcccgcgcggcgctccccggcggttcgccgcccgggagcgccgcgtgcgcaatccgaagaacgaccgccgatattctggcgccattatcacgccaccataaacggaccggctccctcctcgttctccactctggtgacacacgcccgagaggaacccaccgcacgcatatcccattcggtacacggaggtgaagctatgcccgctttgagtcgtcgttcgttcgtgaccctgaccgccctggcctccagcagcatcctgctgagcccgcgagccttcgccgggagcggcgcgacaagcgccgccgggaagccgcaagagaccttcctggatttcaacgaaagcccctacggcccctccgccaaggccagggccgccatgcagcgggcggccgcgctctgcggccgctacgactacgacgcgcaggacgccctggtcggcctgttcgccaagcagaacggcatccccgccgaatgcgtgcatgcctactgcggctcgcgccagccgctgcaatacgccgtcgcggcgttcaccggcaaggagcgcagactggtcatggccgatccctcctacgactccgtggtcggcgccgcccaggtccagggggcgaaggtcgctgccgtgccgctggacgccgaggcggcccacgacatcgagcgcatgctcgccgccgcgcaacgcgacgccgggctgatctatatctgcaacccgaacaacccgaccggcaccctcaccccgcacgagcggatcgtcagggcgatcgaacgcaagcccgagcgcagcgtggtgctggtcgacgaggcgtatatccatttttccgacgcacccagcgtcgttggcctggccatccagcgccaggatgtgctggtcctgcgtaccttctcgaaactctacgggatggccggcgcccggctcggcctggccatcgggcatccgcagctgctggcgcggctggagcgcttcggcggccacaacgtggtgccctcgccgaccgcccacgccgggctggaaagcctgcgtgacgacgatctggtgccacggcgcaagcagcagaacgcagaggtccgcgagcgcaccatcgcctggctgcgccagcagggcttccgctgcaccgcctcacagtccaactgtttcatggtggatatgcgccgtcccgccgagctggtcatcgccgaactggagaaacagcgggtgcacgtcggccgcccgtgggcctcctggcccaactgggtccgcgtgacggtaggcagcgaggaagagatgcaggcgttccggagcgccttcgccagcgtcagccggcgccaccaggtcgccatgcgctag

SEQ ID NO: 14828 - DNA, 240 bp, Pseudomonas aeruginosa
gccattgcgttgatccttctagtcagtgagaagccgccggccctgtggccggcggcggaagcattcggggccggcgacgatgctagcacgctttacccgagcgaaaacctcgggtttgagcgtcgccgtcccccgaggctcaactcctggccttggcgaaatactcccgggtcaggcggaacaccaccggactcagcagcagcaaggcgatcaggttgggaatcgccatcagcgcgttga

SEQ ID NO: 14829 - DNA, 1221 bp, Pseudomonas aeruginosa
acttcaaccccagcatcaggtacaggccggtgccgagaatcagcaccagcatcaacggcccccagaccacgccgttcaggtcgaccacccacttctgcaagctttccatcagcgatccttattcttgttcgaatgaatgcggcctggcggcagcgggcatccggaactcggacgaacatccctgctcgacaggccaaggctgccgatcctaacgaggttctctcggcgaaatcgagaaaaatcttcgcccggaaagcctgcgtctcattgcgtctcgccggccgcctggcgaccgaacagttccaccagccagtcgacgaacaccctcacccgcggcgacaactggcgctgcgagggatacacggcatgcagcggcagcgatggcggcaaccattctccgagcacttgtcggaggctaccgtcggccaggccggcggcgacgtgatagtgcggcgcctggatcagcccgagcccggcccggcaggcggcgacgtaggcatcggcgttgttgacgctgacccggctgcgcatcggcaacgtgcgcagacgcccgtcgacgctgaactcgaagtcgaaggtacgcccgctggaaggcgactggtagttcaccgcgaggtgcccgccgagctcggcgagctgccgcggatggccatgacgctccaggtaggcggcgctggcgcaggtgacctgcggcaggtcggccaggtgccggccgaccaggctggaatcgtgcagttcgccgacccgcagcacgcagtccgcgccctcgcgcagcaggtcgaccaggcgatcgttgctgctcaactgcagctccagttccgggtagcgctcgcagaactccggcaggaacggaatcacccgcatccgccccagtgcgcccggcaggtcgacccgcaagcgcccgcgcgggttgttcaggacgcgtggaaagcagctttccgcctcctccaggtccgccagcaggcgcacgcaacgctcgtagtaggcctgcccgtcgagggtcaggcttacctggcgggtggtgcgctgcagcaactgcacgccaaggtgcgcctccagttgctggatcgcctgggtcacgctggcgcgcggcagctccaggctgtccgcggccttgccgaaggcgcccagctcgacgatgcgggtgaaggcctgcatggcctggaaacgatccatcggacaccctcgattatttggaaaatacgaatggtaaaaccgtaa

SEQ ID NO: 14830 - DNA, 639 bp, Pseudomonas aeruginosa
cgaggaactgctcggcgaggccctgcgcggcaaacgcgagcaggtgttcctggccagcaagttcggcatcgtccgcgaccctgccaatccccgggcgcgcggcgtcgacggcagcccggcgtacatccgccgcgccatcgaaggcagcctgaagcgcctcggtaccgaccgcctggacctgtactatcagcaccgcatggacccgcaggtacccatcgaggacagcgtcggcgccctcgccgacctggtgaaggccggcaagatccgccacatcggtctcagcgaagcctcggcggaaaccctcgagcgtgcccaccgggtgcacccgatcagcgcgttgcagagcgagtactcgctgtggacccgcgatccggaggacaccggggtgctcgccgcctgccgtcgcctgggcatcgccttcgtcccctacagcccgctgggccgaggtttccttaccggcaccctgaagcgtccggaagacttcgccgccgacgactaccgtcgtttcagcccgcgcttccagggcgagaacttcgcgaagaacctgaagctggtggacaaggtcggcgaactggccgcagccaagggcgtgaaaccctcgcaactggcgctggcctgggtgctggcgcagggcgatga

SEQ ID NO: 14831 - DNA, 1209 bp, Pseudomonas aeruginosa
cggtatccgccctacgggtctctatcgctcgcaatttcctggctgcctacacggcgggaaaacgacgacggggcggccgccatcggcaaccgccccgctcccctcggcgccaggcgaacctcagggcgtccaccagtagcgcaccacgtggaagaagatcggcgcggcgaagcacaccgagtccaggcggtcgagcatgccaccgtgaccttcgatcatgtgcccccagtccttgaccccacggtcgcgcttgatcgccgacatcaccaggccgccgaagaagcccagcaggttgatcagcagcgcgatcaacgccgcctgccagaggttgaacggggtgatccaccacagcgaggcgccgatggcggtggccagggcgatgccgccgacgaagccttcgacggtcttcgacggcgacaggttgggagcgatcttgcgcttgccgaacagcttgccgcagatgtactgcatcacgtcggagagctgcacgacgatcaccaggtaggcgatcagcagcaggttgcgcccctcgaagccggggatgtcgagggtcagcagcgccggcacgaaggagatacagaacaccgccagcatcaggccccactgcactttcgaggcgcgttcgaggaagtgcttggtgtcgccgcccagcgaggcgaggatcggcaacagcaggaacacgtacaccgggatgaagatcgagaacatgctgtaccagtcgatgtagatcagcaggtactgcatcggcagcacgaagtagaacgccgccaccagcgccgggtagtcgctgcgccgggtcggggtgagggtgatgaactcgcgcagggcgtagaacgacacgccatagaacagcaggatcaccgccgcctggccaagccagaaggcgaaaccgatcaccaggaccatcgcccaccaggcgttgatccgtgcgttcaggttgtcgatcaccgcgttcgggccgggaccggcgcgccacttgaggacgaagccgaccagcgaggcgagcagcagcagcgcgccgatcccgccgaagagcatccaggtctgttcgttcatctcaggcctcctcttccggcgccaggtccagcagggccatgcgcgctcgttcgaggaacgcctccttgccttcttccgccgtggcgaccagcggcttgccgaagctcagggtgcagagcagcggcaacggcagcatgcggcccttgggcatga

SEQ ID NO: 14832 - DNA, 2322 bp, Pseudomonas aeruginosa
gcaggcgcaggcagtgggtgtccagctcgcgcttgtcccgcggcaacaacagcgacaggccgtagagcaggtcgatcgaccagtacggcaggatggtccagggccacagcggcatcccgcgttcccagtcgaagaccaggctgccgacgtcgccgcgctggctggtcaaccagttggccaggccatagctggcgaagaagaacgggccgaggaacagcagccagagcaccgcccgcttcagtacccccggctcgcgcggcgccatcagcgggcgaccttctgcgccagcgatacgctgaagatgccccactggtcgacccgctgggtgatcttgcggaagccggcggcggccaccagctggtccatttccgcctgggtccggcgccgcatcacccaggcctggccctggcggtggctggtcagcgcgcgggcgatcagttccagctgcgggtgccagggctgtccggtgtaaaccaggtagccgccctcctccagcgcctcgccgaggccggcgagggagtcgccgaccatgcggttgtcggcgaacagctcgtagagcccggaaaccaccccgaggctcggcttcggttgcagcgccgccaggtcggcgcgatcgaaggcgtcgcccttgacgaagcgggcgatgccggcgaggcccttgctttcgatcagggcgctgccgtcacgcacgttgatctcgctgtagtcgcgcaggaggatgctttccggcagcggctcgacgccttgcagggcttcgaggatgtagcggccgtggccggcggcgatgtcgacgatgcgcacctcgcgctgctcctcgcgcaaccgctgcatggccaggcgcagcagctcctcagcgtgcagcttgcgctggcggatgccgcgccagccgatggagtccaggtagttgcggtcgatcaggcgacccagtgggccgctgccgcagggctggttgcggtagacatagtcgagggtgctgccggaatcgaagccggtgtcgaagcccagcttgaccccatccgaccacaggctgcccaggcgcaggccggcacgggtggcgcgccagtagagatcgcgcggcgagttcttcggcaacggcgcggccagcgcctcggcctcggcgcaggtatggcccaggcggtcggcatcgagcaggctcggtcgttcgggggccgtggcgaatgcctcgaggaggaagcgccgggcacggccgacggccaggtgacgatcgcgctcgccaagggtgtcgtggaagaagccgggcaggatgtgcttttccttgcgcaggctgccgagacgctcgaagaagcgctcctgcggcgcacgatggacgacgaagtcggccccggaaatcagcagttgggtgggaatctggatcgcctgtgcgtccgctaccacccgctcggcagcttcgtagaggccgagcaggacgttcaccgagatcgccttggcgatcagcgggtcgctgtcgtaggaggcgatccgctgcgggtcgtgactgaggaagcgtgccttgacatagctgttgacgaagaaattgccgcgccacaggcgcatcagtttcagcccgctgcgggcgaacggcacgtagagcttgacctggaacgccggcgaagccagcaccagtgcgcgcaccttcggcgcgtagtcgtgggcccaggtggaaaccagcaccgcgccgacgctctgcgccaccaccgccatccgctcttcggcgataccgtggacggcctggatatggtcgacgaaggtctgtacgtcgcgcacgctggtagcaaagctcgggctgtcgccgcgggcgcctggcgagaggccgtggccacgggcgtcccaggcgaagaagtcgtgttccggcaggtcgagttcgtcgaccagatgggcgatccgcccggagtgctcatggccgcggtggaacagcagcaccgcctggcgcgtgccgtccggcgccgggcggctggccggccagtggcggtagaagagctctaccccgtcgtgggtggtgaaacgcagttcctgtacgtcgcgcatgtgatgtccctatgtcgttgccccggccgggatcccggcggggttgcttcctgcgggcgcccacctccatggcgttcgcccgttccctctcaggcctggccgttgctgccccgtcgactcgcggacagctcggccaggccctggcgcacgcggttgccgatggtcagcaacagcagggccgcgatcagcaacatcagccagtcgatccaggccagcggcaacaggccgctggccaccccggcgccgatcacgccgaaacacagcgcccggtcgcttttgcccatcgggccgtcgtag

SEQ ID NO: 14833 - DNA, 1461 bp, Pseudomonas aeruginosa
cacagcgcctccagggtcgccaggcatcccccggctgggctagcattcctgttttgccaggacgcccaccatgaaaatcgtctctttcaatatcaacggtctgcgcgcccggccgcaccagttggcggcgctgatcgagcggcaccagcccgacgtgatcgggctgcaggaaaccaaggtcgccgacgaccagtttccccaggccgagatcgaggcgctcggctaccacgtccactaccacgggcagaaaggccactacggcgtcgccctgctctcccgccaggcgcccctggaactgcatcgcggcttcccgagcgacggcgaggaatcccagcggcgcttcatctggggcaccttcagcgacgcccagggcaacccgatcaccgtgatgaacggttacttcccgcaaggcgagaaccgcgagcatccgaccaagttcccggccaagcagcgcttctacgccgatctccagtcgctgctggagaacagcttcaagcccgagcaagccctggtggtgatgggcgacatcaatatctcgccggaggactgcgacatcggcattggcgaggaaaaccgcaagcgctggctgaagaccggcaagtgcagcttcctgccggaagagcgcgaatggctggctacgttgaagaactggggcctggtcgacagcttccgggccctgaatccggaggtgaacgaccgcttcagctggttcgactaccgcagccgtggcttcgaggacaaccccaagcgcggcctgcgcatcgatgtgatcctggccagccgggtgctgcagtcgcgcttcaaggacgccggcatcgactacgacctgcgcggcatggagaagccctccgatcacgccccgatctggctggaactggcctgaggctcagcccaaggaaaaggctcatcccccggatgagccttcaggcgatcgctacctggtccgggcgatctcgccgacgccgcccccctatccggcgcggggcctttccctcaggcaggattgtccacccgcggccccttcagctccactcgattgccatccgggtcgaaaaagtacagcgaccagccgtcgccctcggcgccgaagcggatttccgcgggaacctgcgggaccaggccgaacccctcgagatgggcgaccagcgcggcctcgtcgaacggctcgatgcgcacgcagaaatggtcgacgttgcgcccttccccacccggagccgcaccgccctcccggccgagcgccccggacaccgcgaccagatcgagcatcgacgtgcccaggcgcagatgggccagctccaggtcgtcgcgccacttcaccaccacgcaaccgaggacatcgcgatagaacgcgatgctgcgttccaggtcgcggacccgcaggacgatgtgatcgagacgttcgacgacgaagggttgcatggtcattcacctcttggaccgtggactatggcaagactttag

SEQ ID NO: 14834 - DNA, 459 bp, Pseudomonas aeruginosa
ttactgacagtgaattatccccgtggatcacctcaccgccctcaaggtcttccgcgccgtggccgcgaatggcggcttcgccgccgcggcccggcagatgaatctctcgccggccgccgtgagcaagaacgtcgccgagctggaagcgcacctcaaggtgcgcctgatcaatcgcaccacccgcagcatgagcctgaccgaggccggcgaagtctaccggcagcgcctggagcgcatcctcgacgacctcgaggccgccgacgccgcgctcacttcgatgcagcagggccccagcggcctgctgcgggtcagcgccccgctgaccctcgccctcacctgcctgaccccggccattccggcttttctccagcgttatccggacctgcgcctggaactgctcctgcaggacggccgccaggacctgatcgccgaaggcatcgacctggccctgcgtggtag

SEQ ID NO: 14835 - DNA, 1422 bp, Pseudomonas aeruginosa
aagacgatgcccgcgatgccacaccgccagcgcgccagtgacaaagacctctggagccgtaccctgagcctggttttcctcggattcctctgttacgccttcccctggtcggtattcgccgcccccttgccgatccccacggacgacacgccggcgctgcgcatccagggttccaacaccatcggcgcgaagctcctgccggccctggtcgagggcctgatggaagaggaaggcctggaggatatccgccgtacccccggagaacgggaaaacgaactccatctgctcggcaagagccgcgacggccgcctggtgagggtggagctatccgcccacggttcgagcaccggcttcgccgccctcctcgaacgccacgccgaactcgccgcggcctcgcgtcccgtcaaggacagcgaagttcgtgccctggccggcttcggcgacctgcgcagcccatatgccgagcaggtgatcgccatcgacggactggcgatcatcctgcatccggacaacccgctggcctcgctgcacaccgcgcaactggcggcggtgttcgccggcgaggtgcgtacctgggaagaactgggcggcaagggcggcgccatccgcctgtacgctcgcgacgagcagtccggcacctacgacaccttcaaggaactggtgctggccagtcacggcaaaagcctggccagcgacgcccgccgcttcgaatccaacgatcggctggcggccgcggtgagcgccgatccgcacgccatcggcttcgtcggcatcgcgtcggtgggccgggcccgcgccttggccatcgccgacggcgaatcgctgccgatggcgccccaggaaagcctgatcgccaccgaggactatccgctgtcgcgccgcctgttcctctacctgaagcccggcgagaagaacccctgggcccaggccctggtacgtttcgcccagggcccgcgcggccaggcgatcgtcacccgcagcggcttcgtcgcgcagaagatccaggcggtgcagatcgcaccgcgcccgcagatgcccgccgaataccgcaagctcgcggaacaggcgcggcgcctgacggtgaacttccgcttccaggaaggcagcgcgctgctcgacaacaaggcactgctcgacgtacagcgtttgctggactacctgcggcaaaatcggaagttgcaggagcgcaccgtgctggtgggcttcggcgatcccaagtccgacgccgagcgctcggtcctgctttcgcgcctgcgcgccatggccgtgcgccgcgaactggcccgcggcggcgtgagtttccgcgagatccccggcttcggcgacgagttgccggtcgcccagcaacgaccaggaactgggccgacagaagaaccggcgggtggaagtctgggtctactgaacgctgtagccactttgtaa

SEQ ID NO: 14836 - DNA, 1491 bp, Pseudomonas aeruginosa
cctcgccgttttgccggcgcccggagcctggtttattttttccgagtgactgcgggcccctctgacggtaagcaattgccgccatgtcggagtcacatgaccatccgacaattcgaagcgagggggcccaatggcagctctgcatgcatttctcaccgaaccgttcctcggtacggctacctggttctggctggccttcctggccatcgtcatcgttctcctggtcctcgacctcggcgtgctgcaacgcgaccaccacgaaatcggcgtgcgcgaaagcctgctactgtccgccggctacttcgcctgcggcctggccttcggcggctgggtctggtacgccttcggccccaccagcgcggtggagtactacaccggcttcctggtcgaacagtcgctatcgatggacaacgtgttcgtcatggcgatgatcttcagtttcttcggcatcccccgccgctaccagcaccaggtgctgttctggggcatcctcggcgccatcgtcctgcgggcgatcatgatcggcctgggcgccgcgctggtgaaggagttcgactggatcatgtacgtgttcggcgccttcctgctgttcagcggcgtgaagatgctgttcaacaagcacgaggaagaacccgacctcgagcacaacccggtgctgcgtttcctgcgcaagcacatgcgggtgaccaaggaactgcacgagcatcacttcttcgtccgcctgccggacgccagcggcaagctggtgcgctacgccaccccgctgttcttcgccctggtgctgatcgagctggccgacctggtgttcgcggtggacagcgtgccggcgatcttcgccatcacccaggacccgttcatcgtctacacctcgaacatcttcgccatcctcggcctgcgcgccctgtacttctcgctggcggcgatgatccaccgcttcgtctacctgaaatacgccctggccctggtgctggtgttcatcggtgcgaagatcatgctccacggtgtgatcggcaagattcccgccggcctctcgcttggcgtaaccttcggcctgctggcgggcggcatcctgctctccctgctgaagacccgcacgccgaaagccaccgtcgaggacaaggccgaaccgaatgccgaacacgctctggatcgaacgtctggacacccacgctgaacctttctggcgggtccgcctcggcacgcgtgggatctgcttccgcaacgagcgggcggcccgcgagttcgccgccctgctgcacagccgtcgcgcgtggcagctggaacgcaacgccgaggaaaaaggggcggagtccccggaatgaaaaaggcccgcacccgcgggcctttcccctataccacagccgtcagcggctgctgcgcagcatctccctgggcacgtacttgcccagctcgaacttgccgatcgccgcgcggtgcacctcgtccgggccgtcggccaggcgcagggtgcgctgcatggcgtaccagtaa

SEQ ID NO: 14837 - DNA, 978 bp, Pseudomonas aeruginosa
caagaaaagtcgcggagccagtgccatgaacctgaacaaagtcgacctgaacctgttcatcgtgttcgatgcgatctataccgaagccaacctgacccgcgccgggcagatcgtcggcatcacccagccagccgtatccaacgccctttcccggctgcgcgagaccttcaacgacccgctattcgtgcgcaccgcccaaggcatggtgccgacccctatggcgcagaacatcatcggcccggtgcgcaacgcgctgcagttgctgcgggtttcggtgcaggagagccgcagcttcgatccgcagcaggcgaacaagacctaccgcatcagcatgaccgacctcaccgaagcggtcatcctccccccgctgttccagcgcttgcgccgcctggcgccgaacgtgcatatcgagagcttcctcgccaagcgccgcgagaccaccaaggaactcgccgccggccgcctcgacttcgccgtcgacgcgccgctgaacaccgatccccaggtgcgccacgtcaagctgatggaggaccgctacgtctgcgccatgcgccgcggccacccactggcgggcaagccgaagctggccctggacgattacctgggcctgacccacatccatatttccagccgccgcagcggcctcggctacatcgacctggcgctgggcaagatgggcatccagcgcaagatcgcgctgcgctcgcagcactacctgatggcctccacggtggtccagcagaccgacatggcgatgaccgtgccggaacgcttcgcccgtcaccacgacctgcactacgcggtgctgccggtgagcgacgtgccgaagctggaaacccacctgtactggcacgagagcaccgatcaggacccggccaaccgctggatgcgcgagcagatcatcgagctgtgccagcaggtcaccgcgcgcgagaacaaggcggcgcagccggcgtgagcgcctgccaaggggcgtag

SEQ ID NO: 14838 - DNA, 1260 bp, Pseudomonas aeruginosa
tcgccgctacaggctgcgcgcgatcaccaggcgctgcacgtcgctggtgccctcgtagatctggcagacccgcacgtcccgatagatgcgttccaccgggaagtccttgaggtagccatagccaccgagggtctggatcgccgcggagcaaacttcctcggccatctccgaggcgaacagcttggccatcgaggcttcggtcaggcacggcaggccggcttcgcgcaggctggcggcgtggtggaccatctgccgcgccacggcgatgcgggtggccatgtcggccaggcggaaggccaccgcctggtgctcgatgatcggcttgccgaaggtttcccgctcatgggcgtagtcgcgcgccgcctcgaacgccgcgcgcgccatgccgaccgcctgggcggcgatgccgatgcggccgccttcgaggttggccagggcgatgcggtagccctcgccctcctcgcccaggcgcagcgtggccgggatacgcaggtcgttgaaggccagctggcaggtgtccgaggcgtgctggccgagcttgtcctcgatccgcaccacctcgtagccgggcgtgtcggtgggcacgatgaacgcgctgatgccgcgctttccggcatccggatcggtgaccgcgaagacgatcaccatccccgcgtggctgcccgaagtgatgaactgcttggcaccgttcagcacgtagtggtcaccgtcgcggcgggcgcgggtcttcaggaagctcgcgtcggaaccggcctgcggctcggtcagggcgaaggcgccgagcatcgaaccctgggccagcggacggaggaagcgctccttctgctcggcgctgccgaacttgtggatcggcatgcagccgaccgagttgtgcacgctcatgatggtcgagcaggcgccgtcgccagcggcgatctcctcgagggccatggcgtaggccaggtgcccggtctgcgcgccgccccattcctcgggcaccagcatgccgaggaagccgaggtcggccatctcgcggattgcctcggccgggaaacggtgctcgcggtcccagtcggcggcgaacggtttcagccgttcctgggcgaactgccgcgccatgtcacggatctggatctcttcttcgcagggaatcatcgcgggttcctcttcttcactgcctgcatcagcgcaagcgctcgacggcgatcgcggtcgcctcgccgccgccgatgcagaccgccgccacgccgcgttccaggtcgtactgctgcagggcgttga

SEQ ID NO: 14839 - DNA, 825 bp, Pseudomonas aeruginosa
cgatcggatcttcgcgggtcatgggatcttcctcctgtattagcgggcggccatgcggatggcgccgtcgaggcgaatcacttcgccgttgagcatgctgttctcgatgatctgccggaccagcgcggcgtattcgtccggacgccccaggcgcggcgggaacggcacgctggcgccgagggagtcgcgcacctcctggggcatgccggccatcatcggtgtctcgaagatgcccggggcgatggtcatcacccggatgccgaagcgcgccagctcgcgggcgatgggcagggtcatgccgaccaccccgctcttcgaggcggaataggcggcctggccgatctgcccgtcgaacgccgccaccgaggcggtattgacgatcaccccgcgctcgccgccctcgtccggctggccctgggacatggcctcggcggccaggcgcagcatgttgaaactgcccaccaggttgatgtcgatgacccggcggaaactctccagggcatggatgccattgcgtccgaggaccttctcggccggcgccacgcccgcgcaattggccaggccatggaggccgccgaaggcctccagtgcagcggccacggcctggcggccgtcggcctcgctggcgatgtcggccctgacgaagcgcgcctgggcgccaagctcggcggcattggccgcgccggcctcggcgttgatgtcggccagcaccaccttgccaccctgctccaccagcatcttcgcggtggcggcgccgaggccggagctgccgccggtaaccaggaacactcgattttcgatacgcacgtcgttttctcctgctga

SEQ ID NO: 14840 - DNA, 918 bp, Pseudomonas aeruginosa
ttcatggctttcccttgttgtggttgttctgggaatgtcgctgaaccgtcgtcctgcgccgccagggcgctacgacggacaccggcgagcggtgtcggtgaagtcgaagagcatgtttacgttaacgtaaaggtaaacgcaagaggcttatccgcccagggccgtcggccccggcgcggcccaacggaacggcgtagaatgggcggtttttcacaggagcacagcatgaccccggaaatcgccatcggcctggtgacggccctcggcctcggtgcgctggtcggtctcgagcgacaatggcgacagcgctcttccggcatggccacccacgcgatggtcgcactcggtgcggccagcttctcgatcctgccgctgttgctcgacaacgaagtcagcgtgacccgcatggcggcccaggtagtcagcggcatcggttttctcggcgccggcgtgatcatgcgcgacgggctcagcgtacgcggcctgagcactgcggcgagcatctggagcaccggcgcgatcggcgtactggccggcagcggtttcatcctggcggcctgcatgacgaccgcgctgatcgtcatcgccaacctgttcctgcccgctctcggccgggtggtggaccgccacacctcgggcgaggccgagcaggagcgcttctaccagatcagcgtgtcctgcgaggcgcgcaacgaagcgctggtgcgcatgcagttgctgcaacgcatgggcgacaaccgcctgaacctgcagagcctggaaagccacgcgctgaaaggcagcggcaacgtggaagtgaacgccgtggtgttcaccctgcacaaggaggattcgctggtggaacagatggtcggcgagctgtgcctggcaccgcaggtcaccgccgccagttgggtgatgaatcccgccgcggaatga

SEQ ID NO: 14841 - DNA, 1845 bp, Pseudomonas aeruginosa
cattcgtcacagagattaaccgaagccccgcagaacatccatgccagctatttcccttcgtcggctctggcccggcccctgcgtcgtcctcaagttgtcagatccgctgtcgatactctgcgtgccggaacacgcgccatgcccgcctcgccgggccacagggacgtcctcggctgcctcgtcgcagcctgcgtgccggtccaacctggcaatccatcgaggcgttccatgctgcaacaatccctacgtgcgcaaatccttgtcctgctcggcggcagcctggcggcgctgctactcatagccctggcctgcttcggctcgctgaccggcgacgtacgcgcctaccgcgagctgctcggcggccccgtgcgggcggcgcaactgatcgacgaggccaacctgcaattccgcggccaggtccaggaatggaagaacgtcctgctgcgcggacgccaggcagaggcccagacgaaatactggagccagttcgaagcccaggagcgagcggtgcaggacatcctcgggcgcctgggcagcgtggccgaaggcgagttgaaggatcgtgtcgagcgcctgcgcgaagagcaccggcgactcggtacggcttaccgacaaggcaggcaacggttcctcgaggcgggcgccgaccccatcgccggcgaccaggcggtgaccggcatcgaccgtgccaccaccgcgcagatgcaggccctgcgcgacgaactgcaccaggccagtgatctccattcctcctccatcagcgcggaggcccggcgcaccatgctgctcggcagcctggtgctgatcggcgccagcctggccgtcgccctgctcagcctgtggctggtcaaccgcaacctggtccgtccggtgcaacgcctgatcgagcacatcgcccagctcagccatggcgacttcggcgagcgcatcgagatccggcgcaaggacgaactcggcaagctggccctggccgccaacaccctgcgcgacttcctggtggacatcttcgaccggctgcggcgcagtacccgcgacctggacagcgccagcggctcgctgaacgcgatcgccagcctgatggcggccggtacccgcgagcagttcagccgcaccgaccaggtcgccacggcgatgcaggaaatgtccgccaccgcccaggaagtggcgcgctacgccggcgacgcggccagggccgccgacgaggcggacgattccgcccagcgcggcgaagacgtgatggaagaaacgattcgcagcatcggcgagatgcgcaaggagatcgaccatacggtggaggtcatccgccaattggaaagcgatagcggcaggatcggcaaggtcctcgacgtgatccgtggcatcgccgagcagaccaacctgctcgctctcaacgcggccatcgaagccgcccgcgccggcgatgccggccgtggcttcgcggtggtcgccgacgaggtccgcaccctggcgcagcgcaccgccgagtccatcgccgagatccaccagatcatcgataccgtgcagaacggcgcggtgaatgccgcgcgcgccatcgaaagcgggcagtcgcgcagcgaggccggtgccgagcaggttgccaacgccggcgccatgctgcgccagatcaccgcctcggtcgaatcgatccgcgacatgaaccgccagatcgctaccgccgccgaggaacagaccgccgtggccgaggacatttcccgcaacctcacggaaatcgcctcgatcgcctccagcaaccaggaacaggtggagcagaccgaagccgccagccgcgatctccacggcctctccgcgcaactgggcgatgccctgcaacgcctgcgggcctga

SEQ ID NO: 14842 - DNA, 2076 bp, Pseudomonas aeruginosa
cgagcggtgatgctggccgatataggaagagtccgtttaccaggtaatcgatttcgcagagctggcgtcggcgtcgaaggccgtaccggcatgaccgcgatcaacctccacgccctttcatcgctgcaatctgggaaaagagcccgcgctccacgaaataaaggcacaatgacatcattgattgccgatgcccgacatcgcagtagcccaggagtccagcatggcaaccccaccctatcccgaggacgagcattcgagacaggcctacgtcgaccaactcggtctgctggaagaaggtgcggacgaggtattcgaggaaatcctcgccgccgctacgtcctacttccagacgcccatcgcgctcatttccatcctcgaccatcagcgccagtggtttcgcgcgagcatcggcctcgatatccggcagacgccgcgacgggattcgttctgcgcctatgcgatcctgggcaagggagtattcgaggtggccgacgccaccctcgacccgcgcttccgggacaacccctatgtgcaaggcgaaccgcgcatccgcttctacgccggggctccgctggccaccgcggaaggtctcaacctcggcagcctctgcgtcatcgaccgggaaccacgcgggccgctggccgagcgggacgtcgccatgctcgagcacttcgcccggctggtgatggcccgtatccatacgctccgctcgaccaactacatcgacgagccaaccggcctgtacaaccgtctccgcctgcaggaggacgtttccctgcgcctgcagcgcgacggcgccctcaccgtgatcgccgccgacctcctgcccctcgccctgctgaataccatcatccgtacgctgggctatcccttttccaacgacctcatgctcgaggcgcgcgaccgcatccgcgcggaactgccggatttcactctctacaagatcagcccgacgcgcttcggactgctcctgccacggcagcaacaggaagaaaccgagtcggtctgcctccgcctgctgcgggccttcgaaagccccgtcgtatgtcgcgggatcccgatcaaggccaacgtgggcctcggcgtactaccgcttgccgacgatcccctcgacggcgatcaggactggctgcgcctggtggtcagcgcggccgacgacgcccgcgaccgcggtgtcggctgggcccgctacaacccgccgctggaccaggcccagcagcgtgccttcacattgctgacctcgctgtcccaggcgatcggaaccgaagaaggcttccatctggtgtatcagccgaaaatcgacctgccgacaggcaggtgcacgggcgtggaagcgctgctgcgctggcggcacccgcaactcggcttcgtcagccccgccgaattcgtgcccctggcggagaaaaccgcactgatgcgccccctcagcgactgggtgctgcgccatgccatggcccagctggcgcaatggaacgcacggaacatcccgctcaggctggcgatcaacgtatcggcatcggacatggaagacagcagcttcctggaagaggccgtcagactcgccaaaacctacaacatcgacctttccgccctcgagctggaattcaccgaaagcgtactcatccgcgacgcctcggcggtcggctcggtgctgctgcgtgcccgggagcttggcatgggcatcgcggtggacgacttcggcaccggctacagcaactggacctacctgcgcgatctgccaatcaccgccatcaagctcgaccaatcgttcacccgcgacctcgccggctcgccgaaggcgcagagcgtcacccaggcggtgatcggcctggccagccagttgggttatcgggtggtcgcggaaggcatcgagacccacgacaccttccacctgctgcaagcctggggctgccacgagggccagggctatctgatcgcccagccgatgctgccggagcaactggaggactggctgcggcgttagccaacgcaggcacgtggagtgggccgtaccagcatgctcgccagcctcggcgcgtcgctcagggactggcgagcaaggcccagaccagatag

SEQ ID NO: 14843 - DNA, 330 bp, Pseudomonas aeruginosa
attcctgttcataaacgaaagaggcgaaaaaccctgattcgcgatccttccctgtcagcaaagcacagcaacgaggaagtaccgcctaccaattcatgcaggagaaaagaggataattccgccagtgaattgaatatattcggaaaggaaattaaaaagcaggagcagaagataacgacaaaaaatcaaacttccaaagacaactacttcaagctgaacaaacactcccgctcgccagccagggcgaaccctatacggagccgtactagaatgaaaagcctccaaggccgaggagggaaagaaggcaacgtcgactcgttgactcgttga

SEQ ID NO: 14844 - DNA, 1626 bp, Pseudomonas aeruginosa
tcgccttcgaagcgatcgaaggcgcacgctacacgctgttcgtgcgcctcccggagtcgacgacctaggcggctcccgtcagatcttgaagcgctccaccgacgagcgcatggtcgctgcaacctcgttcaggcgcctggcggtggcggccatctcgtgcatcgcctgggtgttctgctgcgaacgctgggcgatgagctccacgcgctgggcgatttcatcactggcgcgcgactgctcgcggatggtctgggaaatctcatcgaccaccgacgcggcatgacgggttccatcgaggatctcgttgatcgacacccctgcctggcgggcgaacgacaccccctcgttgacccggctcacgccggcctccatgctgttgatcgcttgccccgtgctggcgcggatgcgctcgatcatcgcggtgatctcctgggtcgactgggtggtccgcgccgccagcccgcgtacctcgtcggcgaccacggcgaaaccgcgcccggcctctccggcccgcgccgcctcgatggcggcgttcaacgccagcaggttggtctgctcggcgatccccttgatcacctggatgatcgaatggatctcgtccgacgactggccgagagcggtgatgctggtggaggactggttgaccacgtcggcgatgcggctcatcccttccaccacgttgaggatcacctgcccgccactgctggccagctcctcggacttggccgagatcaccctggcgttgtcggcgtggtcggaaatctgcgagatattggtgatcatctcttccatgctcgcggccatgctggtggcgctgtcggcctgttggctggcaccgtcgacgatcgactgcgaggtctggccgatggattgggaggtgtcatggagctcttcgctttcctggcggatgatggtgatcatctgccgcaggttctcctgcatctcgcccaaggcccgctgcaactgtccggcctcatcgtcgctgtcgacaccgatcggctcctgcaggttgccctgggcgatcacccgggccgaggcgaccagcttgcgcagaggcttgaggacggcgcgcagcaactggcgacaaagctgcccgaggaccaggcaggcgaccaggatgccgcccgcgagcatccaggcggaatagcgcatgctgtcttcgcgcgcccggttggtctgctcgacgtgtttctcgatcaggctgctgagcgcttcgttgcgcccttccagctccttgaaggcctggacgaactgcggcagctcggcccgtgccgccacgggatcgagcaacgccttgccgacgatgctctcggcggcgccgatgtaggcttccaggtcgggccgcaactcgaccagcgcctggtggatggcgtcgttgagaggcagcccctggttctgctcgaccaccttgcgaaaccactggctgtgctcctgcaggtcctggcggacctgctcggccgccgcgccgtcgccgggctggaccacgaacgccgccaggacgtcggcgcgcaaggcgtcgtgcatcatgtcgccttccatgtggttgcgcagcgcattgacgctcagctcgttctccgacagcgccttgcccaaccgcaattgcccccagaagccgaccccgcctag

SEQ ID NO: 14845 - DNA, 1431 bp, Pseudomonas aeruginosa
cagcaccacagccacgatgccgatggcgcccgaagcgaggattctctgccgaatgttcatccctgggctcctttccgtgccgagatatcgctaaggatagtcaaccccaggcaaggcgggattgcccgaacgaagagctattcgggcacggagcggggacgccggccattctcaggaagctgccggccgctcgctctgttcggccgtcaactggaactcttcgcccgcatagtaggcccgcaccttggggtccatgaccgcccgccacagcggcgggatcagcgccagcaccaccatcccggcataaccgctgggcatctgcgggctatcgtcataatgacggaggacctgataggggcgtttggcgaaggcatgatggtcggaatgccgttgcagatggaacaggaccaggttggtgaagacgaagttgctgttccaggagtgggtatggttggtccgctcgtagcgcccgtcctcgccctttcgccgatgcaggccgtagtgctcgacgtagttgatgatctccagcagtgtcaccgcgacgaacgcttggccaaggaagaaaaccatccccagccagccgaacgcccaaccgaaaccgaccagcaacgccaggctcagcaggtaccaccagatcagttcgttctgccagccgaacaccggcaggcccttcttgcgcagccgcaccgcttcaaggcgccaggcgttgaggaagttgtacttgtaggcatgcggcaggaactggtagaccgactggccgaaacgcgccgacgaagcgtcctccggcgtagacacatgcacatggtggccgcgcacatgctcgaccttgaaccccgcgtagcacacggcggccagcagaatgccgccggcagcctgctccagcgccgagtccttgtggatcagctcatgggcgacgacgatccccaccgctcccatcaccgtgcccatcgagaggatccagcccaaccggccgagccagccccactcctggaaagcgacgaacacgccagcggcccacaccagcgtaccgatgagcaccggcaccgtggccagggtcagcaatacgtaatagccctggccgagcaactgcggcgtctgcgtttcctcgtcggggttggccgggtcgcggccgaacagcatgtccagcagcggcccgatgccgaataccgcaatcaccagggaaaatgcccagaaggccggatgtgcgctgtcctgggccatccagtagttgaacggcatggacaacgccagcagcagccagagccaataggcgtacttcttgatggccagcatggtgctgggagagaaattttcaaacatcgtgcgctccagtttttgtccgacaatcctacaatcgaaccatcaccgagccgggctgccaggtcaccatcactaaaggttggccgcctccccggccttcaccctgcttga

SEQ ID NO: 14846 - DNA, 1227 bp, Pseudomonas aeruginosa
cgcattcctctcctccatcaagaaccgccgcaccatctacgccctggacaagcaactgcccgtctcccaggagaaaatcgtcgaactggtcaaggaggccgtctcgcacagcccttccgcgttcaactcgcagagctcgcgggtggtcgtcctgttcggcgccgagcacgagcagttctggaacatcgccaaggacgagttgaagaagatcgttcccgccgacgctttcgccgccaccgaaaccaagctcaattccttcgccgccggtgccggcaccgtactgttcttcgaagaccagacggtagtgcgccagcttcaggagcagttcgccctctacgccgacaacttcccggtgtggtcggagcaggccagcggcatggcccagttcgcggtctggaccgccctcgccgagcacaaggtcggcgccagcctgcagcactacaacccgctggtagatgcgcagacccacaagacctggaacctgccggaaagctggaagctgcgcgcacagatgcctttcggcgccatcgccgctccggcgggcgagaaagccttcatcgccgaaagcgaacgcttcaaggtcttcggcaactgatcggccgagatcgccgtagaaaagccccgcctcgtcgcggggctttttctttcccccgcgcctcagccgcgacgcaccgccggcctcggcaggcgcacgctccaaccctgctgcatgcccgccgcggcgagcaggatggcagccacgccaagccactgggccaggctcaggcgatgttcgaagaccagccagtccaccaggatcgccgcgaccggatagatgaaggacaaggcaccggtcagcgccgtcggcaatttctgaatggcgccgtagagcagtacgtacatcagcccggtatggacgattcccagggtcgccaggctggcccagggagcaacgtcccggggcagttcggcaaggttcgccagcggtgcgagcatcagcacgccggtgcccacctggatcaaggcgataagatgcggcggcgtgccttgcaggcgcttcacgatcagcgcggcaaaggcatacagcagcgcggcagcgagcgccaggaggataccgaacaggtagtccccgcgcggggcgtcgctgtcgccgtgggcgctgacgatcgccagcatgccggcgaacgaaagccccagccagcccagcttgcgcgccgtgaccttctcgccgagaaacgccgcgcctag

SEQ ID NO: 14847 - DNA, 459 bp, Pseudomonas aeruginosa
aaaaaaactttcgaggccgacatgaccgacgacatcgaccaacgcctgatcaacgccctcatggctgactcgcgactgtccctcaaggctctcgcccaggtcagcgggctatcggccccgagcgtcgccgaacgcctgcgcaagctggaagaacgcggcgtgatccgcggctacaccctggatgtcgacccccgctgtttcggctaccagttccaggcgatcgtgcgcatccgccccctgcccggcaggctgcacgaggtcgagcgacagatccaggacatcgccgagttcaccgagtgcgacaaggtcaccggtgacgactgcttcatcgcccgcctccaggttcgttcgatggaacagctcgacacgctgctggacaggatcaacggctacgcggaaaccaacaccgccatcgtcaagaagtccccggttaaacgccggctccccccgatgacctga

SEQ ID NO: 14848 - DNA, 717 bp, Pseudomonas aeruginosa
gcctcgtcccgagagcctggatttcgacccgccactccatccagcgaagcgacacgaggcccgccgtcgaactcagccggcgcgcccgaacaccctgtccaggtgcgcctggtaggcagcgacggtagccgggacgtccgggcgcttcatcacatccaccgcgaggaacgtcggcaggccggacatgccgaggaactggttggccttgtggaaggggaaatacaccgcatccacgcctttcccttcgaagaagtcgctcgaatcgtcgaacgcctgccgtggtgcattccaggtcgccgagatcatgtagcgcttgccctgcaccagaccgccgctgccatatttctgcgtgctgtcggagcgggtacgaccgtcgttggcatagaggctgccatgaccggccgtgaagacttcgtcgatgtagcgcttcaccgtccacggggcgcccatccaccagccgggcatctggtagatcaccacgtcggcccagaggaacttgtccacctccgtcgggatgtcatagccaccgtcgatgaaggtctggcgcaggtcgaagccacggcggtccagatgggccagggcggtttcgtgcagggtctggttgaggcgaccgtcggaatgtgcgaaacgctttccgccgttgagcaggagaatgtttttcatggtgttccgtacatgctggaaccgcagcggagatgcctgccgatcccgggttga

SEQ ID NO: 14849 - DNA, 1050 bp, Pseudomonas aeruginosa
ggatatctcatgaaaaccatcgctcggcgtctgagccccttcgcgatcctgctcccggcaagcctgttgtcagcctgcgcctccctaggcaacgccggactcggcggctcccagcagaatcccaccaaccagctcctgaacatgatcgatgaggctacccgcgaaggcatgtccgtggtgctggtaccggcgctcatgcccaacaagagcgtgacggacctctccagctactcgcatcgggtcatattcaagaacaaggacgtgcccgggatcgcctacatgcaggcctttgccaacaacgacctggagaagatcaaggaagccgtctatctgtgggacttcctcgaggtcaacatcgtcccgccgggaacctacctgctgtccggagggatcgactacaagatcgacagcacccttgcccagatcaaggcgccaaaggggcagccggctgccagcccacttggttcggtgaacctgtccgccgtgctgtatcgccggttcgtgaaggagaactactggcgcgacgcctcctatgcagacaaaacctacacacagaatgtctgcagcgccgtgcacatggcctccggccaatgcgtgggctggaccgagcagcaatacagccagcgggaaatggtctcggatgccggttgggccgaaggcacgaagatcgaggatgtcccctccatcaagctgcaagcgcagatacccgacgcctatgccccgctgtccttcaccattcagcctgggcagatcctgctcagcgatcggttccacttgaagaccccggccgtgagctatgacaggaagacctgcaaggccgtggacacgcaaaacatcaagtgcgccttgcaggatatccaggtcttcatgaggcccgcgcccatggagctgacgaaaaggttcatcgatcgcgagcagccaaggctggatgaaacgggccgccaggtgctcgcgcggatccagccgatgaaaaccgagatactcggcgaagcaggcatggaagacctgacctggggcctgccggtttccttgaaacgcaaggcaagatga

SEQ ID NO: 14850 - DNA, 507 bp, Pseudomonas aeruginosa
ccctttgatttaaaaagatttttagctcacccatcgctggaatggacgcaattatggacggattcgccgagcttggcaagcgctctacgaaaaaaactttgcagatcaggctattgcgtagcacaagccgggagaaacgggcccagacgtccgcgaaatgggcccgcagcgaccggcaaccgaggagcgcgccaggatccgacgcgccctgccccggcgatcagttcgcctcggggctcgcttcggttgcgggcgcttcaggcgtcggcgcctccgtggcggccggcgcctcgccacccgcctgtgcacgcttggcgcgcttctcgcgcatctgctcgcgctgccggcgagacgcctgccgccgcgcatacaccgcctgctcggcggttaccttgccggcaacctggccttgcagatccagtcgcggcgcatcttccaccatacaactccagtagcggctgccctggcaccaggtggcgatggcctgtttcagttgttcggcggtga

SEQ ID NO: 14851 - DNA, 549 bp, Pseudomonas aeruginosa
cgtgctggaaggctggtgcgatccattcccgggctattacctccatcacccaagtcagaggcaaccttcgccgaccttctcagtggtcgtcgaagcgctgcgataccgaagcgctggccttgggacggctcggtcgaacgtggcagccaaagcaacaggcgcacgaaggcggtccaaggtgcaatgaatcgagcccccctggagtgcgacagccacacttctgatgtgccgaggcagcatcttgcggcaagccgcctcgctggcgagacgaagggcttcgcgaaacgtacggccccggtcgccgggaaagcggcaaggagaaccgcccctcggcgcggacgctccacgaacgggtacgggacttggaggcggaacgaaaaaagggcccgaaggccctttctcaatgatctacagacttcattggaactctatagatctatatttggagcgggaaacgagactcgaactcgcgaccccgaccttggcaaggtcgtgctctaccaactgagctattcccgcatcgtcttggtgacgggcgccattctatag

SEQ ID NO: 14852 - DNA, 321 bp, Pseudomonas aeruginosa
ccggcggcgccggcctgcatgaggcgggtggggaacggatcctcttcgcagacggtgactaccacgaccttgatgtcgggctggctgcgcagcagcttgcgggttgcctccaggccgccgataccgggcatcttcacgtccatcaggacgacatccggcttcagttcgcgggccagtttcagacagtcttcaccgcagtcggcctggccgaccacttgcaagccttcgatgtcggccagcatgcgggtaataccggtgcgtaccagatcgtggtcgtcgaccaccagcaccttaatcacgctgcacctcgtcgcgcattag

SEQ ID NO: 14853 - DNA, 1032 bp, Pseudomonas aeruginosa
ccgatgagcccgtccgaaaacatccagtacgatttcgagtggcgaccactcaacaactacctcgccgtgcaacgcatcacgcctccggacatgcgtcagggttcggctgccgagccgcgcctgcccagcgaagcgctctacgagtggatcgtgctgaacggacgctcccccctggaaggcctgagcctgggggagcactaccgcctttccgactacggcgtcgccgggctggcattgcagagtgccggcaccgtgggcgaagccttgcaactgatcaagaccaacatgctgctgttccgcaaggatatccgcgggatcgcggtgcgacgttccagttgcgacaccgtggatgtggatatcgacctgcaggacaagccggactggccgcagtcggcccggctgtatcacgccaacgtcctggcgtcggccgcctacgcggtgttccgcgacctgctgctgggcgagctggaactggtccgcctgcgcctcccggaaaggaacggcgacgtgcgggcatacgaggagtatttccgggtgccggtgtatttcgccggcgcaggcatcaccttcaccctccccgaggaattgctcgaggccgagatcgccactgccaactccgccgtgttccaggcctcgctggcgctcggcagcaaggccttcaacacccgcgtcacccgcgagatgggcggctaccgccaacgcatcgtggcactgctggaggtgctacaggaccgctacccgagcatcgcctgggtcgcccggcagttgaaggtcaccgaacggacgctgcgccgacggctcgccgacgagggcaccaactaccgggaagtgctcgacctggtccgccacgacagggcgcgccaactgctgcgggacgagcgactgcgcatcgaggaagtcgccgagaggctgggctacatggatacctccagttttcgccacgccttccgtcgctggacgggacagtgcgccaacgactatcgccaggcccgcctcgccggcaagaccgcgcggcgccagggcgaacgctag

SEQ ID NO: 14854 - DNA, 729 bp, Pseudomonas aeruginosa
accgctcggtgtgtcgcccaccaggaaccaggccatgccgagcaccgccgccagggcgaagggcaacgccacccgaggcgtcgccacgcggtcgagaagccagcccatcagcggctgcgacagcatcatgccgacccacaacgccgacagcgcggtgcccgcctcgccccgggacaaaccgcgctccaccagcatcggcacgccatgggtcatgatcccggacatcacgaacaccgccagtacctgggttgcccagcaccagccagaaactggcgctgcgccaggcctggggcgccgtcgatccgctcagcgcggtttccgctacggccgtgccggcggccacgccagcatccggcgctggctcgcggaacagccaggccagcagcggcagcgccaggcccagttcgagcacgccgtagaccaggaaagcgccgcgccagccccacgcttcgaggctctggtggccgaccagcaggcccagcggcccgcccaccccgaagcccaggcctaacaggccgtaggccacgcccaggcgttggcggaaccagagtccgaggatacgtccgtaaggcaggttgcctggcgccagcaggccgatcagcaggaacagcgcgtagagttgccagacggcattcaccgccgccaggccgagcagcggcagcgacagggccgcggtcagcccgagcattgtccgccgcgcgccccaacggtcgatcagccagcccttga

SEQ ID NO: 14855 - DNA, 366 bp, Pseudomonas aeruginosa
tcaaggcgggcgtcctccaggaactcgaccgcgaccggctcccccactggaagaacctcgacgcggacatcctcgggaagcttcaggccaacgatcccggcaatcgctatgccgtaccttatctctggggaaccaccgggatcgcctacgacgtggacaaggtccgcaagctgctcggccccgacgcgccggtcgactcctgggacctggtcttcaaggaggagaacatctcccgcctcagccagtgcggcgtggccacgctggactcctccaccgagctggtgtccatcgccctcaactacctgggcctgccgcacaacagccagaatcccgaggactaccagaaagcccaggaactgttgctga

SEQ ID NO: 14856 - DNA, 1404 bp, Pseudomonas aeruginosa
gtgcttcggcgaggggggcggcggcggggaattcgaaccagcggatgtcgtaggtcaggtcgtccagcgcgccggcagcctccaactgggcgcgcatgttgcccttctggtcggccaggcgcagggtcacgcgctcgtcggcacaggcctggccgacgagcaggcagagaagcaggaacaggctcagggtctgacgcattccgtaactcctcaacgctggccgacgcggaggtcggcgggcaactggcgggccacttcggcggcaccggcggacaggctgaagtcgaacgccggggcgacctccagcgacttcggcagcacgccttcggcatggaagaaatcggcggcggtctgcagggtggcggcaacctccggaccgaagaccacaggactgatgcgcgcctcgccaacccagcgccgagtgacttcgcgcggcatgttcagatccttggccagggcctcggcgaacgcctccgggtgcctcagggcccaggcctgggcacgcgccaggcgggtcagcaggtcgctgatcgcggccttcttgcgggcgatcgcagcgtcgctggccagggcataggagtagccggtcatgatcccggcaccgttgtcgatgacccgcgcctgatcgagcagcacggcgctggaggtatagggctcccagggcacccaggcgtctaccgagccacgcaccagggcggcgcggccgtccaccggaccaaggaaggaaaagcttacgtcctgcggtccgaggccggcgcgacgcaacgcgccaagggcgaggaaatgcccccagccgccgcgattgacggcaatgcgcttgcccttgaggccggccaccgaacggatcggcgagtccttgccgaccaccagcgccacggtcgccgggttgaagtgccaggcgcccaccgccttgagcggcgcgccggcagcgtagacgaagaggaacgggatgtcgccggtaaagcctatgtccagggccccggcgttgagcgcctcgagcaccggtgcaccggaggggaacgccgacatttccagcttgtacggcaggtcgtcgagctcgccggacgcgcgcagggcggcgtagcggtcgcccttcacatcgcccaggcgcaggctgatgaggtcggcggcgctggcggctccagccagcagggtcgcggccagcaggccggcaagcacacacaggggtcgtttcatgggcaatctccaggcagctccgcacggagccggggctatcctgggctatccgttccgccggtgcggtcgccgacaaggccagggtcgagaatcgtgggaggtacgtttcaaagactcagcgccgccctccccgccgcgctccagacgctatctttcctgtggcgtgtggacacgtccgcaaagcacgtcgcggtagtgccgctgtag

SEQ ID NO: 14857 - DNA, 657 bp, Pseudomonas aeruginosa
cggattgtgccggctgaggccgtggttgccgctcagttccagggcctcctcgaccaccgccaacgcgttgtcgatgaccgcgaccttgagcagcccggagtcgctggcgggcaactgtccgcagcacgcggcatcgagcagcaggcggttctgcaggagcaggccgtcgatctcgccgagcgcctcctgcatcctcggcaggctcgccaacggcgcgccgagactggccggcacgcgctcgcgcagccagccgacgagccactcgcgggcgctcccggcgataccgtcgtagagagcgccaagcaacaccgcgctagcctgggcgaagtcgcgcagcacggcctggtccggcgccggaggctggtcgtggggatgcaggccgatggcgttttccagaggcaccgccacctcttcgaagagcacctcgtggctgccgctggcgcgcatgcccagatggtcccagctctccacgatacggatgcctgggctgtcgcggcgcaccagccaggtacccacgcgggggatcggctcgtcgctgcgcgcccataccgccagccaggtcaggccgggaatgccggtggtgtagagcttgtgcccggacagctgccagccgtcgccgacacgccgcgccagcgtacccggcagaccgccgcgtga

SEQ ID NO: 14858 - DNA, 582 bp, Pseudomonas aeruginosa
gtttcatcggagctcctcaaccggcgtgccgcaacagcggcaggcgggcgatatggtcatgtatggcgggaatcaggccctggccgtagcgcacggcgtcgccgagcggctcgaagcctcgaatcaggaaggtcgagacgcccagccggtagtactcgccaagcgcagcggcaacctgctcgggggtgcctaccagggcggtggagttccagcgcgccccggtcagccgggccacgccggtccacaaacggctgtcgagcacctcgccctgctcggcggcggccagcaggcgctgcgaaccgacgttctgcggctggtggtcgcgcagcggcagaccgaggcgcgcacggttctcgcggacctgttcgagcacctcggcggcacgcttccaggcggcctcctcggtatccgcgacgatcggccggaatgacaccgagaagcgcggatcgcgtccctgggccttggcggcggcgcgcactcggcggatatgcccgtcgaccgcggccagcggctcgccccagagcatgtaggtgtcggcgtgcctggcggcgacctcgatggctgcgtcggaggagccactga

SEQ ID NO: 14859 - DNA, 183 bp, Pseudomonas aeruginosa
tcatgccgagaatttccacgctcacgctgttgccctcgcctgggccgctcgactgataaggttggcggctgtcgttataagaaaaacatctgcatgggtgcttttcttagaagctacaggctgaaactacatgatggaaattcatttttgtcatatcttaatatgctaaacacgcatatttag

SEQ ID NO: 14860 - DNA, 441 bp, Pseudomonas aeruginosa
cagccctcgctccctcttccctctgaagcgaaaaggggctcgcaggggaatgttgatcccgactgcagccccttctcattcacgctcccgtctcccggggatctcccggcgccgctactcaaccggcttgcatatccaacccctcggccaccgccctgccgaacagccgtgccggcgtttccagattgcccagcaggcgcggacgcaccagccagagctggatcagcggctggaaatcctccagttgcagcacccgcaactgatcgcggtagcggctacgcgccagggccggcgccggcaccaggccgagaccccgacccgcggcgaccaggcccagttgcagctcgctgccgaaagtctcgaggttcagttgcaggcccaggccctgatcggccagggcccgttgcaggccggcacggaagccgcagccatcggggttga

SEQ ID NO: 14861 - DNA, 411 bp, Pseudomonas aeruginosa
gcacccagccatggtggtagcaatcgagcaggcgtcgcgcctggatggcactgtcgcgggcgaccaccacgcagagttccatgcgccctaggggcgtggcgccgagttcttcggggaacaccttgcttggcggaaacaacaccactgccgcgtccagttcggcattctccaggcgcgccagcaaatggctgccccagccagtgccgacctgcgcgcgcagctccgggtactcgtcggccagccgccgaagggcatccagcaacaccacctcgccgatactctgcggcacgcccaggcgcagcacgccacttggtgtggcgtcaccggccaccagttcacgcaggccatccacctcgcgcagcacccgccggcactgttcgtagacccgcagtccgctggcggtgggtttga

SEQ ID NO: 14862 - DNA, 867 bp, Pseudomonas aeruginosa
catcatcggtacccagtcgctgctcaacgccggcatccccaacccggtggcggcattacgcaacggcaccatcggctggacgctggccggtcagcaactggaacacggccagacgcgacgcttcggtgcgatctcgcaggacacacgcaaggccgccgcccagcgcgcccgtgccgtcgccgaccgcgccggcgtcgaacgcctcgacctggccggtctggcccaatggcaggacgagcacgaccgcaccacctacctgctcgacgtacgcacgcccgaggaatacgaagccggtcacctgcctggctcccgctccacgcccggtggccagctggttcaggaaaccgaccatgtcgccagcgtgcgcggcgcgcgcctggtactggtggacgacgatggcgtacgcgccaacatgagcgcctcctggctggcccagatgggctggcaggtcgcggtactggacggactctccgacgccgacttcagcgagaggggcgcctggagcgcgccgctgccgaggcaaccccgggccgacaccatcgacccgaccaccctcgccgactggctgggcgaaccgggcacccgggtgctcgacttcaccgccagcgccaactatgcgaaacgccacatccccggcgccgcctgggtattgcgcagccagttgaagcaggcactggaacggctgggcacggccgagcgctacgtactcacctgcggcagcagcctgctggcacgcttcgccgtggcggaagtccaggcactcagcggcaagccggtgttccttctcgacggcggcaccagcgcctgggtcgccgcgggcctgccgacggaagacggcgaaagcctgttggcgtcgccgcgcattga

SEQ ID NO: 14863 - DNA, 873 bp, Pseudomonas aeruginosa
gattcgaactcacggaagagtctccccttcgacggttttcaagaccgttgccttaaaccactcggccacacctccgcatcgcggggcgccatagtaccggatagcaacacactgtcaaactctatcgattggccctggcagaggctttgctatcatgcccatcagtacgtcatggacccgttcccgttaaggagtacccacaccatgcaagaacagcaatatcagctgaactccgccgtcgcggaacagcgtgaagtcagcggcgttctgcgcaatacctacggcctgctggcactcaccctggccttcagcggcctggtggcctacgtttcgcagcagatgcgcctgccctatccgaacgtgttcgtggtgctgatcggcttctacggcctgttcttcctcaccgtgaagctgcgcaacagcgcctggggtctggtcagcactttcgccctgaccggcttcatgggctacacgctcggcccgatcctcaacatgtacctcggcctgcccaacggcggcagcgtcatcacttcggcgttcgccatgaccgccctggtgttcttcggcctgtccgcctatgtgctgaccacccgcaaggacatgagcttcctgtccggcttcatcaccgccggcttcttcgtcctgctgggcgccgtgctggtatcgctgttcttccagatcagtggcctgcaactggcgatcagcgccggcttcgtcctgttctcctcggcgatgatcctctaccagaccagcgcgatcatccacggcggcgaacgcaactacatcatggccaccatcagcctgtacgtgtcgatctacaacctgttcatcagcctgttgcagatcttcggcatcgccggcggcgacgactga

SEQ ID NO: 14864 - DNA, 753 bp, Pseudomonas aeruginosa
aattcgccatcgccctattcgaccctccccactcccccgccgcccgccgcgcgctgcgcttcagcgaagccgcgctggccggcgggcacgaaatcgtccgcctgttcttctaccaggacggcgtgcacagcgcctcggccaacgtcctggagcgggccagaacaatttcaacctggcccgcccgcctgggcgcgagtttgtcgagcgcaacggcctggacgccgtggtctgcatcgccgccgccctgcgccgcggcgtgctgaacgccgaggaagccgaacgctacggccgtcccggcgccaaccttggcgcaccatgggaactgtccggactcggccagttgcacgaggcggcgcaaagcgcggaccgcctggtctgcttcggaggcgaccgatgagccagtcgctgctgatcatcagccgccagtcgccctggtccggcccgagcgcccgcgaggcgctggacatagccctggccggcggcgccttcgatctaccggtcggcatgctgttcctcgacgacggcgcgttccagctggctcccggccagcatcctgcgcacctgcagcagaaggacctgcaggccaacctgcaggccctgccgatgttcggcgtggacgacctctacgtctcggcccgtagcctgcgcgagcgtggcctggctgaagagcgcctggccctcgcggtcgaggtgctcgacgaccaggccctgcgcgacctgctgcaacgctacgaccaggtgattaccctctga

SEQ ID NO: 14865 - DNA, 1458 bp, Pseudomonas aeruginosa
tgccggcggaaatcgaactgttcgccctgctggaagacctccaggcgcgcggtatcgaggacgtccccgctcgcctggtggcggtggactaccccggcttcgtcgaactcgccacccgcttcgacaaggtcaacagttggctatgacgctccttatgctggaaggccgggaaatccggctggacaaggacggctacctcgccgccctcgacgattggtcggagccggtggcggaagccctggccgcccgcgaggagctggccctgaccgccgagcactgggagattctccaactgctccgcgagttctatgcggagttccagctgtctccggccaaccgcccgctgatcaagtacgtcgcccagcgactgggtccggacaagggcaacagcctgcacctcaaccacctgttcaagggcgccccggccaagcttggcgcgaagctggccggcctgccgaaaccgagcaactgtctatgactctctcgactcccgccgaacatccgttcgcccagttcgtccgcatcctcggcaaaggcaagcgcggagcgcgcagcctgacccgggaggaagcccgcgaggccctcggcatgatcctcgacggcagggtcgaggacacccagctgggcgccttcctcatgctcctgcggcacaaggaggaaagcagcgaggaactggccggtttcaccgaggcggtgcgcgagcgcctgcaagtcccgtccttgcgcgtcgacctcgactggcccagttacgccggcaagaagcgccacctgccctggtacctgctggccgccaagtgcctggccggccatggcgtgcgcatcctcatgcacggcggcggcgcgcataccgccggacgcctgtacagcgaacagttgctggcggcgctggagatcccgctctgccacgactggctgcaggtagaacaggccctggagcgcggccacctggcgttcattccgctcggtgcctggatgccggtgctgcaacgcatgatcgatctgcgcaataccctcggcctgcgctcgccgatccattcgctggttcgcctgctcaaccccctgaatgcggattgcatcctgcagagcatcttccaccccggttaccaggaaacccaccgcgaggccagccgcctgctcggcgaccgggccatcgtcatcaagggcgaaggcggcgagatcgaagtcaacccggacgtcgtcgcccacctgtatggttgcgaccagggcgaagcctgggacgaggaatggccggcattgtcgacgcaccggcacatgaagccggaacagctcgacccgggtttccttcgggccgtctgggacggccgcgaaggcgacgcctatggccacctggcggtgctctccagcatggccctggcgctacgggcccttggcaagaatcgcgaagaagccttcaaggaagccgcacactactgggcgacccgaaacgaatcgatctga

SEQ ID NO: 14866 - DNA, 942 bp, Pseudomonas aeruginosa
tcgatacgaatagccctttatttatataaatttatcgatcgcccgacactagactgttcctccaacgacgtatggaggaacccgctcatgggacagttgatcgatggccgctggcacgaccagtggtatgacacacagaaagacggccgcttccagcgcgaaaacgcccagcgccgccattggctgggcgagccggcgttccccgccgagggcgggcgctaccatctctatgtctcgctggcctgcccctgggcccatcggaccctgatcgtgcgcaagctgaaggggctggagtcgctggtcgatgtttcggtggtcagttggctgatgcgcgagaacggctggaccttcgaccccgcccacggctccaccggcgatcgcctcgacggcctggcctttctgcaccagcgaaacacccgcgacgacccgcactacagcggccgggtcacggtgccgctgctgtgggacaagcaggcgcagaagatcgtcaacaacgaatcagccgatatcgtccgcatcttcaacagcgccttcgacgccatcggcgccaacgcgctggacttctacccggagccgctgcgcgaggagatcgaacgcctcaacggacgcatctatccggcggtcaacaacggcgtgtaccgtgctggcttcgccactcgccaggacgcctacgaggaggccttcgtccagttgttcgaggagctggactacctggaaggcttgctcggcgaacgccgctacctggccggcgaatacctgaccgaggccgatatccgcctgttcaccaccctggtgcgcttcgatgcggtgtaccacggacacttcaagtgcaacctgcggcgcatcgaagactacccgaatctctccggctggttgcgcgagctgtaccaacgcccgggcatcggcgagacagtggacttcgaacatatcaaggggcactag

SEQ ID NO: 14867 - DNA, 354 bp, Pseudomonas aeruginosa
tccgatcctgcggcaccgcatgttcggcgcggcgcttgccgacgtacaggcgttcggcatcgcggcggcataattcgaggatcgacggcgccaccaggcgatcgtaaagcaccacgtcggcctgctgcatcaggcgcagggcacggaacgtcagcaggtccggatcccccggcccggccccgaccagatatacctcgcccgtggctatgtgcgcgaggcctccggccagacgctcttccaggagacgctcggcttccgccggacggccggccaggacacgctcggcgatctcgccctggaacaggttttcccagaacacccggcgctgctgcaggtcgggtagcaattccttga

SEQ ID NO: 14868 - DNA, 1098 bp, Pseudomonas aeruginosa
ccatgctcggcggtatgcaggttgatcatgaactgcgccagggcgcgatgcaggcgggcgatcgggccgcgcatgagggcgaagcgcgcgccggaaagcttggcagcggtctcgaaatccagccagccgtgccgttcaccgagggcgacatggtccttgacctcgaaatcgaaggtcttcggcgtgccccagcgacgcacttcgacgttggcgtcctcgtcggcaccgaccggcaccgactcgtgcggcaggttgggaatgcccagcagcatggcatccagttcgccctggatggcgtccagctggcgcttgccttcctccagctcggagcccatgcgatcgacatcggccagcagcggcgcgatgtcctcgccacgctgcttggcctggccgatcgccttggaacgcgcgttgcgctcggcttgcagctgctcggtacgggtctgtaccgacttgcgctgctcttccagcgcttcgatgcgtgcgacatccagttggaagccacgggtggccaggcgggcagccacttcttgcggctgggtgcgtaccagtttgggatcgagcatgctcttttctcgtctcgtgtcggttatcggcggttcgtggcccggttggcgcttcgccggccccggcgacgtcatcgacgccgtcgcggaagcctggctagctccgccgagcccataccgctcaggattttctgcgttggcggggactggtgcgatccagctcggccaggtgttccagcttgtcgcggatcttcagttccaggcccctcggcaccggttgatagtaacgccgcggctccagatcctcggggaaataatcctctccggcggcataggcatccggctcgtcgtgggcgtagcggtattcctcgccatagccgaggctcttcatcaatttggtcggcgcgttgcgcaagtgcaatggcacttcccgcgagccgctttcggcgacgtcgcgcatcgccgcgttgaacgcgctgtacaccgcattgctcttcggcgcacaggccaggtagacgatggcctgggccaccgccagctcgccttcggggctgcccaggcgctcctgcacgtcccaggccgacaggcatag

SEQ ID NO: 14869 - DNA, 1605 bp, Pseudomonas aeruginosa
gccgagggcgcgaggatcggcgttgccaacctcctcgctggccatgcgcaccacccgccgggcgatgtacaggggatcgcagccgccgtcgagcatacgcgcgaaccaataaagtgccgcgtcgggattggagccgcgcaccgacttgtgcagcgcgctgatctggtcgtagaacgcctcgccgcccttgtcgaaacgtcggcgggtatcgccgagcagattctgcagcagctcggggctgatctcgctgccgtcctcggcgaggtcggcagcgttctccagcaggttcagcaggcgccgcccatcgccgtcggcggcggccaggagaacctggaagctctcctccggcagcctcagcttgcgcttgccgaggcccttgtcctcgttcagcgcgcggcccaccagcttgcgcagggcggcttcgtcgaggctcttgaggacatacacgcgagcccgcgagagcagcgcattgttcaactcgaaggacgggttctcggtggtcgcgccaatgaagatcagcgtgccgtcttccacatagggcaggaaggcatcctgctggctcttgttgaagcggtgcacctcatcgacgaacaggatggtccggcgcccgtattgcgccgcgtgctgcttggccacctcgaccgcctggcggatctccttgaccccggacagcaccgcggaaatggtctcgaaatgggcgtccgacacctgcgccagcagccgcgccagggtagtcttgccgactcccggcgggccccagaagatcatcgagtgcagcgcgccctgctccagcgcctcgcgcaagggcttgccgcgggccagcaggtgttcctgccccacatactcgtccaggtttgcgggcctcagccgtgccgccaggggctgcgcgacgggctcgctgcggaacagatccacggcttgcgcttactcctggatcacgtcgacgcccggcggaacgtcgaaggtgaattgcttggcatccagcgcctcgttcatcttcacgtcgaagaacaggatgttggtgcgctggccgacgccatcgatcatctgcatgtcgttcaccttgccgctgcggaacgacagacgcaaggtgtcgaagagggtgtccttggtcttcggcttgagcacgaaatcgactacgttgccgccttccttgtaggtgatggcgaagctttcgctgatcttcgagatgtcgccggagagcagcagcgccggcgtctgggtcaggcgctgatcgagcttctggatggtcacctgctccaggtccgggtcgtacagccagaccttctcgccgttggaaatgagcaattgctcgttcggcgcatcggtatgccagcggaacagtcccggccgcttcaggctcagttggccggcggtttcctgcaggcgcgtgccgctaccgtccagggtcagttgggaaaaacgcgcggtcagggtctgggccttgttcagcaggccggtcaggcgctggacagcggcgctgtcgtcggcatgggccagcgaagcgcccatggccagggcggcaacgaacaacgtgcggatcagtcgcatcggaatcctctaaaacctgtcgggttcaatcacgaaccggcgccggcgcgatga

SEQ ID NO: 14870 - DNA, 600 bp, Pseudomonas aeruginosa
catagccggcagaactcttcaggcggctccattggagcacgcattttcttatgtgacaaaggcttatggagtctttttatgagtgaagtcaagcattcgcgcctcatcatcctgggctccggtccggccggctataccgccgccgtgtacgccgcacgcgccaatctcaagccagtggtgatcaccggcatccagccaggcggccagctgaccaccaccaccgaagtcgacaactggccgggcgacgtcgaaggccttaccggcccggcgctgatgacccgcatgcagcagcacgccgagcgtttcgacaccgagatcgtctacgaccacatccacaccgccgagttgcaacagcgccccttcacactgaagggcgatagtggcacttatacctgcgatgcattgatcattgccaccggtgcctccgcgcaatacctgggcatgtcgtcggaagaagccttcatgggcaagggcgtttccgcctgcgccacctgcgacggtttttctaccgcaaccaggtggtctgcgtggtcggcggcggcaataccgccgtcgaggaagcgctgtacctggccaacatcgccaaggaagtccacctga

SEQ ID NO: 14871 - DNA, 999 bp, Pseudomonas aeruginosa
agagcaccatcgacggcagcaccagcgagctatcgctggccggcgtgttcatcgccatcggccacaagccgaacaccgacctgttccagggccaactggaaatgcgcgacggctacctgcggatccacggcggcagcgaaggcaatgccacccagaccagcatcgaaggcgtgttcgccgccggcgacgtggccgaccacgtctaccgccaggccatcacttccgccggcgccggctgcatggccgcgctggatgccgaaaaatacctcgacgaccattgatcggacccgggggaggcccgccctcccctaccccgccatgctgacctggctttcccgcaccgacttcgactttccgcccctcgacaaggccctgcaggagcccaacgggctgctcgcggccggcggcgacctcaatccgcaacgcctggtcgcagcctatcgccacggctgcttcccctggtaccaggatggccagccgatcctctggtggtcgcccgacccgcgcaccgtcctgttccccgacgaactgcacgtttcccgcagcctggccaagtgcctgcgccagcaacgcttcgaagtcactttcaaccgtgacttccgggcggtgatccaggcttgtgccgcgccgcgtgactacgccgacggcacctggatcaccacgccgatgcaactggcctaccaggagctgcacctgcgcggcatcgcccactccgtggaagtctggcaggagcgacaactggtcggcggcctctacggcctggccatgggcaggctgttcttcggcgaatcgatgttcagccgcgccgacaacgcttccaaggtcggcttcgtcacgctggtccgccatctgcgcgacgccggcttcgtcctcatcgactgccagatgccgacccgccacctgcacagcctgggcgcccgcgccatcagccggggggaattcgccgactacctgcaacgctatcgcgaccagcctcctaccggcgacctggatttttag

SEQ ID NO: 14872 - DNA, 762 bp, Pseudomonas aeruginosa
gcgagtttccgtgcctggcataaacttgcttatgggtccctgctggagttcaccatgaccgaactcgcccgactgaagttctacgcgacgcaaccgcacccgtgcagctacctgcccgatgagcaggcaaccaccctgttcctcgatcccagccagcccatggacacgcagctgtacgcctcgctgtcggaggtcggcttccgccgcagcggcgaccatctctatcgtccgcactgccagcattgcaccgcctgcatcgccgcgcgcataccggtcgccggcttcagcccgaaccgccagcagcggcgcatcctcaagcgcaatgcggaactgcaggtgatccgcaagcgaccgagcttcaacgaggagtactacgacctctatcggcgctacatcgagcaacgccacgccgacggcgacatgtatccgcccagccgcgaccagttcgccaccttcctggtccgcgacctgcccttctgctgcttcttcgagttccgcctgcatggccgcctgctggccatagccgtgacggacgtgctgccgaacggactctcggccgtctataccttctacgatcccgacgaagagcagcgcagcctgggacgctacgcgatcctctggcagatcgccgagaccgaacgcctgggcctgcaggccgtctacctgggctactggatcaagaattgccgcaagatgaactacaagacccagtaccggcccatcgaactgttcgtcaaccagcgctgggtcgccctcacctga

SEQ ID NO: 14873 - DNA, 222 bp, Pseudomonas aeruginosa
accacgctgtcggccagcaggtccggcacctggccatcgacgatgcgtttggccaggccctcggcgatggccgtcttgccgacccccgcctcgcctaccagcagcgggttgttcttgcgccggcgggcaaggatctgcgccacccgctcgacttcatgctcacgccccaccagcgggtcgatccgcccctggcgagccagttcgttgaggttgctggcatag

SEQ ID NO: 14874 - DNA, 492 bp, Pseudomonas aeruginosa
ttcaccacatcgatacgcgcgatgctctgctgcttgagcaggaacaccgcctggctttcctgttcgctgaagatcgccaccaggacattggccccggtcacttcgcgcttgccggaactctgcacgtggaacaccgcacgctgcaggacgcgctggaagcccagcgtcggctgggtttcgcgctcgtcgtcgtgctgcgggatcagcggcgtggtggaatcgatgaattcctgcaggtcgcgccgcagcttgtccaggttggcaccgcacgcacgcaataccgttgccgccgcctcattgtccagcaaggccagcagcaggtgctcaaccgtcatgaattcatggcgtttggccctcgcctccttgaaggcgagattgagggtgacttcgagctctcgattcaacatggcttcacctcgctcccaaacatccgatcaactgtctttctctatctcgcagagcaatggatgctggctctcccgtgcatactga

SEQ ID NO: 14875 - DNA, 429 bp, Pseudomonas aeruginosa
gcatgctcagcggtaaggtcaagtggttcaacaacgccaagggctacgggttcatcctggccgagggccgagatgaggacctgttcgcccattactcggccattcagatggacggttacaagacactcaaggcgggccagccggtcaatttcgagatcatccagggaccgaagggactgcatgccatcaacatcagccccgccaccgcgacaaccgccgcaccctccgcccccgccccgcaggaagagccgcaggcgacgcccatcgaagcctgaccccagcgcggatgcggaaatgaaaaaggccggtgcaaaccggcctttttctcgttcgggcgctagcccttcctacatcttggcaatcatcgcgtcgccgaactccgagcaggacagcagggtcgcgccgtccatcaggcgttcgaagtcatag

SEQ ID NO: 14876 - DNA, 249 bp, Pseudomonas aeruginosa
gtcacggtcttggcggcgatcgccccgttggtgcccttgatgatcaggtcggccgcctcggtccaacccatgtggcgcagcatcatctccgcggagaggatcagcgaacccgggttgaccttgtcctggccggcgtacttcggcgcggtgccgtgggtcgcctcgaacatggccaccgaatcggacaggttggcgccgggcgcgatgccgatgccaccgacctcggccgccagggcgtcggagagatag

SEQ ID NO: 14877 - DNA, 2226 bp, Pseudomonas aeruginosa
atgtccatccgctcgaagatcacctacaccttcaccgacgaagcacccgcgctcgccacctactcgctcctccccatcgtcaaggcctttgccgcttccgccggcatcgacgtcgagaccagcgacatctctcttgcaggacgcatcctggccaacttcgccgaccgcctcgaagccgaccagcgtatcgaagacgacctcgcccgcctggcggccctggccacctcgcccgacgccaatatcatcaagctgcccaacatcagcgcctcggtgccccagctgaaaggcgcgatcgccgagctgcagggcctgggctacaaggttcccgacttcccggaagacccgcagaccgacgaagagaaagaggttcgcgcacgctacgcgaagatcctcggcagcgccgtgaacccggtcctgcgcgaaggcaattccgaccgtcgcgcgcctgccgcagtgaaggcctacgcccgcaagcacccgcactccatgggcaagtggagcatggcctcgcgctcccacgccgactacatgcgcggcggcgacttcttctccagcgaacagtccatcaccatggccaaggccggtgacgtgcgcatcgaattcgtcggcaaggacggcaaggtcgaggtcaagaagcaactgagcctgcaggaaggcgaagtgctcgacagcatgttcatgagctgcggcaagctgcgcgacttcttcgagaagaccctgcaggactgcaaggaaaccggcgtcatgtggtccctgcacgtcaaggcgaccatgatgaagatttcccacccgatcgtcttcggacatgcggtgagcgtctactacaaggacgtcttcgacaagtggggccaactcttcgaagagctcggcgtgaacccgaacaacggtatctccagcgtctacgacaagatcaagtcgctgcccgcctcccagcaggaagagatcctccacgacatccacgaggtgtacagccaccgcccggaaatggcgatggtcgactccgtgaaaggcatcaccaacctgcacattccgagcgacgtcatcgtcgacgcctcgatgccggcgatgatccgcaactccggccagatgtggggcaaggacggcaagcagaaagacaccaaggcggtaatgccggaaagcacctacgcccgcatctaccaggagatgatcaacttctgcaagaccaacggcgccttcgacccgaccaccatgggcagcgtgccgaacgtcggcctgatggcgcagaaggccgaggaatacggctcccacgacaagaccttcgaaatgaccgccgacggcaccatgcgcgtggtcctggccgacggcagcgtgctgatgcagcacgacgtggagaccggcgacatctggcgcgcctgccagaccaaggacgcaccgatccgcgactgggtcaagctggccgtcacccgcgcacgccagtccgataccccggcgatcttctggctggacccggagcgcgcccacgaccgcgaactgcgcaagaaggtcgagctgtacctcaaggaccacgacctgaccggtctcgacatcagcatcatgggctacaacgaggccattcgcgtcagcatggaacgcctgatccgcggcaaggacaccatctcggtgaccggcaacgtcctgcgcgactacctgaccgacctgttcccgatcatggaactgggcacctcggccaagatgctctccatcgttccgctgatggcgggcggcggcatgtacgaaaccggcgccggcggctcggcacccaagcacgtccagcaactggtggaagagaactacctgcgctgggactccctgggcgagttcctggccctggccgtgtccctggaggaaaccgggatcaagaccggcaacgccaaggccaagctgctcggcaaggcgctggacgaagccaccggcaagctgctggacaacaacaagtcgccgtcgcgcaaggtcggcgacatcgacaaccgcggcagccacttctacctggcgatgtactgggcccaggccctggccgcccaggacgaagacgctgagctgaaagcgcacttcgcaccgctggccaaggccctgaccgagcaggaagcgaccatcgtcgccgaactcaatgcggtccagggcaagccggccgagatcggcggctactatcgctccaacccggagctgaccagcaaggtgatgcgccccagcgccaccttcaacgcggcgatcgacagcctggcctga

SEQ ID NO: 14878 - DNA, 468 bp, Pseudomonas aeruginosa
  unsure (47),(51),(55),(58),(112),(139): Identity of nucleotide at the above locations are unknown.
gctggcatccccatgtgccccgtagcgaccatcgtcgaggaccaggnccgnttcntgntggtcgaggaacaggccgacggccgcgaggtgctgaaccagcccgccgggcacntggagcccgccgaaagcctgttggagnccgccctgcgcgaaaccttcgaggaaaccggctgggaggtcgagctgagcgccgtcaccggcatctacctgtacaccgcgccgtccaacggtgtcacctatcagcgcgtatgcttcgccgcccgccccgtgcgccaccaccccgagcgcgccctcgacgacggcatcatcggcccgcgctggctgagccgcgacgaactggccgcccagccgcagcgctggcgcagccacctggtgctgcgctgcatcgacgactacctggccggcggccgctatcccctggcgctgatccgcgacacccacgtgtcgccctccctaccccaggcctga

SEQ ID NO: 14879 - DNA, 1488 bp, Pseudomonas aeruginosa
cgtgttcgagcacttccttgccgagtacaaggccggccgtacgccgaacccggacatcctctgcaaccgcgaaatcaagttcaaggcgttcctcgactacgcgctgatgctcggcgcggacctgatcgccaccggccactatgtgcggcgccgcgaccgcgacgggcgcaccgagctgctcaagggcctggacccgaacaaggaccagagctacttcctgcacgcggtgggcggcgagcagatcgcccgcagcctgttccccgtcggcgaactggagaagccggaagtccgcgccatcgccgagaagcatggcctcgccacggcgaagaagaaggactccacgggcatctgcttcattggcgagcgacgcttcaccgatttcctcaagcagtacctgccggcccagccgggcgacatcgagaccatcgaaggcaaggtcatcggtcgccacagcggcctgatgtaccacaccatcggccagcgccagggcctcggcatcggcggtctcaaggaagccggcgacgatccctggtacgtgctcggcaaggacctgcaacgcaacgtgctgctggtcggccagggcaacgaccacccgctgctgttctcccgcgccctgctggcctcgcgaatctactgggtcaacccggtcgaactggagcggccgcgccgcctgcgggccaaggtgcgctaccgccagagcgaccaggactgcgtcctggagaaaaccgccgaaggctaccgcgcggtgttcgacgaaccgcagcgcgcggtgaccccggggcaatcggtggtgttctacgacggcgacgtctgcctcggcggcggcgtgatcgaaacggcggaagcctgggatttcggaggacgcccgtgagcgatccgcgacagcaactgattgccctcggcgccgtcttcgaatccgcagccctggtcgacaagctggcacgcaccgggcagatcagcgaagccccgctgggctgcatgctcggcagcctgctggcgcgcaacccggccagcaccctggacgtctacggtggcgacagcctcaacctgcgcgacggcttcaaggccctggccagcgccctggagcgcaagcccggcagcctgcagcgcgaaccgctgcgctacgccctggcgatgctgaccctggaacggcaactggacaagcgcggcgacatgctcgacctgatcggccagcgcctcgaccaggtcgaacagcaggtccagcacttcggcctggtccacgagaacgtcatcgcctcgttcgccagcatctaccaggacaccctcagcaccttccgccagcgcatccaggtacacggcgacatgcgccacctgcaggtcagcagcaacgccgcgcggatccgcgccctgctgctcgccggcatccgctcggcgcggctctggcggcaactgggcggcagccgctggcagatggtattcagccggcgccggctgctcaacgaactctatcccctgctgcgcggctag

SEQ ID NO: 14880 - DNA, 1095 bp, Pseudomonas aeruginosa
tactcccctgcaacttctgggcggactgaccgctgccgaattcctccgcgactactggcagcgcaaaccgctgctggtccgccaggcgatcccggacttcgaaagcccgctgtccgccgacgagctggccgggttgtcgctggaggagtcgatggaatcgcgcatcgtcctcgaacacgggaaaaccccgtgggaaatgcgccgtggcccgttccaggaggaggactaccagcacctgccggaacaggactggaccctgctggtgcaggcggtagaccagttcgtcccggaagtcgcccaactgctggagcaattccgcttcctgcccagctggcggatcgacgacgtgatgatcagctacgccgctcccggcggcggcgtcggtccgcacttcgacaactacgacgtattcctgcttcagggccacggacgccggcgctggaaagtcggacagatgtgcagcagcgacagcccgctgcgcgagcacgccgacctgcgcatcctcgccgacttcgaacagagcgacgagtgggtcctggagcccggcgacatgctctacctgcccccgcgcctcgcccactacggcattgccgaagacgagtgcatgacctactcgatcggcttccgcgcgcccagcgccgccgaagtgctgacccatttcaccgacttcctcggccagttcctctccgacgaggagcgctacaccgatgccggcctgcaaccggtaggcgacgatccgcaccagatccagcgcgacgctctggagcgcctgcagggcctgatccaggagcacatgagcgacgagcgcctgctgctgacttggttcggccagttcatgaccgaaccgcgctatcccgaactggttgccggcgaggagatccccgaagaggagctgttcggcgccctcgaggatggcgcgctgctggtgcgcaaccccagcgcccgcctggcctggagcgagatcgacatcggcctggtgctgttcgccagcggccagagcgtactcctgcccgggcagctcaaggaactgctgaagctggtctgctcggccgatgcgttgcatctggaaaacctcggccaatggctggccgatga

SEQ ID NO: 14881 - DNA, 801 bp, Pseudomonas aeruginosa
tcgccggcctcggccgccgccaggtcctggccggcggcgcggcgctcggcgccctcgccttcctcggcgtcgcgctccccgccagcgccgctcccgccgaagcgcaggcgcccgccgcggaaggcctgcgcggcttgcctttcaaacgccgcaaccgcttgcccttcgaagccatcgccagcggccgcgccgataccatccgggtgcccgccggctacaaggcgacgcccttcataccctggggcaccccgatcagcggcagttatccgggattcctcgacgacgccagcaacagcgcccaggaccaggccgaacagatcggcatgcaccacgacggcatgcacttcttcccgatcgacgcgcagttcggcttcggcggcggacacatcagcaaccatggcctgctggtgctcaaccatgaatacatcgacgcgccgctgctgcacaccaatggcccgaccgtggtcgatggcaagcgcaccgtcgccgatgaagtgcgcaaggaaatcaacgcccatggcgtttccgtcgtggagatccgtcgcaacgtgcgtggcgagtggaatgtcgtaccgtcgcaacgcaatcggcggatcaccgccgccacgccgatgcgtatcgccggcccggcgcgcggccacgaactgctgcgcacccgccacagtccggacggcacccgcacccgcggcacccacaacaactgttccaacggtttcaccccctggggcacctacctcacctgcgaggagaactgggtcggctatttctccacccaggacagcgaactgccgcgcgaactga

SEQ ID NO: 14882 - DNA, 366 bp, Pseudomonas aeruginosa
ccgccatcgcgacgctggaggccggacagatcgagcagatccggcaacaggacaagggcgaggtccgcgtggcggtgctggtcagcgacgagaacggcaaccagccgatcgcctgcgagatggtctgggcctgggtcggcaagaaaccccgggacgctaccgcagcccctaggtagcgcacctccagagcgactacatctgtgctgcgaagcgaaccgccgcaaaccttgcccagcgccttcgcatccgtcacgaagaaccgcgggcgcagccccaggcggcgccacagccgggttgtcatggtgcggaaagaagaaaaaccgccatgcgcccggcccggaaaatattcccggtttaatgcaataa

SEQ ID NO: 14883 - DNA, 465 bp, Pseudomonas aeruginosa
acttgcagctcatcactggggattcgctgccttccttctaagggtcgttggccttctcgccttcatgctaggggtttcgtccctgcttggcagcaaggcatttggtcgcagcaagaacgaacccttcgaatccgggatcgtccccaccggaggcgcacgcctgcgtctctcggcaaaattctatctggtcgcgatgctcttcgtgatcttcgacgtcgaagccctcttcctcttcgcctggtcggtgtcggttcgcgaaagcggctgggccggcctgatcgaggcaaccattttcatagcaattctgttggcgggtcttgtctatctttggcggatcggtgcgctcgattgggctcccgaaagccgtcgcaagcggcaggcgaagctaaaacaatgaggctttggcgatgcaatacaaacttacccggatcgatcccgatgcggccaacgaccaatacccgatag

SEQ ID NO: 14884 - DNA, 1437 bp, Pseudomonas aeruginosa
cgtgatgatcaaggtcgccttgtccgagcgcgacctcaacctgcccaccgccacccgtatctggcccaacgccaactggtacgagcgcgaagtgtgggacatgtacggcatcaccttcaccggccacccgcacctgacccgcatgctgatgccgccgacctggcagggccatccgctgcgcaaggactacccggcgcgcgccaccgagttcgatccctactccctgtccgccgccaagcaggacctggaccgggggccctgcgcttcaagccggaagactggggcatgaagcgccacgggcgagaacgaggactacatgttcctcaacctcggcccgaaccacccgtccgcccacggcgcgttccgcatcatcctgcagctggacggcgaggagatcatcgactgcgtcccggagatcggctaccaccaccgcggcgccgagaagatggccgagcgccagtcctggcacagtttcattccctacaccgaccgcatcgactacctcggcggggtgatgaacaacctgccctacgtactctcggtggagaagctcgccgggatcaaggtgccgcagcgggtcgacgtgatccggatcatgatggcggagttcttccgtatcctgaaccacctgctgtacctgggcacctatatccaggacgtcggcgccatgaccccggtgttcttcaccttcaccgaccgccagcgcgcctacaaggtggtcgaggccatcaccggcttccgcctgcacccggcctggtaccgcatcggcggcgtcgcccacgacctgccgcgcggctgggacaagctggtccgcgagttcctcgactggatgcccaagcgcctcgacgagtacgagaccgcggccctgaagaacagcatcctgcgcggccggaccatcggcgtcgcccagtacaacaccaaggaagccctcgagtggggcaccaccggcgccggcctgcgcgccaccggttgcgacttcgacctgcgcaaggcccgcccctactccggctacgagaacttcgagttcgaggtaccgctggcccacaacggcgacgcctacgaccgctgcatggtcaagatgggcgagatgcgccagagcctgcggatcatcgaacagtgcctgaagaacatgccggaaggcccttacaaggccgaccatccgctgaccacgccgccgccgaaagaacgcacgctgcaacacatcgaaaccctgatcacccacttcctgcaggtttcctggggcccggtcatgccggccaacgaagccttccagatgatcgaggcgaccaagggtatcaacagctactacctgaccagcgacggcagcaccatgagctaccgcacgcgtatccggacgcccagcttcgcgcacctgcaacagatcccctcggtgatcaacggcagcatgatcgcggacctgatcgcctacctgggtag

SEQ ID NO: 14885 - DNA, 309 bp, Pseudomonas aeruginosa
agatcgtccagaaacagcgcggctgggtgccggacggcgccatcccggcgatcggcgaggtgctggggatcccggccagcgacgtcgaaggcgtcgccaccttctatagtcagatattccgccagccggtgggccgccacatcatccgcgtctgcgacagcatggtctgctacatcggcggccacgagtcggtggtcggcgagatccagaagcaactcggcatcggtctcggccagactaccgccgacggacgcttcaccctgctcccggtctgctgcctgggcaactgcgacaaggccccggcgctga

SEQ ID NO: 14886 - DNA, 1539 bp, Pseudomonas aeruginosa
tcgacgacgacactcatggcgacgtgcgtcccgacggtgtcgccaaactgctggaggcctacgtatgacccttacctccattggtccggccaaccgcatggcgcgttcggcggaaacccatccgctgacctggcgcctgcgcgaagacgcccagcccgtctggctcgaggaataccagagcaaggacggctatgccgcggcgcgcaaggcgctgacccagatggcccaggacgacatcgtccagaccgtcaaggactccggcctcaagggccgcggcggcgcgggcttccccaccggcgtgaagtggggcctgatgccgaaggacgagtcgctgaacatccgctacctgctgtgcaacgcggacgagatggagccgaacacctggaaggaccgcatgctcatggagcagctgccgcacctgctggtggaaggcatgctgatttccgcgcgcgcgctgaaggcctaccgcggctacatcttcctgcgcggcgaatacgtcgacgcggcgcgcaacctcaaccgcgccatcgacgaagccaaggccgccggcctgctcggcaagaacatcctcggcagcggcttcgatttcgagctgttcgtccacaccggtgccggccgctacatctgcggcgaagagaccgcgctgatcaactcgctggaaggccgccgcgccaacccgcgttccaaaccgcccttccctgccgccgtcggcgtctggggcaagccgacctgcgtgaacaacgtggagacgctgtgcaacgtgccggccatcgtcggcaacggcgtggactggtacaagaccctggcccgccccggcagcgaagacatgggcaccaagctgatgggcttctccggcaaggtgaagaaccccggcctgtgggaactgccgttcggcgtcagcgcccgcgagctgttcgaggactacgccggcggcatgcgcgacggcttccagctcaaggcctggcagcccggcggcgccggtaccggcttcctgctcccggagcacctggatgcgcagatgttcgccggcggcatcgccaaggtcggcacccggatgggcaccggcctggccatggcggtggacgacagcatcaacatggtttccctgctgcgcaacatggaagagttcttcgcccgcgagtcctgcggctggtgcaccccctgccgcgatggcctgccgtggagcgtgaagctgctgcgtgccctggagcggggcgaaggccagcccggcgacctcgagaccctcgagcagctggtcaacttcctcggcccaggcaagaccttctgcgcccacgcgccgggagccgtcgagccgctgggcagcgccctcaagtatttccgtgccgaattcgaggcgggcatctcccgccagccttcggccgcgccgcgcccggcaacggtcggcgcctgatgctttgcagccggacggccagccgtccggcgatgtttcgtcgtcgtgccgcggcccggccgcaggcccgacggaaccgtgagtttctattagccacgcccgctgacaacgggccaacgaagacttga

SEQ ID NO: 14887 - DNA, 2721 bp, Pseudomonas aeruginosa
accatggccactatccacgtagacggcaagacgctcgaagtcgatggtgcagacaacctcctgcaggcctgtctgtccctcggtctcgacattccctacttctgctggcacccggcgctcggtagcgtcggcgcctgccgccagtgcgcggtgaagcagtacaccgacgagaacgacaagcgtggtcgcctcgtcatgtcctgcatgacccccgccaccgacaacacctggatctccatcgaagacgaagaggccaagcagttccgcgccagcgtcgtcgaatggctgatgaccaaccacccgcacgactgcccggtgtgcgaggaaggcggtcactgccacctgcaggacatgacggtgatgaccggccacaacgagcgccggtaccgcttcaccaagcgcacccaccagaaccaggaactcggcccgttcatcgcccatgagatgaaccgctgcatcgcctgctaccgctgcgtgcgctactacaaggactacgccggcggcaccgacctcggcgtctacggcgcccacgacaacgtctacttcggacgggtcgaggacggcgtgctggaaagcgagttctccggcaacctcaccgaggtctgccccaccggcgtgttcaccgacaagacccactccgagcgctacaaccgcaagtgggacatgcagttcgccccgagcatctgccacggctgctccagcggctgcaacatcagccccggcgagcgctacggcgagatccgccgcatcgagaaccgctacaacggctcggtcaaccactacttcctctgcgaccgcggtcgcttcggctacggctacgtcaaccgcgaagaccgtccgcgccagccgctgctggtgctgagcaagcagaagctgagcctggacggcgccctcgaccaggccgccgccctgctgaaggagcgcaaggtggtcggcatcggttcgccgcgcgccagcctggaaagcaacttcgccctgcgcgagctggttggcgaaggcaacttctacagcggcatcaacgaaggcgagctcgaccgcctgcgcctgatcctgcaggtcatgcaggaaggcccgctgccggtgccgagcatccgcgacatcgaggaccacgacgcggtcttcgtcctcggcgaggacctgacccagaccgccgcccgcatcgccctggccctgcgccagtcggtgaagggcaaggccgtcgagatggctgccgacatgaaggtccagccgtggctcgacgccgcggtgaagaacatcgcccagcatgcgcagaacccgctgttcatcgccagcgtcagcgcgacccgcctcgacgacgtggccgaggaaaccgttcacgccgcgccggacgatctcgctcgcctcggcttcgccgtggcccacgcgatcgacccaagcgccccgtccgtggccgacctcgacccgcaggcccaggccttcgcccagcgcatcgccgatgccctgctggcggccaagcgtccgctggtagtgtccggcaactcgctgggcaacaaggcattgatcgaagccgcggcgaacatcgccaaggccctcaagcagcgcgagaagaacggttccatcagcctggtggtcggcgaagccaacagcctcggcctggcgctcttcggcggcgactccgtggaagccgcgctcgagcgactgacctccggacaggccgacgccgtggtggtgctggagaacgatctctatcgccgcaccgacaccgcccgtgtcgacgcggccctggcggcggccaaggtggtgatcgtcgccgatcaccagcagaccgccaccaccgccaaggcgcacctggtgctgccggcggccagcttcgccgaaggcgacggcaccctggtcagccaggaaggccgcgcccagcgcttcttccaggtgttcgacccgacctactacgacgccaggaacatggtccgcgagggctggcgctggctgcatgcgatccacagcaccctgcaaggcaagcgcgtcgactggacccagttggaccacgtcaccgaagccgtggccgaggcaaagccgatcctggccggcatccgcgacgccgcaccggccgcctcgttccgcatcaagggcctcaagctggcccgcgaaccgcaccggtacagcgggcgcaccgccatgcgcgccaatatcagcgtgcacgagccgcgcaccccgcaggacatcgactcggcgttcgccttctccatggaaggctactccggcagccaggaagaccgtcagcagatcccgttcgcctggtcgccgggctggaactcgccgcaggcctggaacaagttccaggacgaggtcggcggccacctgcgcgccggcgaccccggcgtgcgcctgatcgaaccgaagggcgaaggcctcgactggttccaggccgtgccggtgccgttcagcgccaaggccgacagctggaaggtagtgccgctgtaccacctgttcggcagcgaggaaaacagctcgcgggccgcgccgatccagcagcgcatcccggagacctacgtcgccctgtccaaggaagacgcggaccgcctcggcgtcaacgacggcgcgaccctcggcttccagctcaagggccaggccctgcgcctgccgctgcgtatcgatgaacaactcggcgccggcctgatcggcctgccggtcggcttcgccggcatcccggcggcgatcgccggctgctccgtggaaggtctgcaggaggctgcacaatga

SEQ ID NO: 14888 - DNA, 1104 bp, Pseudomonas aeruginosa
ccggcgcgctcgtgctggccgcggcccagtaaggagaaccaccgtgatcaaagaaatcatcaacgtcgtgcatggcaccttcacccagcttcgcagcctggtgatgatcttcggccatgccttccgcaagcgcgacaccctgcaataccccgaagagccggtctacctgccgccgcgctatcgtggccggatcgtcctgacccgcgaccccgacggcgaggaacgctgcgtagcctgcaacctgtgcgccgtggcctgtccggttggctgcatctccctgcagaaggccgagaccgaggacggtcgctggtatccggagttcttccgcatcaacttctcgcgctgcatcttctgcggcctgtgcgaggaagcctgcccgaccaccgcgatccagctcaccccggacttcgagatgggcgagttcaagcgccaggacctggtctacgagaagcacgacctgctgatctccgggccgggcaagaacccggactacaactactaccgcgttgcggggatggcgatcgccggcaagccgaaaggcgccgcgcagaacgaagccgaaccgatcaacgtgaaaagcctgctgccataaggagacgtcgcgtggaattcgctttctatttcgctgccggcgtcgccgtactggccacgctgcgggtcatcaccaacagcaacccggtgcatgccctgctctacctgatcatttccctgctggccatctcgatgaccttcttcagcctcggcgcacccttcgccggtgccctggagatcatcgtctacgctggcgccatcatggttctgttcgtcttcgtggtgatgatgctcaacctcggcccggccgtggtcgagcaggagcgcaagtggctcacgcccggcatctgggtcgggccttcggccctggccctggtcctgctggtggaactgctggtggtcctcgcccgcaccccgagcggtgccggcatcggccataccacggtagacgccaaggcggtcggcatcagcctctacggcccgtacctgctggtggtcgaactggcctccatgctgttgctcgcggccctggtcgctgcctatcacctgggtcgtcaagacgccaaacaataa

SEQ ID NO: 14889 - DNA, 354 bp, Pseudomonas aeruginosa
aggttcggcgggcgccctgcgcccgccccaagggaacgtaacgctatgaacgcaataccactggaacacggcctggccctcgccagcgtcctgttcgccctcggactggtcggcttgatggtgcgacgcaacatcctgttcgtactgatgagcctggaagtgatgatgaacgccgccgccctcgccttcgtggtcgccggcagccgctggggccaacccgacggccaggtgatgttcatcctggtgctgagcctcgcggccgccgaagcgagcatcggcctggcgatcctgctgcaactgtatcgccgcttccacaccctcgatatcgacgctgccagcgagatgcgcggatga

SEQ ID NO: 14890 - DNA, 1218 bp, Pseudomonas aeruginosa
ccctggcgaccctggccctggctcggcggcgcggtcggcaagtccgcccagctgccgctgcagacctggatggccgacgccatggccggcccgaccccggttttccgcgctgatccacgccgccaccatggtgaccgccggcgtctacctgatcgcccgttgccacggcctgttcaccctggccccggacatcctcgaactggtcggcatcgtcggcgcggtgaccttggtcctggccggcttcgccgccctggtacagaccgatatcaagcgcatcctcgcctactcgaccatgagccagatcggctacatgttcctcgccctcggcgtcggcgcctgggacgcggcgatcttccacctgatgacccacgccttcttcaaggccctgctgttccttgcctcgggcgcggtgatcgtcgcctgccaccacgagcagaacatcttcaagatgggcggcttgtggaagaagctgccgctggcctacgccagcttcgtggtcggcggtgcggcgctggccgccctgcccttcctcaccgcgggcttctactccaaggacgagatcctctgggaggccttcgccagcggccatcgcgaactgctgatcgccggcctggtgggtgcgttcctgacctcgatctacaccttccgcctgatcttcgtcgccttccacggcgagccgaagaccgaagcccacgccggccacgggatttcccactggttgccgctcagcgtgctgatcgtcctgtcgaccttcgtcggcgccctgatcaccccgccgctggctggcgtcctgccggaaagcgtcggccacgcaggtggcgaagccaagcacagcctggaactggcctcgggtgccatcgccatcgccggtatcctgctggccgccctgctcttcctcggccagcgccgcttcgtcagcgccctggcgaagagcgccccgggtcgcttcttcggtacctggtggtaccacgcctggggcttcgactggctgtacgacaagctgttcgtgaaaccctacctgctgctctgccaattgctggggcgcgaccccatcgaccgtaccctgggcgtcgttccgttcagcgtgcgcggcggacacaacctcctcagcctcaccgagaacggccgcctgcgctggtacgccgcttccctggtgggtggagccgccatcctgctcggcgcgctgctgctggcctaacgaattcacggagagactga

SEQ ID NO: 14891 - DNA, 624 bp, Pseudomonas aeruginosa
cggcaagaagacccgcatctacgccgccaccaagttcttcatcttcacccaggccagcggcctggtgatgctggtggcgatcctcggcctggtgttcgtcaacttcaatgccaccggcgtgatcaccttcgactacgccaccctgctgaagacccagctgagcccccacgtggaatggctgctgatgctcggcttcttcgtcgccttcgcggtgaagatgccggtggtgccggtgcattcctggctgccggacgcccacgcccaggcgcccaccgccggctccgtggacctcgccggcatcctcctgaagaccgccgcctacggcctgatccgcttcgccctgccgctgttccccaacgcctcggcggaattcgcgccgatcgccatgtggctcggcatcatcggcatcttctacggtgccctgctgtccttcgcgcagaccgacatcaagcgcctggtcgcctactccagcgtttcgcacatgggcttcgtgatgatcggcatctactccggcagccaggtcgcgctgcagggcgtggtggtgcagatgatcgcccacggcctctccgccgcggcgctgttcatcctctgcggccagctctacgagcgcctgcatacccgtga

SEQ ID NO: 14892 - DNA, 330 bp, Pseudomonas aeruginosa
ccctcgcccacgcctacatggaaagctatccgggtaaccgcgaagagctgtacctgctcctgctgctggccaccgccggcggcctggtgctggtcagcgcgcagcacctggccagcctgttcatcggcctggagctgctctcggtcccggtctacgggatggtcgcctacgccttcttcaacaagcgctcgctggaagccggcatcaagtacaccgtgctctcggccgccgggtccgccttcctgctgttcggcatggccctgctctacgccgagtccggtaccctgggcttcgccggccttggcgccaaggttgccgagcacgtgctga

SEQ ID NO: 14893 - DNA, 486 bp, Pseudomonas aeruginosa
tcggcgccctggtgctgggcagcgccatcggcctgtactactacctgcgggtcatggtcaccctgttcctggtcgagcccggcatccgccagcacgacgcaccgttcaactggggccagcgcgccggcggcatcatgctggtggccatcgccctgctggcgttcttcctcggcgtctacccgcagccgctgctggaaatcctccagcattccggcctggccctcgccggctgagtcgcccgctccacgaaaaccccgcctcggcggggtttttctttggcccgccccacgcaccctgccccgctgccgtggcatgctccgcgctccatggatgaacccggaggcctcatgcccaccttccacgaaatcgacgtcctgcgacacaacagcgccagttgggacgcccaggccgcccgtgactgcgaatggtcgcgaccggtcagcgccgaagaggtcgccgccgcacgccgcggcgactgggcggtga

SEQ ID NO: 14894 - DNA, 1041 bp, Pseudomonas aeruginosa
tcagccggcggacgtggatcgttcacgactgccggccgactccgccgaataatgacaggaaggctctgtggcgcaccactgccggctggctcttttgccggcagcggtcgcgcgggggaagggtcagatgcggaactgaccgaccagtcggcccaggccctggcccagttgcgccaggctgcgggcggtctgcgcgccctgctgggcctcgtcggcgacgctgtccaccgcgccggcgatctggtgcacgctgcggttgatctcctcggccaccgcggtctgttcctcggcggcgctggcgatctgcgcgttcatcgcgttgatggtggcgatcagctgggcgatggcatccagcgaatcgccggcctggttggcctggttgctggtgccctcgccggcctcgccggaacggcgcatggcgtcgaccgcggcgttggtgccctgctgcaggcgatcgatcatgccctggatttcctgggtactctgctgggtgcggctggccagcgcccgcacttcgtcggcgaccaccgcaaagccacgtccggcctcgccggcacgggccgcctcgatggccgcgttgagcgccagcaggttggtctgttcggcaatggagcggatcaccccgagcacactgacgatggattgcacgtcctgctgcaggctatccagagaagtcccgctgtcgcggatctcgtccaccagcgcgtggatgcgctcgatgctgccgtccaccacgcgcttggccgcctggccttcgtggtcggtctgctgcgcggcctcggcggcgcgctgggcgctctgcgccacttcatgggcggcggcggacatctcgttgatcgcggtggcgacctggtcggtctcgtggcgctggcgctccatggcctgctcggaacgctcggcctgggccgacatctgctccaccagttgcttgaggtcgccggtcatcccggcgatctgccgcaccagaccgtggatcttctcgacgaagcggttgaaggaaccggccagctcgcccagctcgtcgtggctggtcaccggtag

SEQ ID NO: 14895 - DNA, 534 bp, Pseudomonas aeruginosa
ttgtgctggccgtcgacgttgagcccggaggtcggcccaagggtcgagtccgacgccggagaacctgcatcccccagcgcgccggcggtgccgacgatgctgacgatggccagcgggctgaagcccagttgcaccgccagcgggacgaagatcgcggcgatgatcggcacggtggagaacgacgagccgatgcccatggtgaccagcaggccgaccagcagcatcagcatggcgccgaccgccttgctgttgccgatccaggccaccgaggcgtcgaccaggctctgcacctcgccggtggccttcatcacctcggcgaaaccggccgcggcgatcatgatgaaaccgatggtggccatcatcttcatgccttcggtgaacaggtcgtcggtctccttccagcgcaccacgccggacagcgagaagaccacgaaaccgaccagcgcgccgatgatcatcgagtccagccacagctgtgcgacgaacgcggcgacgatggataccccggccaccgccaggctcttcgggttgtag

SEQ ID NO: 14896 - DNA, 621 bp, Pseudomonas aeruginosa
agcagcggcggcaccagcagcgggatgaaggcgatatggatcggcaggatattctgcgaggataccgccacgcagagcagcaggccgaccaggatccacttgaacgcaccggcgcccttgccctgctcgtcgtgccggccgagcagcgccaggaccttgtcggccagcgcatgggccacgccggagcgggcgatggccacggcgaaggcgccgagcatggcgtacgacagggccaccgtggcacccccgccgaggccgccgttgaaggccttgagagtcccctcaaggcctaggccaccgaacagtccgccgaccaccgcgccgatgatcagcgccagcacgacatgcacacggcaaaggctgaggacgagcatcagccccaccgccagcaccactgcgttcatcgttgaactccttgcaaatgaaacgaactcgaccgtctgcggccgaaaaaaggggcgtactctgctacagccatccccgcctgtcaaagccgcgcatgcgcgaatgtcgcctggctataaaccgttgtgcacggttcttgcgtgcgattcgccgaacgacggcaatccggcgccagcgaccggaccgtcgtcaagaatgggcgagccctgccgataa

SEQ ID NO: 14897 - DNA, 414 bp, Pseudomonas aeruginosa
gcaacctgcaggcgctcagcgaacagggcaaccgcgaactctatgacggcgtcggccaggtcggcatcctcagcccggccgggctgttcgccggcaacagccgcgacgccggcctgctcggcaagaacctggccaaggcggatccgcagcacgccggcgaactcctgcaactgctggccgccggcaagagccggttgttcaacgagaacgacgacctcaaggtgctgcaaccgttgcagccgattcccggcgccaagccctggggcgtgctcctcgaagtgccgaagagcgccctgctcggcccggccctggcgctggagcggcaactggacgacatgcgtcgcgaaggcacctgggtcgaactgggcctcggcctcggcgccgcggtgctcggcctgctggtgctgtggctga

SEQ ID NO: 14898 - DNA, 1266 bp, Pseudomonas aeruginosa
ccgcggcgaccgcccctcctctcgctgtccactggactcgcccaacaggaacaccagcaccggcagcatcagcgcccagcgccagcggcccgtactcgtccgccgtttcatcgtccaagacctccttgcaagaagcccgggatgctagggaaagcgcaggaggaaatcttgccgggagtgtcggcaaatggtgaagaactgttaagccctggcggcgcggccgctcttctgcaacggcaactcgacgctcacccgcaggccgcccagcgggctgtcctcgagactcaggcggccaccgcaggcctcggcgatgtcgcgcgcgatgcccaggcccaggccatggccgctgacctgctcgtcgagccgggtaccccgctcgagcaccgcctggcgctggtcggggaggataccggggccgtcatcgtcgaccttcaggcggaccatgccctcgccctgcgcgacggtcaggcggacttcgctatcggcccacttgcaggcgttgtccagcagattgccgagcatctccagcaggtcctcgcggtcccatggcaggcgcagccccggtggcgcgctccagctcacctgcaggtgcgggccgtggatcaggcgcagggtgtcgcacagcgacggcaactcctcggcgcaatcgaaatgtgcgccaggcagcgcttcgccgaccaggcgggccttgcccaactcgcgaccgaggcgctgctggatctgttccagctgttcgcgcaggacctgttgcaactccggctggcgcgccatctcctcgcgctcggcgaggctgaccagcaccgccagcggcgtcttcagggcgtgaccgaggttgcccagggcgttgcgcgaacgcttcagggtctcctcggtgtgcgccagcaggtggttgatctgctccaccagcggctccagttcctcgggagcctggttgtccagttggctacgctggccctgctgcagctgggcgatctgcaggcgcacctcctccagcggacgcagcgaacgacgcacggtcaggcgctgcaacagcaataccaggagcagcgccagggcgccggcgcccagacccatccactgcacacgggcgaagctttccaggatcggcgtatagtcctgcgccaccacgatccgcagcttctggcccatgcgcttgtagtggccgcggaacaccagcagtcgctgctcctcgggcccatcgaccaggccctgcaccagccctttcttgtgcggcacttccagctcgctgtcccacagggagcgtga

SEQ ID NO: 14899 - DNA, 1443 bp, Pseudomonas aeruginosa
cgcccgccaggcgccgccgctggccgcgctgaccgacttcccgtcgcgctacctgcacctggacggcggcaacctgcgccaggcgctgctcgcctccggctcgatcccgatggtcatggaaggcgtccgcgacctgcctggcgccggccccggcacctaccgcgacggcggcctgctcgactaccatctcgacctgccctacgaggaccgcggcgtggtgctctacccgcacttcaccgacaaggtgatccccggctggttcgacaagggcttgccctggcgccgtggcgacgccgggcgcctgcaggacgtgctgctgctggcgccgtcgcgcgagtacctggcgcgcctgccgcacgccaagctgccggaccgcaaggacttcacccgctacctcggcgacgacgacggccgcgagcgctactggcgccaggcgatggcggaaagccgcaggctcggcgacgaattcctcgaactggtcgacggcggccggctcggcgaacgcctgcaagcgctggactgagccgccaccgacgagaaggatcctgcatgaaactggccgtagcgctgatccacggcatcggcgaccagcccgatagccgcgacgaggacggtctgcacagctacgcccgcgaactggtggcggcgctgcgccgacgtctcggcgcggaagccggcgaggtggccttccagagcctgtactgggccagcgtactggacgcccgcgagctggactacctcaagcgcatcgagcgcgagccgctgggctggcgctggctgcgccgggcggtgacgctgttcctcggcgacgccagcggctaccgcaaggtcagcgccgcctacgacaccacctaccagcaggtccaccagcacgtgcgcagcgggatcatggccctgcgcgcgaaagtcgggccgcagacgccgctggtgatcctcgcccactccctgggcgggcacatcgtgtccaatttcatctgggaccagcagaaactcaaccgcacgccgagttgctcgatcgaccccttcctcggcctggaaaccctggccgggctggtcaccttcggttgcaacatcccgctgttcaccttcgcctacgagaaggtctgtccgatccgctttcccggccactgcctgcccccggccatccgccagcaggcacgctggctgaacgtctacgcgccggccgatccgctcggctatccgctgcggccgttgcagaactacgccgcggtcgtccacgaggacctcgccctgccggtcggaccctggtacaagcggcacaccccgttgagccacatggagtactggaacgatgcgcgttttcacgattacctggcggactacctgcgccgcctgttggctgctggcctcgagcctgccggcgctggccgcgccctccccgcaggcgagccaggagatcggccgcttgctgagctttgttga

SEQ ID NO: 14900 - DNA, 702 bp, Pseudomonas aeruginosa
ttggagacccgtccacccgcctcgcgcttgacgctgatgcggtattcgcggccgttgctggcagcggaaaagcgaatagttgcggcgcacttcctcgccgtcgatgtccagccgcaggccgatgtactgtcccggctggaacgccagcagcggctggccgtccaccggctccaggtagaacgaggtgatttcctcgctctccgcctgcttgcgtgccacgcggaagcgccgcacgccgcgccagccgccatcggcctgggcgctggcggcatacaccgactcctcggcctcgatcagcaggtcggccagttgctggtaggccgcgccccaggcttcgaggacttcgtcggtggcgatctgttcgccgaggacctcgcggatcgcccgcaacaggcaagtgccgacgatcggatagtgttcgggcagcacctgcagggagacatgcttgttcaccaccttggccaccagcgggccgagttcctgcaactggtcgatgtgcctggcgtacatcagcacgccattggccagcgcccgcggctggtcgccgctggcctggtgggcctggttgaacagcgggcgaacctcggggtactcgccgagcatggtgcggtagaaatgggtgatcagcgcttcaccgccggtctccagcagcggtacggtggctttgatgagggcacgttgggcattggacaacatagatga

SEQ ID NO: 14901 - DNA, 492 bp, Pseudomonas aeruginosa
ctcctgacgcatgcaaggttttgtttcacctcgaagcatttcaggaagcgtgccaaggcaaactaccagaattcacgggccttgcaggccggcataggtcataatgactgcaaccattcagagtcattaggactgcaaagaggtcgaaatgaccaccaaccccttgcttgccaccctgatcccgctggttgccgacctgtcccgcgacctgccggaagacgaacgctaccgccgcctgctccaggccctgcgcgacctgctgccctgcgacgccaccgcgctgctgcgcctggacggcgaatacctgatcccgctggcggtggacggcctcagcccggacaccctcggccggcgcttccgggtcggcgaacatccgcgcctcgaggccctcctggagcgccgcgggccgacccgcttccccgccgactgcggcctgcccgatccctacgacggtctggtggaaggcctccacggccacctggaaatccatga

SEQ ID NO: 14902 - DNA, 1524 bp, Pseudomonas aeruginosa
ttgcctgggctgtccgctgtacctcgacgaccagccctggggcttgctgaccctggataccctcgatccgtcgcgcttcgccagcgccgacctggataccctggaggccttcgccagcctcgccgccgccacggtcaaggccagcgagcggatgcgcgacctgacccgccgcgccgaggacgagcaccagcgcgccgaggcctatctcgaagccgctggcgagcggccacgggaaatgatcggccagagcgccgcgcacaaggcgctgctggaagaaatccgcctggtcgccaacagcgacctgagcgtactgatcaccggcgagaccggggtcggcaaggaactggtggcgcaatccatccaccggcattccatgcgcagcggcaagccgatgatcagtctcaactgcgccgcgctgcccgagaccctggtggaaagcgaattgttcggccatgtgcgcggcgccttctccggcgcggtcaacgaacggcgcggcaagttcgaactggccgacggcggcagcctgttcctcgacgaggtcggcgagttgccgctggcggtgcaggccaagctgctccgcgtgctgcagagcgggcagttgcagcgggtcggctccgatcgcgagcaccgcgtcgacgtacgcctgatcgcagccaccaaccgcgacctggccgaggaagtgcgtgccgggcgcttccgcgccgatctctaccatcgcctcagcgtctatcccttgcgcgtgccgccgctgcgcgagcgcggccgcgatatcctcctgctggccggctacttcctcgaggaaaaccgaccgcgcctgggactgcgcagcctgcgcctggaccacgaggcccaggccgcgctcctcgactatcgctggccgggcaacgtgcgcgaactcgagcacctggtcggccgcgcctcgctcaaggccctcggccacaatccggagcggtcgcggatcgtcaccctgcatcggcaggatctcgacctgcccgcggaaacccccgcgccacctcgcagcgtggtcgagcccgcgcccgccgcgccaacgaccggtcactcgttgcgcgcggccaccgacgcctaccaacgccgcctgatccaggactgcctggcccgccaccagggaagctgggcctcggctgcacgcgagctgggcctggatcgcgccaacctggcgcgcctggcgcgccgcctgcaactcaggtaaacgaccgcccggtcggagcagaccgggtccggcgcgcaaacctgctaccatggcgcccccattccggttgtccgataaccccgatccagagcgcactacagtggaactcttcaaagaattcaccttcgaatccgcccatcgcctgccccacgtccccgaaggccacaaatgcgggcgcctgcacggccactcgttccgtgtcgccatccacatcgaaggtgaggtcgatccgcataccggctggatccgcgacttcgcggaaatcaaggcgatcttcaagccgatctacgagcaactcgaccacaattatctga

SEQ ID NO: 14903 - DNA, 411 bp, Pseudomonas aeruginosa
agccactataaatgcaccaaaacccagcaccatatttttagaacgggagtgaaacgaatgtccaaacttgccgagttccgcgaggcagagcgcaaacttcaggagcaactggccctgctggaaaagctgaaaagcgacagcagcctgaagcaggaactggaattcaaggacaagttgcaggcgttgatggacaagtacggcatgaccctgcacaacatcatcgccatcctcgaccccaaggctccggtcaccgtcagcgccgctccgcagcgccgtgcccgcgccctgaaggtctacaagaacccgaacaacggtgaagtcgtcgaaaccaagggcggcaaccataaggttctgaaagcctggaaagaacagtacggttccgaaaccgtcgaatcctggctgcaacgctaa

SEQ ID NO: 14904 - DNA, 231 bp, Pseudomonas aeruginosa
ccggtgagcgaggactgtacggcgatctccgccgtctccaggtcgcgtatctccccgatcatgatcacatcgggatcctgccgcaggatcgagcgcaaggcggcagcgaaggtcaggccgatgtcggcatggacctggacctgggtgatattgggcacctggtattccacgggatcttccacgctgatgagcttgcgcacgccatcattgatttcctccagcgcgccatag

SEQ ID NO: 14905 - DNA, 1011 bp, Pseudomonas aeruginosa
actgccggaacgacgaacgcagccaaggagaccgccatgcccagtcgcatcaccctcaacgcaaacggaggccccgaggtcctgcgcctggagcaagtccaggcgcagcaaccgggccccggcgaggtctggctggagcaggccgccatcggcgtcaatccgctggacctcggccagcgctcgggagcggtaccgattccgctgccgtccggcctcggcctggaaggcgccggagtggtcgccgcgctgggtccgggagtctccggactggcgccgggcgaccgcgtcgcctatgccaccggcccgctgggcgcctatgccagcgcccggctctaccccgccgagcgcttgctgaagctgcccgacacactcgctttcgaggacgcggcggcgctgctgttcaagggcatcaccgcgcactacctgctgtacgccacctaccccgtcgggcccggcacacgcatcctgctgtacggcgcggcgggcgccgtcggccagttgatggcggcctgggcccggcacctgggcgcctgggtgatcggcgtggtgtcgaaggcggaaagcgtcgagcgggccagggctgccggctgcgacgaggtgctggtgttcgacgcggccagtctcgccgcccaggtcgccgagctgaccgccgggcgcaaggtcgatgtggtctacgaccccatcggtcgcgctaccttcgaggcatccctgaacagcttgcgtccgcgcggcctgctggtgtccttcggcgctacctccggcgtgccgccagccgtcgaagtcgccaccctcaacgccaagggttcgctattcctcacccgtccctcgctcgccgcccacaccgccaacccggaggaataccggctacgcgcgcaggctgtgctgcgcgcccatgcagacggtgtcattcagccccgggtctggcggcgctacccgctggccgaggcggccgtggcgcataccgatctgctggagggacgctcgcaaggcgcgctggtactcttgccctga

SEQ ID NO: 14906 - DNA, 1332 bp, Pseudomonas aeruginosa
ccaatgacccgccgaccggttcctaataggctggttcgcttcgctttcccgttttcccactccaacaacaacccgatgaggaatccaggcatgggacagtacgtcagcatcgccgcgtccgacggcagcggccggttcgacgcgtatctcgcgctccccgccagcggcaaggggccgggcgtggtgatcggtcaggaaatcttcggcgtcaacgcgaacatgcgcgcggtggccgacctgtacgccgaagagggctacgtggccctggtccccgacctgttctggcggctgcagccgggcgtcgacctgggctacgacgaagcggccttcgccaaggccatcgagctgttccagcgcatcgatctggacgccgcggtggacgacatcgccgcctgtatcgagcacctgcgccaacgcgaggaggtggtccacgccgggatcggcttcgtcggcttctgcatgggcggcaagctggcctacctcgccgcgacgcgcaccgacgtctcctgctcggtgggctactacggcatgggcatcgaggcgctgctcgacgaggcgaaacagatcaagggccggctggtgctgcatttcgccgaacaggacgcctactgcccgcagcaggcccgcgacgcgatcctgccctgcctgcgcaacctgcccaagaccgagttgtacctctaccccggcgtcgatcacgccttcgcccgcgtcggcggcatgcacttcgacaaaccggcctacctgatggctcacgaacgcagcatcgccgccctgaagcgggagatcgggccgaacttcgacctctccgcgctgtgggacgagcatgtgcgccacgagttcgatacccgcgacgtcgccgcgaccatggcgaccatggtcgccgagccctacgtcaaccatgtcccgaccctcaccggcggcgtcggccagcgcgaactgagccgcttctaccgccatcacttcatccacggcaacccgccggacatgaccctcacgccgatttcgcggacggtgggggcgctgcaggtggtcgacgagttcgtcatgcgcttcacccacagctgcgagatcgactggctgctgcccggcgtcccacccaccgggcgcttcgtggaaatccccatgctcggcgtggtgcgctttcgcggcgaccgcctttaccacgagcacatctattgggaccaggccggcgtgctggtgcagatcggcctgctcgacccgcagggcctgccggtcgcgggggtggaaagcgcgcgcaagctgctcgacgaaagcctgccgtcgaaccgcctgatggcgcgctgggcagccagcgaaggactcggcctctag

SEQ ID NO: 14907 - DNA, 549 bp, Pseudomonas aeruginosa
gattgcccaaatgctgggtctgggcgccatcggcgagggtctgcggcgtatcgatatgcacgatggcgccgctgcgcagcgaacgctggccatcgttgccggcctccggctccaccccgtagatccggcaggccggcgccagcgcgcggatcgccagggcgcagccggagagcaagccgccgccgccgaggggcgcgaagaaggcgtccagcggaccgacttcttcgaacagttccttggccgcggtgccctgcccggccagcacgtcggggtgatcgtagggcgggatcagggtcaggccatggcgctgcgccaggtcgcggccgatctgctcgcgatcttccgtatagcggtcatagagcactacctgcccgccgtagccacgggtcgcctcgatcttcaccgccggcgcgtcggccggcatcacgatggtcgccgggatccccagcaagcgcgccgagagggcgatggcctgggcgtggttgccggaggagaacgccaccaccccggcggcacgctgctcagcggaaaaccgcgacagcgcgttga

SEQ ID NO: 14908 - DNA, 1764 bp, Pseudomonas aeruginosa
tcattgcggcgggcactcctcttcttcgtccttcagcgggcatttgacgatctgcttgcccgtctgccaggcggcctgggtggccacggccttcttgatggtatcggcatgggcggccttgcgcgcggccagcttggccgcgcggttggcggtgttggccgcctgtccggaaagggtcctgatcgccttggcggactgcaccacggtcttgccggtgctgagcatgcccggcgccacggtgccgatggccgccgaggcgccgacgtgtttccagttgatgtcgatgcacttccacttgatatcggtgaggtcgcgatcgctgtcccagttgtccttcatctgccccagcacctgcttgccggtctgcatccccagctcgatgccggcgcccagcgccgctccgatcgcggcgcgggcggcgaaggcgccgatcaccaccagcgggatgatcaggccggtgggatcgtacgccatcgtgggcgcgttcagcgcataggcatagaggttggggccaccgcccaggccgagcgggtcctggctggcatagcacccggcttccggcaggtattaacggtagcggttgtagtaaaggccgctttcttcatcgtggtactgcccctggaagcggatcggctgcgcacccggctgtcgttccggcgctaccgcccgccagtcgtccggaacgccctgccaacgcagttggccacgttcgtcgctcagctgcaggggggtaccgaggtgatcggtgtggaaaaaagcgatccgcgcctcgcccagcgccggcacgcattgcgccggcagcggctggccttcggcggcgaacgcctggcgcagttgcagcagctccgggggatcgggctcgcaggcctgctccaggcgcagcaacgggacgaaaccgcccggttcgtgaacggtggtgcgcagttcccgcgcaaaggcttcggcgcattggcgatcgccgtcccagccgaagcgcacctgctgctcgacaccgtcgcgcagcaccaccttggcgatccgtcgcgacagcgcgtcgtagcggtagcgcgcctccagccgcgtgccgtcggcgtaatcgcgcgtcagatggaccaggcgctgcgcgccgtcgtaggccaggcgcaggcgctcgccgtcggcgccgatacgctcgaccaggttgcccagcgcatcgaagcgatagcggttgccggcgatcctctccacgcggttgccggcccagcgcgccgggccttcgccggcctggttcgcgcgcacctcggagcgactgaaaccggagcggtacagttcgttctcggcgaatgcctggcgagcgtcctcgcgcgcgtactcgccgacgccctccaggcggttgccggcggcgtcgtatcggtaggtgctggccgccgcgccagcgcgccggctggccagcaggcgaccgccgaggtcgtattcgtagcgcaccgacggatactggttgtcgtcgatgccgaccagttgtccaagtccgtcgtagcgatagccgcgctgccagtcgaaaccgccggccagacgcaggcggctgcgctgcaggcgtcccagcggcgcgtgctggcgctcctgggtgaacaacgcgtcatcctgcccgtcgcggcgggcgtcgcgacgcacctcacggtgcagggcatcgcgctcgaaggccagctcgaccgcaccgaccagcgcgccgtgcagatgacccgggccataggtcagccaggcgaccggcggcgcgtcgccgtagcggctggtctggcgcacgcctag

SEQ ID NO: 14909 - DNA, 2181 bp, Pseudomonas aeruginosa
cgcgtcgtggctgtgctcgacgctgtagacccaaccgtcggcatgtacctggctttccaggcgcaggttaccgacctcgtcgtacgtgtagcgcacctcgcaatccgccccgccggcgctggccaggcggccgtcggccaaccagcggtaacgctcgaccagggccggtgcgtgctcggtggcgggaacccggatgctcgccaggcggccatcgcggtcgtaggcataggtggtctcgcgaccgtcggcatcctcgcgggcgatcagttcgtcagcggcgttgtagcgatagcgttggcgacgaccgtcgaagccggtctcttccaccagacggtccagcaggtcgtagcggaactgcgcctggacgccgttctcgttggtcagggcgaccagcctgccggcttcgtcgtgcaggtaggacaattcgccgccgccggcgtcggaaacccgcgccagcagatcgccgtgcccccaggaaaacagcgtggcgtgcccctcggcatcggcgatacgggtctgccgcccaagggcgtcgtattcatagctcagggcgctgccgtcggccaattccaggccgatcagttgccccagcgggtcgtagcggcgccgggtcagttgtcccagcgggtcgctgctggcgaccaaacgtccttcgttgtcgtagtcgtaacgccagacctggccggaacaatcggtcaacgcggccaacaggccgaagcggttccactccaggcgccgctcgccgccgcgcgggtcgacgattcgcgtcggccggtcgggcaggcgcgggtcttcgtaggcgtagcgggtgctgccggccgggccgcgcaccgtcgtcgcattgccccgttcgtcgcgctcgaaggtccagcggcgctgcatcgcgtcctccagctcgaccagcagcccggtctcttcgtcgacgcgcttgcgatagcgcgccttgcccggcgactcctcctcgagcatccgcccctggccatcgcgccggcgccgcgtctcccgtcccagcggatcgcgcatggcgaccaggcggccgaacaggtcgtagtcgaactcgctacggctgccgtcggccctgaccagcgcggtccagcgccgctgcccaccctcgccggcgaactcgtagcgttcgacgcggccgaggctgtcgctgacctcggtggcatcgcgcaggtagcggaaggtacgggtcaggccgcccgcctcgatctgcttcacgacccgcccgtgcggagcatggacatcccactcgtagcgaacctccagcccacccggttcgccgtgggcgaccagcatgtgctcgcgccaggcgaatacccggaccacctggccaagacggtcgcgcacggcgatcagatcgccgctgtcgctgaactggtagcgcaccagccagtcgagccccgggctctgcggatcgatgtagtccggaggcggtccgtcgtggctggccaggatcacgccgaacagacgcaggccgtcgtcgccctcgctcggctcgcaggcttgctggtagaccagcgcatagctgcgcccggcgctgtcgcgcacgccggtgagcaggccacgtccgctccagcggaactcggtgcggtagccggcgcggccgaagctggcctgcaggcgccagataccgtcggggcaacgctggaaatgcaggtagctgtggccggacagcaccagcacggagccctcctgcgtctgcagttcggccggcaccgccgcccagcgcccgcgccaggcctgcgcttcgccgccgctcgaaccgccgcggcgcagccacagctcctcgctgccggaataatgctgggcaccgggagccagcgcaggaaagccgatccggcggccctgggcgtcgaccagcacgcaggcgtcttcgctcagttccaggtgcatgctctcgcccggcagccaccagccccggccgagccggccgatacgggggttgctcgacaggtagccacgggcgaaggtgaaggtgtccggcgccgccagggcgaaatcgacctcttccggcagcagcttgctgccgagcatcgggttgaccggcttgcccaccaacggcacgcaggcggacacccggtcggccaggccgaccgcgctgctgccgacgtgcacggtgggcgagccggtggagataacccctcccgagactttctcgccgacatgggaaaccggtag

SEQ ID NO: 14910 - DNA, 621 bp, Pseudomonas aeruginosa
cgatcacttcctggccgatccgcgggatctggatcgagccccagttcttccccgcccaggcctgggagacgcgcatccagcaggagctgttctcgttggactggtcgtggcggtcccagtggaaatgcaccttcacccggccgtactggtcggtccagatctcctcgcccttgggcccgaccaccaccgcggtctgcgggccgcgcaccaccggcaccggggtcgacggcaaggggcggaaagcctggccggcgtcgatacagtccagctcgctctcgaactgcgcgccgcccccgccattaccggtctcgtagagttcctggactacccggtactcggcgccaaccaccaggtattcgcggttctggtccaggcgcgggtagttgctcaggtggaacagatggcccgccccgatacccctggcgcatccccgcaggcgaactcgctcgtactgggtctggatcgcctcgatgcgggtccgtgcatagtgttcgccgtcctgactctgcacatactcgccagggtagtcgtagagcgggtagtcggccgcggcatgggcgcgcccgacattggagcgcacttccaggcgggtgccgggacgctggaagtcgtagtcgttga

SEQ ID NO: 14911 - DNA, 1116 bp, Pseudomonas aeruginosa
gcaagccgttcctctaccggagcgtgctgcaccgcagctacacgcgcctcgaccgcggtctcgacgtgcacgtctgcaacctgcggcgcaaactcgccgcggtcgccgtccgtcacctgcagatccaggcggtacgcggccagggctacctgctggtggagacggaacacccctgatgcgcaggcacccgctgttatggaaactggcgctgctgcaggtcggcttctgcctgctgctgacctggctgatctacacctggggcctgtcggtggagcgcagcacctacttcctcgccccggccgaccgcagctacctggcggactacgcgcggcaggcggaggatgcctggcgcagcgagggtgccgcgggcgccgaacgcttccgcaaggaactgtcggcgaaggaagatacctgggtggcgctggtcggaccgcacctggaaagcctcggcagcacgccgctaagcgccgaggagtcgagccacctgaccttcatgcgcaagctcgactggccgatgagccggcgcctgcaggacgaactgccgtacgtcagcatcgagttcccccgacatcccgagcagggccggctggtaatccagttaccggagcgcctgctgcccggcgggctgaccccctggacccacctggtcacccacggcatagtcccgaccctgctggccgccctgctcggcctgctgctctatcgccacctggtggtgccgctgaaccgcttgcgcgatcgcgccgacgccctgcgcgccgacgaactggaaagcactcccctcgccgcaccgctggcggcccgccgcgacgaactgggcgagctggcccaggccctggagcacatggccgagcgcctgcgcctgagtctcgcccagcagcgcctgctgctgcgcaccctgtcccacgaactgcgcacgccgctggcgcgcctgcgcatcgcccacgacagcgagctaccgccggaacagttgcgccagcgcctggatcgcgaaatcggcgacatgcaacgactgctggaagacaccctcgacctcgcctggatggacaccgagcgcccgcaactgcccaccgagccggtgctggcgctgtcggtgtgggaagcgctgcgcgatga

SEQ ID NO: 14912 - DNA, 933 bp, Pseudomonas aeruginosa
tctcttgcatttcgctgcattgcccggagatccccgatgtcctcacgcgcccttcccgccgttcccttcctgctgctgtccagttgcctgctcgccaacgccgtacacgccgccggccagggcgacggctccgtcatcgagctgggcgagcagaccgtggtcgccaccgcccaggaggaaaccaagcaggcgccgggggtttccatcatcaccgccgaggacatcgccaagcgaccgccgagcaacgacctgtcgcagatcatccggaccatgccgggggtcaacctgaccggcaacagctccagcggccagcgtggcaacaaccggcagatcgacatccgcggcatgggcccggagaacaccctgatcctggtcgacggcaagccggtcagctcgcgcaactcggtgcgctacggctggcgcggcgagcgcgacagccgcggcgacaccaactgggtgccggccgaccaggtcgagcgcatcgaagtgatccgcggcccggcggcggcgcgctacggcaacggcgcggcgggcggcgtggtgaacatcatcaccaagcaggccggcgcggaaacccacggtaatctcagcgtctacagcaatttcccgcaacacaaggccgaaggcgccagcgaacggatgagcttcggtctcaacgggccgctcacggaaaacctcagctaccgcgtctacggcaacatcgccaagaccgactcggacgactgggacatcaacgccggccacgaatccaaccgcaccggcaagcaggccggcaccctccccgccggtcgcgaaggcgtgcgcaacaaggacattgacgggctgctcagctggcgcctgacgcccgagcagaccgtcgagttcgaggccggcttcagccgccagggcaacatttacaccggcgacacgcagaacaccaacagcaacaactga

SEQ ID NO: 14913 - DNA, 459 bp, Pseudomonas aeruginosa
gacgcctggccgacggcgacgcaccgctgctggtcgccatcggctaccgcacgccgctgcgcatcgaccgcgccgggcgtaccttcgactacacccccgcgagtcccggccaggccgatcagcgcgacccgctcaacggcctgcccagcggtggcgccgacgccttcctcgacctgctgcgcgacggcatgcgcccggccgtggcggcgcaggcgcccctggacaccgcgcgacaaaccctctggggacactcctacggcggcttgctggtgctccacgcactgttcacccgtcccggcgagttcgcccgctacgccgcggccagcccgtcgctgtggtggcgcgacggggcgatcctcggcgaacgagcggggctcgaacagcgcctgcgcggaaagcgcgcggaactcctgctctggcgcggcagcgccgaaccggccagcccgcgcggctcgctga

SEQ ID NO: 14914 - DNA, 204 bp, Pseudomonas aeruginosa
ccgcttcgcggttattcgccctaccggaagccaggcatccgcgcgccgctgcatccctctacgctgcacggcatcctctcccgcctgcgggagagggttggggtgagggaaaatcgccctacgctaccaccggaatcagcgggtcggccgctgccagcgccacggcgcggtccgccgccggcgggtagatccacacgccattga

SEQ ID NO: 14915 - DNA, 540 bp, Pseudomonas aeruginosa
agccgccgccggcgaccaccacggtgttgcgtgccggtgaatccggcaagtcgcgcagggcatgcaggtgtgcctctaggcgcagggcgtcttccaactggtcgacatcgaaggcagcgtcgatgccgacgacactcgccggacgccacacgccgctgccggccgccagcaccaggcggtcgtagtccagttgcgccagcgtgccctcggcatcgcggtactccacccacttgccggccacgtcgatgcgctgcgcgctgccctgcacgaaacgcacgccgaccgcggcgaacaattcgcccagcggcgccgccatgcgctgcacgtcaggctcgtagaaacgcgggcggatgcgcagctcgggctgcggcgcgagcaccgcgacctcgacgtcgtcgcggccctggcggtcgagctggcgcactgcgctcagcgcgctccacatgccggcgaatccggcaccgacgatcaggatacgttgtttcattgggggctcctggagggaaaggacgggatatccggagaaaagcctctccgtaa

SEQ ID NO: 14916 - DNA, 1233 bp, Pseudomonas aeruginosa
gcttggctgacaggacggcagactcccgcggcggcgccaggttcgacccgcgcgacgatggactcagcgtttccgcacgcgcgccatgcagcgctggtagcgttcgtcgacgcgcttggcgaaccaggcggtggtcagcttgcgggtgatcttcgggctctccagggcgatccccggcagcacggcgcggggcaatgtcttgccggtggcgctttcggccagggcgaagaccttgcggtacagcgcgctgtcggcgaactccgggctgtcgccctgctccagcgcccggcggatcgccgcgtcgctcatgtccaggcgcttgccgaggctgcgcacggccagttcggtggagcccggcgtgcgcgtgccgtagcggatcagatcgccatccagcgccagcggaatccccgagacgcgactcaccgcgctctggaacgcggcgttgcgactggcataccagccggcgttgaagtcggcgaagcggtacagcggcgccgggtagtccgccggatagccaagcaggtgggcgatgccgaaatacatgccgccgcgccggctgaacacctcgcggcggatgctgccgtccagcggatagggatagccgtccgcgtgctgctcggcgaaagcgatgctgacctgcatcggcccgccggtgtgtaccgggttgaagccgccgaacagcttgccgcccatgggcacgatggcgatgaaatcgtcgaatgtctcgctcagttccttctccgtgcgcgccgcggccaggcgctggctgtaggtgcggccatcgggcgacttgatattcagcgccgagctgaccaggaacgccggcacgtgcagcttgccggcacgacgctcgacctcgcgggtggcgatcctgcccaggccggccaccggcgggtcgacctggtaggtggactcctgctcggtcaccgccagcaccgcacagagattctcgtcgctggggtagatctgctgggcggaaaaggccgcgtagatatcgctggcccacccttggcgatcgcgcaccgtggccggcatcaggcggacgatcttcgcccgtacttcgtcggggttgggcggcggcggctccgccgaccgcgaactgcacccggccagcgccaggagcatgagcaaccccgttacgccgcgaccctggcgtactgctttcatctgcgattccctgttccgttgcgaagtgggcggccaatggcgaccgccgaagccagggcattctag

SEQ ID NO: 14917 - DNA, 2010 bp, Pseudomonas aeruginosa
ccgattccgccccgctgccaggagcacgccatgagccacgatccgccgagcaaggaccgccgccatttcctcactaccagttcggtgctgggcgccgccggagtcctgtggtccgccctgcccttcgccaacgccgccagcctttctcccgcaagcaacccaggaggttccatgaccgccgacctgatcctgcacaacggccgtttccacaccgtggaccgcgacaaccccaccgccaccgccgtggcgatcaaggacggcaagttccttgccgtcggcaacgacgccgatgcgatgctccatcgcggcagcgccacccaggtgatcgacctgcagaagcgcaccgtgatccccggtctcaacgactcgcacctgcacctgatccgcggtggcctcaactacaacctggagctgcgctgggaaggcgtgccctccctggccgacgccttgcgcatgctcaagaaccaggccgaacgcacgcccagcccccagtgggtgcgggtggtcggcggctggaacgagttccagttcgccgagaagcgcatgccgaccctggaggaattgaacaaggccgcgccggacaccccggtgttcgtcctccacctgtacgatcgcgccctgctcaaccgcgccgccctgcgcgtggtcggctacaccaaggacacgcccaacccgcccggcggcgagatcgtccgcgacagcagcggcgaacccaccggcatgctgatcgcccggcccaacgcgatgattctctacgccaccctggccaagggaccgaagctgccgctggaataccaggtcaactccacccgccagttcatgcgcgaactcaaccgcctcggcctgaccagcgcgatcgacgccggcggcggcttccagaactacccggacgactaccaggtgattcgcgaactggccgaccagggccagctcaccgtacgcatcgcctacaacctgttcacccagaaaccgaaggaagaactcgccgacttcaagaactggaccggcagcgtcaagtacggccagggcagcgatttcttccgccacaacggcgccggcgagatgctggtgttctccgccgccgacttcgaggacttcctcgaaccgcgccctgacctgccgcagaccatggagcaggagctggagccagtggtccgccacctggtggagcagcgctggccgttccgcctgcacgccacctacgatgaatcgatctcgcggatgctcgacgtgttcgagaaggtcgaccgcgacattccgttcaacggcctgccctggttcttcgaccacgccgagaccatcaccccgtgcaacatcgagcgggtgcgggcactcggcggcggcatcgcgatccaggaccgcatggccttccagggcgagtacttcgtcgaccgctacggtgccaaggccgccgaggccacgccgccgatccagcgcatgctcgccgagggcgtgccggtgggtgccggcaccgacgccacccgggtctccagctacaacccctggacctcgctgtactggctggtcagcggtcgcaccgtcggcggcatggccctgtatccgcagggcctgccgcgggaaaccgcgttgcagctgttcacccacggcagcgcctggttctccagcgagcagggcaagaaaggacagatcaaggttggccagctcgccgacctggcggcgctgtcggcggacttcttcggcgtcgaggaagaggccatcaagtggatcgagtcggtgctcacggtggtcgacggcaaggtcgtctatgccgccgccgagttcgacaagctcggtccgccggcgccgccggtgctgccggactggtcgccggtggccaaggtacccggccactggcggcaaggcgcgccgctgaccgcccaggtccaccagtgcgtcggtgcctgcgcggtacacgcccacgagcacaaccgcgcgcgccactccaacgtaccggtgagcgacttccagggtttctggggcgcattcggctgttcctgcttcgctttctga

SEQ ID NO: 14918 - DNA, 1356 bp, Pseudomonas aeruginosa
cgtacccgggcgggcccttcgcggcccgcctcgcccggagttttcccgatgatccgcgttcgaccggtcggccgcctggcccttttcctggcgctgggcggcacctcgccgtgccacgccgcgacacaggaagccaaggcgcccgactacctggagtggcgcctgctcaaccgcaactacttcctctacaacgactatcgccgcgcggacgccgggcgcggctaccgcaaggaatgggcacacggcctgatcgccgacctggagtcggcctatactcccggccgcgtcggtttcggcctcgatctccacggcttcgccggcttcaagctcgacggcggacgtggccatgccggcaccggcctgttgccgctggactcatccggcgataacgccagcgagtattccgacgccggcgccgcactcaagctgcggctcggcgagagcctgctcaaggtcggcgaaatgaccgtcgagaccccggtcttcgataccagcgacaagcgcctgcaaccccagtacgccaggggcttcttcctgcagagcgacgacctcgaccgcgtgcggatccaggccgggcgcttcaccgccttcaaggaacaggcctccagctccggccatggcgacttcgacggctacggcgcgagcaccgccggcagcgccatcggcttcgccggcgccagcctggcggccagcgacaacctgagcggctcgctgttcgccgcgcaactggacaacgtctggcgccaggtctatctcaacatgaacctgcaacgtgccgcgttcagcctggatggcaacctctatcgcacgcgcgaccagggccgcagccgggccggcgcgatcgacaccctggcctacagcctgcaactgaagtaccgcgtcggcgcgcagggtttctccctggcctaccagcgtgtccatggggatacgccgttcgacttcgtcggaggtgactccatctacctcgccaactcgatcaagtacgccgatttcaacggtccgggcgaacgctcctggcaggcccgctacgatctcgacctggccccgttcggcctgccggggctgagcttcatggcgcgttacgtcagcggccgcgccatcgacggcagccatgcgccggccggcggcgcctacaacccgctgggcgccgatggccgctaccggcccttgcagggcagcggcggcaagcactgggagcgcgacctcgacctgcgctacctgttcgcctcgggcccgttcaaggacctctcgctgaacgtctcgcacctcagccaccgggccaacgcggcccaggccggcgacgacatcgaccgcctctacctgatcgtcgaatacccactcaaaggctcgctctga

SEQ ID NO: 14919 - DNA, 612 bp, Pseudomonas aeruginosa
aaatactccaggtgcttgaactcggtcttgcaggccgagaacagctcctcgcagaccttgacgtgggcgtccatcgagccgccgatgtccagcagcagcaacagcttcaccgtgttgcgccgctccgggcgcatctggatgttgagcagcccggcgtccttcgcggtgtggtcgatggtgccgtcgatgtccagctcctccgccgcgccctcgcgggcgaacttgcgcaggcgccgcagggcgatcttgatgttgcgcgtacccagttcgacctggtcgtcgaggttcttgtattcgcgctggtcccagaccttggccgccttgccctggcgcttgccggcgtcgccgacgcggatgccctccgggttgaaaccgccggagccgaacggactggtaccgccggtaccgatccacttgttaccgccggcatggcgctccttctgttcctcgaggcgtttcttgaactcctcgatcagcttgtccaggccgccgagggactggatctgcgccttttcctcgtcggtcagcaggcgctcgaactccttgcgcagccattcctcggggatcagcgacttgaggtggtcgtcgagcttctccaggcccttgaagtag

SEQ ID NO: 14920 - DNA, 2247 bp, Pseudomonas aeruginosa
acgcagacgggtcattcagtcactgaatgcccggccacctcgcgacccgccgttccgcccgcgtcttcagccgtcgtcgtcgcgcgtcgccggggaacgctcgaaacgagcgttgaacgcctcgacgaacgcgttgcggagaatcccgaggaacgcctggaacgcgctgacgtcccgctggtggatattaccgctcaggttcacacgggttgcgaactggtctttgcgctggttcttcagcacagtctcgccaccgccgaccagcgcctcccacaccgagcggaacaggttcttgtcgccatcctccacgtcctgccgccagttgaacacgtccacgtcgcgcagcagcggcttgatgtagccatccagctggccgcgcttagcctgggcctccagcaccaggtcgccggtgccggcattgaagtcgaacttgccataggcgctggcgaagtcgttgagccgcttcagctcgacgcgggtgacccgcaggcgcaggtcgaagtcctcgaagtcgctcagcgggtcgaaatgcgccgccacttccagcggcgcctggccgagtatccgcgccgtgccttcgagacgcgccggccgctcgccccgggcgtcggccacgttggtcaggttatagatgctggcgttgagcgccgaggcgtgcaggttcaccggcggcttcgaagtgaagttgcggaaacgcagggtgccgtccaccacccgcacctcgttgagggtgatcggcagcagcttgtccagttgctcgcgccagtcggtgccggcaccggtctgcgaggcgtcgcggtcgccgccggcatcgacgaagttgagctgcggacgctcgaagaccacccgcgccactactgcgtgatcatcccagagcgcctgccagctcaccgacaggtcgatgctcggcgcgtcgaggaacggcaccggcaccttgccgttgtccttgacgatgctcagcccgtcgatccgatacgcgccgcgccagagcgccaggtcgacgtcggcgatgtgcccacggtagtcgcccatgtcggccagcttgccgttcaggtagtcgcgcaccaggtacggcagcgccaggtgcagcgccagcaacaacagaagcagcgccgccaggctgcccaggggaatggcatagcgtttcttcatcggtacggccctcctggacagtggacacgcgcggcgcgccgctggttcgaacgcgtctggacgcgcgggcgggggcggaataggctgattgatctttctccatgcgacaaggacaccatcatgagccgcatcttcgcagacaacgcgcagtccatcggcaacacgccgctggtccagatcaaccgcatcgccccgcgcggcgtcaccatcctggccaagatcgaagggcgcaaccccggctattcggtgaagtgccggatcggcgcgaacatgatctgggatgccgaagccagcggcagactgaagtccggcatgaccctggtcgagccgacctccggcaacaccggcatcggcctcgccttcgtcgccgccgcacgcggctacaaactgatcctgaccatgccggcgtcgatgagcctggagcgacgcaaggtgctcaaggcgctgggcgcggagctggtcctgaccgaaccggcgaagggcatgaagggtgcgatccagaaggccgaggaactggtcgcgggggatcccgggaagtacttcatgccgcagcagttcgacaacccggccaacccggcgatccatgagaagaccaccggcccggagatctggaacgataccgagggcgcggtggacgtgctggtctccggggtcggcaccggcggcaccctcaccggcgtctcgcgctacatcaagaacacccggggcaagccgatcctcgccgtggcggtggagccggtgacctcgccggtgatcagccagaccctcgccggcgaggaggtcaagcccgccccgcacaagatccagggcatcggcgccggcttcgtgccgaagaacctcgacctgtcgctggtcgaccgggtcgagaagatcggcgacgacgaagcgaagaacatggcgctgcgcctgatgcaggaagaaggcatcctctgcggcatctcctccggcgcggcgatggccgccgcggtgcgcctggccgaggagccgaacatgcagggcaagaccatcgtggtgatcctccccgattccggcgagcgctatctttcgagcatgctcttcgacggcctgttcagcgaacaggaactgacccagtaa

SEQ ID NO: 14921 - DNA, 1449 bp, Pseudomonas aeruginosa
gcgccggcggcgaaccagtccgtcgccgacgctgtcgtcagccgacaggacacctacaacaatgaagacccgcatcgcttccctcaccctcctcgccctcgcttgcggcagcggcgcaaccctcgccgcggacaacctgaagatctacaactggtccgaatacatcgctcccgaaaccgtggcgaacttcgccaaggaaaccggcatccaggccacctacgacgtctacgacagcaacgagaccctcgacggcaagctgatgaccggccaatccggctacgacgtggtattcccgtcgaaccacttcatggccaagcagatccaggccggcgccctgaagaagctggacaagtcccagctgcccaactggaagaacctcaacccggtgctgctcaaggccctggaggtcaacgatccgggcaaccagtacggcttcccctacctctggggcaccaccggcatcggctacaacccggcgaagatcaaggcggtgctcggcgacgacgcgccgctggactcctgggatatattcttcaagcccgaatacatgcagaaactgagcaagtgcggggtggcggtgctggacaacggccccgagctgctgcccatcaccctcaactacctcggcctgccacaccacagccagaaggccgacgactacaagcaggcccaggcggcgctgctgaaggtgcgcccgtacatccgctacttccactcctcgaagtacgtcagcgacctggccaacggcgagatctgcatggtggtcggtttctccggcgacatcctgcaggccgcgacccgcgccaaggaggccaacaacggcgtggaagtgcgctactcgacgccgaaggaaggctcgccgctgtggttcgacatggtctcgatgccggtcgacgcgcccgacgagaaggccggctacgccttcatgaactacctgctgcgtcccgaggtgatggccgcgatcagcaaccatgtgcactacgccaacggcaacctggccgccgacccgctggtggacgccgagatcaaggccgacccggcgatctacccgccgcaggagaagatggccaagctgttcgccctcgagtccatgccgcagaagatcgaccgcgtgcgcacgcgcacctggaacacggtgaagaccggcaagtgaagcccggcgccggcccggtttgtcgccgggctggcgttttagcgcaaggctcgcccacaggctcgtcaaatcccggacggcccgctatagtccctctcgttgtcttcatcgaccggatagcctccatgaaccagcgctcgcacagctcgctccccgcccttccggtagccaccggcgaggtcggcgcgctccagccgtgcgccagcctgagctgcgtttcccctcctgtagtcgcctcgcctccgcctccccctcccggttcggccgcctgcccgccgccgggcgtcagtccctga

SEQ ID NO: 14922 - DNA, 975 bp, Pseudomonas aeruginosa
cgccccaactctcttccacagcccgccgcaagcagcgccatccgctgccgaggcgtgccgtccgccgccggcccgagcccgcggcatgcccgactacaaggtggcagatccatgtttgcactgaacaaatccgcgctggccggcctggccagcaccagcctcttcgtcctgctctggagcagcggggccatcgcctcgaaatggggcctggcgcactcctcgccgttcgccttcctggtgttccgcttcggcatcgccctggcctgcctgctgccgctcgccccgctgctcaggctgcgcgcgccgcgcagcgcgcgtgagcgcggcaaggccctgctcaccggcctggtgatgctggggatctatccgatcttctatatcttctcgctgaagctgcaggtcactcccggcatgatggcgaccatcctcggcgtgcaaccgatcctcaccgccgtcatcctcgaacgccggcagtcgccggcgcgcctgttcggcctgctgctgggcctggccggcctggtgctggtggtctaccagggcatcggcctggccgggatgtccacggccggcatcctctgcgcactgctggcgctggccggcgtcaccggcggctcgatcatgcagaagggcatccgcgagaacccgctgggcaccctgcccctgcagtacctcgccggcctcggcctgtgcctggcgttcgtgcccttccagccgttcgagttcgaatggaacgccggcttcctggtccccgcgctatggatgggcgtcgtggtctcggtgggcgcgaccctgctgctctaccggctgatcgcccagggcaacctggtcaacgtcaccagcctgttctacctggtgccggcggtgaccgcgatcatggacttcatggtcttcggcaaccgcctcggctggctcagcctgctgggcatggggctgatcgtggtggggctgatgttcgtcttccgcaaggccggctga

SEQ ID NO: 14923 - DNA, 396 bp, Pseudomonas aeruginosa
acaaccgcaagaccgctgcccgcgccggcttcgacgggttgccgccgctggccgccgaccgcctgttccaggccatgctcgacaacccgtccggggtggtcttcgccgaaaccacctacgccgaaagctggcaggccgtcgcccgtcccgaacagcggatcaacctgcacatccccgaactgttgccggaactggccaagctcgcccacagcgcgccaccccacgatccggcctacccgttcatcctcgccgccggcgagcggcgcagcgacaccagcaataccgccgtgcgcgacaccggctggcaccgccgcgggcgctacggcaccctgcgcatcagcccgcaggacgccgaggcgctgggctgcgccgacggcgaggtgctgcgcgtggtga

SEQ ID NO: 14924 - DNA, 456 bp, Pseudomonas aeruginosa
ccgactgcacccagcgcgacttcctcgccggcacgccctggcacaagtacgtgccggcgcgcctggaacggctggcgacgcccgccgctacgaacgcctgagccagggaggacgatcatgaccttcgtcgtgctggaagaatgcatccgctgcaaacacaccgactgcgtggaagtctgtcccgtggactgcttctacgaaggccccaacttcctcgtcatccaccccgatgaatgcatcgactgcgcgctctgcgagccggaatgcccggtcgccgcgattcgcgccgaggacgaggtgccgctcgggcaacggcagttcatcgccctcaatggcgaactcgccgcgcatcccaactggacgcagatcacccgcaagaagccggcgcccgacgaccacgacgcctggttcggcctgccgggcaagctggccgaactcgaccgcaacggcgcctga

SEQ ID NO: 14925 - DNA, 525 bp, Pseudomonas aeruginosa
agtaggcttgaaggtcaacgcgtttcgaggtgcgacatgaaaatcggcgaactggccaagctcaccggcctggcgacatcgcgcatccgcttctacgaggccagcggcctgatccgctcgcagcgcaaggccaacggctaccgcgactatgcggcagacaccgtgtggatcctggagctggtcaccggcgcccagggcgccggcttctccctggaggagatcgctcgcctgctgccgagcggcgacggcgcctggcagcacggcgagctgctcgaaggcttgcgccgcaaggtggccgagatcgaggccctgcaacgacgcctggaacagaacaaggcacaattgctggtggccatcgaaagcatcgagaacaagccggacggtctgcagtgcacggaaaacacccagcgcgtgctggagcgcctgcgcgaggaaggccctccacagacggtcgggcgtccacggcaaacccgctcgcgggcgtcctctcccacgccggcggagcagcggctttccgacgcttga

SEQ ID NO: 14926 - DNA, 762 bp, Pseudomonas aeruginosa
agtgacgccaacccacccggacagcctgccgaaaccggctgccgacgggatcactcaccgaggaaggtcaacgcaatgaccaagcgcatcctgcacgtcgtcaccaacgtcgcccactatgccgatccgacccagcccaccgggctgtggctgtcggagttgacccatgcctacgagatcttcgccgctcggggctaccagcaacgcctggtcagcccccgcggcggcgagtcgccgctggagccgcgcgccctcggctggccccacgccgacgccagcgccaaggcctggctggccgacgagacgcgcctggcgctgctggccgacactgccgctcccgagcaggtcgacgcggaggcgttcgacgccatctatttcaccggcggccacggcgtgatgtgggacttccccgacgacgccgggctgcagcacctgacccgcgagatctaccagcgcggcggcatcgtctcgtcggtctgccacggctattgcggcctgctcaacacacgcctggacgatggccgcctgctggtcgccgggcgccgcctcaccggctactcctggatcgaggaagtgctcgccggggtcgcccgcaaggtgccgtacaacgtcgaggaagaaatgaaacgacgcggcgcgctctacgaaagaagcctgctgccgttcaccagcaaggtggtggtcgacggccgcctggtcaccgggcagaacccgcagtcggccaaggccacggccgagcaggtggccgccctgctcggctga

SEQ ID NO: 14927 - DNA, 516 bp, Pseudomonas aeruginosa
actggcggggtcgaccccgcccgtggagacctcgccatgaacagcaagaacaccatctgcctctggtacgacagcgccgccctggaggccgcgaccttctacgccgagacatttcccgacagcgccgtgctggctgtccatcgcgcgcccggcgattacccttccggcaaggagggcgacgtactgacggtggagttccgggtgatgggcattccctgcctcgggctcaacggcggcccggccttccgccacagcgaagcgttctccttccaggtcgccaccgacgaccaggccgagaccgaccgcctgtggaacgctatcgtcgacaatggcggcgaggaaagcgcctgcggctggtgccgtgacaagtggggcatctcctggcagatcaccccgcgcgtactcagcgaagccatcgccagccccgaccgcgcggcggccaggcgcgccttcgaggcgatgatgacgatgggcaggatcgatatcgccaccatagagaaggcctgcaagggctga

SEQ ID NO: 14928 - DNA, 345 bp, Pseudomonas aeruginosa
aagggatcgcgaaggcgacggacgcagcgaagagtgacgttgttccagcaggagaagggaggcagcatggacgaactgttcgaagagcacctggagatcgccaaggcgctcttcgcgcagcgcttgccgtactggtgcgatgtctttctgcgcccggccgaccaggctttcaacgcctacctgaatgcccgcggccaggcctccacctacctggtgctcgaaggcttcgatccggtctatattcctcgcggctgcgacctcgacgccgtgcgcgcgaccgccagggccagggctcgattgagggaagcggggctgggcgaagacgcgctgcccgtactgctctga

SEQ ID NO: 14929 - DNA, 2025 bp, Pseudomonas aeruginosa
tcggccgcgggatcgaggcggcggcgcaggcgttccgctggggctgccggagctacgacggttgagcaggcgctccgccaagcctggcacccggaactcgtagcggttttcgtcgtctccggcgaggtcagggttggagacatggccctcggggcaatatgctgtggccacgacacacgctgtgagcgactaccgatgccagggactgcactgttcgaaaagccacgctggttgcgcgacctcctgcgcttcctgcccctcaagagtcaattcgtcctctccgggaacatccgcgacctgcaagcctgcgaagtggtgccgggtacggtcaccgcgcagagcttcaaccagaccctctgcgacgccctgctggacgccggctacgcccaggtgctggcctgggatccgctggccgggttccgcgtgctcggccggccgggcagcgaggcgggggccactccgcaggtgcttctcgacctcggcctgaccccggtggacggcgccgcgccggccggcatcgacctactcggcgcgaccctgcaacgcctggtcaaccgtagcggcgagccgatcgccctgatcgtcgacttcgcctcgcgcctggcggtgcgcaacgacgccctgagcgccgccgagcaccagttgttcacccaggccctggtgctctcccaccaggcccgcagccgtcccgccggggaacagcgcaaaccgttcttcaacagcgtgctgtgggtggtggaaaaggaaggcgacctgcccgactggctgctggtggacaacccgcgcctgcgccatatcccggtgtcgaagcccgaccagccggcgcgccgggccctggccccggcgctgctccgcgggctcggcggcgcgggcgtcgccgaggaggccctgcaacaggccgccgcaaccttcgtcgagaacaccgaaggcctgctgctcctcgatctcaacgccatcgtccagttggcgcgcgtggaaggcctggccatggaacgcatcgccgacgccgtgcgccgctacaaggtcggcgtcaccgaagacccctggctgaagatcgaccgccagcgcatccgccaggccgacgagatcgtccgccgccgggtcaagggccagcagcacgcggtgacccacatgctggacatcgtcaagcgcgcgatgaccggggtcggcgccagccgcaagggcaaccgcccgcgcggcgtggccttcctcgccgggcccaccggggtcggcaagaccgagctggcgaagaccgtcaccagcctgctgttcggcgacgagagcgcctacatccgcttcgacatgtccgagttcagcgccgagcatgccgaccagcgcctgatcggcgcgccgcccggctacgtcggctacgacgtcggcggcgaactgaccaacgcgatccgcgaaaaacccttcagcgtggtgctcttcgacgagatcgagaaagcccacccccggatcctcgacaagttcctgcagatcctcgacgacggcgtgctcacctccgggcgcggcgatcgcgtgtacttctccgaggcgctgatcgtgtgcacctcgaacctgggcatctaccgccagggggaaaacggcgaacgggtcgccaacgtgctccccggcgagcccttcgaggcggtgcagggcaaggtccacggcgagatcgagcgctacttcaagctggttctcaaccgcccggaaatcctcaaccggatcggcgagaacatcatcgtcttcgacttcatccgcgccgacgtcgccgagcagatcttcacccagatggtcgacggcaccttcgccgacctccgcgagcagcgcctcgtcatcgaactggccgaggcgccgcgccaggcgctgcacgacctctgcctgggcgacctgtccaacggcggccgcggcatccgcaaccagctcgaagcgcgcctgctcaacccgttgtcgcgggcactgttcgaccaggacgcgcagccgggcgagcgcttcctgatcagcgccctggacgccgacggcctgaccctggaacgccgctga

SEQ ID NO: 14930 - DNA, 441 bp, Pseudomonas aeruginosa
catccgctgccccggctgcatctccgccgatacctgggggccgggacggcggcgcatcgccctggcacgcctgctcgccgacatccagccatggctggagcaggccgagggcatcaccgtctccggcggcgaacccttcgagcagttcgctgccctcctcgccctgctcggcgaactgcgccagcgcagccgcgccgacatcctggtctacagcggctacccgctggagcatctgcacgcgcaactggaacaggccgccgggctgatcgacgcgctgatcagcgacccctaccaacagcacgccgaacagagcctggccctgcgcggcagcgacaaccagcgcctgagcctgctcaccgaactcggccgcgcgcgcctcggcggctaccagcggccactgcgcgaagacgacaaggccctcgacctgatgttcgaccatga

SEQ ID NO: 14931 - DNA, 6327 bp, Pseudomonas aeruginosa
cgtcagcgcccatcggccgcgctgaatggatcgataccgatgatacgtttctgccccaactgccagagcgaacgctcgctttcggaaatcttctgcgaaggctcgatccagggccagccctgcggctgggacctttccgccgaagccatccatcccgccggctggcgaccacagccggtgctgacccaggaagccatcgcgccgcccgccagcgagccgccagcggcgtccgccccgctctgcgccaacggccacccgctgcaacccggcgacctgatgtgcctggagtgcggcgccgcgccggccgaaggcccgctgccgatgcaggccgaggccacgccgcagcccgccgtcacggaaaccctgatcgacggctggcgtctgctgcggcagatcgccagcagcgacggcgtgcgcgagcgctacctggccgaacacgcggaaggcgcccgccaggcggtgctcaccctgtatcgcccgggcgccgagccggacccggcgatctacgacgtgatccgccgcctgccgcgcgaacacgtaccggaaatcctcgccaccggccgctgggacgagcgcgcctacgaagtggtcgaggagctcaccggcggcagcctcgccgacctcggcaccgtgctggaggaccgcgaggcggtgcgccacgtggtccgcgagctgggccacgccctgcacgtgttcaacgaagccggcctgcgccaccgcgacctgcgcccggccagcctgctggtgcgcagccacgagccactggacctggtgatcagcggcttcggctcggcgcgcctgtcggagttcgacctggatatcgtctcgccgctggagaccagccgctacatggcccccgaggcgatcgccggcggcgtggcggcggcttccgactggtggagcctgggcatgatcctgctggagcagttgacccgcggctcctgcttcgaaggagtcaacgccaacgccttcctgatccacgtgctggccaacggcgtggcgctgcccgacgacctcgacccgcagttgcacctgctgctgcgcggcctgcttgcacgcgaccgccaccagcgctggcagtggccgcaggtacaggcctggctgaacggcgaggcggtggacgcgccggcctcggcggacagcgaaaaggacgacgccgaaggcgccagcatcgccctcggcgcacggcgcttccgcaagccgacggtcttcgccctggccgcggcccaggccgagcactgggcggaggccctcgaccacctgctgcgcggggcgatcgtcacctgggccgagcacatcggcctgtcgcccaggctgctcgccggcctgcgccaggtggcccagcacgaggggctggaggacgacttccggctgatgctggcgctcaagctgctgaacccggaaatcccgctgatccagcgcggcgagatcgtcacccccggctggctgctggagcatccgctggagggctaccggctgatcagcggctcggtgcccgacctgctcgaacagttgcacaccgaaagctggctgtcgcggctcaagacccgcgccgagaacgtccgccagcgcgccctgcaccagcacatcgaactcgccgaagaacagttgcgcatctacctgctgtcgacctcgcgggcgcgcctcgccgcgcagtggcaggagcgccagcgcctcctgccggacaccgagcaccccggcctgctggccctggccgagcgccgggtgatcgccgaggaagacctgatcgtcctgctcagcgccaacatcggccagttccgtgccgccgaggcgatcgtcgaggaagccgccggcctggcccgcgacgccgatgtgcacctgttcgacgcggagaccgcgcgcggcctgttgcagcactcgcggcaggagctgtaccgccgcgtcgacgaacgcatcagcggcttcgcccgcagcggcgtgcccagggtcgacgaatgggccgagcagttccgcctggagcggcgcatgccgttggcgagggtcctggtgctgctggcgatcccgccggaacagtggctggaaccgcagaagcagcagtacgtgtcgcagatcctcgatttcttcgagaagaaagtggtcgccgcggtgatgcgcgggccgctggtgcgcatgagcatcggcaagagcaccccacgcatcgacctcaacgaactgcacagcgcgcgacgccccgccgccgccctgctcgaccatctgctgcaacgcaacgcccgcgcggtgagcctcgacccggacagcttcctcgccaacccgcaactggaagtgcggctcaacgcgctgtcccggcaaagctcgctgtacaagcgtgacaccggcatcgacggcctctacctgggcttccccttcctgctcaaccgcgacccgcgcggcaccacccgcacgcgcatcgtgccgctgctgctgtggccgctgaagctgcaactggaagtcggcagccgcggccaggtggcgcttgccttcgacggcgagcgcgaggaagtgcgcctcaacccggccctggaaagcctgctcggccccgagccgtgcaagcgctggcgcaaggtcgccgacgaattgctcggccgctccgcgctgcgcgccgccgatgtgatggatgccttcggcctgctcgccacgccgcgtgctagggtgctggaaggattgccaccgagttccaccgaggtcacgccctaccaggaccaactggcctgcgccgcggtgctgttccacgtcaccttcatgggccaggcgatcggcgaggacctgcgccagctgaagagcctgccgccctccggcaccggactggagaccgcgctgcgcctgcgcgagaacggcgagccggaagcccgcgagagcccgccggagttgcagcgctacttcaccgtggccagcgacccgtcccaggaggccgccgtgctgcaggcccggcagagcccggggctgctggtggagggcccgcccggcaccggcaagagccagaccatcgtcaacatggtcgccgacgccatcggccgccagcgcagcctgctgatcgtctgccagaagcacgccgccctggaagtggtgcacaagcgcctggtggccgagggcctgggccagcgcatcgtcatgctcaacgacgtcaaccgcgaccgcgaaccggtgatccgcaacatccgcgagcagctcgaagcgctgttcgccgaagccggcggcgcccagggctgggagcgccagcgcgagcgcctggcggcgcgtatcgaggcgctggaaggcgaactggaccgctaccaccagagcctgcaccgcgtggacgaggccaccgggctgagctaccggcgcctgctcggcgaactgatcgagctggagaaaggctcgccgccgctggacttcccggccctgcgccagcgcctggcggcgctggacatcggcagcctggcgcgcctggaggaaaactgcgcgccgctggtccgcctctggctaccggcccgctacgaaggcagcccgctggcgcaactgcgcgccttcgccaccgaccaggccaccctgcacgccttcgccgacagcctgcgcgccttcggcgaagcggagaacgcccggcagaaagccctcgacgaacacccggcgagcttcgaggtcgacgacccgacgccctaccgcgcctggctggcaagccaggtcggtaccctgctgaatttgcgcgaggagcagcgccagcgcctggcccactggctgccgctgttccgcgacgccacgccagggcagccgagccgtggcgacggcctgctggcggaggccgagcagatcgaacggcaactgcgccagctcgacctcgaacggcatgcgccgctgctgtcgccggccctcgccatgctcgaagagaacaacctcgaacgcttccaggcccacgcccgccaggtgctcgaggcacgcacctggctggctcggctcaacccgctgcgcctgctgcggcgcggccgcctgcggcgcttcctgcgcgagcacggcgaggccgacgacgacagccgcctggccgccctcctcggcgcctgcgacctggagcgccagtggcggccgctgcgccggcaactggcggcgctgcaacagagcctggggctggcgacagtcgccaccgatgccggtccggaactgaccggcctggccggccacgccagccagcagctgcgcgagatccaggtcctggctcgtggcctggcccaagcgccgcgcgccgagcagctcgacgcggtgatcctcaccggcgagaaacagcgcttcgaagcgctgctcggcgacctcgacgccgcgctgatccgccaggccgcacgccagctcagcctggacaaactgaaggtgctcgccgactggctcggcgacgaactgctggaacagctgcaccgcgccatcgccggcaaccagagcaacctgccggccctcggccgcctgcgcgaggcgctaccgcaactagtcgcctaccagcgcttccgtggccgcgccggccagctcgaagccaccgacctggaattcctggccctgctgcgccagcgccaggaacgactcgacgcgattcccgccgaagaactcgaagccacggtgcgccgcatgctcaaccgcgaagcgcggctgggctggaagcagcgcctggaacaagacaatccggaactgctgttcagccaggacgaagccagggccagggtcgccagcctcgccgaagccgatgtgcagatgcgcgcgctgaaccgcgaactgctcggcaagggcatcggcgccgcgcgcctgggcagccgcaagcaatgggaagacgtcacccgcctgaccggcaagcgctcgcggcgcctgcgcgagttcatcgagctgggcgccgaactcggcctgatgagcctgcgcccggtctggctgatgaaccccgacctggccagccgcgtgctgccgctcaaggccgggctgttcgacatggtgatctacgacgaagcctcgcagatgccggtggagttcgccctgccgaccctctatcgcgggcgggtcacggtggtcagcggcgacgagaagcagatgccgccgaccgcgttcttctccagccgcgtggaaagcgacgaggccgaactgttcgacggcgaagcgcccgacgaggacgccgacgaggagcagcgcgaagcctacgaggacacctggaaccgccgcgagatcaaggactgcccggacctcctgcaactggcgcgcaacgccctgcccagcaccaccctgcagatccactaccgctcggcctaccgcgagctgatcggcttctccaacgcctcgttctacggcaaccgcctgagcgtgccggtacgccatccgcaggccaacatcctgcgcatcaagccgctggaactgatccaggtgaacggcctgtaccagaaccagagcaacgagcgcgaggccgagcgagtcgtcgactacctcgccgaactctggcgccaaccctacgcggcgcggccgtcggtgggcgtggtcaccttcaaccgcaagcaggccgacctcatcgaggagcgcctggaactgcgcgccgagcaggacgagacgttccgcgccgcctacagcgaggagcgcgagcgcagcgaagacggcgaggacatgggcgtgttcgtgaagaacgtggagaacgtgcagggcgacgtgatcgtcttctcctccaccttcggccgcaacggccagggcagcttccggcgcaacttcggcgtgctcgggcagaccggcggcgagcgccgcctcaacgtggcggtgacccgcgcgcggcgcaaggtggtgatgatcacctcgatgccgatcggcgacatctccgacatgctcggcacccagcgctcgccgagcagcccgcgcgactacctgcaaggctacctggaatacgcccgcgcactgtccgccggcgagttcgccggtaccggccaactgctcgagcgcctgcacaccgaccgcagcgaccagcgccgccagcactaccagcgacacgacggcttcagcgagatcgtcggcgagtacatccgctcgctgggctggtccgccgcacccgccggcgaaggcgacgccttcggcctcgacttcgccatcgagaacccggccaccggcctctacgccatcggcatcgaatgcgacgccccctgccacccgctgctggaacgcgcccgcgcccgggaaatctggcgaccctcggtgctgcggcgggcgatcccgcacctccaccgggtttcctcccagggctggtaccacgacggcgacaacgaacgcgcacggctgcgcgccgccatcgagaaggccctggcgcccagcgcggaaacccatcccacggcagcagcggaggcctcccaatga

SEQ ID NO: 14932 - DNA, 1329 bp, Pseudomonas aeruginosa
gaatcgtcacccgggaagaagccatcgccacctgcgagcgcgacctgcaacgcctggacaaggccctcgcgcgctgggaaaaccaggccagccggctcgcccagctcagcgacgccgagcgcgccgccgcccacgcccgccgcgccagcctgcacgccctggctcgaacaggaacgctggctggacgtgcaactacaggtgaagatcgaaagcgaattcctcaagcgcgacctcgccgaacgcgaagagcgcgccatccgccaggccgcggaatcacgccagcaacaccgccgcctccaggaaaacgccagcgccctgctccaggccctcgacgccaagcccgatgccgccagcgcggcagtccggcaaaccctgcaagcgctggccgacggcgccctccgcgacgacgcggaagccctgctcgcccaaggttttgccgccctcgccagcgcccccgccgaggaacgcctcagcgaagcccagcacgaactcgcccagcgcctgaagaccgacgaaacgcccatcaccctggaacagtggcgcgcccgccagcaacaggacgccccgcgcgaacagcgcctggcgcgcatcgaccggcacatcgccgaactgcaactgctgcaaggcgaggccagcgcccaagcgttcctcgagcgactggcacgcgccgaagccgaacagcgcccggagcgccgcaacctgctgctcgacagcctggtcctcgacctcgcccaggccgcccgcgaacaccagcagcaacgccagcgcctggaacacctgcaagacctcgccagcgaagtcgccgccctcggcgccgccgaacacgccgaactgctccagcgcgccgccgcctgccagcccgacagagatccgcagcaactcgccgaactcaccgagcgatgcaacgccatcctcaccgcccacctccagcaacaggccgccctcgcccgccgccaggccgtgctccagggcctcgccagcctcggctacgaagtccgcgaaggcatggccaccgcctgggcgcagaccggcagggtcgtcctgcgcaaacccgccacccccggctacggcctggaagtcggcggcaaggccgacaacggccgcctgcaactgcgcgccgtcgccctcaacgccaaccgcgacagccagcgcgaccgcgacatcgaaaccctctggtgcggcgagttccaacgcctccaggccctgctcgccgcccagggcggcgaactcagcgtggaacgcgcgctgggggtgggagaagtggcgttgaaggagattggcgaggaagagcagcaggagatgggggtggtgcggcagagggggttgtga

SEQ ID NO: 14933 - DNA, 321 bp, Pseudomonas aeruginosa
gagaggtgtctgatgagcaagcaacgacgtacgttttccgccgagttcaaacgagaggccgcggccctggtgttggaccaaggctacagccatatcgacgcctgccgttcgcttgggggtggtggattcggccttgcgccggtggatgaaacagctccagcaggagcgcgatggcgtgaccccgaagagcaaggcgctcacccccgaacagcagaagatccaggagctggaggctcggatcaaccggctggagcggcagaaagcgatcctaaaaaggctaccgctctcttgatgtcggacgaactcgatcgtacgcgctga

SEQ ID NO: 14934 - DNA, 291 bp, Pseudomonas aeruginosa
agtccgttttccgagcaggagacggcagtgaaaaagcgttttaccgaagagcagattctcgacttcctcaagcaggcggaggccggtgtgccggtgaaggaactgtgtcgccgacacggcttcagtgatgcctcgttctacacctggcgggccaagtttggcggtatgaccgtggcggacgccaaacggttgaaggatcttgaactggaaaacagccgattgaagaagttgctcgccgaggcccacctcgacatcgagtcgctgaaagtggtcgcccggggaaaagggtaa

SEQ ID NO: 14935 - DNA, 195 bp, Pseudomonas aeruginosa; identical to SEQ ID NO: 2579

SEQ ID NO: 14936 - DNA, 495 bp, Pseudomonas aeruginosa
atcacgggcctcaccttccaacacggcggcttgggtattcagcatttcggcacgcagccagtgtggctgcgcggcggcttcggcttgttcgcgtttggttttgaaatccaccttccaggcgaattcgttttccacgcggtcggcaaagtcgttggcctcactgccccaccagtcccgctcgggtttgaattcttccagccggatgggtttggttttggaatagctcttgtagcccggcggataggggtgctcgtagaaccagatggtgtcggtgtgaaagtgctcggtaccatcatccacggcgctgcccttggtgaagaacagcaggttggtcttgatggtggtgtacggagcgaacacccccttgggaagacggatgatggtgtgcagcttgcagtcacgcagcagcagttttttcagcgtgcctttgatgccatcgccaaacaaaaaaccatcgggcagcaccacggcagcgcggccgttctctttcaatag

SEQ ID NO: 14937 - DNA, 441 bp, Pseudomonas aeruginosa
gtcttcaatggcgcgtttgtcttcggcactggatttgatgctgagctgattgcggaagtggtcgatggcggcggtcaaaaagccgccggtaccgcaggccgggtccatcacagtttcgcgcttgtccagacgcggattgacgcggtcggccatgaaggcagtaattgcacgcggggtgtagaactcacccgcgtttccagcgccgcgcaggtcgttaagcatctgctcgtagacgtcacccaggttggcgcgggttttgaaatcatggaagttgatggcctcgtccaacttttcgatcacggcgagcatctgcgagccggatttcatgtagttgttggcatcgcggaaaacttcacggatgaccttgtgctgggggctgcggtcggcgtctatctgatctttgagtgcaggaaacagctcattgttgacgaagccgattaa

SEQ ID NO: 14938 - DNA, 204 bp, Pseudomonas aeruginosa
tgctgcagccagcctgctttttgtatggccggagttatgagcttcgtgcagatgtcgcgctcagaatactgcgccccgtccatgacaacccccaaagagctttatccgttcaatcgagactatcgtgcagagaatctcaattggcaaccaattggcaaccagagcggtgcttttttgagcacaacccaaaacagccaagcataa

SEQ ID NO: 14939 - DNA, 297 bp, Pseudomonas aeruginosa
catgcggatttttttggaagttgccgcatgctttcccgtttgtttgtaggccttttcgccctcctcctcgccagcaccggccaggccaacgccccgcgcacgttctccgaagcgaagaaaatcggctggaagctctacgcccggcaatccgtggagttctactgcggctgtcgctactcgggaaatcgtgtcgacctcgccagttgcggctacaagccgaggaagaacgccaaccgcgcgcggcgcatcgagtgggaacatgtgaaatatgccgattgtaacatgttacaaatataa

SEQ ID NO: 14940 - DNA, 369 bp, Pseudomonas aeruginosa
tctcggttgcgtgactcaataaccggccggttccgcttgaatggtaatcgtgaggtgagcatggagattaagtcgcaggcactggtcgatgtggttgaggatgtgatctgcgacgtgtgccgctctggaacgagtatccccggctatggcccccaatacggcaagcttgaagcccaatggggatatggctcccagcatgatggggagcactaccgggtgcatctctgtgagccctgctttttcagggtgctgagcgggttgcgtcgggagcgcacggtcaatggtatgttcgataatgatcagccatttgcttttgaagattttggtctggtcagcaaagacaactactggggaaagaactggttgtag

SEQ ID NO: 14941 - DNA, 633 bp, Pseudomonas aeruginosa
aaaagccccagaaattccggggcttttccgcctttcggcttagccgatgctcacgccgtgagcttcagccagaggcttcaagccgccagcaaaaccttggccgatcgccttgaacttgaactcgtcgttgtgacggtacagttcgccgaagatcatggcggtctcggtggaggcgtcttcggacaggtcgaagcgagcaatctctttgccgtcggctttgttcaggacacggatgtaggcatttcccacctggccgaaagactgcttacgagcttcggcgtcatggatggtgacggcgaagaccagcttcttcacgtctgcgcccaggccgttcagtttgacgttgacttgctcgtcgtcgccatcgccctgaccggagcggttgtcgcccagatgctcgatggagccgtcagcgctcgtcttgttgttgtagaaaatgaagctggcgtcgttgagaactttaccgttttcgccagtgacgaaaacggaggcatcgagatcgaactcggtgccgtcagttacgcgcggatcccagcccaggcccacgatgacctcggtcagacctggtgcttctttggacagactgacgttgccgcccttttggagagaaactgccataatgtgattccttga

SEQ ID NO: 14942 - DNA, 468 bp, Pseudomonas aeruginosa
cttcttgcggctcacaaagaagttatgaccgtacaacttcggccataccgggaagagctttttcgcgaagcggtaggcaagatgttgggagtagtcctcctcttcatcatcatcgtcaccgcccttgagcatcatcacagcggtccaggcaacgatcagcgcgaagacgatctcgacccaggggccaaatgcgagcaggccggtaccgatgaccacgaatacgccacggaagacgatagcgccgatgatgccccaatagagaactcggtgacggaggccatccggtaccttgaaccaggcgaagatggccatgaagacgaacaggttgtcgaccgacagcactttctccaaggcgtagccggtgacgaacaggctggcgacttcagcgccgtgctgcacgtagaggaaacctgcgaacgccagagaaatcgccacccagaacacggaccagatagaggcgcgcgctag

SEQ ID NO: 14943 - DNA, 303 bp, Pseudomonas aeruginosa
gtcggccagatggagcgagacaccaagccggaaacggttgcgcccaagattccggacgggataacccagtcctctgcggaggcggcgagccatgcgcggccgcaggggtcggctaacacaacgagtcggggctcttccgggaaacgcttgtcggcacctagcgtccgcttgagctcgccagagattgctcccttgccggtccagccatccacgaagacaatgttctcagcaccgtgcaactggatgatcgcttcgagggccactgtatcgatcccacgatcacggataatgcttacgccatag

SEQ ID NO: 14944 - DNA, 249 bp, Pseudomonas aeruginosa
gtcccgaaccttactaaatgcggcgaaatggtatcaaacttcaagtctgactacatatcaagttgccactggcaccgcaacggttatggctttcaccctgatgttcggtatccaatcactcaccggctcagccagaccaagccttctagtggcgaagatacctggcaggttcactcccgtatgtcgggtgtagccgatgccaccggagtaccgcggattgatctcgagcagatgtgggacaccgtctaa

SEQ ID NO: 14945 - DNA, 810 bp, Pseudomonas aeruginosa
gccgccgacgccaagtaccgggccggcgccgccgccctttccgatcgcctgcaggcgcagaccgcgctgtcccaggcgagcttcgcccaggtccgcgacgaaggcgccctgagcaacgccttcggcgtcatcgccctgcgcatgggcctggcgccggataccccgctgcgcctctccggcgagctggaggcgcaacccgacaccggcttcgtcaaggccatcgacgagatgctcgccgaagcccgccgcgagcatccggcgctgctcgccgcccaggcgcggctgaaagccgccgccgcctcggtggaggaaagccgcgccgccggccggccgagcctggcgctgagcgccaacctggcacgcagccatagcgaccaggcgatggcgttcaacggcgatacccgcgaacgcgaccgcagcatcggcctgcaactgaacatcccgttgttcgaaggcttcgaacgcacctaccaggtccgcaacgccctggcccgccgcgaagccagcgaagcggagctggccgacaccgagcagcaggtttcgctggaggtgtggaacaactaccagtcgctcagcgtcgagacccgcagcctggcgcgcacccgcgaactggtcgaacagtcgcggcaaagcctggaggtggtgcagggccgctaccgctcaggggtcggcagcatgatcgagctgctcaacgccctgaccgcctacgccagcgccgaggaccagcacatccgcgccctcggcaactggcagacctcgcgcctgcgactggcggcgagcctcggtcgcttggggcttcaaatgatctga

SEQ ID NO: 14946 - DNA, 1224 bp, Pseudomonas aeruginosa
aggcgcactggtgaagaaaggcgacctgctgttccagatcgacccgcgcccgttcgaggccgaggtcaagcgcctcgaagcccaggtgcaacaggcccgcgcggcccaggcgcggagcgtcaacgaagcccagcgcggcgaacgcctgcgcgccagcaacgcgatctccgcggaattcgccgacgcccgcaccaccgccgcccaggaagccaaggcggcggtcgccgcgacccaggcgcaactggacgcggcgcgcctgaacctgagcttcacccggatcaccgcgccgatcgacggtcgcgtcagccgcgccgaggtcaccgccggcaacctggtcaactccggggaaaccctgctcaccaccctggtcagcaccgacaaggtctacgcctacttcgacgccgacgaacgcgtgttcctcaagtacgtcgagctggcccgccaggccggtcgcgacacgcgcagcgagagcccggtctacctcggcctgagcagcgaggacggcaacccgcacctgggccggctggacttcctcgacaaccaggtcaacccgcgtaccggcaccatccgcggccgcgccgtgttcgacaacgccaagggcgagttcaccccgggcctcaacgtgcgcctgaagttggtcggcagcaagacctacgccgccaccctgatcaaggacgaagcggtcggcaccgacctgggcaagaagttcgtgctggtcctggatggcgacaacaagaccgtctaccgcaccgtcgagatgggaccgaagctggagggcctgcgcatcgtccgcagcggcctgagcaagggcgaccggatcgtcgtgaatggcctgcagcgggtccgcccgggcatgcaggtggatccgcagaaggtcgagatggccagcgccgacaccctggccaccctcgcgcgcctgcggcagtcggtcggcgacagcgaaccaccgaaggtggcggcgtccaaggacaacgccactcgcaactagccgcgcggctgagcgcggcgataggaagaaccgatgaatttctcccaattcttcatccagcggccgatcttcgccgcggtgctgtcgctgctgatcctgattggcggcgccatctccctgttccagctacccatcagcgaatacccggaagtggtgccgccgaccgtcgtggtccgcgccaacttccccggcgccaacccgaaagtcatcggcgagaccgtcgcctctccccttga

SEQ ID NO: 14947 - DNA, 243 bp, Pseudomonas aeruginosa
acaggcgatcaccggggtggagaacatgctctacatgtcctcccagtcgacctccgacggcaagctgaccctgaccatcaccttcgccctcggcaccgacctggacaacgcccaggtgcaggtgcagaaccgcgtcacccggaccgagccgaagctcccggaagaagtgacccggctcggcatcaccgtcgacaaggcctcgcccgacctgaccatggtcgtgcacctgacctcgccggataa

SEQ ID NO: 14948 - DNA, 1713 bp, Pseudomonas aeruginosa
ccgctacgacatgctctacctgtcgaactacgcggtgctcaacgtgaaggacgaactggcccgcctcgacggcgtcggcgacgtccagttgttcggcctcggcgactattcgctgcgcgtctggctggacccgaacaaggtcgcctcgcgcaacctcaccgccaccgacgtggtcaacgccatccgcgagcagaaccgccaggtcgccgccggcaccctgggcgcgccgccggcgccgagcgataccagcttccagttgtcgatcaacacccagggtcgcctggtcaccgaggaagagttcgagaacatcatcatccgcgccggcgccaacggcgagatcacccgtctgcgcgacatcgcccgggtcgagctgggctccaaccagtacgccctgcgctcgctgctgaacaacaagccggcggtggcgatcccgatcttccagcgtcccggctcgaacgccatcgagatctccaacctggtgcgggagaagatggccgagctgaagcacagcttcccgcaaggcatggactactccatcgtctacgacccgaccatcttcgtccgcggctccatcgaggcggtggtgcacaccctgttcgaagccctggtgctggtggtgctggtggtgatcctgttcctgcagacctggcgcgcctcgatcatcccgctggccgcggtgccggtgtcgctgatcggcaccttcgcggtgatgcacatgctcggcttctcgctcaacgcgctgtcgctgttcggcctggtgctggccatcggcatcgtggtggacgacgccatcgtggtggtggagaacgtcgagcgcaacatcggcctcggcctcaagccggtggaagccaccaagcgtgccatgcgcgaggtgaccgggccgatcatcgccacggcgctggtgctctgcgcggtgttcatcccgaccgcgttcatctccggcctcaccgggcagttctaccgccagttcgccctgaccatcgcgatctccacggtgatctcggcgttcaactcgctgaccctgtcgccagcgctggcggcggtcctgctcaagggccaccacgagccgaaggaccgcttctcggtgttcctcgacaagctcctcggcagttggctgttccgtccgttcaaccgtttcttcgaccgcgccagccatggctacgtcggcacggtgaaccgggtcctgcgcggcagctcgatcgccctgctggtctacggcggactgatggtgctgacctacttcggcttctccagcacgccgaccggtttcgtcccgcagcaggacaagcagtacctggtggccttcgcccagttgcccgacgcggccagcctggaccgtaccgaggcggtgatcaagcagatgtccgagatcgccctggcgcagcccggcgtggcggactcggtggccttccccggcctgtcgatcaacggcttcaccaacagcccgaacagcggcatcgtgttcaccccgctgaagccgttcgacgagcgcaaggacccgagccagtcggccggggccatcgccgccgcgctgaacgccaagtacgccgacatccaggacgcctacatcgcgatcttcccgccgccgccggtacaggggctggggaccatcggcggcttccgcctgcagatcgaggaccgtggcaaccagggctacgaggagctgttcaagcagacccagaacatcatcaccaaggcccgtgcgctgcctga

SEQ ID NO: 14949 - DNA, 2445 bp, Pseudomonas aeruginosa
gctggaacccagctcggtgttctccagctaccaggtcaacgtgccgcagatcgacgccgacatcgaccgcgagaaggccaagacccacggcgtggcgatcagcgacatcttcgacaccctgcaggtctacctcggctcgctgtacgcgaacgacttcaaccgcttcggccgtacctatcaggtcaacgtccaggccgagcagcagttccgcctcgaacccgagcagatcggccagctgaaggtgcgcaacaacctcggcgagatggtcccgctggcgtccttcatcaaggtcagcgacacctccggtccggaccgtgtgatgcactacaacggcttcatcaccgccgaactcaacggcgccccggccgcgggctacagctccggccaggcgcaggcggcgatcgagaagctgctgaaggaggaactgcccaacggcatgacctacgagtggaccgagctgacctaccagcagatcctcgccggcaataccgcgctgttcgtcttcccgctctgcgtgctgctggccttcctcgtgctggccgcccagtacgagagctggagcctgccgctggcggtgatcctgatcgtgccgatgaccctgctgtcggcgatcaccggggtgatcctggccggcagcgacaacaacatctttacccagatcggcctgatcgttctggtggggctggcgtgcaagaacgcgatcctgatcgtcgagttcgccaaggacaagcaggaggaaggcatggaccgcgtcgccgcggtgctggaagcctgccgcctgcgcctgcggccgatcctgatgacgtccatcgccttcatcatgggcgtggtgccgctggtgatctccaccggcgccggcgccgagatgcgccatgcgatgggcgtggcggtgttctccgggatgatcggggtgaccttcttcggcctgctgctgacgccggtgttctacgtcctcatccgccgcttcgtggagaaccgcgaagcgcgccgcgccgccaacgacaaaggcctgccagaggtgcatgcatgattcacgcgcagtcgatccggagcgggctcgcgtccgccctgggtctgttcagtctgctggcgctcagcgcctgcacggtgggtccggactaccggacccccgacaccgcggcggcgaagatcgacgccacggcgagcaagccctacgaccgcagccgcttcgaaagcctgtggtggaaacagttcgacgatccgaccctgaaccagttggtcgaacagtcgctgagcggcaaccgcgacctgcgcgtggccttcgcccgcctgcgcgccgcccgcgccctgcgcgacgacgtggccaacgatcgcttcccggtggtcaccagccgcgccagcgccgacatcggcaagggccagcaaccgggagtgaccgaggaccgggtcaacagcgagcgctacgaccttggcctggatagcgcctgggagcttgacctgttcgggcgcatccgccgtcagctggagtccagcgacgccctcagcgaagcggccgaggccgacctgcagcaactgcaggtcagcctgatcgccgagctggtggacgcctacggccaactgcgcggcgcgcaactgcgcgagaagattgccctgagcaacctggagaaccagaaggagtcgcgccagctcaccgagcaactgcgcgacgccggggtcggtgccgaactcgacgtactgcgcgccgatgcgcgcctggcggccaccgccgccagcgtgccgcaactgcaggcggaagccgagcgcgccaggcaccgtatcgccaccctcctcggccaacggccggaagagttgacagtggacctttcgccgcgcgacctgccggcgatcaccaaggccctgccgatcggcgatcccggcgaactgctgcgccgccggccggacatccgcgccgccgaacggcgcctggccgccagcaccgccgacgtcggcgtggccaccgccgacctgttcccgcgggtcagcctcagcggcttcctcggcttcaccgccgggcggggctcgcagatcggctcaagcgccgcccgcgcctggagcgtcggcccgagcatcagttgggccgccttcgacctcggcagcgtgcgtgcccgcctgcgcggcgccaaggccgacgccgacgccgcgctggccagctacgaacagcaggtgctgctggccctggaagaatcggcgaatgccttcagcgactatggcaagcgccaggagcgcctggtctcgctggtccgccagtcggaagccagccgcgccgccgcgcaacaggcggcgatccgctaccgcgaaggcaccaccgatttcctggtgctgctggacgccgaacgcgagcaactctccgccgaagatgcccaggcccaggccgaggtcgagctgtaccgcggcatcgtggcgatctaccgctccctcggcggtggctggcaacccagcgcctga

SEQ ID NO: 14950 - DNA, 1668 bp, Pseudomonas aeruginosa
aatcttcatgcgcgaggccatcgccctcgcccgcgccaacgtcgaggccggcggccgcccgttcggcgccgtgctggtgcgcgacgggcgggtcctggcccgcggcgtcaaccagatccacgagacccacgatcccagtgcccacgccgaactgcaggcgatccgccaggccagtcaggcgctcggcagcccgcgtctggacggttgtgtgatctacgccagcggccatccctgcccgatgtgtctggccgccatgcatctctgcggcatccaggcggcctggttcgcctattccaacgaggacggcgaagcgttcggcctgtccactgccacgctctacgccgagatggcgcgcccgccacagcggcagagcctgccgctacgcgccctgcgtcctgccggcgaagagggtctgtaccggcaatggcggcaacgccaggcatgagcgcgcgaatcccttctggcggccaggccgccagcggcgtcggcgcggcggaggtcagttgggtcggcctgctggtgatcttctgcctcggcatcaacctgcgaccgatcctcaccggcatcggcccgctgctcgaggaaatcaccgccggcaccggtctcggcttccagggcgcgtcgctgctgacggtgttgccggtgctctgcatgggcctggtggcgctgttgctgccctggctcgggcgctggctggccgagcaccgcggcatcgtctgcggactgctggccatcgccgcagcctgcctctggcgcctggaactggatagcgggctggcgctgatcgccagcgccgcgctggccggcagcggcgtggcgatcatccaggcgctggtaccgggcgtggtcaagcgctggttcccgaggcgggtcccggcggcgatgggcctctactcggcctcgctgatggccggcggcggaaccgcggcggtgctcagcccgcggatcgccgaacacttctccaactggcaggccggcctcggcgcctgggccgtaccggccctgctggcgctgctgctgtggatgttcgcgcggccaagggaggtgctgccgagcgctggcgaggggccggtccggcacttcttcggcaatcgccgtggctggctgctggcggtgtatttcgggctgatcaacggcggctacaccagcatggtggcctggttgccggtgtactaccgccagctcggctggagcgcccaggacagcggcgggctggtcgggatcatgaccatcttccaggtgctcgccgcgctcagcgtgccgctgctgattcgccgccgcctcgaccgccggccctggctgctggccgcgctgctggtccagctcggcggcttctgcggcctgctgctgatgccgctgcagcacgcggcgctgtgggtggcgttgatcggctacggcctgggcgcctgcttcgccctcagcctgaccctgaccctcgaccacctccacgagccgcgtgcggcgggaagcctggcggccttcgtgcaaggcatcggcttcatcatcaccggcatcgtgccctacctgaccggctggctgcgcgacgtcaccggcagcttccaggcctcctggctgctgctcgcggcgagcgtggtggcgatgttgctggtgaccctgcgcttcgccccgtccggctatgcccgggccatgggcgagacgcgcgactga

SEQ ID NO: 14951 - DNA, 1092 bp, Pseudomonas aeruginosa
gccagccaggccaggcgcggcagcgtcgccagccaggccggcaggcgctggaaacggttggcggcgatccgcagcagttccaggccttcgcaagcggccatgctctcgggcaaggcctccaggcggttgccggccagcatcagcttctgcaacggccggcgacccagttcctcgggcagcgtggcaatccggttgtcggtgaggatcagccagcgcagcgctggcggcagggccgcggccggcacccgctcgatgcggttggacttgaagccgaccatgctcagcgccggacagtcccccaccgccgccggcaattcgtcgaagtcgttggcggaacagaacagcaccttgagacgatgcagccgcccgaggtcgtccggcaggctgtccagggcgttgccgctgaggttgagcacctccagggagtcggccagctcgaagatttcccgggggaactcgcgcaggccgcaggacaggtccaggcgcgtggcgccggccagttcgccgctgcgcagttgctgcaaggtgtgcatggttcgacggactccggccagggcggatggaaagccgcgcatgatagccaaggcgttgcggaacgcgcaccctcgccgtgctagagtggccgccccgaatcgacaggaccacagagaatggaactctcccccgccgaacgccaactcctgctggcccatcgcctggccgtgttcgacggctgcgtggtgtacgacgcccaaccgccggtgtccgccgaacacgtccagcgtcttgccgaaggcctggccggaccgattccagaagacctgctacgcctctggcgcacctgtttcggcgggcgcctcggctatgacctggaagtcgactacgacggccaccgccacccgttctctttcagcgaactgttctatccggacagcgacggctaccacgacctctggggctggatcgaacacgagcgcgagctggcggcggaagccgcggcagaagaaggccgcgactggaacggcaagctggcctacctgccgttcggtggcttcgagtacctggagcggctctacgtctgcgtcgaacccggccccgagcatggcgcggtaa

SEQ ID NO: 14952 - DNA, 294 bp, Pseudomonas aeruginosa
tccgtccgctcttactctttgctcaaacgggacgaatacctcgccccggcgacgagccaacccgagaggtttgccatgaagatcatcccgatgctgctggccgccctgctggcgaccggcgccgccactacccaggcccaggacggcagcgaacgctcctggcagtacaacgccgaattccgcgccgcgcagaaagaactgcgcgaaaagcgcctgcagaagcaacaactggaagcgcaagcgcagaagaccgaccgcagcaaatgcgccgagcgcaagaacggcaacggctga

SEQ ID NO: 14953 - DNA, 732 bp, Pseudomonas aeruginosa
tcgactcgaggctttggatcacggcttggctcattctcgggggtccaccagggttgcggtcgggttttcgacggttcgctgctcaaggctcgctcgataccgagcgggtttcgccgtcgtttcggccaagcatccatcgccttcttcactggggtccaatatcatcttcctctcgaaccataccctggaggtatcatggagcttcgtcacctgcgctacttccaggcgctggcccggaccctcaacttcacccgcgccgccgagcagttgcacatcgcccagccaccgctgagccggcagatccagcaactcgaggaaatgctcggggtggccctgctggagcgcggccggccgctgcgcctgaccgaagccgggcgcttcttccacgaacagagcgcgacgctcctggaccaactggaaagcatctgcgacagcacccggcggatcgggccagggccagcgccagtggttcggcatcggcttcgtgccctcggcgctgtatggcgtgctgccggagctgatccgccacctgctcggcgacccggagctggagctgggcctgctggagatgaccaccctgcaacaggtcgaggcgctgaagagcgggcgtatcgacatcggtttcggacgcatccggcatcgacgacccggcgatccgccagagcgtgctcagcgaagagccgctggtcgccgccctgcccgccgggcacccgttgctcggccagccgctga

SEQ ID NO: 14954 - DNA, 2550 bp, Pseudomonas aeruginosa
ccccatgaacgccggactgcagtaccgcgtcgaacagttcctctaccgccacgccgaactctgcgatgcccaggactgggacggctacctcgcgcagttcgacgaacagtgcgagttccacctgccgcagtgggagtccgagcagcgctacacccgcgatccgaagcgcgagatgtcgctgatctactaccccagccgtgccggcctggaagaccgggtgttccgtatccgcaccggcaaggccgcgtccaccgtgccgatgccgcgcaccctgcaccagatcggcaacgtgcgcatcgccgaggaaggcgaaggcctgctgcgagtgcgggtcaactggcagaccctgttccagcgcctggaccagaccggcagcttcttcggccatgccacctaccgcctgaaaccccatggcgaggcctggctgatcgcgcgcaagcacatcgtcctgctcaacgaccggatcgactcggtcctcgacttctaccacctctgaacggcgggccccgtcacgatgaatcacaaagtcgccctcagcttcgccgacggcaagaccctgttcctgcccgtcggccacgacgacctgctcctcgacgccgccctgcgccacggcatcaacctgccgctggactgccgcgaaggggtctgcggcacctgcatgggccgctgcgaggcgggcagctacagcctggactacgccgacgaggacaccctctccgccgccgacctggagcagcgcaaggtgctcgcctgccagacccgggtgcgctccgacgcggccttctacttcgacttcgcctcgaccctctgccacgccgccgcggcccaggcgcacagcggcgtggtgcgcgaactgcgcctgctctccgaggacaccgcgctgctccgcctcgacgccggcgccgcgggccgccagttggacttcctgcccggccagtacgcgcgcctgcaagtacccggcagcgactgccggcgcgcctactccttcgccaaccggccgaatccgcagaaccacctgcagttcctcatccgcctgctcccgggcggcgccatgagcgactacctgcgccaaggttgccgggtcggcgacgagatccgcttcgaggcgccgctgggcaccttctacctgcgtcaggtggagcgcccgttgctgctggtggccggcggcaccggcctgtctgcgttcctcggcatgctcgacgaactggccgagcgcggctgcgatcgggcggtgcatctctactacggggtacgccgcgccgccgatctctgcgaattgcagcggatcgccggctacgccgagcggcttcccggcttccgcttcgtcccggtgctcagccgaggcggacgccgactgggacggccggcgcggctacctgcactagcatttcgacgccgcccgcctgcgcgacgaagctttcgacctctacctgtgcgggccgccgccgatggtcgaggcggtccgccagtggcttgcgcgagcgctcccttggagcatctacggctgtacctggagaagttcaccgaaagcggcgactgatgcgctcagccgaggtcgccgccagctaccggcagggtcacgccggtgatgtaggacgcctcgtcggaggcgaggaaaaggatcgccgcgacctgctcgtcgatgctgccgtagcgcttcatcaggctgctgtcgagggtctgctcgacgatctgtcgataccagcgccgctcctcctcgctctgcgccgcggcgttgcgcggaatccttcgcggcggcgcgtcggtgccgcccggcgccaccgcgttgacgcggatgccctggtcggcggtctcgaacgccaggcaggcggtcagcgcgttcaccccgcccttggcggcgccatagggcacccggttgaccccgcgggtggcaaccgacgagacgttgacgatcgccccgctgccctgccccagcatcgccggcagcgccgctcggcaacaccacaaggtgggcagcagcgaacgccgcagctcggcctcaatctcgtcctcggcgtagtgttggtagggcttcgcccaaagggtgccgccgacgttgttgaccaggatgtccagccggccgaaacgctccagggtccgctccagtacccgctggcattcggcatagcgctccaggtcggcggtcaggcacaggcaggcgtcaccggccagttcgtggaccagctcggagcggtccaccgccaccacccgcgcgccttcctccagcaggcgccggaccacgcccaggccgataccctgggcggcgccgctgaccagggcgaccttgtcgcggaatctgtcgttcatgggaatctccttggctcgctcgggttcaggccgcgctggcggcgaacttttcgtagtagaaattcgccgggcgcacgccctgctcgcgcaggtagcgctcgaccgcctcgaccatcggcggcggcccgcacaggtagatgtcgacgtcgccctcgtgcaggtgctgcgcggcgatgtgctcggtcacgtagcccttgcgcggatagtcgctgtcggcgctggccacgcacgcgctccaggtga

SEQ ID NO: 14955 - DNA, 1482 bp, Pseudomonas aeruginosa
cgccacctcccgcagcgccacgcgctgcgtccgttcgcgctccagggcggcgagcagcgcctcctgccagtagcgatgctgcaatacgaacagcccttcgtcctcggtgcgcacgccgctcaggcgcggccgcaggtcgatggccgcggccgccgcgtcggcgccctctatccagtgttcggcgccgcgcgacaggtcgttccagccgaccacgctgccctggtagccctgctggcaggaacggaactcctccaggtcgtccggggtggccatgccgctgacgttgaagaagtcctcgtactggcggatgcgccgggcgcgcgcctcggcgctctcgcctttcggcgcgatgcagtagatggtgatttccgtgcggtccaccgacagcggccgggcgatgcggatctgcgagctgaactggtccatcaggtacacgttggggtacaggcagaggttgcgcgagttctcgatcatccagtcggcgcgggcctcgccgaagtcgcgggcaagctcggcgcggcgctcgaaggccggccggtcctcggggttggcccagcgactccagagcagcatgtggccatgctcgaacgagtagaagccgccgccctgccgggcccagcccgcggcgctcatggtccgcagcgggtccgcggcgtcgcgctgctggcgctggctctgggtcgccgcgtagttccagtgcaccgagctgacgtggtagccgtcggcgccgttctcggcggtgagcttccagttgccttcgtagacatagctggaagagccgcgcagcacctcgaggccttccggcgactggtcgacgatcatgtcgatgatcttcgccgactcgcccaggtgctcggccagcggcctgacatcggggttgaggctgccgaacaggaagccacggtaggactcgaagcgcgccacccgggtcaggtcgtgcgagccctcgcagttgaagccctgcgggtagccggcctcggccgggtccttgaccttgagcagcttgccggagttgttgaaggtccagccgtggaacggacaggtatagctgctgcgattgccgctcttgtgccggcagagcatcgcgccacggtggctgcaggcgttgatgaaggcgttgagctggccgtcgcggttgcgcgcgatgacgatcgactggcggccgatctgggtggtcaggtagtcgttgactccggcaacctggctttcgtgggcgagatagacccagttgccctcgaagatgtgcttcatctccagttcgaacaggcgtggatcggtgaacatctcccgcttgcagcggtagacgccgcgctcggggtcttcctcgagcagagaacgcaagtaatcgctacccagggacatggccggggcctccgttgttattgttcaggcccggtcaggttaggtagcgcgtgctgctggggatatccgttgcctgcggatcgctggccgattcctgcacgccgtggcggtcggcgctag

SEQ ID NO: 14956 - DNA, 339 bp, Pseudomonas aeruginosa
ccctgcttgccggccatcagcttgaggcgcgcggtgaaggcatgcggctcggcgatcccggcattggccaccaggccatcgccgctggccttgaacagcaggtcctcgacctcgccggtggcacgctcgacgtcggcgccgaggaccacctcctgcggcgccagcgccttgccgccgcgctcgacccaggccttgagcgggctgccgtcctccggcaccagcagttccagggtcaggtcgccctggcgcaacaacatgccgccgcgcggtccgctgccctcgccctcggcggccgcttcgccggcgccggccggcgccttcccgcccagctccaggtag

SEQ ID NO: 14957 - DNA, 1353 bp, Pseudomonas aeruginosa
gcgccgccgcccaggccgagcagtgccagtgcggtcaccgcgataatcgtcttcttgcccattctgttctcccgaaccgttcggggggcgcgccggcggcccgccccggaaatctcactggccgaggtggccgatgtcttcgccgagcaggcgctccatgctcacccgcgcctgtgccgcggcgtccagcgcgcgcacgtactgggcacggacgccgaccagggtgcgctgggcatcgagcacgtcgaggaagttgaacttgcccatctcgaagccgcgggtcatcgagtccagcgcgctctgtgcgccgggcagcaggtcgcgacggaccagcgccagctcctgttccgaggtgcgcaactggtcgtaggcctgtaccgcttcgctgcgcaggcgcagcagggtcgcgcgctgcaggtcgcgggcctggtcggcgcggctctgggcggcgtagatgttgccctggttgcggtcgaacagcggcagcggcatcgacaggccgatcaggttgacccgttcgccacgtccgtcgcgggcggtctggtcgtacttgctgccgatgctgaccgtcaggttggggatgcgctggcgcttctccaggtcgacctgggcctcgccgcgcgcgacctcctgggccgccaggcgcagggtcggcgactcgtcgagatggcgcagcaaggcgccacgggtgatgctcgccggcaccgcgtcgagcgcgccgccgaccctggcgaagcctggctgcggctcgtcccaggtgctcgacagctgcacataggtgcgctgctgctccagctccgcctggctcaggtcgagctgggcgttgtccgccaggacctgggcgcgaacccgttccaccgaggagatgctgccggccttgacccgtcggtcggcggcctgcagcgcgcgcctggccaggtccagggaggtcttcgccaggcgcacccgctcctgcgcggtcagcgccgcgtagtaggcgccgcggacctgggcgcgcagttcggcgcgacggacttccagttgggtccaggcgatctcgctgccgcgtttcgccacctccacccgcgcaccgcgcttgccgcccagctccagcggctgggcgatgctgacgctggtctggcgattgccctggcgggtgtcctcgacgctccaggacagatccgggttggggatcagcccggcctgctgccgcgcgccgctggcgatctcggtctcgcgccccaccgccgccagctcggggttgctccgcagggcccgctccaacgcctgctcgaggctgatcgaagtgccgttgaaactcaccggcgcttcgttcgccagggccggcaggcccaggcagagtcccatcagtag

SEQ ID NO: 14958 - DNA, 1758 bp, Pseudomonas aeruginosa
tccataccattcgcggcgtcggctacgtcctggaagcgcgccgatgacgccaccaggccgactgtcgctgcgcctggccctgctggtcggcgccctcggcgcgctgctggccctggcgctcggcgcaatggcgcactggaacctcggccgcgagctggaagcccgcgagcgggaaaacctgcaattgaagctggagcagatccgccacagcctggaagacgatctcgacctgcgcagcgacccggccgtacaggcgcatgccctgcaggaccaactggtggctcacagcggcctgcacctgagcattctcgacagccgcagcggccagccgctgatgagcttcggcgaccaggccgcggccagcgtcgcggccaaccgcgcgcttctcgcccgcttgcaggcggatgcccgccagccggtgttccagagctggagcaccggcaacgaccagcgcctgctgagcatcggcgcttccatgcgcatgaagaacggcaccccggtacaggtgttgctgagcagcgagcgcaacgccgacgagcgcctgctcgacggtttcctccgcgccaccctgctggccctgcccttcctcctgccattgatcgccctgaccgcctggtgggtggtgcgtgccggcctcgaaccgttgaaccgcttccgccgggtggccgcccaggtcagcccgcaggatctctcctaccgcatccccgagcagaacctgccgcgcgagctggacagcctggcccgcagcttcaaccacatgctcggccgcctcgaggatggcgtacgccagctctcgcagttctccgacgacctggcccacgaactgcgcgcgccgatctgcaacctgctggtgcgcaaccaggtgctgctcagccagcatcgcgacggcgcggcataccgcgaagccctggagtccaatgccgaggaactggagcggctgtcgcggatcgtcaccgacatgctgttcctggtgcaggtggacaacccggcgatccaggcccagttcggctgcgtcgccctgcacgagcaggcggccaaggtcatcgacctgtacgagatggtcgccgaggacaagggcgtcgaactgcgcctgtccggcaacggcttcgcccacggcgacaacctgatgatccagcgcgccatttccaacctggtgtccaacgccgtgcgccacaccccgcaaggcgggcgcatcgacgtgcggatcggggaacgcgcggggcacaccgaggtgagggtcagcaacgacggtccgggcatcccgccggagtacctgccgcacctgttcgagcgcttctaccgccgcgccggacgccagactggagcccaggccggcaccggcctgggactggccatcgtgcaatcgatcatggcctaccacggcggccgcgccgaagcggaaagcgtaccgcagcagaagacccacctgcgcctgctgttcccttcgacgggcgctgcctgacgccggtttcagcaaccggcgcggcgccgccacagccggtactcgccgcagaaaccggcgaggaacagcgccaggccgagcgccagcagggtccagggcgtccgcagcggggcgcgctggagcggcggttcaccgtgcagcaggacgaagcattgcagcagcgcccagaacatcgcagcgacgccgccaagcatggccaggcggcacaaccagccgagccagtagcctcggcgcgagggcatttccggaaacttccccgacacgtattcacctccacatccgccaccgcactctag

SEQ ID NO: 14959 - DNA, 3201 bp, Pseudomonas aeruginosa
gggtgtctccagcgcaccgtccgtgcgtacgccgcgtttctggttgacccagtggcgcaggcggtcgagatagaggtagaccaccggggtggtgtacagggtcagcaactggctgccgatcagcccgccgacgatggtgatgcccagcggccggcgcagcgcggcgtcgccgccgatgccgaagatcagcggcaaggcgccgagcaaggcggccagggtggtcatcatgatcggccggaagcgcatcatgcaggcctcgaggatcgcctcgcgcgggctcaggccgtggttgcgctcggcctccagggcgaagtcgatcatcatgatcgcgttcttcttgacgatgccgatcagcaggatgatgccgatcagcgcgatcaggctcagctcactgcggcagaggatcagcgcgagcagcgcgccgaccccggccgaaggcagggtcgagaggatggtcagcgggtgcacgtagctctcgtagaggatgccgaggacgatgtacaccgccagcagcgccaggaggatcagccagggcatctggttctgcgtgtcctgcaccgcgccggcgttgccctcgaagctggtctgcacgtccaccgggatgtgcagcggctccagggcctgcatgatggcctcgcgggtcgggccgatctgcgcgcccggcgccaggttgaaggacagcgtggtggcggcgaactggccctggtggttgacctccagcggtgcccggctcggttcgtagtggctgaacgcggacagcggcacgcgctggccgtcgttgccgatcacctggacctggcggaggatctccgggctctgctggtactgctggtcgacctccatcaccacccgatactggttcagcgggttgaagatggtcgacacctggcgctggccgaaggagtcgttgagcaccgcgtcgaccattcccacgttgatccccagggtcgccgcgcggtcgcggtcgatcaccaggcgggtctgcacgcccttgtcctgggagtcgctgttgacgtccaccagctgcggcagcttgcgcatcgccgcctcgaccttcggcgcccattcgcggagcagggtcaggtcgtcgctgcgcagggtgaattcgtactgcgcgttgctgtcgcggccgcccaggcgcacgtcctggccggcgttgagatagagcgccgcgccgggcaccttggcgatccgctcgcgcagccgggtgaggaccttctccaccgggtcgcgttcgccgatcggcttgagggtgacgaagaacgaaccggtgttgctcgactgccagcggccgccgccgatgaagccgaccacgttttccaccgccggatcggaagagaggatcttgcggtactcgcccatcttcgcgctcagggactggaacgagatgctctggtcggccaccgcgtaaccgcgcaggcgcccggagtcctgctgcgggaggaagcccttgggcaccaccacgaacaaccagaggttcatggcgatgcaagccagcatgatcaccaccatcagccgcgagtgctccagcgcccagcccaggctggcgcggtagcgcagcatgaaggcggcgaagaagcgatcgctgcgccgcgcctgggaagcgccttcgggccgtttcagcggacgcagtatacgcgcgcagagcatcggcgtgagggtcaaggataccaccagggacaccaggatcgccgccgagagagtcaccgcgaactcgcggaacaaccgcccggtgaggccgcccatgagcagcagcgggatgaacaccgcgaccagcgagagcgtcatcgacagcacggtgaaaccgacctggcgggcaccggtgatcgccgcctggatcggcggatcgccctcctcgatgcgtcgggcgatgttctccaccaccacgatggcgtcgtccaccacgaagccggtggcgatgatcagcgccatcagcgacaggttgttcaggctgaagtcgcacaggtacatgaccgcgaaggtgccgatcagcgagaccggcaccgccaggctggggatcagcgtggcgcggccgttgcgcaggaacaggaagaccaccaggatcaccagcgccaccgagatcagcagggtcagctcggcctcttccagcgacgcacggatcgacgggctgcgatcgtccatcacgttcagcttgacctgcggcccgagcagttcctgcaacaccggcagttgcgcgtggatggcgtcggtggcctcgatgatgttggcgccgggctggcgggtgacgatcagcagcaccgccggcagatcgtcggaaaagccggcgttgcgcacgtcctccaccgagtcgctgaccttggccacgtcgccgaggcgcaccgcggcgccgttgtcggcgttgtagtggatcaccagcggctcgtactcgcgggccttgcgcaactggtcgttggcgtccacctgccagtgcttgtcgtccttctcgacggcgcccttggggccgttgctgttggccgcggcgatggccgtgcgcacgctgtccagggacagcccgtactggctcatggcatccgggttgaggtcgacccgcaccgccggcagcgagctgccgccgatgctcacctgccctaccccctgcacctgcgacagcttgggcgccagcacggtcgaggcgaggtcgtacatctcgccgcgactctgggtctccgaggtcagggtgaggaccatgatcggcatgtccgaggggttggccttgcggtagctgggattgttcggcataccgctgggcagcaggctcatcgcgccgttgatcgccgcctgcacctcgcgggcggcgccgtcgatgtccttctccaggtcgaacacgagcaccacggtggtcgagcccagcgaactgctggaggtcatctcgctgatcccggcgatccgtcccagcgagcgctccagcggcgtggccaccgacgaggccatggtttccgggctggcgcccggcaggctggcgctgaccacgatggccggaaaatcgacgttgggcagcggcgccaccggcagcaggccgaacgacagggtgccggccagcagcaacgccagggtcagcagcgtggtggcgaccgggcggcggatgaagggcgtggacagactcatcgcccggcgtccccgtcgaacccggcctcggtgttcaggtccagcccgcgctgcttgcgccaggccgcccagcgacgggccaggcggtcgaagtag

SEQ ID NO: 14960 - DNA, 597 bp, Pseudomonas aeruginosa
gcgtcggccgagcgcaactggtcgttggcgtccagggtcgaggcacgggtcgggccgtcgaagctgcccttggggccgttgaggttgttgctggtcaccgtgctgcgcaggtcctccaggctcagccccgccgccgccagcgccgtcgggttggcgcgcacccgcaccgccgggcgctggccgccgctgatgctgaccaggccgaccccggagatctgcgagatcttctgtgccaggcgggtatccaccaggtcctggatctgcggcagcggcatgccgtcggacatcaccgccagggtcaggatcggtgcgtccgccggattcaccttgctgaacaccggctggttcggcaggtcgttgggcagcaggctctgcgcggcgttgatcgccgcctggacttcctgctcggcgacatcgaggttgctctgcaggctgaattgcagggtgatcaccgaggcgccgccggaactgctggaagacatctcgttgagccccggaatctgcccgagctggttctccagcggcgcggtgatcgacgaggtcatgatctccgggctggcgccggggtacagggtgaccacctggatggtcgggtag

SEQ ID NO: 14961 - DNA, 1494 bp, Pseudomonas aeruginosa
tccgtgtcggccacgcctcgccggcctgcgtattcagcgatgtggacgtattcgggggagacgcctgatgcaccagagacagcatttcgaagccctcgccgaggacctgcgccgacacctggccgagggcgaggacttcaccctctggtacagcgccgaggactccgagttcatccgcttcaaccgggcgcgggtgcgccaggccggtcgggtgcgccaggccagcgcgctgctccggctgatccgcgacgaacgccaggcgagcctcgacctgacgctctccggcgcgccggaagaagaccgccagcgtctggccgaaggccttcggcaactgcgccagagcctggcctggattcccgccgatccctatctgctgctcgacaccacggcctggcagcgagagaaccaggacctcggcgcagcgcccgacagcggggcgctgctggccagcctcgaacgccaggcgcgcgacctcgacctggtcggcatctatgccgccggaccgctgttccgtggcttcgccaactcctggggcgccttcggctggcatgccggcagcagcttcaacttcgactggagcctgttccacggcaacggccaggcggtgaaggccgactacgccggccagcgctgggacgacgaagccttcgcccggcgcttcgaacaggcccgggagcagctcggccacctgggcaagccgctgcgccagttgcgccccggcgactaccgcgcctacctggcgccggcggcgctcgaagaagtcatgcagatgctctgctggggcggtttctccgcgcgcgccctggctaccggcgaaagccccctgcaacgcctgcagaacggcgacgccctgctcagcccgctgctgaacctcgccgagcgccctgccacctcgccctccccggcattcagcgcggaaggctcgccgcgcgccgaggtcgaactggtcggcaacggccgcctgagcggacgcctggtgagttcgcgcagcgcccgcgaatatggcctggtagccaatggcgccggcgccaacgaggcgcccacggcgctggacatggccggcggcagcctggagcaggcgcgcatcctcgaggccctggataccggcctgtacatcggcaacctgtggtacctgaactactcggacatgcccgccgcacgcctgaccggaatgacccgcttcgccaccttctgggtggagaacggccagatccgggcgccggtcagcaccatgcgcttcgacgacagcctgtacagcttcctcggcgcccacctggaagacctcagccacgagcgcgaactgcgcctgtccagcaatacctacggcgaacgccagaccgactcgatgcacctgccgggcgcgttgaccgggcgcttcaccctcacgctctgagcccgcgcggcgctccccggcggttcgccgcccgggagcgccgcgtgcgcaatccgaagaacgaccgccgatattctggcgccattatcacgccaccataa

SEQ ID NO: 14962 - DNA, 429 bp, Pseudomonas aeruginosa
gcccgcgagccttcgccgggagcggcgcgacaagcgccgccgggaagccgcaagagaccttcctggatttcaacgaaagcccctacggcccctccgccaaggccagggccgccatgcagcgggcggccgcgctctgcggccgctacgactacgacgcgcaggacgccctggtcggcctgttcgccaagcagaacggcatccccgccgaatgcgtgcatgcctactgcggctcgcgccagccgctgcaatacgccgtcgcggcgttcaccggcaaggagcgcagactggtcatggccgatccctcctacgactccgtggtcggcgccgcccaggtccagggggcgaaggtcgctgccgtgccgctggacgccgaggcggcccacgacatcgagcgcatgctcgccgccgcgcaacgcgacgccgggctga

SEQ ID NO: 14963 - DNA, 1494 bp, Pseudomonas aeruginosa
tcagtgagaagccgccggccctgtggccggcggcggaagcattcggggccggcgacgatgctagcacgctttacccgagcgaaaacctcgggtttgagcgtcgccgtcccccgaggctcaactcctggccttggcgaaatactcccgggtcaggcggaacaccaccggactcagcagcagcaaggcgatcaggttgggaatcgccatcagcgcgttgagggtatccgccaccagccaggcgaagtccagctgggtcatggcgccgaacggaatcgccagggtccagacgatccggaacggcaggatcgcccgggtgcccgccaggtactcccagcagcgctcgccgtagtagctccagccgaggatggtggtataggcgaacaccaccagggccagcgacaggatgtagtggccgacgcccggcatcgccgcctcgaacgccgccgaggacagcgccgcgccgctggcgccgctggtccagacgcccgaggtgatgatcgccaggccggtcaggctgcagatgatcagggtatcgatgaaggtgccgagcataccgatcaggcccgaacgcaccgcgctatgggtcgtgccggcggcctgggcgatgccggcggtgccgaggccggcctcgttggagaagatcccgcgtgcgacaccgaaacggattgccgccatcaccgctgcgccggcgaagccgccggtggcggcgatcggcgtgaaggcgtgggtgaagatcagttggaacgcgccgggaatcgcctcggcatggaccaccaggacgatcaccgaggcgacgatgtagccgacgcacatgaagggcaccagggcttcggcgaccttgccgatacggcggatgccaccaaggatcaccagcccggtgacgagcatggtggcgaccccggtgacccagtcgggcacgccgaaggaaacctccagggcatcggccatgctgttgacctggaccatgttgccgataccgaagccggcgagcccgccgaacagcgcgaaggccgcgccgagccaggcccagcgcttgcccagaccgttcttgatggcatacatcggaccgccgacgtgttcgttgcgctcatccttctcgcggtagtgcaccgccagcaccacttcggagaacttggtggccattcccaccagcgcggtgcaccacatccagaacagcgcgcccgggccgccgaggaagatcgccgtggccaccccggcgatgttgccggtaccgacggtggccgccaggcaggtcatcagcgcctggaacgggctgatctcgccgctgctctcgtcatccttgctacgcccctgccagagcaggcgaaagccgactcccaggcgcaccaggggcatgaacttcaaccccagcatcaggtacaggccggtgccgagaatcagcaccagcatcaacggcccccagaccacgccgttcaggtcgaccacccacttctgcaagctttccatcagcgatccttattcttgttcgaatga

SEQ ID NO: 14964 - DNA, 1077 bp, Pseudomonas aeruginosa
aaccgtaattatgggctttatccagaccaatgcagagcgaagaatgacgacgttttccttccctcccgcgaggctcgacacatgaaaacccgtcaactcggccacaacggcccttccgtctccgccattggcctcggctgcatgggcatgaccgacttctacaccaccggcggcgaccgccaggaggccatcgccaccctgcatcgcgccgtggaactcgggctgaacttcttcgataccgccgacatgtacggcccgcacagtaacgaggaactgctcggcgaggccctgcgcggcaaacgcgagcaggtgttcctggccagcaagttcggcatcgtccgcgaccctgccaatccccgggcgcgcggcgtcgacggcagcccggcgtacatccgccgcgccatcgaaggcagcctgaagcgcctcggtaccgaccgcctggacctgtactatcagcaccgcatggacccgcaggtacccatcgaggacagcgtcggcgccctcgccgacctggtgaaggccggcaagatccgccacatcggtctcagcgaagcctcggcggaaaccctcgagcgtgcccaccgggtgcacccgatcagcgcgttgcagagcgagtactcgctgtggacccgcgatccggaggacaccggggtgctcgccgcctgccgtcgcctgggcatcgccttcgtcccctacagcccgctgggccgaggtttccttaccggcaccctgaagcgtccggaagacttcgccgccgacgactaccgtcgtttcagcccgcgcttccagggcgagaacttcgcgaagaacctgaagctggtggacaaggtcggcgaactggccgcagccaagggcgtgaaaccctcgcaactggcgctggcctgggtgctggcgcagggcgatgacctgatcccgattcccggcaccaaacagcggcgctacctggaggagaacgtcgccgcgacggaattgcgcctgagcgcggcggaactggccgagctggatgcgatcttccccgccgaggcggtcgccggcagtcgctatagcgaggaaggcatgcgcctggtcaatctctga

SEQ ID NO: 14965 - DNA, 1440 bp, Pseudomonas aeruginosa
caccgccacggccgactcgacgtccgccgcgcggccgctgagcagcagccaggcggcgaccagcgtggcgctgcgcgaatagcccagggcacaggccaccagcagcggcccttgcgccagcagttcgtcgatcagcaccgcggcgcgccggcagtcctcgacgtccggcgcgaccaggtcgagcaacggcaggctgcgataggccagcccctgcggctcgcaggaaagttcggcggtagcgtcgagcaatgcgcggaagcggctgtcggccagttccgcggacgacggcaggcgccccaaccagaggcccggcagcacctcgtccggctgcggccggcgacgggtccagagccaggcgttgatccgcgcggcaagcagatatggcgccagcagccagcgcgcggcgacgctcaggcggccagtgctgcccttctggaagccggcggcgccgaacagcaggtagttcagcgccaccagcgccagcgccagcgccggccagcacagccacaacgccgcaccgccgacggcaaaggcgacggcggcgcaggccagcgcgccgaggccgtagcgagcggccagccgccgccgttgccggtcgcggctcagactggcgcgggcgaacggcgcgggctgcgcctgcggccacagccagacgcacagccaaccggccagcgcgccggtgggcacgtcgatgaaatggtgctgccaggtggtcagcaccgacagcccgatcagcgcgaaccagccatgcagcagccagcgccaggcgccgctggcgtagcgcgcgtagcagacccagagcactaccagcagggcgatgtgcagcgacggtgcctggttgtacggtttgtcgaaccccatcagcacgtcgaacagccagccgaacacgccgcccagttccggccgttcgaaggtgaagcgcagggggaacagcaggaagcaggtcaccgacagcacctgggcgctgagcaggcgcaggcagtgggtgtccagctcgcgcttgtcccgcggcaacaacagcgacaggccgtagagcaggtcgatcgaccagtacggcaggatggtccagggccacagcggcatcccgcgttcccagtcgaagaccaggctgccgacgtcgccgcgctggctggtcaaccagttggccaggccatagctggcgaagaagaacgggccgaggaacagcagccagagcaccgcccgcttcagtacccccggctcgcgcggcgccatcagcgggcgaccttctgcgccagcgatacgctgaagatgccccactggtcgacccgctgggtgatcttgcggaagccggcggcggccaccagctggtccatttccgcctgggtccggcgccgcatcacccaggcctggccctggcggtggctggtcagcgcgcgggcgatcagttccagctgcgggtgccagggctgtccggtgtaa

SEQ ID NO: 14966 - DNA, 726 bp, Pseudomonas aeruginosa
tcttcagcgccttcacagttctggccccatggagaagtgcaggcggaaaccgccgtcgtcgtcgagcgcatgggccaggtcgaggcgcaacgggccgaccggcgagacccagcgcacgccgaagccgaccccggtcttgatcgacgggaagtccagcgagttgaaggcgttgccctggtcgacgaaggtcgccaggcgccagcgctcggccagcggatattgatactcgacgctgccggcgatcatgtagcggccgccgatcttgtcgccatcggaattctccggcgacagcgtccggtagtcgtagccacgcacgctctggtcgccgccagcgaagaagcgcagcgagggcgggatcgacttgtagtcgttggtggcgattccgcctacctgcaggcggccgagcaggcgatggccgccggcgaagctggtcaggcccttggccatggcgtcgacatggaggacgtcggcgtcggccagcaggccttccttcgcccccttgacgttgaactgcaggcggtagccatggctggggtcgaccttgttgtcggtctccagcagcgagtagccgatccccggcatcaggaagctgctcagcccggagtcgtcgcccagcttgtactcctcgcgcatccagttcagcgaaaccacccgctgccagccatcgggctgcttgctgtgccattcgccgccaagggtcagcagcttgctctcggtgtcgactag

SEQ ID NO: 14967 - DNA, 840 bp, Pseudomonas aeruginosa
cattcctgttttgccaggacgcccaccatgaaaatcgtctctttcaatatcaacggtctgcgcgcccggccgcaccagttggcggcgctgatcgagcggcaccagcccgacgtgatcgggctgcaggaaaccaaggtcgccgacgaccagtttccccaggccgagatcgaggcgctcggctaccacgtccactaccacgggcagaaaggccactacggcgtcgccctgctctcccgccaggcgcccctggaactgcatcgcggcttcccgagcgacggcgaggaatcccagcggcgcttcatctggggcaccttcagcgacgcccagggcaacccgatcaccgtgatgaacggttacttcccgcaaggcgagaaccgcgagcatccgaccaagttcccggccaagcagcgcttctacgccgatctccagtcgctgctggagaacagcttcaagcccgagcaagccctggtggtgatgggcgacatcaatatctcgccggaggactgcgacatcggcattggcgaggaaaaccgcaagcgctggctgaagaccggcaagtgcagcttcctgccggaagagcgcgaatggctggctacgttgaagaactggggcctggtcgacagcttccgggccctgaatccggaggtgaacgaccgcttcagctggttcgactaccgcagccgtggcttcgaggacaaccccaagcgcggcctgcgcatcgatgtgatcctggccagccgggtgctgcagtcgcgcttcaaggacgccggcatcgactacgacctgcgcggcatggagaagccctccgatcacgccccgatctggctggaactggcctga

SEQ ID NO: 14968 - DNA, 915 bp, Pseudomonas aeruginosa
attatccccgtggatcacctcaccgccctcaaggtcttccgcgccgtggccgcgaatggcggcttcgccgccgcggcccggcagatgaatctctcgccggccgccgtgagcaagaacgtcgccgagctggaagcgcacctcaaggtgcgcctgatcaatcgcaccacccgcagcatgagcctgaccgaggccggcgaagtctaccggcagcgcctggagcgcatcctcgacgacctcgaggccgccgacgccgcgctcacttcgatgcagcagggccccagcggcctgctgcgggtcagcgccccgctgaccctcgccctcacctgcctgaccccggccattccggcttttctccagcgttatccggacctgcgcctggaactgctcctgcaggacggccgccaggacctgatcgccgaaggcatcgacctggccctgcgtggtagcgaccgggttgcggactccggcctggtcgcccgcccgctgctggtcctggagcacgtgctctgcgcggcgccggcctacctcagtcagcatggccagccgctgcggccggaggccctgcgcgaacacgagtgcatccgcttcagcctctctggccatgccgaccgctggaccttccgcaaggaccgcgagtgcatagcggtgcctatcgccggccgttaccgggtgtcctccagcctggcggtgcgcgatgccctgctcgccggcttcggcttgagcctgatcccacggctgtacgtacaggcggaactggccgaaggccgcctggttgaattgctggctgactggaaggccgacgagacggcgatccacgcggtctatccatcgcgccaactggccggcaagacccgggtgtttctcgacttcctgaccgagacaatggcgcagggccatgattccccaacgctgtaa

SEQ ID NO: 14969 - DNA, 1074 bp, Pseudomonas aeruginosa
ccatccgacaattcgaagcgagggggcccaatggcagctctgcatgcatttctcaccgaaccgttcctcggtacggctacctggttctggctggccttcctggccatcgtcatcgttctcctggtcctcgacctcggcgtgctgcaacgcgaccaccacgaaatcggcgtgcgcgaaagcctgctactgtccgccggctacttcgcctgcggcctggccttcggcggctgggtctggtacgccttcggccccaccagcgcggtggagtactacaccggcttcctggtcgaacagtcgctatcgatggacaacgtgttcgtcatggcgatgatcttcagtttcttcggcatcccccgccgctaccagcaccaggtgctgttctggggcatcctcggcgccatcgtcctgcgggcgatcatgatcggcctgggcgccgcgctggtgaaggagttcgactggatcatgtacgtgttcggcgccttcctgctgttcagcggcgtgaagatgctgttcaacaagcacgaggaagaacccgacctcgagcacaacccggtgctgcgtttcctgcgcaagcacatgcgggtgaccaaggaactgcacgagcatcacttcttcgtccgcctgccggacgccagcggcaagctggtgcgctacgccaccccgctgttcttcgccctggtgctgatcgagctggccgacctggtgttcgcggtggacagcgtgccggcgatcttcgccatcacccaggacccgttcatcgtctacacctcgaacatcttcgccatcctcggcctgcgcgccctgtacttctcgctggcggcgatgatccaccgcttcgtctacctgaaatacgccctggccctggtgctggtgttcatcggtgcgaagatcatgctccacggtgtgatcggcaagattcccgccggcctctcgcttggcgtaaccttcggcctgctggcgggcggcatcctgctctccctgctgaagacccgcacgccgaaagccaccgtcgaggacaaggccgaaccgaatgccgaacacgctctggatcgaacgtctggacacccacgctga

SEQ ID NO: 14970 - DNA, 999 bp, Pseudomonas aeruginosa
acattcatgatccatatgggggtcatccaagcccccaataacaagaaaagtcgcggagccagtgccatgaacctgaacaaagtcgacctgaacctgttcatcgtgttcgatgcgatctataccgaagccaacctgacccgcgccgggcagatcgtcggcatcacccagccagccgtatccaacgccctttcccggctgcgcgagaccttcaacgacccgctattcgtgcgcaccgcccaaggcatggtgccgacccctatggcgcagaacatcatcggcccggtgcgcaacgcgctgcagttgctgcgggtttcggtgcaggagagccgcagcttcgatccgcagcaggcgaacaagacctaccgcatcagcatgaccgacctcaccgaagcggtcatcctccccccgctgttccagcgcttgcgccgcctggcgccgaacgtgcatatcgagagcttcctcgccaagcgccgcgagaccaccaaggaactcgccgccggccgcctcgacttcgccgtcgacgcgccgctgaacaccgatccccaggtgcgccacgtcaagctgatggaggaccgctacgtctgcgccatgcgccgcggccacccactggcgggcaagccgaagctggccctggacgattacctgggcctgacccacatccatatttccagccgccgcagcggcctcggctacatcgacctggcgctgggcaagatgggcatccagcgcaagatcgcgctgcgctcgcagcactacctgatggcctccacggtggtccagcagaccgacatggcgatgaccgtgccggaacgcttcgcccgtcaccacgacctgcactacgcggtgctgccggtgagcgacgtgccgaagctggaaacccacctgtactggcacgagagcaccgatcaggacccggccaaccgctggatgcgcgagcagatcatcgagctgtgccagcaggtcaccgcgcgcgagaacaaggcggcgcagccggcgtga

SEQ ID NO: 14971 - DNA, 1437 bp, Pseudomonas aeruginosa
gccaggtgcccggtctgcgcgccgccccattcctcgggcaccagcatgccgaggaagccgaggtcggccatctcgcggattgcctcggccgggaaacggtgctcgcggtcccagtcggcggcgaacggtttcagccgttcctgggcgaactgccgcgccatgtcacggatctggatctcttcttcgcagggaatcatcgcgggttcctcttcttcactgcctgcatcagcgcaagcgctcgacggcgatcgcggtcgcctcgccgccgccgatgcagaccgccgccacgccgcgttccaggtcgtactgctgcagggcgttgagcagggtcacgacgatccgcgcgccggacgcgccgatcggatggcccagcgcacaggcgccgccgtggacgttgaggcgctcgtgggacaggtcgaggtcgcgcattgccgccatgccgaccacggcgaaggcttcgttgacctcgaacaggtcgacctcgcccagcgaccagccggtacgctgcatcaggcgcttcaccgcaccgaccggcgcggtggggaacaggttcggcgcgtcggcgaacgaagcatgcccacgaatcgccgccaacggcgcgagcccgcgtcgctcggcctcggaaaggcgcatcaggaccagcgcggcggcgccgtcggaaatcgaactggagttggccgcggtcaccgtgccgccttcgcggaacgccggcttcagggtcgggatcttgtccagccgggccttcggcggctgctcgtcgctatccaccaggcgctcggtcttgccgacggtgaccgtcagcggcacgatctcggcctggaagcgcccgtcgcgcatggcttgctgcgcgcgggtcagcgaggccacggcgaactcgtcctgtgcttcgcgggtgaagccgtaggcctcggcacagtcctcggcgaaggtgcccatcaggcggcccttgtcgtaggcgtcttcgaggccgtcgaggaacatgtggtcgagcaccttgccgtggcccatgcggtagccgctacgggcgcgctccagcaggtagggcgcgttggacatgctttccatgcccccggccagcgcgaccccggcgctgccggcgagcaacgtgtcatgggcgagcatcagcgccttcatgcccgagccgcacatcttgttcagcgtcgagcacggcgtgccgcgcgccagtccggcgccaagcaccgcctggcgcgccggcgcctggccctggccggcggcgagcacgcagccgagcacggcctcgtccacttcgtcggcttgcaggcgcgcccgctccaccgcggcgcgcaccgccgcggcaccgagggtagcggcgttgacgtccttgaagtcgccgaggaagccgcccatcggggtgcggacggcgctgacgatgacgatcggatcttcgcgggtcatgggatcttcctcctgtattag

SEQ ID NO: 14972 - DNA, 1347 bp, Pseudomonas aeruginosa
gcggcctggccgatctgcccgtcgaacgccgccaccgaggcggtattgacgatcaccccgcgctcgccgccctcgtccggctggccctgggacatggcctcggcggccaggcgcagcatgttgaaactgcccaccaggttgatgtcgatgacccggcggaaactctccagggcatggatgccattgcgtccgaggaccttctcggccggcgccacgcccgcgcaattggccaggccatggaggccgccgaaggcctccagtgcagcggccacggcctggcggccgtcggcctcgctggcgatgtcggccctgacgaagcgcgcctgggcgccaagctcggcggcattggccgcgccggcctcggcgttgatgtcggccagcaccaccttgccaccctgctccaccagcatcttcgcggtggcggcgccgaggccggagctgccgccggtaaccaggaacactcgattttcgatacgcacgtcgttttctcctgctgaatcagttcgcggcggccgcccgtggggccgcctcgcgttgccgggcgatctcctggttgcgcaggagaaagcgctggatcttgccgctgggagtcttcggcagttcctcgaggaactcgatctcccgcgggtaggcgtgcgccgacaggcgctggcgcacgtatcgctgcaatgcgtccgccagttccggcgtcggccggtggccggcgcagagcacgacgaaggccttgaccagttcggtgcgctccgggtcgggcttgccgatcaccgccgcctccatcactgccgggtgttcgatcagcgcgctctccacatcgaacgggccgacccggtagccagaggtggtaatgacgtcgtcggcgcggccgacgaagctgatgctgccgtcttcgttgagttcgacggtatcgccgctcaggtagtagtcgccgacgaaggctgcggtttccaggccctggtagccgggaaaccacatcagcggcgaacgccgccggtcgagggcgaggatgcctggctggccgggcggcagttcgttgagatcgtcgtccagcactactacccggtgcccgggacaggcgaatccggcggcgccgacccgcaccggatgcgccagggcatggtggttgcacagcaccatgcccagctcggtctgcccgtaatgatcgtggatggtggtgccgagcctgtcggcgaaccagcggatcacctccggggtcaacggctcgccggcgctgctgaccgcgcgcatgcgccccttcagcgcagtttccgcggccgcgccggcggccatcagcaggcgataggcggtgggcgatccggcaaggttggtgatgccgtagtccacggatga

SEQ ID NO: 14973 - DNA, 303 bp, Pseudomonas aeruginosa
atttttgccattggaaaaagtctgttcagcgcagcgtttttccaagtcccatccggcccgcaaggagaacccatggctgaaccccaggacaagtacacccggcgcacaggcaggacctgggcggacgaccaggcgacctacaaccgtctgcgcgaagaagccgacgccgctcgccagaagctgcgcgaaagcggctacagcggcgccgagtacgaccagttgcgtcaagccgccttcgatctcaaccgcaaggccaaccagtactgggagcagatgctcagcgacctgcgccaggaagactga

SEQ ID NO: 14974 - DNA, 957 bp, Pseudomonas aeruginosa
acgcctgtcgtcatcccttgttttttccaatgccatcccgcggcccgcgctgtcgaccgactgcacgggccgtgcctcgcccctgggtatcccgatgctacagacgctgaaacagaactggttctccaacctccgcggcgacctgctcgccggcctggtcgtcgccctggcgctgatccccgaggccatcgccttctccatcatcgccggggtcgacccgaagatcggcctgtacgcctccttcagcatggcggtggtgatcgccttcgccggcggccgtccgggaatgatctccgccgcgactggcgccatggcgctgctgatggtcaacctggtgaaggaccacggcctgcaatacctgctggcggcgaccctgctctgcggcgtgctgcagatactcgccggctacctgcgcctgggttcgctgatgcgcttcgtctcgcgctcggtggtgaccggtttcgtcaatgccctggcgatcctcatcttcatggcccagctacccgaactcaccgatgtcggctggccggtctacgcgatgaccgccgcgggcctggcgatcgtctacggcttcccgcacctgccccggatcggccggctgctgccctctccgctggtatgcatcctggtcctcaccggcatatccatctacctgggcctggacatccgcaccgtcggcgacatgggtcagttgcccgacagcctgccgctgttcctctggccggacgtgccgctgaacctcgacaccctgctgatcgtcctgccctactccgccgccctggcggtggtcggccttctggagtcgctgatgaccgccaccatcgtcgacgagatgaccgacaccggcagcgacaagaaccgcgaatgcaagggccagggcctggcgaacatcgccaccggcctgctcggcggcatggctggctgcgcgatgatcggccagtcggtgatcaatgttaa

SEQ ID NO: 14975 - DNA, 1803 bp, Pseudomonas aeruginosa
ttgccgatgcccgacatcgcagtagcccaggagtccagcatggcaaccccaccctatcccgaggacgagcattcgagacaggcctacgtcgaccaactcggtctgctggaagaaggtgcggacgaggtattcgaggaaatcctcgccgccgctacgtcctacttccagacgcccatcgcgctcatttccatcctcgaccatcagcgccagtggtttcgcgcgagcatcggcctcgatatccggcagacgccgcgacgggattcgttctgcgcctatgcgatcctgggcaagggagtattcgaggtggccgacgccaccctcgacccgcgcttccgggacaacccctatgtgcaaggcgaaccgcgcatccgcttctacgccggggctccgctggccaccgcggaaggtctcaacctcggcagcctctgcgtcatcgaccgggaaccacgcgggccgctggccgagcgggacgtcgccatgctcgagcacttcgcccggctggtgatggcccgtatccatacgctccgctcgaccaactacatcgacgagccaaccggcctgtacaaccgtctccgcctgcaggaggacgtttccctgcgcctgcagcgcgacggcgccctcaccgtgatcgccgccgacctcctgcccctcgccctgctgaataccatcatccgtacgctgggctatcccttttccaacgacctcatgctcgaggcgcgcgaccgcatccgcgcggaactgccggatttcactctctacaagatcagcccgacgcgcttcggactgctcctgccacggcagcaacaggaagaaaccgagtcggtctgcctccgcctgctgcgggccttcgaaagccccgtcgtatgtcgcgggatcccgatcaaggccaacgtgggcctcggcgtactaccgcttgccgacgatcccctcgacggcgatcaggactggctgcgcctggtggtcagcgcggccgacgacgcccgcgaccgcggtgtcggctgggcccgctacaacccgccgctggaccaggcccagcagcgtgccttcacattgctgacctcgctgtcccaggcgatcggaaccgaagaaggcttccatctggtgtatcagccgaaaatcgacctgccgacaggcaggtgcacgggcgtggaagcgctgctgcgctggcggcacccgcaactcggcttcgtcagccccgccgaattcgtgcccctggcggagaaaaccgcactgatgcgccccctcagcgactgggtgctgcgccatgccatggcccagctggcgcaatggaacgcacggaacatcccgctcaggctggcgatcaacgtatcggcatcggacatggaagacagcagcttcctggaagaggccgtcagactcgccaaaacctacaacatcgacctttccgccctcgagctggaattcaccgaaagcgtactcatccgcgacgcctcggcggtcggctcggtgctgctgcgtgcccgggagcttggcatgggcatcgcggtggacgacttcggcaccggctacagcaactggacctacctgcgcgatctgccaatcaccgccatcaagctcgaccaatcgttcacccgcgacctcgccggctcgccgaaggcgcagagcgtcacccaggcggtgatcggcctggccagccagttgggttatcgggtggtcgcggaaggcatcgagacccacgacaccttccacctgctgcaagcctggggctgccacgagggccagggctatctgatcgcccagccgatgctgccggagcaactggaggactggctgcggcgttag

SEQ ID NO: 14976 - DNA, 546 bp, Pseudomonas aeruginosa
gagagcgacaaccccaggccggtccccttgcctaccggcttggtggtgaagaacggatcgaagatgcgcggcaggatctcgggggagataccctgccccgagtcttccacttcaatccaggcatgctccacggtatgccccgtgcgaatcacgatgcgaccccgctccggccccatcgcctgggccgcgttcatcaccaggttcatcaccacctggttgatctgcgacggcagacacttcacctcgggtagatcgccgtattcgcggaccacgtcggcccggtacttcagttcgctggcgacgatattgagggtcgactcgatcccctggtgcagatcggtccactgccagtcgtcctcggcgtcgacgcgggagaagttcttcaggtcctggacgatcttgcgcacccgccctataccttccctggattcgcgcagcaacacggcgacatcctccttgacgaaggccagttcgacccgctcaccgagctgctccaggcgtcttgccagcgcctcgtcgcggatcgcggggcgagcctcttcatag

SEQ ID NO: 14977 - DNA, 864 bp, Pseudomonas aeruginosa
cgggttccatcgaggatctcgttgatcgacacccctgcctggcgggcgaacgacaccccctcgttgacccggctcacgccggcctccatgctgttgatcgcttgccccgtgctggcgcggatgcgctcgatcatcgcggtgatctcctgggtcgactgggtggtccgcgccgccagcccgcgtacctcgtcggcgaccacggcgaaaccgcgcccggcctctccggcccgcgccgcctcgatggcggcgttcaacgccagcaggttggtctgctcggcgatccccttgatcacctggatgatcgaatggatctcgtccgacgactggccgagagcggtgatgctggtggaggactggttgaccacgtcggcgatgcggctcatcccttccaccacgttgaggatcacctgcccgccactgctggccagctcctcggacttggccgagatcaccctggcgttgtcggcgtggtcggaaatctgcgagatattggtgatcatctcttccatgctcgcggccatgctggtggcgctgtcggcctgttggctggcaccgtcgacgatcgactgcgaggtctggccgatggattgggaggtgtcatggagctcttcgctttcctggcggatgatggtgatcatctgccgcaggttctcctgcatctcgcccaaggcccgctgcaactgtccggcctcatcgtcgctgtcgacaccgatcggctcctgcaggttgccctgggcgatcacccgggccgaggcgaccagcttgcgcagaggcttgaggacggcgcgcagcaactggcgacaaagctgcccgaggaccaggcaggcgaccaggatgccgcccgcgagcatccaggcggaatag

SEQ ID NO: 14978 - DNA, 873 bp, Pseudomonas aeruginosa
aggttggccgcctccccggccttcaccctgcttgacctgaatcaaaggccaagtcctcgcggttttatgcccatcgactttctcgatattccattttcatccgtactggccgtctctcgctgccggccgcgctggaccgtggatacccggctttcctggggaagccgggtatccatcgcatcagccgataggaatcaccggttatttcccattgatctcatcgaggccgtcgctaatatcgaatccaatttccaaacaaggagcctcacgatgtctgacgcattcctctcctccatcaagaaccgccgcaccatctacgccctggacaagcaactgcccgtctcccaggagaaaatcgtcgaactggtcaaggaggccgtctcgcacagcccttccgcgttcaactcgcagagctcgcgggtggtcgtcctgttcggcgccgagcacgagcagttctggaacatcgccaaggacgagttgaagaagatcgttcccgccgacgctttcgccgccaccgaaaccaagctcaattccttcgccgccggtgccggcaccgtactgttcttcgaagaccagacggtagtgcgccagcttcaggagcagttcgccctctacgccgacaacttcccggtgtggtcggagcaggccagcggcatggcccagttcgcggtctggaccgccctcgccgagcacaaggtcggcgccagcctgcagcactacaacccgctggtagatgcgcagacccacaagacctggaacctgccggaaagctggaagctgcgcgcacagatgcctttcggcgccatcgccgctccggcgggcgagaaagccttcatcgccgaaagcgaacgcttcaaggtcttcggcaactga

SEQ ID NO: 14979 - DNA, 1230 bp, Pseudomonas aeruginosa
atagggcgtcagcacttcgaggccggaatcgaagcgctccgacgaaggcatggtcggcgtaaccaatgcctcccccgcatccagtcggcttttcgtctcgacgaagttgcgtgctccagtgaaggaaaactgcaggccactgcgcttgccgatcaggtccagatagtcacgcccgataccactcagcctcccctcgttatccagttgcccgagcgcgccaagggaatggttgatcaccaccggcacgaccgggtgcgcggagagccaacgctgctccgccggcgacagcgtcacccggggctcgtcgaagcgcaggcgccgcccggcgctccagctgcgcaacagttcgtcgccgtagcgcccgctaatatgcggcagggcgcgatcgatgagcgcgagcagaggttcgtcacctggccggagcaggaaacggaaaccctggctgtcgatgggtgcgaagttctcgatgcgcaagttcagcaggtaatgggtctggatgaggtagtgcgtggaaactgcgtcccccagcacgccatcgacatcccccatgctcagcgcttccagggcaagctgcggcgagtcgaaccagatgatcctgctgtgcggataggcagctttgatacgttcggcgggaagatagcccttgaccgtggccagccaggactccgcctgcgaatcgaacggggcaccgctggaagacaccagtaccggccggtcggaaagatacgcagcggatgccagcaagccgtgttgtcgggcctcgacctcgctaccgacgccaagcaggtcgatctccccttgcgacaacgcgtcgattgccgcctgccgcgacggaaagtccctgacgcgcaacggccgctcgaacaccagggccaggtaatcggccgtgaagcccttgtaggagcctgcgtagaagatggacaacggcggatagtcgggggaaaccacgcctaccgtcagcggctcccgtgcatccagccactgcctggctcgtttatcgagccagggacgcatcgttgtcgtcgtacgcccatccggcaggatggattcggcttcgacgggcagcggctgcagagcgatcagcaacaggcaaaagaccgcggacagcaacgaccttgtcagcatgtcgagtctacgatggcaaagttctccggccggacagaaagcagcgcatccgcgacccggagcctgcggatacatcggcaacgatgccgccatgttagcaggtag

SEQ ID NO: 14980 - DNA, 285 bp, Pseudomonas aeruginosa
atcgatgaagccgcttgcgatgacgtgcgccctggccgtggcatgcctgcactcgaaagcccagttcgagccgcacatcgccgagggcaacctggtagcgtgctggaaggctggtgcgatccattcccgggctattacctccatcacccaagtcagaggcaaccttcgccgaccttctcagtggtcgtcgaagcgctgcgataccgaagcgctggccttgggacggctcggtcgaacgtggcagccaaagcaacaggcgcacgaaggcggtccaaggtgcaatga

SEQ ID NO: 14981 - DNA, 495 bp, Pseudomonas aeruginosa
tcaagaccaacatgctgctgttccgcaaggatatccgcgggatcgcggtgcgacgttccagttgcgacaccgtggatgtggatatcgacctgcaggacaagccggactggccgcagtcggcccggctgtatcacgccaacgtcctggcgtcggccgcctacgcggtgttccgcgacctgctgctgggcgagctggaactggtccgcctgcgcctcccggaaaggaacggcgacgtgcgggcatacgaggagtatttccgggtgccggtgtatttcgccggcgcaggcatcaccttcaccctccccgaggaattgctcgaggccgagatcgccactgccaactccgccgtgttccaggcctcgctggcgctcggcagcaaggccttcaacacccgcgtcacccgcgagatgggcggctaccgccaacgcatcgtggcactgctggaggtgctacaggaccgctacccgagcatcgcctgggtcgcccggcagttga

SEQ ID NO: 14982 - DNA, 627 bp, Pseudomonas aeruginosa
agatacctctcccccagggcgggaaagccccgggcatgcctgatggagaaaaccatgcttatccatttctgccccaggctgctgacgcctgcggggttcgacctaccgtgcgagttgatcgacatccgcatcaaggagttcgacctgcacctgcttggcgggcgcgacgtggtggcgcgtcaccccctccccgacaagcgctaccacgtggcctgccgcaagtccggctgcaaggcggtgaatggcctgctggtggacgtggaaaagcacgttccgctgttcaccgtggacacccgctggagcatcgacgccgaagtggtcctgcgccaccgcgtcgagtacgtggtgctcgacgccgagcacgatgcggtgagcgactacatgctgctgtggtgcgacgaggtgcccaactacttcctcggccagagcaccccggccatgcaggttccgttgatggagctgatgcgcggcaatgcgttgcagaccgagcggcaggatgtgttccgcctgccgacgctgaggtccgaacgcctgcgccagggcaacgccgatgccaaccagcatcttccgagccgtgagcaggcgttccacgtcaaagccgagcagatcagctatgggctggcctga
